United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 132

SEQ ID NO: 5599650 - DNA, 11 bp, Homo sapiens
cgctgccctgt

SEQ ID NO: 5599651 - DNA, 14 bp, Homo sapiens
cgctgccctgtgag

SEQ ID NO: 5599652 - DNA, 16 bp, Homo sapiens
cgctgccctgtggaca

SEQ ID NO: 5599653 - DNA, 16 bp, Homo sapiens
cgctgccgagtccggg

SEQ ID NO: 5599654 - DNA, 20 bp, Homo sapiens
cgctgccgcaccccagagtg

SEQ ID NO: 5599655 - DNA, 15 bp, Homo sapiens
cgctgccgctgcacc

SEQ ID NO: 5599656 - DNA, 15 bp, Homo sapiens
cgctgccgctgccgc

SEQ ID NO: 5599657 - DNA, 13 bp, Homo sapiens
cgctgccgggaga

SEQ ID NO: 5599658 - DNA, 16 bp, Homo sapiens
cgctgccgggagactg

SEQ ID NO: 5599659 - DNA, 14 bp, Homo sapiens
cgctgcctccatgg

SEQ ID NO: 5599660 - DNA, 17 bp, Homo sapiens
cgctgcctcctggtaac

SEQ ID NO: 5599661 - DNA, 12 bp, Homo sapiens
cgctgcctcttg

SEQ ID NO: 5599662 - DNA, 10 bp, Homo sapiens
cgctgcctgg

SEQ ID NO: 5599663 - DNA, 22 bp, Homo sapiens
cgctgcctggaacaccagcagc

SEQ ID NO: 5599664 - DNA, 12 bp, Homo sapiens
cgctgcctggcc

SEQ ID NO: 5599665 - DNA, 21 bp, Homo sapiens
cgctgcctggcgggcagcccc

SEQ ID NO: 5599666 - DNA, 23 bp, Homo sapiens
cgctgcctggcgggcagcccctg

SEQ ID NO: 5599667 - DNA, 18 bp, Homo sapiens
cgctgcctggtctgtctg

SEQ ID NO: 5599668 - DNA, 13 bp, Homo sapiens
cgctgcctgtgtg

SEQ ID NO: 5599669 - DNA, 15 bp, Homo sapiens
cgctgccttgccatg

SEQ ID NO: 5599670 - DNA, 17 bp, Homo sapiens
cgctgcgctgccctgca

SEQ ID NO: 5599671 - DNA, 21 bp, Homo sapiens
cgctgcgtcctcatttcccct

SEQ ID NO: 5599672 - DNA, 22 bp, Homo sapiens
cgctgcgtctccatcaacactg

SEQ ID NO: 5599673 - DNA, 14 bp, Homo sapiens
cgctgcgtgccatg

SEQ ID NO: 5599674 - DNA, 16 bp, Homo sapiens
cgctgctagagaaggg

SEQ ID NO: 5599675 - DNA, 13 bp, Homo sapiens
cgctgctcaacct

SEQ ID NO: 5599676 - DNA, 18 bp, Homo sapiens
cgctgctcaacctctctc

SEQ ID NO: 5599677 - DNA, 19 bp, Homo sapiens
cgctgctccacgcgcttcg

SEQ ID NO: 5599678 - DNA, 19 bp, Homo sapiens
cgctgctctagctggcagg

SEQ ID NO: 5599679 - DNA, 13 bp, Homo sapiens
cgctgctctcata

SEQ ID NO: 5599680 - DNA, 14 bp, Homo sapiens
cgctgctctcccag

SEQ ID NO: 5599681 - DNA, 18 bp, Homo sapiens
cgctgctctcccaggtga

SEQ ID NO: 5599682 - DNA, 15 bp, Homo sapiens
cgctgctctcctgac

SEQ ID NO: 5599683 - DNA, 19 bp, Homo sapiens
cgctgctgcgccctgggct

SEQ ID NO: 5599684 - DNA, 20 bp, Homo sapiens
cgctgctgcgccctgggctc

SEQ ID NO: 5599685 - DNA, 15 bp, Homo sapiens
cgctgcttccaggct

SEQ ID NO: 5599686 - DNA, 14 bp, Homo sapiens
cgctgcttccaggt

SEQ ID NO: 5599687 - DNA, 18 bp, Homo sapiens
cgctgcttcgtgggatac

SEQ ID NO: 5599688 - DNA, 17 bp, Homo sapiens
cgctgctttttcatcaa

SEQ ID NO: 5599689 - DNA, 21 bp, Homo sapiens
cgctggaatcaatttcccaga

SEQ ID NO: 5599690 - DNA, 20 bp, Homo sapiens
cgctggaatccagaaggaag

SEQ ID NO: 5599691 - DNA, 16 bp, Homo sapiens
cgctggacaacccaga

SEQ ID NO: 5599692 - DNA, 17 bp, Homo sapiens
cgctggacaacccagaa

SEQ ID NO: 5599693 - DNA, 15 bp, Homo sapiens
cgctggacacctaca

SEQ ID NO: 5599694 - DNA, 15 bp, Homo sapiens
cgctggagaccctgc

SEQ ID NO: 5599695 - DNA, 19 bp, Homo sapiens
cgctggagaccctgcgccc

SEQ ID NO: 5599696 - DNA, 15 bp, Homo sapiens
cgctggagcccacag

SEQ ID NO: 5599697 - DNA, 17 bp, Homo sapiens
cgctggagcccacagcg

SEQ ID NO: 5599698 - DNA, 17 bp, Homo sapiens
cgctggagtgcagtgag

SEQ ID NO: 5599699 - DNA, 19 bp, Homo sapiens
cggagctgggtatctcaaa

SEQ ID NO: 5599700 - DNA, 15 bp, Homo sapiens
cggagctggttcctc

SEQ ID NO: 5599701 - DNA, 15 bp, Homo sapiens
cggagcttctccagc

SEQ ID NO: 5599702 - DNA, 17 bp, Homo sapiens
cggagcttctccagcca

SEQ ID NO: 5599703 - DNA, 23 bp, Homo sapiens
cggagcttgcctgcctgcctgtg

SEQ ID NO: 5599704 - DNA, 15 bp, Homo sapiens
cggagcttggccctg

SEQ ID NO: 5599705 - DNA, 11 bp, Homo sapiens
cggaggaagcc

SEQ ID NO: 5599706 - DNA, 14 bp, Homo sapiens
cggaggactgagcc

SEQ ID NO: 5599707 - DNA, 16 bp, Homo sapiens
cggaggactgagcccc

SEQ ID NO: 5599708 - DNA, 23 bp, Homo sapiens
cggaggacttgggggcagagcag

SEQ ID NO: 5599709 - DNA, 18 bp, Homo sapiens
cggaggagaccagctcag

SEQ ID NO: 5599710 - DNA, 12 bp, Homo sapiens
cggaggagcagc

SEQ ID NO: 5599711 - DNA, 16 bp, Homo sapiens
cggaggagcatgcgca

SEQ ID NO: 5599712 - DNA, 22 bp, Homo sapiens
cggaggagctagcctgaaggat

SEQ ID NO: 5599713 - DNA, 22 bp, Homo sapiens
cggaggagctccgctaagacct

SEQ ID NO: 5599714 - DNA, 14 bp, Homo sapiens
cggaggagctgcct

SEQ ID NO: 5599715 - DNA, 13 bp, Homo sapiens
cggaggaggagat

SEQ ID NO: 5599716 - DNA, 22 bp, Homo sapiens
cggaggaggagggaggccaggc

SEQ ID NO: 5599717 - DNA, 23 bp, Homo sapiens
cggaggaggagggaggccaggcg

SEQ ID NO: 5599718 - DNA, 13 bp, Homo sapiens
cggaggaggctgc

SEQ ID NO: 5599719 - DNA, 21 bp, Homo sapiens
cggaggagggaagcatagaga

SEQ ID NO: 5599720 - DNA, 19 bp, Homo sapiens
cggaggaggggaaggggct

SEQ ID NO: 5599721 - DNA, 20 bp, Homo sapiens
cggaggaggggaaggggctg

SEQ ID NO: 5599722 - DNA, 21 bp, Homo sapiens
cggaggaggggaaggggctga

SEQ ID NO: 5599723 - DNA, 21 bp, Homo sapiens
cggaggcaaaaggcagtgggg

SEQ ID NO: 5599724 - DNA, 16 bp, Homo sapiens
cggaggcaaagctggc

SEQ ID NO: 5599725 - DNA, 19 bp, Homo sapiens
cggaggcaaagctggctca

SEQ ID NO: 5599726 - DNA, 16 bp, Homo sapiens
cggaggccacatgagt

SEQ ID NO: 5599727 - DNA, 21 bp, Homo sapiens
cggaggccacatgagtcccag

SEQ ID NO: 5599728 - DNA, 21 bp, Homo sapiens
cggaggccagacacaggccgt

SEQ ID NO: 5599729 - DNA, 13 bp, Homo sapiens
cggaggccagcta

SEQ ID NO: 5599730 - DNA, 16 bp, Homo sapiens
cggaggccagctatct

SEQ ID NO: 5599731 - DNA, 13 bp, Homo sapiens
cggaggccatggg

SEQ ID NO: 5599732 - DNA, 18 bp, Homo sapiens
cggaggccccactgatgc

SEQ ID NO: 5599733 - DNA, 18 bp, Homo sapiens
cggaggcctcgagcagag

SEQ ID NO: 5599734 - DNA, 20 bp, Homo sapiens
cggaggcctgcgaccctggg

SEQ ID NO: 5599735 - DNA, 14 bp, Homo sapiens
cggaggccttccct

SEQ ID NO: 5599736 - DNA, 13 bp, Homo sapiens
cggaggccttggg

SEQ ID NO: 5599737 - DNA, 21 bp, Homo sapiens
cggaggccttggggtgggggc

SEQ ID NO: 5599738 - DNA, 16 bp, Homo sapiens
cggaggcggctccagg

SEQ ID NO: 5599739 - DNA, 20 bp, Homo sapiens
cggaggctacccgctgtggc

SEQ ID NO: 5599740 - DNA, 21 bp, Homo sapiens
cggaggctacccgctgtggcc

SEQ ID NO: 5599741 - DNA, 15 bp, Homo sapiens
cggaggctcctccct

SEQ ID NO: 5599742 - DNA, 17 bp, Homo sapiens
cggaggctcctccctct

SEQ ID NO: 5599743 - DNA, 22 bp, Homo sapiens
cggaggctcctccctctgcctc

SEQ ID NO: 5599744 - DNA, 19 bp, Homo sapiens
cggaggctcggccgtgggc

SEQ ID NO: 5599745 - DNA, 22 bp, Homo sapiens
cggaggctcggccgtgggccgg

SEQ ID NO: 5599746 - DNA, 13 bp, Homo sapiens
cggaggctgcccc

SEQ ID NO: 5599747 - DNA, 16 bp, Homo sapiens
cggaggctgcccccgg

SEQ ID NO: 5599748 - DNA, 22 bp, Homo sapiens
cggaggctgcccccggccccct

SEQ ID NO: 5599749 - DNA, 12 bp, Homo sapiens
cggaggctgtgt

SEQ ID NO: 5599750 - DNA, 16 bp, Homo sapiens
cggaggcttgggaccg

SEQ ID NO: 5599751 - DNA, 21 bp, Homo sapiens
cggaggcttgtcagagctggg

SEQ ID NO: 5599752 - DNA, 15 bp, Homo sapiens
cggagggagccctga

SEQ ID NO: 5599753 - DNA, 16 bp, Homo sapiens
cggagggatggagaaa

SEQ ID NO: 5599754 - DNA, 18 bp, Homo sapiens
cggagggccgcagggccc

SEQ ID NO: 5599755 - DNA, 19 bp, Homo sapiens
cggaggggacccagctcct

SEQ ID NO: 5599756 - DNA, 20 bp, Homo sapiens
cggaggggactggtcccggt

SEQ ID NO: 5599757 - DNA, 16 bp, Homo sapiens
cggaggggcctggcag

SEQ ID NO: 5599758 - DNA, 20 bp, Homo sapiens
cggaggggcttggagcagag

SEQ ID NO: 5599759 - DNA, 21 bp, Homo sapiens
cggagggggacggggctcagc

SEQ ID NO: 5599760 - DNA, 23 bp, Homo sapiens
cggagggggtcctcctcgctcct

SEQ ID NO: 5599761 - DNA, 15 bp, Homo sapiens
cggaggggttgcggg

SEQ ID NO: 5599762 - DNA, 23 bp, Homo sapiens
cggaggggttgcgggggagctgg

SEQ ID NO: 5599763 - DNA, 22 bp, Homo sapiens
cggagggtgccgtgcgggcgag

SEQ ID NO: 5599764 - DNA, 16 bp, Homo sapiens
cggaggtgctgtcccc

SEQ ID NO: 5599765 - DNA, 21 bp, Homo sapiens
cggaggtggagtggccactgg

SEQ ID NO: 5599766 - DNA, 16 bp, Homo sapiens
cggaggtgtggagccg

SEQ ID NO: 5599767 - DNA, 23 bp, Homo sapiens
cggaggtgttcccaggctgcccc

SEQ ID NO: 5599768 - DNA, 13 bp, Homo sapiens
cggaggttgcagg

SEQ ID NO: 5599769 - DNA, 22 bp, Homo sapiens
cggaggttgcagtgagctgaga

SEQ ID NO: 5599770 - DNA, 22 bp, Homo sapiens
cggaggttgggtgggccggctt

SEQ ID NO: 5599771 - DNA, 18 bp, Homo sapiens
cggagtatctgggaactg

SEQ ID NO: 5599772 - DNA, 15 bp, Homo sapiens
cggagtatgtgcagt

SEQ ID NO: 5599773 - DNA, 15 bp, Homo sapiens
cggagtcagtgccag

SEQ ID NO: 5599774 - DNA, 14 bp, Homo sapiens
cggagtcccacctt

SEQ ID NO: 5599775 - DNA, 23 bp, Homo sapiens
cggagtcccaccttggctgcagg

SEQ ID NO: 5599776 - DNA, 23 bp, Homo sapiens
cggagtcgtggggtgtgctggga

SEQ ID NO: 5599777 - DNA, 23 bp, Homo sapiens
cggagtctcgctctgtcgcccag

SEQ ID NO: 5599778 - DNA, 13 bp, Homo sapiens
cggagtgcctgga

SEQ ID NO: 5599779 - DNA, 14 bp, Homo sapiens
cggagtgcctggag

SEQ ID NO: 5599780 - DNA, 16 bp, Homo sapiens
cggagtgcctggagtc

SEQ ID NO: 5599781 - DNA, 13 bp, Homo sapiens
cggagtggacacc

SEQ ID NO: 5599782 - DNA, 16 bp, Homo sapiens
cggagtggacaccgct

SEQ ID NO: 5599783 - DNA, 18 bp, Homo sapiens
cggagtggacaccgctca

SEQ ID NO: 5599784 - DNA, 23 bp, Homo sapiens
cggagtggacaccgctcagtatt

SEQ ID NO: 5599785 - DNA, 13 bp, Homo sapiens
cggagtgtggcct

SEQ ID NO: 5599786 - DNA, 20 bp, Homo sapiens
cggagttcctaacaggatga

SEQ ID NO: 5599787 - DNA, 13 bp, Homo sapiens
cggagttgggggt

SEQ ID NO: 5599788 - DNA, 18 bp, Homo sapiens
cggagtttccatttggat

SEQ ID NO: 5599789 - DNA, 16 bp, Homo sapiens
cggatcaaccaggcag

SEQ ID NO: 5599790 - DNA, 17 bp, Homo sapiens
cggatcaaccaggcaga

SEQ ID NO: 5599791 - DNA, 23 bp, Homo sapiens
cggatcacgaggtcaggagatcg

SEQ ID NO: 5599792 - DNA, 18 bp, Homo sapiens
cggatcagagcaggacct

SEQ ID NO: 5599793 - DNA, 19 bp, Homo sapiens
cggatcagagcaggacctc

SEQ ID NO: 5599794 - DNA, 22 bp, Homo sapiens
cggatcagagcaggacctccct

SEQ ID NO: 5599795 - DNA, 17 bp, Homo sapiens
cggatcaggctcccagg

SEQ ID NO: 5599796 - DNA, 13 bp, Homo sapiens
cggatccagggag

SEQ ID NO: 5599797 - DNA, 15 bp, Homo sapiens
cggatccagtttccc

SEQ ID NO: 5599798 - DNA, 12 bp, Homo sapiens
cggatcctgtga

SEQ ID NO: 5599799 - DNA, 20 bp, Homo sapiens
cggatctagccatggctggc

SEQ ID NO: 5599800 - DNA, 15 bp, Homo sapiens
cggatctcactcagc

SEQ ID NO: 5599801 - DNA, 12 bp, Homo sapiens
cggatctccagg

SEQ ID NO: 5599802 - DNA, 15 bp, Homo sapiens
cggatctccaggccc

SEQ ID NO: 5599803 - DNA, 17 bp, Homo sapiens
cggatctccaggcccag

SEQ ID NO: 5599804 - DNA, 21 bp, Homo sapiens
cggatctccaggcccagcctg

SEQ ID NO: 5599805 - DNA, 14 bp, Homo sapiens
cggatctgagaatc

SEQ ID NO: 5599806 - DNA, 15 bp, Homo sapiens
cggatctgttgcaaa

SEQ ID NO: 5599807 - DNA, 16 bp, Homo sapiens
cggatctttggacaga

SEQ ID NO: 5599808 - DNA, 19 bp, Homo sapiens
cggatctttggacagaagc

SEQ ID NO: 5599809 - DNA, 18 bp, Homo sapiens
cggatgacaccctggcct

SEQ ID NO: 5599810 - DNA, 20 bp, Homo sapiens
cggatgacaccctggcctga

SEQ ID NO: 5599811 - DNA, 13 bp, Homo sapiens
cggatgacagcca

SEQ ID NO: 5599812 - DNA, 13 bp, Homo sapiens
cggatgaccaaac

SEQ ID NO: 5599813 - DNA, 21 bp, Homo sapiens
cggatgaccaaaccagccttc

SEQ ID NO: 5599814 - DNA, 18 bp, Homo sapiens
cggatgaccatactcaga

SEQ ID NO: 5599815 - DNA, 18 bp, Homo sapiens
cggatgaggtcatttcta

SEQ ID NO: 5599816 - DNA, 13 bp, Homo sapiens
cggatgagttatt

SEQ ID NO: 5599817 - DNA, 13 bp, Homo sapiens
cggatgcacagag

SEQ ID NO: 5599818 - DNA, 20 bp, Homo sapiens
cggatgcccacccctgctgc

SEQ ID NO: 5599819 - DNA, 20 bp, Homo sapiens
cggatgcccattcctgcctg

SEQ ID NO: 5599820 - DNA, 21 bp, Homo sapiens
cggatgcccattcctgcctgg

SEQ ID NO: 5599821 - DNA, 18 bp, Homo sapiens
cggatgctccatttcaat

SEQ ID NO: 5599822 - DNA, 15 bp, Homo sapiens
cggatggaaggagag

SEQ ID NO: 5599823 - DNA, 19 bp, Homo sapiens
cggatggaaggagagaggt

SEQ ID NO: 5599824 - DNA, 20 bp, Homo sapiens
cggatggaccaacctgctct

SEQ ID NO: 5599825 - DNA, 22 bp, Homo sapiens
cggatggaccaacctgctctgt

SEQ ID NO: 5599826 - DNA, 14 bp, Homo sapiens
cggatggcagattg

SEQ ID NO: 5599827 - DNA, 16 bp, Homo sapiens
cggatggcaggatcca

SEQ ID NO: 5599828 - DNA, 19 bp, Homo sapiens
cggatggcaggatccaagg

SEQ ID NO: 5599829 - DNA, 13 bp, Homo sapiens
cggatggcggtgg

SEQ ID NO: 5599830 - DNA, 14 bp, Homo sapiens
cggattatctagag

SEQ ID NO: 5599831 - DNA, 14 bp, Homo sapiens
cggattattttttc

SEQ ID NO: 5599832 - DNA, 18 bp, Homo sapiens
cggattattttttcagac

SEQ ID NO: 5599833 - DNA, 24 bp, Homo sapiens
cggattccaaagagtagaattgca

SEQ ID NO: 5599834 - DNA, 17 bp, Homo sapiens
cggattccggccctggc

SEQ ID NO: 5599835 - DNA, 15 bp, Homo sapiens
cggattgctctggag

SEQ ID NO: 5599836 - DNA, 18 bp, Homo sapiens
cggattgctctggagcag

SEQ ID NO: 5599837 - DNA, 14 bp, Homo sapiens
cggattggccctgc

SEQ ID NO: 5599838 - DNA, 16 bp, Homo sapiens
cggattggccctgccc

SEQ ID NO: 5599839 - DNA, 21 bp, Homo sapiens
cggattggccctgcccctccc

SEQ ID NO: 5599840 - DNA, 16 bp, Homo sapiens
cggatttatttttcca

SEQ ID NO: 5599841 - DNA, 12 bp, Homo sapiens
cggatttctaac

SEQ ID NO: 5599842 - DNA, 13 bp, Homo sapiens
cggatttgacaaa

SEQ ID NO: 5599843 - DNA, 23 bp, Homo sapiens
cggatttgacaaaataacatttg

SEQ ID NO: 5599844 - DNA, 17 bp, Homo sapiens
cggatttggggattagg

SEQ ID NO: 5599845 - DNA, 15 bp, Homo sapiens
cggatttgtccaaat

SEQ ID NO: 5599846 - DNA, 13 bp, Homo sapiens
cggcaaaaggaaa

SEQ ID NO: 5599847 - DNA, 16 bp, Homo sapiens
cggcaaacctttcccc

SEQ ID NO: 5599848 - DNA, 12 bp, Homo sapiens
cggcaacatcaa

SEQ ID NO: 5599849 - DNA, 20 bp, Homo sapiens
cggcaaccacatgtcccaga

SEQ ID NO: 5599850 - DNA, 20 bp, Homo sapiens
cggcaaccccagttctgctc

SEQ ID NO: 5599851 - DNA, 21 bp, Homo sapiens
cggcaaccccagttctgctcc

SEQ ID NO: 5599852 - DNA, 17 bp, Homo sapiens
cggcaacccctgcagct

SEQ ID NO: 5599853 - DNA, 20 bp, Homo sapiens
cggcaaccgtggggaggcca

SEQ ID NO: 5599854 - DNA, 12 bp, Homo sapiens
cggcaacctgta

SEQ ID NO: 5599855 - DNA, 13 bp, Homo sapiens
cggcaacctgtaa

SEQ ID NO: 5599856 - DNA, 16 bp, Homo sapiens
cggcaacctgtaactg

SEQ ID NO: 5599857 - DNA, 19 bp, Homo sapiens
cggcaacgtagcctgggct

SEQ ID NO: 5599858 - DNA, 19 bp, Homo sapiens
cggcaactaagcagtccct

SEQ ID NO: 5599859 - DNA, 22 bp, Homo sapiens
cggcaactaagcagtccctgag

SEQ ID NO: 5599860 - DNA, 17 bp, Homo sapiens
cggcaaggggcgcgcgc

SEQ ID NO: 5599861 - DNA, 16 bp, Homo sapiens
cggcaataaaagccca

SEQ ID NO: 5599862 - DNA, 17 bp, Homo sapiens
cggcaataaaagcccag

SEQ ID NO: 5599863 - DNA, 18 bp, Homo sapiens
cggcaataaaagcccagg

SEQ ID NO: 5599864 - DNA, 13 bp, Homo sapiens
cggcacactgcca

SEQ ID NO: 5599865 - DNA, 18 bp, Homo sapiens
cggcacagatgctccagg

SEQ ID NO: 5599866 - DNA, 13 bp, Homo sapiens
cggcacagcctgg

SEQ ID NO: 5599867 - DNA, 15 bp, Homo sapiens
cggcacagctgggat

SEQ ID NO: 5599868 - DNA, 16 bp, Homo sapiens
cggcacagctgggata

SEQ ID NO: 5599869 - DNA, 13 bp, Homo sapiens
cggcacaggaaac

SEQ ID NO: 5599870 - DNA, 14 bp, Homo sapiens
cggcacagggtctg

SEQ ID NO: 5599871 - DNA, 22 bp, Homo sapiens
cggcaccaaaccctgtcctccc

SEQ ID NO: 5599872 - DNA, 17 bp, Homo sapiens
cggcaccagtgcctcag

SEQ ID NO: 5599873 - DNA, 16 bp, Homo sapiens
cggcacccaggcctcc

SEQ ID NO: 5599874 - DNA, 17 bp, Homo sapiens
cggcacccaggcctccc

SEQ ID NO: 5599875 - DNA, 19 bp, Homo sapiens
cggcacccaggcctccctg

SEQ ID NO: 5599876 - DNA, 21 bp, Homo sapiens
cggcaccctggtctgtggaga

SEQ ID NO: 5599877 - DNA, 18 bp, Homo sapiens
cggcgtcttgcccagcag

SEQ ID NO: 5599878 - DNA, 17 bp, Homo sapiens
cggcgtggcccaaggct

SEQ ID NO: 5599879 - DNA, 22 bp, Homo sapiens
cggcgtggcccaaggctggcag

SEQ ID NO: 5599880 - DNA, 15 bp, Homo sapiens
cggcgtgggcgaggc

SEQ ID NO: 5599881 - DNA, 20 bp, Homo sapiens
cggcgtggtgtgtccctgga

SEQ ID NO: 5599882 - DNA, 15 bp, Homo sapiens
cggcgtgtgcagtgc

SEQ ID NO: 5599883 - DNA, 14 bp, Homo sapiens
cggctaaaaagaat

SEQ ID NO: 5599884 - DNA, 21 bp, Homo sapiens
cggctaaaaagaatgcagaga

SEQ ID NO: 5599885 - DNA, 14 bp, Homo sapiens
cggctaacttattc

SEQ ID NO: 5599886 - DNA, 14 bp, Homo sapiens
cggctaatgtttgt

SEQ ID NO: 5599887 - DNA, 18 bp, Homo sapiens
cggctaatttttgtattt

SEQ ID NO: 5599888 - DNA, 13 bp, Homo sapiens
cggctacatcagc

SEQ ID NO: 5599889 - DNA, 22 bp, Homo sapiens
cggctaccccccgtctcctgcc

SEQ ID NO: 5599890 - DNA, 23 bp, Homo sapiens
cggctacccctcgactcagcacc

SEQ ID NO: 5599891 - DNA, 15 bp, Homo sapiens
cggctactctggaat

SEQ ID NO: 5599892 - DNA, 20 bp, Homo sapiens
cggctaggccggccagctcc

SEQ ID NO: 5599893 - DNA, 17 bp, Homo sapiens
cggctcaagcccaggag

SEQ ID NO: 5599894 - DNA, 19 bp, Homo sapiens
cggctcactgaaacctctg

SEQ ID NO: 5599895 - DNA, 17 bp, Homo sapiens
cggctcactgcagcctc

SEQ ID NO: 5599896 - DNA, 19 bp, Homo sapiens
cggctcactgcagcctcaa

SEQ ID NO: 5599897 - DNA, 13 bp, Homo sapiens
cggctcagcctcc

SEQ ID NO: 5599898 - DNA, 17 bp, Homo sapiens
cggctcagcctcccgag

SEQ ID NO: 5599899 - DNA, 22 bp, Homo sapiens
cggctcaggagagggccttccc

SEQ ID NO: 5599900 - DNA, 22 bp, Homo sapiens
cggctccaactcctttcagcca

SEQ ID NO: 5599901 - DNA, 13 bp, Homo sapiens
cggctccagagca

SEQ ID NO: 5599902 - DNA, 15 bp, Homo sapiens
cggctccagagcagg

SEQ ID NO: 5599903 - DNA, 13 bp, Homo sapiens
cggctccagctca

SEQ ID NO: 5599904 - DNA, 13 bp, Homo sapiens
cggctccaggctc

SEQ ID NO: 5599905 - DNA, 21 bp, Homo sapiens
cggctcccaccggtgccaaac

SEQ ID NO: 5599906 - DNA, 13 bp, Homo sapiens
cggctcccagcct

SEQ ID NO: 5599907 - DNA, 20 bp, Homo sapiens
cggctccccatgtgtcctgg

SEQ ID NO: 5599908 - DNA, 21 bp, Homo sapiens
cggctcccccaggcctgagct

SEQ ID NO: 5599909 - DNA, 22 bp, Homo sapiens
cggctcccccaggcctgagctg

SEQ ID NO: 5599910 - DNA, 22 bp, Homo sapiens
cggctccccctccagccagaga

SEQ ID NO: 5599911 - DNA, 15 bp, Homo sapiens
cggctccccctgcca

SEQ ID NO: 5599912 - DNA, 16 bp, Homo sapiens
cggctccccctgccag

SEQ ID NO: 5599913 - DNA, 18 bp, Homo sapiens
cggctccccctgccagca

SEQ ID NO: 5599914 - DNA, 15 bp, Homo sapiens
cggctccccctgctt

SEQ ID NO: 5599915 - DNA, 22 bp, Homo sapiens
cggctccccctgcttctcagcc

SEQ ID NO: 5599916 - DNA, 16 bp, Homo sapiens
cggctccccctggacg

SEQ ID NO: 5599917 - DNA, 17 bp, Homo sapiens
cggctccccctggacgg

SEQ ID NO: 5599918 - DNA, 14 bp, Homo sapiens
cggctcccctctgc

SEQ ID NO: 5599919 - DNA, 18 bp, Homo sapiens
cggctcccctctgcttct

SEQ ID NO: 5599920 - DNA, 17 bp, Homo sapiens
cggctcccgcttgctct

SEQ ID NO: 5599921 - DNA, 20 bp, Homo sapiens
cggctcccgcttgctctcct

SEQ ID NO: 5599922 - DNA, 22 bp, Homo sapiens
cggctcccgcttgctctcctgg

SEQ ID NO: 5599923 - DNA, 22 bp, Homo sapiens
cggctcccggggcagggcagcc

SEQ ID NO: 5599924 - DNA, 12 bp, Homo sapiens
cggctccctcct

SEQ ID NO: 5599925 - DNA, 18 bp, Homo sapiens
cggctccgagggcggcca

SEQ ID NO: 5599926 - DNA, 21 bp, Homo sapiens
cggctccgagggcggccaggg

SEQ ID NO: 5599927 - DNA, 22 bp, Homo sapiens
cggctccgagggcggccaggga

SEQ ID NO: 5599928 - DNA, 16 bp, Homo sapiens
cggctcctcagagcgc

SEQ ID NO: 5599929 - DNA, 20 bp, Homo sapiens
cggctcctcagagcgccagg

SEQ ID NO: 5599930 - DNA, 14 bp, Homo sapiens
cggctcctcgcccc

SEQ ID NO: 5599931 - DNA, 19 bp, Homo sapiens
cggctcctcggactctgct

SEQ ID NO: 5599932 - DNA, 22 bp, Homo sapiens
cggctcctctctaacctccttt

SEQ ID NO: 5599933 - DNA, 15 bp, Homo sapiens
cggctcctgctgcac

SEQ ID NO: 5599934 - DNA, 23 bp, Homo sapiens
cggctcctgctgcaccaacccag

SEQ ID NO: 5599935 - DNA, 12 bp, Homo sapiens
cggctcctggac

SEQ ID NO: 5599936 - DNA, 17 bp, Homo sapiens
cggctcctggactcatt

SEQ ID NO: 5599937 - DNA, 19 bp, Homo sapiens
cggctcctggtcacctagg

SEQ ID NO: 5599938 - DNA, 14 bp, Homo sapiens
cggctcctgtgctt

SEQ ID NO: 5599939 - DNA, 20 bp, Homo sapiens
cggctcgagcagtcctgcct

SEQ ID NO: 5599940 - DNA, 20 bp, Homo sapiens
cggctcggaggaagccccca

SEQ ID NO: 5599941 - DNA, 13 bp, Homo sapiens
cggctcggcccag

SEQ ID NO: 5599942 - DNA, 21 bp, Homo sapiens
cggctcgtgtatttattaccg

SEQ ID NO: 5599943 - DNA, 18 bp, Homo sapiens
cggctcgttcccccaggg

SEQ ID NO: 5599944 - DNA, 23 bp, Homo sapiens
cggctctagggcctcagtctgga

SEQ ID NO: 5599945 - DNA, 18 bp, Homo sapiens
cggctctaggtggggcgg

SEQ ID NO: 5599946 - DNA, 10 bp, Homo sapiens
cggctctcca

SEQ ID NO: 5599947 - DNA, 15 bp, Homo sapiens
cggctctccagacct

SEQ ID NO: 5599948 - DNA, 16 bp, Homo sapiens
cggctctcctgagagg

SEQ ID NO: 5599949 - DNA, 15 bp, Homo sapiens
cggctctgaagcaag

SEQ ID NO: 5599950 - DNA, 21 bp, Homo sapiens
cggctctgaagcaaggcggtg

SEQ ID NO: 5599951 - DNA, 19 bp, Homo sapiens
cggctctgagcaggggcag

SEQ ID NO: 5599952 - DNA, 13 bp, Homo sapiens
cggctctgcagtc

SEQ ID NO: 5599953 - DNA, 13 bp, Homo sapiens
cggctctgcatgt

SEQ ID NO: 5599954 - DNA, 19 bp, Homo sapiens
cggctctgggctggctgct

SEQ ID NO: 5599955 - DNA, 18 bp, Homo sapiens
cggctctgggggtgggaa

SEQ ID NO: 5599956 - DNA, 22 bp, Homo sapiens
cggctctgggggtgggaagtgg

SEQ ID NO: 5599957 - DNA, 13 bp, Homo sapiens
cggctctggggta

SEQ ID NO: 5599958 - DNA, 13 bp, Homo sapiens
cggctctgggtgg

SEQ ID NO: 5599959 - DNA, 17 bp, Homo sapiens
cggctctggtcctcgga

SEQ ID NO: 5599960 - DNA, 23 bp, Homo sapiens
cggctctggtggccactgagctg

SEQ ID NO: 5599961 - DNA, 20 bp, Homo sapiens
cggctctggttcctccagcc

SEQ ID NO: 5599962 - DNA, 14 bp, Homo sapiens
cggctctgtcccca

SEQ ID NO: 5599963 - DNA, 16 bp, Homo sapiens
cggctctgtccccagc

SEQ ID NO: 5599964 - DNA, 12 bp, Homo sapiens
cggctctgtgcc

SEQ ID NO: 5599965 - DNA, 14 bp, Homo sapiens
cggctctgtgcccg

SEQ ID NO: 5599966 - DNA, 17 bp, Homo sapiens
cggctctgtgcccggtg

SEQ ID NO: 5599967 - DNA, 23 bp, Homo sapiens
cggctcttatagaagcttcagca

SEQ ID NO: 5599968 - DNA, 15 bp, Homo sapiens
cggctgaacaggccg

SEQ ID NO: 5599969 - DNA, 15 bp, Homo sapiens
cggctgaactgagaa

SEQ ID NO: 5599970 - DNA, 20 bp, Homo sapiens
cggctgaactgagaaggcag

SEQ ID NO: 5599971 - DNA, 23 bp, Homo sapiens
cggctgaccaacattcaaaagca

SEQ ID NO: 5599972 - DNA, 15 bp, Homo sapiens
cggctgaccatgctc

SEQ ID NO: 5599973 - DNA, 16 bp, Homo sapiens
cggctgaccatgctca

SEQ ID NO: 5599974 - DNA, 18 bp, Homo sapiens
cggctgagagccccagct

SEQ ID NO: 5599975 - DNA, 18 bp, Homo sapiens
cggctgagccccccatgc

SEQ ID NO: 5599976 - DNA, 12 bp, Homo sapiens
cggctgagcctt

SEQ ID NO: 5599977 - DNA, 20 bp, Homo sapiens
cggctgagctgggcagctgg

SEQ ID NO: 5599978 - DNA, 14 bp, Homo sapiens
cggctgagctgtgc

SEQ ID NO: 5599979 - DNA, 22 bp, Homo sapiens
cggctgagtcatgatctccctg

SEQ ID NO: 5599980 - DNA, 11 bp, Homo sapiens
cggctgagtgg

SEQ ID NO: 5599981 - DNA, 16 bp, Homo sapiens
cggctgagtggcagca

SEQ ID NO: 5599982 - DNA, 13 bp, Homo sapiens
cggctgcacaaca

SEQ ID NO: 5599983 - DNA, 23 bp, Homo sapiens
cggctgcaccctgtatggagcta

SEQ ID NO: 5599984 - DNA, 17 bp, Homo sapiens
cggctgcacctgcaggg

SEQ ID NO: 5599985 - DNA, 19 bp, Homo sapiens
cggctgcacctgcagggag

SEQ ID NO: 5599986 - DNA, 21 bp, Homo sapiens
cggctgccaggggctctgtgg

SEQ ID NO: 5599987 - DNA, 18 bp, Homo sapiens
cggctgcccccatcacct

SEQ ID NO: 5599988 - DNA, 14 bp, Homo sapiens
cggctgccctctgg

SEQ ID NO: 5599989 - DNA, 12 bp, Homo sapiens
cggctgcccttt

SEQ ID NO: 5599990 - DNA, 14 bp, Homo sapiens
cggctgcctcctga

SEQ ID NO: 5599991 - DNA, 11 bp, Homo sapiens
cggctgcctgc

SEQ ID NO: 5599992 - DNA, 13 bp, Homo sapiens
cggctgcctgccg

SEQ ID NO: 5599993 - DNA, 14 bp, Homo sapiens
cggctgcctgccgc

SEQ ID NO: 5599994 - DNA, 22 bp, Homo sapiens
cggctgcctgccgcccaaagag

SEQ ID NO: 5599995 - DNA, 20 bp, Homo sapiens
cggctgctcctccagccctt

SEQ ID NO: 5599996 - DNA, 19 bp, Homo sapiens
cggctgctccttcaggcga

SEQ ID NO: 5599997 - DNA, 14 bp, Homo sapiens
cggctgctgcttgg

SEQ ID NO: 5599998 - DNA, 13 bp, Homo sapiens
cggctgctggcac

SEQ ID NO: 5599999 - DNA, 17 bp, Homo sapiens
cggctgcttccttctgc

SEQ ID NO: 5600000 - DNA, 23 bp, Homo sapiens
cggctgcttggcagttgcagtgc

SEQ ID NO: 5600001 - DNA, 18 bp, Homo sapiens
cggctggaaagaggagaa

SEQ ID NO: 5600002 - DNA, 19 bp, Homo sapiens
cggctggaaagaggagaag

SEQ ID NO: 5600003 - DNA, 23 bp, Homo sapiens
cggctggaaagaggagaaggaga

SEQ ID NO: 5600004 - DNA, 15 bp, Homo sapiens
cggctggaagaacat

SEQ ID NO: 5600005 - DNA, 20 bp, Homo sapiens
cggctggacttttgcagctt

SEQ ID NO: 5600006 - DNA, 19 bp, Homo sapiens
cggctggagaaagatgcag

SEQ ID NO: 5600007 - DNA, 17 bp, Homo sapiens
cggctggagaccatgca

SEQ ID NO: 5600008 - DNA, 22 bp, Homo sapiens
cggctggagaccatgcagagcg

SEQ ID NO: 5600009 - DNA, 13 bp, Homo sapiens
cggctggatgggg

SEQ ID NO: 5600010 - DNA, 22 bp, Homo sapiens
cggctggatgggggctctgcac

SEQ ID NO: 5600011 - DNA, 14 bp, Homo sapiens
cggctggcagccca

SEQ ID NO: 5600012 - DNA, 22 bp, Homo sapiens
cggctggccggtccaccccgtc

SEQ ID NO: 5600013 - DNA, 15 bp, Homo sapiens
cggctggcctggccc

SEQ ID NO: 5600014 - DNA, 18 bp, Homo sapiens
cggctggcctggcccctc

SEQ ID NO: 5600015 - DNA, 19 bp, Homo sapiens
cggctggcctggcccctca

SEQ ID NO: 5600016 - DNA, 15 bp, Homo sapiens
cggctggctcccctg

SEQ ID NO: 5600017 - DNA, 18 bp, Homo sapiens
cggctggctcccctgcag

SEQ ID NO: 5600018 - DNA, 17 bp, Homo sapiens
cggctggctctgtggag

SEQ ID NO: 5600019 - DNA, 20 bp, Homo sapiens
cggctggctctgtggagggg

SEQ ID NO: 5600020 - DNA, 21 bp, Homo sapiens
cggctggctctgtggaggggc

SEQ ID NO: 5600021 - DNA, 22 bp, Homo sapiens
cggctgggagcctcgcccctcc

SEQ ID NO: 5600022 - DNA, 16 bp, Homo sapiens
cggctgggcacacgcc

SEQ ID NO: 5600023 - DNA, 13 bp, Homo sapiens
cggctgggcaggg

SEQ ID NO: 5600024 - DNA, 17 bp, Homo sapiens
cggctgggcagggccgc

SEQ ID NO: 5600025 - DNA, 23 bp, Homo sapiens
cggctgggcagggccgcagggcg

SEQ ID NO: 5600026 - DNA, 12 bp, Homo sapiens
cggctgggcccg

SEQ ID NO: 5600027 - DNA, 15 bp, Homo sapiens
cggctgggcccgagg

SEQ ID NO: 5600028 - DNA, 22 bp, Homo sapiens
cggctgggtcggccctgcccaa

SEQ ID NO: 5600029 - DNA, 17 bp, Homo sapiens
cggctggtcactctgcc

SEQ ID NO: 5600030 - DNA, 23 bp, Homo sapiens
cggctggtcactctgccctctgc

SEQ ID NO: 5600031 - DNA, 15 bp, Homo sapiens
cggctggtgcagggc

SEQ ID NO: 5600032 - DNA, 18 bp, Homo sapiens
cggctgtgacgcagccgg

SEQ ID NO: 5600033 - DNA, 22 bp, Homo sapiens
cggctgtggagcaaaaggcagc

SEQ ID NO: 5600034 - DNA, 23 bp, Homo sapiens
cggctgtggagcaaaaggcagct

SEQ ID NO: 5600035 - DNA, 14 bp, Homo sapiens
cggctgtgtatttc

SEQ ID NO: 5600036 - DNA, 17 bp, Homo sapiens
cggctgtgtatttctgt

SEQ ID NO: 5600037 - DNA, 19 bp, Homo sapiens
cggctgtgtatttctgtag

SEQ ID NO: 5600038 - DNA, 19 bp, Homo sapiens
cggctgtgtggggagggtg

SEQ ID NO: 5600039 - DNA, 22 bp, Homo sapiens
cggctgttcctcccctgtaggg

SEQ ID NO: 5600040 - DNA, 16 bp, Homo sapiens
cggctgtttcctgaca

SEQ ID NO: 5600041 - DNA, 23 bp, Homo sapiens
cggcttagacttcgactcaggat

SEQ ID NO: 5600042 - DNA, 21 bp, Homo sapiens
cggcttcactgaccagcggct

SEQ ID NO: 5600043 - DNA, 21 bp, Homo sapiens
cggcttccccatcgccttctg

SEQ ID NO: 5600044 - DNA, 17 bp, Homo sapiens
cggcttccgagggcact

SEQ ID NO: 5600045 - DNA, 14 bp, Homo sapiens
cggcttcctcaggg

SEQ ID NO: 5600046 - DNA, 17 bp, Homo sapiens
cggcttcctcattcctt

SEQ ID NO: 5600047 - DNA, 15 bp, Homo sapiens
cggcttcctgtccac

SEQ ID NO: 5600048 - DNA, 16 bp, Homo sapiens
cggcttcctgtccact

SEQ ID NO: 5600049 - DNA, 15 bp, Homo sapiens
cggcttcctttccca

SEQ ID NO: 5600050 - DNA, 20 bp, Homo sapiens
cggcttctcacgctttgttt

SEQ ID NO: 5600051 - DNA, 16 bp, Homo sapiens
cggcttctcatgctat

SEQ ID NO: 5600052 - DNA, 18 bp, Homo sapiens
cggcttcttggaccttgg

SEQ ID NO: 5600053 - DNA, 16 bp, Homo sapiens
cggcttgatcacagct

SEQ ID NO: 5600054 - DNA, 14 bp, Homo sapiens
cggggacagctcct

SEQ ID NO: 5600055 - DNA, 23 bp, Homo sapiens
cggggacagctccttctgtccta

SEQ ID NO: 5600056 - DNA, 16 bp, Homo sapiens
cggggaccttggtctg

SEQ ID NO: 5600057 - DNA, 23 bp, Homo sapiens
cggggactcggagggtgccgtgc

SEQ ID NO: 5600058 - DNA, 16 bp, Homo sapiens
cggggactgctggctc

SEQ ID NO: 5600059 - DNA, 22 bp, Homo sapiens
cggggactgctggctcacgccc

SEQ ID NO: 5600060 - DNA, 18 bp, Homo sapiens
cggggagaaacccagaga

SEQ ID NO: 5600061 - DNA, 18 bp, Homo sapiens
cggggagaaataatgcat

SEQ ID NO: 5600062 - DNA, 21 bp, Homo sapiens
cggggagaagaagcggccagg

SEQ ID NO: 5600063 - DNA, 16 bp, Homo sapiens
cggggagagggggagg

SEQ ID NO: 5600064 - DNA, 16 bp, Homo sapiens
cggggagcccccgccc

SEQ ID NO: 5600065 - DNA, 23 bp, Homo sapiens
cggggagcggcggaaagcctgta

SEQ ID NO: 5600066 - DNA, 15 bp, Homo sapiens
cggggagctgagggg

SEQ ID NO: 5600067 - DNA, 17 bp, Homo sapiens
cggggaggaggaacggg

SEQ ID NO: 5600068 - DNA, 16 bp, Homo sapiens
cggggaggaggagctg

SEQ ID NO: 5600069 - DNA, 18 bp, Homo sapiens
cggggaggaggagctgcc

SEQ ID NO: 5600070 - DNA, 13 bp, Homo sapiens
cggggaggcagag

SEQ ID NO: 5600071 - DNA, 21 bp, Homo sapiens
cggggaggccaagtgcaggct

SEQ ID NO: 5600072 - DNA, 18 bp, Homo sapiens
cggggaggccggcgcagc

SEQ ID NO: 5600073 - DNA, 20 bp, Homo sapiens
cggggaggccggcgcagcgc

SEQ ID NO: 5600074 - DNA, 21 bp, Homo sapiens
cggggagggggcacggcaggc

SEQ ID NO: 5600075 - DNA, 15 bp, Homo sapiens
cggggagggtgacag

SEQ ID NO: 5600076 - DNA, 22 bp, Homo sapiens
cggggaggtgcctgagctgggg

SEQ ID NO: 5600077 - DNA, 20 bp, Homo sapiens
cggggagtttccgcggcggc

SEQ ID NO: 5600078 - DNA, 23 bp, Homo sapiens
cggggagtttccgcggcggcttc

SEQ ID NO: 5600079 - DNA, 15 bp, Homo sapiens
cggggatcatctctg

SEQ ID NO: 5600080 - DNA, 15 bp, Homo sapiens
cggggatcccccgcc

SEQ ID NO: 5600081 - DNA, 13 bp, Homo sapiens
cggggatctgatg

SEQ ID NO: 5600082 - DNA, 19 bp, Homo sapiens
cggggatggttccccagga

SEQ ID NO: 5600083 - DNA, 22 bp, Homo sapiens
cggggcaaagctgctgggccag

SEQ ID NO: 5600084 - DNA, 17 bp, Homo sapiens
cggggcactggctgctc

SEQ ID NO: 5600085 - DNA, 13 bp, Homo sapiens
cggggcagagctg

SEQ ID NO: 5600086 - DNA, 14 bp, Homo sapiens
cggggcagagctga

SEQ ID NO: 5600087 - DNA, 15 bp, Homo sapiens
cggggcagagctgag

SEQ ID NO: 5600088 - DNA, 19 bp, Homo sapiens
cggggcagcaaagcagctg

SEQ ID NO: 5600089 - DNA, 21 bp, Homo sapiens
cggggcagcagcagccctgcc

SEQ ID NO: 5600090 - DNA, 19 bp, Homo sapiens
cggggcagccccctcacag

SEQ ID NO: 5600091 - DNA, 14 bp, Homo sapiens
cggggcagctgcca

SEQ ID NO: 5600092 - DNA, 13 bp, Homo sapiens
cggggcaggaagt

SEQ ID NO: 5600093 - DNA, 14 bp, Homo sapiens
cggggcaggaggcc

SEQ ID NO: 5600094 - DNA, 15 bp, Homo sapiens
cggggcaggaggcct

SEQ ID NO: 5600095 - DNA, 17 bp, Homo sapiens
cggggcaggaggcctgg

SEQ ID NO: 5600096 - DNA, 21 bp, Homo sapiens
cggggcaggccaggggagggg

SEQ ID NO: 5600097 - DNA, 14 bp, Homo sapiens
cggggcaggcgctg

SEQ ID NO: 5600098 - DNA, 22 bp, Homo sapiens
cggggcagggggtatgcagagc

SEQ ID NO: 5600099 - DNA, 20 bp, Homo sapiens
cggggcagtatgtgatggac

SEQ ID NO: 5600100 - DNA, 15 bp, Homo sapiens
cggggcagtcagatt

SEQ ID NO: 5600101 - DNA, 21 bp, Homo sapiens
cggggcagttagagcagcctc

SEQ ID NO: 5600102 - DNA, 17 bp, Homo sapiens
cggggcatgctggggca

SEQ ID NO: 5600103 - DNA, 21 bp, Homo sapiens
cggggccacgtgtgctgtggc

SEQ ID NO: 5600104 - DNA, 13 bp, Homo sapiens
cggggccagaggc

SEQ ID NO: 5600105 - DNA, 14 bp, Homo sapiens
cggggccagctccg

SEQ ID NO: 5600106 - DNA, 20 bp, Homo sapiens
cggggccatttggccggctc

SEQ ID NO: 5600107 - DNA, 16 bp, Homo sapiens
cggggcccagcgctct

SEQ ID NO: 5600108 - DNA, 12 bp, Homo sapiens
cggggcccagga

SEQ ID NO: 5600109 - DNA, 20 bp, Homo sapiens
cggggcccagggcaagctcc

SEQ ID NO: 5600110 - DNA, 18 bp, Homo sapiens
cggggccccactggctgg

SEQ ID NO: 5600111 - DNA, 14 bp, Homo sapiens
cggggcccctgctc

SEQ ID NO: 5600112 - DNA, 20 bp, Homo sapiens
cggggcccgccccaggcccc

SEQ ID NO: 5600113 - DNA, 15 bp, Homo sapiens
cggggcccttcctcg

SEQ ID NO: 5600114 - DNA, 18 bp, Homo sapiens
cggggcccttggggcctg

SEQ ID NO: 5600115 - DNA, 20 bp, Homo sapiens
cggggcccttggggcctggc

SEQ ID NO: 5600116 - DNA, 18 bp, Homo sapiens
cggggccgcagccacacc

SEQ ID NO: 5600117 - DNA, 15 bp, Homo sapiens
cggggccgggactgg

SEQ ID NO: 5600118 - DNA, 17 bp, Homo sapiens
cggggcctcgggacctc

SEQ ID NO: 5600119 - DNA, 14 bp, Homo sapiens
cggggcctgcaggc

SEQ ID NO: 5600120 - DNA, 13 bp, Homo sapiens
cggggcctggaca

SEQ ID NO: 5600121 - DNA, 14 bp, Homo sapiens
cggggcctggacag

SEQ ID NO: 5600122 - DNA, 17 bp, Homo sapiens
cggggcctggacaggcg

SEQ ID NO: 5600123 - DNA, 21 bp, Homo sapiens
cggggcctggacaggcgggct

SEQ ID NO: 5600124 - DNA, 22 bp, Homo sapiens
cggggcctggcgggatgggcca

SEQ ID NO: 5600125 - DNA, 17 bp, Homo sapiens
cggggcctgggcaggag

SEQ ID NO: 5600126 - DNA, 13 bp, Homo sapiens
cggggcctgtctc

SEQ ID NO: 5600127 - DNA, 15 bp, Homo sapiens
cggggcctgtctcag

SEQ ID NO: 5600128 - DNA, 17 bp, Homo sapiens
cggggcctgtctcagtg

SEQ ID NO: 5600129 - DNA, 19 bp, Homo sapiens
cggggccttttgcccggag

SEQ ID NO: 5600130 - DNA, 21 bp, Homo sapiens
cggggcgacccctcagtgctc

SEQ ID NO: 5600131 - DNA, 17 bp, Homo sapiens
cggggcgatgctccctc

SEQ ID NO: 5600132 - DNA, 15 bp, Homo sapiens
cggggcgcctagagc

SEQ ID NO: 5600133 - DNA, 19 bp, Homo sapiens
cggggcgcctagagcgcgg

SEQ ID NO: 5600134 - DNA, 14 bp, Homo sapiens
cggggcgtttcttt

SEQ ID NO: 5600135 - DNA, 14 bp, Homo sapiens
cggggctcactctg

SEQ ID NO: 5600136 - DNA, 15 bp, Homo sapiens
cggggctcactctgg

SEQ ID NO: 5600137 - DNA, 16 bp, Homo sapiens
cggggctcactctggc

SEQ ID NO: 5600138 - DNA, 17 bp, Homo sapiens
cggggctcactctggcc

SEQ ID NO: 5600139 - DNA, 15 bp, Homo sapiens
cggggctcagccctg

SEQ ID NO: 5600140 - DNA, 13 bp, Homo sapiens
cggggctcctcct

SEQ ID NO: 5600141 - DNA, 16 bp, Homo sapiens
cggggctcctcctgaa

SEQ ID NO: 5600142 - DNA, 17 bp, Homo sapiens
cggggctcctcctgaag

SEQ ID NO: 5600143 - DNA, 23 bp, Homo sapiens
cggggctctaggatggggcacgg

SEQ ID NO: 5600144 - DNA, 19 bp, Homo sapiens
cggggctgaagccacacag

SEQ ID NO: 5600145 - DNA, 22 bp, Homo sapiens
cggggctgaagccacacagccc

SEQ ID NO: 5600146 - DNA, 20 bp, Homo sapiens
cggggctgccgcatctgcct

SEQ ID NO: 5600147 - DNA, 23 bp, Homo sapiens
cggggctgccgcatctgcctgga

SEQ ID NO: 5600148 - DNA, 13 bp, Homo sapiens
cggggctggccct

SEQ ID NO: 5600149 - DNA, 16 bp, Homo sapiens
cggggctggccctgcc

SEQ ID NO: 5600150 - DNA, 20 bp, Homo sapiens
cggggctggccctgccctcc

SEQ ID NO: 5600151 - DNA, 13 bp, Homo sapiens
cggggctgggaag

SEQ ID NO: 5600152 - DNA, 15 bp, Homo sapiens
cggggctgggaggaa

SEQ ID NO: 5600153 - DNA, 13 bp, Homo sapiens
cggggctgggcag

SEQ ID NO: 5600154 - DNA, 21 bp, Homo sapiens
cggggctgggggctgcagggc

SEQ ID NO: 5600155 - DNA, 23 bp, Homo sapiens
cggggctgggggctgcagggctg

SEQ ID NO: 5600156 - DNA, 19 bp, Homo sapiens
cggggctgtcggcgctgcc

SEQ ID NO: 5600157 - DNA, 12 bp, Homo sapiens
cggggcttcacc

SEQ ID NO: 5600158 - DNA, 22 bp, Homo sapiens
cggggcttctctccgcgggtgg

SEQ ID NO: 5600159 - DNA, 13 bp, Homo sapiens
cggggcttctctt

SEQ ID NO: 5600160 - DNA, 21 bp, Homo sapiens
cggggcttctgcggggctgag

SEQ ID NO: 5600161 - DNA, 15 bp, Homo sapiens
cggggcttctgggcg

SEQ ID NO: 5600162 - DNA, 22 bp, Homo sapiens
cggggcttctgggtggctcctg

SEQ ID NO: 5600163 - DNA, 23 bp, Homo sapiens
cggggcttctgggtggctcctgc

SEQ ID NO: 5600164 - DNA, 22 bp, Homo sapiens
cggggcttctgtgcacctgggc

SEQ ID NO: 5600165 - DNA, 18 bp, Homo sapiens
cggggcttgccttctggt

SEQ ID NO: 5600166 - DNA, 13 bp, Homo sapiens
cgggggacaggaa

SEQ ID NO: 5600167 - DNA, 13 bp, Homo sapiens
cgggggagagagt

SEQ ID NO: 5600168 - DNA, 21 bp, Homo sapiens
cgggggagcaaaaggcggtga

SEQ ID NO: 5600169 - DNA, 20 bp, Homo sapiens
cgggggagcagagagagcca

SEQ ID NO: 5600170 - DNA, 14 bp, Homo sapiens
cgggggagcaggca

SEQ ID NO: 5600171 - DNA, 15 bp, Homo sapiens
cgggggagcaggcag

SEQ ID NO: 5600172 - DNA, 12 bp, Homo sapiens
cgggggagccag

SEQ ID NO: 5600173 - DNA, 15 bp, Homo sapiens
cgggggagcctggag

SEQ ID NO: 5600174 - DNA, 17 bp, Homo sapiens
cgggggaggagcacccc

SEQ ID NO: 5600175 - DNA, 19 bp, Homo sapiens
cgggggaggggccctcagg

SEQ ID NO: 5600176 - DNA, 15 bp, Homo sapiens
cgggggatcctggag

SEQ ID NO: 5600177 - DNA, 16 bp, Homo sapiens
cgggggatcctggagc

SEQ ID NO: 5600178 - DNA, 16 bp, Homo sapiens
cgggggcacgtgtggg

SEQ ID NO: 5600179 - DNA, 17 bp, Homo sapiens
cgggggcagtctgagag

SEQ ID NO: 5600180 - DNA, 22 bp, Homo sapiens
cgggggccaactcacccttggc

SEQ ID NO: 5600181 - DNA, 17 bp, Homo sapiens
cgggggccagacacaga

SEQ ID NO: 5600182 - DNA, 18 bp, Homo sapiens
cgggggccagacacagat

SEQ ID NO: 5600183 - DNA, 19 bp, Homo sapiens
cgggggcctagtggcttca

SEQ ID NO: 5600184 - DNA, 23 bp, Homo sapiens
cgggggcctgcaaatctagtgcc

SEQ ID NO: 5600185 - DNA, 12 bp, Homo sapiens
cgggggcctgtg

SEQ ID NO: 5600186 - DNA, 22 bp, Homo sapiens
cgggggccttgaagactccctg

SEQ ID NO: 5600187 - DNA, 16 bp, Homo sapiens
cgggggcggaggagga

SEQ ID NO: 5600188 - DNA, 18 bp, Homo sapiens
cgggggcgtggctggcct

SEQ ID NO: 5600189 - DNA, 16 bp, Homo sapiens
cgggggctaactggcc

SEQ ID NO: 5600190 - DNA, 18 bp, Homo sapiens
cgggggctaactggcccc

SEQ ID NO: 5600191 - DNA, 20 bp, Homo sapiens
cgggggctaactggccccag

SEQ ID NO: 5600192 - DNA, 22 bp, Homo sapiens
cgggggctaactggccccaggc

SEQ ID NO: 5600193 - DNA, 23 bp, Homo sapiens
cgggggctaactggccccaggcg

SEQ ID NO: 5600194 - DNA, 15 bp, Homo sapiens
cgggggctcttcccc

SEQ ID NO: 5600195 - DNA, 15 bp, Homo sapiens
cgggggctgctgggc

SEQ ID NO: 5600196 - DNA, 16 bp, Homo sapiens
cgggggctgctgggcg

SEQ ID NO: 5600197 - DNA, 12 bp, Homo sapiens
cgggggctggcc

SEQ ID NO: 5600198 - DNA, 13 bp, Homo sapiens
cgggggctggcct

SEQ ID NO: 5600199 - DNA, 18 bp, Homo sapiens
cgggggctggcctaggag

SEQ ID NO: 5600200 - DNA, 18 bp, Homo sapiens
cgggggctgtgactctgg

SEQ ID NO: 5600201 - DNA, 21 bp, Homo sapiens
cgggggctgtggctctgggtg

SEQ ID NO: 5600202 - DNA, 17 bp, Homo sapiens
cggggggaaagaaaagg

SEQ ID NO: 5600203 - DNA, 18 bp, Homo sapiens
cggggggaaagaaaagga

SEQ ID NO: 5600204 - DNA, 15 bp, Homo sapiens
cggggggacagctcc

SEQ ID NO: 5600205 - DNA, 12 bp, Homo sapiens
cggggggagggg

SEQ ID NO: 5600206 - DNA, 15 bp, Homo sapiens
cggggggaggggaca

SEQ ID NO: 5600207 - DNA, 22 bp, Homo sapiens
cggggggccccagtcagcctct

SEQ ID NO: 5600208 - DNA, 16 bp, Homo sapiens
cggggggctcctgccc

SEQ ID NO: 5600209 - DNA, 21 bp, Homo sapiens
cggggggctcctgcccaggcc

SEQ ID NO: 5600210 - DNA, 14 bp, Homo sapiens
cggggggctctgcc

SEQ ID NO: 5600211 - DNA, 20 bp, Homo sapiens
cggggggctgcgggcggggc

SEQ ID NO: 5600212 - DNA, 13 bp, Homo sapiens
cggggggctggga

SEQ ID NO: 5600213 - DNA, 14 bp, Homo sapiens
cggggggctgggac

SEQ ID NO: 5600214 - DNA, 18 bp, Homo sapiens
cggggggggcgcctggag

SEQ ID NO: 5600215 - DNA, 20 bp, Homo sapiens
cggggggggcgcctggagag

SEQ ID NO: 5600216 - DNA, 18 bp, Homo sapiens
cggggggggtaggagagg

SEQ ID NO: 5600217 - DNA, 13 bp, Homo sapiens
cggggggtggacc

SEQ ID NO: 5600218 - DNA, 18 bp, Homo sapiens
cggggggtgtcttccctg

SEQ ID NO: 5600219 - DNA, 22 bp, Homo sapiens
cggggggtgtcttccctgcctg

SEQ ID NO: 5600220 - DNA, 22 bp, Homo sapiens
cgggggtccccggacgctggct

SEQ ID NO: 5600221 - DNA, 19 bp, Homo sapiens
cgggggtctatacattcct

SEQ ID NO: 5600222 - DNA, 20 bp, Homo sapiens
cgggggtgcggcaggagcag

SEQ ID NO: 5600223 - DNA, 14 bp, Homo sapiens
cgggggtgctgggg

SEQ ID NO: 5600224 - DNA, 15 bp, Homo sapiens
cgggggtggctctgt

SEQ ID NO: 5600225 - DNA, 14 bp, Homo sapiens
cgggggtgggaggt

SEQ ID NO: 5600226 - DNA, 20 bp, Homo sapiens
cgggggtgggggcctgctgt

SEQ ID NO: 5600227 - DNA, 19 bp, Homo sapiens
cgggggttccgtgtccacc

SEQ ID NO: 5600228 - DNA, 15 bp, Homo sapiens
cggggtatcctgggg

SEQ ID NO: 5600229 - DNA, 14 bp, Homo sapiens
cggggtatgaagag

SEQ ID NO: 5600230 - DNA, 17 bp, Homo sapiens
cggggtattcccactca

SEQ ID NO: 5600231 - DNA, 22 bp, Homo sapiens
cggggtattcccactcaccagc

SEQ ID NO: 5600232 - DNA, 23 bp, Homo sapiens
cgtcattgatggagcctgaaccg

SEQ ID NO: 5600233 - DNA, 13 bp, Homo sapiens
cgtcatttgtgca

SEQ ID NO: 5600234 - DNA, 21 bp, Homo sapiens
cgtcattttctttcccagaag

SEQ ID NO: 5600235 - DNA, 17 bp, Homo sapiens
cgtcattttgcagtgtg

SEQ ID NO: 5600236 - DNA, 22 bp, Homo sapiens
cgtccaaaggagtgcatggcca

SEQ ID NO: 5600237 - DNA, 21 bp, Homo sapiens
cgtccacaggggcaggcctgg

SEQ ID NO: 5600238 - DNA, 13 bp, Homo sapiens
cgtccacatacac

SEQ ID NO: 5600239 - DNA, 22 bp, Homo sapiens
cgtccaccatggggtcctacca

SEQ ID NO: 5600240 - DNA, 14 bp, Homo sapiens
cgtccacccaggct

SEQ ID NO: 5600241 - DNA, 16 bp, Homo sapiens
cgtccacccaggctgc

SEQ ID NO: 5600242 - DNA, 17 bp, Homo sapiens
cgtccacccaggctgca

SEQ ID NO: 5600243 - DNA, 20 bp, Homo sapiens
cgtccacccaggctgcactg

SEQ ID NO: 5600244 - DNA, 16 bp, Homo sapiens
cgtccaccctgagctc

SEQ ID NO: 5600245 - DNA, 19 bp, Homo sapiens
cgtccaccctgagctcggg

SEQ ID NO: 5600246 - DNA, 14 bp, Homo sapiens
cgtccacccttcca

SEQ ID NO: 5600247 - DNA, 12 bp, Homo sapiens
cgtccactgtca

SEQ ID NO: 5600248 - DNA, 14 bp, Homo sapiens
cgtccactttccct

SEQ ID NO: 5600249 - DNA, 20 bp, Homo sapiens
cgtccactttcccttcccct

SEQ ID NO: 5600250 - DNA, 12 bp, Homo sapiens
cgtccagccctc

SEQ ID NO: 5600251 - DNA, 21 bp, Homo sapiens
cgtccagccgccattgccacc

SEQ ID NO: 5600252 - DNA, 15 bp, Homo sapiens
cgtccagctcagccc

SEQ ID NO: 5600253 - DNA, 21 bp, Homo sapiens
cgtccaggggagatggggagg

SEQ ID NO: 5600254 - DNA, 17 bp, Homo sapiens
cgtccagggtttacatt

SEQ ID NO: 5600255 - DNA, 11 bp, Homo sapiens
cgtccaggtcc

SEQ ID NO: 5600256 - DNA, 20 bp, Homo sapiens
cgtccaggtccgtagctccc

SEQ ID NO: 5600257 - DNA, 23 bp, Homo sapiens
cgtccaggtccgtagctcccctg

SEQ ID NO: 5600258 - DNA, 12 bp, Homo sapiens
cgtccaggtgat

SEQ ID NO: 5600259 - DNA, 19 bp, Homo sapiens
cgtccatagctcctctccc

SEQ ID NO: 5600260 - DNA, 14 bp, Homo sapiens
cgtccatcactggc

SEQ ID NO: 5600261 - DNA, 20 bp, Homo sapiens
cgtccatcactggctctcta

SEQ ID NO: 5600262 - DNA, 15 bp, Homo sapiens
cgtccatcagggatc

SEQ ID NO: 5600263 - DNA, 13 bp, Homo sapiens
cgtccatctctct

SEQ ID NO: 5600264 - DNA, 17 bp, Homo sapiens
cgtccatctctctccct

SEQ ID NO: 5600265 - DNA, 15 bp, Homo sapiens
cgtccatggcaccag

SEQ ID NO: 5600266 - DNA, 17 bp, Homo sapiens
cgtccattcagaaagct

SEQ ID NO: 5600267 - DNA, 13 bp, Homo sapiens
cgtcccaccagct

SEQ ID NO: 5600268 - DNA, 17 bp, Homo sapiens
cgtcccaccccacctct

SEQ ID NO: 5600269 - DNA, 13 bp, Homo sapiens
cgtcccaccccct

SEQ ID NO: 5600270 - DNA, 23 bp, Homo sapiens
cgtcccagaggccgctgcccctg

SEQ ID NO: 5600271 - DNA, 18 bp, Homo sapiens
cgtcccagcatccctgga

SEQ ID NO: 5600272 - DNA, 19 bp, Homo sapiens
cgtcccagcatccctggag

SEQ ID NO: 5600273 - DNA, 12 bp, Homo sapiens
cgtcccagcctg

SEQ ID NO: 5600274 - DNA, 16 bp, Homo sapiens
cgtcccagctcccctc

SEQ ID NO: 5600275 - DNA, 12 bp, Homo sapiens
cgtcccaggcca

SEQ ID NO: 5600276 - DNA, 13 bp, Homo sapiens
cgtcccaggccac

SEQ ID NO: 5600277 - DNA, 23 bp, Homo sapiens
cgtcccagggtacccgcctgagc

SEQ ID NO: 5600278 - DNA, 15 bp, Homo sapiens
cgtcccatatcctgc

SEQ ID NO: 5600279 - DNA, 16 bp, Homo sapiens
cgtccccaaacctagc

SEQ ID NO: 5600280 - DNA, 13 bp, Homo sapiens
cgtccccactccc

SEQ ID NO: 5600281 - DNA, 14 bp, Homo sapiens
cgtccccactccct

SEQ ID NO: 5600282 - DNA, 12 bp, Homo sapiens
cgtccccagacc

SEQ ID NO: 5600283 - DNA, 15 bp, Homo sapiens
cgtccccagaccagt

SEQ ID NO: 5600284 - DNA, 13 bp, Homo sapiens
cgtccccagggtg

SEQ ID NO: 5600285 - DNA, 19 bp, Homo sapiens
cgtccccagggtgcaggcg

SEQ ID NO: 5600286 - DNA, 16 bp, Homo sapiens
cgtcccccagaacctc

SEQ ID NO: 5600287 - DNA, 17 bp, Homo sapiens
cgtcccccagccctcag

SEQ ID NO: 5600288 - DNA, 11 bp, Homo sapiens
cgtccccccat

SEQ ID NO: 5600289 - DNA, 21 bp, Homo sapiens
cgtcccccgccgcgccagtcc

SEQ ID NO: 5600290 - DNA, 16 bp, Homo sapiens
cgtccccctccagtgc

SEQ ID NO: 5600291 - DNA, 13 bp, Homo sapiens
cgtccccctgggg

SEQ ID NO: 5600292 - DNA, 21 bp, Homo sapiens
cgtccccggcccctgccccgc

SEQ ID NO: 5600293 - DNA, 18 bp, Homo sapiens
cgtcccctcaagcccctt

SEQ ID NO: 5600294 - DNA, 21 bp, Homo sapiens
cgtcccctcccccacccctgc

SEQ ID NO: 5600295 - DNA, 13 bp, Homo sapiens
cgtcccctccgcc

SEQ ID NO: 5600296 - DNA, 14 bp, Homo sapiens
cgtcccctccgccg

SEQ ID NO: 5600297 - DNA, 15 bp, Homo sapiens
cgtcccctccgccgt

SEQ ID NO: 5600298 - DNA, 21 bp, Homo sapiens
cgtcccctccgccgtgccggc

SEQ ID NO: 5600299 - DNA, 15 bp, Homo sapiens
cgtcccctgggccac

SEQ ID NO: 5600300 - DNA, 11 bp, Homo sapiens
cgtcccctgtc

SEQ ID NO: 5600301 - DNA, 14 bp, Homo sapiens
cgtcccctgtcccc

SEQ ID NO: 5600302 - DNA, 20 bp, Homo sapiens
cgtcccgagggcgcctgggt

SEQ ID NO: 5600303 - DNA, 21 bp, Homo sapiens
cgtcccgagggcgcctgggtc

SEQ ID NO: 5600304 - DNA, 16 bp, Homo sapiens
cgtcccgcacagtgga

SEQ ID NO: 5600305 - DNA, 14 bp, Homo sapiens
cgtcccgccagtgc

SEQ ID NO: 5600306 - DNA, 14 bp, Homo sapiens
cgtcccgctgcctc

SEQ ID NO: 5600307 - DNA, 21 bp, Homo sapiens
cgtcccgctgctgtgctctgg

SEQ ID NO: 5600308 - DNA, 22 bp, Homo sapiens
cgtcccgctgctgtgctctggg

SEQ ID NO: 5600309 - DNA, 14 bp, Homo sapiens
cgtcccgtccctcc

SEQ ID NO: 5600310 - DNA, 15 bp, Homo sapiens
cgtccctagcagtga

SEQ ID NO: 5600311 - DNA, 22 bp, Homo sapiens
cgtccctatatcagggcctgag

SEQ ID NO: 5600312 - DNA, 12 bp, Homo sapiens
cgtccctcctgt

SEQ ID NO: 5600313 - DNA, 15 bp, Homo sapiens
cgtccctctccccgg

SEQ ID NO: 5600314 - DNA, 17 bp, Homo sapiens
cgtccctctgccttgca

SEQ ID NO: 5600315 - DNA, 18 bp, Homo sapiens
cgtccctgacttcccagc

SEQ ID NO: 5600316 - DNA, 20 bp, Homo sapiens
cgtccctgacttcccagctg

SEQ ID NO: 5600317 - DNA, 14 bp, Homo sapiens
cgtccctgcccaga

SEQ ID NO: 5600318 - DNA, 13 bp, Homo sapiens
cgtccctgtcccc

SEQ ID NO: 5600319 - DNA, 18 bp, Homo sapiens
cgtccctgtcccccagca

SEQ ID NO: 5600320 - DNA, 12 bp, Homo sapiens
cgtcccttctct

SEQ ID NO: 5600321 - DNA, 20 bp, Homo sapiens
cgtcccttggaaagttcagc

SEQ ID NO: 5600322 - DNA, 17 bp, Homo sapiens
cgtccgcccgcccaccc

SEQ ID NO: 5600323 - DNA, 19 bp, Homo sapiens
cgtccgcccgcccaccccg

SEQ ID NO: 5600324 - DNA, 20 bp, Homo sapiens
cgtccgcccgcccaccccgc

SEQ ID NO: 5600325 - DNA, 15 bp, Homo sapiens
cgtccgcgcgccagc

SEQ ID NO: 5600326 - DNA, 18 bp, Homo sapiens
cgtccggcctgcagccca

SEQ ID NO: 5600327 - DNA, 15 bp, Homo sapiens
cgtccggtgtgtcag

SEQ ID NO: 5600328 - DNA, 15 bp, Homo sapiens
cgtccgtctgtctcg

SEQ ID NO: 5600329 - DNA, 20 bp, Homo sapiens
cgtcctcacccctgtcctca

SEQ ID NO: 5600330 - DNA, 22 bp, Homo sapiens
cgtcctccaccggtgcctcctc

SEQ ID NO: 5600331 - DNA, 12 bp, Homo sapiens
cgtcctccctca

SEQ ID NO: 5600332 - DNA, 14 bp, Homo sapiens
cgtcctccctcagc

SEQ ID NO: 5600333 - DNA, 14 bp, Homo sapiens
cgtcctcctctgtg

SEQ ID NO: 5600334 - DNA, 23 bp, Homo sapiens
cgtcctcgtggcggggcagcagg

SEQ ID NO: 5600335 - DNA, 13 bp, Homo sapiens
cgtcctctcccca

SEQ ID NO: 5600336 - DNA, 14 bp, Homo sapiens
cgtcctctccccag

SEQ ID NO: 5600337 - DNA, 23 bp, Homo sapiens
cgtcctctcgtagaacctgcgca

SEQ ID NO: 5600338 - DNA, 13 bp, Homo sapiens
cgtcctgaggaat

SEQ ID NO: 5600339 - DNA, 14 bp, Homo sapiens
cgtcctgaggaata

SEQ ID NO: 5600340 - DNA, 22 bp, Homo sapiens
cgtcctgaggagtgtcctgtct

SEQ ID NO: 5600341 - DNA, 17 bp, Homo sapiens
cgtcctgatccctccac

SEQ ID NO: 5600342 - DNA, 15 bp, Homo sapiens
cgtcctgcagtgtga

SEQ ID NO: 5600343 - DNA, 14 bp, Homo sapiens
cgtcctgccacctg

SEQ ID NO: 5600344 - DNA, 22 bp, Homo sapiens
cgtcctgcccccgacagcccag

SEQ ID NO: 5600345 - DNA, 14 bp, Homo sapiens
cgtcctgccctgcc

SEQ ID NO: 5600346 - DNA, 16 bp, Homo sapiens
cgtcctgcctggcact

SEQ ID NO: 5600347 - DNA, 13 bp, Homo sapiens
cgtcctgcctgtg

SEQ ID NO: 5600348 - DNA, 16 bp, Homo sapiens
cgtcctgcctgtggcg

SEQ ID NO: 5600349 - DNA, 22 bp, Homo sapiens
cgtcctgctggcacctcagaca

SEQ ID NO: 5600350 - DNA, 19 bp, Homo sapiens
cgtcctgctgtccctgtca

SEQ ID NO: 5600351 - DNA, 13 bp, Homo sapiens
cgtcctggaatga

SEQ ID NO: 5600352 - DNA, 20 bp, Homo sapiens
cgtcctggaggttccccagc

SEQ ID NO: 5600353 - DNA, 22 bp, Homo sapiens
cgtcctggggtggttggaggcc

SEQ ID NO: 5600354 - DNA, 14 bp, Homo sapiens
cgtcctgtcactga

SEQ ID NO: 5600355 - DNA, 23 bp, Homo sapiens
cgtcctgtccacacccagctcag

SEQ ID NO: 5600356 - DNA, 13 bp, Homo sapiens
cgtcctgtcccag

SEQ ID NO: 5600357 - DNA, 22 bp, Homo sapiens
cgtcctgtcccctccttccagc

SEQ ID NO: 5600358 - DNA, 17 bp, Homo sapiens
cgtcctttcacacatct

SEQ ID NO: 5600359 - DNA, 22 bp, Homo sapiens
cgtcctttcctctcctctctgg

SEQ ID NO: 5600360 - DNA, 15 bp, Homo sapiens
cgtcgaccaggaaag

SEQ ID NO: 5600361 - DNA, 16 bp, Homo sapiens
cgtcgacgtagaacct

SEQ ID NO: 5600362 - DNA, 20 bp, Homo sapiens
cgtcgagctgggaaggttcc

SEQ ID NO: 5600363 - DNA, 13 bp, Homo sapiens
cgtcgcacagtct

SEQ ID NO: 5600364 - DNA, 20 bp, Homo sapiens
cgtcgctggacaacccagaa

SEQ ID NO: 5600365 - DNA, 20 bp, Homo sapiens
cgtcgctgtccgtcctgctc

SEQ ID NO: 5600366 - DNA, 16 bp, Homo sapiens
cgtcggagctgcctgc

SEQ ID NO: 5600367 - DNA, 22 bp, Homo sapiens
cgtcggagctgcctgcagcaca

SEQ ID NO: 5600368 - DNA, 12 bp, Homo sapiens
cgtcggccctgc

SEQ ID NO: 5600369 - DNA, 23 bp, Homo sapiens
cgtcggccctgcgtcggccctgg

SEQ ID NO: 5600370 - DNA, 15 bp, Homo sapiens
cgtcggccgaccagg

SEQ ID NO: 5600371 - DNA, 22 bp, Homo sapiens
cgtcgggcgtgggtctctgggg

SEQ ID NO: 5600372 - DNA, 18 bp, Homo sapiens
cgtcggggggacagctcc

SEQ ID NO: 5600373 - DNA, 20 bp, Homo sapiens
cgtcgtgtgctgaagacatg

SEQ ID NO: 5600374 - DNA, 18 bp, Homo sapiens
cgtcgttttacaagaaaa

SEQ ID NO: 5600375 - DNA, 17 bp, Homo sapiens
cgtctaaccacagctcc

SEQ ID NO: 5600376 - DNA, 14 bp, Homo sapiens
cgtctacagctccc

SEQ ID NO: 5600377 - DNA, 15 bp, Homo sapiens
cgtctacccagactc

SEQ ID NO: 5600378 - DNA, 20 bp, Homo sapiens
cgtctacccagactcagaga

SEQ ID NO: 5600379 - DNA, 22 bp, Homo sapiens
cgtctagctatgctgtatctgt

SEQ ID NO: 5600380 - DNA, 16 bp, Homo sapiens
cgtctatcaccaggat

SEQ ID NO: 5600381 - DNA, 23 bp, Homo sapiens
cgtctcaaaaaaaaaaaaatgca

SEQ ID NO: 5600382 - DNA, 13 bp, Homo sapiens
cgtctcagaaggc

SEQ ID NO: 5600383 - DNA, 16 bp, Homo sapiens
cgtctcagaatctaaa

SEQ ID NO: 5600384 - DNA, 16 bp, Homo sapiens
cgtctcatactcacct

SEQ ID NO: 5600385 - DNA, 14 bp, Homo sapiens
cgtctcatctccca

SEQ ID NO: 5600386 - DNA, 19 bp, Homo sapiens
cgtctccaggggctgcttc

SEQ ID NO: 5600387 - DNA, 21 bp, Homo sapiens
cgtctccaggggctgcttcct

SEQ ID NO: 5600388 - DNA, 16 bp, Homo sapiens
cgtctccatctctggt

SEQ ID NO: 5600389 - DNA, 15 bp, Homo sapiens
cgtctcccatcctga

SEQ ID NO: 5600390 - DNA, 19 bp, Homo sapiens
cgtctcccatcctgatccc

SEQ ID NO: 5600391 - DNA, 18 bp, Homo sapiens
cgtctcccatcttaactc

SEQ ID NO: 5600392 - DNA, 10 bp, Homo sapiens
cgtctccccc

SEQ ID NO: 5600393 - DNA, 21 bp, Homo sapiens
cgtctcccccgtgttcccctc

SEQ ID NO: 5600394 - DNA, 22 bp, Homo sapiens
cgtctcccccgtgttcccctct

SEQ ID NO: 5600395 - DNA, 21 bp, Homo sapiens
cgtctccccttctctgcctca

SEQ ID NO: 5600396 - DNA, 15 bp, Homo sapiens
cgtctccctaaaata

SEQ ID NO: 5600397 - DNA, 16 bp, Homo sapiens
cgtctccctaaaataa

SEQ ID NO: 5600398 - DNA, 19 bp, Homo sapiens
cgtctccctaaaataaaaa

SEQ ID NO: 5600399 - DNA, 15 bp, Homo sapiens
cgtctccctggccac

SEQ ID NO: 5600400 - DNA, 15 bp, Homo sapiens
cgtctccctggcccc

SEQ ID NO: 5600401 - DNA, 17 bp, Homo sapiens
cgtctccctggccccag

SEQ ID NO: 5600402 - DNA, 18 bp, Homo sapiens
cgtctccctggtgcctct

SEQ ID NO: 5600403 - DNA, 20 bp, Homo sapiens
cgtctcccttggcccagaga

SEQ ID NO: 5600404 - DNA, 18 bp, Homo sapiens
cgtctccgaagaaaagat

SEQ ID NO: 5600405 - DNA, 12 bp, Homo sapiens
cgtctcctctcc

SEQ ID NO: 5600406 - DNA, 19 bp, Homo sapiens
cgtctcgaagcagtattct

SEQ ID NO: 5600407 - DNA, 13 bp, Homo sapiens
cgtctcggccctg

SEQ ID NO: 5600408 - DNA, 17 bp, Homo sapiens
cgtctcggcccttgccg

SEQ ID NO: 5600409 - DNA, 19 bp, Homo sapiens
cgtctctaatgtctgcagc

SEQ ID NO: 5600410 - DNA, 20 bp, Homo sapiens
cgtctctcccaccccctccc

SEQ ID NO: 5600411 - DNA, 18 bp, Homo sapiens
cgtctctctcccatggag

SEQ ID NO: 5600412 - DNA, 13 bp, Homo sapiens
cgtggatctcctt

SEQ ID NO: 5600413 - DNA, 17 bp, Homo sapiens
cgtggatctccttccct

SEQ ID NO: 5600414 - DNA, 13 bp, Homo sapiens
cgtggattaaact

SEQ ID NO: 5600415 - DNA, 14 bp, Homo sapiens
cgtggcacagctgg

SEQ ID NO: 5600416 - DNA, 20 bp, Homo sapiens
cgtggcacagctgggagcct

SEQ ID NO: 5600417 - DNA, 22 bp, Homo sapiens
cgtggcacagctgggagcctgg

SEQ ID NO: 5600418 - DNA, 18 bp, Homo sapiens
cgtggcacgtattgctgt

SEQ ID NO: 5600419 - DNA, 15 bp, Homo sapiens
cgtggcactagaatg

SEQ ID NO: 5600420 - DNA, 20 bp, Homo sapiens
cgtggcagcttgctgggctt

SEQ ID NO: 5600421 - DNA, 23 bp, Homo sapiens
cgtggcatagcccagacacagaa

SEQ ID NO: 5600422 - DNA, 13 bp, Homo sapiens
cgtggcatcacct

SEQ ID NO: 5600423 - DNA, 20 bp, Homo sapiens
cgtggcatgtggcctgtggc

SEQ ID NO: 5600424 - DNA, 20 bp, Homo sapiens
cgtggcatgttttgatttgt

SEQ ID NO: 5600425 - DNA, 19 bp, Homo sapiens
cgtggccaacgtggacctg

SEQ ID NO: 5600426 - DNA, 22 bp, Homo sapiens
cgtggccaacgtggacctgcct

SEQ ID NO: 5600427 - DNA, 22 bp, Homo sapiens
cgtggccacgggggcagtgtga

SEQ ID NO: 5600428 - DNA, 19 bp, Homo sapiens
cgtggccagcccggctggt

SEQ ID NO: 5600429 - DNA, 14 bp, Homo sapiens
cgtggcccaaggct

SEQ ID NO: 5600430 - DNA, 13 bp, Homo sapiens
cgtggccccagcc

SEQ ID NO: 5600431 - DNA, 14 bp, Homo sapiens
cgtggccccagcct

SEQ ID NO: 5600432 - DNA, 16 bp, Homo sapiens
cgtggccccagcctgg

SEQ ID NO: 5600433 - DNA, 18 bp, Homo sapiens
cgtggccccagcctggcc

SEQ ID NO: 5600434 - DNA, 21 bp, Homo sapiens
cgtggccccagcctggcccag

SEQ ID NO: 5600435 - DNA, 23 bp, Homo sapiens
cgtggccccagcctggcccagct

SEQ ID NO: 5600436 - DNA, 19 bp, Homo sapiens
cgtggccccgccctcaggc

SEQ ID NO: 5600437 - DNA, 16 bp, Homo sapiens
cgtggcccgtggcctg

SEQ ID NO: 5600438 - DNA, 17 bp, Homo sapiens
cgtggcccgtggcctgg

SEQ ID NO: 5600439 - DNA, 15 bp, Homo sapiens
cgtggcccttcctgg

SEQ ID NO: 5600440 - DNA, 22 bp, Homo sapiens
cgtggcccttcctggacagctg

SEQ ID NO: 5600441 - DNA, 14 bp, Homo sapiens
cgtggccgctgccc

SEQ ID NO: 5600442 - DNA, 21 bp, Homo sapiens
cgtggccgctgcccacgtccc

SEQ ID NO: 5600443 - DNA, 15 bp, Homo sapiens
cgtggccggggtcca

SEQ ID NO: 5600444 - DNA, 22 bp, Homo sapiens
cgtggcctccccatgggcacag

SEQ ID NO: 5600445 - DNA, 19 bp, Homo sapiens
cgtggcctcgtgaggggca

SEQ ID NO: 5600446 - DNA, 17 bp, Homo sapiens
cgtggcctcgtgctccg

SEQ ID NO: 5600447 - DNA, 12 bp, Homo sapiens
cgtggcctctct

SEQ ID NO: 5600448 - DNA, 16 bp, Homo sapiens
cgtggcctcttgagca

SEQ ID NO: 5600449 - DNA, 20 bp, Homo sapiens
cgtggcctgcataggctcct

SEQ ID NO: 5600450 - DNA, 16 bp, Homo sapiens
cgtggcctggcatctg

SEQ ID NO: 5600451 - DNA, 17 bp, Homo sapiens
cgtggcctggcatctgt

SEQ ID NO: 5600452 - DNA, 20 bp, Homo sapiens
cgtggccttgttctgtcacc

SEQ ID NO: 5600453 - DNA, 19 bp, Homo sapiens
cgtggcgggaatgagctgt

SEQ ID NO: 5600454 - DNA, 14 bp, Homo sapiens
cgtggcgtggcccg

SEQ ID NO: 5600455 - DNA, 15 bp, Homo sapiens
cgtggcgtggcccgt

SEQ ID NO: 5600456 - DNA, 15 bp, Homo sapiens
cgtggctcagccagc

SEQ ID NO: 5600457 - DNA, 20 bp, Homo sapiens
cgtggctccaccttgatggg

SEQ ID NO: 5600458 - DNA, 20 bp, Homo sapiens
cgtggctcccagcagaggcc

SEQ ID NO: 5600459 - DNA, 15 bp, Homo sapiens
cgtggctctgctggc

SEQ ID NO: 5600460 - DNA, 12 bp, Homo sapiens
cgtggctctggg

SEQ ID NO: 5600461 - DNA, 13 bp, Homo sapiens
cgtggctctggga

SEQ ID NO: 5600462 - DNA, 14 bp, Homo sapiens
cgtggctctgggag

SEQ ID NO: 5600463 - DNA, 17 bp, Homo sapiens
cgtggctctgggtgagg

SEQ ID NO: 5600464 - DNA, 13 bp, Homo sapiens
cgtggctgcaaaa

SEQ ID NO: 5600465 - DNA, 19 bp, Homo sapiens
cgtggctgcggcacccttg

SEQ ID NO: 5600466 - DNA, 17 bp, Homo sapiens
cgtggctgcttcaagga

SEQ ID NO: 5600467 - DNA, 23 bp, Homo sapiens
cgtggctgtgctctcaccagctg

SEQ ID NO: 5600468 - DNA, 16 bp, Homo sapiens
cgtggcttccctgtcc

SEQ ID NO: 5600469 - DNA, 18 bp, Homo sapiens
cgtggcttccctgtccca

SEQ ID NO: 5600470 - DNA, 14 bp, Homo sapiens
cgtggcttctgatg

SEQ ID NO: 5600471 - DNA, 17 bp, Homo sapiens
cgtggcttggcatctgt

SEQ ID NO: 5600472 - DNA, 18 bp, Homo sapiens
cgtggcttgggctggtca

SEQ ID NO: 5600473 - DNA, 15 bp, Homo sapiens
cgtgggacccaggct

SEQ ID NO: 5600474 - DNA, 20 bp, Homo sapiens
cgtgggacccaggctcccag

SEQ ID NO: 5600475 - DNA, 18 bp, Homo sapiens
cgtgggaccctcagcagc

SEQ ID NO: 5600476 - DNA, 19 bp, Homo sapiens
cgtgggaccctcagcagct

SEQ ID NO: 5600477 - DNA, 21 bp, Homo sapiens
cgtgggaccctcagcagctct

SEQ ID NO: 5600478 - DNA, 19 bp, Homo sapiens
cgtgggacggtgcccaagc

SEQ ID NO: 5600479 - DNA, 15 bp, Homo sapiens
cgtgggagaggagag

SEQ ID NO: 5600480 - DNA, 16 bp, Homo sapiens
cgtgggagaggcagaa

SEQ ID NO: 5600481 - DNA, 21 bp, Homo sapiens
cgtgggatccagagagaagca

SEQ ID NO: 5600482 - DNA, 16 bp, Homo sapiens
cgtgggattcagagaa

SEQ ID NO: 5600483 - DNA, 13 bp, Homo sapiens
cgtgggcagagga

SEQ ID NO: 5600484 - DNA, 14 bp, Homo sapiens
cgtgggcagaggaa

SEQ ID NO: 5600485 - DNA, 17 bp, Homo sapiens
cgtgggcagtgccaccc

SEQ ID NO: 5600486 - DNA, 21 bp, Homo sapiens
cgtgggcatatctggggagcc

SEQ ID NO: 5600487 - DNA, 23 bp, Homo sapiens
cgtgggccagtccccgaggagct

SEQ ID NO: 5600488 - DNA, 13 bp, Homo sapiens
cgtgggccatggc

SEQ ID NO: 5600489 - DNA, 20 bp, Homo sapiens
cgtgggccctcaagctttcc

SEQ ID NO: 5600490 - DNA, 14 bp, Homo sapiens
cgtgggccctgcag

SEQ ID NO: 5600491 - DNA, 15 bp, Homo sapiens
cgtgggccctgcagg

SEQ ID NO: 5600492 - DNA, 22 bp, Homo sapiens
cgtgggcgcaaaggtgcctcat

SEQ ID NO: 5600493 - DNA, 16 bp, Homo sapiens
cgtgggctcccctctt

SEQ ID NO: 5600494 - DNA, 13 bp, Homo sapiens
cgtgggctccctg

SEQ ID NO: 5600495 - DNA, 17 bp, Homo sapiens
cgtgggctctgccaatg

SEQ ID NO: 5600496 - DNA, 16 bp, Homo sapiens
cgtgggctctggctcc

SEQ ID NO: 5600497 - DNA, 17 bp, Homo sapiens
cgtgggctctggctccc

SEQ ID NO: 5600498 - DNA, 20 bp, Homo sapiens
cgtgggctctggctccctgg

SEQ ID NO: 5600499 - DNA, 19 bp, Homo sapiens
cgtgggctgaccaggcttc

SEQ ID NO: 5600500 - DNA, 22 bp, Homo sapiens
cgtgggctgggcccacaaaggc

SEQ ID NO: 5600501 - DNA, 18 bp, Homo sapiens
cgtgggcttgtgctcggg

SEQ ID NO: 5600502 - DNA, 12 bp, Homo sapiens
cgtggggaaggg

SEQ ID NO: 5600503 - DNA, 23 bp, Homo sapiens
cgtggggaatgggcaggtggcct

SEQ ID NO: 5600504 - DNA, 17 bp, Homo sapiens
cgtggggaggggctgag

SEQ ID NO: 5600505 - DNA, 20 bp, Homo sapiens
cgtggggaggggctgaggat

SEQ ID NO: 5600506 - DNA, 18 bp, Homo sapiens
cgtggggcagcacagaga

SEQ ID NO: 5600507 - DNA, 15 bp, Homo sapiens
cgtggggcagcagct

SEQ ID NO: 5600508 - DNA, 16 bp, Homo sapiens
cgtggggcagggagct

SEQ ID NO: 5600509 - DNA, 21 bp, Homo sapiens
cgtggggccccggctcccacc

SEQ ID NO: 5600510 - DNA, 19 bp, Homo sapiens
cgtggggctaacgggcgcc

SEQ ID NO: 5600511 - DNA, 16 bp, Homo sapiens
cgtggggggagctctg

SEQ ID NO: 5600512 - DNA, 23 bp, Homo sapiens
cgtgggggtggccactcctgggc

SEQ ID NO: 5600513 - DNA, 15 bp, Homo sapiens
cgtggggtgctgccc

SEQ ID NO: 5600514 - DNA, 17 bp, Homo sapiens
cgtggggtgtgctggga

SEQ ID NO: 5600515 - DNA, 17 bp, Homo sapiens
cgtgggtgccctctcca

SEQ ID NO: 5600516 - DNA, 22 bp, Homo sapiens
cgtgggtgggcctggccctgct

SEQ ID NO: 5600517 - DNA, 23 bp, Homo sapiens
cgtgggtgtgtgtagccaaggtc

SEQ ID NO: 5600518 - DNA, 19 bp, Homo sapiens
cgtgggttgctaactgaac

SEQ ID NO: 5600519 - DNA, 17 bp, Homo sapiens
cgtggtagaagccagta

SEQ ID NO: 5600520 - DNA, 16 bp, Homo sapiens
cgtggtatgtctgcca

SEQ ID NO: 5600521 - DNA, 20 bp, Homo sapiens
cgtggtcactgtgcactgcc

SEQ ID NO: 5600522 - DNA, 14 bp, Homo sapiens
cgtggtcccgagga

SEQ ID NO: 5600523 - DNA, 14 bp, Homo sapiens
cgtggtctttgaat

SEQ ID NO: 5600524 - DNA, 16 bp, Homo sapiens
cgtggtctttgaataa

SEQ ID NO: 5600525 - DNA, 18 bp, Homo sapiens
cgtggtctttgaataaag

SEQ ID NO: 5600526 - DNA, 21 bp, Homo sapiens
cgtggtctttgaataaagtct

SEQ ID NO: 5600527 - DNA, 22 bp, Homo sapiens
cgtggtctttgaataaagtctg

SEQ ID NO: 5600528 - DNA, 23 bp, Homo sapiens
cgtggtctttgaataaagtctga

SEQ ID NO: 5600529 - DNA, 12 bp, Homo sapiens
cgtggtgaggct

SEQ ID NO: 5600530 - DNA, 14 bp, Homo sapiens
cgtggtgaggctga

SEQ ID NO: 5600531 - DNA, 23 bp, Homo sapiens
cgtggtgaggttgtgctgcctgt

SEQ ID NO: 5600532 - DNA, 21 bp, Homo sapiens
cgtggtgatcaattaaatgta

SEQ ID NO: 5600533 - DNA, 12 bp, Homo sapiens
cgtggtgcctgc

SEQ ID NO: 5600534 - DNA, 15 bp, Homo sapiens
cgtggtgcctgcaca

SEQ ID NO: 5600535 - DNA, 14 bp, Homo sapiens
cgtggtggcaggca

SEQ ID NO: 5600536 - DNA, 18 bp, Homo sapiens
cgtggtggcggcggcact

SEQ ID NO: 5600537 - DNA, 21 bp, Homo sapiens
cgtggtggcggtggctgcccc

SEQ ID NO: 5600538 - DNA, 20 bp, Homo sapiens
cgtggtggctcacacctgca

SEQ ID NO: 5600539 - DNA, 21 bp, Homo sapiens
cgtggtgggatttgctcctgg

SEQ ID NO: 5600540 - DNA, 22 bp, Homo sapiens
cgtggtgggggaggagcctctg

SEQ ID NO: 5600541 - DNA, 13 bp, Homo sapiens
cgtggtggtccct

SEQ ID NO: 5600542 - DNA, 15 bp, Homo sapiens
cgtggtggtccctgg

SEQ ID NO: 5600543 - DNA, 15 bp, Homo sapiens
cgtggtgtgaggccc

SEQ ID NO: 5600544 - DNA, 16 bp, Homo sapiens
cgtggtgtgaggcccc

SEQ ID NO: 5600545 - DNA, 15 bp, Homo sapiens
cgtggtgtggcccgt

SEQ ID NO: 5600546 - DNA, 18 bp, Homo sapiens
cgtggtgttatttaaaga

SEQ ID NO: 5600547 - DNA, 13 bp, Homo sapiens
cgtggttcagaga

SEQ ID NO: 5600548 - DNA, 21 bp, Homo sapiens
cgtggttcagagactggcagc

SEQ ID NO: 5600549 - DNA, 14 bp, Homo sapiens
cgtggttccaagaa

SEQ ID NO: 5600550 - DNA, 12 bp, Homo sapiens
cgtgtaaaccaa

SEQ ID NO: 5600551 - DNA, 20 bp, Homo sapiens
cgtgtaaatatgtacatttc

SEQ ID NO: 5600552 - DNA, 14 bp, Homo sapiens
cgtgtaacttgtgc

SEQ ID NO: 5600553 - DNA, 14 bp, Homo sapiens
cgtgtacagcacag

SEQ ID NO: 5600554 - DNA, 16 bp, Homo sapiens
cgtgtacagcacagaa

SEQ ID NO: 5600555 - DNA, 20 bp, Homo sapiens
cgtgtaccacctaatgttta

SEQ ID NO: 5600556 - DNA, 14 bp, Homo sapiens
cgtgtagcgtcctg

SEQ ID NO: 5600557 - DNA, 17 bp, Homo sapiens
cgtgtaggagtgagaag

SEQ ID NO: 5600558 - DNA, 20 bp, Homo sapiens
cgtgtagtggaagagcagcc

SEQ ID NO: 5600559 - DNA, 22 bp, Homo sapiens
cgtgtagtggaagagcagcctg

SEQ ID NO: 5600560 - DNA, 19 bp, Homo sapiens
cgtgtagtgtccattttgt

SEQ ID NO: 5600561 - DNA, 19 bp, Homo sapiens
cgtgtatatgaggatgtat

SEQ ID NO: 5600562 - DNA, 22 bp, Homo sapiens
cgtgtatatgaggatgtatgtg

SEQ ID NO: 5600563 - DNA, 15 bp, Homo sapiens
cgtgtatatgtgctt

SEQ ID NO: 5600564 - DNA, 16 bp, Homo sapiens
cgtgtatcctggggct

SEQ ID NO: 5600565 - DNA, 14 bp, Homo sapiens
cgtgtatgtttctt

SEQ ID NO: 5600566 - DNA, 17 bp, Homo sapiens
cgtgtattgagatttct

SEQ ID NO: 5600567 - DNA, 18 bp, Homo sapiens
cgtgtatttggctgggct

SEQ ID NO: 5600568 - DNA, 16 bp, Homo sapiens
cgtgtcatgagagaat

SEQ ID NO: 5600569 - DNA, 13 bp, Homo sapiens
cgtgtccaccccc

SEQ ID NO: 5600570 - DNA, 16 bp, Homo sapiens
cgtgtccagcacagaa

SEQ ID NO: 5600571 - DNA, 16 bp, Homo sapiens
cgtgtccccggcctca

SEQ ID NO: 5600572 - DNA, 16 bp, Homo sapiens
cgtgtcccctgacagg

SEQ ID NO: 5600573 - DNA, 18 bp, Homo sapiens
cgtgtcccctgacagggc

SEQ ID NO: 5600574 - DNA, 18 bp, Homo sapiens
cgtgtccctcctcttcct

SEQ ID NO: 5600575 - DNA, 16 bp, Homo sapiens
cgtgtccgtccaccct

SEQ ID NO: 5600576 - DNA, 16 bp, Homo sapiens
cgtgtccgtctgtctg

SEQ ID NO: 5600577 - DNA, 17 bp, Homo sapiens
cgtgtcctacagcctca

SEQ ID NO: 5600578 - DNA, 14 bp, Homo sapiens
cgtgtcctgccttg

SEQ ID NO: 5600579 - DNA, 15 bp, Homo sapiens
cgtgtcgtgggtgtg

SEQ ID NO: 5600580 - DNA, 16 bp, Homo sapiens
cgtgtctcagcctctg

SEQ ID NO: 5600581 - DNA, 18 bp, Homo sapiens
cgtgtctcatttgccagg

SEQ ID NO: 5600582 - DNA, 14 bp, Homo sapiens
cgtgtctctgagga

SEQ ID NO: 5600583 - DNA, 19 bp, Homo sapiens
cgtgtctgggtatctttgt

SEQ ID NO: 5600584 - DNA, 22 bp, Homo sapiens
cgtgtctgtatttatgtgtgag

SEQ ID NO: 5600585 - DNA, 17 bp, Homo sapiens
cgtgtctgtggccctct

SEQ ID NO: 5600586 - DNA, 20 bp, Homo sapiens
cgtgtcttaggctgatgcca

SEQ ID NO: 5600587 - DNA, 13 bp, Homo sapiens
cgtgtcttccact

SEQ ID NO: 5600588 - DNA, 17 bp, Homo sapiens
cgtgtcttgtgttgctg

SEQ ID NO: 5600589 - DNA, 14 bp, Homo sapiens
cgtgtgaaatctgt

SEQ ID NO: 5600590 - DNA, 14 bp, Homo sapiens
ctaaatgctggtct

SEQ ID NO: 5600591 - DNA, 17 bp, Homo sapiens
ctaaatggcaacaaaca

SEQ ID NO: 5600592 - DNA, 20 bp, Homo sapiens
ctaaatggcaacaaacacat

SEQ ID NO: 5600593 - DNA, 23 bp, Homo sapiens
ctaaatggcagtgagatgtcaga

SEQ ID NO: 5600594 - DNA, 13 bp, Homo sapiens
ctaaatggcctca

SEQ ID NO: 5600595 - DNA, 19 bp, Homo sapiens
ctaaatggcctctctccac

SEQ ID NO: 5600596 - DNA, 21 bp, Homo sapiens
ctaaatggcctctctccacta

SEQ ID NO: 5600597 - DNA, 21 bp, Homo sapiens
ctaaatggtcgcccaggagac

SEQ ID NO: 5600598 - DNA, 22 bp, Homo sapiens
ctaaatgtagttctgctccaga

SEQ ID NO: 5600599 - DNA, 21 bp, Homo sapiens
ctaaatgtatatgttgattta

SEQ ID NO: 5600600 - DNA, 21 bp, Homo sapiens
ctaaatgtgcaatagaaggtg

SEQ ID NO: 5600601 - DNA, 15 bp, Homo sapiens
ctaaatgtgtaataa

SEQ ID NO: 5600602 - DNA, 23 bp, Homo sapiens
ctaaatgtgtaataatgtaacat

SEQ ID NO: 5600603 - DNA, 13 bp, Homo sapiens
ctaaatgtgtaca

SEQ ID NO: 5600604 - DNA, 17 bp, Homo sapiens
ctaaatgttaaagatgt

SEQ ID NO: 5600605 - DNA, 12 bp, Homo sapiens
ctaaatgttcat

SEQ ID NO: 5600606 - DNA, 14 bp, Homo sapiens
ctaaatgttcatgt

SEQ ID NO: 5600607 - DNA, 21 bp, Homo sapiens
ctaaatgtttggcatgtaaat

SEQ ID NO: 5600608 - DNA, 13 bp, Homo sapiens
ctaaattaacttc

SEQ ID NO: 5600609 - DNA, 18 bp, Homo sapiens
ctaaattaacttctattt

SEQ ID NO: 5600610 - DNA, 23 bp, Homo sapiens
ctaaattaatactcctcctttta

SEQ ID NO: 5600611 - DNA, 17 bp, Homo sapiens
ctaaattagtttaaaat

SEQ ID NO: 5600612 - DNA, 17 bp, Homo sapiens
ctaaattataaaattga

SEQ ID NO: 5600613 - DNA, 19 bp, Homo sapiens
ctaaattataaaattgaaa

SEQ ID NO: 5600614 - DNA, 22 bp, Homo sapiens
ctaaattataaaattgaaaaca

SEQ ID NO: 5600615 - DNA, 21 bp, Homo sapiens
ctaaattattagcatttgttt

SEQ ID NO: 5600616 - DNA, 14 bp, Homo sapiens
ctaaattatttact

SEQ ID NO: 5600617 - DNA, 23 bp, Homo sapiens
ctaaattatttactgcaaaaaga

SEQ ID NO: 5600618 - DNA, 14 bp, Homo sapiens
ctaaattccacact

SEQ ID NO: 5600619 - DNA, 19 bp, Homo sapiens
ctaaattctataaaaacca

SEQ ID NO: 5600620 - DNA, 22 bp, Homo sapiens
ctaaattctatgttaaatactg

SEQ ID NO: 5600621 - DNA, 15 bp, Homo sapiens
ctaaattctttattt

SEQ ID NO: 5600622 - DNA, 18 bp, Homo sapiens
ctaaattctttcatgagc

SEQ ID NO: 5600623 - DNA, 12 bp, Homo sapiens
ctaaattgaata

SEQ ID NO: 5600624 - DNA, 13 bp, Homo sapiens
ctaaattgaatac

SEQ ID NO: 5600625 - DNA, 17 bp, Homo sapiens
ctaaattgaatacacaa

SEQ ID NO: 5600626 - DNA, 19 bp, Homo sapiens
ctaaattgacacttaaaaa

SEQ ID NO: 5600627 - DNA, 19 bp, Homo sapiens
ctaaattgatcattcataa

SEQ ID NO: 5600628 - DNA, 16 bp, Homo sapiens
ctaaattgatgttgat

SEQ ID NO: 5600629 - DNA, 16 bp, Homo sapiens
ctaaattgattgaatt

SEQ ID NO: 5600630 - DNA, 21 bp, Homo sapiens
ctaaattgcagtttacagtat

SEQ ID NO: 5600631 - DNA, 22 bp, Homo sapiens
ctaaattgcagtttacagtatt

SEQ ID NO: 5600632 - DNA, 12 bp, Homo sapiens
ctaaattgtata

SEQ ID NO: 5600633 - DNA, 16 bp, Homo sapiens
ctaaattgtctgccat

SEQ ID NO: 5600634 - DNA, 14 bp, Homo sapiens
ctaaatttaaattt

SEQ ID NO: 5600635 - DNA, 19 bp, Homo sapiens
ctaaatttaaatttaaaga

SEQ ID NO: 5600636 - DNA, 15 bp, Homo sapiens
ctaaatttaatgctg

SEQ ID NO: 5600637 - DNA, 16 bp, Homo sapiens
ctaaatttaatgctgc

SEQ ID NO: 5600638 - DNA, 20 bp, Homo sapiens
ctaaatttacgtatatttca

SEQ ID NO: 5600639 - DNA, 15 bp, Homo sapiens
ctaaatttatattca

SEQ ID NO: 5600640 - DNA, 16 bp, Homo sapiens
ctaaatttattaaata

SEQ ID NO: 5600641 - DNA, 17 bp, Homo sapiens
ctaaatttattaaataa

SEQ ID NO: 5600642 - DNA, 12 bp, Homo sapiens
ctaaatttctca

SEQ ID NO: 5600643 - DNA, 13 bp, Homo sapiens
ctaaatttctcag

SEQ ID NO: 5600644 - DNA, 23 bp, Homo sapiens
ctaaatttctcagtttttgctga

SEQ ID NO: 5600645 - DNA, 14 bp, Homo sapiens
ctaaatttgatact

SEQ ID NO: 5600646 - DNA, 16 bp, Homo sapiens
ctaaatttgatactta

SEQ ID NO: 5600647 - DNA, 17 bp, Homo sapiens
ctaaatttgatacttat

SEQ ID NO: 5600648 - DNA, 23 bp, Homo sapiens
ctaaatttgatacttatattttc

SEQ ID NO: 5600649 - DNA, 21 bp, Homo sapiens
ctaaatttggaacttacaaag

SEQ ID NO: 5600650 - DNA, 20 bp, Homo sapiens
ctaaatttggggacagattc

SEQ ID NO: 5600651 - DNA, 23 bp, Homo sapiens
ctaaatttggggacagattcagt

SEQ ID NO: 5600652 - DNA, 15 bp, Homo sapiens
ctaaatttgtctttc

SEQ ID NO: 5600653 - DNA, 16 bp, Homo sapiens
ctaaatttgtctttca

SEQ ID NO: 5600654 - DNA, 19 bp, Homo sapiens
ctaaatttgtctttcaagt

SEQ ID NO: 5600655 - DNA, 21 bp, Homo sapiens
ctaaatttgtctttcaagtga

SEQ ID NO: 5600656 - DNA, 14 bp, Homo sapiens
ctaaattttaaagc

SEQ ID NO: 5600657 - DNA, 17 bp, Homo sapiens
ctaaattttaaagccat

SEQ ID NO: 5600658 - DNA, 15 bp, Homo sapiens
ctaaattttatatct

SEQ ID NO: 5600659 - DNA, 16 bp, Homo sapiens
ctaaattttcctgtcc

SEQ ID NO: 5600660 - DNA, 17 bp, Homo sapiens
ctaaattttcctgtcct

SEQ ID NO: 5600661 - DNA, 15 bp, Homo sapiens
ctaaattttctgaaa

SEQ ID NO: 5600662 - DNA, 15 bp, Homo sapiens
ctaaatttttaactg

SEQ ID NO: 5600663 - DNA, 19 bp, Homo sapiens
ctaaatttttataataatt

SEQ ID NO: 5600664 - DNA, 15 bp, Homo sapiens
ctaaatttttcatag

SEQ ID NO: 5600665 - DNA, 12 bp, Homo sapiens
ctaacaaaagaa

SEQ ID NO: 5600666 - DNA, 13 bp, Homo sapiens
ctaacaaaagaac

SEQ ID NO: 5600667 - DNA, 18 bp, Homo sapiens
ctaacaaaagaactaaga

SEQ ID NO: 5600668 - DNA, 13 bp, Homo sapiens
ctaacaaaagata

SEQ ID NO: 5600669 - DNA, 21 bp, Homo sapiens
ctaacaaaagatatgaagaac

SEQ ID NO: 5600670 - DNA, 21 bp, Homo sapiens
ctaacaaatgtaaaattatga

SEQ ID NO: 5600671 - DNA, 21 bp, Homo sapiens
ctaacaaattttaagtgccac

SEQ ID NO: 5600672 - DNA, 16 bp, Homo sapiens
ctaacaagattaaata

SEQ ID NO: 5600673 - DNA, 18 bp, Homo sapiens
ctaacaagtgtatctcga

SEQ ID NO: 5600674 - DNA, 15 bp, Homo sapiens
ctaacaataatattt

SEQ ID NO: 5600675 - DNA, 21 bp, Homo sapiens
ctaacaataatatttcaagtg

SEQ ID NO: 5600676 - DNA, 22 bp, Homo sapiens
ctaacaataatatttcaagtgc

SEQ ID NO: 5600677 - DNA, 22 bp, Homo sapiens
ctaacaatcagctccttcctgg

SEQ ID NO: 5600678 - DNA, 18 bp, Homo sapiens
ctaacaatgccttgttgt

SEQ ID NO: 5600679 - DNA, 13 bp, Homo sapiens
ctaacaattgtta

SEQ ID NO: 5600680 - DNA, 16 bp, Homo sapiens
ctaacacacagctccc

SEQ ID NO: 5600681 - DNA, 15 bp, Homo sapiens
ctaacacattaaatg

SEQ ID NO: 5600682 - DNA, 12 bp, Homo sapiens
ctaacacatttc

SEQ ID NO: 5600683 - DNA, 17 bp, Homo sapiens
ctaacacatttttaaag

SEQ ID NO: 5600684 - DNA, 21 bp, Homo sapiens
ctaacaccagcgtttgagggg

SEQ ID NO: 5600685 - DNA, 14 bp, Homo sapiens
ctaacacccagtct

SEQ ID NO: 5600686 - DNA, 20 bp, Homo sapiens
ctaacactagcttatttcca

SEQ ID NO: 5600687 - DNA, 19 bp, Homo sapiens
ctaacactagtctgtgtgc

SEQ ID NO: 5600688 - DNA, 16 bp, Homo sapiens
ctaacactcagaagcc

SEQ ID NO: 5600689 - DNA, 19 bp, Homo sapiens
ctaacactcagaagcctgg

SEQ ID NO: 5600690 - DNA, 17 bp, Homo sapiens
ctaacactggcccctag

SEQ ID NO: 5600691 - DNA, 23 bp, Homo sapiens
ctaacacttaccccatggctgca

SEQ ID NO: 5600692 - DNA, 20 bp, Homo sapiens
ctaacacttttgctctgcag

SEQ ID NO: 5600693 - DNA, 17 bp, Homo sapiens
ctaacagataagcaaga

SEQ ID NO: 5600694 - DNA, 17 bp, Homo sapiens
ctaacagatcagaacat

SEQ ID NO: 5600695 - DNA, 18 bp, Homo sapiens
ctaacagatcagaacatg

SEQ ID NO: 5600696 - DNA, 22 bp, Homo sapiens
ctaacagattataataaattgt

SEQ ID NO: 5600697 - DNA, 22 bp, Homo sapiens
ctaacagcaacagcaagaaata

SEQ ID NO: 5600698 - DNA, 23 bp, Homo sapiens
ctaacagcaacagcaagaaataa

SEQ ID NO: 5600699 - DNA, 17 bp, Homo sapiens
ctaacagcacagggaag

SEQ ID NO: 5600700 - DNA, 24 bp, Homo sapiens
ctaacagcatccccaaaacaaagt

SEQ ID NO: 5600701 - DNA, 20 bp, Homo sapiens
ctaacagctacaaactttta

SEQ ID NO: 5600702 - DNA, 21 bp, Homo sapiens
ctaacagctacaaacttttaa

SEQ ID NO: 5600703 - DNA, 14 bp, Homo sapiens
ctaacagctgaagt

SEQ ID NO: 5600704 - DNA, 15 bp, Homo sapiens
ctaacaggggctggt

SEQ ID NO: 5600705 - DNA, 14 bp, Homo sapiens
ctaacagtgaagat

SEQ ID NO: 5600706 - DNA, 15 bp, Homo sapiens
ctaacagtgacttca

SEQ ID NO: 5600707 - DNA, 17 bp, Homo sapiens
ctaacagttcacttgca

SEQ ID NO: 5600708 - DNA, 21 bp, Homo sapiens
ctaacagtttgcctgctgtat

SEQ ID NO: 5600709 - DNA, 22 bp, Homo sapiens
ctaacagtttgcctgctgtatt

SEQ ID NO: 5600710 - DNA, 16 bp, Homo sapiens
ctaacataaaatctgt

SEQ ID NO: 5600711 - DNA, 23 bp, Homo sapiens
ctaacataaaatctgtgaattaa

SEQ ID NO: 5600712 - DNA, 21 bp, Homo sapiens
ctaacataacactaaatgctg

SEQ ID NO: 5600713 - DNA, 23 bp, Homo sapiens
ctaacatataatgttgttattta

SEQ ID NO: 5600714 - DNA, 18 bp, Homo sapiens
ctaacatatgatactgat

SEQ ID NO: 5600715 - DNA, 19 bp, Homo sapiens
ctaacatattcaatgcaag

SEQ ID NO: 5600716 - DNA, 23 bp, Homo sapiens
ctaacatccttggactgagaaat

SEQ ID NO: 5600717 - DNA, 11 bp, Homo sapiens
ctaacatgaaa

SEQ ID NO: 5600718 - DNA, 12 bp, Homo sapiens
ctaacatgaaat

SEQ ID NO: 5600719 - DNA, 15 bp, Homo sapiens
ctaacatgatttggg

SEQ ID NO: 5600720 - DNA, 17 bp, Homo sapiens
ctaacatgtcctgccta

SEQ ID NO: 5600721 - DNA, 17 bp, Homo sapiens
ctaacattactgccttc

SEQ ID NO: 5600722 - DNA, 12 bp, Homo sapiens
ctaacattatat

SEQ ID NO: 5600723 - DNA, 16 bp, Homo sapiens
ctaacattatattgca

SEQ ID NO: 5600724 - DNA, 14 bp, Homo sapiens
ctaacattgtgact

SEQ ID NO: 5600725 - DNA, 22 bp, Homo sapiens
ctaacattgtgactttgctttg

SEQ ID NO: 5600726 - DNA, 18 bp, Homo sapiens
ctaacatttgataatttt

SEQ ID NO: 5600727 - DNA, 18 bp, Homo sapiens
ctaaccaaagagtctctg

SEQ ID NO: 5600728 - DNA, 19 bp, Homo sapiens
ctaaccaaagagtctctgg

SEQ ID NO: 5600729 - DNA, 22 bp, Homo sapiens
ctaaccaaatctctcaaatctg

SEQ ID NO: 5600730 - DNA, 13 bp, Homo sapiens
ctaaccaaatgca

SEQ ID NO: 5600731 - DNA, 20 bp, Homo sapiens
ctaaccaagctgagtttcct

SEQ ID NO: 5600732 - DNA, 10 bp, Homo sapiens
ctaaccaagt

SEQ ID NO: 5600733 - DNA, 17 bp, Homo sapiens
ctaaccacgctggacct

SEQ ID NO: 5600734 - DNA, 10 bp, Homo sapiens
ctaaccacta

SEQ ID NO: 5600735 - DNA, 23 bp, Homo sapiens
ctaaccacttcgcacacacccat

SEQ ID NO: 5600736 - DNA, 18 bp, Homo sapiens
ctaaccagagcaagcttt

SEQ ID NO: 5600737 - DNA, 18 bp, Homo sapiens
ctaaccagatggaacact

SEQ ID NO: 5600738 - DNA, 17 bp, Homo sapiens
ctaaccagcagaaatgc

SEQ ID NO: 5600739 - DNA, 16 bp, Homo sapiens
ctaaccagcattccct

SEQ ID NO: 5600740 - DNA, 21 bp, Homo sapiens
ctaaccagggaagctgtccct

SEQ ID NO: 5600741 - DNA, 19 bp, Homo sapiens
ctaaccagttctctttgta

SEQ ID NO: 5600742 - DNA, 14 bp, Homo sapiens
ctaaccatccccaa

SEQ ID NO: 5600743 - DNA, 22 bp, Homo sapiens
ctaaccatgggctcagggccag

SEQ ID NO: 5600744 - DNA, 18 bp, Homo sapiens
ctaaccatgtgttatgtt

SEQ ID NO: 5600745 - DNA, 13 bp, Homo sapiens
ctaaccattcaaa

SEQ ID NO: 5600746 - DNA, 14 bp, Homo sapiens
ctaaccatttctta

SEQ ID NO: 5600747 - DNA, 16 bp, Homo sapiens
ctaacccaatgcctgt

SEQ ID NO: 5600748 - DNA, 16 bp, Homo sapiens
ctaacccatgggtcca

SEQ ID NO: 5600749 - DNA, 15 bp, Homo sapiens
ctaaccccaggcccc

SEQ ID NO: 5600750 - DNA, 21 bp, Homo sapiens
ctaaccccagggcactgccag

SEQ ID NO: 5600751 - DNA, 19 bp, Homo sapiens
ctaacccccagcccacaga

SEQ ID NO: 5600752 - DNA, 19 bp, Homo sapiens
ctaacccccagtgccacag

SEQ ID NO: 5600753 - DNA, 16 bp, Homo sapiens
ctaaccccgggcgggt

SEQ ID NO: 5600754 - DNA, 19 bp, Homo sapiens
ctaaccccgtctgctcctc

SEQ ID NO: 5600755 - DNA, 17 bp, Homo sapiens
ctaaccccttacccatc

SEQ ID NO: 5600756 - DNA, 22 bp, Homo sapiens
ctaaccccttacccatctctct

SEQ ID NO: 5600757 - DNA, 19 bp, Homo sapiens
ctaaccctacatgcatgtt

SEQ ID NO: 5600758 - DNA, 23 bp, Homo sapiens
ctaaccctatactgtagtattct

SEQ ID NO: 5600759 - DNA, 20 bp, Homo sapiens
ctaaccctcccatggcacct

SEQ ID NO: 5600760 - DNA, 15 bp, Homo sapiens
ctaaccctctgtcac

SEQ ID NO: 5600761 - DNA, 19 bp, Homo sapiens
ctaaccctgggctccctgg

SEQ ID NO: 5600762 - DNA, 17 bp, Homo sapiens
ctaacccttaaaaatgc

SEQ ID NO: 5600763 - DNA, 18 bp, Homo sapiens
ctaacctacgaccccaga

SEQ ID NO: 5600764 - DNA, 14 bp, Homo sapiens
ctaacctcactgcc

SEQ ID NO: 5600765 - DNA, 16 bp, Homo sapiens
ctaacctcactgcctc

SEQ ID NO: 5600766 - DNA, 18 bp, Homo sapiens
ctaacctccaacacagtg

SEQ ID NO: 5600767 - DNA, 20 bp, Homo sapiens
ctaaggcgtggagctgcctg

SEQ ID NO: 5600768 - DNA, 21 bp, Homo sapiens
ctaaggcgtggagctgcctga

SEQ ID NO: 5600769 - DNA, 14 bp, Homo sapiens
ctaaggctccccac

SEQ ID NO: 5600770 - DNA, 21 bp, Homo sapiens
ctaaggctcgagttaaaacaa

SEQ ID NO: 5600771 - DNA, 15 bp, Homo sapiens
ctaaggctctgagag

SEQ ID NO: 5600772 - DNA, 23 bp, Homo sapiens
ctaaggctctgagagtctagatt

SEQ ID NO: 5600773 - DNA, 14 bp, Homo sapiens
ctaaggctgaactt

SEQ ID NO: 5600774 - DNA, 13 bp, Homo sapiens
ctaaggctgctgg

SEQ ID NO: 5600775 - DNA, 16 bp, Homo sapiens
ctaaggctgctggctt

SEQ ID NO: 5600776 - DNA, 23 bp, Homo sapiens
ctaaggctgctggcttcagggag

SEQ ID NO: 5600777 - DNA, 22 bp, Homo sapiens
ctaaggctgcttcaaagattat

SEQ ID NO: 5600778 - DNA, 17 bp, Homo sapiens
ctaagggaagacatttc

SEQ ID NO: 5600779 - DNA, 18 bp, Homo sapiens
ctaagggaagacatttct

SEQ ID NO: 5600780 - DNA, 20 bp, Homo sapiens
ctaagggaagatcactgtag

SEQ ID NO: 5600781 - DNA, 16 bp, Homo sapiens
ctaagggagacaggcc

SEQ ID NO: 5600782 - DNA, 18 bp, Homo sapiens
ctaagggagacaggcctt

SEQ ID NO: 5600783 - DNA, 19 bp, Homo sapiens
ctaagggagacaggccttt

SEQ ID NO: 5600784 - DNA, 23 bp, Homo sapiens
ctaagggagacaggcctttccct

SEQ ID NO: 5600785 - DNA, 23 bp, Homo sapiens
ctaagggagagtggtatttgcag

SEQ ID NO: 5600786 - DNA, 19 bp, Homo sapiens
ctaagggaggcacttcctc

SEQ ID NO: 5600787 - DNA, 14 bp, Homo sapiens
ctaagggatccaga

SEQ ID NO: 5600788 - DNA, 15 bp, Homo sapiens
ctaagggatccagag

SEQ ID NO: 5600789 - DNA, 16 bp, Homo sapiens
ctaagggatccagaga

SEQ ID NO: 5600790 - DNA, 20 bp, Homo sapiens
ctaagggatccagagacctg

SEQ ID NO: 5600791 - DNA, 15 bp, Homo sapiens
ctaagggcagccctc

SEQ ID NO: 5600792 - DNA, 16 bp, Homo sapiens
ctaagggcagccctcc

SEQ ID NO: 5600793 - DNA, 16 bp, Homo sapiens
ctaaggggcagctcct

SEQ ID NO: 5600794 - DNA, 17 bp, Homo sapiens
ctaaggggcagctcctg

SEQ ID NO: 5600795 - DNA, 18 bp, Homo sapiens
ctaaggggcagctcctga

SEQ ID NO: 5600796 - DNA, 21 bp, Homo sapiens
ctaaggggcagctcctgacca

SEQ ID NO: 5600797 - DNA, 17 bp, Homo sapiens
ctaagggtcgaaagctc

SEQ ID NO: 5600798 - DNA, 14 bp, Homo sapiens
ctaagggtggagag

SEQ ID NO: 5600799 - DNA, 14 bp, Homo sapiens
ctaagggtgggtgc

SEQ ID NO: 5600800 - DNA, 14 bp, Homo sapiens
ctaagggtgtcaag

SEQ ID NO: 5600801 - DNA, 15 bp, Homo sapiens
ctaaggtaatcctat

SEQ ID NO: 5600802 - DNA, 16 bp, Homo sapiens
ctaaggtactgtgggg

SEQ ID NO: 5600803 - DNA, 21 bp, Homo sapiens
ctaaggtcagtgttataaaat

SEQ ID NO: 5600804 - DNA, 22 bp, Homo sapiens
ctaaggtccctgggggtgcaga

SEQ ID NO: 5600805 - DNA, 20 bp, Homo sapiens
ctaaggtccggtgttctaag

SEQ ID NO: 5600806 - DNA, 12 bp, Homo sapiens
ctaaggtcctaa

SEQ ID NO: 5600807 - DNA, 13 bp, Homo sapiens
ctaaggtcctaag

SEQ ID NO: 5600808 - DNA, 14 bp, Homo sapiens
ctaaggtctcatgc

SEQ ID NO: 5600809 - DNA, 21 bp, Homo sapiens
ctaaggtcttggaacttgcct

SEQ ID NO: 5600810 - DNA, 23 bp, Homo sapiens
ctaaggtcttggaacttgcctgc

SEQ ID NO: 5600811 - DNA, 17 bp, Homo sapiens
ctaaggtgactttctga

SEQ ID NO: 5600812 - DNA, 22 bp, Homo sapiens
ctaaggtggacagcagacaaga

SEQ ID NO: 5600813 - DNA, 17 bp, Homo sapiens
ctaaggtggattttcat

SEQ ID NO: 5600814 - DNA, 16 bp, Homo sapiens
ctaaggtgtgctctga

SEQ ID NO: 5600815 - DNA, 12 bp, Homo sapiens
ctaaggttctaa

SEQ ID NO: 5600816 - DNA, 13 bp, Homo sapiens
ctaaggttctaag

SEQ ID NO: 5600817 - DNA, 14 bp, Homo sapiens
ctaaggttctaagg

SEQ ID NO: 5600818 - DNA, 22 bp, Homo sapiens
ctaaggttgtctacgggggcac

SEQ ID NO: 5600819 - DNA, 19 bp, Homo sapiens
ctaaggttttgttgtgttc

SEQ ID NO: 5600820 - DNA, 18 bp, Homo sapiens
ctaagtaaaaccacagca

SEQ ID NO: 5600821 - DNA, 22 bp, Homo sapiens
ctaagtaaaaccacagcagttg

SEQ ID NO: 5600822 - DNA, 14 bp, Homo sapiens
ctaagtaaatacaa

SEQ ID NO: 5600823 - DNA, 15 bp, Homo sapiens
ctaagtaaatacaat

SEQ ID NO: 5600824 - DNA, 19 bp, Homo sapiens
ctaagtaaatacaattttt

SEQ ID NO: 5600825 - DNA, 17 bp, Homo sapiens
ctaagtaaataggaatt

SEQ ID NO: 5600826 - DNA, 17 bp, Homo sapiens
ctaagtaaatctaaatt

SEQ ID NO: 5600827 - DNA, 18 bp, Homo sapiens
ctaagtaaatctcttctg

SEQ ID NO: 5600828 - DNA, 14 bp, Homo sapiens
ctaagtaacctcta

SEQ ID NO: 5600829 - DNA, 22 bp, Homo sapiens
ctaagtaacctctacaggcatt

SEQ ID NO: 5600830 - DNA, 20 bp, Homo sapiens
ctaagtaagaacactgagat

SEQ ID NO: 5600831 - DNA, 18 bp, Homo sapiens
ctaagtaagtttcttcct

SEQ ID NO: 5600832 - DNA, 23 bp, Homo sapiens
ctaagtaatctcacagcatttgc

SEQ ID NO: 5600833 - DNA, 23 bp, Homo sapiens
ctaagtacctttcctacattttc

SEQ ID NO: 5600834 - DNA, 14 bp, Homo sapiens
ctaagtacttaaaa

SEQ ID NO: 5600835 - DNA, 22 bp, Homo sapiens
ctaagtagaataaagaaaaacg

SEQ ID NO: 5600836 - DNA, 23 bp, Homo sapiens
ctaagtatattatatggcaggag

SEQ ID NO: 5600837 - DNA, 11 bp, Homo sapiens
ctaagtattaa

SEQ ID NO: 5600838 - DNA, 18 bp, Homo sapiens
ctaagtattaaaacattg

SEQ ID NO: 5600839 - DNA, 11 bp, Homo sapiens
ctaagtattta

SEQ ID NO: 5600840 - DNA, 16 bp, Homo sapiens
ctaagtatttaaatgt

SEQ ID NO: 5600841 - DNA, 19 bp, Homo sapiens
ctaagtatttaaatgttct

SEQ ID NO: 5600842 - DNA, 14 bp, Homo sapiens
ctaagtatttccca

SEQ ID NO: 5600843 - DNA, 17 bp, Homo sapiens
ctaagtatttcccagca

SEQ ID NO: 5600844 - DNA, 15 bp, Homo sapiens
ctaagtcaaaacttg

SEQ ID NO: 5600845 - DNA, 17 bp, Homo sapiens
ctaagtcaggtaatata

SEQ ID NO: 5600846 - DNA, 15 bp, Homo sapiens
ctaagtcagtaccca

SEQ ID NO: 5600847 - DNA, 22 bp, Homo sapiens
ctaagtcagtttcacatatttg

SEQ ID NO: 5600848 - DNA, 14 bp, Homo sapiens
ctaagtcatggtcc

SEQ ID NO: 5600849 - DNA, 19 bp, Homo sapiens
ctaagtcatggtcctggct

SEQ ID NO: 5600850 - DNA, 15 bp, Homo sapiens
ctaagtcatgtatgt

SEQ ID NO: 5600851 - DNA, 18 bp, Homo sapiens
ctaagtcatgtatgtttc

SEQ ID NO: 5600852 - DNA, 18 bp, Homo sapiens
ctaagtccaactactaaa

SEQ ID NO: 5600853 - DNA, 14 bp, Homo sapiens
ctaagtccagctct

SEQ ID NO: 5600854 - DNA, 21 bp, Homo sapiens
ctaagtccagtccagtcctat

SEQ ID NO: 5600855 - DNA, 16 bp, Homo sapiens
ctaagtcccttcctat

SEQ ID NO: 5600856 - DNA, 17 bp, Homo sapiens
ctaagtcccttcctatt

SEQ ID NO: 5600857 - DNA, 23 bp, Homo sapiens
ctaagtcgttgagggaatgacac

SEQ ID NO: 5600858 - DNA, 12 bp, Homo sapiens
ctaagtctctgt

SEQ ID NO: 5600859 - DNA, 18 bp, Homo sapiens
ctaagtctttactctgac

SEQ ID NO: 5600860 - DNA, 20 bp, Homo sapiens
ctaagtgaaataagccagac

SEQ ID NO: 5600861 - DNA, 19 bp, Homo sapiens
ctaagtgaaatttctagcc

SEQ ID NO: 5600862 - DNA, 15 bp, Homo sapiens
ctaagtgagatgttt

SEQ ID NO: 5600863 - DNA, 20 bp, Homo sapiens
ctaagtgagatgtttggcaa

SEQ ID NO: 5600864 - DNA, 14 bp, Homo sapiens
ctaagtgatataaa

SEQ ID NO: 5600865 - DNA, 20 bp, Homo sapiens
ctaagtgatcctcccacctc

SEQ ID NO: 5600866 - DNA, 23 bp, Homo sapiens
ctaagtgatcctcccacctcagc

SEQ ID NO: 5600867 - DNA, 18 bp, Homo sapiens
ctaagtgcaaacacagca

SEQ ID NO: 5600868 - DNA, 21 bp, Homo sapiens
ctaagtgccaacaattttcta

SEQ ID NO: 5600869 - DNA, 13 bp, Homo sapiens
ctaagtgctgctg

SEQ ID NO: 5600870 - DNA, 15 bp, Homo sapiens
ctaagtgctgctgtg

SEQ ID NO: 5600871 - DNA, 18 bp, Homo sapiens
ctaagtgctgctgtggag

SEQ ID NO: 5600872 - DNA, 19 bp, Homo sapiens
ctaagtgctgctgtggagt

SEQ ID NO: 5600873 - DNA, 17 bp, Homo sapiens
ctaagtgcttattacat

SEQ ID NO: 5600874 - DNA, 16 bp, Homo sapiens
ctaagtggaagacaga

SEQ ID NO: 5600875 - DNA, 21 bp, Homo sapiens
ctaagtggaagacagagatgg

SEQ ID NO: 5600876 - DNA, 17 bp, Homo sapiens
ctaagtggcgtgtgcat

SEQ ID NO: 5600877 - DNA, 15 bp, Homo sapiens
ctaagtggctgcctt

SEQ ID NO: 5600878 - DNA, 19 bp, Homo sapiens
ctaagtggctgccttcttt

SEQ ID NO: 5600879 - DNA, 17 bp, Homo sapiens
ctaagtgggaagtgaag

SEQ ID NO: 5600880 - DNA, 22 bp, Homo sapiens
ctaagtgggaagtgaagcccct

SEQ ID NO: 5600881 - DNA, 12 bp, Homo sapiens
ctaagtgggaga

SEQ ID NO: 5600882 - DNA, 20 bp, Homo sapiens
ctaagtgggagacaatatta

SEQ ID NO: 5600883 - DNA, 21 bp, Homo sapiens
ctaagtgtaaaaaaaagtctt

SEQ ID NO: 5600884 - DNA, 16 bp, Homo sapiens
ctaagtgtaaatgtta

SEQ ID NO: 5600885 - DNA, 18 bp, Homo sapiens
ctaagtgtaacctcagta

SEQ ID NO: 5600886 - DNA, 20 bp, Homo sapiens
ctaagtgtaacctcagtatt

SEQ ID NO: 5600887 - DNA, 17 bp, Homo sapiens
ctaagtgtaatgttgct

SEQ ID NO: 5600888 - DNA, 14 bp, Homo sapiens
ctaagtgtgcttag

SEQ ID NO: 5600889 - DNA, 15 bp, Homo sapiens
ctaagtgtgcttagt

SEQ ID NO: 5600890 - DNA, 13 bp, Homo sapiens
ctaagtgtggaga

SEQ ID NO: 5600891 - DNA, 16 bp, Homo sapiens
ctaagtgtggagaagg

SEQ ID NO: 5600892 - DNA, 17 bp, Homo sapiens
ctaagtgtggatgttca

SEQ ID NO: 5600893 - DNA, 23 bp, Homo sapiens
ctaagtgttcgtctttagttttg

SEQ ID NO: 5600894 - DNA, 16 bp, Homo sapiens
ctaagtgttgaagaag

SEQ ID NO: 5600895 - DNA, 13 bp, Homo sapiens
ctaagtgttgatt

SEQ ID NO: 5600896 - DNA, 17 bp, Homo sapiens
ctaagtgtttcataaat

SEQ ID NO: 5600897 - DNA, 18 bp, Homo sapiens
ctaagttaaatcattttc

SEQ ID NO: 5600898 - DNA, 15 bp, Homo sapiens
ctaagttaatttaaa

SEQ ID NO: 5600899 - DNA, 17 bp, Homo sapiens
ctaagttaatttaaagt

SEQ ID NO: 5600900 - DNA, 17 bp, Homo sapiens
ctaagttataagactct

SEQ ID NO: 5600901 - DNA, 21 bp, Homo sapiens
ctaagttataagactctcaca

SEQ ID NO: 5600902 - DNA, 20 bp, Homo sapiens
ctaagttatgactgtgaaat

SEQ ID NO: 5600903 - DNA, 11 bp, Homo sapiens
ctaagttatta

SEQ ID NO: 5600904 - DNA, 16 bp, Homo sapiens
ctaagttattgctgca

SEQ ID NO: 5600905 - DNA, 22 bp, Homo sapiens
ctaagttattgctgcataaatt

SEQ ID NO: 5600906 - DNA, 14 bp, Homo sapiens
ctaagttattgtta

SEQ ID NO: 5600907 - DNA, 14 bp, Homo sapiens
ctaagttattttat

SEQ ID NO: 5600908 - DNA, 13 bp, Homo sapiens
ctaagttcacagt

SEQ ID NO: 5600909 - DNA, 20 bp, Homo sapiens
ctaagttcatgtttgtaaat

SEQ ID NO: 5600910 - DNA, 17 bp, Homo sapiens
ctaagttctaagttcat

SEQ ID NO: 5600911 - DNA, 15 bp, Homo sapiens
ctaagttctcccaac

SEQ ID NO: 5600912 - DNA, 19 bp, Homo sapiens
ctaagttgagtatattata

SEQ ID NO: 5600913 - DNA, 22 bp, Homo sapiens
ctaagttgagtatattataata

SEQ ID NO: 5600914 - DNA, 24 bp, Homo sapiens
ctaagttgggatctaggagaggag

SEQ ID NO: 5600915 - DNA, 17 bp, Homo sapiens
ctaagttgtattttaat

SEQ ID NO: 5600916 - DNA, 21 bp, Homo sapiens
ctaagttgtattttaataaag

SEQ ID NO: 5600917 - DNA, 20 bp, Homo sapiens
ctaagtttaaaggactgatt

SEQ ID NO: 5600918 - DNA, 22 bp, Homo sapiens
ctaagtttaaaggactgatttg

SEQ ID NO: 5600919 - DNA, 13 bp, Homo sapiens
ctaagtttcagtt

SEQ ID NO: 5600920 - DNA, 19 bp, Homo sapiens
ctaagtttcagttgatttt

SEQ ID NO: 5600921 - DNA, 17 bp, Homo sapiens
ctaagtttctaagattc

SEQ ID NO: 5600922 - DNA, 20 bp, Homo sapiens
ctaagttttagggtacatgt

SEQ ID NO: 5600923 - DNA, 21 bp, Homo sapiens
ctaagttttagggtacatgtg

SEQ ID NO: 5600924 - DNA, 19 bp, Homo sapiens
ctaagttttgtgtgtatat

SEQ ID NO: 5600925 - DNA, 14 bp, Homo sapiens
ctaagtttttatgg

SEQ ID NO: 5600926 - DNA, 15 bp, Homo sapiens
ctaataaaaaacatt

SEQ ID NO: 5600927 - DNA, 11 bp, Homo sapiens
ctaataaaaag

SEQ ID NO: 5600928 - DNA, 17 bp, Homo sapiens
ctaataaaaagcttttg

SEQ ID NO: 5600929 - DNA, 14 bp, Homo sapiens
ctaataaaaaggtg

SEQ ID NO: 5600930 - DNA, 15 bp, Homo sapiens
ctaataaaaaggttt

SEQ ID NO: 5600931 - DNA, 21 bp, Homo sapiens
ctaataaaagtcagagctcag

SEQ ID NO: 5600932 - DNA, 14 bp, Homo sapiens
ctaataaaatacat

SEQ ID NO: 5600933 - DNA, 15 bp, Homo sapiens
ctaataaaatacata

SEQ ID NO: 5600934 - DNA, 12 bp, Homo sapiens
ctaataaaatat

SEQ ID NO: 5600935 - DNA, 14 bp, Homo sapiens
ctaataaaatatca

SEQ ID NO: 5600936 - DNA, 17 bp, Homo sapiens
ctaataaaatatcattc

SEQ ID NO: 5600937 - DNA, 19 bp, Homo sapiens
ctaataaaatatcattcag

SEQ ID NO: 5600938 - DNA, 13 bp, Homo sapiens
ctaataaaatatt

SEQ ID NO: 5600939 - DNA, 21 bp, Homo sapiens
ctaataaaatattttctgtgt

SEQ ID NO: 5600940 - DNA, 22 bp, Homo sapiens
ctaataaaatattttctgtgtg

SEQ ID NO: 5600941 - DNA, 12 bp, Homo sapiens
ctaataaaatgt

SEQ ID NO: 5600942 - DNA, 19 bp, Homo sapiens
ctaataaaattcgctttct

SEQ ID NO: 5600943 - DNA, 20 bp, Homo sapiens
ctaataaaatttaaaagtct

SEQ ID NO: 5600944 - DNA, 15 bp, Homo sapiens
ctaataaacactggc

SEQ ID NO: 5600945 - DNA, 18 bp, Homo sapiens
ctacagaaaagaaactct

SEQ ID NO: 5600946 - DNA, 13 bp, Homo sapiens
ctacagaaaatgc

SEQ ID NO: 5600947 - DNA, 19 bp, Homo sapiens
ctacagaaaatgctggctg

SEQ ID NO: 5600948 - DNA, 21 bp, Homo sapiens
ctacagaaaccaggtaagccc

SEQ ID NO: 5600949 - DNA, 22 bp, Homo sapiens
ctacagaaagcaaatcagacac

SEQ ID NO: 5600950 - DNA, 19 bp, Homo sapiens
ctacagaaatactgctctg

SEQ ID NO: 5600951 - DNA, 21 bp, Homo sapiens
ctacagaaattctgcaagttt

SEQ ID NO: 5600952 - DNA, 14 bp, Homo sapiens
ctacagaacaaaga

SEQ ID NO: 5600953 - DNA, 15 bp, Homo sapiens
ctacagaacctgagg

SEQ ID NO: 5600954 - DNA, 17 bp, Homo sapiens
ctacagaacctgagggc

SEQ ID NO: 5600955 - DNA, 20 bp, Homo sapiens
ctacagaactacatatttgt

SEQ ID NO: 5600956 - DNA, 17 bp, Homo sapiens
ctacagaacttcagaaa

SEQ ID NO: 5600957 - DNA, 21 bp, Homo sapiens
ctacagaaggacatatttcct

SEQ ID NO: 5600958 - DNA, 15 bp, Homo sapiens
ctacagaagtggaag

SEQ ID NO: 5600959 - DNA, 17 bp, Homo sapiens
ctacagaagtggaagga

SEQ ID NO: 5600960 - DNA, 20 bp, Homo sapiens
ctacagaagtggaagtgctt

SEQ ID NO: 5600961 - DNA, 13 bp, Homo sapiens
ctacagaataatc

SEQ ID NO: 5600962 - DNA, 21 bp, Homo sapiens
ctacagaatattaaatattat

SEQ ID NO: 5600963 - DNA, 23 bp, Homo sapiens
ctacagacaaagagagtggaaat

SEQ ID NO: 5600964 - DNA, 19 bp, Homo sapiens
ctacagacagacatacata

SEQ ID NO: 5600965 - DNA, 23 bp, Homo sapiens
ctacagacagcttacaggagcca

SEQ ID NO: 5600966 - DNA, 17 bp, Homo sapiens
ctacagacctggctctc

SEQ ID NO: 5600967 - DNA, 21 bp, Homo sapiens
ctacagacctggctctcagag

SEQ ID NO: 5600968 - DNA, 15 bp, Homo sapiens
ctacagactccatct

SEQ ID NO: 5600969 - DNA, 16 bp, Homo sapiens
ctacagactccatctc

SEQ ID NO: 5600970 - DNA, 17 bp, Homo sapiens
ctacagactccatctct

SEQ ID NO: 5600971 - DNA, 11 bp, Homo sapiens
ctacagagaaa

SEQ ID NO: 5600972 - DNA, 16 bp, Homo sapiens
ctacagagaaaccagc

SEQ ID NO: 5600973 - DNA, 17 bp, Homo sapiens
ctacagagaaaccagct

SEQ ID NO: 5600974 - DNA, 12 bp, Homo sapiens
ctacagagaagc

SEQ ID NO: 5600975 - DNA, 15 bp, Homo sapiens
ctacagagaagcctt

SEQ ID NO: 5600976 - DNA, 22 bp, Homo sapiens
ctacagagaagccttcaagctc

SEQ ID NO: 5600977 - DNA, 20 bp, Homo sapiens
ctacagagaaggctgcctgc

SEQ ID NO: 5600978 - DNA, 16 bp, Homo sapiens
ctacagagcagctccc

SEQ ID NO: 5600979 - DNA, 17 bp, Homo sapiens
ctacagagcagctcccc

SEQ ID NO: 5600980 - DNA, 18 bp, Homo sapiens
ctacagagcagctcccca

SEQ ID NO: 5600981 - DNA, 21 bp, Homo sapiens
ctacagagccgagcaatattt

SEQ ID NO: 5600982 - DNA, 12 bp, Homo sapiens
ctacagagctgt

SEQ ID NO: 5600983 - DNA, 16 bp, Homo sapiens
ctacagagcttccctg

SEQ ID NO: 5600984 - DNA, 20 bp, Homo sapiens
ctacagagcttccctgactc

SEQ ID NO: 5600985 - DNA, 13 bp, Homo sapiens
ctacagaggaggc

SEQ ID NO: 5600986 - DNA, 14 bp, Homo sapiens
ctacagaggaggcc

SEQ ID NO: 5600987 - DNA, 17 bp, Homo sapiens
ctacagaggaggcctca

SEQ ID NO: 5600988 - DNA, 22 bp, Homo sapiens
ctacagaggccatgggcctcct

SEQ ID NO: 5600989 - DNA, 18 bp, Homo sapiens
ctacagagtctgacagga

SEQ ID NO: 5600990 - DNA, 14 bp, Homo sapiens
ctacagatcctccg

SEQ ID NO: 5600991 - DNA, 23 bp, Homo sapiens
ctacagatgatagaggattttat

SEQ ID NO: 5600992 - DNA, 13 bp, Homo sapiens
ctacagcaaattt

SEQ ID NO: 5600993 - DNA, 22 bp, Homo sapiens
ctacagcaaatttataatttta

SEQ ID NO: 5600994 - DNA, 23 bp, Homo sapiens
ctacagcaccttaaaaattagaa

SEQ ID NO: 5600995 - DNA, 19 bp, Homo sapiens
ctacagcactactgggtgt

SEQ ID NO: 5600996 - DNA, 20 bp, Homo sapiens
ctacagcactactgggtgtc

SEQ ID NO: 5600997 - DNA, 21 bp, Homo sapiens
ctacagcagatccacctgcac

SEQ ID NO: 5600998 - DNA, 23 bp, Homo sapiens
ctacagcagatccacctgcacaa

SEQ ID NO: 5600999 - DNA, 18 bp, Homo sapiens
ctacagcataaatctgtt

SEQ ID NO: 5601000 - DNA, 23 bp, Homo sapiens
ctacagcataaatctgttagcat

SEQ ID NO: 5601001 - DNA, 22 bp, Homo sapiens
ctacagccaaattgcagaagaa

SEQ ID NO: 5601002 - DNA, 14 bp, Homo sapiens
ctacagccacatcc

SEQ ID NO: 5601003 - DNA, 22 bp, Homo sapiens
ctacagccacatccccaagccc

SEQ ID NO: 5601004 - DNA, 12 bp, Homo sapiens
ctacagccagcg

SEQ ID NO: 5601005 - DNA, 22 bp, Homo sapiens
ctacagccagtaaggcagctct

SEQ ID NO: 5601006 - DNA, 14 bp, Homo sapiens
ctacagcctcagaa

SEQ ID NO: 5601007 - DNA, 13 bp, Homo sapiens
ctacagcctgcac

SEQ ID NO: 5601008 - DNA, 18 bp, Homo sapiens
ctacagcctgcacacacc

SEQ ID NO: 5601009 - DNA, 18 bp, Homo sapiens
ctacagcgagctgcatta

SEQ ID NO: 5601010 - DNA, 19 bp, Homo sapiens
ctacagctaatcagcattc

SEQ ID NO: 5601011 - DNA, 21 bp, Homo sapiens
ctacagctaatcagcattctc

SEQ ID NO: 5601012 - DNA, 17 bp, Homo sapiens
ctacagctccacacgcc

SEQ ID NO: 5601013 - DNA, 22 bp, Homo sapiens
ctacagctccacacgccccggt

SEQ ID NO: 5601014 - DNA, 11 bp, Homo sapiens
ctacagctctt

SEQ ID NO: 5601015 - DNA, 18 bp, Homo sapiens
ctacagctggggtgcagg

SEQ ID NO: 5601016 - DNA, 20 bp, Homo sapiens
ctacagctgttatctttcct

SEQ ID NO: 5601017 - DNA, 23 bp, Homo sapiens
ctacagcttgaccgtgaggccag

SEQ ID NO: 5601018 - DNA, 21 bp, Homo sapiens
ctacagcttgtttaacggcag

SEQ ID NO: 5601019 - DNA, 11 bp, Homo sapiens
ctacagctttc

SEQ ID NO: 5601020 - DNA, 23 bp, Homo sapiens
ctacagctttcttgctcccttca

SEQ ID NO: 5601021 - DNA, 19 bp, Homo sapiens
ctacagctttgatccctga

SEQ ID NO: 5601022 - DNA, 22 bp, Homo sapiens
ctacagctttgtgactgtatat

SEQ ID NO: 5601023 - DNA, 20 bp, Homo sapiens
ctacaggaagcaccccatgc

SEQ ID NO: 5601024 - DNA, 21 bp, Homo sapiens
ctacaggaatctctgattaca

SEQ ID NO: 5601025 - DNA, 22 bp, Homo sapiens
ctacaggaatctctgattacag

SEQ ID NO: 5601026 - DNA, 16 bp, Homo sapiens
ctacaggacaaggggc

SEQ ID NO: 5601027 - DNA, 18 bp, Homo sapiens
ctacaggacaaggggcat

SEQ ID NO: 5601028 - DNA, 13 bp, Homo sapiens
ctacaggactggg

SEQ ID NO: 5601029 - DNA, 16 bp, Homo sapiens
ctacaggagtgagcac

SEQ ID NO: 5601030 - DNA, 17 bp, Homo sapiens
ctacaggcacccaccat

SEQ ID NO: 5601031 - DNA, 17 bp, Homo sapiens
ctacaggcagtctctct

SEQ ID NO: 5601032 - DNA, 20 bp, Homo sapiens
ctacaggcctcacacacaat

SEQ ID NO: 5601033 - DNA, 18 bp, Homo sapiens
ctacaggcctcttcctgt

SEQ ID NO: 5601034 - DNA, 12 bp, Homo sapiens
ctacaggcctgc

SEQ ID NO: 5601035 - DNA, 14 bp, Homo sapiens
ctacaggcctgcag

SEQ ID NO: 5601036 - DNA, 17 bp, Homo sapiens
ctacaggcctgcagccc

SEQ ID NO: 5601037 - DNA, 16 bp, Homo sapiens
ctacaggcgctccagg

SEQ ID NO: 5601038 - DNA, 13 bp, Homo sapiens
ctacagggaactg

SEQ ID NO: 5601039 - DNA, 22 bp, Homo sapiens
ctacagggcgagactctgtctc

SEQ ID NO: 5601040 - DNA, 16 bp, Homo sapiens
ctacaggggaggctga

SEQ ID NO: 5601041 - DNA, 16 bp, Homo sapiens
ctacaggggccagaag

SEQ ID NO: 5601042 - DNA, 21 bp, Homo sapiens
ctacagggggtctggctggtg

SEQ ID NO: 5601043 - DNA, 23 bp, Homo sapiens
ctacagggggtctggctggtgtt

SEQ ID NO: 5601044 - DNA, 19 bp, Homo sapiens
ctacaggggttagcctgga

SEQ ID NO: 5601045 - DNA, 16 bp, Homo sapiens
ctacaggtgagtgcca

SEQ ID NO: 5601046 - DNA, 15 bp, Homo sapiens
ctacaggtgccccac

SEQ ID NO: 5601047 - DNA, 19 bp, Homo sapiens
ctacaggtgccccacctcc

SEQ ID NO: 5601048 - DNA, 23 bp, Homo sapiens
ctacaggtgcgcgccaccgtgcc

SEQ ID NO: 5601049 - DNA, 14 bp, Homo sapiens
ctacaggttacaac

SEQ ID NO: 5601050 - DNA, 17 bp, Homo sapiens
ctacaggttacaacaga

SEQ ID NO: 5601051 - DNA, 20 bp, Homo sapiens
ctacaggttacaacagattt

SEQ ID NO: 5601052 - DNA, 16 bp, Homo sapiens
ctacagtagctgtggg

SEQ ID NO: 5601053 - DNA, 21 bp, Homo sapiens
ctacagtagctgtggggagct

SEQ ID NO: 5601054 - DNA, 23 bp, Homo sapiens
ctacagtagctgtggggagctgg

SEQ ID NO: 5601055 - DNA, 11 bp, Homo sapiens
ctacagtattt

SEQ ID NO: 5601056 - DNA, 16 bp, Homo sapiens
ctacagtattttttat

SEQ ID NO: 5601057 - DNA, 20 bp, Homo sapiens
ctacagtcctcccatctcac

SEQ ID NO: 5601058 - DNA, 19 bp, Homo sapiens
ctacagtgaaatgagcagc

SEQ ID NO: 5601059 - DNA, 20 bp, Homo sapiens
ctacagtgactccctgggag

SEQ ID NO: 5601060 - DNA, 23 bp, Homo sapiens
ctacagtgatgattgaattctaa

SEQ ID NO: 5601061 - DNA, 20 bp, Homo sapiens
ctacagtgccaactcctcac

SEQ ID NO: 5601062 - DNA, 16 bp, Homo sapiens
ctacagtggagggaga

SEQ ID NO: 5601063 - DNA, 16 bp, Homo sapiens
ctacagtggttttata

SEQ ID NO: 5601064 - DNA, 21 bp, Homo sapiens
ctacagtggttttatactgaa

SEQ ID NO: 5601065 - DNA, 13 bp, Homo sapiens
ctacagtgtacag

SEQ ID NO: 5601066 - DNA, 15 bp, Homo sapiens
ctacagtgtacagtc

SEQ ID NO: 5601067 - DNA, 23 bp, Homo sapiens
ctacagttagggttgagttactt

SEQ ID NO: 5601068 - DNA, 19 bp, Homo sapiens
ctacagttgaaaaacagct

SEQ ID NO: 5601069 - DNA, 21 bp, Homo sapiens
ctacagttggaaatccatcca

SEQ ID NO: 5601070 - DNA, 14 bp, Homo sapiens
ctacagtttttcct

SEQ ID NO: 5601071 - DNA, 12 bp, Homo sapiens
ctacataaactg

SEQ ID NO: 5601072 - DNA, 17 bp, Homo sapiens
ctacataaactgacttt

SEQ ID NO: 5601073 - DNA, 22 bp, Homo sapiens
ctacataagactggacatttaa

SEQ ID NO: 5601074 - DNA, 15 bp, Homo sapiens
ctacataattgtgac

SEQ ID NO: 5601075 - DNA, 17 bp, Homo sapiens
ctacataattgtgacca

SEQ ID NO: 5601076 - DNA, 15 bp, Homo sapiens
ctacataatttagtt

SEQ ID NO: 5601077 - DNA, 22 bp, Homo sapiens
ctacataccacacttaaaagat

SEQ ID NO: 5601078 - DNA, 23 bp, Homo sapiens
ctacatacgcaaaaacttccttt

SEQ ID NO: 5601079 - DNA, 18 bp, Homo sapiens
ctacatactatggaattt

SEQ ID NO: 5601080 - DNA, 14 bp, Homo sapiens
ctacatagttattc

SEQ ID NO: 5601081 - DNA, 19 bp, Homo sapiens
ctacatatgataggcagca

SEQ ID NO: 5601082 - DNA, 18 bp, Homo sapiens
ctacatatgctgatcttt

SEQ ID NO: 5601083 - DNA, 22 bp, Homo sapiens
ctacatatttgtatgtttttct

SEQ ID NO: 5601084 - DNA, 19 bp, Homo sapiens
ctacatccagctcctctag

SEQ ID NO: 5601085 - DNA, 17 bp, Homo sapiens
ctacatccccaggtctc

SEQ ID NO: 5601086 - DNA, 13 bp, Homo sapiens
ctacatctgaaat

SEQ ID NO: 5601087 - DNA, 17 bp, Homo sapiens
ctacatctgatatcagg

SEQ ID NO: 5601088 - DNA, 13 bp, Homo sapiens
ctacatctgcctc

SEQ ID NO: 5601089 - DNA, 13 bp, Homo sapiens
ctacatcttcagc

SEQ ID NO: 5601090 - DNA, 16 bp, Homo sapiens
ctacatcttttataca

SEQ ID NO: 5601091 - DNA, 15 bp, Homo sapiens
ctacatgaaacagaa

SEQ ID NO: 5601092 - DNA, 21 bp, Homo sapiens
ctacatgaagttgtaagaaaa

SEQ ID NO: 5601093 - DNA, 19 bp, Homo sapiens
ctacatgacgacaaagctg

SEQ ID NO: 5601094 - DNA, 14 bp, Homo sapiens
ctacatgactgggc

SEQ ID NO: 5601095 - DNA, 18 bp, Homo sapiens
ctacatgactgggcctcc

SEQ ID NO: 5601096 - DNA, 14 bp, Homo sapiens
ctacatgagaacaa

SEQ ID NO: 5601097 - DNA, 17 bp, Homo sapiens
ctacatgagaacaaaca

SEQ ID NO: 5601098 - DNA, 19 bp, Homo sapiens
ctacatgatgctaaaggct

SEQ ID NO: 5601099 - DNA, 17 bp, Homo sapiens
ctacatgcagcccatgc

SEQ ID NO: 5601100 - DNA, 22 bp, Homo sapiens
ctacatgcataaactaaaaact

SEQ ID NO: 5601101 - DNA, 18 bp, Homo sapiens
ctacatgccccctccctt

SEQ ID NO: 5601102 - DNA, 22 bp, Homo sapiens
ctacatgccccctcccttcaca

SEQ ID NO: 5601103 - DNA, 19 bp, Homo sapiens
ctacatgcttgttgacaga

SEQ ID NO: 5601104 - DNA, 23 bp, Homo sapiens
ctacatggttgaaaccccatctc

SEQ ID NO: 5601105 - DNA, 15 bp, Homo sapiens
ctacatgtaatgaca

SEQ ID NO: 5601106 - DNA, 22 bp, Homo sapiens
ctacatgtattgcacattgtaa

SEQ ID NO: 5601107 - DNA, 16 bp, Homo sapiens
ctacatgttctttgta

SEQ ID NO: 5601108 - DNA, 17 bp, Homo sapiens
ctacatgttctttgtac

SEQ ID NO: 5601109 - DNA, 17 bp, Homo sapiens
ctacattaaaagcttta

SEQ ID NO: 5601110 - DNA, 16 bp, Homo sapiens
ctacattaaaatgaca

SEQ ID NO: 5601111 - DNA, 24 bp, Homo sapiens
ctacattaaaatgacaaacatgat

SEQ ID NO: 5601112 - DNA, 12 bp, Homo sapiens
ctacattaaaca

SEQ ID NO: 5601113 - DNA, 20 bp, Homo sapiens
ctacattaaacaatgatcac

SEQ ID NO: 5601114 - DNA, 16 bp, Homo sapiens
ctacattaacttgaaa

SEQ ID NO: 5601115 - DNA, 22 bp, Homo sapiens
ctacattaacttgaaaattttt

SEQ ID NO: 5601116 - DNA, 17 bp, Homo sapiens
ctacattaggttgtgaa

SEQ ID NO: 5601117 - DNA, 17 bp, Homo sapiens
ctacattataaacgctt

SEQ ID NO: 5601118 - DNA, 18 bp, Homo sapiens
ctacattataataaaatt

SEQ ID NO: 5601119 - DNA, 23 bp, Homo sapiens
ctacattattgcttattgcttag

SEQ ID NO: 5601120 - DNA, 15 bp, Homo sapiens
ctacattccccagag

SEQ ID NO: 5601121 - DNA, 19 bp, Homo sapiens
ctactcttcctttctaaat

SEQ ID NO: 5601122 - DNA, 19 bp, Homo sapiens
ctactcttctctctgctct

SEQ ID NO: 5601123 - DNA, 21 bp, Homo sapiens
ctactcttgagagctcaggca

SEQ ID NO: 5601124 - DNA, 15 bp, Homo sapiens
ctactcttgtcattt

SEQ ID NO: 5601125 - DNA, 12 bp, Homo sapiens
ctactctttgat

SEQ ID NO: 5601126 - DNA, 18 bp, Homo sapiens
ctactcttttgaagtgtt

SEQ ID NO: 5601127 - DNA, 14 bp, Homo sapiens
ctactgaaaatgca

SEQ ID NO: 5601128 - DNA, 13 bp, Homo sapiens
ctactgaaacaga

SEQ ID NO: 5601129 - DNA, 18 bp, Homo sapiens
ctactgaaacagatttca

SEQ ID NO: 5601130 - DNA, 18 bp, Homo sapiens
ctactgaacacatgtgta

SEQ ID NO: 5601131 - DNA, 14 bp, Homo sapiens
ctactgaaccagcc

SEQ ID NO: 5601132 - DNA, 16 bp, Homo sapiens
ctactgaaccagccac

SEQ ID NO: 5601133 - DNA, 18 bp, Homo sapiens
ctactgaacccagagtca

SEQ ID NO: 5601134 - DNA, 18 bp, Homo sapiens
ctactgaaccctgcctct

SEQ ID NO: 5601135 - DNA, 13 bp, Homo sapiens
ctactgaagccct

SEQ ID NO: 5601136 - DNA, 15 bp, Homo sapiens
ctactgaagtggctg

SEQ ID NO: 5601137 - DNA, 18 bp, Homo sapiens
ctactgaataaatcatgt

SEQ ID NO: 5601138 - DNA, 23 bp, Homo sapiens
ctactgaataaatcatgtggcct

SEQ ID NO: 5601139 - DNA, 15 bp, Homo sapiens
ctactgaatgtgttt

SEQ ID NO: 5601140 - DNA, 16 bp, Homo sapiens
ctactgacagggagca

SEQ ID NO: 5601141 - DNA, 20 bp, Homo sapiens
ctactgacatgtggggccag

SEQ ID NO: 5601142 - DNA, 18 bp, Homo sapiens
ctactgaccagacaagct

SEQ ID NO: 5601143 - DNA, 15 bp, Homo sapiens
ctactgacccaactg

SEQ ID NO: 5601144 - DNA, 17 bp, Homo sapiens
ctactgacctttgtcct

SEQ ID NO: 5601145 - DNA, 14 bp, Homo sapiens
ctactgactatatt

SEQ ID NO: 5601146 - DNA, 14 bp, Homo sapiens
ctactgagaaactt

SEQ ID NO: 5601147 - DNA, 21 bp, Homo sapiens
ctactgagaacataaaatctt

SEQ ID NO: 5601148 - DNA, 11 bp, Homo sapiens
ctactgagact

SEQ ID NO: 5601149 - DNA, 12 bp, Homo sapiens
ctactgagccac

SEQ ID NO: 5601150 - DNA, 22 bp, Homo sapiens
ctactgagcggacagaatgatg

SEQ ID NO: 5601151 - DNA, 18 bp, Homo sapiens
ctactgaggagcaaagca

SEQ ID NO: 5601152 - DNA, 20 bp, Homo sapiens
ctactgaggatatggacact

SEQ ID NO: 5601153 - DNA, 14 bp, Homo sapiens
ctactgaggtgcta

SEQ ID NO: 5601154 - DNA, 17 bp, Homo sapiens
ctactgataaagaaaga

SEQ ID NO: 5601155 - DNA, 23 bp, Homo sapiens
ctactgatgaaatctgctagaaa

SEQ ID NO: 5601156 - DNA, 17 bp, Homo sapiens
ctactgattacttgtaa

SEQ ID NO: 5601157 - DNA, 14 bp, Homo sapiens
ctactgattccgca

SEQ ID NO: 5601158 - DNA, 21 bp, Homo sapiens
ctactgattttaaaatgaata

SEQ ID NO: 5601159 - DNA, 15 bp, Homo sapiens
ctactgcaaatggca

SEQ ID NO: 5601160 - DNA, 13 bp, Homo sapiens
ctactgcaagttc

SEQ ID NO: 5601161 - DNA, 14 bp, Homo sapiens
ctactgcaccattt

SEQ ID NO: 5601162 - DNA, 18 bp, Homo sapiens
ctactgcaccatttaaaa

SEQ ID NO: 5601163 - DNA, 17 bp, Homo sapiens
ctactgcactccagcct

SEQ ID NO: 5601164 - DNA, 18 bp, Homo sapiens
ctactgcactccagcctg

SEQ ID NO: 5601165 - DNA, 13 bp, Homo sapiens
ctactgcactgag

SEQ ID NO: 5601166 - DNA, 14 bp, Homo sapiens
ctactgcactgagt

SEQ ID NO: 5601167 - DNA, 19 bp, Homo sapiens
ctactgcactttccccctt

SEQ ID NO: 5601168 - DNA, 20 bp, Homo sapiens
ctactgcactttcccccttc

SEQ ID NO: 5601169 - DNA, 22 bp, Homo sapiens
ctactgcactttcccccttccc

SEQ ID NO: 5601170 - DNA, 14 bp, Homo sapiens
ctactgcagcttta

SEQ ID NO: 5601171 - DNA, 13 bp, Homo sapiens
ctactgcagtctt

SEQ ID NO: 5601172 - DNA, 15 bp, Homo sapiens
ctactgcagtcttta

SEQ ID NO: 5601173 - DNA, 17 bp, Homo sapiens
ctactgcagtctttatt

SEQ ID NO: 5601174 - DNA, 18 bp, Homo sapiens
ctactgcagtctttattt

SEQ ID NO: 5601175 - DNA, 19 bp, Homo sapiens
ctactgcatttagggagta

SEQ ID NO: 5601176 - DNA, 23 bp, Homo sapiens
ctactgccactcaggcagcctgt

SEQ ID NO: 5601177 - DNA, 15 bp, Homo sapiens
ctactgccactgtgt

SEQ ID NO: 5601178 - DNA, 16 bp, Homo sapiens
ctactgccactgtgtg

SEQ ID NO: 5601179 - DNA, 22 bp, Homo sapiens
ctactgccatcctggcccaggg

SEQ ID NO: 5601180 - DNA, 11 bp, Homo sapiens
ctactgcccac

SEQ ID NO: 5601181 - DNA, 15 bp, Homo sapiens
ctactgcccaggcac

SEQ ID NO: 5601182 - DNA, 19 bp, Homo sapiens
ctactgcccctctccgaaa

SEQ ID NO: 5601183 - DNA, 14 bp, Homo sapiens
ctactgcccctgcc

SEQ ID NO: 5601184 - DNA, 23 bp, Homo sapiens
ctactgcccctgccctgaggagg

SEQ ID NO: 5601185 - DNA, 16 bp, Homo sapiens
ctactgccttgaaaaa

SEQ ID NO: 5601186 - DNA, 17 bp, Homo sapiens
ctactgccttgaaaaat

SEQ ID NO: 5601187 - DNA, 18 bp, Homo sapiens
ctactgccttgaaaaatg

SEQ ID NO: 5601188 - DNA, 11 bp, Homo sapiens
ctactgccttt

SEQ ID NO: 5601189 - DNA, 15 bp, Homo sapiens
ctactgcgcctcgtg

SEQ ID NO: 5601190 - DNA, 13 bp, Homo sapiens
ctactgctatttt

SEQ ID NO: 5601191 - DNA, 13 bp, Homo sapiens
ctactgctcagct

SEQ ID NO: 5601192 - DNA, 15 bp, Homo sapiens
ctactgctcagcttc

SEQ ID NO: 5601193 - DNA, 17 bp, Homo sapiens
ctactgctcctgtggca

SEQ ID NO: 5601194 - DNA, 16 bp, Homo sapiens
ctactgctgcaaagtg

SEQ ID NO: 5601195 - DNA, 22 bp, Homo sapiens
ctactgcttcctctgaatatta

SEQ ID NO: 5601196 - DNA, 14 bp, Homo sapiens
ctactggaatggtg

SEQ ID NO: 5601197 - DNA, 21 bp, Homo sapiens
ctactggaatggtgttttgtc

SEQ ID NO: 5601198 - DNA, 16 bp, Homo sapiens
ctactggattcttatt

SEQ ID NO: 5601199 - DNA, 12 bp, Homo sapiens
ctactggcagct

SEQ ID NO: 5601200 - DNA, 20 bp, Homo sapiens
ctactggcattaattattaa

SEQ ID NO: 5601201 - DNA, 18 bp, Homo sapiens
ctactggcctctgtgcca

SEQ ID NO: 5601202 - DNA, 19 bp, Homo sapiens
ctactgggaaattacttat

SEQ ID NO: 5601203 - DNA, 14 bp, Homo sapiens
ctactgggaaggct

SEQ ID NO: 5601204 - DNA, 14 bp, Homo sapiens
ctactgggagactg

SEQ ID NO: 5601205 - DNA, 18 bp, Homo sapiens
ctactgggagcctaccca

SEQ ID NO: 5601206 - DNA, 20 bp, Homo sapiens
ctactggggaaactggccat

SEQ ID NO: 5601207 - DNA, 17 bp, Homo sapiens
ctactggggaggctgag

SEQ ID NO: 5601208 - DNA, 19 bp, Homo sapiens
ctactggggaggctgaggc

SEQ ID NO: 5601209 - DNA, 14 bp, Homo sapiens
ctactgggtgtcat

SEQ ID NO: 5601210 - DNA, 16 bp, Homo sapiens
ctactgggtgtcattt

SEQ ID NO: 5601211 - DNA, 19 bp, Homo sapiens
ctactgggtgtcatttcat

SEQ ID NO: 5601212 - DNA, 19 bp, Homo sapiens
ctactggtcctcttaactg

SEQ ID NO: 5601213 - DNA, 15 bp, Homo sapiens
ctactggtctctcta

SEQ ID NO: 5601214 - DNA, 20 bp, Homo sapiens
ctactggtctctctatgcct

SEQ ID NO: 5601215 - DNA, 22 bp, Homo sapiens
ctactggtgtaatctcaatgca

SEQ ID NO: 5601216 - DNA, 17 bp, Homo sapiens
ctactggttacctggag

SEQ ID NO: 5601217 - DNA, 19 bp, Homo sapiens
ctactggttacctggagaa

SEQ ID NO: 5601218 - DNA, 23 bp, Homo sapiens
ctactgtaacttttttaaattaa

SEQ ID NO: 5601219 - DNA, 21 bp, Homo sapiens
ctactgtaagcaagaaaaata

SEQ ID NO: 5601220 - DNA, 23 bp, Homo sapiens
ctactgtaatagatcagcatcca

SEQ ID NO: 5601221 - DNA, 19 bp, Homo sapiens
ctactgtaatgctgcctca

SEQ ID NO: 5601222 - DNA, 21 bp, Homo sapiens
ctactgtaatttgtgatacaa

SEQ ID NO: 5601223 - DNA, 16 bp, Homo sapiens
ctactgtaattttata

SEQ ID NO: 5601224 - DNA, 17 bp, Homo sapiens
ctactgtaattttatat

SEQ ID NO: 5601225 - DNA, 13 bp, Homo sapiens
ctactgtacattt

SEQ ID NO: 5601226 - DNA, 12 bp, Homo sapiens
ctactgtacttt

SEQ ID NO: 5601227 - DNA, 16 bp, Homo sapiens
ctactgtactttgcca

SEQ ID NO: 5601228 - DNA, 14 bp, Homo sapiens
ctactgtagaaagg

SEQ ID NO: 5601229 - DNA, 19 bp, Homo sapiens
ctactgtagaactgcaatt

SEQ ID NO: 5601230 - DNA, 20 bp, Homo sapiens
ctactgtatcaataaaattc

SEQ ID NO: 5601231 - DNA, 11 bp, Homo sapiens
ctactgtcagt

SEQ ID NO: 5601232 - DNA, 20 bp, Homo sapiens
ctactgtcctacccaccctc

SEQ ID NO: 5601233 - DNA, 15 bp, Homo sapiens
ctactgtcctcagag

SEQ ID NO: 5601234 - DNA, 17 bp, Homo sapiens
ctactgtctcctccctg

SEQ ID NO: 5601235 - DNA, 16 bp, Homo sapiens
ctactgtctccttccc

SEQ ID NO: 5601236 - DNA, 18 bp, Homo sapiens
ctactgtctccttcccac

SEQ ID NO: 5601237 - DNA, 20 bp, Homo sapiens
ctactgtctccttcccactg

SEQ ID NO: 5601238 - DNA, 15 bp, Homo sapiens
ctactgtgcatctcc

SEQ ID NO: 5601239 - DNA, 16 bp, Homo sapiens
ctactgtgcatctcct

SEQ ID NO: 5601240 - DNA, 14 bp, Homo sapiens
ctactgtggaaaaa

SEQ ID NO: 5601241 - DNA, 15 bp, Homo sapiens
ctactgtggaaaaat

SEQ ID NO: 5601242 - DNA, 18 bp, Homo sapiens
ctactgtggaaaaatatt

SEQ ID NO: 5601243 - DNA, 21 bp, Homo sapiens
ctactgtggaaaaatatttaa

SEQ ID NO: 5601244 - DNA, 22 bp, Homo sapiens
ctactgtggaaaaatatttaag

SEQ ID NO: 5601245 - DNA, 11 bp, Homo sapiens
ctactgtgggg

SEQ ID NO: 5601246 - DNA, 16 bp, Homo sapiens
ctactgtgtgatcagg

SEQ ID NO: 5601247 - DNA, 15 bp, Homo sapiens
ctactgtgtgccagg

SEQ ID NO: 5601248 - DNA, 15 bp, Homo sapiens
ctactgtgtgtgtga

SEQ ID NO: 5601249 - DNA, 23 bp, Homo sapiens
ctactgtgttatgcaaaagcaag

SEQ ID NO: 5601250 - DNA, 13 bp, Homo sapiens
ctactgtgttcct

SEQ ID NO: 5601251 - DNA, 14 bp, Homo sapiens
ctactgttaacact

SEQ ID NO: 5601252 - DNA, 13 bp, Homo sapiens
ctactgttactct

SEQ ID NO: 5601253 - DNA, 18 bp, Homo sapiens
ctactgttactctaaata

SEQ ID NO: 5601254 - DNA, 19 bp, Homo sapiens
ctactgttaggaacagcag

SEQ ID NO: 5601255 - DNA, 23 bp, Homo sapiens
ctactgttaggaacagcagtgtt

SEQ ID NO: 5601256 - DNA, 23 bp, Homo sapiens
ctactgttatcagtaatgctaaa

SEQ ID NO: 5601257 - DNA, 19 bp, Homo sapiens
ctactgttatgtgagaaca

SEQ ID NO: 5601258 - DNA, 12 bp, Homo sapiens
ctactgttctaa

SEQ ID NO: 5601259 - DNA, 22 bp, Homo sapiens
ctactgttctaaagctctgaca

SEQ ID NO: 5601260 - DNA, 15 bp, Homo sapiens
ctactgttcttgaca

SEQ ID NO: 5601261 - DNA, 13 bp, Homo sapiens
ctactgttgcaca

SEQ ID NO: 5601262 - DNA, 18 bp, Homo sapiens
ctactgttgcacagccag

SEQ ID NO: 5601263 - DNA, 22 bp, Homo sapiens
ctactgttgtaagaattctgat

SEQ ID NO: 5601264 - DNA, 15 bp, Homo sapiens
ctacttaaaaaaaat

SEQ ID NO: 5601265 - DNA, 16 bp, Homo sapiens
ctacttaaacaaaaac

SEQ ID NO: 5601266 - DNA, 22 bp, Homo sapiens
ctacttaaacaaaaactttcca

SEQ ID NO: 5601267 - DNA, 17 bp, Homo sapiens
ctacttaaatttgaatc

SEQ ID NO: 5601268 - DNA, 19 bp, Homo sapiens
ctacttaaatttgaatctg

SEQ ID NO: 5601269 - DNA, 13 bp, Homo sapiens
ctacttaatgctt

SEQ ID NO: 5601270 - DNA, 14 bp, Homo sapiens
ctacttaatgtaat

SEQ ID NO: 5601271 - DNA, 23 bp, Homo sapiens
ctacttaatgtaattcaggactc

SEQ ID NO: 5601272 - DNA, 19 bp, Homo sapiens
ctacttaattcctttctca

SEQ ID NO: 5601273 - DNA, 13 bp, Homo sapiens
ctacttacacatc

SEQ ID NO: 5601274 - DNA, 19 bp, Homo sapiens
ctacttaccatatgtgctt

SEQ ID NO: 5601275 - DNA, 16 bp, Homo sapiens
ctacttacttagagat

SEQ ID NO: 5601276 - DNA, 16 bp, Homo sapiens
ctacttagacccagtc

SEQ ID NO: 5601277 - DNA, 18 bp, Homo sapiens
ctacttagatatttcatg

SEQ ID NO: 5601278 - DNA, 16 bp, Homo sapiens
ctacttagcacttcag

SEQ ID NO: 5601279 - DNA, 19 bp, Homo sapiens
ctacttagcacttcagggc

SEQ ID NO: 5601280 - DNA, 20 bp, Homo sapiens
ctacttagcatcctaagaaa

SEQ ID NO: 5601281 - DNA, 23 bp, Homo sapiens
ctacttagcatcctaagaaatat

SEQ ID NO: 5601282 - DNA, 22 bp, Homo sapiens
ctacttagcatgtccctaccga

SEQ ID NO: 5601283 - DNA, 12 bp, Homo sapiens
ctacttagctgg

SEQ ID NO: 5601284 - DNA, 20 bp, Homo sapiens
ctacttagctggccaaggag

SEQ ID NO: 5601285 - DNA, 14 bp, Homo sapiens
ctacttagggaaga

SEQ ID NO: 5601286 - DNA, 21 bp, Homo sapiens
ctacttagggaagaaaaagca

SEQ ID NO: 5601287 - DNA, 16 bp, Homo sapiens
ctacttagtaaaaatt

SEQ ID NO: 5601288 - DNA, 14 bp, Homo sapiens
ctacttatcatttt

SEQ ID NO: 5601289 - DNA, 13 bp, Homo sapiens
ctacttatttcag

SEQ ID NO: 5601290 - DNA, 16 bp, Homo sapiens
ctacttcaattagttc

SEQ ID NO: 5601291 - DNA, 19 bp, Homo sapiens
ctacttcatagctccttgg

SEQ ID NO: 5601292 - DNA, 17 bp, Homo sapiens
ctacttcattttcagag

SEQ ID NO: 5601293 - DNA, 23 bp, Homo sapiens
ctacttcattttcagagtgacac

SEQ ID NO: 5601294 - DNA, 22 bp, Homo sapiens
ctacttccccatggccctgagc

SEQ ID NO: 5601295 - DNA, 23 bp, Homo sapiens
ctacttccccatggccctgagcg

SEQ ID NO: 5601296 - DNA, 14 bp, Homo sapiens
ctacttcccctggg

SEQ ID NO: 5601297 - DNA, 20 bp, Homo sapiens
ctacttccccttcctaattc

SEQ ID NO: 5601298 - DNA, 16 bp, Homo sapiens
ctacttccctcaccca

SEQ ID NO: 5601299 - DNA, 22 bp, Homo sapiens
ctacttccctgccggaatgaac

SEQ ID NO: 5601300 - DNA, 14 bp, Homo sapiens
ctagaggagacagc

SEQ ID NO: 5601301 - DNA, 22 bp, Homo sapiens
ctagaggatgaaggctgtgaaa

SEQ ID NO: 5601302 - DNA, 18 bp, Homo sapiens
ctagaggcaacagtgttc

SEQ ID NO: 5601303 - DNA, 16 bp, Homo sapiens
ctagaggcaagcctgg

SEQ ID NO: 5601304 - DNA, 19 bp, Homo sapiens
ctagaggccacctatgcca

SEQ ID NO: 5601305 - DNA, 21 bp, Homo sapiens
ctagaggccagccccacccag

SEQ ID NO: 5601306 - DNA, 23 bp, Homo sapiens
ctagaggccagccccacccagga

SEQ ID NO: 5601307 - DNA, 23 bp, Homo sapiens
ctagaggctccagctctggcaca

SEQ ID NO: 5601308 - DNA, 17 bp, Homo sapiens
ctagaggctgcctgggc

SEQ ID NO: 5601309 - DNA, 15 bp, Homo sapiens
ctagaggctggcaag

SEQ ID NO: 5601310 - DNA, 19 bp, Homo sapiens
ctagagggacctctcccag

SEQ ID NO: 5601311 - DNA, 20 bp, Homo sapiens
ctagagggacctctcccagg

SEQ ID NO: 5601312 - DNA, 19 bp, Homo sapiens
ctagagggagaagactgtg

SEQ ID NO: 5601313 - DNA, 15 bp, Homo sapiens
ctagagggaggggcc

SEQ ID NO: 5601314 - DNA, 19 bp, Homo sapiens
ctagagggaggggcctagg

SEQ ID NO: 5601315 - DNA, 17 bp, Homo sapiens
ctagagggatccaccgc

SEQ ID NO: 5601316 - DNA, 22 bp, Homo sapiens
ctagagggcaggttagagacag

SEQ ID NO: 5601317 - DNA, 17 bp, Homo sapiens
ctagagggcccaaagct

SEQ ID NO: 5601318 - DNA, 18 bp, Homo sapiens
ctagagggcccatcaggc

SEQ ID NO: 5601319 - DNA, 22 bp, Homo sapiens
ctagagggcccatcaggcagtg

SEQ ID NO: 5601320 - DNA, 15 bp, Homo sapiens
ctagagggcgaggga

SEQ ID NO: 5601321 - DNA, 23 bp, Homo sapiens
ctagaggggacaagccaggccct

SEQ ID NO: 5601322 - DNA, 16 bp, Homo sapiens
ctagagggttcctgta

SEQ ID NO: 5601323 - DNA, 15 bp, Homo sapiens
ctagaggtcaggacg

SEQ ID NO: 5601324 - DNA, 20 bp, Homo sapiens
ctagaggtcaggacggctcc

SEQ ID NO: 5601325 - DNA, 19 bp, Homo sapiens
ctagaggtgagaaatttaa

SEQ ID NO: 5601326 - DNA, 13 bp, Homo sapiens
ctagaggtggcat

SEQ ID NO: 5601327 - DNA, 16 bp, Homo sapiens
ctagaggtgggcagct

SEQ ID NO: 5601328 - DNA, 20 bp, Homo sapiens
ctagaggtgggcagctgggc

SEQ ID NO: 5601329 - DNA, 20 bp, Homo sapiens
ctagaggtgttacagaggac

SEQ ID NO: 5601330 - DNA, 23 bp, Homo sapiens
ctagaggtgttacagaggaccct

SEQ ID NO: 5601331 - DNA, 15 bp, Homo sapiens
ctagaggttcaaaga

SEQ ID NO: 5601332 - DNA, 21 bp, Homo sapiens
ctagaggttctgggttttctg

SEQ ID NO: 5601333 - DNA, 16 bp, Homo sapiens
ctagagtagaggtata

SEQ ID NO: 5601334 - DNA, 14 bp, Homo sapiens
ctagagtcatgtga

SEQ ID NO: 5601335 - DNA, 15 bp, Homo sapiens
ctagagtccaaggtt

SEQ ID NO: 5601336 - DNA, 23 bp, Homo sapiens
ctagagtccaaggtttaaagagt

SEQ ID NO: 5601337 - DNA, 21 bp, Homo sapiens
ctagagtcccaggttggctct

SEQ ID NO: 5601338 - DNA, 20 bp, Homo sapiens
ctagagtctgaacagctgta

SEQ ID NO: 5601339 - DNA, 17 bp, Homo sapiens
ctagagtgatgactgct

SEQ ID NO: 5601340 - DNA, 14 bp, Homo sapiens
ctagagtggcagcc

SEQ ID NO: 5601341 - DNA, 16 bp, Homo sapiens
ctagagtgtagcctaa

SEQ ID NO: 5601342 - DNA, 16 bp, Homo sapiens
ctagagttaaaagtta

SEQ ID NO: 5601343 - DNA, 17 bp, Homo sapiens
ctagagttaaaagttag

SEQ ID NO: 5601344 - DNA, 17 bp, Homo sapiens
ctagagttagatatgtg

SEQ ID NO: 5601345 - DNA, 17 bp, Homo sapiens
ctagagttatcttcttt

SEQ ID NO: 5601346 - DNA, 20 bp, Homo sapiens
ctagagttatcttctttatt

SEQ ID NO: 5601347 - DNA, 18 bp, Homo sapiens
ctagagtttagctggaaa

SEQ ID NO: 5601348 - DNA, 18 bp, Homo sapiens
ctagagttttatagcctg

SEQ ID NO: 5601349 - DNA, 13 bp, Homo sapiens
ctagataaaaaga

SEQ ID NO: 5601350 - DNA, 21 bp, Homo sapiens
ctagataaaaggagagaaagc

SEQ ID NO: 5601351 - DNA, 12 bp, Homo sapiens
ctagataaaatg

SEQ ID NO: 5601352 - DNA, 21 bp, Homo sapiens
ctagataacttaaataattta

SEQ ID NO: 5601353 - DNA, 23 bp, Homo sapiens
ctagatacagaagcccatgtctt

SEQ ID NO: 5601354 - DNA, 15 bp, Homo sapiens
ctagatactcttatt

SEQ ID NO: 5601355 - DNA, 17 bp, Homo sapiens
ctagatagctattaaga

SEQ ID NO: 5601356 - DNA, 16 bp, Homo sapiens
ctagatagctgactca

SEQ ID NO: 5601357 - DNA, 23 bp, Homo sapiens
ctagatatcaatcagtaattaac

SEQ ID NO: 5601358 - DNA, 14 bp, Homo sapiens
ctagatatcgactt

SEQ ID NO: 5601359 - DNA, 21 bp, Homo sapiens
ctagatatcgacttgtttttg

SEQ ID NO: 5601360 - DNA, 24 bp, Homo sapiens
ctagatatgaatatatggcatttg

SEQ ID NO: 5601361 - DNA, 15 bp, Homo sapiens
ctagatatgagaaat

SEQ ID NO: 5601362 - DNA, 16 bp, Homo sapiens
ctagatatgagaaata

SEQ ID NO: 5601363 - DNA, 18 bp, Homo sapiens
ctagatcaaggagcccag

SEQ ID NO: 5601364 - DNA, 15 bp, Homo sapiens
ctagatcagatgctc

SEQ ID NO: 5601365 - DNA, 14 bp, Homo sapiens
ctagatcatttgtt

SEQ ID NO: 5601366 - DNA, 13 bp, Homo sapiens
ctagatccacaca

SEQ ID NO: 5601367 - DNA, 22 bp, Homo sapiens
ctagatccacgtgtggcctccg

SEQ ID NO: 5601368 - DNA, 10 bp, Homo sapiens
ctagatccag

SEQ ID NO: 5601369 - DNA, 14 bp, Homo sapiens
ctagatccagccca

SEQ ID NO: 5601370 - DNA, 15 bp, Homo sapiens
ctagatcctaagggt

SEQ ID NO: 5601371 - DNA, 16 bp, Homo sapiens
ctagatcctaagggtc

SEQ ID NO: 5601372 - DNA, 14 bp, Homo sapiens
ctagatcctgcacc

SEQ ID NO: 5601373 - DNA, 17 bp, Homo sapiens
ctagatcctgcacccca

SEQ ID NO: 5601374 - DNA, 20 bp, Homo sapiens
ctagatcctgcaccccagca

SEQ ID NO: 5601375 - DNA, 21 bp, Homo sapiens
ctagatctcctatttttcaga

SEQ ID NO: 5601376 - DNA, 14 bp, Homo sapiens
ctagatctcctgta

SEQ ID NO: 5601377 - DNA, 15 bp, Homo sapiens
ctagatgaagaaaga

SEQ ID NO: 5601378 - DNA, 13 bp, Homo sapiens
ctagatgacctca

SEQ ID NO: 5601379 - DNA, 16 bp, Homo sapiens
ctagatgacctcatta

SEQ ID NO: 5601380 - DNA, 21 bp, Homo sapiens
ctagatgagaattcagctgcc

SEQ ID NO: 5601381 - DNA, 22 bp, Homo sapiens
ctagatgagaattcagctgccc

SEQ ID NO: 5601382 - DNA, 20 bp, Homo sapiens
ctagatgattaaataagatt

SEQ ID NO: 5601383 - DNA, 21 bp, Homo sapiens
ctagatgattaaataagattc

SEQ ID NO: 5601384 - DNA, 23 bp, Homo sapiens
ctagatgattaaataagattcta

SEQ ID NO: 5601385 - DNA, 20 bp, Homo sapiens
ctagatgattttttgaaagt

SEQ ID NO: 5601386 - DNA, 21 bp, Homo sapiens
ctagatgattttttgaaagtt

SEQ ID NO: 5601387 - DNA, 15 bp, Homo sapiens
ctagatggctcctct

SEQ ID NO: 5601388 - DNA, 14 bp, Homo sapiens
ctagatgggttctt

SEQ ID NO: 5601389 - DNA, 14 bp, Homo sapiens
ctagatggtgctga

SEQ ID NO: 5601390 - DNA, 16 bp, Homo sapiens
ctagatggtgctgaga

SEQ ID NO: 5601391 - DNA, 19 bp, Homo sapiens
ctagatggtgctgagaagc

SEQ ID NO: 5601392 - DNA, 12 bp, Homo sapiens
ctagatggttcc

SEQ ID NO: 5601393 - DNA, 14 bp, Homo sapiens
ctagatgtaaattt

SEQ ID NO: 5601394 - DNA, 20 bp, Homo sapiens
ctagatgtttaacaaatcta

SEQ ID NO: 5601395 - DNA, 19 bp, Homo sapiens
ctagattaagatctgtgtt

SEQ ID NO: 5601396 - DNA, 23 bp, Homo sapiens
ctagattaagatctgtgttttag

SEQ ID NO: 5601397 - DNA, 11 bp, Homo sapiens
ctagattacag

SEQ ID NO: 5601398 - DNA, 15 bp, Homo sapiens
ctagattacatctgc

SEQ ID NO: 5601399 - DNA, 21 bp, Homo sapiens
ctagattaccccctcattgtt

SEQ ID NO: 5601400 - DNA, 17 bp, Homo sapiens
ctagattagaagtgttt

SEQ ID NO: 5601401 - DNA, 16 bp, Homo sapiens
ctagattatatcaaag

SEQ ID NO: 5601402 - DNA, 18 bp, Homo sapiens
ctagattattgaattctt

SEQ ID NO: 5601403 - DNA, 14 bp, Homo sapiens
ctagattcaaaggt

SEQ ID NO: 5601404 - DNA, 17 bp, Homo sapiens
ctagattcaaaggttct

SEQ ID NO: 5601405 - DNA, 18 bp, Homo sapiens
ctagattcaaaggttcta

SEQ ID NO: 5601406 - DNA, 14 bp, Homo sapiens
ctagattcagggaa

SEQ ID NO: 5601407 - DNA, 14 bp, Homo sapiens
ctagattcataaat

SEQ ID NO: 5601408 - DNA, 15 bp, Homo sapiens
ctagattcataaata

SEQ ID NO: 5601409 - DNA, 21 bp, Homo sapiens
ctagattcatggctttaacag

SEQ ID NO: 5601410 - DNA, 22 bp, Homo sapiens
ctagattccattggtccaagat

SEQ ID NO: 5601411 - DNA, 16 bp, Homo sapiens
ctagattctaacatat

SEQ ID NO: 5601412 - DNA, 20 bp, Homo sapiens
ctagattctacatattcttt

SEQ ID NO: 5601413 - DNA, 15 bp, Homo sapiens
ctagattctcacctg

SEQ ID NO: 5601414 - DNA, 15 bp, Homo sapiens
ctagatttataaatg

SEQ ID NO: 5601415 - DNA, 11 bp, Homo sapiens
ctagatttcta

SEQ ID NO: 5601416 - DNA, 14 bp, Homo sapiens
ctagatttgggaga

SEQ ID NO: 5601417 - DNA, 18 bp, Homo sapiens
ctagatttgtccttttat

SEQ ID NO: 5601418 - DNA, 13 bp, Homo sapiens
ctagattttcact

SEQ ID NO: 5601419 - DNA, 14 bp, Homo sapiens
ctagattttgaaaa

SEQ ID NO: 5601420 - DNA, 17 bp, Homo sapiens
ctagcaaaaaaactctt

SEQ ID NO: 5601421 - DNA, 15 bp, Homo sapiens
ctagcaaaagaagta

SEQ ID NO: 5601422 - DNA, 16 bp, Homo sapiens
ctagcaaaagtgcaag

SEQ ID NO: 5601423 - DNA, 17 bp, Homo sapiens
ctagcaaaataaaacat

SEQ ID NO: 5601424 - DNA, 15 bp, Homo sapiens
ctagcaaaggaaaat

SEQ ID NO: 5601425 - DNA, 15 bp, Homo sapiens
ctagcaaatacagga

SEQ ID NO: 5601426 - DNA, 15 bp, Homo sapiens
ctagcaaattagaaa

SEQ ID NO: 5601427 - DNA, 19 bp, Homo sapiens
ctagcaacatatctctgcc

SEQ ID NO: 5601428 - DNA, 13 bp, Homo sapiens
ctagcaagaagat

SEQ ID NO: 5601429 - DNA, 21 bp, Homo sapiens
ctagcaagaagattctaaaac

SEQ ID NO: 5601430 - DNA, 22 bp, Homo sapiens
ctagcaagaagattctaaaaca

SEQ ID NO: 5601431 - DNA, 18 bp, Homo sapiens
ctagcaatacagggaggc

SEQ ID NO: 5601432 - DNA, 20 bp, Homo sapiens
ctagcaatacagggaggctc

SEQ ID NO: 5601433 - DNA, 21 bp, Homo sapiens
ctagcaatacagggaggctcc

SEQ ID NO: 5601434 - DNA, 20 bp, Homo sapiens
ctagcaatcacaacactggc

SEQ ID NO: 5601435 - DNA, 15 bp, Homo sapiens
ctagcaatgcctgag

SEQ ID NO: 5601436 - DNA, 17 bp, Homo sapiens
ctagcaattttctttgt

SEQ ID NO: 5601437 - DNA, 12 bp, Homo sapiens
ctagcacacctg

SEQ ID NO: 5601438 - DNA, 12 bp, Homo sapiens
ctagcacagagg

SEQ ID NO: 5601439 - DNA, 14 bp, Homo sapiens
ctagcacagaggcc

SEQ ID NO: 5601440 - DNA, 15 bp, Homo sapiens
ctagcacagaggcct

SEQ ID NO: 5601441 - DNA, 15 bp, Homo sapiens
ctagcacagcagctt

SEQ ID NO: 5601442 - DNA, 16 bp, Homo sapiens
ctagcacagctccctt

SEQ ID NO: 5601443 - DNA, 17 bp, Homo sapiens
ctagcacagctcccttc

SEQ ID NO: 5601444 - DNA, 14 bp, Homo sapiens
ctagcacagctgtg

SEQ ID NO: 5601445 - DNA, 13 bp, Homo sapiens
ctagcacatgccc

SEQ ID NO: 5601446 - DNA, 20 bp, Homo sapiens
ctagcacatgcttcaatagt

SEQ ID NO: 5601447 - DNA, 12 bp, Homo sapiens
ctagcaccctgg

SEQ ID NO: 5601448 - DNA, 16 bp, Homo sapiens
ctagcaccctggagag

SEQ ID NO: 5601449 - DNA, 14 bp, Homo sapiens
ctagcacctccccc

SEQ ID NO: 5601450 - DNA, 18 bp, Homo sapiens
ctagcacctgccagggag

SEQ ID NO: 5601451 - DNA, 23 bp, Homo sapiens
ctagcacggacatggtctgtcct

SEQ ID NO: 5601452 - DNA, 16 bp, Homo sapiens
ctagcactcacatgct

SEQ ID NO: 5601453 - DNA, 21 bp, Homo sapiens
ctagcactcacatgctggaca

SEQ ID NO: 5601454 - DNA, 18 bp, Homo sapiens
ctagcactcattttctat

SEQ ID NO: 5601455 - DNA, 17 bp, Homo sapiens
ctagcactgccccacat

SEQ ID NO: 5601456 - DNA, 18 bp, Homo sapiens
ctagcactgccccacatg

SEQ ID NO: 5601457 - DNA, 21 bp, Homo sapiens
ctagcactgccccacatgcat

SEQ ID NO: 5601458 - DNA, 15 bp, Homo sapiens
ctagcactggcctgc

SEQ ID NO: 5601459 - DNA, 13 bp, Homo sapiens
ctagcacttcctt

SEQ ID NO: 5601460 - DNA, 14 bp, Homo sapiens
ctagcacttccttg

SEQ ID NO: 5601461 - DNA, 16 bp, Homo sapiens
ctagcacttggagcca

SEQ ID NO: 5601462 - DNA, 21 bp, Homo sapiens
ctagcactttgggaggccaag

SEQ ID NO: 5601463 - DNA, 17 bp, Homo sapiens
ctagcagaagacaaggc

SEQ ID NO: 5601464 - DNA, 11 bp, Homo sapiens
ctagcagagag

SEQ ID NO: 5601465 - DNA, 19 bp, Homo sapiens
ctagcagagcaggggcagg

SEQ ID NO: 5601466 - DNA, 13 bp, Homo sapiens
ctagcagagtgct

SEQ ID NO: 5601467 - DNA, 19 bp, Homo sapiens
ctagcagagtgctggcact

SEQ ID NO: 5601468 - DNA, 20 bp, Homo sapiens
ctagcagagtgctggcactt

SEQ ID NO: 5601469 - DNA, 20 bp, Homo sapiens
ctagcagcaccgttctgtgc

SEQ ID NO: 5601470 - DNA, 12 bp, Homo sapiens
ctagcagcaggg

SEQ ID NO: 5601471 - DNA, 22 bp, Homo sapiens
ctagcagcagggagggcttctg

SEQ ID NO: 5601472 - DNA, 20 bp, Homo sapiens
ctagcagcccaccctgctgc

SEQ ID NO: 5601473 - DNA, 14 bp, Homo sapiens
ctagcagcccttgt

SEQ ID NO: 5601474 - DNA, 24 bp, Homo sapiens
ctagcagcccttgtgtgtgccctg

SEQ ID NO: 5601475 - DNA, 14 bp, Homo sapiens
ctagcagctgcagt

SEQ ID NO: 5601476 - DNA, 13 bp, Homo sapiens
ctagcagctggcc

SEQ ID NO: 5601477 - DNA, 20 bp, Homo sapiens
ctagcaggaacttctagctc

SEQ ID NO: 5601478 - DNA, 22 bp, Homo sapiens
ctaggccaggtgcaaccaggga

SEQ ID NO: 5601479 - DNA, 13 bp, Homo sapiens
ctaggcccaggcc

SEQ ID NO: 5601480 - DNA, 18 bp, Homo sapiens
ctaggcccattgtcctcc

SEQ ID NO: 5601481 - DNA, 21 bp, Homo sapiens
ctaggcccattgtcctccttt

SEQ ID NO: 5601482 - DNA, 15 bp, Homo sapiens
ctaggccccagaggc

SEQ ID NO: 5601483 - DNA, 21 bp, Homo sapiens
ctaggccccagaggccctgga

SEQ ID NO: 5601484 - DNA, 15 bp, Homo sapiens
ctaggcccccaaatt

SEQ ID NO: 5601485 - DNA, 13 bp, Homo sapiens
ctaggcccccact

SEQ ID NO: 5601486 - DNA, 20 bp, Homo sapiens
ctaggcccccacttgcctct

SEQ ID NO: 5601487 - DNA, 21 bp, Homo sapiens
ctaggcccctcctagacccag

SEQ ID NO: 5601488 - DNA, 11 bp, Homo sapiens
ctaggccctac

SEQ ID NO: 5601489 - DNA, 16 bp, Homo sapiens
ctaggccctggtctgg

SEQ ID NO: 5601490 - DNA, 14 bp, Homo sapiens
ctaggccctgtgag

SEQ ID NO: 5601491 - DNA, 16 bp, Homo sapiens
ctaggccctgtgagca

SEQ ID NO: 5601492 - DNA, 17 bp, Homo sapiens
ctaggccctgtgagcac

SEQ ID NO: 5601493 - DNA, 16 bp, Homo sapiens
ctaggccggccagctc

SEQ ID NO: 5601494 - DNA, 18 bp, Homo sapiens
ctaggccggccagctccc

SEQ ID NO: 5601495 - DNA, 21 bp, Homo sapiens
ctaggcctcaactcctcccat

SEQ ID NO: 5601496 - DNA, 13 bp, Homo sapiens
ctaggcctcagcc

SEQ ID NO: 5601497 - DNA, 14 bp, Homo sapiens
ctaggcctcagtgt

SEQ ID NO: 5601498 - DNA, 17 bp, Homo sapiens
ctaggcctcctggccca

SEQ ID NO: 5601499 - DNA, 23 bp, Homo sapiens
ctaggcctgaaatgacatttcac

SEQ ID NO: 5601500 - DNA, 19 bp, Homo sapiens
ctaggcctggcatggcacc

SEQ ID NO: 5601501 - DNA, 19 bp, Homo sapiens
ctaggcctggccagatgca

SEQ ID NO: 5601502 - DNA, 21 bp, Homo sapiens
ctaggccttgcggctcctcag

SEQ ID NO: 5601503 - DNA, 17 bp, Homo sapiens
ctaggcctttcctctgc

SEQ ID NO: 5601504 - DNA, 21 bp, Homo sapiens
ctaggcctttcctctgcacgc

SEQ ID NO: 5601505 - DNA, 14 bp, Homo sapiens
ctaggcctttcctg

SEQ ID NO: 5601506 - DNA, 16 bp, Homo sapiens
ctaggcgggatgggct

SEQ ID NO: 5601507 - DNA, 15 bp, Homo sapiens
ctaggcgtgagaagc

SEQ ID NO: 5601508 - DNA, 20 bp, Homo sapiens
ctaggcgtggtggtgcatgc

SEQ ID NO: 5601509 - DNA, 13 bp, Homo sapiens
ctaggctaggacg

SEQ ID NO: 5601510 - DNA, 16 bp, Homo sapiens
ctaggctaggacgttg

SEQ ID NO: 5601511 - DNA, 15 bp, Homo sapiens
ctaggctagggtggg

SEQ ID NO: 5601512 - DNA, 12 bp, Homo sapiens
ctaggctcagag

SEQ ID NO: 5601513 - DNA, 13 bp, Homo sapiens
ctaggctcagaga

SEQ ID NO: 5601514 - DNA, 22 bp, Homo sapiens
ctaggctcagagatgtgcaccc

SEQ ID NO: 5601515 - DNA, 13 bp, Homo sapiens
ctaggctcctggg

SEQ ID NO: 5601516 - DNA, 18 bp, Homo sapiens
ctaggctcgccttccctc

SEQ ID NO: 5601517 - DNA, 20 bp, Homo sapiens
ctaggctcgccttccctcct

SEQ ID NO: 5601518 - DNA, 22 bp, Homo sapiens
ctaggctctgtctggaagatgg

SEQ ID NO: 5601519 - DNA, 18 bp, Homo sapiens
ctaggctgagatgcacca

SEQ ID NO: 5601520 - DNA, 15 bp, Homo sapiens
ctaggctgagtctag

SEQ ID NO: 5601521 - DNA, 23 bp, Homo sapiens
ctaggctgccccgggtccccagc

SEQ ID NO: 5601522 - DNA, 13 bp, Homo sapiens
ctaggctgctgca

SEQ ID NO: 5601523 - DNA, 14 bp, Homo sapiens
ctaggctgctgcac

SEQ ID NO: 5601524 - DNA, 15 bp, Homo sapiens
ctaggctggaagagc

SEQ ID NO: 5601525 - DNA, 19 bp, Homo sapiens
ctaggctggaagagccaaa

SEQ ID NO: 5601526 - DNA, 15 bp, Homo sapiens
ctaggctggaagcca

SEQ ID NO: 5601527 - DNA, 13 bp, Homo sapiens
ctaggctggaagg

SEQ ID NO: 5601528 - DNA, 15 bp, Homo sapiens
ctaggctggaaggag

SEQ ID NO: 5601529 - DNA, 19 bp, Homo sapiens
ctaggctggaaggaggaag

SEQ ID NO: 5601530 - DNA, 15 bp, Homo sapiens
ctaggctggagccca

SEQ ID NO: 5601531 - DNA, 13 bp, Homo sapiens
ctaggctggggaa

SEQ ID NO: 5601532 - DNA, 17 bp, Homo sapiens
ctaggctgggtgcccac

SEQ ID NO: 5601533 - DNA, 21 bp, Homo sapiens
ctaggcttaatacctgggtga

SEQ ID NO: 5601534 - DNA, 20 bp, Homo sapiens
ctaggcttcaggttgcattg

SEQ ID NO: 5601535 - DNA, 21 bp, Homo sapiens
ctaggcttcaggttgcattgg

SEQ ID NO: 5601536 - DNA, 19 bp, Homo sapiens
ctagggaaaaaccagcgtg

SEQ ID NO: 5601537 - DNA, 21 bp, Homo sapiens
ctagggaaaacacggccctcc

SEQ ID NO: 5601538 - DNA, 16 bp, Homo sapiens
ctagggaaatttttca

SEQ ID NO: 5601539 - DNA, 20 bp, Homo sapiens
ctagggaagaaagcagaaca

SEQ ID NO: 5601540 - DNA, 14 bp, Homo sapiens
ctagggaaggccac

SEQ ID NO: 5601541 - DNA, 17 bp, Homo sapiens
ctagggaaggccacctg

SEQ ID NO: 5601542 - DNA, 21 bp, Homo sapiens
ctagggaaggccacctgcagg

SEQ ID NO: 5601543 - DNA, 17 bp, Homo sapiens
ctagggaatctggatta

SEQ ID NO: 5601544 - DNA, 13 bp, Homo sapiens
ctagggaattcct

SEQ ID NO: 5601545 - DNA, 16 bp, Homo sapiens
ctagggacatgggaaa

SEQ ID NO: 5601546 - DNA, 15 bp, Homo sapiens
ctagggacccctcct

SEQ ID NO: 5601547 - DNA, 17 bp, Homo sapiens
ctagggacccctcctcc

SEQ ID NO: 5601548 - DNA, 20 bp, Homo sapiens
ctagggacccctcctccctt

SEQ ID NO: 5601549 - DNA, 20 bp, Homo sapiens
ctagggactatcaggtaata

SEQ ID NO: 5601550 - DNA, 14 bp, Homo sapiens
ctagggagagaccc

SEQ ID NO: 5601551 - DNA, 11 bp, Homo sapiens
ctagggagagg

SEQ ID NO: 5601552 - DNA, 22 bp, Homo sapiens
ctagggagagggaagagggaga

SEQ ID NO: 5601553 - DNA, 10 bp, Homo sapiens
ctagggagcc

SEQ ID NO: 5601554 - DNA, 14 bp, Homo sapiens
ctagggagccatgt

SEQ ID NO: 5601555 - DNA, 13 bp, Homo sapiens
ctagggaggctga

SEQ ID NO: 5601556 - DNA, 14 bp, Homo sapiens
ctagggaggctgag

SEQ ID NO: 5601557 - DNA, 16 bp, Homo sapiens
ctagggagtggtcttt

SEQ ID NO: 5601558 - DNA, 17 bp, Homo sapiens
ctagggatataaaaaca

SEQ ID NO: 5601559 - DNA, 17 bp, Homo sapiens
ctagggatccctcatct

SEQ ID NO: 5601560 - DNA, 13 bp, Homo sapiens
ctagggatctgaa

SEQ ID NO: 5601561 - DNA, 16 bp, Homo sapiens
ctagggatctgaaatc

SEQ ID NO: 5601562 - DNA, 16 bp, Homo sapiens
ctagggattcaggctg

SEQ ID NO: 5601563 - DNA, 17 bp, Homo sapiens
ctagggattcaggctgc

SEQ ID NO: 5601564 - DNA, 18 bp, Homo sapiens
ctagggcacaaagacttc

SEQ ID NO: 5601565 - DNA, 20 bp, Homo sapiens
ctagggcagggtgggagccg

SEQ ID NO: 5601566 - DNA, 18 bp, Homo sapiens
ctagggccaagcccagca

SEQ ID NO: 5601567 - DNA, 20 bp, Homo sapiens
ctagggcctcggaggctcct

SEQ ID NO: 5601568 - DNA, 22 bp, Homo sapiens
ctagggcctcggaggctcctcc

SEQ ID NO: 5601569 - DNA, 14 bp, Homo sapiens
ctagggctagtctt

SEQ ID NO: 5601570 - DNA, 18 bp, Homo sapiens
ctagggctcagaggggcc

SEQ ID NO: 5601571 - DNA, 15 bp, Homo sapiens
ctagggctctccaag

SEQ ID NO: 5601572 - DNA, 13 bp, Homo sapiens
ctagggctgagca

SEQ ID NO: 5601573 - DNA, 16 bp, Homo sapiens
ctagggctgctgcttc

SEQ ID NO: 5601574 - DNA, 17 bp, Homo sapiens
ctagggctgctgcttct

SEQ ID NO: 5601575 - DNA, 16 bp, Homo sapiens
ctaggggaacagacca

SEQ ID NO: 5601576 - DNA, 22 bp, Homo sapiens
ctaggggaacagaccagtgacc

SEQ ID NO: 5601577 - DNA, 17 bp, Homo sapiens
ctaggggaaggactggc

SEQ ID NO: 5601578 - DNA, 12 bp, Homo sapiens
ctaggggaaggg

SEQ ID NO: 5601579 - DNA, 13 bp, Homo sapiens
ctaggggaatgag

SEQ ID NO: 5601580 - DNA, 14 bp, Homo sapiens
ctaggggaatgagg

SEQ ID NO: 5601581 - DNA, 19 bp, Homo sapiens
ctaggggaatgagggggct

SEQ ID NO: 5601582 - DNA, 17 bp, Homo sapiens
ctaggggagaagagccc

SEQ ID NO: 5601583 - DNA, 12 bp, Homo sapiens
ctaggggaggag

SEQ ID NO: 5601584 - DNA, 15 bp, Homo sapiens
ctaggggagggggga

SEQ ID NO: 5601585 - DNA, 17 bp, Homo sapiens
ctaggggaggggggagc

SEQ ID NO: 5601586 - DNA, 20 bp, Homo sapiens
ctaggggaggggggagccag

SEQ ID NO: 5601587 - DNA, 22 bp, Homo sapiens
ctaggggaggggggagccagag

SEQ ID NO: 5601588 - DNA, 14 bp, Homo sapiens
ctaggggatgaggg

SEQ ID NO: 5601589 - DNA, 12 bp, Homo sapiens
ctaggggcagcc

SEQ ID NO: 5601590 - DNA, 15 bp, Homo sapiens
ctaggggcaggtgaa

SEQ ID NO: 5601591 - DNA, 11 bp, Homo sapiens
ctaggggctgg

SEQ ID NO: 5601592 - DNA, 15 bp, Homo sapiens
ctaggggctggggcc

SEQ ID NO: 5601593 - DNA, 14 bp, Homo sapiens
ctaggggctggtcc

SEQ ID NO: 5601594 - DNA, 16 bp, Homo sapiens
ctagggggacggggct

SEQ ID NO: 5601595 - DNA, 18 bp, Homo sapiens
ctagggggacggggctga

SEQ ID NO: 5601596 - DNA, 21 bp, Homo sapiens
ctaggggggtcagccagccct

SEQ ID NO: 5601597 - DNA, 23 bp, Homo sapiens
ctaggggggtcagccagccctct

SEQ ID NO: 5601598 - DNA, 16 bp, Homo sapiens
ctagggggtgtcagaa

SEQ ID NO: 5601599 - DNA, 15 bp, Homo sapiens
ctaggggtcactgta

SEQ ID NO: 5601600 - DNA, 16 bp, Homo sapiens
ctaggggtcaggctcc

SEQ ID NO: 5601601 - DNA, 18 bp, Homo sapiens
ctaggggtcaggctccat

SEQ ID NO: 5601602 - DNA, 23 bp, Homo sapiens
ctaggggtgcgctcacctgcagc

SEQ ID NO: 5601603 - DNA, 18 bp, Homo sapiens
ctaggggtttcacctgca

SEQ ID NO: 5601604 - DNA, 15 bp, Homo sapiens
ctaggggtttctgtt

SEQ ID NO: 5601605 - DNA, 18 bp, Homo sapiens
ctagggtcccccttcgtg

SEQ ID NO: 5601606 - DNA, 22 bp, Homo sapiens
ctagggtcccccttcgtggagc

SEQ ID NO: 5601607 - DNA, 18 bp, Homo sapiens
ctagggtcctcaggcagt

SEQ ID NO: 5601608 - DNA, 21 bp, Homo sapiens
ctagggtctgataggaacaga

SEQ ID NO: 5601609 - DNA, 21 bp, Homo sapiens
ctagggtgaggtttagccatc

SEQ ID NO: 5601610 - DNA, 15 bp, Homo sapiens
ctagggtgcctgctc

SEQ ID NO: 5601611 - DNA, 16 bp, Homo sapiens
ctagggtgcctgctct

SEQ ID NO: 5601612 - DNA, 13 bp, Homo sapiens
ctagggtggccct

SEQ ID NO: 5601613 - DNA, 20 bp, Homo sapiens
ctagggtgggaaggggctag

SEQ ID NO: 5601614 - DNA, 15 bp, Homo sapiens
ctagggtggggagag

SEQ ID NO: 5601615 - DNA, 15 bp, Homo sapiens
ctagggtttcttaaa

SEQ ID NO: 5601616 - DNA, 15 bp, Homo sapiens
ctagggttttggcct

SEQ ID NO: 5601617 - DNA, 17 bp, Homo sapiens
ctagggttttggcctgc

SEQ ID NO: 5601618 - DNA, 22 bp, Homo sapiens
ctaggtaaattacagttcctag

SEQ ID NO: 5601619 - DNA, 18 bp, Homo sapiens
ctaggtaatgttttgtat

SEQ ID NO: 5601620 - DNA, 20 bp, Homo sapiens
ctaggtaatgttttgtatat

SEQ ID NO: 5601621 - DNA, 22 bp, Homo sapiens
ctaggtaatgttttgtatatac

SEQ ID NO: 5601622 - DNA, 20 bp, Homo sapiens
ctaggtaatttttacagaat

SEQ ID NO: 5601623 - DNA, 21 bp, Homo sapiens
ctaggtacataagttaaatga

SEQ ID NO: 5601624 - DNA, 14 bp, Homo sapiens
ctaggtacgatgac

SEQ ID NO: 5601625 - DNA, 14 bp, Homo sapiens
ctaggtacttcagg

SEQ ID NO: 5601626 - DNA, 17 bp, Homo sapiens
ctaggtagaaaaagggt

SEQ ID NO: 5601627 - DNA, 18 bp, Homo sapiens
ctaggtagaaaaagggtc

SEQ ID NO: 5601628 - DNA, 18 bp, Homo sapiens
ctaggtagaggcatttgt

SEQ ID NO: 5601629 - DNA, 20 bp, Homo sapiens
ctaggtagaggcatttgtct

SEQ ID NO: 5601630 - DNA, 17 bp, Homo sapiens
ctaggtagagtctgagg

SEQ ID NO: 5601631 - DNA, 14 bp, Homo sapiens
ctaggtaggaagag

SEQ ID NO: 5601632 - DNA, 16 bp, Homo sapiens
ctaggtaggcttctac

SEQ ID NO: 5601633 - DNA, 20 bp, Homo sapiens
ctaggtaggcttctacctgc

SEQ ID NO: 5601634 - DNA, 20 bp, Homo sapiens
ctaggtatcattcaactctc

SEQ ID NO: 5601635 - DNA, 14 bp, Homo sapiens
ctaggtatgaagta

SEQ ID NO: 5601636 - DNA, 15 bp, Homo sapiens
ctaggtcaaggcctg

SEQ ID NO: 5601637 - DNA, 19 bp, Homo sapiens
ctaggtcaaggcctgtccc

SEQ ID NO: 5601638 - DNA, 19 bp, Homo sapiens
ctaggtcacgttggccctc

SEQ ID NO: 5601639 - DNA, 22 bp, Homo sapiens
ctaggtcagtacccacctgagc

SEQ ID NO: 5601640 - DNA, 23 bp, Homo sapiens
ctaggtcatgaaggacactctgc

SEQ ID NO: 5601641 - DNA, 16 bp, Homo sapiens
ctaggtcatttgtaga

SEQ ID NO: 5601642 - DNA, 14 bp, Homo sapiens
ctaggtcccttccc

SEQ ID NO: 5601643 - DNA, 16 bp, Homo sapiens
ctaggtcgccagtgaa

SEQ ID NO: 5601644 - DNA, 22 bp, Homo sapiens
ctaggtcgccagtgaaatagaa

SEQ ID NO: 5601645 - DNA, 14 bp, Homo sapiens
ctaggtctccaccc

SEQ ID NO: 5601646 - DNA, 15 bp, Homo sapiens
ctaggtctgctcctg

SEQ ID NO: 5601647 - DNA, 20 bp, Homo sapiens
ctaggtgaacagcaggatgc

SEQ ID NO: 5601648 - DNA, 14 bp, Homo sapiens
ctaggtgacagagt

SEQ ID NO: 5601649 - DNA, 16 bp, Homo sapiens
ctaggtgacatgtcta

SEQ ID NO: 5601650 - DNA, 13 bp, Homo sapiens
ctaggtgcagctc

SEQ ID NO: 5601651 - DNA, 17 bp, Homo sapiens
ctaggtgcccagggcca

SEQ ID NO: 5601652 - DNA, 23 bp, Homo sapiens
ctaggtgccttttgtttttggct

SEQ ID NO: 5601653 - DNA, 19 bp, Homo sapiens
ctaggtgctaaaattcaga

SEQ ID NO: 5601654 - DNA, 11 bp, Homo sapiens
ctaggtgctca

SEQ ID NO: 5601655 - DNA, 19 bp, Homo sapiens
ctaggtgctcataactaga

SEQ ID NO: 5601656 - DNA, 18 bp, Homo sapiens
ctaggtgctgcagcccct

SEQ ID NO: 5601657 - DNA, 23 bp, Homo sapiens
ctatataggaaactaagcattgt

SEQ ID NO: 5601658 - DNA, 19 bp, Homo sapiens
ctatatagtacctttgctc

SEQ ID NO: 5601659 - DNA, 21 bp, Homo sapiens
ctatatagttccttgccttaa

SEQ ID NO: 5601660 - DNA, 22 bp, Homo sapiens
ctatatagtttattgacaataa

SEQ ID NO: 5601661 - DNA, 10 bp, Homo sapiens
ctatatataa

SEQ ID NO: 5601662 - DNA, 15 bp, Homo sapiens
ctatatataaaacgg

SEQ ID NO: 5601663 - DNA, 16 bp, Homo sapiens
ctatatataaagacaa

SEQ ID NO: 5601664 - DNA, 23 bp, Homo sapiens
ctatatataaagacaacaaaaga

SEQ ID NO: 5601665 - DNA, 16 bp, Homo sapiens
ctatatataattctgt

SEQ ID NO: 5601666 - DNA, 19 bp, Homo sapiens
ctatatataattctgtaca

SEQ ID NO: 5601667 - DNA, 14 bp, Homo sapiens
ctatatataatttg

SEQ ID NO: 5601668 - DNA, 22 bp, Homo sapiens
ctatatataatttgagtgtata

SEQ ID NO: 5601669 - DNA, 19 bp, Homo sapiens
ctatatatacatgtatagt

SEQ ID NO: 5601670 - DNA, 14 bp, Homo sapiens
ctatatatataaat

SEQ ID NO: 5601671 - DNA, 16 bp, Homo sapiens
ctatatatataaatgt

SEQ ID NO: 5601672 - DNA, 17 bp, Homo sapiens
ctatatatataaatgta

SEQ ID NO: 5601673 - DNA, 13 bp, Homo sapiens
ctatatatataat

SEQ ID NO: 5601674 - DNA, 22 bp, Homo sapiens
ctatatatatatatatatgtat

SEQ ID NO: 5601675 - DNA, 18 bp, Homo sapiens
ctatatatatatgccttt

SEQ ID NO: 5601676 - DNA, 23 bp, Homo sapiens
ctatatatgaataattatgttta

SEQ ID NO: 5601677 - DNA, 12 bp, Homo sapiens
ctatatatttct

SEQ ID NO: 5601678 - DNA, 16 bp, Homo sapiens
ctatatattttatgat

SEQ ID NO: 5601679 - DNA, 21 bp, Homo sapiens
ctatatcaataaattccatgt

SEQ ID NO: 5601680 - DNA, 14 bp, Homo sapiens
ctatatcatatttc

SEQ ID NO: 5601681 - DNA, 18 bp, Homo sapiens
ctatatcatatttctgtg

SEQ ID NO: 5601682 - DNA, 23 bp, Homo sapiens
ctatatccaaaattcagggcttt

SEQ ID NO: 5601683 - DNA, 16 bp, Homo sapiens
ctatatccatgtactg

SEQ ID NO: 5601684 - DNA, 19 bp, Homo sapiens
ctatatccatgtactgtag

SEQ ID NO: 5601685 - DNA, 18 bp, Homo sapiens
ctatatcctccttctcct

SEQ ID NO: 5601686 - DNA, 17 bp, Homo sapiens
ctatatcctgtgactgt

SEQ ID NO: 5601687 - DNA, 19 bp, Homo sapiens
ctatatctataaacactgt

SEQ ID NO: 5601688 - DNA, 14 bp, Homo sapiens
ctatatctctaaac

SEQ ID NO: 5601689 - DNA, 14 bp, Homo sapiens
ctatatctgagaga

SEQ ID NO: 5601690 - DNA, 20 bp, Homo sapiens
ctatatctgtatataaaata

SEQ ID NO: 5601691 - DNA, 18 bp, Homo sapiens
ctatatctgtttgtatat

SEQ ID NO: 5601692 - DNA, 21 bp, Homo sapiens
ctatatctgtttgtatatttg

SEQ ID NO: 5601693 - DNA, 13 bp, Homo sapiens
ctatatctgtttt

SEQ ID NO: 5601694 - DNA, 19 bp, Homo sapiens
ctatatctttaaataaatg

SEQ ID NO: 5601695 - DNA, 17 bp, Homo sapiens
ctatatgagaagaatag

SEQ ID NO: 5601696 - DNA, 22 bp, Homo sapiens
ctatatgatcctgaaaaaatga

SEQ ID NO: 5601697 - DNA, 21 bp, Homo sapiens
ctatatgcacccctggaacca

SEQ ID NO: 5601698 - DNA, 17 bp, Homo sapiens
ctatatgcagtctcttt

SEQ ID NO: 5601699 - DNA, 16 bp, Homo sapiens
ctatatgcatttaatt

SEQ ID NO: 5601700 - DNA, 20 bp, Homo sapiens
ctatatgcatttaattctga

SEQ ID NO: 5601701 - DNA, 21 bp, Homo sapiens
ctatatggcaaatagccacaa

SEQ ID NO: 5601702 - DNA, 16 bp, Homo sapiens
ctatatggtttttcca

SEQ ID NO: 5601703 - DNA, 13 bp, Homo sapiens
ctatatgtaactt

SEQ ID NO: 5601704 - DNA, 20 bp, Homo sapiens
ctatatgtaacttcagatgt

SEQ ID NO: 5601705 - DNA, 21 bp, Homo sapiens
ctatatgtacagctctcccct

SEQ ID NO: 5601706 - DNA, 21 bp, Homo sapiens
ctatatgtagtataaagaaaa

SEQ ID NO: 5601707 - DNA, 22 bp, Homo sapiens
ctatatgtagtgcatttttaaa

SEQ ID NO: 5601708 - DNA, 10 bp, Homo sapiens
ctatatgtat

SEQ ID NO: 5601709 - DNA, 12 bp, Homo sapiens
ctatatgtgaat

SEQ ID NO: 5601710 - DNA, 21 bp, Homo sapiens
ctatattaaaggtatacaaat

SEQ ID NO: 5601711 - DNA, 13 bp, Homo sapiens
ctatattaaagtg

SEQ ID NO: 5601712 - DNA, 13 bp, Homo sapiens
ctatattaaatga

SEQ ID NO: 5601713 - DNA, 19 bp, Homo sapiens
ctatattaaatgagggttt

SEQ ID NO: 5601714 - DNA, 12 bp, Homo sapiens
ctatattaaatt

SEQ ID NO: 5601715 - DNA, 14 bp, Homo sapiens
ctatattaactttt

SEQ ID NO: 5601716 - DNA, 13 bp, Homo sapiens
ctatattaatcac

SEQ ID NO: 5601717 - DNA, 15 bp, Homo sapiens
ctatattagctgaaa

SEQ ID NO: 5601718 - DNA, 18 bp, Homo sapiens
ctatattatcataagaat

SEQ ID NO: 5601719 - DNA, 21 bp, Homo sapiens
ctatattatcataagaatttt

SEQ ID NO: 5601720 - DNA, 12 bp, Homo sapiens
ctatattatgtc

SEQ ID NO: 5601721 - DNA, 16 bp, Homo sapiens
ctatattattatatat

SEQ ID NO: 5601722 - DNA, 17 bp, Homo sapiens
ctatattattatatata

SEQ ID NO: 5601723 - DNA, 18 bp, Homo sapiens
ctatattattatatatat

SEQ ID NO: 5601724 - DNA, 12 bp, Homo sapiens
ctatattctata

SEQ ID NO: 5601725 - DNA, 14 bp, Homo sapiens
ctatattgatttaa

SEQ ID NO: 5601726 - DNA, 15 bp, Homo sapiens
ctatattgatttaaa

SEQ ID NO: 5601727 - DNA, 19 bp, Homo sapiens
ctatattgatttaaaagtg

SEQ ID NO: 5601728 - DNA, 14 bp, Homo sapiens
ctatattgcagtgt

SEQ ID NO: 5601729 - DNA, 14 bp, Homo sapiens
ctatattgcccagg

SEQ ID NO: 5601730 - DNA, 19 bp, Homo sapiens
ctatattgcccaggctggt

SEQ ID NO: 5601731 - DNA, 19 bp, Homo sapiens
ctatattgtttgctaagca

SEQ ID NO: 5601732 - DNA, 16 bp, Homo sapiens
ctatatttaacaagat

SEQ ID NO: 5601733 - DNA, 13 bp, Homo sapiens
ctatatttaagta

SEQ ID NO: 5601734 - DNA, 22 bp, Homo sapiens
ctatatttaagtattcaagaaa

SEQ ID NO: 5601735 - DNA, 22 bp, Homo sapiens
ctatatttaataccaccaacaa

SEQ ID NO: 5601736 - DNA, 13 bp, Homo sapiens
ctatatttacaaa

SEQ ID NO: 5601737 - DNA, 12 bp, Homo sapiens
ctatatttacag

SEQ ID NO: 5601738 - DNA, 13 bp, Homo sapiens
ctatatttactgt

SEQ ID NO: 5601739 - DNA, 15 bp, Homo sapiens
ctatatttcagtgac

SEQ ID NO: 5601740 - DNA, 14 bp, Homo sapiens
ctatatttcatatt

SEQ ID NO: 5601741 - DNA, 16 bp, Homo sapiens
ctatatttcatattga

SEQ ID NO: 5601742 - DNA, 23 bp, Homo sapiens
ctatatttgattatgtatggata

SEQ ID NO: 5601743 - DNA, 23 bp, Homo sapiens
ctatatttgctagactctagaca

SEQ ID NO: 5601744 - DNA, 17 bp, Homo sapiens
ctatatttggattcaca

SEQ ID NO: 5601745 - DNA, 23 bp, Homo sapiens
ctatatttggattcacagccttt

SEQ ID NO: 5601746 - DNA, 22 bp, Homo sapiens
ctatatttgggcctgctccaga

SEQ ID NO: 5601747 - DNA, 21 bp, Homo sapiens
ctatatttgtaactttgcatg

SEQ ID NO: 5601748 - DNA, 22 bp, Homo sapiens
ctatatttgtatatattttata

SEQ ID NO: 5601749 - DNA, 14 bp, Homo sapiens
ctatatttgtcttc

SEQ ID NO: 5601750 - DNA, 15 bp, Homo sapiens
ctatatttgtcttcc

SEQ ID NO: 5601751 - DNA, 16 bp, Homo sapiens
ctatatttgtcttccg

SEQ ID NO: 5601752 - DNA, 20 bp, Homo sapiens
ctatatttgtgctatttaat

SEQ ID NO: 5601753 - DNA, 16 bp, Homo sapiens
ctatattttaatagaa

SEQ ID NO: 5601754 - DNA, 17 bp, Homo sapiens
ctatattttacataaat

SEQ ID NO: 5601755 - DNA, 18 bp, Homo sapiens
ctatattttcccttatta

SEQ ID NO: 5601756 - DNA, 13 bp, Homo sapiens
ctatattttcctg

SEQ ID NO: 5601757 - DNA, 14 bp, Homo sapiens
ctatattttcctga

SEQ ID NO: 5601758 - DNA, 15 bp, Homo sapiens
ctatattttgtcata

SEQ ID NO: 5601759 - DNA, 16 bp, Homo sapiens
ctatatttttatataa

SEQ ID NO: 5601760 - DNA, 19 bp, Homo sapiens
ctatatttttctcaatgtt

SEQ ID NO: 5601761 - DNA, 21 bp, Homo sapiens
ctatatttttgggaggagcca

SEQ ID NO: 5601762 - DNA, 16 bp, Homo sapiens
ctatattttttaaatt

SEQ ID NO: 5601763 - DNA, 20 bp, Homo sapiens
ctatattttttgttaaatga

SEQ ID NO: 5601764 - DNA, 22 bp, Homo sapiens
ctatattttttgttaaatgatt

SEQ ID NO: 5601765 - DNA, 15 bp, Homo sapiens
ctatcaaaaactgac

SEQ ID NO: 5601766 - DNA, 18 bp, Homo sapiens
ctatcaaaaactgacttt

SEQ ID NO: 5601767 - DNA, 23 bp, Homo sapiens
ctatcaaaaactgactttattta

SEQ ID NO: 5601768 - DNA, 15 bp, Homo sapiens
ctatcaaaacatatc

SEQ ID NO: 5601769 - DNA, 17 bp, Homo sapiens
ctatcaaaacatatcaa

SEQ ID NO: 5601770 - DNA, 19 bp, Homo sapiens
ctatcaaaacatatcaatt

SEQ ID NO: 5601771 - DNA, 21 bp, Homo sapiens
ctatcaaactgaagccagaaa

SEQ ID NO: 5601772 - DNA, 16 bp, Homo sapiens
ctatcaaatgaaactc

SEQ ID NO: 5601773 - DNA, 16 bp, Homo sapiens
ctatcaacattgaata

SEQ ID NO: 5601774 - DNA, 17 bp, Homo sapiens
ctatcaaccccagacac

SEQ ID NO: 5601775 - DNA, 19 bp, Homo sapiens
ctatcaaccccagacactg

SEQ ID NO: 5601776 - DNA, 21 bp, Homo sapiens
ctatcaaccccagacactggt

SEQ ID NO: 5601777 - DNA, 20 bp, Homo sapiens
ctatcaagagagtaaacaga

SEQ ID NO: 5601778 - DNA, 15 bp, Homo sapiens
ctatcaagcccaggt

SEQ ID NO: 5601779 - DNA, 15 bp, Homo sapiens
ctatcaagtcaatca

SEQ ID NO: 5601780 - DNA, 14 bp, Homo sapiens
ctatcaatagtcaa

SEQ ID NO: 5601781 - DNA, 20 bp, Homo sapiens
ctatcaatagtcaagaaaaa

SEQ ID NO: 5601782 - DNA, 13 bp, Homo sapiens
ctatcaatattta

SEQ ID NO: 5601783 - DNA, 15 bp, Homo sapiens
ctatcaatatttaag

SEQ ID NO: 5601784 - DNA, 22 bp, Homo sapiens
ctatcaatccaaattccctctg

SEQ ID NO: 5601785 - DNA, 11 bp, Homo sapiens
ctatcaatgag

SEQ ID NO: 5601786 - DNA, 13 bp, Homo sapiens
ctatcaatgagtt

SEQ ID NO: 5601787 - DNA, 13 bp, Homo sapiens
ctatcaattttaa

SEQ ID NO: 5601788 - DNA, 14 bp, Homo sapiens
ctatcacacagtgg

SEQ ID NO: 5601789 - DNA, 16 bp, Homo sapiens
ctatcacatgtgaaaa

SEQ ID NO: 5601790 - DNA, 20 bp, Homo sapiens
ctatcaccaaaagacgaggc

SEQ ID NO: 5601791 - DNA, 14 bp, Homo sapiens
ctatcaccagtgca

SEQ ID NO: 5601792 - DNA, 18 bp, Homo sapiens
ctatcaccagtgcatcac

SEQ ID NO: 5601793 - DNA, 17 bp, Homo sapiens
ctatcacctatttccat

SEQ ID NO: 5601794 - DNA, 11 bp, Homo sapiens
ctatcacctgt

SEQ ID NO: 5601795 - DNA, 15 bp, Homo sapiens
ctatcacgagccttt

SEQ ID NO: 5601796 - DNA, 14 bp, Homo sapiens
ctatcactgcatta

SEQ ID NO: 5601797 - DNA, 23 bp, Homo sapiens
ctatcactgcattatcttgctca

SEQ ID NO: 5601798 - DNA, 18 bp, Homo sapiens
ctatcactggcaatattt

SEQ ID NO: 5601799 - DNA, 17 bp, Homo sapiens
ctatcactggtttggtt

SEQ ID NO: 5601800 - DNA, 13 bp, Homo sapiens
ctatcactgtctt

SEQ ID NO: 5601801 - DNA, 13 bp, Homo sapiens
ctatcacttacat

SEQ ID NO: 5601802 - DNA, 14 bp, Homo sapiens
ctatcagaaataca

SEQ ID NO: 5601803 - DNA, 18 bp, Homo sapiens
ctatcagagaagcagcat

SEQ ID NO: 5601804 - DNA, 20 bp, Homo sapiens
ctatcagagaagcagcatca

SEQ ID NO: 5601805 - DNA, 20 bp, Homo sapiens
ctatcagagcctctcccaca

SEQ ID NO: 5601806 - DNA, 21 bp, Homo sapiens
ctatcagaggtgaaagctata

SEQ ID NO: 5601807 - DNA, 14 bp, Homo sapiens
ctatcagcaatact

SEQ ID NO: 5601808 - DNA, 22 bp, Homo sapiens
ctatcagcaatactcatcagag

SEQ ID NO: 5601809 - DNA, 22 bp, Homo sapiens
ctatcagcagcggcagcagcag

SEQ ID NO: 5601810 - DNA, 13 bp, Homo sapiens
ctatcagccttgc

SEQ ID NO: 5601811 - DNA, 16 bp, Homo sapiens
ctatcaggagtccact

SEQ ID NO: 5601812 - DNA, 18 bp, Homo sapiens
ctatcaggagtccactgc

SEQ ID NO: 5601813 - DNA, 12 bp, Homo sapiens
ctatcaggcaga

SEQ ID NO: 5601814 - DNA, 19 bp, Homo sapiens
ctatcaggcagaagaatct

SEQ ID NO: 5601815 - DNA, 16 bp, Homo sapiens
ctatcagggaggaaga

SEQ ID NO: 5601816 - DNA, 16 bp, Homo sapiens
ctatcagggcaagctc

SEQ ID NO: 5601817 - DNA, 17 bp, Homo sapiens
ctatcagggcaagctca

SEQ ID NO: 5601818 - DNA, 14 bp, Homo sapiens
ctatcagtactttt

SEQ ID NO: 5601819 - DNA, 17 bp, Homo sapiens
ctatcagtgacttctga

SEQ ID NO: 5601820 - DNA, 14 bp, Homo sapiens
ctatcagtgctttg

SEQ ID NO: 5601821 - DNA, 12 bp, Homo sapiens
ctatcagtgtgc

SEQ ID NO: 5601822 - DNA, 23 bp, Homo sapiens
ctatcagtgtgccccccatcctg

SEQ ID NO: 5601823 - DNA, 19 bp, Homo sapiens
ctatcagtgttcttctcaa

SEQ ID NO: 5601824 - DNA, 20 bp, Homo sapiens
ctatcagttgatttttctta

SEQ ID NO: 5601825 - DNA, 23 bp, Homo sapiens
ctatcagttttatagctttattt

SEQ ID NO: 5601826 - DNA, 17 bp, Homo sapiens
ctatcatagttaacata

SEQ ID NO: 5601827 - DNA, 14 bp, Homo sapiens
ctatcatatgaaga

SEQ ID NO: 5601828 - DNA, 18 bp, Homo sapiens
ctatcatatgaagataac

SEQ ID NO: 5601829 - DNA, 14 bp, Homo sapiens
ctatcatggtgaaa

SEQ ID NO: 5601830 - DNA, 13 bp, Homo sapiens
ctatcattctcag

SEQ ID NO: 5601831 - DNA, 15 bp, Homo sapiens
ctatcattctcagtg

SEQ ID NO: 5601832 - DNA, 13 bp, Homo sapiens
ctatcatttaata

SEQ ID NO: 5601833 - DNA, 12 bp, Homo sapiens
ctatcatttatt

SEQ ID NO: 5601834 - DNA, 23 bp, Homo sapiens
ctatcatttattggatgggtggg

SEQ ID NO: 5601835 - DNA, 20 bp, Homo sapiens
ctatcatttccgttttgcct

SEQ ID NO: 5601836 - DNA, 15 bp, Homo sapiens
ctatggtgaggtgtg

SEQ ID NO: 5601837 - DNA, 17 bp, Homo sapiens
ctatggtgctctgtcta

SEQ ID NO: 5601838 - DNA, 18 bp, Homo sapiens
ctatggttcccaataaaa

SEQ ID NO: 5601839 - DNA, 20 bp, Homo sapiens
ctatggttgccaccccaacc

SEQ ID NO: 5601840 - DNA, 19 bp, Homo sapiens
ctatggtttgccattattt

SEQ ID NO: 5601841 - DNA, 11 bp, Homo sapiens
ctatggttttt

SEQ ID NO: 5601842 - DNA, 13 bp, Homo sapiens
ctatgtaaactac

SEQ ID NO: 5601843 - DNA, 11 bp, Homo sapiens
ctatgtaaatt

SEQ ID NO: 5601844 - DNA, 13 bp, Homo sapiens
ctatgtaaattat

SEQ ID NO: 5601845 - DNA, 17 bp, Homo sapiens
ctatgtaaattattgta

SEQ ID NO: 5601846 - DNA, 21 bp, Homo sapiens
ctatgtaaattattgtaaact

SEQ ID NO: 5601847 - DNA, 18 bp, Homo sapiens
ctatgtaacaaacctgca

SEQ ID NO: 5601848 - DNA, 18 bp, Homo sapiens
ctatgtaagggctttaaa

SEQ ID NO: 5601849 - DNA, 21 bp, Homo sapiens
ctatgtaagggctttaaataa

SEQ ID NO: 5601850 - DNA, 18 bp, Homo sapiens
ctatgtaataatgtacag

SEQ ID NO: 5601851 - DNA, 21 bp, Homo sapiens
ctatgtaatttttaaagcaaa

SEQ ID NO: 5601852 - DNA, 16 bp, Homo sapiens
ctatgtacagagcttt

SEQ ID NO: 5601853 - DNA, 19 bp, Homo sapiens
ctatgtacagagctttctt

SEQ ID NO: 5601854 - DNA, 15 bp, Homo sapiens
ctatgtagaatgtct

SEQ ID NO: 5601855 - DNA, 16 bp, Homo sapiens
ctatgtagaatgtctt

SEQ ID NO: 5601856 - DNA, 14 bp, Homo sapiens
ctatgtaggaaaaa

SEQ ID NO: 5601857 - DNA, 22 bp, Homo sapiens
ctatgtaggaaagaccattttt

SEQ ID NO: 5601858 - DNA, 16 bp, Homo sapiens
ctatgtagtcataata

SEQ ID NO: 5601859 - DNA, 19 bp, Homo sapiens
ctatgtagtgtctttattt

SEQ ID NO: 5601860 - DNA, 14 bp, Homo sapiens
ctatgtatatacat

SEQ ID NO: 5601861 - DNA, 18 bp, Homo sapiens
ctatgtatatcttctaca

SEQ ID NO: 5601862 - DNA, 16 bp, Homo sapiens
ctatgtatcaaatgta

SEQ ID NO: 5601863 - DNA, 17 bp, Homo sapiens
ctatgtatgtaaaatat

SEQ ID NO: 5601864 - DNA, 21 bp, Homo sapiens
ctatgtatgtgccaattttgt

SEQ ID NO: 5601865 - DNA, 15 bp, Homo sapiens
ctatgtattttgtga

SEQ ID NO: 5601866 - DNA, 16 bp, Homo sapiens
ctatgtatttttctat

SEQ ID NO: 5601867 - DNA, 14 bp, Homo sapiens
ctatgtcaattgat

SEQ ID NO: 5601868 - DNA, 20 bp, Homo sapiens
ctatgtcaattgatatttct

SEQ ID NO: 5601869 - DNA, 17 bp, Homo sapiens
ctatgtcaatttgtata

SEQ ID NO: 5601870 - DNA, 20 bp, Homo sapiens
ctatgtcactaccctcctgt

SEQ ID NO: 5601871 - DNA, 16 bp, Homo sapiens
ctatgtcatttcattt

SEQ ID NO: 5601872 - DNA, 22 bp, Homo sapiens
ctatgtcatttctactttgact

SEQ ID NO: 5601873 - DNA, 15 bp, Homo sapiens
ctatgtccaacagag

SEQ ID NO: 5601874 - DNA, 13 bp, Homo sapiens
ctatgtcccagcc

SEQ ID NO: 5601875 - DNA, 13 bp, Homo sapiens
ctatgtcccttgc

SEQ ID NO: 5601876 - DNA, 22 bp, Homo sapiens
ctatgtcctaaggacacactaa

SEQ ID NO: 5601877 - DNA, 19 bp, Homo sapiens
ctatgtcgtgttttcaagg

SEQ ID NO: 5601878 - DNA, 19 bp, Homo sapiens
ctatgtctctagcagtgag

SEQ ID NO: 5601879 - DNA, 11 bp, Homo sapiens
ctatgtctgaa

SEQ ID NO: 5601880 - DNA, 15 bp, Homo sapiens
ctatgtctggcagat

SEQ ID NO: 5601881 - DNA, 22 bp, Homo sapiens
ctatgtctggcagatgagggct

SEQ ID NO: 5601882 - DNA, 13 bp, Homo sapiens
ctatgtctgtgat

SEQ ID NO: 5601883 - DNA, 14 bp, Homo sapiens
ctatgtgaaaagat

SEQ ID NO: 5601884 - DNA, 12 bp, Homo sapiens
ctatgtgacaat

SEQ ID NO: 5601885 - DNA, 13 bp, Homo sapiens
ctatgtgacagac

SEQ ID NO: 5601886 - DNA, 20 bp, Homo sapiens
ctatgtgacttgcatcgtgg

SEQ ID NO: 5601887 - DNA, 14 bp, Homo sapiens
ctatgtgagaccat

SEQ ID NO: 5601888 - DNA, 21 bp, Homo sapiens
ctatgtgagtttcagaaattc

SEQ ID NO: 5601889 - DNA, 11 bp, Homo sapiens
ctatgtgatgt

SEQ ID NO: 5601890 - DNA, 20 bp, Homo sapiens
ctatgtgattttaactctgt

SEQ ID NO: 5601891 - DNA, 12 bp, Homo sapiens
ctatgtgcaagg

SEQ ID NO: 5601892 - DNA, 19 bp, Homo sapiens
ctatgtgccttatgttgaa

SEQ ID NO: 5601893 - DNA, 17 bp, Homo sapiens
ctatgtgcgagacattg

SEQ ID NO: 5601894 - DNA, 15 bp, Homo sapiens
ctatgtgctgggtgc

SEQ ID NO: 5601895 - DNA, 19 bp, Homo sapiens
ctatgtggaagtggggcgg

SEQ ID NO: 5601896 - DNA, 19 bp, Homo sapiens
ctatgtggattttttccta

SEQ ID NO: 5601897 - DNA, 22 bp, Homo sapiens
ctatgtgtagggcgggaggatg

SEQ ID NO: 5601898 - DNA, 15 bp, Homo sapiens
ctatgtgtatatatt

SEQ ID NO: 5601899 - DNA, 17 bp, Homo sapiens
ctatgtgtatatattat

SEQ ID NO: 5601900 - DNA, 14 bp, Homo sapiens
ctatgtgtgtgctt

SEQ ID NO: 5601901 - DNA, 14 bp, Homo sapiens
ctatgtgtgttgtt

SEQ ID NO: 5601902 - DNA, 18 bp, Homo sapiens
ctatgtgtgttgtttcca

SEQ ID NO: 5601903 - DNA, 19 bp, Homo sapiens
ctatgtgtgttgtttccat

SEQ ID NO: 5601904 - DNA, 21 bp, Homo sapiens
ctatgtgtgttgtttccatag

SEQ ID NO: 5601905 - DNA, 14 bp, Homo sapiens
ctatgtgtttctgt

SEQ ID NO: 5601906 - DNA, 22 bp, Homo sapiens
ctatgtgtttttctcatatttg

SEQ ID NO: 5601907 - DNA, 14 bp, Homo sapiens
ctatgttaaatact

SEQ ID NO: 5601908 - DNA, 17 bp, Homo sapiens
ctatgttaaatactgtg

SEQ ID NO: 5601909 - DNA, 18 bp, Homo sapiens
ctatgttaaatactgtgc

SEQ ID NO: 5601910 - DNA, 19 bp, Homo sapiens
ctatgttaaatactgtgca

SEQ ID NO: 5601911 - DNA, 17 bp, Homo sapiens
ctatgttaatattttag

SEQ ID NO: 5601912 - DNA, 21 bp, Homo sapiens
ctatgttaatattttaggtgt

SEQ ID NO: 5601913 - DNA, 22 bp, Homo sapiens
ctatgttaatattttatgtgta

SEQ ID NO: 5601914 - DNA, 21 bp, Homo sapiens
ctatgttagtataagcttttc

SEQ ID NO: 5601915 - DNA, 22 bp, Homo sapiens
ctatgttcagaacttcatctgc

SEQ ID NO: 5601916 - DNA, 13 bp, Homo sapiens
ctatgttcataaa

SEQ ID NO: 5601917 - DNA, 22 bp, Homo sapiens
ctatgttcatgatagtgtgatt

SEQ ID NO: 5601918 - DNA, 12 bp, Homo sapiens
ctatgttcccca

SEQ ID NO: 5601919 - DNA, 22 bp, Homo sapiens
ctatgttgatccatccagcttg

SEQ ID NO: 5601920 - DNA, 16 bp, Homo sapiens
ctatgttgcccaggca

SEQ ID NO: 5601921 - DNA, 21 bp, Homo sapiens
ctatgttgcccaggctgctct

SEQ ID NO: 5601922 - DNA, 22 bp, Homo sapiens
ctatgttggcattaacaataaa

SEQ ID NO: 5601923 - DNA, 16 bp, Homo sapiens
ctatgtttctcagact

SEQ ID NO: 5601924 - DNA, 16 bp, Homo sapiens
ctatgtttctcagatt

SEQ ID NO: 5601925 - DNA, 14 bp, Homo sapiens
ctatgtttgcactt

SEQ ID NO: 5601926 - DNA, 17 bp, Homo sapiens
ctatgtttgtatttgga

SEQ ID NO: 5601927 - DNA, 23 bp, Homo sapiens
ctatgtttgtatttggaatattt

SEQ ID NO: 5601928 - DNA, 13 bp, Homo sapiens
ctatgtttgtgtg

SEQ ID NO: 5601929 - DNA, 19 bp, Homo sapiens
ctatgtttgtgtgatttcc

SEQ ID NO: 5601930 - DNA, 15 bp, Homo sapiens
ctatgttttaaaata

SEQ ID NO: 5601931 - DNA, 17 bp, Homo sapiens
ctatgttttaaaataat

SEQ ID NO: 5601932 - DNA, 18 bp, Homo sapiens
ctatgttttgacattttt

SEQ ID NO: 5601933 - DNA, 14 bp, Homo sapiens
ctatgtttttaatg

SEQ ID NO: 5601934 - DNA, 22 bp, Homo sapiens
ctatgtttttgttcaaagccag

SEQ ID NO: 5601935 - DNA, 16 bp, Homo sapiens
ctattaaaaatagaca

SEQ ID NO: 5601936 - DNA, 13 bp, Homo sapiens
ctattaaaactca

SEQ ID NO: 5601937 - DNA, 13 bp, Homo sapiens
ctattaaaagact

SEQ ID NO: 5601938 - DNA, 20 bp, Homo sapiens
ctattaaaagactcatccgt

SEQ ID NO: 5601939 - DNA, 19 bp, Homo sapiens
ctattaaaatacattttaa

SEQ ID NO: 5601940 - DNA, 18 bp, Homo sapiens
ctattaaaattgccattt

SEQ ID NO: 5601941 - DNA, 15 bp, Homo sapiens
ctattaaaggaataa

SEQ ID NO: 5601942 - DNA, 13 bp, Homo sapiens
ctattaaaggttc

SEQ ID NO: 5601943 - DNA, 19 bp, Homo sapiens
ctattaaagtgctaaggtt

SEQ ID NO: 5601944 - DNA, 22 bp, Homo sapiens
ctattaaagtggagaagcacac

SEQ ID NO: 5601945 - DNA, 22 bp, Homo sapiens
ctattaaatagttatataattc

SEQ ID NO: 5601946 - DNA, 22 bp, Homo sapiens
ctattaaatgttgcacatcatt

SEQ ID NO: 5601947 - DNA, 19 bp, Homo sapiens
ctattaacaattaattgtc

SEQ ID NO: 5601948 - DNA, 21 bp, Homo sapiens
ctattaacaattaattgtctt

SEQ ID NO: 5601949 - DNA, 19 bp, Homo sapiens
ctattaacatgatgtacta

SEQ ID NO: 5601950 - DNA, 16 bp, Homo sapiens
ctattaaccttttttg

SEQ ID NO: 5601951 - DNA, 23 bp, Homo sapiens
ctattaagaggcagaaaattgca

SEQ ID NO: 5601952 - DNA, 17 bp, Homo sapiens
ctattaagattggaaat

SEQ ID NO: 5601953 - DNA, 16 bp, Homo sapiens
ctattaagatttccaa

SEQ ID NO: 5601954 - DNA, 17 bp, Homo sapiens
ctattaagatttccaag

SEQ ID NO: 5601955 - DNA, 16 bp, Homo sapiens
ctattaagcaagaatg

SEQ ID NO: 5601956 - DNA, 21 bp, Homo sapiens
ctattaagggaaaggaaaaga

SEQ ID NO: 5601957 - DNA, 22 bp, Homo sapiens
ctattaagtatgtcaacagcca

SEQ ID NO: 5601958 - DNA, 15 bp, Homo sapiens
ctattaatatatgta

SEQ ID NO: 5601959 - DNA, 21 bp, Homo sapiens
ctattaatatttatgtgtttt

SEQ ID NO: 5601960 - DNA, 14 bp, Homo sapiens
ctattaatcaagag

SEQ ID NO: 5601961 - DNA, 16 bp, Homo sapiens
ctattaatctttcttt

SEQ ID NO: 5601962 - DNA, 19 bp, Homo sapiens
ctattaatttattaaattt

SEQ ID NO: 5601963 - DNA, 12 bp, Homo sapiens
ctattacaaata

SEQ ID NO: 5601964 - DNA, 12 bp, Homo sapiens
ctattacagtgt

SEQ ID NO: 5601965 - DNA, 21 bp, Homo sapiens
ctattaccactgaagatagaa

SEQ ID NO: 5601966 - DNA, 16 bp, Homo sapiens
ctattacccctcattt

SEQ ID NO: 5601967 - DNA, 22 bp, Homo sapiens
ctattacgtgggtgccctctcc

SEQ ID NO: 5601968 - DNA, 23 bp, Homo sapiens
ctattactgtctggttttaacaa

SEQ ID NO: 5601969 - DNA, 16 bp, Homo sapiens
ctattacttgaacttt

SEQ ID NO: 5601970 - DNA, 21 bp, Homo sapiens
ctattacttggcaaattctga

SEQ ID NO: 5601971 - DNA, 13 bp, Homo sapiens
ctattacttttct

SEQ ID NO: 5601972 - DNA, 20 bp, Homo sapiens
ctattacttttgcaaactgt

SEQ ID NO: 5601973 - DNA, 14 bp, Homo sapiens
ctattagactgtag

SEQ ID NO: 5601974 - DNA, 18 bp, Homo sapiens
ctattagactttagaaat

SEQ ID NO: 5601975 - DNA, 18 bp, Homo sapiens
ctattagagtatttccct

SEQ ID NO: 5601976 - DNA, 21 bp, Homo sapiens
ctattagatgttttacaaatt

SEQ ID NO: 5601977 - DNA, 13 bp, Homo sapiens
ctattagccagtc

SEQ ID NO: 5601978 - DNA, 14 bp, Homo sapiens
ctattagtgttata

SEQ ID NO: 5601979 - DNA, 19 bp, Homo sapiens
ctattagtgttatatgaac

SEQ ID NO: 5601980 - DNA, 13 bp, Homo sapiens
ctattagtttcaa

SEQ ID NO: 5601981 - DNA, 14 bp, Homo sapiens
ctattataaaacca

SEQ ID NO: 5601982 - DNA, 16 bp, Homo sapiens
ctattataatatagaa

SEQ ID NO: 5601983 - DNA, 23 bp, Homo sapiens
ctattataattgtcatgactttc

SEQ ID NO: 5601984 - DNA, 15 bp, Homo sapiens
ctattataatttaat

SEQ ID NO: 5601985 - DNA, 14 bp, Homo sapiens
ctattatagaaatt

SEQ ID NO: 5601986 - DNA, 17 bp, Homo sapiens
ctattatccccatttct

SEQ ID NO: 5601987 - DNA, 21 bp, Homo sapiens
ctattatctgtgcttttgagg

SEQ ID NO: 5601988 - DNA, 22 bp, Homo sapiens
ctattatgaatgtgaagccttc

SEQ ID NO: 5601989 - DNA, 23 bp, Homo sapiens
ctattatgaatgtgaagccttcc

SEQ ID NO: 5601990 - DNA, 18 bp, Homo sapiens
ctattatgatgttttgca

SEQ ID NO: 5601991 - DNA, 17 bp, Homo sapiens
ctattatggaaaactgt

SEQ ID NO: 5601992 - DNA, 18 bp, Homo sapiens
ctattatggaaaactgtg

SEQ ID NO: 5601993 - DNA, 19 bp, Homo sapiens
ctattatgtggaataatac

SEQ ID NO: 5601994 - DNA, 13 bp, Homo sapiens
ctattattgaaat

SEQ ID NO: 5601995 - DNA, 22 bp, Homo sapiens
ctattatttattgtattaggaa

SEQ ID NO: 5601996 - DNA, 12 bp, Homo sapiens
ctattatttgga

SEQ ID NO: 5601997 - DNA, 22 bp, Homo sapiens
ctattattttcactgtagaatg

SEQ ID NO: 5601998 - DNA, 16 bp, Homo sapiens
ctattatttttataat

SEQ ID NO: 5601999 - DNA, 22 bp, Homo sapiens
ctattcaagaggaaatgtcaca

SEQ ID NO: 5602000 - DNA, 22 bp, Homo sapiens
ctattcaataaatcgtgctggg

SEQ ID NO: 5602001 - DNA, 17 bp, Homo sapiens
ctattcacaaaatatca

SEQ ID NO: 5602002 - DNA, 11 bp, Homo sapiens
ctattcacaac

SEQ ID NO: 5602003 - DNA, 20 bp, Homo sapiens
ctattcaccctccacttccc

SEQ ID NO: 5602004 - DNA, 19 bp, Homo sapiens
ctattcagaataaatgggt

SEQ ID NO: 5602005 - DNA, 23 bp, Homo sapiens
ctattcagaatcaaaccttttta

SEQ ID NO: 5602006 - DNA, 14 bp, Homo sapiens
ctattcagacaagc

SEQ ID NO: 5602007 - DNA, 17 bp, Homo sapiens
ctattcagacaagcaac

SEQ ID NO: 5602008 - DNA, 23 bp, Homo sapiens
ctattcagcacaaggaaataaaa

SEQ ID NO: 5602009 - DNA, 14 bp, Homo sapiens
ctattcatggctac

SEQ ID NO: 5602010 - DNA, 20 bp, Homo sapiens
ctattcatggctacctcaga

SEQ ID NO: 5602011 - DNA, 12 bp, Homo sapiens
ctattcatgttt

SEQ ID NO: 5602012 - DNA, 17 bp, Homo sapiens
ctattcattaaatgttt

SEQ ID NO: 5602013 - DNA, 14 bp, Homo sapiens
ctattcattatgca

SEQ ID NO: 5602014 - DNA, 20 bp, Homo sapiens
ctcaaactaaaagacatttg

SEQ ID NO: 5602015 - DNA, 22 bp, Homo sapiens
ctcaaactaaaagacatttgtt

SEQ ID NO: 5602016 - DNA, 20 bp, Homo sapiens
ctcaaactaaattcaaagaa

SEQ ID NO: 5602017 - DNA, 21 bp, Homo sapiens
ctcaaactaacaggcttagtg

SEQ ID NO: 5602018 - DNA, 15 bp, Homo sapiens
ctcaaactaggagga

SEQ ID NO: 5602019 - DNA, 16 bp, Homo sapiens
ctcaaactaggaggaa

SEQ ID NO: 5602020 - DNA, 15 bp, Homo sapiens
ctcaaactcattgca

SEQ ID NO: 5602021 - DNA, 23 bp, Homo sapiens
ctcaaactcattgcagcagataa

SEQ ID NO: 5602022 - DNA, 14 bp, Homo sapiens
ctcaaactcctgac

SEQ ID NO: 5602023 - DNA, 19 bp, Homo sapiens
ctcaaactcctgacctcag

SEQ ID NO: 5602024 - DNA, 13 bp, Homo sapiens
ctcaaactcctgg

SEQ ID NO: 5602025 - DNA, 19 bp, Homo sapiens
ctcaaactctggggctcaa

SEQ ID NO: 5602026 - DNA, 20 bp, Homo sapiens
ctcaaactcttgacctcagg

SEQ ID NO: 5602027 - DNA, 17 bp, Homo sapiens
ctcaaactgccttggct

SEQ ID NO: 5602028 - DNA, 13 bp, Homo sapiens
ctcaaactgggta

SEQ ID NO: 5602029 - DNA, 14 bp, Homo sapiens
ctcaaacttctggc

SEQ ID NO: 5602030 - DNA, 16 bp, Homo sapiens
ctcaaacttctggctc

SEQ ID NO: 5602031 - DNA, 15 bp, Homo sapiens
ctcaaacttgtggcc

SEQ ID NO: 5602032 - DNA, 16 bp, Homo sapiens
ctcaaacttgtggcct

SEQ ID NO: 5602033 - DNA, 13 bp, Homo sapiens
ctcaaagaaagtg

SEQ ID NO: 5602034 - DNA, 17 bp, Homo sapiens
ctcaaagaaagtgtatt

SEQ ID NO: 5602035 - DNA, 23 bp, Homo sapiens
ctcaaagaaatctactatatccc

SEQ ID NO: 5602036 - DNA, 22 bp, Homo sapiens
ctcaaagaaatttccactcagg

SEQ ID NO: 5602037 - DNA, 17 bp, Homo sapiens
ctcaaagaagtcggaat

SEQ ID NO: 5602038 - DNA, 16 bp, Homo sapiens
ctcaaagaccccatgg

SEQ ID NO: 5602039 - DNA, 16 bp, Homo sapiens
ctcaaagagattcgaa

SEQ ID NO: 5602040 - DNA, 18 bp, Homo sapiens
ctcaaagagggagtgcat

SEQ ID NO: 5602041 - DNA, 13 bp, Homo sapiens
ctcaaagagggtg

SEQ ID NO: 5602042 - DNA, 17 bp, Homo sapiens
ctcaaagagggtgaggg

SEQ ID NO: 5602043 - DNA, 18 bp, Homo sapiens
ctcaaagatgaaagctgt

SEQ ID NO: 5602044 - DNA, 22 bp, Homo sapiens
ctcaaagatgaaagctgtttca

SEQ ID NO: 5602045 - DNA, 22 bp, Homo sapiens
ctcaaagatgcgtttgcctcct

SEQ ID NO: 5602046 - DNA, 18 bp, Homo sapiens
ctcaaagatgtactgaga

SEQ ID NO: 5602047 - DNA, 19 bp, Homo sapiens
ctcaaagatgtactgagag

SEQ ID NO: 5602048 - DNA, 23 bp, Homo sapiens
ctcaaagatgtactgagaggagg

SEQ ID NO: 5602049 - DNA, 12 bp, Homo sapiens
ctcaaagcaaaa

SEQ ID NO: 5602050 - DNA, 19 bp, Homo sapiens
ctcaaagcaagcattcaga

SEQ ID NO: 5602051 - DNA, 18 bp, Homo sapiens
ctcaaagcaagctcttct

SEQ ID NO: 5602052 - DNA, 19 bp, Homo sapiens
ctcaaagcacaatgtggat

SEQ ID NO: 5602053 - DNA, 21 bp, Homo sapiens
ctcaaagcacctgaaccactg

SEQ ID NO: 5602054 - DNA, 20 bp, Homo sapiens
ctcaaagcatcaaataatac

SEQ ID NO: 5602055 - DNA, 22 bp, Homo sapiens
ctcaaagcccccacttctctcc

SEQ ID NO: 5602056 - DNA, 12 bp, Homo sapiens
ctcaaaggactg

SEQ ID NO: 5602057 - DNA, 14 bp, Homo sapiens
ctcaaaggagaaaa

SEQ ID NO: 5602058 - DNA, 16 bp, Homo sapiens
ctcaaaggagaaaaaa

SEQ ID NO: 5602059 - DNA, 17 bp, Homo sapiens
ctcaaaggagaaaaaaa

SEQ ID NO: 5602060 - DNA, 22 bp, Homo sapiens
ctcaaaggagaaaaaaaacctt

SEQ ID NO: 5602061 - DNA, 17 bp, Homo sapiens
ctcaaaggagctttctc

SEQ ID NO: 5602062 - DNA, 22 bp, Homo sapiens
ctcaaaggtttggaaggagcag

SEQ ID NO: 5602063 - DNA, 23 bp, Homo sapiens
ctcaaaggtttggaaggagcaga

SEQ ID NO: 5602064 - DNA, 20 bp, Homo sapiens
ctcaaagtaggtatacaaaa

SEQ ID NO: 5602065 - DNA, 21 bp, Homo sapiens
ctcaaagtcccttgagactcc

SEQ ID NO: 5602066 - DNA, 17 bp, Homo sapiens
ctcaaagttaacctacc

SEQ ID NO: 5602067 - DNA, 20 bp, Homo sapiens
ctcaaagttaattcacctat

SEQ ID NO: 5602068 - DNA, 17 bp, Homo sapiens
ctcaaagtttaacacaa

SEQ ID NO: 5602069 - DNA, 15 bp, Homo sapiens
ctcaaagtttgacag

SEQ ID NO: 5602070 - DNA, 19 bp, Homo sapiens
ctcaaagttttgaaaagct

SEQ ID NO: 5602071 - DNA, 21 bp, Homo sapiens
ctcaaagtttttacagtgtat

SEQ ID NO: 5602072 - DNA, 21 bp, Homo sapiens
ctcaaataaaaagtgcttttg

SEQ ID NO: 5602073 - DNA, 13 bp, Homo sapiens
ctcaaataaaata

SEQ ID NO: 5602074 - DNA, 22 bp, Homo sapiens
ctcaaatacatacctactgact

SEQ ID NO: 5602075 - DNA, 16 bp, Homo sapiens
ctcaaatacatgcaca

SEQ ID NO: 5602076 - DNA, 20 bp, Homo sapiens
ctcaaataggctattaaaaa

SEQ ID NO: 5602077 - DNA, 17 bp, Homo sapiens
ctcaaatcaaaaacagg

SEQ ID NO: 5602078 - DNA, 22 bp, Homo sapiens
ctcaaatcaaaaacaggcaggt

SEQ ID NO: 5602079 - DNA, 22 bp, Homo sapiens
ctcaaatccactgacagatata

SEQ ID NO: 5602080 - DNA, 23 bp, Homo sapiens
ctcaaatccaggaccctgccagg

SEQ ID NO: 5602081 - DNA, 16 bp, Homo sapiens
ctcaaatctgctttca

SEQ ID NO: 5602082 - DNA, 18 bp, Homo sapiens
ctcaaatctgctttcatc

SEQ ID NO: 5602083 - DNA, 15 bp, Homo sapiens
ctcaaatcttaagaa

SEQ ID NO: 5602084 - DNA, 16 bp, Homo sapiens
ctcaaatcttaagaaa

SEQ ID NO: 5602085 - DNA, 20 bp, Homo sapiens
ctcaaatgatcctcccacct

SEQ ID NO: 5602086 - DNA, 22 bp, Homo sapiens
ctcaaatgcagtatttttgttg

SEQ ID NO: 5602087 - DNA, 17 bp, Homo sapiens
ctcaaatgctaaatgca

SEQ ID NO: 5602088 - DNA, 24 bp, Homo sapiens
ctcaaatgctaaatgcaaacactg

SEQ ID NO: 5602089 - DNA, 20 bp, Homo sapiens
ctcaaatgctggcaaatcca

SEQ ID NO: 5602090 - DNA, 15 bp, Homo sapiens
ctcaaatggacaata

SEQ ID NO: 5602091 - DNA, 20 bp, Homo sapiens
ctcaaatggggccagatcca

SEQ ID NO: 5602092 - DNA, 11 bp, Homo sapiens
ctcaaatggtg

SEQ ID NO: 5602093 - DNA, 20 bp, Homo sapiens
ctcaaatggtgtcatggctg

SEQ ID NO: 5602094 - DNA, 15 bp, Homo sapiens
ctcaaatgttctaag

SEQ ID NO: 5602095 - DNA, 19 bp, Homo sapiens
ctcaaatgttctaagtttc

SEQ ID NO: 5602096 - DNA, 21 bp, Homo sapiens
ctcaaatgttctaagtttcta

SEQ ID NO: 5602097 - DNA, 22 bp, Homo sapiens
ctcaaatgttctaagtttctaa

SEQ ID NO: 5602098 - DNA, 15 bp, Homo sapiens
ctcaaatgttttctg

SEQ ID NO: 5602099 - DNA, 16 bp, Homo sapiens
ctcaaattaatctttc

SEQ ID NO: 5602100 - DNA, 23 bp, Homo sapiens
ctcaaattaatctttctttacct

SEQ ID NO: 5602101 - DNA, 16 bp, Homo sapiens
ctcaaattactaatga

SEQ ID NO: 5602102 - DNA, 19 bp, Homo sapiens
ctcaaattcaatgcttcta

SEQ ID NO: 5602103 - DNA, 17 bp, Homo sapiens
ctcaaattgttaggaag

SEQ ID NO: 5602104 - DNA, 13 bp, Homo sapiens
ctcaaatttctaa

SEQ ID NO: 5602105 - DNA, 14 bp, Homo sapiens
ctcaaattttgagt

SEQ ID NO: 5602106 - DNA, 12 bp, Homo sapiens
ctcaaatttttc

SEQ ID NO: 5602107 - DNA, 17 bp, Homo sapiens
ctcaaatttttcatctc

SEQ ID NO: 5602108 - DNA, 22 bp, Homo sapiens
ctcaacaaaaaaccgaggccct

SEQ ID NO: 5602109 - DNA, 20 bp, Homo sapiens
ctcaacaaaagtgctttgga

SEQ ID NO: 5602110 - DNA, 22 bp, Homo sapiens
ctcaacaaagaagaaccatctt

SEQ ID NO: 5602111 - DNA, 17 bp, Homo sapiens
ctcaacaacaattttaa

SEQ ID NO: 5602112 - DNA, 15 bp, Homo sapiens
ctcaacaagggagag

SEQ ID NO: 5602113 - DNA, 22 bp, Homo sapiens
ctcaacaagggagagacctcat

SEQ ID NO: 5602114 - DNA, 21 bp, Homo sapiens
ctcaacaatggttgaatgaat

SEQ ID NO: 5602115 - DNA, 16 bp, Homo sapiens
ctcaacaccatgattc

SEQ ID NO: 5602116 - DNA, 19 bp, Homo sapiens
ctcaacaccatgattcctt

SEQ ID NO: 5602117 - DNA, 21 bp, Homo sapiens
ctcaacaccatgattccttta

SEQ ID NO: 5602118 - DNA, 20 bp, Homo sapiens
ctcaacacccaactgtctcg

SEQ ID NO: 5602119 - DNA, 19 bp, Homo sapiens
ctcaacaccctgcttctcc

SEQ ID NO: 5602120 - DNA, 17 bp, Homo sapiens
ctcaacagcaggaggca

SEQ ID NO: 5602121 - DNA, 23 bp, Homo sapiens
ctcaacagcaggaggcacagcag

SEQ ID NO: 5602122 - DNA, 13 bp, Homo sapiens
ctcaacaggccca

SEQ ID NO: 5602123 - DNA, 16 bp, Homo sapiens
ctcaacaggcccaggg

SEQ ID NO: 5602124 - DNA, 21 bp, Homo sapiens
ctcaacaggcccagggaggga

SEQ ID NO: 5602125 - DNA, 14 bp, Homo sapiens
ctcaacaggcctca

SEQ ID NO: 5602126 - DNA, 18 bp, Homo sapiens
ctcaacaggcctcagggc

SEQ ID NO: 5602127 - DNA, 16 bp, Homo sapiens
ctcaacataacataag

SEQ ID NO: 5602128 - DNA, 20 bp, Homo sapiens
ctcaacatgagtcaagagca

SEQ ID NO: 5602129 - DNA, 22 bp, Homo sapiens
ctcaacatgtctcctactgagg

SEQ ID NO: 5602130 - DNA, 20 bp, Homo sapiens
ctcaaccaaatggtacaaaa

SEQ ID NO: 5602131 - DNA, 23 bp, Homo sapiens
ctcaaccacacacacctgtctgt

SEQ ID NO: 5602132 - DNA, 13 bp, Homo sapiens
ctcaaccactgtg

SEQ ID NO: 5602133 - DNA, 18 bp, Homo sapiens
ctcaaccatgacctcacc

SEQ ID NO: 5602134 - DNA, 20 bp, Homo sapiens
ctcaaccatgacctcacccc

SEQ ID NO: 5602135 - DNA, 21 bp, Homo sapiens
ctcaaccccaccatatgaatt

SEQ ID NO: 5602136 - DNA, 17 bp, Homo sapiens
ctcaacccccctcccag

SEQ ID NO: 5602137 - DNA, 16 bp, Homo sapiens
ctcaaccctccctcag

SEQ ID NO: 5602138 - DNA, 18 bp, Homo sapiens
ctcaaccctccctcagcc

SEQ ID NO: 5602139 - DNA, 19 bp, Homo sapiens
ctcaaccctccctcagccc

SEQ ID NO: 5602140 - DNA, 13 bp, Homo sapiens
ctcaaccctctca

SEQ ID NO: 5602141 - DNA, 14 bp, Homo sapiens
ctcaacctccctgg

SEQ ID NO: 5602142 - DNA, 18 bp, Homo sapiens
ctcaacctccctggctca

SEQ ID NO: 5602143 - DNA, 15 bp, Homo sapiens
ctcaacctcctgggc

SEQ ID NO: 5602144 - DNA, 14 bp, Homo sapiens
ctcaacctcctgtg

SEQ ID NO: 5602145 - DNA, 14 bp, Homo sapiens
ctcaacctctacag

SEQ ID NO: 5602146 - DNA, 12 bp, Homo sapiens
ctcaacctctca

SEQ ID NO: 5602147 - DNA, 18 bp, Homo sapiens
ctcaacctcttctggctc

SEQ ID NO: 5602148 - DNA, 15 bp, Homo sapiens
ctcaacctgtaaatt

SEQ ID NO: 5602149 - DNA, 18 bp, Homo sapiens
ctcaacctgtaaattatt

SEQ ID NO: 5602150 - DNA, 19 bp, Homo sapiens
ctcaacctgtaaattattt

SEQ ID NO: 5602151 - DNA, 21 bp, Homo sapiens
ctcaacctgtgatgaggggag

SEQ ID NO: 5602152 - DNA, 19 bp, Homo sapiens
ctcaacggtctggcagggc

SEQ ID NO: 5602153 - DNA, 22 bp, Homo sapiens
ctcaacggtctggcagggcagc

SEQ ID NO: 5602154 - DNA, 16 bp, Homo sapiens
ctcaacgtattgtttc

SEQ ID NO: 5602155 - DNA, 18 bp, Homo sapiens
ctcaacgttgctccccat

SEQ ID NO: 5602156 - DNA, 15 bp, Homo sapiens
ctcaactaaatccaa

SEQ ID NO: 5602157 - DNA, 19 bp, Homo sapiens
ctcaactaacccttaaaaa

SEQ ID NO: 5602158 - DNA, 21 bp, Homo sapiens
ctcaactaattttatttctat

SEQ ID NO: 5602159 - DNA, 14 bp, Homo sapiens
ctcaactattctgt

SEQ ID NO: 5602160 - DNA, 20 bp, Homo sapiens
ctcaactattctgttccaca

SEQ ID NO: 5602161 - DNA, 20 bp, Homo sapiens
ctcaactccaccctctgcga

SEQ ID NO: 5602162 - DNA, 19 bp, Homo sapiens
ctcaactccagagcccctt

SEQ ID NO: 5602163 - DNA, 13 bp, Homo sapiens
ctcaactccagga

SEQ ID NO: 5602164 - DNA, 20 bp, Homo sapiens
ctcaactctacccctgctcc

SEQ ID NO: 5602165 - DNA, 14 bp, Homo sapiens
ctcaactctcctcc

SEQ ID NO: 5602166 - DNA, 16 bp, Homo sapiens
ctcaactctcctccag

SEQ ID NO: 5602167 - DNA, 16 bp, Homo sapiens
ctcaactctgctgagg

SEQ ID NO: 5602168 - DNA, 22 bp, Homo sapiens
ctcaactgagaagccaagcctg

SEQ ID NO: 5602169 - DNA, 23 bp, Homo sapiens
ctcaactgagaagccaagcctgg

SEQ ID NO: 5602170 - DNA, 12 bp, Homo sapiens
ctcaactgcctc

SEQ ID NO: 5602171 - DNA, 18 bp, Homo sapiens
ctcaactgtcccaaggag

SEQ ID NO: 5602172 - DNA, 19 bp, Homo sapiens
ctcaactgttgccaggaga

SEQ ID NO: 5602173 - DNA, 15 bp, Homo sapiens
ctcaacttctttcct

SEQ ID NO: 5602174 - DNA, 13 bp, Homo sapiens
ctcaactttctgt

SEQ ID NO: 5602175 - DNA, 17 bp, Homo sapiens
ctcaactttctgttgga

SEQ ID NO: 5602176 - DNA, 11 bp, Homo sapiens
ctcaagaaaca

SEQ ID NO: 5602177 - DNA, 22 bp, Homo sapiens
ctcaagaaataaaaggaagcca

SEQ ID NO: 5602178 - DNA, 23 bp, Homo sapiens
ctcaagaaataaaaggaagccaa

SEQ ID NO: 5602179 - DNA, 15 bp, Homo sapiens
ctcaagaaattccca

SEQ ID NO: 5602180 - DNA, 16 bp, Homo sapiens
ctcaagaaattttcaa

SEQ ID NO: 5602181 - DNA, 16 bp, Homo sapiens
ctcaagaactgccata

SEQ ID NO: 5602182 - DNA, 20 bp, Homo sapiens
ctcaagaagaagaggggcat

SEQ ID NO: 5602183 - DNA, 19 bp, Homo sapiens
ctcaagaagacatggagac

SEQ ID NO: 5602184 - DNA, 22 bp, Homo sapiens
ctcaagaagacatggagactcc

SEQ ID NO: 5602185 - DNA, 12 bp, Homo sapiens
ctcaagaataaa

SEQ ID NO: 5602186 - DNA, 11 bp, Homo sapiens
ctcaagacaat

SEQ ID NO: 5602187 - DNA, 24 bp, Homo sapiens
ctcaagaccaggctgcagcctcca

SEQ ID NO: 5602188 - DNA, 14 bp, Homo sapiens
ctcaagacttccag

SEQ ID NO: 5602189 - DNA, 13 bp, Homo sapiens
ctcaagactttag

SEQ ID NO: 5602190 - DNA, 18 bp, Homo sapiens
ctcactcttatgaaatgg

SEQ ID NO: 5602191 - DNA, 19 bp, Homo sapiens
ctcactcttcctcatcctg

SEQ ID NO: 5602192 - DNA, 24 bp, Homo sapiens
ctcactcttgaagtccaggactgg

SEQ ID NO: 5602193 - DNA, 20 bp, Homo sapiens
ctcactcttgtcacccaggc

SEQ ID NO: 5602194 - DNA, 22 bp, Homo sapiens
ctcactcttgtcacccaggctg

SEQ ID NO: 5602195 - DNA, 14 bp, Homo sapiens
ctcactgaaaccag

SEQ ID NO: 5602196 - DNA, 20 bp, Homo sapiens
ctcactgaagcccagacctc

SEQ ID NO: 5602197 - DNA, 16 bp, Homo sapiens
ctcactgaagcctgcg

SEQ ID NO: 5602198 - DNA, 17 bp, Homo sapiens
ctcactgacttctcccg

SEQ ID NO: 5602199 - DNA, 13 bp, Homo sapiens
ctcactgagaagg

SEQ ID NO: 5602200 - DNA, 18 bp, Homo sapiens
ctcactgagcactgtttt

SEQ ID NO: 5602201 - DNA, 22 bp, Homo sapiens
ctcactgcaacctccgcctccc

SEQ ID NO: 5602202 - DNA, 19 bp, Homo sapiens
ctcactgcaacctctgcct

SEQ ID NO: 5602203 - DNA, 22 bp, Homo sapiens
ctcactgcaacctctgcctcct

SEQ ID NO: 5602204 - DNA, 22 bp, Homo sapiens
ctcactgcaacttccgcctcct

SEQ ID NO: 5602205 - DNA, 23 bp, Homo sapiens
ctcactgcaagctctgcctcccg

SEQ ID NO: 5602206 - DNA, 15 bp, Homo sapiens
ctcactgcagcctcg

SEQ ID NO: 5602207 - DNA, 21 bp, Homo sapiens
ctcactgcaggcatgctgaac

SEQ ID NO: 5602208 - DNA, 15 bp, Homo sapiens
ctcactgcagtctta

SEQ ID NO: 5602209 - DNA, 14 bp, Homo sapiens
ctcactgcatcttt

SEQ ID NO: 5602210 - DNA, 12 bp, Homo sapiens
ctcactgccagg

SEQ ID NO: 5602211 - DNA, 19 bp, Homo sapiens
ctcactgccatgccagctt

SEQ ID NO: 5602212 - DNA, 15 bp, Homo sapiens
ctcactgccccacca

SEQ ID NO: 5602213 - DNA, 12 bp, Homo sapiens
ctcactgcccgc

SEQ ID NO: 5602214 - DNA, 13 bp, Homo sapiens
ctcactgccctcc

SEQ ID NO: 5602215 - DNA, 12 bp, Homo sapiens
ctcactgcctag

SEQ ID NO: 5602216 - DNA, 13 bp, Homo sapiens
ctcactgcctccc

SEQ ID NO: 5602217 - DNA, 20 bp, Homo sapiens
ctcactgcctctcggtgacc

SEQ ID NO: 5602218 - DNA, 21 bp, Homo sapiens
ctcactgcctgcagctgagat

SEQ ID NO: 5602219 - DNA, 22 bp, Homo sapiens
ctcactgcctgcagctgagatt

SEQ ID NO: 5602220 - DNA, 20 bp, Homo sapiens
ctcactgcctggtaaaatta

SEQ ID NO: 5602221 - DNA, 13 bp, Homo sapiens
ctcactgccttcc

SEQ ID NO: 5602222 - DNA, 15 bp, Homo sapiens
ctcactgccttccag

SEQ ID NO: 5602223 - DNA, 19 bp, Homo sapiens
ctcactgccttccaggagc

SEQ ID NO: 5602224 - DNA, 13 bp, Homo sapiens
ctcactgcctttg

SEQ ID NO: 5602225 - DNA, 23 bp, Homo sapiens
ctcactgctaagaatatttgaat

SEQ ID NO: 5602226 - DNA, 23 bp, Homo sapiens
ctcactgctccctgaagccagcc

SEQ ID NO: 5602227 - DNA, 12 bp, Homo sapiens
ctcactgctgat

SEQ ID NO: 5602228 - DNA, 18 bp, Homo sapiens
ctcactgctggggagtcc

SEQ ID NO: 5602229 - DNA, 19 bp, Homo sapiens
ctcactgctgtcagccaag

SEQ ID NO: 5602230 - DNA, 21 bp, Homo sapiens
ctcactgcttctgctttttct

SEQ ID NO: 5602231 - DNA, 16 bp, Homo sapiens
ctcactgcttgaacta

SEQ ID NO: 5602232 - DNA, 18 bp, Homo sapiens
ctcactggaggagcagct

SEQ ID NO: 5602233 - DNA, 20 bp, Homo sapiens
ctcactggaggagcagcttc

SEQ ID NO: 5602234 - DNA, 22 bp, Homo sapiens
ctcactggaggagcagcttcct

SEQ ID NO: 5602235 - DNA, 13 bp, Homo sapiens
ctcactggcagcc

SEQ ID NO: 5602236 - DNA, 17 bp, Homo sapiens
ctcactggcaggtgtgg

SEQ ID NO: 5602237 - DNA, 17 bp, Homo sapiens
ctcactggctctcctgg

SEQ ID NO: 5602238 - DNA, 19 bp, Homo sapiens
ctcactggctctcctggcc

SEQ ID NO: 5602239 - DNA, 21 bp, Homo sapiens
ctcactggctctcctggccct

SEQ ID NO: 5602240 - DNA, 16 bp, Homo sapiens
ctcactggctgggagt

SEQ ID NO: 5602241 - DNA, 14 bp, Homo sapiens
ctcactggctgggg

SEQ ID NO: 5602242 - DNA, 20 bp, Homo sapiens
ctcactggctggggcagagg

SEQ ID NO: 5602243 - DNA, 22 bp, Homo sapiens
ctcactgggaagctcccacccc

SEQ ID NO: 5602244 - DNA, 17 bp, Homo sapiens
ctcactgggactttgta

SEQ ID NO: 5602245 - DNA, 12 bp, Homo sapiens
ctcactgggccc

SEQ ID NO: 5602246 - DNA, 20 bp, Homo sapiens
ctcactgggctcactgcagg

SEQ ID NO: 5602247 - DNA, 16 bp, Homo sapiens
ctcactggggcctaca

SEQ ID NO: 5602248 - DNA, 18 bp, Homo sapiens
ctcactggggcctacagc

SEQ ID NO: 5602249 - DNA, 18 bp, Homo sapiens
ctcactgggggctttggg

SEQ ID NO: 5602250 - DNA, 12 bp, Homo sapiens
ctcactgggtgg

SEQ ID NO: 5602251 - DNA, 17 bp, Homo sapiens
ctcactgggtgtggcct

SEQ ID NO: 5602252 - DNA, 21 bp, Homo sapiens
ctcactgggtgtggcctggct

SEQ ID NO: 5602253 - DNA, 17 bp, Homo sapiens
ctcactggtccatttct

SEQ ID NO: 5602254 - DNA, 20 bp, Homo sapiens
ctcactgtcagtcccactgc

SEQ ID NO: 5602255 - DNA, 15 bp, Homo sapiens
ctcactgtcatctgc

SEQ ID NO: 5602256 - DNA, 21 bp, Homo sapiens
ctcactgtcgcccaggctgga

SEQ ID NO: 5602257 - DNA, 12 bp, Homo sapiens
ctcactgtctga

SEQ ID NO: 5602258 - DNA, 10 bp, Homo sapiens
ctcactgtga

SEQ ID NO: 5602259 - DNA, 15 bp, Homo sapiens
ctcactgtgacctgc

SEQ ID NO: 5602260 - DNA, 20 bp, Homo sapiens
ctcactgtgacctgctcctg

SEQ ID NO: 5602261 - DNA, 21 bp, Homo sapiens
ctcactgtgacctgctcctgc

SEQ ID NO: 5602262 - DNA, 13 bp, Homo sapiens
ctcactgtgctcc

SEQ ID NO: 5602263 - DNA, 14 bp, Homo sapiens
ctcactgtgctcct

SEQ ID NO: 5602264 - DNA, 20 bp, Homo sapiens
ctcactgtggtaaatgccac

SEQ ID NO: 5602265 - DNA, 20 bp, Homo sapiens
ctcactgtggtgtctgtgtt

SEQ ID NO: 5602266 - DNA, 23 bp, Homo sapiens
ctcactgtgttactgctttgcaa

SEQ ID NO: 5602267 - DNA, 16 bp, Homo sapiens
ctcactgtgttgccca

SEQ ID NO: 5602268 - DNA, 12 bp, Homo sapiens
ctcactgttccc

SEQ ID NO: 5602269 - DNA, 18 bp, Homo sapiens
ctcactgttccctctgct

SEQ ID NO: 5602270 - DNA, 21 bp, Homo sapiens
ctcactgttgaattttctcta

SEQ ID NO: 5602271 - DNA, 22 bp, Homo sapiens
ctcactgttgcagtggcctggc

SEQ ID NO: 5602272 - DNA, 22 bp, Homo sapiens
ctcactgttgcccaggctggcg

SEQ ID NO: 5602273 - DNA, 14 bp, Homo sapiens
ctcactgttgtgaa

SEQ ID NO: 5602274 - DNA, 21 bp, Homo sapiens
ctcactgtttgtttttattta

SEQ ID NO: 5602275 - DNA, 17 bp, Homo sapiens
ctcacttaattctcatt

SEQ ID NO: 5602276 - DNA, 14 bp, Homo sapiens
ctcacttagtcctt

SEQ ID NO: 5602277 - DNA, 15 bp, Homo sapiens
ctcacttagtccttt

SEQ ID NO: 5602278 - DNA, 13 bp, Homo sapiens
ctcacttatacca

SEQ ID NO: 5602279 - DNA, 17 bp, Homo sapiens
ctcacttataccaaagg

SEQ ID NO: 5602280 - DNA, 18 bp, Homo sapiens
ctcacttcaatgtgtcat

SEQ ID NO: 5602281 - DNA, 12 bp, Homo sapiens
ctcacttcaggt

SEQ ID NO: 5602282 - DNA, 20 bp, Homo sapiens
ctcacttcagttgtggcctc

SEQ ID NO: 5602283 - DNA, 13 bp, Homo sapiens
ctcacttccagat

SEQ ID NO: 5602284 - DNA, 22 bp, Homo sapiens
ctcacttccagatatccacata

SEQ ID NO: 5602285 - DNA, 18 bp, Homo sapiens
ctcacttccatacagctc

SEQ ID NO: 5602286 - DNA, 15 bp, Homo sapiens
ctcacttccccttgc

SEQ ID NO: 5602287 - DNA, 19 bp, Homo sapiens
ctcacttccccttgcaccc

SEQ ID NO: 5602288 - DNA, 21 bp, Homo sapiens
ctcacttcccgtagctgccag

SEQ ID NO: 5602289 - DNA, 13 bp, Homo sapiens
ctcacttcctttg

SEQ ID NO: 5602290 - DNA, 18 bp, Homo sapiens
ctcacttcctttgccctt

SEQ ID NO: 5602291 - DNA, 22 bp, Homo sapiens
ctcacttcctttgcccttcctc

SEQ ID NO: 5602292 - DNA, 11 bp, Homo sapiens
ctcacttctgg

SEQ ID NO: 5602293 - DNA, 24 bp, Homo sapiens
ctcacttgaggaggagctggcctg

SEQ ID NO: 5602294 - DNA, 19 bp, Homo sapiens
ctcacttgattcatctctg

SEQ ID NO: 5602295 - DNA, 17 bp, Homo sapiens
ctcacttgccattgcca

SEQ ID NO: 5602296 - DNA, 12 bp, Homo sapiens
ctcacttggggg

SEQ ID NO: 5602297 - DNA, 14 bp, Homo sapiens
ctcacttgggggaa

SEQ ID NO: 5602298 - DNA, 18 bp, Homo sapiens
ctcacttggtctgccagg

SEQ ID NO: 5602299 - DNA, 20 bp, Homo sapiens
ctcacttgtggcagcttccc

SEQ ID NO: 5602300 - DNA, 13 bp, Homo sapiens
ctcactttaaacc

SEQ ID NO: 5602301 - DNA, 16 bp, Homo sapiens
ctcactttaaacctgt

SEQ ID NO: 5602302 - DNA, 15 bp, Homo sapiens
ctcactttactttca

SEQ ID NO: 5602303 - DNA, 16 bp, Homo sapiens
ctcactttccaccaag

SEQ ID NO: 5602304 - DNA, 15 bp, Homo sapiens
ctcactttggttttg

SEQ ID NO: 5602305 - DNA, 14 bp, Homo sapiens
ctcactttgtaaat

SEQ ID NO: 5602306 - DNA, 16 bp, Homo sapiens
ctcactttgtaaataa

SEQ ID NO: 5602307 - DNA, 14 bp, Homo sapiens
ctcacttttcactt

SEQ ID NO: 5602308 - DNA, 22 bp, Homo sapiens
ctcacttttcacttgtcttgct

SEQ ID NO: 5602309 - DNA, 15 bp, Homo sapiens
ctcacttttcccact

SEQ ID NO: 5602310 - DNA, 17 bp, Homo sapiens
ctcacttttctcatctg

SEQ ID NO: 5602311 - DNA, 14 bp, Homo sapiens
ctcacttttctcca

SEQ ID NO: 5602312 - DNA, 22 bp, Homo sapiens
ctcacttttctttattgctgtg

SEQ ID NO: 5602313 - DNA, 14 bp, Homo sapiens
ctcacttttgtgaa

SEQ ID NO: 5602314 - DNA, 19 bp, Homo sapiens
ctcactttttacccagaac

SEQ ID NO: 5602315 - DNA, 13 bp, Homo sapiens
ctcactttttcca

SEQ ID NO: 5602316 - DNA, 20 bp, Homo sapiens
ctcacttttttacaactcca

SEQ ID NO: 5602317 - DNA, 17 bp, Homo sapiens
ctcagaaaacttctctt

SEQ ID NO: 5602318 - DNA, 21 bp, Homo sapiens
ctcagaaaatggggcttgccc

SEQ ID NO: 5602319 - DNA, 19 bp, Homo sapiens
ctcagaaacagaagaaaaa

SEQ ID NO: 5602320 - DNA, 13 bp, Homo sapiens
ctcagaaagaggt

SEQ ID NO: 5602321 - DNA, 18 bp, Homo sapiens
ctcagaaagtcaccagga

SEQ ID NO: 5602322 - DNA, 20 bp, Homo sapiens
ctcagaaagtcaccaggact

SEQ ID NO: 5602323 - DNA, 21 bp, Homo sapiens
ctcagaaagtcaccaggactt

SEQ ID NO: 5602324 - DNA, 14 bp, Homo sapiens
ctcagaaatgctgt

SEQ ID NO: 5602325 - DNA, 23 bp, Homo sapiens
ctcagaaatggacaaagaaaacg

SEQ ID NO: 5602326 - DNA, 16 bp, Homo sapiens
ctcagaaattgaaagc

SEQ ID NO: 5602327 - DNA, 14 bp, Homo sapiens
ctcagaacatactg

SEQ ID NO: 5602328 - DNA, 14 bp, Homo sapiens
ctcagaacccaggg

SEQ ID NO: 5602329 - DNA, 17 bp, Homo sapiens
ctcagaacccagggctc

SEQ ID NO: 5602330 - DNA, 20 bp, Homo sapiens
ctcagaacctgttattttat

SEQ ID NO: 5602331 - DNA, 21 bp, Homo sapiens
ctcagaaccttgtcccagcca

SEQ ID NO: 5602332 - DNA, 18 bp, Homo sapiens
ctcagaactctccaggga

SEQ ID NO: 5602333 - DNA, 12 bp, Homo sapiens
ctcagaactgtc

SEQ ID NO: 5602334 - DNA, 14 bp, Homo sapiens
ctcagaactgtccc

SEQ ID NO: 5602335 - DNA, 23 bp, Homo sapiens
ctcagaactgtcccatccccagg

SEQ ID NO: 5602336 - DNA, 21 bp, Homo sapiens
ctcagaactgtcggaggaaag

SEQ ID NO: 5602337 - DNA, 11 bp, Homo sapiens
ctcagaagaaa

SEQ ID NO: 5602338 - DNA, 20 bp, Homo sapiens
ctcagaagaaaaagaagctg

SEQ ID NO: 5602339 - DNA, 17 bp, Homo sapiens
ctcagaagaaaacaaag

SEQ ID NO: 5602340 - DNA, 21 bp, Homo sapiens
ctcagaagacacatgtggaga

SEQ ID NO: 5602341 - DNA, 15 bp, Homo sapiens
ctcagaagacactga

SEQ ID NO: 5602342 - DNA, 14 bp, Homo sapiens
ctcagaagagaaat

SEQ ID NO: 5602343 - DNA, 13 bp, Homo sapiens
ctcagaagagcag

SEQ ID NO: 5602344 - DNA, 16 bp, Homo sapiens
ctcagaagccagtctg

SEQ ID NO: 5602345 - DNA, 21 bp, Homo sapiens
ctcagaagcctgggggcctgg

SEQ ID NO: 5602346 - DNA, 22 bp, Homo sapiens
ctcagaagcctgggggcctggc

SEQ ID NO: 5602347 - DNA, 14 bp, Homo sapiens
ctcagaagccttct

SEQ ID NO: 5602348 - DNA, 15 bp, Homo sapiens
ctcagaagccttctt

SEQ ID NO: 5602349 - DNA, 17 bp, Homo sapiens
ctcagaaggaatggtgc

SEQ ID NO: 5602350 - DNA, 20 bp, Homo sapiens
ctcagaaggcaaatgacttt

SEQ ID NO: 5602351 - DNA, 15 bp, Homo sapiens
ctcagaaggcaggag

SEQ ID NO: 5602352 - DNA, 20 bp, Homo sapiens
ctcagaaggccccagagaga

SEQ ID NO: 5602353 - DNA, 22 bp, Homo sapiens
ctcagaaggctctatctgctgg

SEQ ID NO: 5602354 - DNA, 14 bp, Homo sapiens
ctcagaaggctttg

SEQ ID NO: 5602355 - DNA, 13 bp, Homo sapiens
ctcagaaggtatt

SEQ ID NO: 5602356 - DNA, 17 bp, Homo sapiens
ctcagaaggtctgtttt

SEQ ID NO: 5602357 - DNA, 21 bp, Homo sapiens
ctcagaagtacttttctgttc

SEQ ID NO: 5602358 - DNA, 16 bp, Homo sapiens
ctcagaagtctttcag

SEQ ID NO: 5602359 - DNA, 21 bp, Homo sapiens
ctcagaagtgcatctggagag

SEQ ID NO: 5602360 - DNA, 16 bp, Homo sapiens
ctcagaagtttcttct

SEQ ID NO: 5602361 - DNA, 19 bp, Homo sapiens
ctcagaataactacctcct

SEQ ID NO: 5602362 - DNA, 17 bp, Homo sapiens
ctcagaataaggcaggc

SEQ ID NO: 5602363 - DNA, 14 bp, Homo sapiens
ctcagaatatattc

SEQ ID NO: 5602364 - DNA, 16 bp, Homo sapiens
ctcagaatctcaaata

SEQ ID NO: 5602365 - DNA, 21 bp, Homo sapiens
ctcagaatgatttgtaaatag

SEQ ID NO: 5602366 - DNA, 14 bp, Homo sapiens
ctcagaatgctcta

SEQ ID NO: 5602367 - DNA, 15 bp, Homo sapiens
ctcagaatgttggca

SEQ ID NO: 5602368 - DNA, 23 bp, Homo sapiens
ctcagctggaagtctacctgctg

SEQ ID NO: 5602369 - DNA, 15 bp, Homo sapiens
ctcagctggcagtgc

SEQ ID NO: 5602370 - DNA, 12 bp, Homo sapiens
ctcagctggccg

SEQ ID NO: 5602371 - DNA, 13 bp, Homo sapiens
ctcagctggccgg

SEQ ID NO: 5602372 - DNA, 21 bp, Homo sapiens
ctcagctggccgggttggagg

SEQ ID NO: 5602373 - DNA, 23 bp, Homo sapiens
ctcagctggccgggttggaggcc

SEQ ID NO: 5602374 - DNA, 13 bp, Homo sapiens
ctcagctggcgga

SEQ ID NO: 5602375 - DNA, 18 bp, Homo sapiens
ctcagctggcggaacctg

SEQ ID NO: 5602376 - DNA, 21 bp, Homo sapiens
ctcagctggcggaacctggct

SEQ ID NO: 5602377 - DNA, 22 bp, Homo sapiens
ctcagctggcggaacctggctg

SEQ ID NO: 5602378 - DNA, 19 bp, Homo sapiens
ctcagctggttactcaggg

SEQ ID NO: 5602379 - DNA, 19 bp, Homo sapiens
ctcagctgtcaaggctcag

SEQ ID NO: 5602380 - DNA, 12 bp, Homo sapiens
ctcagctgtcac

SEQ ID NO: 5602381 - DNA, 13 bp, Homo sapiens
ctcagctgtcacc

SEQ ID NO: 5602382 - DNA, 16 bp, Homo sapiens
ctcagctgtcctgcag

SEQ ID NO: 5602383 - DNA, 11 bp, Homo sapiens
ctcagctgtgg

SEQ ID NO: 5602384 - DNA, 18 bp, Homo sapiens
ctcagctgtggctggagg

SEQ ID NO: 5602385 - DNA, 23 bp, Homo sapiens
ctcagctgtggctggaggagctg

SEQ ID NO: 5602386 - DNA, 22 bp, Homo sapiens
ctcagctgttcagattggacat

SEQ ID NO: 5602387 - DNA, 19 bp, Homo sapiens
ctcagcttaattctccttc

SEQ ID NO: 5602388 - DNA, 21 bp, Homo sapiens
ctcagcttaattctccttccc

SEQ ID NO: 5602389 - DNA, 14 bp, Homo sapiens
ctcagcttatctct

SEQ ID NO: 5602390 - DNA, 20 bp, Homo sapiens
ctcagcttcatttccgtgaa

SEQ ID NO: 5602391 - DNA, 14 bp, Homo sapiens
ctcagcttcccaag

SEQ ID NO: 5602392 - DNA, 16 bp, Homo sapiens
ctcagcttcctaccca

SEQ ID NO: 5602393 - DNA, 22 bp, Homo sapiens
ctcagcttcctacccacacctc

SEQ ID NO: 5602394 - DNA, 18 bp, Homo sapiens
ctcagcttctaattttgt

SEQ ID NO: 5602395 - DNA, 21 bp, Homo sapiens
ctcagcttctaattttgtgct

SEQ ID NO: 5602396 - DNA, 16 bp, Homo sapiens
ctcagcttctcctgtg

SEQ ID NO: 5602397 - DNA, 20 bp, Homo sapiens
ctcagcttcttcacaggcac

SEQ ID NO: 5602398 - DNA, 19 bp, Homo sapiens
ctcagcttcttctttcatt

SEQ ID NO: 5602399 - DNA, 16 bp, Homo sapiens
ctcagcttggcactca

SEQ ID NO: 5602400 - DNA, 20 bp, Homo sapiens
ctcagcttgggcttcttcct

SEQ ID NO: 5602401 - DNA, 13 bp, Homo sapiens
ctcagctttgaga

SEQ ID NO: 5602402 - DNA, 13 bp, Homo sapiens
ctcagctttgctt

SEQ ID NO: 5602403 - DNA, 14 bp, Homo sapiens
ctcagctttttccc

SEQ ID NO: 5602404 - DNA, 14 bp, Homo sapiens
ctcagcttttttct

SEQ ID NO: 5602405 - DNA, 21 bp, Homo sapiens
ctcaggaaagaatagaaagaa

SEQ ID NO: 5602406 - DNA, 23 bp, Homo sapiens
ctcaggaaatgctgacccatggg

SEQ ID NO: 5602407 - DNA, 16 bp, Homo sapiens
ctcaggaacccaccct

SEQ ID NO: 5602408 - DNA, 19 bp, Homo sapiens
ctcaggaacccaccctctc

SEQ ID NO: 5602409 - DNA, 15 bp, Homo sapiens
ctcaggaaccctgga

SEQ ID NO: 5602410 - DNA, 13 bp, Homo sapiens
ctcaggaagaaca

SEQ ID NO: 5602411 - DNA, 14 bp, Homo sapiens
ctcaggaagaacac

SEQ ID NO: 5602412 - DNA, 17 bp, Homo sapiens
ctcaggaagaagagatg

SEQ ID NO: 5602413 - DNA, 15 bp, Homo sapiens
ctcaggaagccccca

SEQ ID NO: 5602414 - DNA, 23 bp, Homo sapiens
ctcaggaagggggccgccaccct

SEQ ID NO: 5602415 - DNA, 22 bp, Homo sapiens
ctcaggaatcatctcctttgca

SEQ ID NO: 5602416 - DNA, 15 bp, Homo sapiens
ctcaggaatgggctg

SEQ ID NO: 5602417 - DNA, 19 bp, Homo sapiens
ctcaggaattcagtgcctt

SEQ ID NO: 5602418 - DNA, 21 bp, Homo sapiens
ctcaggaattcagtgccttca

SEQ ID NO: 5602419 - DNA, 17 bp, Homo sapiens
ctcaggaattccaatta

SEQ ID NO: 5602420 - DNA, 24 bp, Homo sapiens
ctcaggaattgaagatgtaaggaa

SEQ ID NO: 5602421 - DNA, 20 bp, Homo sapiens
ctcaggacacaggcctgtgt

SEQ ID NO: 5602422 - DNA, 12 bp, Homo sapiens
ctcaggacagat

SEQ ID NO: 5602423 - DNA, 18 bp, Homo sapiens
ctcaggacagatgccaca

SEQ ID NO: 5602424 - DNA, 23 bp, Homo sapiens
ctcaggacagcatcccttcccac

SEQ ID NO: 5602425 - DNA, 20 bp, Homo sapiens
ctcaggaccaaagctttcat

SEQ ID NO: 5602426 - DNA, 19 bp, Homo sapiens
ctcaggaccaccctgccaa

SEQ ID NO: 5602427 - DNA, 20 bp, Homo sapiens
ctcaggaccaccctgccaag

SEQ ID NO: 5602428 - DNA, 21 bp, Homo sapiens
ctcaggaccaccctgccaagg

SEQ ID NO: 5602429 - DNA, 23 bp, Homo sapiens
ctcaggaccagatgtccgtctct

SEQ ID NO: 5602430 - DNA, 15 bp, Homo sapiens
ctcaggaccaggcaa

SEQ ID NO: 5602431 - DNA, 17 bp, Homo sapiens
ctcaggacccaggccct

SEQ ID NO: 5602432 - DNA, 12 bp, Homo sapiens
ctcaggacccca

SEQ ID NO: 5602433 - DNA, 15 bp, Homo sapiens
ctcaggaccccagag

SEQ ID NO: 5602434 - DNA, 14 bp, Homo sapiens
ctcaggaccctcag

SEQ ID NO: 5602435 - DNA, 15 bp, Homo sapiens
ctcaggaccctcagc

SEQ ID NO: 5602436 - DNA, 21 bp, Homo sapiens
ctcaggaccctccccacccac

SEQ ID NO: 5602437 - DNA, 15 bp, Homo sapiens
ctcaggaccctcgct

SEQ ID NO: 5602438 - DNA, 14 bp, Homo sapiens
ctcaggacctctgt

SEQ ID NO: 5602439 - DNA, 21 bp, Homo sapiens
ctcaggacctctgtaggcagc

SEQ ID NO: 5602440 - DNA, 22 bp, Homo sapiens
ctcaggacctctgtaggcagca

SEQ ID NO: 5602441 - DNA, 16 bp, Homo sapiens
ctcaggacctgggacc

SEQ ID NO: 5602442 - DNA, 22 bp, Homo sapiens
ctcaggacggaaggtcagttgc

SEQ ID NO: 5602443 - DNA, 16 bp, Homo sapiens
ctcaggactcagaagc

SEQ ID NO: 5602444 - DNA, 16 bp, Homo sapiens
ctcaggactccagccc

SEQ ID NO: 5602445 - DNA, 14 bp, Homo sapiens
ctcaggactctgaa

SEQ ID NO: 5602446 - DNA, 16 bp, Homo sapiens
ctcaggactgcaacag

SEQ ID NO: 5602447 - DNA, 14 bp, Homo sapiens
ctcaggactgcgac

SEQ ID NO: 5602448 - DNA, 14 bp, Homo sapiens
ctcaggactgggag

SEQ ID NO: 5602449 - DNA, 15 bp, Homo sapiens
ctcaggactgggagc

SEQ ID NO: 5602450 - DNA, 23 bp, Homo sapiens
ctcaggactgggagcccccagcc

SEQ ID NO: 5602451 - DNA, 13 bp, Homo sapiens
ctcaggagaagcc

SEQ ID NO: 5602452 - DNA, 15 bp, Homo sapiens
ctcaggagaagccag

SEQ ID NO: 5602453 - DNA, 20 bp, Homo sapiens
ctcaggagaagccagtgtct

SEQ ID NO: 5602454 - DNA, 13 bp, Homo sapiens
ctcaggagaaggc

SEQ ID NO: 5602455 - DNA, 19 bp, Homo sapiens
ctcaggagaaggcctgccc

SEQ ID NO: 5602456 - DNA, 12 bp, Homo sapiens
ctcaggagagac

SEQ ID NO: 5602457 - DNA, 17 bp, Homo sapiens
ctcaggagagacccctc

SEQ ID NO: 5602458 - DNA, 20 bp, Homo sapiens
ctcaggagagacccctcccc

SEQ ID NO: 5602459 - DNA, 23 bp, Homo sapiens
ctcaggagagcatcaccaccaca

SEQ ID NO: 5602460 - DNA, 18 bp, Homo sapiens
ctcaggagagggccttcc

SEQ ID NO: 5602461 - DNA, 22 bp, Homo sapiens
ctcaggagagggccttcccctc

SEQ ID NO: 5602462 - DNA, 14 bp, Homo sapiens
ctcaggagcacagc

SEQ ID NO: 5602463 - DNA, 15 bp, Homo sapiens
ctcaggagcacagcc

SEQ ID NO: 5602464 - DNA, 16 bp, Homo sapiens
ctcaggagcacagcca

SEQ ID NO: 5602465 - DNA, 22 bp, Homo sapiens
ctcaggagcacaggcagctgga

SEQ ID NO: 5602466 - DNA, 19 bp, Homo sapiens
ctcaggagcaccctgtctt

SEQ ID NO: 5602467 - DNA, 13 bp, Homo sapiens
ctcaggagcaggg

SEQ ID NO: 5602468 - DNA, 12 bp, Homo sapiens
ctcaggagccat

SEQ ID NO: 5602469 - DNA, 13 bp, Homo sapiens
ctcaggagccctg

SEQ ID NO: 5602470 - DNA, 20 bp, Homo sapiens
ctcaggagccctgggaggct

SEQ ID NO: 5602471 - DNA, 23 bp, Homo sapiens
ctcaggagccgaagcccaggggc

SEQ ID NO: 5602472 - DNA, 14 bp, Homo sapiens
ctcaggagcttggg

SEQ ID NO: 5602473 - DNA, 23 bp, Homo sapiens
ctcaggaggaggctgccctgagg

SEQ ID NO: 5602474 - DNA, 21 bp, Homo sapiens
ctcaggaggcagtggcttgga

SEQ ID NO: 5602475 - DNA, 21 bp, Homo sapiens
ctcaggaggcgaataaatgtt

SEQ ID NO: 5602476 - DNA, 23 bp, Homo sapiens
ctcaggaggcgaataaatgttca

SEQ ID NO: 5602477 - DNA, 19 bp, Homo sapiens
ctcaggaggcgcagcccga

SEQ ID NO: 5602478 - DNA, 15 bp, Homo sapiens
ctcaggaggctgaga

SEQ ID NO: 5602479 - DNA, 17 bp, Homo sapiens
ctcaggaggctgagaca

SEQ ID NO: 5602480 - DNA, 20 bp, Homo sapiens
ctcaggaggctgagacagga

SEQ ID NO: 5602481 - DNA, 22 bp, Homo sapiens
ctcaggaggctgaggcaggagg

SEQ ID NO: 5602482 - DNA, 16 bp, Homo sapiens
ctcaggagggcaggct

SEQ ID NO: 5602483 - DNA, 24 bp, Homo sapiens
ctcaggagggcaggctgaggtggg

SEQ ID NO: 5602484 - DNA, 20 bp, Homo sapiens
ctcaggagggtgacgcccag

SEQ ID NO: 5602485 - DNA, 23 bp, Homo sapiens
ctcaggaggtcaagaccagcctg

SEQ ID NO: 5602486 - DNA, 19 bp, Homo sapiens
ctcaggaggtcacctgccg

SEQ ID NO: 5602487 - DNA, 23 bp, Homo sapiens
ctcaggaggtcacctgccgccct

SEQ ID NO: 5602488 - DNA, 17 bp, Homo sapiens
ctcaggaggtgtctcct

SEQ ID NO: 5602489 - DNA, 17 bp, Homo sapiens
ctcaggataacagagaa

SEQ ID NO: 5602490 - DNA, 22 bp, Homo sapiens
ctcaggatatccttatcagagc

SEQ ID NO: 5602491 - DNA, 12 bp, Homo sapiens
ctcaggatatta

SEQ ID NO: 5602492 - DNA, 15 bp, Homo sapiens
ctcaggatattatgt

SEQ ID NO: 5602493 - DNA, 21 bp, Homo sapiens
ctcaggatattcactctgtgg

SEQ ID NO: 5602494 - DNA, 12 bp, Homo sapiens
ctcaggatccaa

SEQ ID NO: 5602495 - DNA, 13 bp, Homo sapiens
ctcaggatctctt

SEQ ID NO: 5602496 - DNA, 17 bp, Homo sapiens
ctcaggatgggccaaac

SEQ ID NO: 5602497 - DNA, 22 bp, Homo sapiens
ctcaggatgtcctttgtgtcca

SEQ ID NO: 5602498 - DNA, 19 bp, Homo sapiens
ctcaggattgctaggagct

SEQ ID NO: 5602499 - DNA, 19 bp, Homo sapiens
ctcaggatttcgtgggtct

SEQ ID NO: 5602500 - DNA, 21 bp, Homo sapiens
ctcaggcaagcccctcagccc

SEQ ID NO: 5602501 - DNA, 18 bp, Homo sapiens
ctcaggcaattccttttg

SEQ ID NO: 5602502 - DNA, 15 bp, Homo sapiens
ctcaggcacacagct

SEQ ID NO: 5602503 - DNA, 14 bp, Homo sapiens
ctcaggcactagcc

SEQ ID NO: 5602504 - DNA, 18 bp, Homo sapiens
ctcaggcactagcctttg

SEQ ID NO: 5602505 - DNA, 19 bp, Homo sapiens
ctcaggcacttgaggcttt

SEQ ID NO: 5602506 - DNA, 18 bp, Homo sapiens
ctcaggcagacaagagct

SEQ ID NO: 5602507 - DNA, 19 bp, Homo sapiens
ctcaggcagacaagagctg

SEQ ID NO: 5602508 - DNA, 22 bp, Homo sapiens
ctcaggcagacaagagctgctg

SEQ ID NO: 5602509 - DNA, 16 bp, Homo sapiens
ctcaggcagcaccaca

SEQ ID NO: 5602510 - DNA, 20 bp, Homo sapiens
ctcaggcagcaccacactgg

SEQ ID NO: 5602511 - DNA, 13 bp, Homo sapiens
ctcaggcagcctg

SEQ ID NO: 5602512 - DNA, 22 bp, Homo sapiens
ctcaggcagcgttagggctgct

SEQ ID NO: 5602513 - DNA, 15 bp, Homo sapiens
ctcaggcagctcaag

SEQ ID NO: 5602514 - DNA, 13 bp, Homo sapiens
ctcaggcagtggc

SEQ ID NO: 5602515 - DNA, 20 bp, Homo sapiens
ctcaggcagtggcccaggga

SEQ ID NO: 5602516 - DNA, 22 bp, Homo sapiens
ctcaggcataggcctgggtgct

SEQ ID NO: 5602517 - DNA, 15 bp, Homo sapiens
ctcaggcatgcctgt

SEQ ID NO: 5602518 - DNA, 16 bp, Homo sapiens
ctcaggcatgcctgtg

SEQ ID NO: 5602519 - DNA, 18 bp, Homo sapiens
ctcaggcatgcctgtgtg

SEQ ID NO: 5602520 - DNA, 18 bp, Homo sapiens
ctcaggccaagggaccag

SEQ ID NO: 5602521 - DNA, 19 bp, Homo sapiens
ctcaggccacagtggggct

SEQ ID NO: 5602522 - DNA, 18 bp, Homo sapiens
ctcaggccaccacagagg

SEQ ID NO: 5602523 - DNA, 18 bp, Homo sapiens
ctcaggccaccctccacg

SEQ ID NO: 5602524 - DNA, 16 bp, Homo sapiens
ctcaggccacctgccc

SEQ ID NO: 5602525 - DNA, 18 bp, Homo sapiens
ctcaggccacctgccccc

SEQ ID NO: 5602526 - DNA, 19 bp, Homo sapiens
ctcaggccacctgccccct

SEQ ID NO: 5602527 - DNA, 22 bp, Homo sapiens
ctcaggccacctgcccccttct

SEQ ID NO: 5602528 - DNA, 17 bp, Homo sapiens
ctcaggccagagccaag

SEQ ID NO: 5602529 - DNA, 18 bp, Homo sapiens
ctcaggccagagccaagg

SEQ ID NO: 5602530 - DNA, 13 bp, Homo sapiens
ctcaggccagctg

SEQ ID NO: 5602531 - DNA, 15 bp, Homo sapiens
ctcaggccagctgct

SEQ ID NO: 5602532 - DNA, 17 bp, Homo sapiens
ctcaggccagctgcttg

SEQ ID NO: 5602533 - DNA, 15 bp, Homo sapiens
ctcaggccaggtgca

SEQ ID NO: 5602534 - DNA, 18 bp, Homo sapiens
ctcaggccaggtgcagtg

SEQ ID NO: 5602535 - DNA, 22 bp, Homo sapiens
ctcaggccagtaatcccagtga

SEQ ID NO: 5602536 - DNA, 20 bp, Homo sapiens
ctcaggccagtgccaggaca

SEQ ID NO: 5602537 - DNA, 22 bp, Homo sapiens
ctcaggccagtgccaggacagc

SEQ ID NO: 5602538 - DNA, 13 bp, Homo sapiens
ctcaggccattcc

SEQ ID NO: 5602539 - DNA, 16 bp, Homo sapiens
ctcaggcccaaagcct

SEQ ID NO: 5602540 - DNA, 11 bp, Homo sapiens
ctcaggcccag

SEQ ID NO: 5602541 - DNA, 19 bp, Homo sapiens
ctcaggcccagctgctccc

SEQ ID NO: 5602542 - DNA, 12 bp, Homo sapiens
ctcaggccgaga

SEQ ID NO: 5602543 - DNA, 16 bp, Homo sapiens
ctcaggccgagagcct

SEQ ID NO: 5602544 - DNA, 23 bp, Homo sapiens
ctcaggccggcagccccagcctg

SEQ ID NO: 5602545 - DNA, 16 bp, Homo sapiens
ctcatcctgaacagca

SEQ ID NO: 5602546 - DNA, 12 bp, Homo sapiens
ctcatcctgaga

SEQ ID NO: 5602547 - DNA, 13 bp, Homo sapiens
ctcatcctgctct

SEQ ID NO: 5602548 - DNA, 18 bp, Homo sapiens
ctcatcctgctcttttgt

SEQ ID NO: 5602549 - DNA, 14 bp, Homo sapiens
ctcatcctgcttct

SEQ ID NO: 5602550 - DNA, 15 bp, Homo sapiens
ctcatcctgcttctc

SEQ ID NO: 5602551 - DNA, 16 bp, Homo sapiens
ctcatcctgcttctct

SEQ ID NO: 5602552 - DNA, 22 bp, Homo sapiens
ctcatcctggcacgccctactc

SEQ ID NO: 5602553 - DNA, 15 bp, Homo sapiens
ctcatcctgtgtggg

SEQ ID NO: 5602554 - DNA, 20 bp, Homo sapiens
ctcatccttctaaagtgctg

SEQ ID NO: 5602555 - DNA, 16 bp, Homo sapiens
ctcatccttgtataaa

SEQ ID NO: 5602556 - DNA, 15 bp, Homo sapiens
ctcatcggagactgc

SEQ ID NO: 5602557 - DNA, 12 bp, Homo sapiens
ctcatcggaggc

SEQ ID NO: 5602558 - DNA, 17 bp, Homo sapiens
ctcatcgggcccaggga

SEQ ID NO: 5602559 - DNA, 14 bp, Homo sapiens
ctcatcgtctttta

SEQ ID NO: 5602560 - DNA, 17 bp, Homo sapiens
ctcatcgttctaaaatc

SEQ ID NO: 5602561 - DNA, 14 bp, Homo sapiens
ctcatctacacata

SEQ ID NO: 5602562 - DNA, 14 bp, Homo sapiens
ctcatctatctcaa

SEQ ID NO: 5602563 - DNA, 18 bp, Homo sapiens
ctcatctatctcaatcct

SEQ ID NO: 5602564 - DNA, 20 bp, Homo sapiens
ctcatctatgaggaaaggtt

SEQ ID NO: 5602565 - DNA, 12 bp, Homo sapiens
ctcatctcactg

SEQ ID NO: 5602566 - DNA, 15 bp, Homo sapiens
ctcatctcagaccct

SEQ ID NO: 5602567 - DNA, 16 bp, Homo sapiens
ctcatctcagaccctg

SEQ ID NO: 5602568 - DNA, 18 bp, Homo sapiens
ctcatctcagtgaagaat

SEQ ID NO: 5602569 - DNA, 12 bp, Homo sapiens
ctcatctccaag

SEQ ID NO: 5602570 - DNA, 20 bp, Homo sapiens
ctcatctccaaggatcctct

SEQ ID NO: 5602571 - DNA, 13 bp, Homo sapiens
ctcatctcccagg

SEQ ID NO: 5602572 - DNA, 21 bp, Homo sapiens
ctcatctcctgaccctcccac

SEQ ID NO: 5602573 - DNA, 18 bp, Homo sapiens
ctcatctctaacagctca

SEQ ID NO: 5602574 - DNA, 24 bp, Homo sapiens
ctcatctctaacagctcaggatct

SEQ ID NO: 5602575 - DNA, 14 bp, Homo sapiens
ctcatctctgaaaa

SEQ ID NO: 5602576 - DNA, 12 bp, Homo sapiens
ctcatctctgcc

SEQ ID NO: 5602577 - DNA, 16 bp, Homo sapiens
ctcatctctgcctgac

SEQ ID NO: 5602578 - DNA, 22 bp, Homo sapiens
ctcatctctgcctgacaaggcc

SEQ ID NO: 5602579 - DNA, 13 bp, Homo sapiens
ctcatctctggaa

SEQ ID NO: 5602580 - DNA, 21 bp, Homo sapiens
ctcatctctggaaggggcagc

SEQ ID NO: 5602581 - DNA, 15 bp, Homo sapiens
ctcatctctgtccca

SEQ ID NO: 5602582 - DNA, 17 bp, Homo sapiens
ctcatctcttcaggttc

SEQ ID NO: 5602583 - DNA, 15 bp, Homo sapiens
ctcatctcttctttt

SEQ ID NO: 5602584 - DNA, 15 bp, Homo sapiens
ctcatctgagaggct

SEQ ID NO: 5602585 - DNA, 23 bp, Homo sapiens
ctcatctgatatgcagagtattt

SEQ ID NO: 5602586 - DNA, 13 bp, Homo sapiens
ctcatctgcaaaa

SEQ ID NO: 5602587 - DNA, 20 bp, Homo sapiens
ctcatctgcacccttctttt

SEQ ID NO: 5602588 - DNA, 21 bp, Homo sapiens
ctcatctgcacccttcttttc

SEQ ID NO: 5602589 - DNA, 16 bp, Homo sapiens
ctcatctgcctggaaa

SEQ ID NO: 5602590 - DNA, 17 bp, Homo sapiens
ctcatctgcctggaaag

SEQ ID NO: 5602591 - DNA, 12 bp, Homo sapiens
ctcatctgctca

SEQ ID NO: 5602592 - DNA, 21 bp, Homo sapiens
ctcatctggagttctcaaaga

SEQ ID NO: 5602593 - DNA, 12 bp, Homo sapiens
ctcatctgggga

SEQ ID NO: 5602594 - DNA, 21 bp, Homo sapiens
ctcatctggggagcaggcagc

SEQ ID NO: 5602595 - DNA, 18 bp, Homo sapiens
ctcatctgggggagtgga

SEQ ID NO: 5602596 - DNA, 15 bp, Homo sapiens
ctcatctgggtctcc

SEQ ID NO: 5602597 - DNA, 16 bp, Homo sapiens
ctcatctgtaaaacca

SEQ ID NO: 5602598 - DNA, 19 bp, Homo sapiens
ctcatctgtaaaaccaggc

SEQ ID NO: 5602599 - DNA, 20 bp, Homo sapiens
ctcatctgtaaaaccaggct

SEQ ID NO: 5602600 - DNA, 13 bp, Homo sapiens
ctcatctgtaaac

SEQ ID NO: 5602601 - DNA, 17 bp, Homo sapiens
ctcatctgtccctccgg

SEQ ID NO: 5602602 - DNA, 18 bp, Homo sapiens
ctcatctgtccctccggg

SEQ ID NO: 5602603 - DNA, 13 bp, Homo sapiens
ctcatctgtctgg

SEQ ID NO: 5602604 - DNA, 23 bp, Homo sapiens
ctcatctgtctggaggggagctc

SEQ ID NO: 5602605 - DNA, 18 bp, Homo sapiens
ctcatcttagtgcctgag

SEQ ID NO: 5602606 - DNA, 13 bp, Homo sapiens
ctcatcttagttc

SEQ ID NO: 5602607 - DNA, 21 bp, Homo sapiens
ctcatcttcaaagtttttact

SEQ ID NO: 5602608 - DNA, 19 bp, Homo sapiens
ctcatcttccccagccctc

SEQ ID NO: 5602609 - DNA, 20 bp, Homo sapiens
ctcatcttgaagggcccagg

SEQ ID NO: 5602610 - DNA, 22 bp, Homo sapiens
ctcatcttgacagagcctgccc

SEQ ID NO: 5602611 - DNA, 21 bp, Homo sapiens
ctcatcttggccctcctcagc

SEQ ID NO: 5602612 - DNA, 14 bp, Homo sapiens
ctcatcttgtaaat

SEQ ID NO: 5602613 - DNA, 14 bp, Homo sapiens
ctcatctttatcct

SEQ ID NO: 5602614 - DNA, 14 bp, Homo sapiens
ctcatctttctcct

SEQ ID NO: 5602615 - DNA, 17 bp, Homo sapiens
ctcatctttctccttca

SEQ ID NO: 5602616 - DNA, 13 bp, Homo sapiens
ctcatctttctgc

SEQ ID NO: 5602617 - DNA, 13 bp, Homo sapiens
ctcatctttcttg

SEQ ID NO: 5602618 - DNA, 17 bp, Homo sapiens
ctcatgaagcaggaggc

SEQ ID NO: 5602619 - DNA, 14 bp, Homo sapiens
ctcatgaatgtaaa

SEQ ID NO: 5602620 - DNA, 15 bp, Homo sapiens
ctcatgacagccaga

SEQ ID NO: 5602621 - DNA, 19 bp, Homo sapiens
ctcatgacagccagagcct

SEQ ID NO: 5602622 - DNA, 19 bp, Homo sapiens
ctcatgacattatatttga

SEQ ID NO: 5602623 - DNA, 16 bp, Homo sapiens
ctcatgaccctcctgt

SEQ ID NO: 5602624 - DNA, 18 bp, Homo sapiens
ctcatgaccctcctgtcc

SEQ ID NO: 5602625 - DNA, 22 bp, Homo sapiens
ctcatgaccctcctgtccagca

SEQ ID NO: 5602626 - DNA, 18 bp, Homo sapiens
ctcatgacggcctgcctg

SEQ ID NO: 5602627 - DNA, 19 bp, Homo sapiens
ctcatgacggcctgcctgc

SEQ ID NO: 5602628 - DNA, 15 bp, Homo sapiens
ctcatgactgcatga

SEQ ID NO: 5602629 - DNA, 16 bp, Homo sapiens
ctcatgagaagccaag

SEQ ID NO: 5602630 - DNA, 16 bp, Homo sapiens
ctcatgaggctgaggc

SEQ ID NO: 5602631 - DNA, 21 bp, Homo sapiens
ctcatgagtctacctgagcat

SEQ ID NO: 5602632 - DNA, 16 bp, Homo sapiens
ctcatgatcaagatat

SEQ ID NO: 5602633 - DNA, 20 bp, Homo sapiens
ctcatgatcaagatatatgt

SEQ ID NO: 5602634 - DNA, 23 bp, Homo sapiens
ctcatgatccacccacctcagcc

SEQ ID NO: 5602635 - DNA, 19 bp, Homo sapiens
ctcatgatcttgtgacata

SEQ ID NO: 5602636 - DNA, 19 bp, Homo sapiens
ctcatgatgtaaaaaatat

SEQ ID NO: 5602637 - DNA, 16 bp, Homo sapiens
ctcatgattttttaca

SEQ ID NO: 5602638 - DNA, 21 bp, Homo sapiens
ctcatgcaaactgctttattt

SEQ ID NO: 5602639 - DNA, 16 bp, Homo sapiens
ctcatgcaaatcaatt

SEQ ID NO: 5602640 - DNA, 19 bp, Homo sapiens
ctcatgcaaatcaattact

SEQ ID NO: 5602641 - DNA, 20 bp, Homo sapiens
ctcatgcaaatcaattactg

SEQ ID NO: 5602642 - DNA, 18 bp, Homo sapiens
ctcatgcaagacttcact

SEQ ID NO: 5602643 - DNA, 17 bp, Homo sapiens
ctcatgcacccctgagc

SEQ ID NO: 5602644 - DNA, 16 bp, Homo sapiens
ctcatgcatctccacc

SEQ ID NO: 5602645 - DNA, 12 bp, Homo sapiens
ctcatgccacac

SEQ ID NO: 5602646 - DNA, 12 bp, Homo sapiens
ctcatgccagat

SEQ ID NO: 5602647 - DNA, 21 bp, Homo sapiens
ctcatgccatggtctttgcta

SEQ ID NO: 5602648 - DNA, 20 bp, Homo sapiens
ctcatgcccaccccctgccc

SEQ ID NO: 5602649 - DNA, 23 bp, Homo sapiens
ctcatgcccaccccctgccctgc

SEQ ID NO: 5602650 - DNA, 23 bp, Homo sapiens
ctcatgcccactcccccaggagc

SEQ ID NO: 5602651 - DNA, 19 bp, Homo sapiens
ctcatgcccagctctctga

SEQ ID NO: 5602652 - DNA, 23 bp, Homo sapiens
ctcatgccccctttcagatgtct

SEQ ID NO: 5602653 - DNA, 19 bp, Homo sapiens
ctcatgccccgccatggtc

SEQ ID NO: 5602654 - DNA, 16 bp, Homo sapiens
ctcatgccccttgggg

SEQ ID NO: 5602655 - DNA, 17 bp, Homo sapiens
ctcatgccgctgtgtct

SEQ ID NO: 5602656 - DNA, 21 bp, Homo sapiens
ctcatgcctcatcctcccaag

SEQ ID NO: 5602657 - DNA, 12 bp, Homo sapiens
ctcatgcctgag

SEQ ID NO: 5602658 - DNA, 13 bp, Homo sapiens
ctcatgcctgctg

SEQ ID NO: 5602659 - DNA, 15 bp, Homo sapiens
ctcatgcctgctgag

SEQ ID NO: 5602660 - DNA, 22 bp, Homo sapiens
ctcatgcctggcccccctccag

SEQ ID NO: 5602661 - DNA, 21 bp, Homo sapiens
ctcatgcggcccagccatggg

SEQ ID NO: 5602662 - DNA, 12 bp, Homo sapiens
ctcatgctattt

SEQ ID NO: 5602663 - DNA, 15 bp, Homo sapiens
ctcatgctatttcta

SEQ ID NO: 5602664 - DNA, 16 bp, Homo sapiens
ctcatgctctctgaac

SEQ ID NO: 5602665 - DNA, 12 bp, Homo sapiens
ctcatgctctga

SEQ ID NO: 5602666 - DNA, 14 bp, Homo sapiens
ctcatgctgaaagc

SEQ ID NO: 5602667 - DNA, 12 bp, Homo sapiens
ctcatgctgcca

SEQ ID NO: 5602668 - DNA, 14 bp, Homo sapiens
ctcatgctgccaat

SEQ ID NO: 5602669 - DNA, 22 bp, Homo sapiens
ctcatgctgccaatatcctaat

SEQ ID NO: 5602670 - DNA, 14 bp, Homo sapiens
ctcatgctgcccct

SEQ ID NO: 5602671 - DNA, 12 bp, Homo sapiens
ctcatgctgctc

SEQ ID NO: 5602672 - DNA, 16 bp, Homo sapiens
ctcatgctgttgctgc

SEQ ID NO: 5602673 - DNA, 16 bp, Homo sapiens
ctcatgcttcttctca

SEQ ID NO: 5602674 - DNA, 17 bp, Homo sapiens
ctcatggaaactggcca

SEQ ID NO: 5602675 - DNA, 22 bp, Homo sapiens
ctcatggactccaggatcctcc

SEQ ID NO: 5602676 - DNA, 23 bp, Homo sapiens
ctcatggagtcatcttgcacaca

SEQ ID NO: 5602677 - DNA, 18 bp, Homo sapiens
ctcatggattgccacagc

SEQ ID NO: 5602678 - DNA, 20 bp, Homo sapiens
ctcatggatttggttatgat

SEQ ID NO: 5602679 - DNA, 15 bp, Homo sapiens
ctcatggcagctgtt

SEQ ID NO: 5602680 - DNA, 19 bp, Homo sapiens
ctcatggcccatcaggggc

SEQ ID NO: 5602681 - DNA, 18 bp, Homo sapiens
ctcatggcccccaggggc

SEQ ID NO: 5602682 - DNA, 19 bp, Homo sapiens
ctcatggcccccaggggca

SEQ ID NO: 5602683 - DNA, 23 bp, Homo sapiens
ctcatggccctgtagttaggcct

SEQ ID NO: 5602684 - DNA, 18 bp, Homo sapiens
ctcatggcgggactggag

SEQ ID NO: 5602685 - DNA, 20 bp, Homo sapiens
ctcatggcgtaatgggcctg

SEQ ID NO: 5602686 - DNA, 23 bp, Homo sapiens
ctcatggcgtaatgggcctgccc

SEQ ID NO: 5602687 - DNA, 22 bp, Homo sapiens
ctcatggctgttatctgtcttt

SEQ ID NO: 5602688 - DNA, 20 bp, Homo sapiens
ctcatggcttgggctggagt

SEQ ID NO: 5602689 - DNA, 18 bp, Homo sapiens
ctcatgggaagcatgtgg

SEQ ID NO: 5602690 - DNA, 15 bp, Homo sapiens
ctcatgggacctgcc

SEQ ID NO: 5602691 - DNA, 15 bp, Homo sapiens
ctcatgggagtcagg

SEQ ID NO: 5602692 - DNA, 19 bp, Homo sapiens
ctcatgggagtcagggagc

SEQ ID NO: 5602693 - DNA, 15 bp, Homo sapiens
ctcatggggaagctt

SEQ ID NO: 5602694 - DNA, 19 bp, Homo sapiens
ctcatggggaagcttccat

SEQ ID NO: 5602695 - DNA, 14 bp, Homo sapiens
ctcatgggtggcac

SEQ ID NO: 5602696 - DNA, 19 bp, Homo sapiens
ctcatgggtggcactcagt

SEQ ID NO: 5602697 - DNA, 14 bp, Homo sapiens
ctcatgggtggctg

SEQ ID NO: 5602698 - DNA, 15 bp, Homo sapiens
ctcatgggtggctgt

SEQ ID NO: 5602699 - DNA, 20 bp, Homo sapiens
ctcatggtcccacttcccca

SEQ ID NO: 5602700 - DNA, 22 bp, Homo sapiens
ctcatggtcccacttccccatc

SEQ ID NO: 5602701 - DNA, 20 bp, Homo sapiens
ctcatggtccccatggcatg

SEQ ID NO: 5602702 - DNA, 23 bp, Homo sapiens
ctcatggtgaaatctgctctgta

SEQ ID NO: 5602703 - DNA, 17 bp, Homo sapiens
ctcatggtgcatataaa

SEQ ID NO: 5602704 - DNA, 14 bp, Homo sapiens
ctcatgtaacacat

SEQ ID NO: 5602705 - DNA, 18 bp, Homo sapiens
ctcatgtaacacataaac

SEQ ID NO: 5602706 - DNA, 21 bp, Homo sapiens
ctcatgtaacacataaacaat

SEQ ID NO: 5602707 - DNA, 14 bp, Homo sapiens
ctcatgtaatttgc

SEQ ID NO: 5602708 - DNA, 16 bp, Homo sapiens
ctcatgtaatttgcat

SEQ ID NO: 5602709 - DNA, 23 bp, Homo sapiens
ctcatgtatattacccaatggaa

SEQ ID NO: 5602710 - DNA, 17 bp, Homo sapiens
ctcatgtatcatctgga

SEQ ID NO: 5602711 - DNA, 19 bp, Homo sapiens
ctcatgtcattatgacatt

SEQ ID NO: 5602712 - DNA, 20 bp, Homo sapiens
ctcatgtccccttcctgttc

SEQ ID NO: 5602713 - DNA, 17 bp, Homo sapiens
ctcatgtccctatttat

SEQ ID NO: 5602714 - DNA, 14 bp, Homo sapiens
ctcatgtccctcca

SEQ ID NO: 5602715 - DNA, 19 bp, Homo sapiens
ctcatgtccctgtccccag

SEQ ID NO: 5602716 - DNA, 21 bp, Homo sapiens
ctcatgtccctgtccccaggc

SEQ ID NO: 5602717 - DNA, 23 bp, Homo sapiens
ctcatgtccctgtccccaggccc

SEQ ID NO: 5602718 - DNA, 14 bp, Homo sapiens
ctcatgtcctgtcc

SEQ ID NO: 5602719 - DNA, 15 bp, Homo sapiens
ctcatgtcctgtcct

SEQ ID NO: 5602720 - DNA, 21 bp, Homo sapiens
ctcatgtcctgtcctggtcct

SEQ ID NO: 5602721 - DNA, 15 bp, Homo sapiens
ctcatgtctcagcct

SEQ ID NO: 5602722 - DNA, 20 bp, Homo sapiens
ctcatgtctctttggggaga

SEQ ID NO: 5602723 - DNA, 15 bp, Homo sapiens
ctccactccttcctg

SEQ ID NO: 5602724 - DNA, 19 bp, Homo sapiens
ctccactccttcctgccac

SEQ ID NO: 5602725 - DNA, 22 bp, Homo sapiens
ctccactccttcctgccacctg

SEQ ID NO: 5602726 - DNA, 16 bp, Homo sapiens
ctccactctagttcta

SEQ ID NO: 5602727 - DNA, 20 bp, Homo sapiens
ctccactctagttctagatg

SEQ ID NO: 5602728 - DNA, 13 bp, Homo sapiens
ctccactctcccc

SEQ ID NO: 5602729 - DNA, 20 bp, Homo sapiens
ctccactctccttcgtgtct

SEQ ID NO: 5602730 - DNA, 14 bp, Homo sapiens
ctccactctgaggt

SEQ ID NO: 5602731 - DNA, 15 bp, Homo sapiens
ctccactctgaggtc

SEQ ID NO: 5602732 - DNA, 18 bp, Homo sapiens
ctccactctgaggtctca

SEQ ID NO: 5602733 - DNA, 23 bp, Homo sapiens
ctccactctgaggtctcaccttc

SEQ ID NO: 5602734 - DNA, 22 bp, Homo sapiens
ctccactctgattcacctcttc

SEQ ID NO: 5602735 - DNA, 23 bp, Homo sapiens
ctccactctgattcacctcttcc

SEQ ID NO: 5602736 - DNA, 12 bp, Homo sapiens
ctccactctgct

SEQ ID NO: 5602737 - DNA, 14 bp, Homo sapiens
ctccactctgcttc

SEQ ID NO: 5602738 - DNA, 16 bp, Homo sapiens
ctccactctgcttctc

SEQ ID NO: 5602739 - DNA, 20 bp, Homo sapiens
ctccactctgcttctctgac

SEQ ID NO: 5602740 - DNA, 21 bp, Homo sapiens
ctccactctgcttctctgact

SEQ ID NO: 5602741 - DNA, 22 bp, Homo sapiens
ctccactgacctggaagagctg

SEQ ID NO: 5602742 - DNA, 22 bp, Homo sapiens
ctccactgcaagagggggggcc

SEQ ID NO: 5602743 - DNA, 15 bp, Homo sapiens
ctccactgccctggc

SEQ ID NO: 5602744 - DNA, 19 bp, Homo sapiens
ctccactgccctggcagca

SEQ ID NO: 5602745 - DNA, 11 bp, Homo sapiens
ctccactgcct

SEQ ID NO: 5602746 - DNA, 15 bp, Homo sapiens
ctccactgccttcga

SEQ ID NO: 5602747 - DNA, 16 bp, Homo sapiens
ctccactgccttcgat

SEQ ID NO: 5602748 - DNA, 15 bp, Homo sapiens
ctccactgcctttgg

SEQ ID NO: 5602749 - DNA, 20 bp, Homo sapiens
ctccactgctctcagcctcc

SEQ ID NO: 5602750 - DNA, 11 bp, Homo sapiens
ctccactgctg

SEQ ID NO: 5602751 - DNA, 19 bp, Homo sapiens
ctccactggacagacccag

SEQ ID NO: 5602752 - DNA, 23 bp, Homo sapiens
ctccactggccggagtcagtgcc

SEQ ID NO: 5602753 - DNA, 17 bp, Homo sapiens
ctccactggctccatga

SEQ ID NO: 5602754 - DNA, 13 bp, Homo sapiens
ctccactgtcaca

SEQ ID NO: 5602755 - DNA, 23 bp, Homo sapiens
ctccactgtcataatctctttcc

SEQ ID NO: 5602756 - DNA, 17 bp, Homo sapiens
ctccactgtgcctttgc

SEQ ID NO: 5602757 - DNA, 18 bp, Homo sapiens
ctccactgtttcatgagc

SEQ ID NO: 5602758 - DNA, 21 bp, Homo sapiens
ctccactgtttcatgagccca

SEQ ID NO: 5602759 - DNA, 22 bp, Homo sapiens
ctccacttactataatggttgg

SEQ ID NO: 5602760 - DNA, 21 bp, Homo sapiens
ctccacttcatttttaagaaa

SEQ ID NO: 5602761 - DNA, 20 bp, Homo sapiens
ctccacttcccgtctcagaa

SEQ ID NO: 5602762 - DNA, 13 bp, Homo sapiens
ctccacttccctc

SEQ ID NO: 5602763 - DNA, 22 bp, Homo sapiens
ctccacttctggtcccctgtgg

SEQ ID NO: 5602764 - DNA, 18 bp, Homo sapiens
ctccacttggacatgggc

SEQ ID NO: 5602765 - DNA, 15 bp, Homo sapiens
ctccacttggtctgt

SEQ ID NO: 5602766 - DNA, 16 bp, Homo sapiens
ctccacttggtctgtg

SEQ ID NO: 5602767 - DNA, 23 bp, Homo sapiens
ctccacttggtctgtgagatgct

SEQ ID NO: 5602768 - DNA, 20 bp, Homo sapiens
ctccactttcagctgtcttt

SEQ ID NO: 5602769 - DNA, 20 bp, Homo sapiens
ctccactttctagccagagg

SEQ ID NO: 5602770 - DNA, 17 bp, Homo sapiens
ctccactttctcatccg

SEQ ID NO: 5602771 - DNA, 15 bp, Homo sapiens
ctccactttgttgga

SEQ ID NO: 5602772 - DNA, 16 bp, Homo sapiens
ctccagaaacagctgc

SEQ ID NO: 5602773 - DNA, 19 bp, Homo sapiens
ctccagaaacagctgcttc

SEQ ID NO: 5602774 - DNA, 15 bp, Homo sapiens
ctccagaaacggcca

SEQ ID NO: 5602775 - DNA, 22 bp, Homo sapiens
ctccagaaatgtctaaatgctg

SEQ ID NO: 5602776 - DNA, 22 bp, Homo sapiens
ctccagaacaaacctctatatg

SEQ ID NO: 5602777 - DNA, 20 bp, Homo sapiens
ctccagaaccttactggcac

SEQ ID NO: 5602778 - DNA, 22 bp, Homo sapiens
ctccagaaccttactggcactg

SEQ ID NO: 5602779 - DNA, 19 bp, Homo sapiens
ctccagaactcttcctcca

SEQ ID NO: 5602780 - DNA, 14 bp, Homo sapiens
ctccagaagatagc

SEQ ID NO: 5602781 - DNA, 23 bp, Homo sapiens
ctccagaagatagcttcacccca

SEQ ID NO: 5602782 - DNA, 22 bp, Homo sapiens
ctccagaagatgccagcttctc

SEQ ID NO: 5602783 - DNA, 16 bp, Homo sapiens
ctccagaagcagcagc

SEQ ID NO: 5602784 - DNA, 14 bp, Homo sapiens
ctccagaagcctcc

SEQ ID NO: 5602785 - DNA, 15 bp, Homo sapiens
ctccagaagcctcct

SEQ ID NO: 5602786 - DNA, 21 bp, Homo sapiens
ctccagaagcctccttacatt

SEQ ID NO: 5602787 - DNA, 15 bp, Homo sapiens
ctccagaagcctctg

SEQ ID NO: 5602788 - DNA, 15 bp, Homo sapiens
ctccagaagctgctc

SEQ ID NO: 5602789 - DNA, 14 bp, Homo sapiens
ctccagaagtccct

SEQ ID NO: 5602790 - DNA, 18 bp, Homo sapiens
ctccagaagtcccttcaa

SEQ ID NO: 5602791 - DNA, 18 bp, Homo sapiens
ctccagaataccttcttc

SEQ ID NO: 5602792 - DNA, 22 bp, Homo sapiens
ctccagaatctgctgttgccat

SEQ ID NO: 5602793 - DNA, 15 bp, Homo sapiens
ctccagaatgtgctg

SEQ ID NO: 5602794 - DNA, 16 bp, Homo sapiens
ctccagaatgtgctgc

SEQ ID NO: 5602795 - DNA, 17 bp, Homo sapiens
ctccagaatgtgctgcc

SEQ ID NO: 5602796 - DNA, 18 bp, Homo sapiens
ctccagaatgtgctgcct

SEQ ID NO: 5602797 - DNA, 18 bp, Homo sapiens
ctccagaattacccttcc

SEQ ID NO: 5602798 - DNA, 20 bp, Homo sapiens
ctccagacaaaccagaagca

SEQ ID NO: 5602799 - DNA, 14 bp, Homo sapiens
ctccagacacagag

SEQ ID NO: 5602800 - DNA, 19 bp, Homo sapiens
ctccagacacatgtccaag

SEQ ID NO: 5602801 - DNA, 22 bp, Homo sapiens
ctccagacagatacagccccaa

SEQ ID NO: 5602802 - DNA, 17 bp, Homo sapiens
ctccagacaggaggagt

SEQ ID NO: 5602803 - DNA, 16 bp, Homo sapiens
ctccagaccaaagcaa

SEQ ID NO: 5602804 - DNA, 12 bp, Homo sapiens
ctccagacccag

SEQ ID NO: 5602805 - DNA, 16 bp, Homo sapiens
ctccagacccccaccc

SEQ ID NO: 5602806 - DNA, 18 bp, Homo sapiens
ctccagacccccacccct

SEQ ID NO: 5602807 - DNA, 12 bp, Homo sapiens
ctccagacccct

SEQ ID NO: 5602808 - DNA, 21 bp, Homo sapiens
ctccagacccctaccctttcc

SEQ ID NO: 5602809 - DNA, 14 bp, Homo sapiens
ctccagacccctgg

SEQ ID NO: 5602810 - DNA, 21 bp, Homo sapiens
ctccagacccctggcttttca

SEQ ID NO: 5602811 - DNA, 15 bp, Homo sapiens
ctccagacccctgtg

SEQ ID NO: 5602812 - DNA, 22 bp, Homo sapiens
ctccagacccctgtggcagacc

SEQ ID NO: 5602813 - DNA, 14 bp, Homo sapiens
ctccagaccctgcc

SEQ ID NO: 5602814 - DNA, 15 bp, Homo sapiens
ctccagaccctgcct

SEQ ID NO: 5602815 - DNA, 21 bp, Homo sapiens
ctccagaccctgcctgagccc

SEQ ID NO: 5602816 - DNA, 22 bp, Homo sapiens
ctccagacctgcccctccctct

SEQ ID NO: 5602817 - DNA, 20 bp, Homo sapiens
ctccagacgtaggggagggg

SEQ ID NO: 5602818 - DNA, 23 bp, Homo sapiens
ctccagactaacatgtcagtttt

SEQ ID NO: 5602819 - DNA, 21 bp, Homo sapiens
ctccagactcagcagagtgag

SEQ ID NO: 5602820 - DNA, 18 bp, Homo sapiens
ctccagactcgagagggc

SEQ ID NO: 5602821 - DNA, 23 bp, Homo sapiens
ctccagactcgagagggctgagc

SEQ ID NO: 5602822 - DNA, 13 bp, Homo sapiens
ctccagactctct

SEQ ID NO: 5602823 - DNA, 16 bp, Homo sapiens
ctccagactgcggagc

SEQ ID NO: 5602824 - DNA, 22 bp, Homo sapiens
ctccagactgcggagcagcctc

SEQ ID NO: 5602825 - DNA, 20 bp, Homo sapiens
ctccagagaaacccagggag

SEQ ID NO: 5602826 - DNA, 22 bp, Homo sapiens
ctccagagaaagcacaatttaa

SEQ ID NO: 5602827 - DNA, 18 bp, Homo sapiens
ctccagagaagccccgca

SEQ ID NO: 5602828 - DNA, 24 bp, Homo sapiens
ctccagagaagccccgcacgggct

SEQ ID NO: 5602829 - DNA, 19 bp, Homo sapiens
ctccagagacactgagcca

SEQ ID NO: 5602830 - DNA, 21 bp, Homo sapiens
ctccagagacactgagccagt

SEQ ID NO: 5602831 - DNA, 16 bp, Homo sapiens
ctccagagacaggaaa

SEQ ID NO: 5602832 - DNA, 18 bp, Homo sapiens
ctccagagacaggaaaga

SEQ ID NO: 5602833 - DNA, 19 bp, Homo sapiens
ctccagagactcgagtccc

SEQ ID NO: 5602834 - DNA, 21 bp, Homo sapiens
ctccagagagaaatcaggcct

SEQ ID NO: 5602835 - DNA, 14 bp, Homo sapiens
ctccagagcaggaa

SEQ ID NO: 5602836 - DNA, 13 bp, Homo sapiens
ctccagagccagc

SEQ ID NO: 5602837 - DNA, 19 bp, Homo sapiens
ctccagagccagcctggga

SEQ ID NO: 5602838 - DNA, 21 bp, Homo sapiens
ctccagagccagcctgggact

SEQ ID NO: 5602839 - DNA, 18 bp, Homo sapiens
ctccagagccccacagcc

SEQ ID NO: 5602840 - DNA, 21 bp, Homo sapiens
ctccagagctgcggtgtctcc

SEQ ID NO: 5602841 - DNA, 22 bp, Homo sapiens
ctccagagctgtcctcctggca

SEQ ID NO: 5602842 - DNA, 23 bp, Homo sapiens
ctccagagctgtcctcctggcac

SEQ ID NO: 5602843 - DNA, 18 bp, Homo sapiens
ctccagagggcactcaga

SEQ ID NO: 5602844 - DNA, 20 bp, Homo sapiens
ctccagagggcactcagaag

SEQ ID NO: 5602845 - DNA, 20 bp, Homo sapiens
ctccagaggggctcaggtca

SEQ ID NO: 5602846 - DNA, 16 bp, Homo sapiens
ctccagagtcagaagt

SEQ ID NO: 5602847 - DNA, 16 bp, Homo sapiens
ctccagagtctgagcc

SEQ ID NO: 5602848 - DNA, 17 bp, Homo sapiens
ctccagagtctgagccc

SEQ ID NO: 5602849 - DNA, 18 bp, Homo sapiens
ctccagagtctgagcccc

SEQ ID NO: 5602850 - DNA, 19 bp, Homo sapiens
ctccagagtctgagccccc

SEQ ID NO: 5602851 - DNA, 20 bp, Homo sapiens
ctccagagtgtgcagactga

SEQ ID NO: 5602852 - DNA, 21 bp, Homo sapiens
ctccagataactctctttcct

SEQ ID NO: 5602853 - DNA, 22 bp, Homo sapiens
ctccagataactctctttcctt

SEQ ID NO: 5602854 - DNA, 15 bp, Homo sapiens
ctccagatagagaaa

SEQ ID NO: 5602855 - DNA, 23 bp, Homo sapiens
ctccagatatgaacagggcccag

SEQ ID NO: 5602856 - DNA, 23 bp, Homo sapiens
ctccagatcctctttccccactg

SEQ ID NO: 5602857 - DNA, 14 bp, Homo sapiens
ctccagatctgcac

SEQ ID NO: 5602858 - DNA, 16 bp, Homo sapiens
ctccagatgcagggca

SEQ ID NO: 5602859 - DNA, 18 bp, Homo sapiens
ctccagatgcagggcagt

SEQ ID NO: 5602860 - DNA, 17 bp, Homo sapiens
ctccagatgtttccaga

SEQ ID NO: 5602861 - DNA, 17 bp, Homo sapiens
ctccagatgtttctcat

SEQ ID NO: 5602862 - DNA, 22 bp, Homo sapiens
ctccagattagagcctgtaaac

SEQ ID NO: 5602863 - DNA, 14 bp, Homo sapiens
ctccagattatttt

SEQ ID NO: 5602864 - DNA, 19 bp, Homo sapiens
ctccagattattttctata

SEQ ID NO: 5602865 - DNA, 14 bp, Homo sapiens
ctccagatttttaa

SEQ ID NO: 5602866 - DNA, 20 bp, Homo sapiens
ctccagatttttcggaggcc

SEQ ID NO: 5602867 - DNA, 16 bp, Homo sapiens
ctccagcaacacagcc

SEQ ID NO: 5602868 - DNA, 20 bp, Homo sapiens
ctccagcaacacagcctggg

SEQ ID NO: 5602869 - DNA, 17 bp, Homo sapiens
ctccagcaactgccctt

SEQ ID NO: 5602870 - DNA, 19 bp, Homo sapiens
ctccagcaactgcccttcc

SEQ ID NO: 5602871 - DNA, 11 bp, Homo sapiens
ctccagcacaa

SEQ ID NO: 5602872 - DNA, 21 bp, Homo sapiens
ctccagcacaaacacaaggtc

SEQ ID NO: 5602873 - DNA, 13 bp, Homo sapiens
ctccagcacagac

SEQ ID NO: 5602874 - DNA, 20 bp, Homo sapiens
ctccagcacctgtggctgac

SEQ ID NO: 5602875 - DNA, 13 bp, Homo sapiens
ctccagcaccttc

SEQ ID NO: 5602876 - DNA, 23 bp, Homo sapiens
ctccagcaccttctttctggact

SEQ ID NO: 5602877 - DNA, 23 bp, Homo sapiens
ctccagcacgcgacttctcagga

SEQ ID NO: 5602878 - DNA, 23 bp, Homo sapiens
ctccagcacgttttctggcttct

SEQ ID NO: 5602879 - DNA, 14 bp, Homo sapiens
ctccagcactacca

SEQ ID NO: 5602880 - DNA, 11 bp, Homo sapiens
ctccagcactc

SEQ ID NO: 5602881 - DNA, 19 bp, Homo sapiens
ctccagcagactcctgctc

SEQ ID NO: 5602882 - DNA, 18 bp, Homo sapiens
ctccagcagataaggccg

SEQ ID NO: 5602883 - DNA, 22 bp, Homo sapiens
ctccagcaggaaggaccccaca

SEQ ID NO: 5602884 - DNA, 13 bp, Homo sapiens
ctccagcaggagg

SEQ ID NO: 5602885 - DNA, 14 bp, Homo sapiens
ctccagcagtgctg

SEQ ID NO: 5602886 - DNA, 15 bp, Homo sapiens
ctccagcagtgctgg

SEQ ID NO: 5602887 - DNA, 23 bp, Homo sapiens
ctccagcagtgctgggcccagcc

SEQ ID NO: 5602888 - DNA, 14 bp, Homo sapiens
ctccagcatccagc

SEQ ID NO: 5602889 - DNA, 16 bp, Homo sapiens
ctccagcatccagcct

SEQ ID NO: 5602890 - DNA, 18 bp, Homo sapiens
ctccagcatccagcctgt

SEQ ID NO: 5602891 - DNA, 12 bp, Homo sapiens
ctccagcatccc

SEQ ID NO: 5602892 - DNA, 13 bp, Homo sapiens
ctccagcatccca

SEQ ID NO: 5602893 - DNA, 15 bp, Homo sapiens
ctccagcatcccagc

SEQ ID NO: 5602894 - DNA, 19 bp, Homo sapiens
ctccagcatcccagcctca

SEQ ID NO: 5602895 - DNA, 14 bp, Homo sapiens
ctccagcatctttt

SEQ ID NO: 5602896 - DNA, 21 bp, Homo sapiens
ctccagcatcttttccatcct

SEQ ID NO: 5602897 - DNA, 23 bp, Homo sapiens
ctccagcatcttttccatcctga

SEQ ID NO: 5602898 - DNA, 16 bp, Homo sapiens
ctcccaaagtgctggg

SEQ ID NO: 5602899 - DNA, 17 bp, Homo sapiens
ctcccaaagtgctggga

SEQ ID NO: 5602900 - DNA, 19 bp, Homo sapiens
ctcccaaagtgctgggatt

SEQ ID NO: 5602901 - DNA, 18 bp, Homo sapiens
ctcccaaatatgcccctc

SEQ ID NO: 5602902 - DNA, 22 bp, Homo sapiens
ctcccaaatatgcccctcccca

SEQ ID NO: 5602903 - DNA, 19 bp, Homo sapiens
ctcccaaatgcagcttcag

SEQ ID NO: 5602904 - DNA, 14 bp, Homo sapiens
ctcccaacagagct

SEQ ID NO: 5602905 - DNA, 19 bp, Homo sapiens
ctcccaacatgggagggat

SEQ ID NO: 5602906 - DNA, 21 bp, Homo sapiens
ctcccaacatgggagggatca

SEQ ID NO: 5602907 - DNA, 15 bp, Homo sapiens
ctcccaaccaaccag

SEQ ID NO: 5602908 - DNA, 22 bp, Homo sapiens
ctcccaacccaattcaggactg

SEQ ID NO: 5602909 - DNA, 17 bp, Homo sapiens
ctcccaacccagccgtc

SEQ ID NO: 5602910 - DNA, 15 bp, Homo sapiens
ctcccaacccattca

SEQ ID NO: 5602911 - DNA, 23 bp, Homo sapiens
ctcccaacctcaatgccctgcca

SEQ ID NO: 5602912 - DNA, 19 bp, Homo sapiens
ctcccaacgagcctcctca

SEQ ID NO: 5602913 - DNA, 17 bp, Homo sapiens
ctcccaacgctgaagcg

SEQ ID NO: 5602914 - DNA, 19 bp, Homo sapiens
ctcccaacgctgaagcggt

SEQ ID NO: 5602915 - DNA, 21 bp, Homo sapiens
ctcccaactataaaactaggt

SEQ ID NO: 5602916 - DNA, 14 bp, Homo sapiens
ctcccaactcagcc

SEQ ID NO: 5602917 - DNA, 18 bp, Homo sapiens
ctcccaactcagcctgtt

SEQ ID NO: 5602918 - DNA, 15 bp, Homo sapiens
ctcccaactcccttc

SEQ ID NO: 5602919 - DNA, 17 bp, Homo sapiens
ctcccaactcccttctg

SEQ ID NO: 5602920 - DNA, 16 bp, Homo sapiens
ctcccaactctggcct

SEQ ID NO: 5602921 - DNA, 20 bp, Homo sapiens
ctcccaacttcttcctgtga

SEQ ID NO: 5602922 - DNA, 17 bp, Homo sapiens
ctcccaagaacagcagg

SEQ ID NO: 5602923 - DNA, 20 bp, Homo sapiens
ctcccaagagcttccagagc

SEQ ID NO: 5602924 - DNA, 13 bp, Homo sapiens
ctcccaagcagct

SEQ ID NO: 5602925 - DNA, 16 bp, Homo sapiens
ctcccaagcagctgaa

SEQ ID NO: 5602926 - DNA, 15 bp, Homo sapiens
ctcccaagccactag

SEQ ID NO: 5602927 - DNA, 22 bp, Homo sapiens
ctcccaagcccacgtcaggcct

SEQ ID NO: 5602928 - DNA, 13 bp, Homo sapiens
ctcccaagcccct

SEQ ID NO: 5602929 - DNA, 18 bp, Homo sapiens
ctcccaagcgttcctggc

SEQ ID NO: 5602930 - DNA, 20 bp, Homo sapiens
ctcccaagcgttcctggcct

SEQ ID NO: 5602931 - DNA, 22 bp, Homo sapiens
ctcccaagcgttcctggccttc

SEQ ID NO: 5602932 - DNA, 19 bp, Homo sapiens
ctcccaagctcagagcagc

SEQ ID NO: 5602933 - DNA, 11 bp, Homo sapiens
ctcccaagctg

SEQ ID NO: 5602934 - DNA, 18 bp, Homo sapiens
ctcccaagctgatggaca

SEQ ID NO: 5602935 - DNA, 17 bp, Homo sapiens
ctcccaagctgatttta

SEQ ID NO: 5602936 - DNA, 20 bp, Homo sapiens
ctcccaaggactttccagtg

SEQ ID NO: 5602937 - DNA, 21 bp, Homo sapiens
ctcccaaggactttccagtga

SEQ ID NO: 5602938 - DNA, 21 bp, Homo sapiens
ctcccaaggcattctcccagc

SEQ ID NO: 5602939 - DNA, 18 bp, Homo sapiens
ctcccaaggctgcgtctg

SEQ ID NO: 5602940 - DNA, 21 bp, Homo sapiens
ctcccaaggctgcgtctggag

SEQ ID NO: 5602941 - DNA, 14 bp, Homo sapiens
ctcccaagggatgg

SEQ ID NO: 5602942 - DNA, 18 bp, Homo sapiens
ctcccaaggtcctctcag

SEQ ID NO: 5602943 - DNA, 17 bp, Homo sapiens
ctcccaagtagctggga

SEQ ID NO: 5602944 - DNA, 23 bp, Homo sapiens
ctcccaagtagctgggaccacag

SEQ ID NO: 5602945 - DNA, 19 bp, Homo sapiens
ctcccaagtagctgggatt

SEQ ID NO: 5602946 - DNA, 22 bp, Homo sapiens
ctcccaagtagctgggattaca

SEQ ID NO: 5602947 - DNA, 19 bp, Homo sapiens
ctcccaagtcacacccact

SEQ ID NO: 5602948 - DNA, 18 bp, Homo sapiens
ctcccaagtcccaccctc

SEQ ID NO: 5602949 - DNA, 22 bp, Homo sapiens
ctcccaagtcccaccctcttcc

SEQ ID NO: 5602950 - DNA, 17 bp, Homo sapiens
ctcccaagtctacagag

SEQ ID NO: 5602951 - DNA, 17 bp, Homo sapiens
ctcccaagtggtgccta

SEQ ID NO: 5602952 - DNA, 14 bp, Homo sapiens
ctcccaatcagctt

SEQ ID NO: 5602953 - DNA, 15 bp, Homo sapiens
ctcccaatcagcttt

SEQ ID NO: 5602954 - DNA, 17 bp, Homo sapiens
ctcccaatcagcttttg

SEQ ID NO: 5602955 - DNA, 23 bp, Homo sapiens
ctcccaatcagcttttgttctag

SEQ ID NO: 5602956 - DNA, 17 bp, Homo sapiens
ctcccaatcctctctcc

SEQ ID NO: 5602957 - DNA, 18 bp, Homo sapiens
ctcccaatcctctctccc

SEQ ID NO: 5602958 - DNA, 19 bp, Homo sapiens
ctcccaatcctctctcccc

SEQ ID NO: 5602959 - DNA, 19 bp, Homo sapiens
ctcccaatggtgcttggag

SEQ ID NO: 5602960 - DNA, 13 bp, Homo sapiens
ctcccaattcatc

SEQ ID NO: 5602961 - DNA, 21 bp, Homo sapiens
ctcccaatttcagactcccat

SEQ ID NO: 5602962 - DNA, 22 bp, Homo sapiens
ctcccacaaataagttcccatt

SEQ ID NO: 5602963 - DNA, 15 bp, Homo sapiens
ctcccacaagcctga

SEQ ID NO: 5602964 - DNA, 22 bp, Homo sapiens
ctcccacacccaaagctgagcc

SEQ ID NO: 5602965 - DNA, 20 bp, Homo sapiens
ctcccacaccgcgtcccagc

SEQ ID NO: 5602966 - DNA, 15 bp, Homo sapiens
ctcccacactcgcca

SEQ ID NO: 5602967 - DNA, 16 bp, Homo sapiens
ctcccacacttgtgcc

SEQ ID NO: 5602968 - DNA, 13 bp, Homo sapiens
ctcccacagacct

SEQ ID NO: 5602969 - DNA, 16 bp, Homo sapiens
ctcccacagacctgca

SEQ ID NO: 5602970 - DNA, 15 bp, Homo sapiens
ctcccacagagacaa

SEQ ID NO: 5602971 - DNA, 18 bp, Homo sapiens
ctcccacagagtgctgga

SEQ ID NO: 5602972 - DNA, 21 bp, Homo sapiens
ctcccacagagtgctggactg

SEQ ID NO: 5602973 - DNA, 22 bp, Homo sapiens
ctcccacagagtgctggactgt

SEQ ID NO: 5602974 - DNA, 18 bp, Homo sapiens
ctcccacagcctggctat

SEQ ID NO: 5602975 - DNA, 16 bp, Homo sapiens
ctcccacagcttcctg

SEQ ID NO: 5602976 - DNA, 14 bp, Homo sapiens
ctcccacaggcagc

SEQ ID NO: 5602977 - DNA, 15 bp, Homo sapiens
ctcccacaggcagct

SEQ ID NO: 5602978 - DNA, 21 bp, Homo sapiens
ctcccacaggcccttcctctc

SEQ ID NO: 5602979 - DNA, 20 bp, Homo sapiens
ctcccacagtcccatctgct

SEQ ID NO: 5602980 - DNA, 14 bp, Homo sapiens
ctcccaccaccctc

SEQ ID NO: 5602981 - DNA, 15 bp, Homo sapiens
ctcccaccaccctcc

SEQ ID NO: 5602982 - DNA, 17 bp, Homo sapiens
ctcccaccactccactc

SEQ ID NO: 5602983 - DNA, 13 bp, Homo sapiens
ctcccaccagagc

SEQ ID NO: 5602984 - DNA, 18 bp, Homo sapiens
ctcccaccagagccggga

SEQ ID NO: 5602985 - DNA, 21 bp, Homo sapiens
ctcccaccaggcagctccagc

SEQ ID NO: 5602986 - DNA, 22 bp, Homo sapiens
ctcccaccaggcagctccagct

SEQ ID NO: 5602987 - DNA, 14 bp, Homo sapiens
ctcccaccaggcta

SEQ ID NO: 5602988 - DNA, 20 bp, Homo sapiens
ctcccaccataatccctgtc

SEQ ID NO: 5602989 - DNA, 14 bp, Homo sapiens
ctcccaccatgcgc

SEQ ID NO: 5602990 - DNA, 16 bp, Homo sapiens
ctcccacccaaccaac

SEQ ID NO: 5602991 - DNA, 21 bp, Homo sapiens
ctcccacccagtctctgctcc

SEQ ID NO: 5602992 - DNA, 22 bp, Homo sapiens
ctcccaccccacccccttcagt

SEQ ID NO: 5602993 - DNA, 14 bp, Homo sapiens
ctcccaccccactc

SEQ ID NO: 5602994 - DNA, 17 bp, Homo sapiens
ctcccaccccactcagg

SEQ ID NO: 5602995 - DNA, 22 bp, Homo sapiens
ctcccaccccactcaggggacc

SEQ ID NO: 5602996 - DNA, 12 bp, Homo sapiens
ctcccaccccag

SEQ ID NO: 5602997 - DNA, 20 bp, Homo sapiens
ctcccaccccagaaatcact

SEQ ID NO: 5602998 - DNA, 22 bp, Homo sapiens
ctcccaccccagaaatcactgt

SEQ ID NO: 5602999 - DNA, 22 bp, Homo sapiens
ctcccaccccagcctcaagtag

SEQ ID NO: 5603000 - DNA, 15 bp, Homo sapiens
ctcccacccccagcc

SEQ ID NO: 5603001 - DNA, 19 bp, Homo sapiens
ctcccaccccctccccggg

SEQ ID NO: 5603002 - DNA, 18 bp, Homo sapiens
ctcccacccccttctctg

SEQ ID NO: 5603003 - DNA, 17 bp, Homo sapiens
ctcccaccccggcctcc

SEQ ID NO: 5603004 - DNA, 17 bp, Homo sapiens
ctcccacccgatgctgc

SEQ ID NO: 5603005 - DNA, 21 bp, Homo sapiens
ctcccacccgatgctgctttc

SEQ ID NO: 5603006 - DNA, 23 bp, Homo sapiens
ctcccacccgatgctgctttccc

SEQ ID NO: 5603007 - DNA, 18 bp, Homo sapiens
ctcccacccggccacagc

SEQ ID NO: 5603008 - DNA, 19 bp, Homo sapiens
ctcccacccggccacagct

SEQ ID NO: 5603009 - DNA, 20 bp, Homo sapiens
ctcccacccggccacagctg

SEQ ID NO: 5603010 - DNA, 19 bp, Homo sapiens
ctcccacccggctgcagag

SEQ ID NO: 5603011 - DNA, 15 bp, Homo sapiens
ctcccaccctaaggg

SEQ ID NO: 5603012 - DNA, 20 bp, Homo sapiens
ctcccaccctaagggcagcc

SEQ ID NO: 5603013 - DNA, 14 bp, Homo sapiens
ctcccaccctaccc

SEQ ID NO: 5603014 - DNA, 19 bp, Homo sapiens
ctcccaccctttctgccag

SEQ ID NO: 5603015 - DNA, 12 bp, Homo sapiens
ctcccaccgccc

SEQ ID NO: 5603016 - DNA, 13 bp, Homo sapiens
ctcccaccgcccc

SEQ ID NO: 5603017 - DNA, 19 bp, Homo sapiens
ctcccaccgcccccacccc

SEQ ID NO: 5603018 - DNA, 20 bp, Homo sapiens
ctcccaccgcccccacccct

SEQ ID NO: 5603019 - DNA, 17 bp, Homo sapiens
ctcccaccgctgcctcg

SEQ ID NO: 5603020 - DNA, 14 bp, Homo sapiens
ctcccacctcagcc

SEQ ID NO: 5603021 - DNA, 18 bp, Homo sapiens
ctcccacctccccttggg

SEQ ID NO: 5603022 - DNA, 15 bp, Homo sapiens
ctcccacctcccttc

SEQ ID NO: 5603023 - DNA, 15 bp, Homo sapiens
ctcccacctcctgac

SEQ ID NO: 5603024 - DNA, 14 bp, Homo sapiens
ctcccacctccttc

SEQ ID NO: 5603025 - DNA, 16 bp, Homo sapiens
ctcccacctccttcct

SEQ ID NO: 5603026 - DNA, 13 bp, Homo sapiens
ctcccacctctgt

SEQ ID NO: 5603027 - DNA, 15 bp, Homo sapiens
ctcccacctctgtga

SEQ ID NO: 5603028 - DNA, 20 bp, Homo sapiens
ctcccacctctgtgacctca

SEQ ID NO: 5603029 - DNA, 14 bp, Homo sapiens
ctcccacctgacac

SEQ ID NO: 5603030 - DNA, 21 bp, Homo sapiens
ctcccacctgacacaccaggc

SEQ ID NO: 5603031 - DNA, 18 bp, Homo sapiens
ctcccacctgtttctgga

SEQ ID NO: 5603032 - DNA, 14 bp, Homo sapiens
ctcccaccttggcc

SEQ ID NO: 5603033 - DNA, 15 bp, Homo sapiens
ctcccacctttaatc

SEQ ID NO: 5603034 - DNA, 23 bp, Homo sapiens
ctcccacgatgtcaaggactcct

SEQ ID NO: 5603035 - DNA, 14 bp, Homo sapiens
ctcccacgccctcc

SEQ ID NO: 5603036 - DNA, 15 bp, Homo sapiens
ctcccacgccctcct

SEQ ID NO: 5603037 - DNA, 20 bp, Homo sapiens
ctcccacgctgggacacaga

SEQ ID NO: 5603038 - DNA, 22 bp, Homo sapiens
ctcccacgctgggacacagacc

SEQ ID NO: 5603039 - DNA, 18 bp, Homo sapiens
ctcccacggggaccactg

SEQ ID NO: 5603040 - DNA, 12 bp, Homo sapiens
ctcccactccca

SEQ ID NO: 5603041 - DNA, 17 bp, Homo sapiens
ctcccactcccatggct

SEQ ID NO: 5603042 - DNA, 20 bp, Homo sapiens
ctcccactcctaatcaagag

SEQ ID NO: 5603043 - DNA, 13 bp, Homo sapiens
ctcccactcctgc

SEQ ID NO: 5603044 - DNA, 15 bp, Homo sapiens
ctcccactcctgctg

SEQ ID NO: 5603045 - DNA, 17 bp, Homo sapiens
ctcccactcctgctgca

SEQ ID NO: 5603046 - DNA, 16 bp, Homo sapiens
ctcccactctcctagg

SEQ ID NO: 5603047 - DNA, 17 bp, Homo sapiens
ctcccactctcctaggc

SEQ ID NO: 5603048 - DNA, 14 bp, Homo sapiens
ctcccactcttgaa

SEQ ID NO: 5603049 - DNA, 17 bp, Homo sapiens
ctcccactcttgaagag

SEQ ID NO: 5603050 - DNA, 16 bp, Homo sapiens
ctcccactctttgaat

SEQ ID NO: 5603051 - DNA, 14 bp, Homo sapiens
ctcccactgccagg

SEQ ID NO: 5603052 - DNA, 17 bp, Homo sapiens
ctcccactgcccactgg

SEQ ID NO: 5603053 - DNA, 17 bp, Homo sapiens
ctcccactgcccctgca

SEQ ID NO: 5603054 - DNA, 14 bp, Homo sapiens
ctcccactgcgggg

SEQ ID NO: 5603055 - DNA, 23 bp, Homo sapiens
ctcccactggggtccagggagca

SEQ ID NO: 5603056 - DNA, 19 bp, Homo sapiens
ctcccacttccctgacact

SEQ ID NO: 5603057 - DNA, 14 bp, Homo sapiens
ctcccacttcctcc

SEQ ID NO: 5603058 - DNA, 16 bp, Homo sapiens
ctcccacttcctccta

SEQ ID NO: 5603059 - DNA, 19 bp, Homo sapiens
ctcccacttcctcctacct

SEQ ID NO: 5603060 - DNA, 16 bp, Homo sapiens
ctcccacttctgccag

SEQ ID NO: 5603061 - DNA, 17 bp, Homo sapiens
ctcccacttgacctgag

SEQ ID NO: 5603062 - DNA, 15 bp, Homo sapiens
ctcccacttggccaa

SEQ ID NO: 5603063 - DNA, 12 bp, Homo sapiens
ctcccactttgc

SEQ ID NO: 5603064 - DNA, 16 bp, Homo sapiens
ctcccactttgtctgt

SEQ ID NO: 5603065 - DNA, 17 bp, Homo sapiens
ctcccactttgtctgta

SEQ ID NO: 5603066 - DNA, 19 bp, Homo sapiens
ctcccactttgtctgtaca

SEQ ID NO: 5603067 - DNA, 23 bp, Homo sapiens
ctcccactttgtctgtacatact

SEQ ID NO: 5603068 - DNA, 23 bp, Homo sapiens
ctcccagaaaaactggctctgat

SEQ ID NO: 5603069 - DNA, 16 bp, Homo sapiens
ctcccagaaacatctc

SEQ ID NO: 5603070 - DNA, 18 bp, Homo sapiens
ctcccagaaacatctctg

SEQ ID NO: 5603071 - DNA, 21 bp, Homo sapiens
ctcccagaaacatctctggcc

SEQ ID NO: 5603072 - DNA, 24 bp, Homo sapiens
ctcccagaacacactccatcagct

SEQ ID NO: 5603073 - DNA, 17 bp, Homo sapiens
ctcccagaacctctaag

SEQ ID NO: 5603074 - DNA, 23 bp, Homo sapiens
ctcccagaacctctaagtgctgc

SEQ ID NO: 5603075 - DNA, 15 bp, Homo sapiens
ctcccccactccact

SEQ ID NO: 5603076 - DNA, 16 bp, Homo sapiens
ctcccccactccacta

SEQ ID NO: 5603077 - DNA, 17 bp, Homo sapiens
ctcccccactccactac

SEQ ID NO: 5603078 - DNA, 12 bp, Homo sapiens
ctcccccagagc

SEQ ID NO: 5603079 - DNA, 14 bp, Homo sapiens
ctcccccagagccc

SEQ ID NO: 5603080 - DNA, 13 bp, Homo sapiens
ctcccccagagtg

SEQ ID NO: 5603081 - DNA, 20 bp, Homo sapiens
ctcccccagcaaagccccca

SEQ ID NO: 5603082 - DNA, 13 bp, Homo sapiens
ctcccccagcaca

SEQ ID NO: 5603083 - DNA, 12 bp, Homo sapiens
ctcccccagcag

SEQ ID NO: 5603084 - DNA, 14 bp, Homo sapiens
ctcccccagccagg

SEQ ID NO: 5603085 - DNA, 20 bp, Homo sapiens
ctcccccagccccatcctct

SEQ ID NO: 5603086 - DNA, 13 bp, Homo sapiens
ctcccccagccct

SEQ ID NO: 5603087 - DNA, 12 bp, Homo sapiens
ctcccccagctc

SEQ ID NO: 5603088 - DNA, 13 bp, Homo sapiens
ctcccccaggcag

SEQ ID NO: 5603089 - DNA, 15 bp, Homo sapiens
ctcccccaggcctga

SEQ ID NO: 5603090 - DNA, 18 bp, Homo sapiens
ctcccccaggctgcgcct

SEQ ID NO: 5603091 - DNA, 19 bp, Homo sapiens
ctcccccatagcaccctgc

SEQ ID NO: 5603092 - DNA, 17 bp, Homo sapiens
ctcccccatcctcccct

SEQ ID NO: 5603093 - DNA, 13 bp, Homo sapiens
ctcccccatttta

SEQ ID NO: 5603094 - DNA, 15 bp, Homo sapiens
ctccccccactgcag

SEQ ID NO: 5603095 - DNA, 12 bp, Homo sapiens
ctccccccactt

SEQ ID NO: 5603096 - DNA, 15 bp, Homo sapiens
ctccccccagactct

SEQ ID NO: 5603097 - DNA, 16 bp, Homo sapiens
ctccccccagactctt

SEQ ID NO: 5603098 - DNA, 15 bp, Homo sapiens
ctccccccagctccc

SEQ ID NO: 5603099 - DNA, 18 bp, Homo sapiens
ctccccccagctccctgc

SEQ ID NO: 5603100 - DNA, 19 bp, Homo sapiens
ctccccccatcccagggtc

SEQ ID NO: 5603101 - DNA, 21 bp, Homo sapiens
ctcccccccatgcactgtgaa

SEQ ID NO: 5603102 - DNA, 16 bp, Homo sapiens
ctcccccccccctcca

SEQ ID NO: 5603103 - DNA, 21 bp, Homo sapiens
ctccccccgcccacccacgca

SEQ ID NO: 5603104 - DNA, 18 bp, Homo sapiens
ctcccccctccattccca

SEQ ID NO: 5603105 - DNA, 18 bp, Homo sapiens
ctcccccctggccacaga

SEQ ID NO: 5603106 - DNA, 15 bp, Homo sapiens
ctcccccgacactgc

SEQ ID NO: 5603107 - DNA, 21 bp, Homo sapiens
ctcccccgacactgctgcacc

SEQ ID NO: 5603108 - DNA, 22 bp, Homo sapiens
ctcccccgacactgctgcacca

SEQ ID NO: 5603109 - DNA, 18 bp, Homo sapiens
ctcccccgcagtccccag

SEQ ID NO: 5603110 - DNA, 15 bp, Homo sapiens
ctcccccgccacctg

SEQ ID NO: 5603111 - DNA, 22 bp, Homo sapiens
ctcccccgccagccccaagctg

SEQ ID NO: 5603112 - DNA, 14 bp, Homo sapiens
ctcccccgcccaag

SEQ ID NO: 5603113 - DNA, 15 bp, Homo sapiens
ctcccccggctctac

SEQ ID NO: 5603114 - DNA, 16 bp, Homo sapiens
ctcccccggctgggcc

SEQ ID NO: 5603115 - DNA, 18 bp, Homo sapiens
ctcccccgggaggggccc

SEQ ID NO: 5603116 - DNA, 18 bp, Homo sapiens
ctcccccgtggtgcctgc

SEQ ID NO: 5603117 - DNA, 22 bp, Homo sapiens
ctcccccgtttctccttttcct

SEQ ID NO: 5603118 - DNA, 19 bp, Homo sapiens
ctccccctacccatatccc

SEQ ID NO: 5603119 - DNA, 22 bp, Homo sapiens
ctccccctaccgcatggcagct

SEQ ID NO: 5603120 - DNA, 16 bp, Homo sapiens
ctccccctagccattt

SEQ ID NO: 5603121 - DNA, 22 bp, Homo sapiens
ctccccctagtttgtgagaaac

SEQ ID NO: 5603122 - DNA, 19 bp, Homo sapiens
ctccccctcaacctcacca

SEQ ID NO: 5603123 - DNA, 13 bp, Homo sapiens
ctccccctcactt

SEQ ID NO: 5603124 - DNA, 12 bp, Homo sapiens
ctccccctcagc

SEQ ID NO: 5603125 - DNA, 13 bp, Homo sapiens
ctccccctcctga

SEQ ID NO: 5603126 - DNA, 17 bp, Homo sapiens
ctccccctcctgctgtg

SEQ ID NO: 5603127 - DNA, 18 bp, Homo sapiens
ctccccctcctgctgtgc

SEQ ID NO: 5603128 - DNA, 17 bp, Homo sapiens
ctccccctccttcccag

SEQ ID NO: 5603129 - DNA, 20 bp, Homo sapiens
ctccccctccttcccagctg

SEQ ID NO: 5603130 - DNA, 17 bp, Homo sapiens
ctccccctccttgtgcc

SEQ ID NO: 5603131 - DNA, 12 bp, Homo sapiens
ctccccctctgc

SEQ ID NO: 5603132 - DNA, 13 bp, Homo sapiens
ctccccctctgtc

SEQ ID NO: 5603133 - DNA, 14 bp, Homo sapiens
ctccccctctgtct

SEQ ID NO: 5603134 - DNA, 15 bp, Homo sapiens
ctccccctctgtctt

SEQ ID NO: 5603135 - DNA, 12 bp, Homo sapiens
ctccccctgcaa

SEQ ID NO: 5603136 - DNA, 20 bp, Homo sapiens
ctccccctgccagaggcctg

SEQ ID NO: 5603137 - DNA, 21 bp, Homo sapiens
ctccccctgccagaggcctgg

SEQ ID NO: 5603138 - DNA, 16 bp, Homo sapiens
ctccccctgccagtgc

SEQ ID NO: 5603139 - DNA, 17 bp, Homo sapiens
ctccccctgccagtgcc

SEQ ID NO: 5603140 - DNA, 11 bp, Homo sapiens
ctccccctgcg

SEQ ID NO: 5603141 - DNA, 13 bp, Homo sapiens
ctccccctgctcc

SEQ ID NO: 5603142 - DNA, 17 bp, Homo sapiens
ctccccctgctccccta

SEQ ID NO: 5603143 - DNA, 16 bp, Homo sapiens
ctccccctgctgctca

SEQ ID NO: 5603144 - DNA, 13 bp, Homo sapiens
ctcccccttcagc

SEQ ID NO: 5603145 - DNA, 14 bp, Homo sapiens
ctcccccttcagct

SEQ ID NO: 5603146 - DNA, 16 bp, Homo sapiens
ctcccccttcagctcc

SEQ ID NO: 5603147 - DNA, 19 bp, Homo sapiens
ctcccccttcagctcctga

SEQ ID NO: 5603148 - DNA, 23 bp, Homo sapiens
ctcccccttccccttctgtgtca

SEQ ID NO: 5603149 - DNA, 16 bp, Homo sapiens
ctcccccttcccttgg

SEQ ID NO: 5603150 - DNA, 14 bp, Homo sapiens
ctcccccttctccc

SEQ ID NO: 5603151 - DNA, 19 bp, Homo sapiens
ctcccccttgtcttccccc

SEQ ID NO: 5603152 - DNA, 15 bp, Homo sapiens
ctcccccttttccct

SEQ ID NO: 5603153 - DNA, 21 bp, Homo sapiens
ctccccgaggctgccccaggc

SEQ ID NO: 5603154 - DNA, 13 bp, Homo sapiens
ctccccgcagccc

SEQ ID NO: 5603155 - DNA, 20 bp, Homo sapiens
ctccccgcagcccgcctgcc

SEQ ID NO: 5603156 - DNA, 15 bp, Homo sapiens
ctccccgcagccctc

SEQ ID NO: 5603157 - DNA, 17 bp, Homo sapiens
ctccccgccccctgaaa

SEQ ID NO: 5603158 - DNA, 15 bp, Homo sapiens
ctccccgcccctgtg

SEQ ID NO: 5603159 - DNA, 17 bp, Homo sapiens
ctccccgcccctgtggc

SEQ ID NO: 5603160 - DNA, 17 bp, Homo sapiens
ctccccgcctcctccca

SEQ ID NO: 5603161 - DNA, 18 bp, Homo sapiens
ctccccgcctcctcccac

SEQ ID NO: 5603162 - DNA, 15 bp, Homo sapiens
ctccccgcctggcca

SEQ ID NO: 5603163 - DNA, 21 bp, Homo sapiens
ctccccgcctggccagggcag

SEQ ID NO: 5603164 - DNA, 14 bp, Homo sapiens
ctccccgcctgttc

SEQ ID NO: 5603165 - DNA, 16 bp, Homo sapiens
ctccccgcctgttccc

SEQ ID NO: 5603166 - DNA, 17 bp, Homo sapiens
ctccccgcctgttcccc

SEQ ID NO: 5603167 - DNA, 14 bp, Homo sapiens
ctccccgccttaga

SEQ ID NO: 5603168 - DNA, 19 bp, Homo sapiens
ctccccgcgccccagtcac

SEQ ID NO: 5603169 - DNA, 19 bp, Homo sapiens
ctccccgctcaggggcctg

SEQ ID NO: 5603170 - DNA, 21 bp, Homo sapiens
ctccccgctcaggggcctgga

SEQ ID NO: 5603171 - DNA, 22 bp, Homo sapiens
ctccccgctccgtctctgtcct

SEQ ID NO: 5603172 - DNA, 19 bp, Homo sapiens
ctccccgctctccctgtca

SEQ ID NO: 5603173 - DNA, 15 bp, Homo sapiens
ctccccggccacatg

SEQ ID NO: 5603174 - DNA, 16 bp, Homo sapiens
ctccccggccctacca

SEQ ID NO: 5603175 - DNA, 13 bp, Homo sapiens
ctccccgggcagc

SEQ ID NO: 5603176 - DNA, 22 bp, Homo sapiens
ctccccgggcagcagagagaga

SEQ ID NO: 5603177 - DNA, 19 bp, Homo sapiens
ctccccggtaatgtcactg

SEQ ID NO: 5603178 - DNA, 22 bp, Homo sapiens
ctccccggtaatgtcactgttt

SEQ ID NO: 5603179 - DNA, 18 bp, Homo sapiens
ctccccgtagccactctc

SEQ ID NO: 5603180 - DNA, 21 bp, Homo sapiens
ctccccgtttcagtggaccct

SEQ ID NO: 5603181 - DNA, 19 bp, Homo sapiens
ctcccctaaagccaggctc

SEQ ID NO: 5603182 - DNA, 16 bp, Homo sapiens
ctcccctaaccctact

SEQ ID NO: 5603183 - DNA, 22 bp, Homo sapiens
ctcccctagagccctctcctcc

SEQ ID NO: 5603184 - DNA, 19 bp, Homo sapiens
ctcccctagctcaccaggc

SEQ ID NO: 5603185 - DNA, 21 bp, Homo sapiens
ctcccctagctcaccaggcct

SEQ ID NO: 5603186 - DNA, 22 bp, Homo sapiens
ctcccctagctcaccaggcctg

SEQ ID NO: 5603187 - DNA, 17 bp, Homo sapiens
ctcccctatccacccag

SEQ ID NO: 5603188 - DNA, 21 bp, Homo sapiens
ctcccctatccacccagccca

SEQ ID NO: 5603189 - DNA, 18 bp, Homo sapiens
ctcccctatgctggtaga

SEQ ID NO: 5603190 - DNA, 23 bp, Homo sapiens
ctcccctcaaaagcttcgtgcca

SEQ ID NO: 5603191 - DNA, 11 bp, Homo sapiens
ctcccctcaca

SEQ ID NO: 5603192 - DNA, 21 bp, Homo sapiens
ctcccctcacacacaaattga

SEQ ID NO: 5603193 - DNA, 14 bp, Homo sapiens
ctcccctcacagcc

SEQ ID NO: 5603194 - DNA, 13 bp, Homo sapiens
ctcccctcacatc

SEQ ID NO: 5603195 - DNA, 16 bp, Homo sapiens
ctcccctcagcctctc

SEQ ID NO: 5603196 - DNA, 21 bp, Homo sapiens
ctcccctcagcctgcccacct

SEQ ID NO: 5603197 - DNA, 23 bp, Homo sapiens
ctcccctcagcctgcccacctct

SEQ ID NO: 5603198 - DNA, 15 bp, Homo sapiens
ctcccctccaacctg

SEQ ID NO: 5603199 - DNA, 15 bp, Homo sapiens
ctcccctccacagct

SEQ ID NO: 5603200 - DNA, 12 bp, Homo sapiens
ctcccctccacg

SEQ ID NO: 5603201 - DNA, 23 bp, Homo sapiens
ctcccctccacgcaaggctgtgc

SEQ ID NO: 5603202 - DNA, 11 bp, Homo sapiens
ctcccctccag

SEQ ID NO: 5603203 - DNA, 20 bp, Homo sapiens
ctcccctccagacccctacc

SEQ ID NO: 5603204 - DNA, 17 bp, Homo sapiens
ctcccctccatccccat

SEQ ID NO: 5603205 - DNA, 15 bp, Homo sapiens
ctcccctccatccct

SEQ ID NO: 5603206 - DNA, 16 bp, Homo sapiens
ctcccctccatccctg

SEQ ID NO: 5603207 - DNA, 23 bp, Homo sapiens
ctcccctcccaggggagccagct

SEQ ID NO: 5603208 - DNA, 15 bp, Homo sapiens
ctcccctcccagtcc

SEQ ID NO: 5603209 - DNA, 16 bp, Homo sapiens
ctcccctcccagtcct

SEQ ID NO: 5603210 - DNA, 13 bp, Homo sapiens
ctcccctccccag

SEQ ID NO: 5603211 - DNA, 18 bp, Homo sapiens
ctcccctccccagcccaa

SEQ ID NO: 5603212 - DNA, 19 bp, Homo sapiens
ctcccctccccatctgtgt

SEQ ID NO: 5603213 - DNA, 13 bp, Homo sapiens
ctcccctcccccc

SEQ ID NO: 5603214 - DNA, 15 bp, Homo sapiens
ctcccctcccccctg

SEQ ID NO: 5603215 - DNA, 21 bp, Homo sapiens
ctcccctccccgcctggccag

SEQ ID NO: 5603216 - DNA, 15 bp, Homo sapiens
ctcccctcccctgct

SEQ ID NO: 5603217 - DNA, 17 bp, Homo sapiens
ctcccctcccctgctgc

SEQ ID NO: 5603218 - DNA, 14 bp, Homo sapiens
ctcccctccctcct

SEQ ID NO: 5603219 - DNA, 14 bp, Homo sapiens
ctcccctccctctt

SEQ ID NO: 5603220 - DNA, 13 bp, Homo sapiens
ctcccctcccttg

SEQ ID NO: 5603221 - DNA, 23 bp, Homo sapiens
ctcccctccgcagcagggaagct

SEQ ID NO: 5603222 - DNA, 12 bp, Homo sapiens
ctcccctcctct

SEQ ID NO: 5603223 - DNA, 16 bp, Homo sapiens
ctcccctcctctcccc

SEQ ID NO: 5603224 - DNA, 13 bp, Homo sapiens
ctcccctcctctg

SEQ ID NO: 5603225 - DNA, 20 bp, Homo sapiens
ctcccctcctctgcttgcca

SEQ ID NO: 5603226 - DNA, 23 bp, Homo sapiens
ctcccctcctcttcccttagcct

SEQ ID NO: 5603227 - DNA, 13 bp, Homo sapiens
ctcccctcctgca

SEQ ID NO: 5603228 - DNA, 15 bp, Homo sapiens
ctcccctcctgctgg

SEQ ID NO: 5603229 - DNA, 11 bp, Homo sapiens
ctcccctcctt

SEQ ID NO: 5603230 - DNA, 12 bp, Homo sapiens
ctcccctccttg

SEQ ID NO: 5603231 - DNA, 16 bp, Homo sapiens
ctcccctccttgcctc

SEQ ID NO: 5603232 - DNA, 12 bp, Homo sapiens
ctcccctccttt

SEQ ID NO: 5603233 - DNA, 18 bp, Homo sapiens
ctcccctcgacagctctc

SEQ ID NO: 5603234 - DNA, 17 bp, Homo sapiens
ctcccctcgctgctggg

SEQ ID NO: 5603235 - DNA, 17 bp, Homo sapiens
ctcccctcgtgtcagct

SEQ ID NO: 5603236 - DNA, 20 bp, Homo sapiens
ctcccctcgtgtcagctcag

SEQ ID NO: 5603237 - DNA, 21 bp, Homo sapiens
ctcccctctatttagcatgac

SEQ ID NO: 5603238 - DNA, 13 bp, Homo sapiens
ctcccctctcaga

SEQ ID NO: 5603239 - DNA, 23 bp, Homo sapiens
ctcccctctcagaacatactgat

SEQ ID NO: 5603240 - DNA, 19 bp, Homo sapiens
ctcccctctcatccccctg

SEQ ID NO: 5603241 - DNA, 21 bp, Homo sapiens
ctcccctctcatccccctgtg

SEQ ID NO: 5603242 - DNA, 22 bp, Homo sapiens
ctcccctctcatccccctgtgg

SEQ ID NO: 5603243 - DNA, 13 bp, Homo sapiens
ctcccctctccca

SEQ ID NO: 5603244 - DNA, 14 bp, Homo sapiens
ctcccctctcccag

SEQ ID NO: 5603245 - DNA, 17 bp, Homo sapiens
ctcccctctcccaggga

SEQ ID NO: 5603246 - DNA, 13 bp, Homo sapiens
ctcccctctcctc

SEQ ID NO: 5603247 - DNA, 14 bp, Homo sapiens
ctcccctctcctga

SEQ ID NO: 5603248 - DNA, 18 bp, Homo sapiens
ctcccctctcctgagcct

SEQ ID NO: 5603249 - DNA, 14 bp, Homo sapiens
ctcccctctctgct

SEQ ID NO: 5603250 - DNA, 12 bp, Homo sapiens
ctcccctctctt

SEQ ID NO: 5603251 - DNA, 15 bp, Homo sapiens
ctcccctctcttgca

SEQ ID NO: 5603252 - DNA, 17 bp, Homo sapiens
ctcccctctcttgcacc

SEQ ID NO: 5603253 - DNA, 22 bp, Homo sapiens
ctcccctctgaaagttgtacat

SEQ ID NO: 5603254 - DNA, 21 bp, Homo sapiens
ctcccctctgcaaccccccag

SEQ ID NO: 5603255 - DNA, 20 bp, Homo sapiens
ctccctgtaatgcactcctg

SEQ ID NO: 5603256 - DNA, 19 bp, Homo sapiens
ctccctgtacacagtgccc

SEQ ID NO: 5603257 - DNA, 15 bp, Homo sapiens
ctccctgtacagtgt

SEQ ID NO: 5603258 - DNA, 18 bp, Homo sapiens
ctccctgtacagtgttac

SEQ ID NO: 5603259 - DNA, 21 bp, Homo sapiens
ctccctgtaggaagtcatcct

SEQ ID NO: 5603260 - DNA, 18 bp, Homo sapiens
ctccctgtatcaccccct

SEQ ID NO: 5603261 - DNA, 17 bp, Homo sapiens
ctccctgtcacacactg

SEQ ID NO: 5603262 - DNA, 15 bp, Homo sapiens
ctccctgtcacgctc

SEQ ID NO: 5603263 - DNA, 17 bp, Homo sapiens
ctccctgtcccagggcc

SEQ ID NO: 5603264 - DNA, 16 bp, Homo sapiens
ctccctgtcccctcat

SEQ ID NO: 5603265 - DNA, 17 bp, Homo sapiens
ctccctgtcccctcatg

SEQ ID NO: 5603266 - DNA, 19 bp, Homo sapiens
ctccctgtcccttcctttc

SEQ ID NO: 5603267 - DNA, 16 bp, Homo sapiens
ctccctgtcctcctcg

SEQ ID NO: 5603268 - DNA, 17 bp, Homo sapiens
ctccctgtcggcctggt

SEQ ID NO: 5603269 - DNA, 15 bp, Homo sapiens
ctccctgtctccagc

SEQ ID NO: 5603270 - DNA, 17 bp, Homo sapiens
ctccctgtctccagctg

SEQ ID NO: 5603271 - DNA, 18 bp, Homo sapiens
ctccctgtctccagctgc

SEQ ID NO: 5603272 - DNA, 23 bp, Homo sapiens
ctccctgtctccagctgcctggg

SEQ ID NO: 5603273 - DNA, 17 bp, Homo sapiens
ctccctgtctctgcatc

SEQ ID NO: 5603274 - DNA, 18 bp, Homo sapiens
ctccctgtctctgcatct

SEQ ID NO: 5603275 - DNA, 13 bp, Homo sapiens
ctccctgtctgtg

SEQ ID NO: 5603276 - DNA, 15 bp, Homo sapiens
ctccctgtctgtgtc

SEQ ID NO: 5603277 - DNA, 22 bp, Homo sapiens
ctccctgtctgtgtcccagcca

SEQ ID NO: 5603278 - DNA, 23 bp, Homo sapiens
ctccctgtctgtgtcccagccac

SEQ ID NO: 5603279 - DNA, 16 bp, Homo sapiens
ctccctgtgagagagt

SEQ ID NO: 5603280 - DNA, 20 bp, Homo sapiens
ctccctgtgcccccagcctc

SEQ ID NO: 5603281 - DNA, 22 bp, Homo sapiens
ctccctgtggcactcagggagc

SEQ ID NO: 5603282 - DNA, 17 bp, Homo sapiens
ctccctgtgggggtggc

SEQ ID NO: 5603283 - DNA, 24 bp, Homo sapiens
ctccctgtgggggtggccatccct

SEQ ID NO: 5603284 - DNA, 18 bp, Homo sapiens
ctccctgtgttctgggct

SEQ ID NO: 5603285 - DNA, 19 bp, Homo sapiens
ctccctgtgttctgggctg

SEQ ID NO: 5603286 - DNA, 21 bp, Homo sapiens
ctccctgtgttctgggctggg

SEQ ID NO: 5603287 - DNA, 22 bp, Homo sapiens
ctccctgtgttctgggctgggg

SEQ ID NO: 5603288 - DNA, 23 bp, Homo sapiens
ctccctgttcacggtgacacagg

SEQ ID NO: 5603289 - DNA, 14 bp, Homo sapiens
ctccctgttcccca

SEQ ID NO: 5603290 - DNA, 17 bp, Homo sapiens
ctccctgttccccagag

SEQ ID NO: 5603291 - DNA, 18 bp, Homo sapiens
ctccctgttccccagaga

SEQ ID NO: 5603292 - DNA, 17 bp, Homo sapiens
ctccctgttcttgggta

SEQ ID NO: 5603293 - DNA, 21 bp, Homo sapiens
ctccctgtttgaagcctgccc

SEQ ID NO: 5603294 - DNA, 21 bp, Homo sapiens
ctccctgttttagtttctgaa

SEQ ID NO: 5603295 - DNA, 23 bp, Homo sapiens
ctcccttacccatcttgcttcca

SEQ ID NO: 5603296 - DNA, 22 bp, Homo sapiens
ctcccttaggcattatttaatg

SEQ ID NO: 5603297 - DNA, 12 bp, Homo sapiens
ctcccttcaacc

SEQ ID NO: 5603298 - DNA, 20 bp, Homo sapiens
ctcccttcaaccattcccca

SEQ ID NO: 5603299 - DNA, 22 bp, Homo sapiens
ctcccttcaaccattccccatg

SEQ ID NO: 5603300 - DNA, 22 bp, Homo sapiens
ctcccttcaagacgaggggcag

SEQ ID NO: 5603301 - DNA, 19 bp, Homo sapiens
ctcccttcaatgctagaaa

SEQ ID NO: 5603302 - DNA, 14 bp, Homo sapiens
ctcccttccaggaa

SEQ ID NO: 5603303 - DNA, 11 bp, Homo sapiens
ctcccttccca

SEQ ID NO: 5603304 - DNA, 14 bp, Homo sapiens
ctcccttcccacct

SEQ ID NO: 5603305 - DNA, 22 bp, Homo sapiens
ctcccttcccacctactgcact

SEQ ID NO: 5603306 - DNA, 15 bp, Homo sapiens
ctcccttcccacctc

SEQ ID NO: 5603307 - DNA, 14 bp, Homo sapiens
ctcccttcccagtg

SEQ ID NO: 5603308 - DNA, 16 bp, Homo sapiens
ctcccttccccataga

SEQ ID NO: 5603309 - DNA, 18 bp, Homo sapiens
ctcccttccctccctgag

SEQ ID NO: 5603310 - DNA, 14 bp, Homo sapiens
ctcccttccgaccc

SEQ ID NO: 5603311 - DNA, 19 bp, Homo sapiens
ctcccttccgaccctctgg

SEQ ID NO: 5603312 - DNA, 19 bp, Homo sapiens
ctcccttccgtccatcccc

SEQ ID NO: 5603313 - DNA, 17 bp, Homo sapiens
ctcccttcctgccactg

SEQ ID NO: 5603314 - DNA, 16 bp, Homo sapiens
ctcccttcctggcctc

SEQ ID NO: 5603315 - DNA, 17 bp, Homo sapiens
ctcccttcctggcctca

SEQ ID NO: 5603316 - DNA, 20 bp, Homo sapiens
ctcccttccttttccctgct

SEQ ID NO: 5603317 - DNA, 17 bp, Homo sapiens
ctcccttcgctctgctg

SEQ ID NO: 5603318 - DNA, 22 bp, Homo sapiens
ctcccttcggtggaagagctca

SEQ ID NO: 5603319 - DNA, 16 bp, Homo sapiens
ctcccttctacagcct

SEQ ID NO: 5603320 - DNA, 15 bp, Homo sapiens
ctcccttctacctgc

SEQ ID NO: 5603321 - DNA, 18 bp, Homo sapiens
ctcccttctcatctcccc

SEQ ID NO: 5603322 - DNA, 11 bp, Homo sapiens
ctcccttctcc

SEQ ID NO: 5603323 - DNA, 15 bp, Homo sapiens
ctcccttctctctct

SEQ ID NO: 5603324 - DNA, 14 bp, Homo sapiens
ctcccttctgcttg

SEQ ID NO: 5603325 - DNA, 16 bp, Homo sapiens
ctcccttctgcttgtc

SEQ ID NO: 5603326 - DNA, 22 bp, Homo sapiens
ctcccttcttacaccgtgaggc

SEQ ID NO: 5603327 - DNA, 16 bp, Homo sapiens
ctcccttctttccttc

SEQ ID NO: 5603328 - DNA, 18 bp, Homo sapiens
ctcccttctttccttcct

SEQ ID NO: 5603329 - DNA, 17 bp, Homo sapiens
ctcccttcttttatcct

SEQ ID NO: 5603330 - DNA, 20 bp, Homo sapiens
ctcccttgagaattccctgt

SEQ ID NO: 5603331 - DNA, 21 bp, Homo sapiens
ctcccttgagctggttttctc

SEQ ID NO: 5603332 - DNA, 20 bp, Homo sapiens
ctcccttgagggtttgagag

SEQ ID NO: 5603333 - DNA, 18 bp, Homo sapiens
ctcccttgatggggtcca

SEQ ID NO: 5603334 - DNA, 14 bp, Homo sapiens
ctcccttgccccag

SEQ ID NO: 5603335 - DNA, 21 bp, Homo sapiens
ctcccttgcctttcgaggcct

SEQ ID NO: 5603336 - DNA, 23 bp, Homo sapiens
ctcccttgctcagtgcctcctgg

SEQ ID NO: 5603337 - DNA, 17 bp, Homo sapiens
ctcccttgctggcccca

SEQ ID NO: 5603338 - DNA, 21 bp, Homo sapiens
ctcccttggaaacctgccctg

SEQ ID NO: 5603339 - DNA, 16 bp, Homo sapiens
ctcccttggccacggc

SEQ ID NO: 5603340 - DNA, 18 bp, Homo sapiens
ctcccttggccacggcct

SEQ ID NO: 5603341 - DNA, 21 bp, Homo sapiens
ctcccttggccacggcctggg

SEQ ID NO: 5603342 - DNA, 23 bp, Homo sapiens
ctcccttggccacggcctgggag

SEQ ID NO: 5603343 - DNA, 13 bp, Homo sapiens
ctcccttggccca

SEQ ID NO: 5603344 - DNA, 23 bp, Homo sapiens
ctcccttggctttgaggccgaag

SEQ ID NO: 5603345 - DNA, 18 bp, Homo sapiens
ctcccttgggctccctgt

SEQ ID NO: 5603346 - DNA, 23 bp, Homo sapiens
ctcccttgggctctgatgaaaaa

SEQ ID NO: 5603347 - DNA, 16 bp, Homo sapiens
ctcccttgggctggaa

SEQ ID NO: 5603348 - DNA, 14 bp, Homo sapiens
ctcccttggtgccc

SEQ ID NO: 5603349 - DNA, 16 bp, Homo sapiens
ctcccttggtgccctc

SEQ ID NO: 5603350 - DNA, 19 bp, Homo sapiens
ctcccttgtcctgcttggg

SEQ ID NO: 5603351 - DNA, 13 bp, Homo sapiens
ctcccttgtgttc

SEQ ID NO: 5603352 - DNA, 18 bp, Homo sapiens
ctccctttagttctgctg

SEQ ID NO: 5603353 - DNA, 17 bp, Homo sapiens
ctccctttccaacctca

SEQ ID NO: 5603354 - DNA, 14 bp, Homo sapiens
ctccctttctcagg

SEQ ID NO: 5603355 - DNA, 16 bp, Homo sapiens
ctccctttctcttctt

SEQ ID NO: 5603356 - DNA, 22 bp, Homo sapiens
ctccctttgccagccacccctc

SEQ ID NO: 5603357 - DNA, 23 bp, Homo sapiens
ctccctttgccagccacccctcc

SEQ ID NO: 5603358 - DNA, 15 bp, Homo sapiens
ctccctttgcgcagc

SEQ ID NO: 5603359 - DNA, 20 bp, Homo sapiens
ctccctttgcgtcaggagca

SEQ ID NO: 5603360 - DNA, 12 bp, Homo sapiens
ctccctttgtgg

SEQ ID NO: 5603361 - DNA, 19 bp, Homo sapiens
ctccctttgtggactttat

SEQ ID NO: 5603362 - DNA, 13 bp, Homo sapiens
ctcccttttcaga

SEQ ID NO: 5603363 - DNA, 18 bp, Homo sapiens
ctcccttttctttttccc

SEQ ID NO: 5603364 - DNA, 18 bp, Homo sapiens
ctcccttttgacacagtt

SEQ ID NO: 5603365 - DNA, 17 bp, Homo sapiens
ctcccttttgtccttcc

SEQ ID NO: 5603366 - DNA, 16 bp, Homo sapiens
ctccctttttacactt

SEQ ID NO: 5603367 - DNA, 23 bp, Homo sapiens
ctccctttttccttgtccccaca

SEQ ID NO: 5603368 - DNA, 14 bp, Homo sapiens
ctccctttttgaat

SEQ ID NO: 5603369 - DNA, 16 bp, Homo sapiens
ctccctttttgaattg

SEQ ID NO: 5603370 - DNA, 14 bp, Homo sapiens
ctccgaaagtctga

SEQ ID NO: 5603371 - DNA, 23 bp, Homo sapiens
ctccgaaagtctgaatctcccaa

SEQ ID NO: 5603372 - DNA, 16 bp, Homo sapiens
ctccgaaatgctgtct

SEQ ID NO: 5603373 - DNA, 22 bp, Homo sapiens
ctccgaacaccctcgaagcgcg

SEQ ID NO: 5603374 - DNA, 18 bp, Homo sapiens
ctccgaacgctgctccat

SEQ ID NO: 5603375 - DNA, 15 bp, Homo sapiens
ctccgaagaaaagaa

SEQ ID NO: 5603376 - DNA, 15 bp, Homo sapiens
ctccgaccagacacc

SEQ ID NO: 5603377 - DNA, 15 bp, Homo sapiens
ctccgaccctcatgg

SEQ ID NO: 5603378 - DNA, 15 bp, Homo sapiens
ctccgactccccctc

SEQ ID NO: 5603379 - DNA, 17 bp, Homo sapiens
ctccgactccccctccc

SEQ ID NO: 5603380 - DNA, 18 bp, Homo sapiens
ctccgactctgcacccgc

SEQ ID NO: 5603381 - DNA, 22 bp, Homo sapiens
ctccgacttgtgcacaggcaga

SEQ ID NO: 5603382 - DNA, 15 bp, Homo sapiens
ctccgagaacaacag

SEQ ID NO: 5603383 - DNA, 17 bp, Homo sapiens
ctccgagacagtccagt

SEQ ID NO: 5603384 - DNA, 19 bp, Homo sapiens
ctccgagacccaggagaca

SEQ ID NO: 5603385 - DNA, 14 bp, Homo sapiens
ctccgagagcagtg

SEQ ID NO: 5603386 - DNA, 20 bp, Homo sapiens
ctccgagagcagtgggcagg

SEQ ID NO: 5603387 - DNA, 14 bp, Homo sapiens
ctccgagagggaga

SEQ ID NO: 5603388 - DNA, 22 bp, Homo sapiens
ctccgagaggtgggccagtctg

SEQ ID NO: 5603389 - DNA, 16 bp, Homo sapiens
ctccgaggactggact

SEQ ID NO: 5603390 - DNA, 13 bp, Homo sapiens
ctccgaggccagt

SEQ ID NO: 5603391 - DNA, 17 bp, Homo sapiens
ctccgaggctccccgcc

SEQ ID NO: 5603392 - DNA, 23 bp, Homo sapiens
ctccgaggctccccgcctccact

SEQ ID NO: 5603393 - DNA, 19 bp, Homo sapiens
ctccgagggcggccaggga

SEQ ID NO: 5603394 - DNA, 21 bp, Homo sapiens
ctccgaggtggtgggggcgcc

SEQ ID NO: 5603395 - DNA, 23 bp, Homo sapiens
ctccgagtgaactggtcttcctt

SEQ ID NO: 5603396 - DNA, 12 bp, Homo sapiens
ctccgagtgagt

SEQ ID NO: 5603397 - DNA, 15 bp, Homo sapiens
ctccgatccttcctc

SEQ ID NO: 5603398 - DNA, 20 bp, Homo sapiens
ctccgatgcccgcccgggga

SEQ ID NO: 5603399 - DNA, 20 bp, Homo sapiens
ctccgatgcctggcctgcca

SEQ ID NO: 5603400 - DNA, 21 bp, Homo sapiens
ctccgatgcctggcctgccag

SEQ ID NO: 5603401 - DNA, 15 bp, Homo sapiens
ctccgatgctgaggc

SEQ ID NO: 5603402 - DNA, 20 bp, Homo sapiens
ctccgcacacctctggctgt

SEQ ID NO: 5603403 - DNA, 16 bp, Homo sapiens
ctccgcacttggaaag

SEQ ID NO: 5603404 - DNA, 23 bp, Homo sapiens
ctccgcagggcgcccagcgccgt

SEQ ID NO: 5603405 - DNA, 23 bp, Homo sapiens
ctccgcagtgcctgcaggggagc

SEQ ID NO: 5603406 - DNA, 14 bp, Homo sapiens
ctccgcagtgtctc

SEQ ID NO: 5603407 - DNA, 18 bp, Homo sapiens
ctccgcatcacctcacca

SEQ ID NO: 5603408 - DNA, 15 bp, Homo sapiens
ctccgcattggaaga

SEQ ID NO: 5603409 - DNA, 18 bp, Homo sapiens
ctccgccaatttctctca

SEQ ID NO: 5603410 - DNA, 15 bp, Homo sapiens
ctccgccagccacag

SEQ ID NO: 5603411 - DNA, 16 bp, Homo sapiens
ctccgccagccacagg

SEQ ID NO: 5603412 - DNA, 18 bp, Homo sapiens
ctccgccagccacaggac

SEQ ID NO: 5603413 - DNA, 13 bp, Homo sapiens
ctccgccagcctc

SEQ ID NO: 5603414 - DNA, 21 bp, Homo sapiens
ctccgccagcctcctctggac

SEQ ID NO: 5603415 - DNA, 23 bp, Homo sapiens
ctccgccaggcgagatggggtgg

SEQ ID NO: 5603416 - DNA, 23 bp, Homo sapiens
ctccgccattctcaagccctgca

SEQ ID NO: 5603417 - DNA, 15 bp, Homo sapiens
ctccgcccagcctct

SEQ ID NO: 5603418 - DNA, 17 bp, Homo sapiens
ctccgccccagacacac

SEQ ID NO: 5603419 - DNA, 17 bp, Homo sapiens
ctccgcccccagcctat

SEQ ID NO: 5603420 - DNA, 22 bp, Homo sapiens
ctccgcccgctcctgccgcaga

SEQ ID NO: 5603421 - DNA, 17 bp, Homo sapiens
ctccgccctcctcgggc

SEQ ID NO: 5603422 - DNA, 20 bp, Homo sapiens
ctccgccctcctcgggccga

SEQ ID NO: 5603423 - DNA, 14 bp, Homo sapiens
ctccgcctactgtc

SEQ ID NO: 5603424 - DNA, 13 bp, Homo sapiens
ctccgcctccaca

SEQ ID NO: 5603425 - DNA, 22 bp, Homo sapiens
ctccgcctccacactgaccaag

SEQ ID NO: 5603426 - DNA, 15 bp, Homo sapiens
ctccgcctcccatcc

SEQ ID NO: 5603427 - DNA, 14 bp, Homo sapiens
ctccgcctcccggg

SEQ ID NO: 5603428 - DNA, 16 bp, Homo sapiens
ctccgcctctgctggc

SEQ ID NO: 5603429 - DNA, 14 bp, Homo sapiens
ctccgcctggcacc

SEQ ID NO: 5603430 - DNA, 14 bp, Homo sapiens
ctccgcctgggatc

SEQ ID NO: 5603431 - DNA, 20 bp, Homo sapiens
ctcctcccacccggctgcag

SEQ ID NO: 5603432 - DNA, 13 bp, Homo sapiens
ctcctcccactgc

SEQ ID NO: 5603433 - DNA, 17 bp, Homo sapiens
ctcctcccactgcccac

SEQ ID NO: 5603434 - DNA, 21 bp, Homo sapiens
ctcctcccactgggactccca

SEQ ID NO: 5603435 - DNA, 15 bp, Homo sapiens
ctcctcccacttctc

SEQ ID NO: 5603436 - DNA, 13 bp, Homo sapiens
ctcctcccagcac

SEQ ID NO: 5603437 - DNA, 18 bp, Homo sapiens
ctcctcccagcgtgtgta

SEQ ID NO: 5603438 - DNA, 19 bp, Homo sapiens
ctcctcccagcgtgtgtat

SEQ ID NO: 5603439 - DNA, 20 bp, Homo sapiens
ctcctcccagcgtgtgtatc

SEQ ID NO: 5603440 - DNA, 21 bp, Homo sapiens
ctcctcccagcgtgtgtatcc

SEQ ID NO: 5603441 - DNA, 15 bp, Homo sapiens
ctcctcccagctgct

SEQ ID NO: 5603442 - DNA, 21 bp, Homo sapiens
ctcctcccagggttttaactt

SEQ ID NO: 5603443 - DNA, 22 bp, Homo sapiens
ctcctcccagggttttaacttt

SEQ ID NO: 5603444 - DNA, 18 bp, Homo sapiens
ctcctcccaggtttcttc

SEQ ID NO: 5603445 - DNA, 11 bp, Homo sapiens
ctcctcccata

SEQ ID NO: 5603446 - DNA, 13 bp, Homo sapiens
ctcctcccatcca

SEQ ID NO: 5603447 - DNA, 13 bp, Homo sapiens
ctcctcccatctc

SEQ ID NO: 5603448 - DNA, 14 bp, Homo sapiens
ctcctcccatgtca

SEQ ID NO: 5603449 - DNA, 14 bp, Homo sapiens
ctcctcccattccc

SEQ ID NO: 5603450 - DNA, 14 bp, Homo sapiens
ctcctccccaaatc

SEQ ID NO: 5603451 - DNA, 17 bp, Homo sapiens
ctcctccccacctgtag

SEQ ID NO: 5603452 - DNA, 18 bp, Homo sapiens
ctcctccccacctgtagc

SEQ ID NO: 5603453 - DNA, 19 bp, Homo sapiens
ctcctccccacctgtagct

SEQ ID NO: 5603454 - DNA, 20 bp, Homo sapiens
ctcctccccacctgtagctg

SEQ ID NO: 5603455 - DNA, 14 bp, Homo sapiens
ctcctccccagagc

SEQ ID NO: 5603456 - DNA, 15 bp, Homo sapiens
ctcctccccagagct

SEQ ID NO: 5603457 - DNA, 14 bp, Homo sapiens
ctcctccccagctc

SEQ ID NO: 5603458 - DNA, 15 bp, Homo sapiens
ctcctccccaggtgg

SEQ ID NO: 5603459 - DNA, 12 bp, Homo sapiens
ctcctcccccac

SEQ ID NO: 5603460 - DNA, 17 bp, Homo sapiens
ctcctcccccacccctt

SEQ ID NO: 5603461 - DNA, 14 bp, Homo sapiens
ctcctcccccacgc

SEQ ID NO: 5603462 - DNA, 19 bp, Homo sapiens
ctcctcccccacgcctcca

SEQ ID NO: 5603463 - DNA, 16 bp, Homo sapiens
ctcctcccccggctgg

SEQ ID NO: 5603464 - DNA, 21 bp, Homo sapiens
ctcctccccctcctccatgct

SEQ ID NO: 5603465 - DNA, 22 bp, Homo sapiens
ctcctccccctcctccatgctg

SEQ ID NO: 5603466 - DNA, 16 bp, Homo sapiens
ctcctccccctgttct

SEQ ID NO: 5603467 - DNA, 23 bp, Homo sapiens
ctcctccccgctccgtctctgtc

SEQ ID NO: 5603468 - DNA, 14 bp, Homo sapiens
ctcctcccctgccg

SEQ ID NO: 5603469 - DNA, 18 bp, Homo sapiens
ctcctcccctgccgcctc

SEQ ID NO: 5603470 - DNA, 14 bp, Homo sapiens
ctcctcccctggca

SEQ ID NO: 5603471 - DNA, 15 bp, Homo sapiens
ctcctccccttcctc

SEQ ID NO: 5603472 - DNA, 16 bp, Homo sapiens
ctcctccccttcctgc

SEQ ID NO: 5603473 - DNA, 18 bp, Homo sapiens
ctcctccccttcctgcac

SEQ ID NO: 5603474 - DNA, 19 bp, Homo sapiens
ctcctccccttttttttct

SEQ ID NO: 5603475 - DNA, 17 bp, Homo sapiens
ctcctcccgaaaaatgt

SEQ ID NO: 5603476 - DNA, 17 bp, Homo sapiens
ctcctcccggtgcccaa

SEQ ID NO: 5603477 - DNA, 13 bp, Homo sapiens
ctcctccctcaga

SEQ ID NO: 5603478 - DNA, 15 bp, Homo sapiens
ctcctccctcagacc

SEQ ID NO: 5603479 - DNA, 18 bp, Homo sapiens
ctcctccctcagacccag

SEQ ID NO: 5603480 - DNA, 17 bp, Homo sapiens
ctcctccctcagactca

SEQ ID NO: 5603481 - DNA, 14 bp, Homo sapiens
ctcctccctcaggc

SEQ ID NO: 5603482 - DNA, 15 bp, Homo sapiens
ctcctccctcaggcc

SEQ ID NO: 5603483 - DNA, 20 bp, Homo sapiens
ctcctccctcaggcccagga

SEQ ID NO: 5603484 - DNA, 21 bp, Homo sapiens
ctcctccctccaagcctggca

SEQ ID NO: 5603485 - DNA, 23 bp, Homo sapiens
ctcctccctcccagctgcacttt

SEQ ID NO: 5603486 - DNA, 14 bp, Homo sapiens
ctcctccctcctca

SEQ ID NO: 5603487 - DNA, 17 bp, Homo sapiens
ctcctccctcctgggga

SEQ ID NO: 5603488 - DNA, 13 bp, Homo sapiens
ctcctccctctgc

SEQ ID NO: 5603489 - DNA, 16 bp, Homo sapiens
ctcctccctctgcctc

SEQ ID NO: 5603490 - DNA, 14 bp, Homo sapiens
ctcctccctctgtc

SEQ ID NO: 5603491 - DNA, 15 bp, Homo sapiens
ctcctccctgatgta

SEQ ID NO: 5603492 - DNA, 19 bp, Homo sapiens
ctcctccctgatgtacagt

SEQ ID NO: 5603493 - DNA, 15 bp, Homo sapiens
ctcctccctgcatct

SEQ ID NO: 5603494 - DNA, 18 bp, Homo sapiens
ctcctccctgcatctgac

SEQ ID NO: 5603495 - DNA, 13 bp, Homo sapiens
ctcctccctgcct

SEQ ID NO: 5603496 - DNA, 14 bp, Homo sapiens
ctcctccctgcctg

SEQ ID NO: 5603497 - DNA, 15 bp, Homo sapiens
ctcctccctgctcct

SEQ ID NO: 5603498 - DNA, 22 bp, Homo sapiens
ctcctccctgctcctcatggga

SEQ ID NO: 5603499 - DNA, 14 bp, Homo sapiens
ctcctccctggagc

SEQ ID NO: 5603500 - DNA, 15 bp, Homo sapiens
ctcctccctggagct

SEQ ID NO: 5603501 - DNA, 12 bp, Homo sapiens
ctcctccctggc

SEQ ID NO: 5603502 - DNA, 20 bp, Homo sapiens
ctcctccctggctgccctgg

SEQ ID NO: 5603503 - DNA, 21 bp, Homo sapiens
ctcctccctgggatggacgct

SEQ ID NO: 5603504 - DNA, 15 bp, Homo sapiens
ctcctccctgggggt

SEQ ID NO: 5603505 - DNA, 13 bp, Homo sapiens
ctcctcccttcct

SEQ ID NO: 5603506 - DNA, 14 bp, Homo sapiens
ctcctcccttcctt

SEQ ID NO: 5603507 - DNA, 18 bp, Homo sapiens
ctcctccctttccttcct

SEQ ID NO: 5603508 - DNA, 19 bp, Homo sapiens
ctcctccctttttccttgt

SEQ ID NO: 5603509 - DNA, 13 bp, Homo sapiens
ctcctccgagacc

SEQ ID NO: 5603510 - DNA, 12 bp, Homo sapiens
ctcctccgcctg

SEQ ID NO: 5603511 - DNA, 17 bp, Homo sapiens
ctcctccgcctgtgtcc

SEQ ID NO: 5603512 - DNA, 12 bp, Homo sapiens
ctcctccgtctg

SEQ ID NO: 5603513 - DNA, 17 bp, Homo sapiens
ctcctccgtctgaccct

SEQ ID NO: 5603514 - DNA, 13 bp, Homo sapiens
ctcctccgtggca

SEQ ID NO: 5603515 - DNA, 16 bp, Homo sapiens
ctcctccgtgggcagc

SEQ ID NO: 5603516 - DNA, 22 bp, Homo sapiens
ctcctcctagaaaacccttccc

SEQ ID NO: 5603517 - DNA, 13 bp, Homo sapiens
ctcctcctcaccc

SEQ ID NO: 5603518 - DNA, 14 bp, Homo sapiens
ctcctcctcaccct

SEQ ID NO: 5603519 - DNA, 21 bp, Homo sapiens
ctcctcctcacccttcccggc

SEQ ID NO: 5603520 - DNA, 16 bp, Homo sapiens
ctcctcctcccctcct

SEQ ID NO: 5603521 - DNA, 16 bp, Homo sapiens
ctcctcctcctcctgt

SEQ ID NO: 5603522 - DNA, 13 bp, Homo sapiens
ctcctcctcgaag

SEQ ID NO: 5603523 - DNA, 14 bp, Homo sapiens
ctcctcctcggaag

SEQ ID NO: 5603524 - DNA, 11 bp, Homo sapiens
ctcctcctctc

SEQ ID NO: 5603525 - DNA, 14 bp, Homo sapiens
ctcctcctcttcac

SEQ ID NO: 5603526 - DNA, 13 bp, Homo sapiens
ctcctcctctttc

SEQ ID NO: 5603527 - DNA, 14 bp, Homo sapiens
ctcctcctctttct

SEQ ID NO: 5603528 - DNA, 17 bp, Homo sapiens
ctcctcctctttctctc

SEQ ID NO: 5603529 - DNA, 19 bp, Homo sapiens
ctcctcctctttctctccc

SEQ ID NO: 5603530 - DNA, 23 bp, Homo sapiens
ctcctcctgaaggaggcggggct

SEQ ID NO: 5603531 - DNA, 13 bp, Homo sapiens
ctcctcctgagag

SEQ ID NO: 5603532 - DNA, 11 bp, Homo sapiens
ctcctcctgca

SEQ ID NO: 5603533 - DNA, 15 bp, Homo sapiens
ctcctcctgcatgtc

SEQ ID NO: 5603534 - DNA, 13 bp, Homo sapiens
ctcctcctgccag

SEQ ID NO: 5603535 - DNA, 14 bp, Homo sapiens
ctcctcctgccagc

SEQ ID NO: 5603536 - DNA, 17 bp, Homo sapiens
ctcctcctgccagctct

SEQ ID NO: 5603537 - DNA, 14 bp, Homo sapiens
ctcctcctgccctc

SEQ ID NO: 5603538 - DNA, 15 bp, Homo sapiens
ctcctcctgccctcc

SEQ ID NO: 5603539 - DNA, 16 bp, Homo sapiens
ctcctcctgccctccg

SEQ ID NO: 5603540 - DNA, 16 bp, Homo sapiens
ctcctcctgccctgtc

SEQ ID NO: 5603541 - DNA, 14 bp, Homo sapiens
ctcctcctgctgct

SEQ ID NO: 5603542 - DNA, 14 bp, Homo sapiens
ctcctcctgggggc

SEQ ID NO: 5603543 - DNA, 13 bp, Homo sapiens
ctcctcctgtgtg

SEQ ID NO: 5603544 - DNA, 15 bp, Homo sapiens
ctcctcctgttcctg

SEQ ID NO: 5603545 - DNA, 13 bp, Homo sapiens
ctcctccttccca

SEQ ID NO: 5603546 - DNA, 14 bp, Homo sapiens
ctcctccttcccag

SEQ ID NO: 5603547 - DNA, 17 bp, Homo sapiens
ctcctccttcccaggga

SEQ ID NO: 5603548 - DNA, 14 bp, Homo sapiens
ctcctccttcccct

SEQ ID NO: 5603549 - DNA, 22 bp, Homo sapiens
ctcctccttgcctgcttttctt

SEQ ID NO: 5603550 - DNA, 19 bp, Homo sapiens
ctcctcctttctttgctgt

SEQ ID NO: 5603551 - DNA, 12 bp, Homo sapiens
ctcctcctttta

SEQ ID NO: 5603552 - DNA, 15 bp, Homo sapiens
ctcctcctttttcct

SEQ ID NO: 5603553 - DNA, 23 bp, Homo sapiens
ctcctcgaatgtgtgggcccaag

SEQ ID NO: 5603554 - DNA, 24 bp, Homo sapiens
ctcctcgagatcccaacactgcca

SEQ ID NO: 5603555 - DNA, 12 bp, Homo sapiens
ctcctcgagccc

SEQ ID NO: 5603556 - DNA, 13 bp, Homo sapiens
ctcctcgagccct

SEQ ID NO: 5603557 - DNA, 16 bp, Homo sapiens
ctcctcgagccctccc

SEQ ID NO: 5603558 - DNA, 16 bp, Homo sapiens
ctcctcgcaagctggg

SEQ ID NO: 5603559 - DNA, 19 bp, Homo sapiens
ctcctcgcaagctgggtaa

SEQ ID NO: 5603560 - DNA, 13 bp, Homo sapiens
ctcctcgccccca

SEQ ID NO: 5603561 - DNA, 19 bp, Homo sapiens
ctcctcgcccccaccagtg

SEQ ID NO: 5603562 - DNA, 12 bp, Homo sapiens
ctcctcgctcct

SEQ ID NO: 5603563 - DNA, 22 bp, Homo sapiens
ctcctcgctcctccttcccagg

SEQ ID NO: 5603564 - DNA, 18 bp, Homo sapiens
ctcctcgctgtgccacca

SEQ ID NO: 5603565 - DNA, 19 bp, Homo sapiens
ctcctcggaaccgctcacc

SEQ ID NO: 5603566 - DNA, 22 bp, Homo sapiens
ctcctcggaaccgctcacctag

SEQ ID NO: 5603567 - DNA, 14 bp, Homo sapiens
ctcctcggaagagc

SEQ ID NO: 5603568 - DNA, 21 bp, Homo sapiens
ctcctcggacacccagggtct

SEQ ID NO: 5603569 - DNA, 17 bp, Homo sapiens
ctcctcggactgtgtgc

SEQ ID NO: 5603570 - DNA, 17 bp, Homo sapiens
ctcctcggagagcagca

SEQ ID NO: 5603571 - DNA, 20 bp, Homo sapiens
ctcctcggagagcagcagca

SEQ ID NO: 5603572 - DNA, 21 bp, Homo sapiens
ctcctcggagagcagcagcac

SEQ ID NO: 5603573 - DNA, 17 bp, Homo sapiens
ctcctcggccagagctc

SEQ ID NO: 5603574 - DNA, 20 bp, Homo sapiens
ctcctcggccagagctccca

SEQ ID NO: 5603575 - DNA, 21 bp, Homo sapiens
ctcctcggccagagctcccag

SEQ ID NO: 5603576 - DNA, 23 bp, Homo sapiens
ctcctcggccagagctcccagga

SEQ ID NO: 5603577 - DNA, 19 bp, Homo sapiens
ctcctcggccccctccatc

SEQ ID NO: 5603578 - DNA, 15 bp, Homo sapiens
ctcctcggcctggct

SEQ ID NO: 5603579 - DNA, 18 bp, Homo sapiens
ctcctcggcctggctcct

SEQ ID NO: 5603580 - DNA, 19 bp, Homo sapiens
ctcctcggctggctgtcca

SEQ ID NO: 5603581 - DNA, 16 bp, Homo sapiens
ctcctcgggcaagggc

SEQ ID NO: 5603582 - DNA, 21 bp, Homo sapiens
ctcctcgggcaagggccgtgc

SEQ ID NO: 5603583 - DNA, 22 bp, Homo sapiens
ctcctcgggcaagggccgtgcc

SEQ ID NO: 5603584 - DNA, 15 bp, Homo sapiens
ctcctcgggccgagg

SEQ ID NO: 5603585 - DNA, 23 bp, Homo sapiens
ctcctcgggcgcctgcgctcctc

SEQ ID NO: 5603586 - DNA, 18 bp, Homo sapiens
ctcctcggggctccaggc

SEQ ID NO: 5603587 - DNA, 20 bp, Homo sapiens
ctcctcggtggcatttgctg

SEQ ID NO: 5603588 - DNA, 15 bp, Homo sapiens
ctcctcgtccggcct

SEQ ID NO: 5603589 - DNA, 17 bp, Homo sapiens
ctcctcgtccggcctgc

SEQ ID NO: 5603590 - DNA, 20 bp, Homo sapiens
ctcctcgtccggcctgcagc

SEQ ID NO: 5603591 - DNA, 19 bp, Homo sapiens
ctcctcgttggttcatgtg

SEQ ID NO: 5603592 - DNA, 17 bp, Homo sapiens
ctcctctaacaggggct

SEQ ID NO: 5603593 - DNA, 13 bp, Homo sapiens
ctcctctaagcca

SEQ ID NO: 5603594 - DNA, 17 bp, Homo sapiens
ctcctctacctctctcc

SEQ ID NO: 5603595 - DNA, 19 bp, Homo sapiens
ctcctctagctgtgggggt

SEQ ID NO: 5603596 - DNA, 18 bp, Homo sapiens
ctcctctaggggcagcct

SEQ ID NO: 5603597 - DNA, 19 bp, Homo sapiens
ctcctctcaaacctggcag

SEQ ID NO: 5603598 - DNA, 14 bp, Homo sapiens
ctcctctcagcttc

SEQ ID NO: 5603599 - DNA, 15 bp, Homo sapiens
ctcctctcagcttct

SEQ ID NO: 5603600 - DNA, 13 bp, Homo sapiens
ctcctctccacca

SEQ ID NO: 5603601 - DNA, 14 bp, Homo sapiens
ctcctctccaccat

SEQ ID NO: 5603602 - DNA, 15 bp, Homo sapiens
ctcctctccagacac

SEQ ID NO: 5603603 - DNA, 13 bp, Homo sapiens
ctcctctccatgc

SEQ ID NO: 5603604 - DNA, 11 bp, Homo sapiens
ctcctctccca

SEQ ID NO: 5603605 - DNA, 15 bp, Homo sapiens
ctcctctcccatccc

SEQ ID NO: 5603606 - DNA, 23 bp, Homo sapiens
ctcctctcccattgtccctctgc

SEQ ID NO: 5603607 - DNA, 21 bp, Homo sapiens
ctcctctccccagcccagaga

SEQ ID NO: 5603608 - DNA, 12 bp, Homo sapiens
ctcctctccccc

SEQ ID NO: 5603609 - DNA, 17 bp, Homo sapiens
ctcctctcccctaccac

SEQ ID NO: 5603610 - DNA, 14 bp, Homo sapiens
ctcctctcccgtct

SEQ ID NO: 5603611 - DNA, 21 bp, Homo sapiens
ctcctctcctactcggctctg

SEQ ID NO: 5603612 - DNA, 14 bp, Homo sapiens
ctcctgtgctattt

SEQ ID NO: 5603613 - DNA, 17 bp, Homo sapiens
ctcctgtgctatttgta

SEQ ID NO: 5603614 - DNA, 23 bp, Homo sapiens
ctcctgtgctatttgtacaaata

SEQ ID NO: 5603615 - DNA, 14 bp, Homo sapiens
ctcctgtgctcacc

SEQ ID NO: 5603616 - DNA, 15 bp, Homo sapiens
ctcctgtggcctgcc

SEQ ID NO: 5603617 - DNA, 10 bp, Homo sapiens
ctcctgtggt

SEQ ID NO: 5603618 - DNA, 22 bp, Homo sapiens
ctcctgtggtagtcctcccaag

SEQ ID NO: 5603619 - DNA, 20 bp, Homo sapiens
ctcctgtggtttgctccaga

SEQ ID NO: 5603620 - DNA, 14 bp, Homo sapiens
ctcctgtgtactgt

SEQ ID NO: 5603621 - DNA, 16 bp, Homo sapiens
ctcctgtgtactgtgt

SEQ ID NO: 5603622 - DNA, 23 bp, Homo sapiens
ctcctgtgtcggggctgacctct

SEQ ID NO: 5603623 - DNA, 13 bp, Homo sapiens
ctcctgtgtgctt

SEQ ID NO: 5603624 - DNA, 14 bp, Homo sapiens
ctcctgtgtgtctg

SEQ ID NO: 5603625 - DNA, 17 bp, Homo sapiens
ctcctgtgtgtctgcag

SEQ ID NO: 5603626 - DNA, 23 bp, Homo sapiens
ctcctgtgtgtctgcagacaagt

SEQ ID NO: 5603627 - DNA, 21 bp, Homo sapiens
ctcctgtgtgtgcgcctacag

SEQ ID NO: 5603628 - DNA, 22 bp, Homo sapiens
ctcctgttccatttcagttcag

SEQ ID NO: 5603629 - DNA, 18 bp, Homo sapiens
ctcctgttccgtgtgggc

SEQ ID NO: 5603630 - DNA, 14 bp, Homo sapiens
ctcctgttgccaca

SEQ ID NO: 5603631 - DNA, 18 bp, Homo sapiens
ctcctgttggccttggaa

SEQ ID NO: 5603632 - DNA, 16 bp, Homo sapiens
ctcctgttgggagagg

SEQ ID NO: 5603633 - DNA, 21 bp, Homo sapiens
ctcctgttgtgaaatcaccac

SEQ ID NO: 5603634 - DNA, 15 bp, Homo sapiens
ctcctgtttcagacc

SEQ ID NO: 5603635 - DNA, 17 bp, Homo sapiens
ctcctgtttcagaccag

SEQ ID NO: 5603636 - DNA, 12 bp, Homo sapiens
ctcctgtttcca

SEQ ID NO: 5603637 - DNA, 15 bp, Homo sapiens
ctcctgtttggaacg

SEQ ID NO: 5603638 - DNA, 13 bp, Homo sapiens
ctcctgttttata

SEQ ID NO: 5603639 - DNA, 15 bp, Homo sapiens
ctcctgttttatata

SEQ ID NO: 5603640 - DNA, 22 bp, Homo sapiens
ctcctgttttcacaccttacaa

SEQ ID NO: 5603641 - DNA, 17 bp, Homo sapiens
ctcctgttttctccctc

SEQ ID NO: 5603642 - DNA, 20 bp, Homo sapiens
ctcctgttttctccctctca

SEQ ID NO: 5603643 - DNA, 19 bp, Homo sapiens
ctcctgttttgcacagcca

SEQ ID NO: 5603644 - DNA, 16 bp, Homo sapiens
ctccttaaaaatgtat

SEQ ID NO: 5603645 - DNA, 18 bp, Homo sapiens
ctccttaaactaccaccc

SEQ ID NO: 5603646 - DNA, 20 bp, Homo sapiens
ctccttaacactgagctgtc

SEQ ID NO: 5603647 - DNA, 23 bp, Homo sapiens
ctccttaagctgcagagatttct

SEQ ID NO: 5603648 - DNA, 21 bp, Homo sapiens
ctccttacattaaaaagcctt

SEQ ID NO: 5603649 - DNA, 19 bp, Homo sapiens
ctccttaccaatagcctga

SEQ ID NO: 5603650 - DNA, 18 bp, Homo sapiens
ctccttacctctggaacc

SEQ ID NO: 5603651 - DNA, 14 bp, Homo sapiens
ctccttacctggag

SEQ ID NO: 5603652 - DNA, 15 bp, Homo sapiens
ctccttactctgagc

SEQ ID NO: 5603653 - DNA, 18 bp, Homo sapiens
ctccttactctgagccca

SEQ ID NO: 5603654 - DNA, 20 bp, Homo sapiens
ctccttactctgagcccagg

SEQ ID NO: 5603655 - DNA, 21 bp, Homo sapiens
ctccttacttcggttcctctg

SEQ ID NO: 5603656 - DNA, 14 bp, Homo sapiens
ctccttagaaaaaa

SEQ ID NO: 5603657 - DNA, 20 bp, Homo sapiens
ctccttagaagtggaagtag

SEQ ID NO: 5603658 - DNA, 14 bp, Homo sapiens
ctccttagacacct

SEQ ID NO: 5603659 - DNA, 17 bp, Homo sapiens
ctccttagccctgtctg

SEQ ID NO: 5603660 - DNA, 20 bp, Homo sapiens
ctccttagctagttagctca

SEQ ID NO: 5603661 - DNA, 22 bp, Homo sapiens
ctccttagctgccaagccccat

SEQ ID NO: 5603662 - DNA, 18 bp, Homo sapiens
ctccttagggttttctct

SEQ ID NO: 5603663 - DNA, 19 bp, Homo sapiens
ctccttagtcttctcatag

SEQ ID NO: 5603664 - DNA, 17 bp, Homo sapiens
ctccttataagcccagc

SEQ ID NO: 5603665 - DNA, 17 bp, Homo sapiens
ctccttatcaaaggaca

SEQ ID NO: 5603666 - DNA, 22 bp, Homo sapiens
ctccttatcaaaggacaccatt

SEQ ID NO: 5603667 - DNA, 17 bp, Homo sapiens
ctccttatctctttcca

SEQ ID NO: 5603668 - DNA, 16 bp, Homo sapiens
ctccttattttgtatt

SEQ ID NO: 5603669 - DNA, 23 bp, Homo sapiens
ctccttcaacaaggcttgctgca

SEQ ID NO: 5603670 - DNA, 19 bp, Homo sapiens
ctccttcacagatgggtgc

SEQ ID NO: 5603671 - DNA, 19 bp, Homo sapiens
ctccttcaccacccccacg

SEQ ID NO: 5603672 - DNA, 20 bp, Homo sapiens
ctccttcaccacccccacga

SEQ ID NO: 5603673 - DNA, 16 bp, Homo sapiens
ctccttcacctttgtc

SEQ ID NO: 5603674 - DNA, 18 bp, Homo sapiens
ctccttcactctaaaaat

SEQ ID NO: 5603675 - DNA, 16 bp, Homo sapiens
ctccttcactctgaca

SEQ ID NO: 5603676 - DNA, 13 bp, Homo sapiens
ctccttcactgtt

SEQ ID NO: 5603677 - DNA, 15 bp, Homo sapiens
ctccttcagccctca

SEQ ID NO: 5603678 - DNA, 19 bp, Homo sapiens
ctccttcagttctgcttgc

SEQ ID NO: 5603679 - DNA, 20 bp, Homo sapiens
ctccttcagttctgcttgct

SEQ ID NO: 5603680 - DNA, 19 bp, Homo sapiens
ctccttcatgcttttctca

SEQ ID NO: 5603681 - DNA, 14 bp, Homo sapiens
ctccttccaacagg

SEQ ID NO: 5603682 - DNA, 18 bp, Homo sapiens
ctccttccaacaggagct

SEQ ID NO: 5603683 - DNA, 18 bp, Homo sapiens
ctccttccaactgctgcc

SEQ ID NO: 5603684 - DNA, 19 bp, Homo sapiens
ctccttccacatgtacata

SEQ ID NO: 5603685 - DNA, 15 bp, Homo sapiens
ctccttccagacctt

SEQ ID NO: 5603686 - DNA, 16 bp, Homo sapiens
ctccttccagcctgag

SEQ ID NO: 5603687 - DNA, 17 bp, Homo sapiens
ctccttccaggccccag

SEQ ID NO: 5603688 - DNA, 22 bp, Homo sapiens
ctccttccaggccccaggctgg

SEQ ID NO: 5603689 - DNA, 14 bp, Homo sapiens
ctccttccattcag

SEQ ID NO: 5603690 - DNA, 13 bp, Homo sapiens
ctccttcccaaag

SEQ ID NO: 5603691 - DNA, 22 bp, Homo sapiens
ctccttcccaaaggactccacc

SEQ ID NO: 5603692 - DNA, 23 bp, Homo sapiens
ctccttcccaaaggactccaccc

SEQ ID NO: 5603693 - DNA, 13 bp, Homo sapiens
ctccttcccaagg

SEQ ID NO: 5603694 - DNA, 17 bp, Homo sapiens
ctccttcccaaggcagc

SEQ ID NO: 5603695 - DNA, 12 bp, Homo sapiens
ctccttcccaat

SEQ ID NO: 5603696 - DNA, 14 bp, Homo sapiens
ctccttcccaatct

SEQ ID NO: 5603697 - DNA, 13 bp, Homo sapiens
ctccttcccacaa

SEQ ID NO: 5603698 - DNA, 15 bp, Homo sapiens
ctccttcccacaaaa

SEQ ID NO: 5603699 - DNA, 21 bp, Homo sapiens
ctccttcccacccctacacac

SEQ ID NO: 5603700 - DNA, 15 bp, Homo sapiens
ctccttcccactctt

SEQ ID NO: 5603701 - DNA, 18 bp, Homo sapiens
ctccttcccactcttctc

SEQ ID NO: 5603702 - DNA, 19 bp, Homo sapiens
ctccttcccactcttctca

SEQ ID NO: 5603703 - DNA, 15 bp, Homo sapiens
ctccttcccactgtc

SEQ ID NO: 5603704 - DNA, 16 bp, Homo sapiens
ctccttcccactgtcc

SEQ ID NO: 5603705 - DNA, 20 bp, Homo sapiens
ctccttcccactgtcctttc

SEQ ID NO: 5603706 - DNA, 21 bp, Homo sapiens
ctccttcccactgtcctttct

SEQ ID NO: 5603707 - DNA, 13 bp, Homo sapiens
ctccttcccagat

SEQ ID NO: 5603708 - DNA, 22 bp, Homo sapiens
ctccttcccagcaacactccgg

SEQ ID NO: 5603709 - DNA, 15 bp, Homo sapiens
ctccttcccagctct

SEQ ID NO: 5603710 - DNA, 16 bp, Homo sapiens
ctccttcccagctgcc

SEQ ID NO: 5603711 - DNA, 15 bp, Homo sapiens
ctccttcccagggac

SEQ ID NO: 5603712 - DNA, 17 bp, Homo sapiens
ctccttcccagggacca

SEQ ID NO: 5603713 - DNA, 18 bp, Homo sapiens
ctccttcccagggaccag

SEQ ID NO: 5603714 - DNA, 23 bp, Homo sapiens
ctccttcccagggaccagcacct

SEQ ID NO: 5603715 - DNA, 22 bp, Homo sapiens
ctccttcccatttctctacact

SEQ ID NO: 5603716 - DNA, 13 bp, Homo sapiens
ctccttccccacc

SEQ ID NO: 5603717 - DNA, 17 bp, Homo sapiens
ctccttccccaccccat

SEQ ID NO: 5603718 - DNA, 14 bp, Homo sapiens
ctccttccccagac

SEQ ID NO: 5603719 - DNA, 17 bp, Homo sapiens
ctccttccccagaccca

SEQ ID NO: 5603720 - DNA, 18 bp, Homo sapiens
ctccttccccagacccag

SEQ ID NO: 5603721 - DNA, 13 bp, Homo sapiens
ctccttccccagc

SEQ ID NO: 5603722 - DNA, 16 bp, Homo sapiens
ctccttccccatttcc

SEQ ID NO: 5603723 - DNA, 16 bp, Homo sapiens
ctccttcccccagccc

SEQ ID NO: 5603724 - DNA, 18 bp, Homo sapiens
ctccttcccccagcccaa

SEQ ID NO: 5603725 - DNA, 20 bp, Homo sapiens
ctccttcccccagcccaata

SEQ ID NO: 5603726 - DNA, 22 bp, Homo sapiens
ctccttcccccagcccaataaa

SEQ ID NO: 5603727 - DNA, 23 bp, Homo sapiens
ctccttcccccagcccaataaag

SEQ ID NO: 5603728 - DNA, 19 bp, Homo sapiens
ctccttccccccatctctg

SEQ ID NO: 5603729 - DNA, 22 bp, Homo sapiens
ctccttccccccatctctgagt

SEQ ID NO: 5603730 - DNA, 15 bp, Homo sapiens
ctccttcccctgcac

SEQ ID NO: 5603731 - DNA, 22 bp, Homo sapiens
ctccttcccgccgcccgacccc

SEQ ID NO: 5603732 - DNA, 10 bp, Homo sapiens
ctccttccct

SEQ ID NO: 5603733 - DNA, 18 bp, Homo sapiens
ctccttccctcaccccca

SEQ ID NO: 5603734 - DNA, 23 bp, Homo sapiens
ctccttccctcacccccagcaca

SEQ ID NO: 5603735 - DNA, 19 bp, Homo sapiens
ctccttccctcctgtgccc

SEQ ID NO: 5603736 - DNA, 19 bp, Homo sapiens
ctccttccctgtgtctttt

SEQ ID NO: 5603737 - DNA, 18 bp, Homo sapiens
ctccttcccttctctcct

SEQ ID NO: 5603738 - DNA, 17 bp, Homo sapiens
ctccttcccttctcttg

SEQ ID NO: 5603739 - DNA, 14 bp, Homo sapiens
ctccttcccttgct

SEQ ID NO: 5603740 - DNA, 20 bp, Homo sapiens
ctccttcctagttcatccct

SEQ ID NO: 5603741 - DNA, 16 bp, Homo sapiens
ctccttcctcagcctc

SEQ ID NO: 5603742 - DNA, 19 bp, Homo sapiens
ctccttcctcagtcctgga

SEQ ID NO: 5603743 - DNA, 20 bp, Homo sapiens
ctccttcctcagtcctggaa

SEQ ID NO: 5603744 - DNA, 11 bp, Homo sapiens
ctccttcctgc

SEQ ID NO: 5603745 - DNA, 13 bp, Homo sapiens
ctccttcctgccc

SEQ ID NO: 5603746 - DNA, 15 bp, Homo sapiens
ctccttcctgcccca

SEQ ID NO: 5603747 - DNA, 20 bp, Homo sapiens
ctccttcctggagcccagag

SEQ ID NO: 5603748 - DNA, 14 bp, Homo sapiens
ctccttcctggcct

SEQ ID NO: 5603749 - DNA, 23 bp, Homo sapiens
ctccttcctggcgggggtgggcc

SEQ ID NO: 5603750 - DNA, 13 bp, Homo sapiens
ctccttcctggga

SEQ ID NO: 5603751 - DNA, 15 bp, Homo sapiens
ctccttcctgggacc

SEQ ID NO: 5603752 - DNA, 13 bp, Homo sapiens
ctccttcctgtct

SEQ ID NO: 5603753 - DNA, 18 bp, Homo sapiens
ctccttcctgtgccgtaa

SEQ ID NO: 5603754 - DNA, 13 bp, Homo sapiens
ctccttcctgtgt

SEQ ID NO: 5603755 - DNA, 19 bp, Homo sapiens
ctccttcctgtttgttttg

SEQ ID NO: 5603756 - DNA, 23 bp, Homo sapiens
ctccttccttacccaaactgttc

SEQ ID NO: 5603757 - DNA, 18 bp, Homo sapiens
ctccttccttcacctctg

SEQ ID NO: 5603758 - DNA, 14 bp, Homo sapiens
ctccttccttccaa

SEQ ID NO: 5603759 - DNA, 17 bp, Homo sapiens
ctccttccttgaccagc

SEQ ID NO: 5603760 - DNA, 13 bp, Homo sapiens
ctccttccttgtt

SEQ ID NO: 5603761 - DNA, 19 bp, Homo sapiens
ctccttcgcaggcatgtcc

SEQ ID NO: 5603762 - DNA, 18 bp, Homo sapiens
ctccttcgtatcccgagt

SEQ ID NO: 5603763 - DNA, 19 bp, Homo sapiens
ctccttcgtatcccgagtc

SEQ ID NO: 5603764 - DNA, 20 bp, Homo sapiens
ctccttcgtgtctctcccac

SEQ ID NO: 5603765 - DNA, 21 bp, Homo sapiens
ctccttcgtgtctctcccacc

SEQ ID NO: 5603766 - DNA, 20 bp, Homo sapiens
ctccttctaaaaacttctca

SEQ ID NO: 5603767 - DNA, 14 bp, Homo sapiens
ctccttctccccaa

SEQ ID NO: 5603768 - DNA, 16 bp, Homo sapiens
ctccttctcccctcca

SEQ ID NO: 5603769 - DNA, 18 bp, Homo sapiens
ctccttctcccctccaga

SEQ ID NO: 5603770 - DNA, 14 bp, Homo sapiens
ctccttctcccctg

SEQ ID NO: 5603771 - DNA, 11 bp, Homo sapiens
ctccttctctt

SEQ ID NO: 5603772 - DNA, 13 bp, Homo sapiens
ctccttctcttct

SEQ ID NO: 5603773 - DNA, 18 bp, Homo sapiens
ctccttctcttctcttct

SEQ ID NO: 5603774 - DNA, 14 bp, Homo sapiens
ctccttctgagctc

SEQ ID NO: 5603775 - DNA, 20 bp, Homo sapiens
ctccttctgagctcctgtcc

SEQ ID NO: 5603776 - DNA, 23 bp, Homo sapiens
ctccttctgagctcctgtcccct

SEQ ID NO: 5603777 - DNA, 14 bp, Homo sapiens
ctccttctgcaaag

SEQ ID NO: 5603778 - DNA, 22 bp, Homo sapiens
ctccttctgctgtgtatcatgg

SEQ ID NO: 5603779 - DNA, 15 bp, Homo sapiens
ctccttctgtcctac

SEQ ID NO: 5603780 - DNA, 22 bp, Homo sapiens
ctccttcttaactctgcaggaa

SEQ ID NO: 5603781 - DNA, 17 bp, Homo sapiens
ctccttcttccacttct

SEQ ID NO: 5603782 - DNA, 16 bp, Homo sapiens
ctccttcttccctgtt

SEQ ID NO: 5603783 - DNA, 14 bp, Homo sapiens
ctccttcttgccct

SEQ ID NO: 5603784 - DNA, 13 bp, Homo sapiens
ctccttcttttcc

SEQ ID NO: 5603785 - DNA, 21 bp, Homo sapiens
ctccttgaaaacactgttctc

SEQ ID NO: 5603786 - DNA, 23 bp, Homo sapiens
ctccttgaccctgaaaggaacac

SEQ ID NO: 5603787 - DNA, 14 bp, Homo sapiens
ctccttgagactgg

SEQ ID NO: 5603788 - DNA, 17 bp, Homo sapiens
ctccttgagagaccagg

SEQ ID NO: 5603789 - DNA, 22 bp, Homo sapiens
ctccttgagggcaagagccaca

SEQ ID NO: 5603790 - DNA, 15 bp, Homo sapiens
ctctgatgcagaaat

SEQ ID NO: 5603791 - DNA, 13 bp, Homo sapiens
ctctgatgcagct

SEQ ID NO: 5603792 - DNA, 18 bp, Homo sapiens
ctctgatgcagcttatac

SEQ ID NO: 5603793 - DNA, 21 bp, Homo sapiens
ctctgatggaatgtgccacct

SEQ ID NO: 5603794 - DNA, 23 bp, Homo sapiens
ctctgatggaatgtgccacctgt

SEQ ID NO: 5603795 - DNA, 13 bp, Homo sapiens
ctctgatgtccca

SEQ ID NO: 5603796 - DNA, 16 bp, Homo sapiens
ctctgattacatgtat

SEQ ID NO: 5603797 - DNA, 22 bp, Homo sapiens
ctctgattagttgacagtatta

SEQ ID NO: 5603798 - DNA, 14 bp, Homo sapiens
ctctgattatcagg

SEQ ID NO: 5603799 - DNA, 23 bp, Homo sapiens
ctctgattatgtgccctggccag

SEQ ID NO: 5603800 - DNA, 17 bp, Homo sapiens
ctctgattcacctcttc

SEQ ID NO: 5603801 - DNA, 18 bp, Homo sapiens
ctctgattcacctcttcc

SEQ ID NO: 5603802 - DNA, 13 bp, Homo sapiens
ctctgattctatg

SEQ ID NO: 5603803 - DNA, 20 bp, Homo sapiens
ctctgattctatgtaacttg

SEQ ID NO: 5603804 - DNA, 20 bp, Homo sapiens
ctctgattggaatttctggc

SEQ ID NO: 5603805 - DNA, 20 bp, Homo sapiens
ctctgattgggtcagctggc

SEQ ID NO: 5603806 - DNA, 18 bp, Homo sapiens
ctctgattttcaaagctt

SEQ ID NO: 5603807 - DNA, 14 bp, Homo sapiens
ctctgattttctcc

SEQ ID NO: 5603808 - DNA, 23 bp, Homo sapiens
ctctgattttttactggctgtgt

SEQ ID NO: 5603809 - DNA, 18 bp, Homo sapiens
ctctgcaaaaggagagac

SEQ ID NO: 5603810 - DNA, 14 bp, Homo sapiens
ctctgcaaaggcct

SEQ ID NO: 5603811 - DNA, 15 bp, Homo sapiens
ctctgcaaaggcctg

SEQ ID NO: 5603812 - DNA, 14 bp, Homo sapiens
ctctgcaactgaat

SEQ ID NO: 5603813 - DNA, 14 bp, Homo sapiens
ctctgcaagaagaa

SEQ ID NO: 5603814 - DNA, 20 bp, Homo sapiens
ctctgcaagcccactggcca

SEQ ID NO: 5603815 - DNA, 19 bp, Homo sapiens
ctctgcaagcttcttgctg

SEQ ID NO: 5603816 - DNA, 12 bp, Homo sapiens
ctctgcaagtgc

SEQ ID NO: 5603817 - DNA, 20 bp, Homo sapiens
ctctgcaagtgctcagggaa

SEQ ID NO: 5603818 - DNA, 21 bp, Homo sapiens
ctctgcaagtgctcagggaaa

SEQ ID NO: 5603819 - DNA, 15 bp, Homo sapiens
ctctgcacaagctgc

SEQ ID NO: 5603820 - DNA, 16 bp, Homo sapiens
ctctgcacaagctgca

SEQ ID NO: 5603821 - DNA, 20 bp, Homo sapiens
ctctgcacagacaagcagcc

SEQ ID NO: 5603822 - DNA, 22 bp, Homo sapiens
ctctgcacagacaagcagccct

SEQ ID NO: 5603823 - DNA, 15 bp, Homo sapiens
ctctgcacagatgga

SEQ ID NO: 5603824 - DNA, 13 bp, Homo sapiens
ctctgcacatgtc

SEQ ID NO: 5603825 - DNA, 15 bp, Homo sapiens
ctctgcacccacgtg

SEQ ID NO: 5603826 - DNA, 16 bp, Homo sapiens
ctctgcacccagaaca

SEQ ID NO: 5603827 - DNA, 14 bp, Homo sapiens
ctctgcacccagtg

SEQ ID NO: 5603828 - DNA, 16 bp, Homo sapiens
ctctgcacccccatat

SEQ ID NO: 5603829 - DNA, 23 bp, Homo sapiens
ctctgcacccgcctcgacctccc

SEQ ID NO: 5603830 - DNA, 13 bp, Homo sapiens
ctctgcaccggac

SEQ ID NO: 5603831 - DNA, 18 bp, Homo sapiens
ctctgcaccgtactgtgg

SEQ ID NO: 5603832 - DNA, 15 bp, Homo sapiens
ctctgcacctgtctc

SEQ ID NO: 5603833 - DNA, 16 bp, Homo sapiens
ctctgcaccttctgac

SEQ ID NO: 5603834 - DNA, 23 bp, Homo sapiens
ctctgcaccttctgacgcagcct

SEQ ID NO: 5603835 - DNA, 17 bp, Homo sapiens
ctctgcacgctcaatgc

SEQ ID NO: 5603836 - DNA, 21 bp, Homo sapiens
ctctgcacgtgcacacacctg

SEQ ID NO: 5603837 - DNA, 22 bp, Homo sapiens
ctctgcacgtgcacacacctgc

SEQ ID NO: 5603838 - DNA, 15 bp, Homo sapiens
ctctgcactaagaga

SEQ ID NO: 5603839 - DNA, 13 bp, Homo sapiens
ctctgcactactc

SEQ ID NO: 5603840 - DNA, 13 bp, Homo sapiens
ctctgcactccat

SEQ ID NO: 5603841 - DNA, 14 bp, Homo sapiens
ctctgcactccatg

SEQ ID NO: 5603842 - DNA, 19 bp, Homo sapiens
ctctgcactccatggccac

SEQ ID NO: 5603843 - DNA, 22 bp, Homo sapiens
ctctgcactccatggccacccc

SEQ ID NO: 5603844 - DNA, 23 bp, Homo sapiens
ctctgcactccatggccaccccg

SEQ ID NO: 5603845 - DNA, 16 bp, Homo sapiens
ctctgcactcccctgc

SEQ ID NO: 5603846 - DNA, 13 bp, Homo sapiens
ctctgcactctcc

SEQ ID NO: 5603847 - DNA, 23 bp, Homo sapiens
ctctgcactctccaccctggctg

SEQ ID NO: 5603848 - DNA, 21 bp, Homo sapiens
ctctgcactggggcgtttcct

SEQ ID NO: 5603849 - DNA, 18 bp, Homo sapiens
ctctgcagaaactactga

SEQ ID NO: 5603850 - DNA, 18 bp, Homo sapiens
ctctgcagaacagtgaaa

SEQ ID NO: 5603851 - DNA, 16 bp, Homo sapiens
ctctgcagactgctag

SEQ ID NO: 5603852 - DNA, 21 bp, Homo sapiens
ctctgcagatagtgcctctgc

SEQ ID NO: 5603853 - DNA, 17 bp, Homo sapiens
ctctgcagcattgaagt

SEQ ID NO: 5603854 - DNA, 15 bp, Homo sapiens
ctctgcagccagccc

SEQ ID NO: 5603855 - DNA, 19 bp, Homo sapiens
ctctgcagccagcccagcc

SEQ ID NO: 5603856 - DNA, 13 bp, Homo sapiens
ctctgcagcccac

SEQ ID NO: 5603857 - DNA, 18 bp, Homo sapiens
ctctgcagcccacagagg

SEQ ID NO: 5603858 - DNA, 20 bp, Homo sapiens
ctctgcagcccacagaggac

SEQ ID NO: 5603859 - DNA, 21 bp, Homo sapiens
ctctgcagcccattcccaagg

SEQ ID NO: 5603860 - DNA, 23 bp, Homo sapiens
ctctgcagcccattcccaaggga

SEQ ID NO: 5603861 - DNA, 13 bp, Homo sapiens
ctctgcagccctc

SEQ ID NO: 5603862 - DNA, 12 bp, Homo sapiens
ctctgcagcctc

SEQ ID NO: 5603863 - DNA, 13 bp, Homo sapiens
ctctgcagcctca

SEQ ID NO: 5603864 - DNA, 13 bp, Homo sapiens
ctctgcagcctga

SEQ ID NO: 5603865 - DNA, 14 bp, Homo sapiens
ctctgcagcctgag

SEQ ID NO: 5603866 - DNA, 16 bp, Homo sapiens
ctctgcagcctgagct

SEQ ID NO: 5603867 - DNA, 13 bp, Homo sapiens
ctctgcagctgcc

SEQ ID NO: 5603868 - DNA, 19 bp, Homo sapiens
ctctgcaggacacagatct

SEQ ID NO: 5603869 - DNA, 20 bp, Homo sapiens
ctctgcaggacacagatctg

SEQ ID NO: 5603870 - DNA, 19 bp, Homo sapiens
ctctgcaggctggggaggt

SEQ ID NO: 5603871 - DNA, 23 bp, Homo sapiens
ctctgcaggcttaataaaaatga

SEQ ID NO: 5603872 - DNA, 16 bp, Homo sapiens
ctctgcagggcagcct

SEQ ID NO: 5603873 - DNA, 23 bp, Homo sapiens
ctctgcagggcagcctgtgggag

SEQ ID NO: 5603874 - DNA, 19 bp, Homo sapiens
ctctgcagggccgccaggg

SEQ ID NO: 5603875 - DNA, 14 bp, Homo sapiens
ctctgcaggtccct

SEQ ID NO: 5603876 - DNA, 19 bp, Homo sapiens
ctctgcaggtccctaataa

SEQ ID NO: 5603877 - DNA, 21 bp, Homo sapiens
ctctgcaggtccctaataaag

SEQ ID NO: 5603878 - DNA, 13 bp, Homo sapiens
ctctgcagtaaaa

SEQ ID NO: 5603879 - DNA, 19 bp, Homo sapiens
ctctgcagtaaaacacatt

SEQ ID NO: 5603880 - DNA, 19 bp, Homo sapiens
ctctgcagtacttgatgta

SEQ ID NO: 5603881 - DNA, 20 bp, Homo sapiens
ctctgcagtcctactcaagc

SEQ ID NO: 5603882 - DNA, 21 bp, Homo sapiens
ctctgcagtcgcttgccaaag

SEQ ID NO: 5603883 - DNA, 14 bp, Homo sapiens
ctctgcagtctcta

SEQ ID NO: 5603884 - DNA, 14 bp, Homo sapiens
ctctgcagtgcctt

SEQ ID NO: 5603885 - DNA, 23 bp, Homo sapiens
ctctgcagtgtggcaagcaagag

SEQ ID NO: 5603886 - DNA, 19 bp, Homo sapiens
ctctgcagtttttcccaag

SEQ ID NO: 5603887 - DNA, 23 bp, Homo sapiens
ctctgcataagattatatacaaa

SEQ ID NO: 5603888 - DNA, 15 bp, Homo sapiens
ctctgcataccctca

SEQ ID NO: 5603889 - DNA, 23 bp, Homo sapiens
ctctgcatactcattaggatggc

SEQ ID NO: 5603890 - DNA, 23 bp, Homo sapiens
ctctgcatatatgtctctttgga

SEQ ID NO: 5603891 - DNA, 14 bp, Homo sapiens
ctctgcatccagag

SEQ ID NO: 5603892 - DNA, 14 bp, Homo sapiens
ctctgcatcccagc

SEQ ID NO: 5603893 - DNA, 15 bp, Homo sapiens
ctctgcatcccagca

SEQ ID NO: 5603894 - DNA, 18 bp, Homo sapiens
ctctgcatcccagcacct

SEQ ID NO: 5603895 - DNA, 19 bp, Homo sapiens
ctctgcatcccagcacctg

SEQ ID NO: 5603896 - DNA, 17 bp, Homo sapiens
ctctgcatctactccca

SEQ ID NO: 5603897 - DNA, 19 bp, Homo sapiens
ctctgcatctactcccaag

SEQ ID NO: 5603898 - DNA, 20 bp, Homo sapiens
ctctgcatctactcccaagt

SEQ ID NO: 5603899 - DNA, 15 bp, Homo sapiens
ctctgcatctcattg

SEQ ID NO: 5603900 - DNA, 15 bp, Homo sapiens
ctctgcatcttcagt

SEQ ID NO: 5603901 - DNA, 18 bp, Homo sapiens
ctctgcatcttgctctgt

SEQ ID NO: 5603902 - DNA, 21 bp, Homo sapiens
ctctgcatgcggcccagcccg

SEQ ID NO: 5603903 - DNA, 15 bp, Homo sapiens
ctctgcatgctcctc

SEQ ID NO: 5603904 - DNA, 18 bp, Homo sapiens
ctctgcatgctcctctgc

SEQ ID NO: 5603905 - DNA, 13 bp, Homo sapiens
ctctgcatgtgtg

SEQ ID NO: 5603906 - DNA, 16 bp, Homo sapiens
ctctgcattgacctgg

SEQ ID NO: 5603907 - DNA, 22 bp, Homo sapiens
ctctgcattgacctggagggga

SEQ ID NO: 5603908 - DNA, 13 bp, Homo sapiens
ctctgcattgcct

SEQ ID NO: 5603909 - DNA, 17 bp, Homo sapiens
ctctgcatttaaaaaaa

SEQ ID NO: 5603910 - DNA, 19 bp, Homo sapiens
ctctgccaaagcttgtgga

SEQ ID NO: 5603911 - DNA, 18 bp, Homo sapiens
ctctgccaacatgaggac

SEQ ID NO: 5603912 - DNA, 22 bp, Homo sapiens
ctctgccaacatgaggacagaa

SEQ ID NO: 5603913 - DNA, 21 bp, Homo sapiens
ctctgccaatgtgggctgccc

SEQ ID NO: 5603914 - DNA, 17 bp, Homo sapiens
ctctgccacactctgac

SEQ ID NO: 5603915 - DNA, 14 bp, Homo sapiens
ctctgccacccact

SEQ ID NO: 5603916 - DNA, 16 bp, Homo sapiens
ctctgccacccactca

SEQ ID NO: 5603917 - DNA, 18 bp, Homo sapiens
ctctgccacccactcagg

SEQ ID NO: 5603918 - DNA, 19 bp, Homo sapiens
ctctgccacccactcagga

SEQ ID NO: 5603919 - DNA, 14 bp, Homo sapiens
ctctgccactggga

SEQ ID NO: 5603920 - DNA, 17 bp, Homo sapiens
ctctgccagaagatccc

SEQ ID NO: 5603921 - DNA, 15 bp, Homo sapiens
ctctgccagcaggaa

SEQ ID NO: 5603922 - DNA, 14 bp, Homo sapiens
ctctgccagccaca

SEQ ID NO: 5603923 - DNA, 21 bp, Homo sapiens
ctctgccagcgtccccggcca

SEQ ID NO: 5603924 - DNA, 14 bp, Homo sapiens
ctctgccagctcca

SEQ ID NO: 5603925 - DNA, 15 bp, Homo sapiens
ctctgccaggcctgt

SEQ ID NO: 5603926 - DNA, 13 bp, Homo sapiens
ctctgccagggca

SEQ ID NO: 5603927 - DNA, 15 bp, Homo sapiens
ctctgccagggcagt

SEQ ID NO: 5603928 - DNA, 13 bp, Homo sapiens
ctctgccagtcct

SEQ ID NO: 5603929 - DNA, 17 bp, Homo sapiens
ctctgccagtcctgtcc

SEQ ID NO: 5603930 - DNA, 19 bp, Homo sapiens
ctctgccagtcgggagagc

SEQ ID NO: 5603931 - DNA, 13 bp, Homo sapiens
ctctgccagtgac

SEQ ID NO: 5603932 - DNA, 15 bp, Homo sapiens
ctctgccagtgacag

SEQ ID NO: 5603933 - DNA, 16 bp, Homo sapiens
ctctgccagtggatcc

SEQ ID NO: 5603934 - DNA, 22 bp, Homo sapiens
ctctgccagtggatcccctgcg

SEQ ID NO: 5603935 - DNA, 18 bp, Homo sapiens
ctctgccatcagcccctg

SEQ ID NO: 5603936 - DNA, 22 bp, Homo sapiens
ctctgccatcagcccctgctgc

SEQ ID NO: 5603937 - DNA, 12 bp, Homo sapiens
ctctgccatcct

SEQ ID NO: 5603938 - DNA, 13 bp, Homo sapiens
ctctgccatcctc

SEQ ID NO: 5603939 - DNA, 20 bp, Homo sapiens
ctctgccatgaactggaggc

SEQ ID NO: 5603940 - DNA, 22 bp, Homo sapiens
ctctgccatggccttggcaggc

SEQ ID NO: 5603941 - DNA, 22 bp, Homo sapiens
ctctgccatgtttttcccctgc

SEQ ID NO: 5603942 - DNA, 14 bp, Homo sapiens
ctctgcccaaccct

SEQ ID NO: 5603943 - DNA, 20 bp, Homo sapiens
ctctgcccaacccttccctc

SEQ ID NO: 5603944 - DNA, 24 bp, Homo sapiens
ctctgcccaagcagcctggagact

SEQ ID NO: 5603945 - DNA, 20 bp, Homo sapiens
ctctgcccaagttgctctgt

SEQ ID NO: 5603946 - DNA, 17 bp, Homo sapiens
ctctgcccaccctcctg

SEQ ID NO: 5603947 - DNA, 16 bp, Homo sapiens
ctctgcccacctgggg

SEQ ID NO: 5603948 - DNA, 16 bp, Homo sapiens
ctctgcccactccctg

SEQ ID NO: 5603949 - DNA, 13 bp, Homo sapiens
ctctgcccagagc

SEQ ID NO: 5603950 - DNA, 17 bp, Homo sapiens
ctctgcccagcttgggc

SEQ ID NO: 5603951 - DNA, 22 bp, Homo sapiens
ctctgcccaggcaaggaacaga

SEQ ID NO: 5603952 - DNA, 19 bp, Homo sapiens
ctctgcccaggcactgcta

SEQ ID NO: 5603953 - DNA, 14 bp, Homo sapiens
ctctgcccatgcct

SEQ ID NO: 5603954 - DNA, 15 bp, Homo sapiens
ctctgcccattcccc

SEQ ID NO: 5603955 - DNA, 19 bp, Homo sapiens
ctctgcccattccccagcc

SEQ ID NO: 5603956 - DNA, 18 bp, Homo sapiens
ctctgccccaagcagcca

SEQ ID NO: 5603957 - DNA, 19 bp, Homo sapiens
ctctgccccaagcagccag

SEQ ID NO: 5603958 - DNA, 20 bp, Homo sapiens
ctctgccccaagcagccagc

SEQ ID NO: 5603959 - DNA, 21 bp, Homo sapiens
ctctgccccaagcagccagcc

SEQ ID NO: 5603960 - DNA, 23 bp, Homo sapiens
ctctgccccaaggggcccacaaa

SEQ ID NO: 5603961 - DNA, 22 bp, Homo sapiens
ctctgccccaatcgggtccaga

SEQ ID NO: 5603962 - DNA, 22 bp, Homo sapiens
ctctgccccacccaagcccaaa

SEQ ID NO: 5603963 - DNA, 16 bp, Homo sapiens
ctctgccccaccctca

SEQ ID NO: 5603964 - DNA, 16 bp, Homo sapiens
ctctgccccagcctgt

SEQ ID NO: 5603965 - DNA, 17 bp, Homo sapiens
ctctgccccagctctgg

SEQ ID NO: 5603966 - DNA, 21 bp, Homo sapiens
ctctgccccatcctccagcag

SEQ ID NO: 5603967 - DNA, 15 bp, Homo sapiens
ctctgggtccttcct

SEQ ID NO: 5603968 - DNA, 17 bp, Homo sapiens
ctctgggtccttcctga

SEQ ID NO: 5603969 - DNA, 19 bp, Homo sapiens
ctctgggtccttggctccc

SEQ ID NO: 5603970 - DNA, 21 bp, Homo sapiens
ctctgggtggaagtgcccagc

SEQ ID NO: 5603971 - DNA, 22 bp, Homo sapiens
ctctgggtgggcgtggcctgca

SEQ ID NO: 5603972 - DNA, 21 bp, Homo sapiens
ctctgggttcgttggggacat

SEQ ID NO: 5603973 - DNA, 21 bp, Homo sapiens
ctctgggttttgggatttggg

SEQ ID NO: 5603974 - DNA, 22 bp, Homo sapiens
ctctggtacaatttcttttggt

SEQ ID NO: 5603975 - DNA, 19 bp, Homo sapiens
ctctggtagcatgatggct

SEQ ID NO: 5603976 - DNA, 21 bp, Homo sapiens
ctctggtccacactagaaaga

SEQ ID NO: 5603977 - DNA, 19 bp, Homo sapiens
ctctggtccatagagagca

SEQ ID NO: 5603978 - DNA, 16 bp, Homo sapiens
ctctggtcccctctct

SEQ ID NO: 5603979 - DNA, 22 bp, Homo sapiens
ctctggtccggacactcctaga

SEQ ID NO: 5603980 - DNA, 17 bp, Homo sapiens
ctctggtcctcggagct

SEQ ID NO: 5603981 - DNA, 17 bp, Homo sapiens
ctctggtcctgtgtctt

SEQ ID NO: 5603982 - DNA, 14 bp, Homo sapiens
ctctggtccttctg

SEQ ID NO: 5603983 - DNA, 14 bp, Homo sapiens
ctctggtctacctg

SEQ ID NO: 5603984 - DNA, 17 bp, Homo sapiens
ctctggtctactctaga

SEQ ID NO: 5603985 - DNA, 19 bp, Homo sapiens
ctctggtctactctagaag

SEQ ID NO: 5603986 - DNA, 22 bp, Homo sapiens
ctctggtctcctctttgttttg

SEQ ID NO: 5603987 - DNA, 13 bp, Homo sapiens
ctctggtctgtag

SEQ ID NO: 5603988 - DNA, 21 bp, Homo sapiens
ctctggtgagtcttggcggca

SEQ ID NO: 5603989 - DNA, 22 bp, Homo sapiens
ctctggtgagtcttggcggcag

SEQ ID NO: 5603990 - DNA, 16 bp, Homo sapiens
ctctggtgataaggac

SEQ ID NO: 5603991 - DNA, 15 bp, Homo sapiens
ctctggtgccgggga

SEQ ID NO: 5603992 - DNA, 18 bp, Homo sapiens
ctctggtggccacttcat

SEQ ID NO: 5603993 - DNA, 21 bp, Homo sapiens
ctctggtggccacttcattcc

SEQ ID NO: 5603994 - DNA, 16 bp, Homo sapiens
ctctggtggctcctcc

SEQ ID NO: 5603995 - DNA, 17 bp, Homo sapiens
ctctggtggctcctcct

SEQ ID NO: 5603996 - DNA, 19 bp, Homo sapiens
ctctggtggctgggctgct

SEQ ID NO: 5603997 - DNA, 20 bp, Homo sapiens
ctctggtggctgggctgctc

SEQ ID NO: 5603998 - DNA, 18 bp, Homo sapiens
ctctggtggcttaagtga

SEQ ID NO: 5603999 - DNA, 21 bp, Homo sapiens
ctctggtggcttaagtgagca

SEQ ID NO: 5604000 - DNA, 18 bp, Homo sapiens
ctctggtggtcttccttc

SEQ ID NO: 5604001 - DNA, 13 bp, Homo sapiens
ctctggtggtgct

SEQ ID NO: 5604002 - DNA, 20 bp, Homo sapiens
ctctggtggtgcttttgtat

SEQ ID NO: 5604003 - DNA, 16 bp, Homo sapiens
ctctggtgtgtggtga

SEQ ID NO: 5604004 - DNA, 18 bp, Homo sapiens
ctctggtgtgtggtgagg

SEQ ID NO: 5604005 - DNA, 23 bp, Homo sapiens
ctctggtgtgtggtgaggggctt

SEQ ID NO: 5604006 - DNA, 22 bp, Homo sapiens
ctctggttatttttctcttgta

SEQ ID NO: 5604007 - DNA, 23 bp, Homo sapiens
ctctggttatttttctcttgtac

SEQ ID NO: 5604008 - DNA, 14 bp, Homo sapiens
ctctggttcctcca

SEQ ID NO: 5604009 - DNA, 21 bp, Homo sapiens
ctctggttcctttcatctctc

SEQ ID NO: 5604010 - DNA, 22 bp, Homo sapiens
ctctggttcctttcatctctct

SEQ ID NO: 5604011 - DNA, 16 bp, Homo sapiens
ctctggttcttcattt

SEQ ID NO: 5604012 - DNA, 20 bp, Homo sapiens
ctctggttgtttctgttcca

SEQ ID NO: 5604013 - DNA, 22 bp, Homo sapiens
ctctggttgtttctgttccaaa

SEQ ID NO: 5604014 - DNA, 16 bp, Homo sapiens
ctctggtttaattaca

SEQ ID NO: 5604015 - DNA, 14 bp, Homo sapiens
ctctggtttctcat

SEQ ID NO: 5604016 - DNA, 15 bp, Homo sapiens
ctctgtaaaagtgtc

SEQ ID NO: 5604017 - DNA, 14 bp, Homo sapiens
ctctgtaaaatgaa

SEQ ID NO: 5604018 - DNA, 15 bp, Homo sapiens
ctctgtaaaatgaac

SEQ ID NO: 5604019 - DNA, 21 bp, Homo sapiens
ctctgtaaagctaaaataaag

SEQ ID NO: 5604020 - DNA, 21 bp, Homo sapiens
ctctgtaacatcgcacagttt

SEQ ID NO: 5604021 - DNA, 15 bp, Homo sapiens
ctctgtaaccacctc

SEQ ID NO: 5604022 - DNA, 20 bp, Homo sapiens
ctctgtaacttacacctgga

SEQ ID NO: 5604023 - DNA, 20 bp, Homo sapiens
ctctgtaagaaactgccaaa

SEQ ID NO: 5604024 - DNA, 19 bp, Homo sapiens
ctctgtaagatatcccagc

SEQ ID NO: 5604025 - DNA, 23 bp, Homo sapiens
ctctgtaagtagatgcatttggg

SEQ ID NO: 5604026 - DNA, 18 bp, Homo sapiens
ctctgtaatctcgtttca

SEQ ID NO: 5604027 - DNA, 19 bp, Homo sapiens
ctctgtaattgaatattat

SEQ ID NO: 5604028 - DNA, 15 bp, Homo sapiens
ctctgtaattgcaaa

SEQ ID NO: 5604029 - DNA, 12 bp, Homo sapiens
ctctgtacagac

SEQ ID NO: 5604030 - DNA, 13 bp, Homo sapiens
ctctgtacagagc

SEQ ID NO: 5604031 - DNA, 14 bp, Homo sapiens
ctctgtacagagcc

SEQ ID NO: 5604032 - DNA, 16 bp, Homo sapiens
ctctgtacagagccca

SEQ ID NO: 5604033 - DNA, 22 bp, Homo sapiens
ctctgtacagcaagatgtttct

SEQ ID NO: 5604034 - DNA, 19 bp, Homo sapiens
ctctgtaccgcccggcagc

SEQ ID NO: 5604035 - DNA, 19 bp, Homo sapiens
ctctgtacgaggcttctct

SEQ ID NO: 5604036 - DNA, 13 bp, Homo sapiens
ctctgtagaatct

SEQ ID NO: 5604037 - DNA, 16 bp, Homo sapiens
ctctgtagcaaatttg

SEQ ID NO: 5604038 - DNA, 17 bp, Homo sapiens
ctctgtagcaaatttgt

SEQ ID NO: 5604039 - DNA, 13 bp, Homo sapiens
ctctgtagcctaa

SEQ ID NO: 5604040 - DNA, 17 bp, Homo sapiens
ctctgtagcctggtctg

SEQ ID NO: 5604041 - DNA, 18 bp, Homo sapiens
ctctgtagcctggtctgt

SEQ ID NO: 5604042 - DNA, 19 bp, Homo sapiens
ctctgtagctccctcctcc

SEQ ID NO: 5604043 - DNA, 22 bp, Homo sapiens
ctctgtagctccctcctcccat

SEQ ID NO: 5604044 - DNA, 20 bp, Homo sapiens
ctctgtagctgctagtgagc

SEQ ID NO: 5604045 - DNA, 16 bp, Homo sapiens
ctctgtaggatcgtaa

SEQ ID NO: 5604046 - DNA, 21 bp, Homo sapiens
ctctgtaggcacagagctgca

SEQ ID NO: 5604047 - DNA, 19 bp, Homo sapiens
ctctgtaggcagcagagag

SEQ ID NO: 5604048 - DNA, 18 bp, Homo sapiens
ctctgtagggaactctgg

SEQ ID NO: 5604049 - DNA, 21 bp, Homo sapiens
ctctgtagtctcagttcgtgt

SEQ ID NO: 5604050 - DNA, 14 bp, Homo sapiens
ctctgtagtggccc

SEQ ID NO: 5604051 - DNA, 20 bp, Homo sapiens
ctctgtagttcctaatggat

SEQ ID NO: 5604052 - DNA, 17 bp, Homo sapiens
ctctgtagtttatggca

SEQ ID NO: 5604053 - DNA, 18 bp, Homo sapiens
ctctgtagtttatggcag

SEQ ID NO: 5604054 - DNA, 15 bp, Homo sapiens
ctctgtatagaaatc

SEQ ID NO: 5604055 - DNA, 22 bp, Homo sapiens
ctctgtatgccattaaaaaaca

SEQ ID NO: 5604056 - DNA, 23 bp, Homo sapiens
ctctgtattctgcaacagcctgt

SEQ ID NO: 5604057 - DNA, 22 bp, Homo sapiens
ctctgtatttgaatcagcctac

SEQ ID NO: 5604058 - DNA, 15 bp, Homo sapiens
ctctgtattttttct

SEQ ID NO: 5604059 - DNA, 23 bp, Homo sapiens
ctctgtcaaatctagtttcctat

SEQ ID NO: 5604060 - DNA, 13 bp, Homo sapiens
ctctgtcacccag

SEQ ID NO: 5604061 - DNA, 17 bp, Homo sapiens
ctctgtcaccctggcca

SEQ ID NO: 5604062 - DNA, 18 bp, Homo sapiens
ctctgtcaccctggccac

SEQ ID NO: 5604063 - DNA, 19 bp, Homo sapiens
ctctgtcacccttgtcctt

SEQ ID NO: 5604064 - DNA, 15 bp, Homo sapiens
ctctgtcactccagg

SEQ ID NO: 5604065 - DNA, 20 bp, Homo sapiens
ctctgtcatcactccctgga

SEQ ID NO: 5604066 - DNA, 22 bp, Homo sapiens
ctctgtcatcactccctggatg

SEQ ID NO: 5604067 - DNA, 19 bp, Homo sapiens
ctctgtccaaacatttcat

SEQ ID NO: 5604068 - DNA, 17 bp, Homo sapiens
ctctgtccaattccaga

SEQ ID NO: 5604069 - DNA, 22 bp, Homo sapiens
ctctgtccaattccagagctgt

SEQ ID NO: 5604070 - DNA, 11 bp, Homo sapiens
ctctgtccaca

SEQ ID NO: 5604071 - DNA, 16 bp, Homo sapiens
ctctgtccactctgaa

SEQ ID NO: 5604072 - DNA, 21 bp, Homo sapiens
ctctgtccacttgtgggtcct

SEQ ID NO: 5604073 - DNA, 16 bp, Homo sapiens
ctctgtccagccagct

SEQ ID NO: 5604074 - DNA, 13 bp, Homo sapiens
ctctgtccaggcc

SEQ ID NO: 5604075 - DNA, 23 bp, Homo sapiens
ctctgtccaggccactgtggcca

SEQ ID NO: 5604076 - DNA, 14 bp, Homo sapiens
ctctgtccagggcc

SEQ ID NO: 5604077 - DNA, 22 bp, Homo sapiens
ctctgtccagggccctgagctc

SEQ ID NO: 5604078 - DNA, 16 bp, Homo sapiens
ctctgtccagggcttc

SEQ ID NO: 5604079 - DNA, 19 bp, Homo sapiens
ctctgtccagggcttcaga

SEQ ID NO: 5604080 - DNA, 15 bp, Homo sapiens
ctctgtcccacccct

SEQ ID NO: 5604081 - DNA, 17 bp, Homo sapiens
ctctgtcccattccctg

SEQ ID NO: 5604082 - DNA, 19 bp, Homo sapiens
ctctgtcccattccctggg

SEQ ID NO: 5604083 - DNA, 16 bp, Homo sapiens
ctctgtccccacgagg

SEQ ID NO: 5604084 - DNA, 17 bp, Homo sapiens
ctctgtccccacgaggg

SEQ ID NO: 5604085 - DNA, 23 bp, Homo sapiens
ctctgtccccacgaggggaccca

SEQ ID NO: 5604086 - DNA, 16 bp, Homo sapiens
ctctgtccccagcctg

SEQ ID NO: 5604087 - DNA, 13 bp, Homo sapiens
ctctgtccccagg

SEQ ID NO: 5604088 - DNA, 14 bp, Homo sapiens
ctctgtccccaggc

SEQ ID NO: 5604089 - DNA, 22 bp, Homo sapiens
ctctgtccccaggcctggctcc

SEQ ID NO: 5604090 - DNA, 12 bp, Homo sapiens
ctctgtccccat

SEQ ID NO: 5604091 - DNA, 15 bp, Homo sapiens
ctctgtccccgagcc

SEQ ID NO: 5604092 - DNA, 17 bp, Homo sapiens
ctctgtccccttctctc

SEQ ID NO: 5604093 - DNA, 21 bp, Homo sapiens
ctctgtcccggttcaccttgc

SEQ ID NO: 5604094 - DNA, 15 bp, Homo sapiens
ctctgtccctcactg

SEQ ID NO: 5604095 - DNA, 22 bp, Homo sapiens
ctctgtccctcactgccttcca

SEQ ID NO: 5604096 - DNA, 15 bp, Homo sapiens
ctctgtccctctcct

SEQ ID NO: 5604097 - DNA, 16 bp, Homo sapiens
ctctgtccctctcctt

SEQ ID NO: 5604098 - DNA, 14 bp, Homo sapiens
ctctgtccctgtcc

SEQ ID NO: 5604099 - DNA, 16 bp, Homo sapiens
ctctgtcccttgctgt

SEQ ID NO: 5604100 - DNA, 22 bp, Homo sapiens
ctctgtccgtgccccttccctg

SEQ ID NO: 5604101 - DNA, 14 bp, Homo sapiens
ctctgtcctcccat

SEQ ID NO: 5604102 - DNA, 19 bp, Homo sapiens
ctctgtcctctgtcagtca

SEQ ID NO: 5604103 - DNA, 17 bp, Homo sapiens
ctctgtcctcttggcca

SEQ ID NO: 5604104 - DNA, 18 bp, Homo sapiens
ctctgtcctggctgtgca

SEQ ID NO: 5604105 - DNA, 19 bp, Homo sapiens
ctctgtccttcccccagca

SEQ ID NO: 5604106 - DNA, 16 bp, Homo sapiens
ctctgtcgagcctggg

SEQ ID NO: 5604107 - DNA, 18 bp, Homo sapiens
ctctgtcgcccaggctgg

SEQ ID NO: 5604108 - DNA, 16 bp, Homo sapiens
ctctgtctaccatctc

SEQ ID NO: 5604109 - DNA, 16 bp, Homo sapiens
ctctgtctacctggtc

SEQ ID NO: 5604110 - DNA, 20 bp, Homo sapiens
ctctgtctacctggtctggt

SEQ ID NO: 5604111 - DNA, 15 bp, Homo sapiens
ctctgtctagcatgc

SEQ ID NO: 5604112 - DNA, 18 bp, Homo sapiens
ctctgtctataggactta

SEQ ID NO: 5604113 - DNA, 15 bp, Homo sapiens
ctctgtctcatccat

SEQ ID NO: 5604114 - DNA, 14 bp, Homo sapiens
ctctgtctcatcct

SEQ ID NO: 5604115 - DNA, 19 bp, Homo sapiens
ctctgtctcatcctcctgg

SEQ ID NO: 5604116 - DNA, 14 bp, Homo sapiens
ctctgtctcatgtg

SEQ ID NO: 5604117 - DNA, 16 bp, Homo sapiens
ctctgtctccaggcag

SEQ ID NO: 5604118 - DNA, 14 bp, Homo sapiens
ctctgtctcccagg

SEQ ID NO: 5604119 - DNA, 16 bp, Homo sapiens
ctctgtctcccaggct

SEQ ID NO: 5604120 - DNA, 17 bp, Homo sapiens
ctctgtctcccaggctg

SEQ ID NO: 5604121 - DNA, 18 bp, Homo sapiens
ctctgtctcccaggctgg

SEQ ID NO: 5604122 - DNA, 20 bp, Homo sapiens
ctctgtctcccaggctggag

SEQ ID NO: 5604123 - DNA, 12 bp, Homo sapiens
ctctgtctcctc

SEQ ID NO: 5604124 - DNA, 10 bp, Homo sapiens
ctctgtctct

SEQ ID NO: 5604125 - DNA, 15 bp, Homo sapiens
ctctgtctctcctag

SEQ ID NO: 5604126 - DNA, 18 bp, Homo sapiens
ctctgtctctcctagccc

SEQ ID NO: 5604127 - DNA, 12 bp, Homo sapiens
ctctgtctctgc

SEQ ID NO: 5604128 - DNA, 16 bp, Homo sapiens
ctctgtctgagacagg

SEQ ID NO: 5604129 - DNA, 13 bp, Homo sapiens
ctctgtctgccct

SEQ ID NO: 5604130 - DNA, 15 bp, Homo sapiens
ctctgtctgccctca

SEQ ID NO: 5604131 - DNA, 22 bp, Homo sapiens
ctctgtctgcccttcaccccag

SEQ ID NO: 5604132 - DNA, 20 bp, Homo sapiens
ctctgtctggcaatgccaca

SEQ ID NO: 5604133 - DNA, 13 bp, Homo sapiens
ctctgtctggcca

SEQ ID NO: 5604134 - DNA, 21 bp, Homo sapiens
ctctgtctggctgtacgtctg

SEQ ID NO: 5604135 - DNA, 14 bp, Homo sapiens
ctctgtctgtctct

SEQ ID NO: 5604136 - DNA, 21 bp, Homo sapiens
ctctgtcttaaagaatttgaa

SEQ ID NO: 5604137 - DNA, 17 bp, Homo sapiens
ctctgtcttcaaggact

SEQ ID NO: 5604138 - DNA, 18 bp, Homo sapiens
ctctgtcttcaggctctg

SEQ ID NO: 5604139 - DNA, 13 bp, Homo sapiens
ctctgtcttctct

SEQ ID NO: 5604140 - DNA, 21 bp, Homo sapiens
ctctgtcttctctatcctctc

SEQ ID NO: 5604141 - DNA, 14 bp, Homo sapiens
ctctgtcttctctc

SEQ ID NO: 5604142 - DNA, 16 bp, Homo sapiens
ctctgtcttctctcca

SEQ ID NO: 5604143 - DNA, 18 bp, Homo sapiens
ctctgtcttctctccact

SEQ ID NO: 5604144 - DNA, 17 bp, Homo sapiens
ctcttctttagaacagg

SEQ ID NO: 5604145 - DNA, 20 bp, Homo sapiens
ctcttctttcatctggggat

SEQ ID NO: 5604146 - DNA, 12 bp, Homo sapiens
ctcttctttggg

SEQ ID NO: 5604147 - DNA, 14 bp, Homo sapiens
ctcttctttgtgcc

SEQ ID NO: 5604148 - DNA, 16 bp, Homo sapiens
ctcttctttgtgcctt

SEQ ID NO: 5604149 - DNA, 23 bp, Homo sapiens
ctcttcttttaaaccattttctt

SEQ ID NO: 5604150 - DNA, 16 bp, Homo sapiens
ctcttcttttggcttc

SEQ ID NO: 5604151 - DNA, 19 bp, Homo sapiens
ctcttcttttggcttccat

SEQ ID NO: 5604152 - DNA, 22 bp, Homo sapiens
ctcttgaaaaatgcccatttgc

SEQ ID NO: 5604153 - DNA, 13 bp, Homo sapiens
ctcttgaaaagtt

SEQ ID NO: 5604154 - DNA, 12 bp, Homo sapiens
ctcttgaaacct

SEQ ID NO: 5604155 - DNA, 20 bp, Homo sapiens
ctcttgaaatattcagaaat

SEQ ID NO: 5604156 - DNA, 16 bp, Homo sapiens
ctcttgaactgagctt

SEQ ID NO: 5604157 - DNA, 19 bp, Homo sapiens
ctcttgaactgagcttgga

SEQ ID NO: 5604158 - DNA, 12 bp, Homo sapiens
ctcttgaagagg

SEQ ID NO: 5604159 - DNA, 20 bp, Homo sapiens
ctcttgaaggtgctgccacc

SEQ ID NO: 5604160 - DNA, 18 bp, Homo sapiens
ctcttgaagtcacaccag

SEQ ID NO: 5604161 - DNA, 15 bp, Homo sapiens
ctcttgaagtccagg

SEQ ID NO: 5604162 - DNA, 18 bp, Homo sapiens
ctcttgaagtccaggact

SEQ ID NO: 5604163 - DNA, 15 bp, Homo sapiens
ctcttgaatatgtgc

SEQ ID NO: 5604164 - DNA, 13 bp, Homo sapiens
ctcttgaattcct

SEQ ID NO: 5604165 - DNA, 20 bp, Homo sapiens
ctcttgacatcaagggagga

SEQ ID NO: 5604166 - DNA, 22 bp, Homo sapiens
ctcttgacattcaaaacagtta

SEQ ID NO: 5604167 - DNA, 19 bp, Homo sapiens
ctcttgaccaggctgcctc

SEQ ID NO: 5604168 - DNA, 22 bp, Homo sapiens
ctcttgaccctgtcacttgctg

SEQ ID NO: 5604169 - DNA, 13 bp, Homo sapiens
ctcttgacctcag

SEQ ID NO: 5604170 - DNA, 15 bp, Homo sapiens
ctcttgacctcaggt

SEQ ID NO: 5604171 - DNA, 16 bp, Homo sapiens
ctcttgacctcaggtg

SEQ ID NO: 5604172 - DNA, 16 bp, Homo sapiens
ctcttgagaggggtga

SEQ ID NO: 5604173 - DNA, 19 bp, Homo sapiens
ctcttgagataaggtttta

SEQ ID NO: 5604174 - DNA, 18 bp, Homo sapiens
ctcttgagcagtggctgg

SEQ ID NO: 5604175 - DNA, 22 bp, Homo sapiens
ctcttgagcagtggctggtcca

SEQ ID NO: 5604176 - DNA, 21 bp, Homo sapiens
ctcttgagcatcaatcttgtt

SEQ ID NO: 5604177 - DNA, 22 bp, Homo sapiens
ctcttgagcatcaatcttgtta

SEQ ID NO: 5604178 - DNA, 20 bp, Homo sapiens
ctcttgagccctcctggaat

SEQ ID NO: 5604179 - DNA, 13 bp, Homo sapiens
ctcttgagcctgg

SEQ ID NO: 5604180 - DNA, 13 bp, Homo sapiens
ctcttgagctggc

SEQ ID NO: 5604181 - DNA, 22 bp, Homo sapiens
ctcttgagctggcctctctagc

SEQ ID NO: 5604182 - DNA, 18 bp, Homo sapiens
ctcttgaggaagcccagg

SEQ ID NO: 5604183 - DNA, 16 bp, Homo sapiens
ctcttgaggcctgtgc

SEQ ID NO: 5604184 - DNA, 14 bp, Homo sapiens
ctcttgagggagct

SEQ ID NO: 5604185 - DNA, 23 bp, Homo sapiens
ctcttgagggtcattttcctttc

SEQ ID NO: 5604186 - DNA, 16 bp, Homo sapiens
ctcttgagttcctctg

SEQ ID NO: 5604187 - DNA, 16 bp, Homo sapiens
ctcttgagttgttttt

SEQ ID NO: 5604188 - DNA, 20 bp, Homo sapiens
ctcttgagttgtttttgtat

SEQ ID NO: 5604189 - DNA, 22 bp, Homo sapiens
ctcttgagttgtttttgtatat

SEQ ID NO: 5604190 - DNA, 23 bp, Homo sapiens
ctcttgagttgtttttgtatatt

SEQ ID NO: 5604191 - DNA, 18 bp, Homo sapiens
ctcttgatacccccctct

SEQ ID NO: 5604192 - DNA, 23 bp, Homo sapiens
ctcttgatctctcttgtcctctt

SEQ ID NO: 5604193 - DNA, 20 bp, Homo sapiens
ctcttgatggtggactaagc

SEQ ID NO: 5604194 - DNA, 14 bp, Homo sapiens
ctcttgatgtgaag

SEQ ID NO: 5604195 - DNA, 23 bp, Homo sapiens
ctcttgatgtgaagataatttgc

SEQ ID NO: 5604196 - DNA, 16 bp, Homo sapiens
ctcttgattaagggct

SEQ ID NO: 5604197 - DNA, 14 bp, Homo sapiens
ctcttgattcctgg

SEQ ID NO: 5604198 - DNA, 21 bp, Homo sapiens
ctcttgattgatttttaaagt

SEQ ID NO: 5604199 - DNA, 21 bp, Homo sapiens
ctcttgatttcacatttctac

SEQ ID NO: 5604200 - DNA, 13 bp, Homo sapiens
ctcttgattttca

SEQ ID NO: 5604201 - DNA, 23 bp, Homo sapiens
ctcttgcaatccacaatctgaca

SEQ ID NO: 5604202 - DNA, 20 bp, Homo sapiens
ctcttgcacagtcactgctc

SEQ ID NO: 5604203 - DNA, 21 bp, Homo sapiens
ctcttgcacagtcactgctct

SEQ ID NO: 5604204 - DNA, 12 bp, Homo sapiens
ctcttgcacccg

SEQ ID NO: 5604205 - DNA, 13 bp, Homo sapiens
ctcttgcagggtc

SEQ ID NO: 5604206 - DNA, 14 bp, Homo sapiens
ctcttgcaggtctc

SEQ ID NO: 5604207 - DNA, 18 bp, Homo sapiens
ctcttgcaggtctcaacc

SEQ ID NO: 5604208 - DNA, 19 bp, Homo sapiens
ctcttgcataagcctcagg

SEQ ID NO: 5604209 - DNA, 19 bp, Homo sapiens
ctcttgccacatcttgaaa

SEQ ID NO: 5604210 - DNA, 17 bp, Homo sapiens
ctcttgccactgcctct

SEQ ID NO: 5604211 - DNA, 12 bp, Homo sapiens
ctcttgccagcc

SEQ ID NO: 5604212 - DNA, 13 bp, Homo sapiens
ctcttgccagcct

SEQ ID NO: 5604213 - DNA, 15 bp, Homo sapiens
ctcttgccagcctcc

SEQ ID NO: 5604214 - DNA, 17 bp, Homo sapiens
ctcttgccagcctcctt

SEQ ID NO: 5604215 - DNA, 13 bp, Homo sapiens
ctcttgccatcct

SEQ ID NO: 5604216 - DNA, 16 bp, Homo sapiens
ctcttgccatcctgat

SEQ ID NO: 5604217 - DNA, 13 bp, Homo sapiens
ctcttgcccagca

SEQ ID NO: 5604218 - DNA, 14 bp, Homo sapiens
ctcttgcccatcct

SEQ ID NO: 5604219 - DNA, 16 bp, Homo sapiens
ctcttgcccatcctga

SEQ ID NO: 5604220 - DNA, 20 bp, Homo sapiens
ctcttgcccatcctgactga

SEQ ID NO: 5604221 - DNA, 14 bp, Homo sapiens
ctcttgccccaacc

SEQ ID NO: 5604222 - DNA, 23 bp, Homo sapiens
ctcttgccccaacccccagcacc

SEQ ID NO: 5604223 - DNA, 20 bp, Homo sapiens
ctcttgccccactccctggc

SEQ ID NO: 5604224 - DNA, 20 bp, Homo sapiens
ctcttgccccccaccccagc

SEQ ID NO: 5604225 - DNA, 22 bp, Homo sapiens
ctcttgccccccaccccagcct

SEQ ID NO: 5604226 - DNA, 17 bp, Homo sapiens
ctcttgcccgcacccct

SEQ ID NO: 5604227 - DNA, 22 bp, Homo sapiens
ctcttgcccgcacccctccctg

SEQ ID NO: 5604228 - DNA, 23 bp, Homo sapiens
ctcttgcccgtcggccctgcgtc

SEQ ID NO: 5604229 - DNA, 17 bp, Homo sapiens
ctcttgcccttccctgt

SEQ ID NO: 5604230 - DNA, 19 bp, Homo sapiens
ctcttgcccttccctgtcc

SEQ ID NO: 5604231 - DNA, 14 bp, Homo sapiens
ctcttgcctcctgg

SEQ ID NO: 5604232 - DNA, 14 bp, Homo sapiens
ctcttgcctgcacc

SEQ ID NO: 5604233 - DNA, 15 bp, Homo sapiens
ctcttgcctgcaccc

SEQ ID NO: 5604234 - DNA, 23 bp, Homo sapiens
ctcttgcctgcacccttcctcct

SEQ ID NO: 5604235 - DNA, 12 bp, Homo sapiens
ctcttgcctgcc

SEQ ID NO: 5604236 - DNA, 22 bp, Homo sapiens
ctcttgcctgccactgtgtgaa

SEQ ID NO: 5604237 - DNA, 15 bp, Homo sapiens
ctcttgcctttctta

SEQ ID NO: 5604238 - DNA, 21 bp, Homo sapiens
ctcttgcctttcttatttgca

SEQ ID NO: 5604239 - DNA, 16 bp, Homo sapiens
ctcttgctattgaatt

SEQ ID NO: 5604240 - DNA, 20 bp, Homo sapiens
ctcttgctcaaaaatctgtt

SEQ ID NO: 5604241 - DNA, 11 bp, Homo sapiens
ctcttgctcac

SEQ ID NO: 5604242 - DNA, 12 bp, Homo sapiens
ctcttgctcact

SEQ ID NO: 5604243 - DNA, 14 bp, Homo sapiens
ctcttgctcactcc

SEQ ID NO: 5604244 - DNA, 15 bp, Homo sapiens
ctcttgctcactccc

SEQ ID NO: 5604245 - DNA, 16 bp, Homo sapiens
ctcttgctcactccct

SEQ ID NO: 5604246 - DNA, 18 bp, Homo sapiens
ctcttgctcactccctaa

SEQ ID NO: 5604247 - DNA, 17 bp, Homo sapiens
ctcttgctcctgcttct

SEQ ID NO: 5604248 - DNA, 16 bp, Homo sapiens
ctcttgctctcttgtg

SEQ ID NO: 5604249 - DNA, 12 bp, Homo sapiens
ctcttgctcttt

SEQ ID NO: 5604250 - DNA, 15 bp, Homo sapiens
ctcttgctctttcta

SEQ ID NO: 5604251 - DNA, 15 bp, Homo sapiens
ctcttgctgtctctg

SEQ ID NO: 5604252 - DNA, 18 bp, Homo sapiens
ctcttgctgtctctgctc

SEQ ID NO: 5604253 - DNA, 21 bp, Homo sapiens
ctcttgctgtttaccgcccac

SEQ ID NO: 5604254 - DNA, 21 bp, Homo sapiens
ctcttgctttaaagagtcctc

SEQ ID NO: 5604255 - DNA, 14 bp, Homo sapiens
ctcttgctttctat

SEQ ID NO: 5604256 - DNA, 18 bp, Homo sapiens
ctcttggaaatgttaaga

SEQ ID NO: 5604257 - DNA, 15 bp, Homo sapiens
ctcttggaactgcac

SEQ ID NO: 5604258 - DNA, 17 bp, Homo sapiens
ctcttggaccctgggag

SEQ ID NO: 5604259 - DNA, 17 bp, Homo sapiens
ctcttggacctctgctc

SEQ ID NO: 5604260 - DNA, 18 bp, Homo sapiens
ctcttggacctctgctct

SEQ ID NO: 5604261 - DNA, 17 bp, Homo sapiens
ctcttggactccctccc

SEQ ID NO: 5604262 - DNA, 21 bp, Homo sapiens
ctcttggactccctccccacc

SEQ ID NO: 5604263 - DNA, 22 bp, Homo sapiens
ctcttggactccctccccaccc

SEQ ID NO: 5604264 - DNA, 12 bp, Homo sapiens
ctcttggacttg

SEQ ID NO: 5604265 - DNA, 19 bp, Homo sapiens
ctcttggagaagtctcagc

SEQ ID NO: 5604266 - DNA, 18 bp, Homo sapiens
ctcttggagaccttaccc

SEQ ID NO: 5604267 - DNA, 19 bp, Homo sapiens
ctcttggaggtgtctgtat

SEQ ID NO: 5604268 - DNA, 19 bp, Homo sapiens
ctcttggataccagctcag

SEQ ID NO: 5604269 - DNA, 20 bp, Homo sapiens
ctcttggataccagctcagg

SEQ ID NO: 5604270 - DNA, 22 bp, Homo sapiens
ctcttggataccagctcagggg

SEQ ID NO: 5604271 - DNA, 23 bp, Homo sapiens
ctcttggcaagatgtttcttata

SEQ ID NO: 5604272 - DNA, 18 bp, Homo sapiens
ctcttggcacctgcctag

SEQ ID NO: 5604273 - DNA, 20 bp, Homo sapiens
ctcttggcacctgcctagct

SEQ ID NO: 5604274 - DNA, 22 bp, Homo sapiens
ctcttggcacctgcctagctct

SEQ ID NO: 5604275 - DNA, 14 bp, Homo sapiens
ctcttggccatcct

SEQ ID NO: 5604276 - DNA, 11 bp, Homo sapiens
ctcttggcctc

SEQ ID NO: 5604277 - DNA, 12 bp, Homo sapiens
ctcttggcctct

SEQ ID NO: 5604278 - DNA, 14 bp, Homo sapiens
ctcttggcctttgc

SEQ ID NO: 5604279 - DNA, 17 bp, Homo sapiens
ctcttggctattgaaga

SEQ ID NO: 5604280 - DNA, 22 bp, Homo sapiens
ctcttggctatttctgtgtcca

SEQ ID NO: 5604281 - DNA, 14 bp, Homo sapiens
ctcttggctccact

SEQ ID NO: 5604282 - DNA, 16 bp, Homo sapiens
ctcttggctgacccct

SEQ ID NO: 5604283 - DNA, 12 bp, Homo sapiens
ctcttggctgga

SEQ ID NO: 5604284 - DNA, 15 bp, Homo sapiens
ctcttggctggcttc

SEQ ID NO: 5604285 - DNA, 15 bp, Homo sapiens
ctcttggcttccaga

SEQ ID NO: 5604286 - DNA, 19 bp, Homo sapiens
ctcttggcttccagaaggc

SEQ ID NO: 5604287 - DNA, 18 bp, Homo sapiens
ctcttggcttctcagccc

SEQ ID NO: 5604288 - DNA, 21 bp, Homo sapiens
ctcttggcttctcagcccctt

SEQ ID NO: 5604289 - DNA, 22 bp, Homo sapiens
ctcttggcttctcagccccttt

SEQ ID NO: 5604290 - DNA, 21 bp, Homo sapiens
ctcttgggaactgaactcact

SEQ ID NO: 5604291 - DNA, 22 bp, Homo sapiens
ctcttgggaagcagtttcagat

SEQ ID NO: 5604292 - DNA, 22 bp, Homo sapiens
ctcttgggagtcaggacctccg

SEQ ID NO: 5604293 - DNA, 15 bp, Homo sapiens
ctcttgggcaatatt

SEQ ID NO: 5604294 - DNA, 16 bp, Homo sapiens
ctcttgggcaatattc

SEQ ID NO: 5604295 - DNA, 20 bp, Homo sapiens
ctcttgggcaatattctctg

SEQ ID NO: 5604296 - DNA, 20 bp, Homo sapiens
ctcttgggcatgctcagccc

SEQ ID NO: 5604297 - DNA, 22 bp, Homo sapiens
ctcttgggcatgctcagccctt

SEQ ID NO: 5604298 - DNA, 17 bp, Homo sapiens
ctcttgggcctgacctc

SEQ ID NO: 5604299 - DNA, 22 bp, Homo sapiens
ctcttgggcctgacctccagtc

SEQ ID NO: 5604300 - DNA, 15 bp, Homo sapiens
ctcttgggctgagac

SEQ ID NO: 5604301 - DNA, 21 bp, Homo sapiens
ctcttggggaaggatctcccc

SEQ ID NO: 5604302 - DNA, 22 bp, Homo sapiens
ctcttggggaaggatctccccg

SEQ ID NO: 5604303 - DNA, 20 bp, Homo sapiens
ctcttggggaaggggcacct

SEQ ID NO: 5604304 - DNA, 20 bp, Homo sapiens
ctcttgggggccggggggaa

SEQ ID NO: 5604305 - DNA, 20 bp, Homo sapiens
ctcttgggtatgtagaactg

SEQ ID NO: 5604306 - DNA, 12 bp, Homo sapiens
ctcttgggtggg

SEQ ID NO: 5604307 - DNA, 13 bp, Homo sapiens
ctcttgggtggga

SEQ ID NO: 5604308 - DNA, 18 bp, Homo sapiens
ctcttgggtgggacaggg

SEQ ID NO: 5604309 - DNA, 22 bp, Homo sapiens
ctcttgggtgggacagggcttc

SEQ ID NO: 5604310 - DNA, 15 bp, Homo sapiens
ctcttggtacctgtg

SEQ ID NO: 5604311 - DNA, 16 bp, Homo sapiens
ctcttggtcacctcaa

SEQ ID NO: 5604312 - DNA, 15 bp, Homo sapiens
ctcttggtcccatgg

SEQ ID NO: 5604313 - DNA, 13 bp, Homo sapiens
ctcttggtccctg

SEQ ID NO: 5604314 - DNA, 18 bp, Homo sapiens
ctcttggtccctggaagc

SEQ ID NO: 5604315 - DNA, 16 bp, Homo sapiens
ctcttggtccctggtc

SEQ ID NO: 5604316 - DNA, 13 bp, Homo sapiens
ctcttggtctctt

SEQ ID NO: 5604317 - DNA, 23 bp, Homo sapiens
ctcttggtctctttctttccaaa

SEQ ID NO: 5604318 - DNA, 22 bp, Homo sapiens
ctcttggtgtgattgcacagaa

SEQ ID NO: 5604319 - DNA, 17 bp, Homo sapiens
ctcttggtgttaaaaca

SEQ ID NO: 5604320 - DNA, 20 bp, Homo sapiens
ctcttggttcgatacctgga

SEQ ID NO: 5604321 - DNA, 16 bp, Homo sapiens
ctgaacaagaattgga

SEQ ID NO: 5604322 - DNA, 15 bp, Homo sapiens
ctgaacaatctccaa

SEQ ID NO: 5604323 - DNA, 15 bp, Homo sapiens
ctgaacaattacctg

SEQ ID NO: 5604324 - DNA, 13 bp, Homo sapiens
ctgaacacacaca

SEQ ID NO: 5604325 - DNA, 14 bp, Homo sapiens
ctgaacacacacac

SEQ ID NO: 5604326 - DNA, 22 bp, Homo sapiens
ctgaacacacaccagtttacag

SEQ ID NO: 5604327 - DNA, 16 bp, Homo sapiens
ctgaacacacacgcca

SEQ ID NO: 5604328 - DNA, 19 bp, Homo sapiens
ctgaacacacacgccagct

SEQ ID NO: 5604329 - DNA, 15 bp, Homo sapiens
ctgaacacaggcagc

SEQ ID NO: 5604330 - DNA, 19 bp, Homo sapiens
ctgaacacaggcagctttc

SEQ ID NO: 5604331 - DNA, 22 bp, Homo sapiens
ctgaacacaggcagctttctag

SEQ ID NO: 5604332 - DNA, 22 bp, Homo sapiens
ctgaacacagtgtctgttcagc

SEQ ID NO: 5604333 - DNA, 17 bp, Homo sapiens
ctgaacacatactagaa

SEQ ID NO: 5604334 - DNA, 14 bp, Homo sapiens
ctgaacacatttct

SEQ ID NO: 5604335 - DNA, 17 bp, Homo sapiens
ctgaacacatttctttt

SEQ ID NO: 5604336 - DNA, 22 bp, Homo sapiens
ctgaacacatttctttttaaaa

SEQ ID NO: 5604337 - DNA, 16 bp, Homo sapiens
ctgaacacttattgct

SEQ ID NO: 5604338 - DNA, 20 bp, Homo sapiens
ctgaacacttattgctttga

SEQ ID NO: 5604339 - DNA, 19 bp, Homo sapiens
ctgaacacttttgttgtaa

SEQ ID NO: 5604340 - DNA, 22 bp, Homo sapiens
ctgaacagaccggggtggagtc

SEQ ID NO: 5604341 - DNA, 17 bp, Homo sapiens
ctgaacagatgtaaatc

SEQ ID NO: 5604342 - DNA, 22 bp, Homo sapiens
ctgaacagcagaaacccatgtg

SEQ ID NO: 5604343 - DNA, 22 bp, Homo sapiens
ctgaacagcagtaatcctgggg

SEQ ID NO: 5604344 - DNA, 12 bp, Homo sapiens
ctgaacagctgg

SEQ ID NO: 5604345 - DNA, 13 bp, Homo sapiens
ctgaacagctggg

SEQ ID NO: 5604346 - DNA, 20 bp, Homo sapiens
ctgaacaggaaagagctagg

SEQ ID NO: 5604347 - DNA, 19 bp, Homo sapiens
ctgaacaggccgcacatct

SEQ ID NO: 5604348 - DNA, 14 bp, Homo sapiens
ctgaacaggctggg

SEQ ID NO: 5604349 - DNA, 16 bp, Homo sapiens
ctgaacatagttttca

SEQ ID NO: 5604350 - DNA, 18 bp, Homo sapiens
ctgaacatagttttcacc

SEQ ID NO: 5604351 - DNA, 19 bp, Homo sapiens
ctgaacatctgagtcctgg

SEQ ID NO: 5604352 - DNA, 23 bp, Homo sapiens
ctgaacatctgagtcctggatga

SEQ ID NO: 5604353 - DNA, 15 bp, Homo sapiens
ctgaacatctgtgtg

SEQ ID NO: 5604354 - DNA, 19 bp, Homo sapiens
ctgaacatctgtgtgtgtc

SEQ ID NO: 5604355 - DNA, 17 bp, Homo sapiens
ctgaacatgacatttct

SEQ ID NO: 5604356 - DNA, 22 bp, Homo sapiens
ctgaacatgagtgtcaactcca

SEQ ID NO: 5604357 - DNA, 12 bp, Homo sapiens
ctgaacatgcct

SEQ ID NO: 5604358 - DNA, 18 bp, Homo sapiens
ctgaacattagttgcact

SEQ ID NO: 5604359 - DNA, 14 bp, Homo sapiens
ctgaacattgcata

SEQ ID NO: 5604360 - DNA, 12 bp, Homo sapiens
ctgaacattgga

SEQ ID NO: 5604361 - DNA, 15 bp, Homo sapiens
ctgaacatttttaaa

SEQ ID NO: 5604362 - DNA, 12 bp, Homo sapiens
ctgaaccaaatt

SEQ ID NO: 5604363 - DNA, 20 bp, Homo sapiens
ctgaaccaaattgcactgaa

SEQ ID NO: 5604364 - DNA, 13 bp, Homo sapiens
ctgaaccacagaa

SEQ ID NO: 5604365 - DNA, 19 bp, Homo sapiens
ctgaaccacctttgtctct

SEQ ID NO: 5604366 - DNA, 17 bp, Homo sapiens
ctgaaccacgaggctgc

SEQ ID NO: 5604367 - DNA, 20 bp, Homo sapiens
ctgaaccactgcttctcttt

SEQ ID NO: 5604368 - DNA, 12 bp, Homo sapiens
ctgaaccactgt

SEQ ID NO: 5604369 - DNA, 15 bp, Homo sapiens
ctgaaccactgtggc

SEQ ID NO: 5604370 - DNA, 16 bp, Homo sapiens
ctgaaccactgtggcc

SEQ ID NO: 5604371 - DNA, 17 bp, Homo sapiens
ctgaaccacttgtagat

SEQ ID NO: 5604372 - DNA, 13 bp, Homo sapiens
ctgaaccagccac

SEQ ID NO: 5604373 - DNA, 13 bp, Homo sapiens
ctgaaccaggcca

SEQ ID NO: 5604374 - DNA, 14 bp, Homo sapiens
ctgaaccaggccag

SEQ ID NO: 5604375 - DNA, 17 bp, Homo sapiens
ctgaaccagtcctgctg

SEQ ID NO: 5604376 - DNA, 21 bp, Homo sapiens
ctgaaccagtcctgctgcctg

SEQ ID NO: 5604377 - DNA, 22 bp, Homo sapiens
ctgaaccagtcctgctgcctgg

SEQ ID NO: 5604378 - DNA, 12 bp, Homo sapiens
ctgaaccattac

SEQ ID NO: 5604379 - DNA, 15 bp, Homo sapiens
ctgaaccattactgt

SEQ ID NO: 5604380 - DNA, 15 bp, Homo sapiens
ctgaacccacacctg

SEQ ID NO: 5604381 - DNA, 18 bp, Homo sapiens
ctgaacccacacctgggc

SEQ ID NO: 5604382 - DNA, 17 bp, Homo sapiens
ctgaacccagctgtgcc

SEQ ID NO: 5604383 - DNA, 16 bp, Homo sapiens
ctgaacccaggcagct

SEQ ID NO: 5604384 - DNA, 17 bp, Homo sapiens
ctgaaccccagaggcag

SEQ ID NO: 5604385 - DNA, 18 bp, Homo sapiens
ctgaaccccagaggcaga

SEQ ID NO: 5604386 - DNA, 19 bp, Homo sapiens
ctgaaccccagaggcagag

SEQ ID NO: 5604387 - DNA, 15 bp, Homo sapiens
ctgaaccccagggct

SEQ ID NO: 5604388 - DNA, 16 bp, Homo sapiens
ctgaaccccatgggct

SEQ ID NO: 5604389 - DNA, 17 bp, Homo sapiens
ctgaaccccatgggctt

SEQ ID NO: 5604390 - DNA, 19 bp, Homo sapiens
ctgaaccccatgggcttgg

SEQ ID NO: 5604391 - DNA, 18 bp, Homo sapiens
ctgaaccccccccccccg

SEQ ID NO: 5604392 - DNA, 16 bp, Homo sapiens
ctgaaccccctccaga

SEQ ID NO: 5604393 - DNA, 12 bp, Homo sapiens
ctgaacccctgg

SEQ ID NO: 5604394 - DNA, 15 bp, Homo sapiens
ctgaacccctggcca

SEQ ID NO: 5604395 - DNA, 16 bp, Homo sapiens
ctgaacccctggccag

SEQ ID NO: 5604396 - DNA, 15 bp, Homo sapiens
ctgaaccctccaaag

SEQ ID NO: 5604397 - DNA, 15 bp, Homo sapiens
ctgaaccctgtgctg

SEQ ID NO: 5604398 - DNA, 20 bp, Homo sapiens
ctgaaccgcacagctcagga

SEQ ID NO: 5604399 - DNA, 21 bp, Homo sapiens
ctgaaccgcacagctcaggag

SEQ ID NO: 5604400 - DNA, 19 bp, Homo sapiens
ctgaaccgctacaagaggg

SEQ ID NO: 5604401 - DNA, 17 bp, Homo sapiens
ctgaaccggctttacca

SEQ ID NO: 5604402 - DNA, 20 bp, Homo sapiens
ctgaaccggctttaccaaac

SEQ ID NO: 5604403 - DNA, 15 bp, Homo sapiens
ctgaaccgtgtgctc

SEQ ID NO: 5604404 - DNA, 16 bp, Homo sapiens
ctgaaccgtgtgctcc

SEQ ID NO: 5604405 - DNA, 14 bp, Homo sapiens
ctgaacctcagttt

SEQ ID NO: 5604406 - DNA, 14 bp, Homo sapiens
ctgaacctgatgct

SEQ ID NO: 5604407 - DNA, 20 bp, Homo sapiens
ctgaacctgggaaagagatt

SEQ ID NO: 5604408 - DNA, 20 bp, Homo sapiens
ctgaacctgtctcctcccag

SEQ ID NO: 5604409 - DNA, 13 bp, Homo sapiens
ctgaacctgtctt

SEQ ID NO: 5604410 - DNA, 23 bp, Homo sapiens
ctgaaccttaggctttgtatgac

SEQ ID NO: 5604411 - DNA, 14 bp, Homo sapiens
ctgaaccttccatc

SEQ ID NO: 5604412 - DNA, 16 bp, Homo sapiens
ctgaaccttccatctc

SEQ ID NO: 5604413 - DNA, 20 bp, Homo sapiens
ctgaaccttgttgatgccag

SEQ ID NO: 5604414 - DNA, 17 bp, Homo sapiens
ctgaacctttcaaaatg

SEQ ID NO: 5604415 - DNA, 14 bp, Homo sapiens
ctgaacgagggata

SEQ ID NO: 5604416 - DNA, 19 bp, Homo sapiens
ctgaacgatccttcaaagt

SEQ ID NO: 5604417 - DNA, 14 bp, Homo sapiens
ctgaacgcagaaga

SEQ ID NO: 5604418 - DNA, 18 bp, Homo sapiens
ctgaacgccctggtaagg

SEQ ID NO: 5604419 - DNA, 17 bp, Homo sapiens
ctgaacggggagaaaag

SEQ ID NO: 5604420 - DNA, 18 bp, Homo sapiens
ctgaacgtttggttcaaa

SEQ ID NO: 5604421 - DNA, 16 bp, Homo sapiens
ctgaacgttttcttct

SEQ ID NO: 5604422 - DNA, 21 bp, Homo sapiens
ctgaacgttttcttctttccc

SEQ ID NO: 5604423 - DNA, 23 bp, Homo sapiens
ctgaacgttttcttctttccctg

SEQ ID NO: 5604424 - DNA, 19 bp, Homo sapiens
ctgaactaaaataaaaatg

SEQ ID NO: 5604425 - DNA, 20 bp, Homo sapiens
ctgaactatcagggcaagct

SEQ ID NO: 5604426 - DNA, 16 bp, Homo sapiens
ctgaactattttaaat

SEQ ID NO: 5604427 - DNA, 20 bp, Homo sapiens
ctgaactattttaaataaaa

SEQ ID NO: 5604428 - DNA, 15 bp, Homo sapiens
ctgaactcaaactga

SEQ ID NO: 5604429 - DNA, 18 bp, Homo sapiens
ctgaactcaagctgcgtt

SEQ ID NO: 5604430 - DNA, 13 bp, Homo sapiens
ctgaactcacaga

SEQ ID NO: 5604431 - DNA, 16 bp, Homo sapiens
ctgaactcacagactg

SEQ ID NO: 5604432 - DNA, 21 bp, Homo sapiens
ctgaactcacagactgctgtc

SEQ ID NO: 5604433 - DNA, 13 bp, Homo sapiens
ctgaactcacttt

SEQ ID NO: 5604434 - DNA, 21 bp, Homo sapiens
ctgaactccatacagcctcta

SEQ ID NO: 5604435 - DNA, 21 bp, Homo sapiens
ctgaactcctgccatagtctt

SEQ ID NO: 5604436 - DNA, 14 bp, Homo sapiens
ctgaactcctggct

SEQ ID NO: 5604437 - DNA, 13 bp, Homo sapiens
ctgaactctccag

SEQ ID NO: 5604438 - DNA, 19 bp, Homo sapiens
ctgaactgaaaggactgtg

SEQ ID NO: 5604439 - DNA, 16 bp, Homo sapiens
ctgaactgagaaggca

SEQ ID NO: 5604440 - DNA, 17 bp, Homo sapiens
ctgaactgagaaggcag

SEQ ID NO: 5604441 - DNA, 12 bp, Homo sapiens
ctgaactgagcc

SEQ ID NO: 5604442 - DNA, 15 bp, Homo sapiens
ctgaactgagcccca

SEQ ID NO: 5604443 - DNA, 23 bp, Homo sapiens
ctgaactgaggagatgaccaggg

SEQ ID NO: 5604444 - DNA, 16 bp, Homo sapiens
ctgaactgcaacactg

SEQ ID NO: 5604445 - DNA, 23 bp, Homo sapiens
ctgaactgcttttaaaagtgcac

SEQ ID NO: 5604446 - DNA, 15 bp, Homo sapiens
ctgaactggccccag

SEQ ID NO: 5604447 - DNA, 19 bp, Homo sapiens
ctgaactggccccagctcc

SEQ ID NO: 5604448 - DNA, 15 bp, Homo sapiens
ctgaactgtgtgtaa

SEQ ID NO: 5604449 - DNA, 13 bp, Homo sapiens
ctgaacttcagct

SEQ ID NO: 5604450 - DNA, 16 bp, Homo sapiens
ctgaacttgaagctaa

SEQ ID NO: 5604451 - DNA, 17 bp, Homo sapiens
ctgaacttgaagctaac

SEQ ID NO: 5604452 - DNA, 21 bp, Homo sapiens
ctgaacttggcgctgcccctg

SEQ ID NO: 5604453 - DNA, 13 bp, Homo sapiens
ctgaactttcatt

SEQ ID NO: 5604454 - DNA, 14 bp, Homo sapiens
ctgaactttctccc

SEQ ID NO: 5604455 - DNA, 16 bp, Homo sapiens
ctgaactttctccctc

SEQ ID NO: 5604456 - DNA, 17 bp, Homo sapiens
ctgaactttctccctca

SEQ ID NO: 5604457 - DNA, 13 bp, Homo sapiens
ctgaactttgctg

SEQ ID NO: 5604458 - DNA, 14 bp, Homo sapiens
ctgaactttggaga

SEQ ID NO: 5604459 - DNA, 12 bp, Homo sapiens
ctgaactttgtt

SEQ ID NO: 5604460 - DNA, 18 bp, Homo sapiens
ctgaacttttgtggagtt

SEQ ID NO: 5604461 - DNA, 21 bp, Homo sapiens
ctgaagaaaaaatcagaacta

SEQ ID NO: 5604462 - DNA, 15 bp, Homo sapiens
ctgaagaaaatgaag

SEQ ID NO: 5604463 - DNA, 16 bp, Homo sapiens
ctgaagaaacacagca

SEQ ID NO: 5604464 - DNA, 11 bp, Homo sapiens
ctgaagaacag

SEQ ID NO: 5604465 - DNA, 22 bp, Homo sapiens
ctgaagaaccagtccccccacc

SEQ ID NO: 5604466 - DNA, 20 bp, Homo sapiens
ctgaagaagaccagtcacag

SEQ ID NO: 5604467 - DNA, 23 bp, Homo sapiens
ctgaagaagaccagtcacagcca

SEQ ID NO: 5604468 - DNA, 22 bp, Homo sapiens
ctgaagaagcacttctgctgca

SEQ ID NO: 5604469 - DNA, 19 bp, Homo sapiens
ctgaagaaggaaggcctga

SEQ ID NO: 5604470 - DNA, 21 bp, Homo sapiens
ctgaagaaggaaggcctgagc

SEQ ID NO: 5604471 - DNA, 17 bp, Homo sapiens
ctgaagaagttaattct

SEQ ID NO: 5604472 - DNA, 23 bp, Homo sapiens
ctgaagaatctcgactctcgtga

SEQ ID NO: 5604473 - DNA, 12 bp, Homo sapiens
ctgaagaatgaa

SEQ ID NO: 5604474 - DNA, 13 bp, Homo sapiens
ctgaagaattgaa

SEQ ID NO: 5604475 - DNA, 19 bp, Homo sapiens
ctgaagaattgaaaaacca

SEQ ID NO: 5604476 - DNA, 23 bp, Homo sapiens
ctgaagacaccgttcattcaggc

SEQ ID NO: 5604477 - DNA, 21 bp, Homo sapiens
ctgaagacatgtttcaagaac

SEQ ID NO: 5604478 - DNA, 23 bp, Homo sapiens
ctgaagaccccagatgtgagggc

SEQ ID NO: 5604479 - DNA, 18 bp, Homo sapiens
ctgaagactctgcagccc

SEQ ID NO: 5604480 - DNA, 20 bp, Homo sapiens
ctgaagactctgcagccctc

SEQ ID NO: 5604481 - DNA, 17 bp, Homo sapiens
ctgaagactgagaactt

SEQ ID NO: 5604482 - DNA, 21 bp, Homo sapiens
ctgaagactgagaactttttt

SEQ ID NO: 5604483 - DNA, 15 bp, Homo sapiens
ctgaagactgaggac

SEQ ID NO: 5604484 - DNA, 14 bp, Homo sapiens
ctgaagacttgccc

SEQ ID NO: 5604485 - DNA, 22 bp, Homo sapiens
ctgaagagacagttatttatag

SEQ ID NO: 5604486 - DNA, 20 bp, Homo sapiens
ctgaagagaccactcaatcc

SEQ ID NO: 5604487 - DNA, 20 bp, Homo sapiens
ctgaagagagggacaggcac

SEQ ID NO: 5604488 - DNA, 19 bp, Homo sapiens
ctgaagagcgctcctctgc

SEQ ID NO: 5604489 - DNA, 20 bp, Homo sapiens
ctgaagagctattatataaa

SEQ ID NO: 5604490 - DNA, 22 bp, Homo sapiens
ctgaagagctcttggcccggca

SEQ ID NO: 5604491 - DNA, 15 bp, Homo sapiens
ctgaagaggcgggcc

SEQ ID NO: 5604492 - DNA, 16 bp, Homo sapiens
ctgaagaggcgggcca

SEQ ID NO: 5604493 - DNA, 20 bp, Homo sapiens
ctgaagaggcgggccagcca

SEQ ID NO: 5604494 - DNA, 21 bp, Homo sapiens
ctgaagaggcgggccagccag

SEQ ID NO: 5604495 - DNA, 18 bp, Homo sapiens
ctgaagaggcttctcctg

SEQ ID NO: 5604496 - DNA, 21 bp, Homo sapiens
ctgaagagtttgtaaatgact

SEQ ID NO: 5604497 - DNA, 22 bp, Homo sapiens
ctgaagatagaagaaaaaagaa

SEQ ID NO: 5604498 - DNA, 16 bp, Homo sapiens
ctgaagatcaatttct

SEQ ID NO: 5604499 - DNA, 15 bp, Homo sapiens
ctgaattattttgtt

SEQ ID NO: 5604500 - DNA, 16 bp, Homo sapiens
ctgaattcaaagcttg

SEQ ID NO: 5604501 - DNA, 22 bp, Homo sapiens
ctgaattcaaagcttgtgaaaa

SEQ ID NO: 5604502 - DNA, 14 bp, Homo sapiens
ctgaattcactcca

SEQ ID NO: 5604503 - DNA, 22 bp, Homo sapiens
ctgaattcacttaagtttttcc

SEQ ID NO: 5604504 - DNA, 16 bp, Homo sapiens
ctgaattcattgtctc

SEQ ID NO: 5604505 - DNA, 20 bp, Homo sapiens
ctgaattcctttacaactaa

SEQ ID NO: 5604506 - DNA, 19 bp, Homo sapiens
ctgaattcgagacaggcag

SEQ ID NO: 5604507 - DNA, 17 bp, Homo sapiens
ctgaattctatttgctg

SEQ ID NO: 5604508 - DNA, 21 bp, Homo sapiens
ctgaattctgctctaaataaa

SEQ ID NO: 5604509 - DNA, 15 bp, Homo sapiens
ctgaattgaaagaga

SEQ ID NO: 5604510 - DNA, 23 bp, Homo sapiens
ctgaattgaaagagaatttggag

SEQ ID NO: 5604511 - DNA, 15 bp, Homo sapiens
ctgaattgctttctg

SEQ ID NO: 5604512 - DNA, 20 bp, Homo sapiens
ctgaattgctttctgctctt

SEQ ID NO: 5604513 - DNA, 19 bp, Homo sapiens
ctgaattggctaaaagaca

SEQ ID NO: 5604514 - DNA, 17 bp, Homo sapiens
ctgaattgtcagatgtg

SEQ ID NO: 5604515 - DNA, 15 bp, Homo sapiens
ctgaattgtccccag

SEQ ID NO: 5604516 - DNA, 16 bp, Homo sapiens
ctgaattgtgttttca

SEQ ID NO: 5604517 - DNA, 16 bp, Homo sapiens
ctgaattgttatgtaa

SEQ ID NO: 5604518 - DNA, 14 bp, Homo sapiens
ctgaatttaaatag

SEQ ID NO: 5604519 - DNA, 12 bp, Homo sapiens
ctgaatttaact

SEQ ID NO: 5604520 - DNA, 15 bp, Homo sapiens
ctgaatttattgccg

SEQ ID NO: 5604521 - DNA, 15 bp, Homo sapiens
ctgaatttcaggcat

SEQ ID NO: 5604522 - DNA, 22 bp, Homo sapiens
ctgaatttcaggcattttgttc

SEQ ID NO: 5604523 - DNA, 20 bp, Homo sapiens
ctgaatttccccatctgcca

SEQ ID NO: 5604524 - DNA, 23 bp, Homo sapiens
ctgaatttctatggcatattgat

SEQ ID NO: 5604525 - DNA, 14 bp, Homo sapiens
ctgaatttctttga

SEQ ID NO: 5604526 - DNA, 15 bp, Homo sapiens
ctgaatttctttgat

SEQ ID NO: 5604527 - DNA, 14 bp, Homo sapiens
ctgaatttgataaa

SEQ ID NO: 5604528 - DNA, 13 bp, Homo sapiens
ctgaatttgcaaa

SEQ ID NO: 5604529 - DNA, 19 bp, Homo sapiens
ctgaatttgcaaagtactg

SEQ ID NO: 5604530 - DNA, 20 bp, Homo sapiens
ctgaatttgcaaagtactgt

SEQ ID NO: 5604531 - DNA, 16 bp, Homo sapiens
ctgaatttgccctggg

SEQ ID NO: 5604532 - DNA, 18 bp, Homo sapiens
ctgaatttgccctgggaa

SEQ ID NO: 5604533 - DNA, 19 bp, Homo sapiens
ctgaatttgccctgggaaa

SEQ ID NO: 5604534 - DNA, 22 bp, Homo sapiens
ctgaatttggggctacttatat

SEQ ID NO: 5604535 - DNA, 13 bp, Homo sapiens
ctgaattttcaca

SEQ ID NO: 5604536 - DNA, 14 bp, Homo sapiens
ctgaattttcacat

SEQ ID NO: 5604537 - DNA, 12 bp, Homo sapiens
ctgaattttctg

SEQ ID NO: 5604538 - DNA, 14 bp, Homo sapiens
ctgaattttctgga

SEQ ID NO: 5604539 - DNA, 20 bp, Homo sapiens
ctgaattttgcaatgtattt

SEQ ID NO: 5604540 - DNA, 24 bp, Homo sapiens
ctgaattttgcaatgtatttagct

SEQ ID NO: 5604541 - DNA, 15 bp, Homo sapiens
ctgaattttgggact

SEQ ID NO: 5604542 - DNA, 20 bp, Homo sapiens
ctgaattttggggattttca

SEQ ID NO: 5604543 - DNA, 18 bp, Homo sapiens
ctgaatttttaaacaagt

SEQ ID NO: 5604544 - DNA, 21 bp, Homo sapiens
ctgaatttttaaacaagtatt

SEQ ID NO: 5604545 - DNA, 22 bp, Homo sapiens
ctgaatttttaaacaagtattt

SEQ ID NO: 5604546 - DNA, 18 bp, Homo sapiens
ctgaatttttatgtgtga

SEQ ID NO: 5604547 - DNA, 16 bp, Homo sapiens
ctgaatttttttgtaa

SEQ ID NO: 5604548 - DNA, 20 bp, Homo sapiens
ctgaatttttttgtaataag

SEQ ID NO: 5604549 - DNA, 15 bp, Homo sapiens
ctgaattttttttaa

SEQ ID NO: 5604550 - DNA, 17 bp, Homo sapiens
ctgacaaacgtccccag

SEQ ID NO: 5604551 - DNA, 18 bp, Homo sapiens
ctgacaaaggagccttga

SEQ ID NO: 5604552 - DNA, 19 bp, Homo sapiens
ctgacaaaggagccttgat

SEQ ID NO: 5604553 - DNA, 21 bp, Homo sapiens
ctgacaaaggtggtaaattca

SEQ ID NO: 5604554 - DNA, 22 bp, Homo sapiens
ctgacaaaggtggtaaattcag

SEQ ID NO: 5604555 - DNA, 20 bp, Homo sapiens
ctgacaaagtcatcccctct

SEQ ID NO: 5604556 - DNA, 23 bp, Homo sapiens
ctgacaaagtcatcccctctcag

SEQ ID NO: 5604557 - DNA, 13 bp, Homo sapiens
ctgacaaagtggg

SEQ ID NO: 5604558 - DNA, 15 bp, Homo sapiens
ctgacaaatatttta

SEQ ID NO: 5604559 - DNA, 23 bp, Homo sapiens
ctgacaaatcaagtttccaagca

SEQ ID NO: 5604560 - DNA, 22 bp, Homo sapiens
ctgacaacactcattgacctga

SEQ ID NO: 5604561 - DNA, 23 bp, Homo sapiens
ctgacaacactcattgacctgag

SEQ ID NO: 5604562 - DNA, 16 bp, Homo sapiens
ctgacaacagcctgag

SEQ ID NO: 5604563 - DNA, 18 bp, Homo sapiens
ctgacaacagcctgagaa

SEQ ID NO: 5604564 - DNA, 18 bp, Homo sapiens
ctgacaaccattaaagtc

SEQ ID NO: 5604565 - DNA, 19 bp, Homo sapiens
ctgacaaccattaaagtca

SEQ ID NO: 5604566 - DNA, 13 bp, Homo sapiens
ctgacaacttctg

SEQ ID NO: 5604567 - DNA, 20 bp, Homo sapiens
ctgacaagatggaaaataaa

SEQ ID NO: 5604568 - DNA, 14 bp, Homo sapiens
ctgacaagccatct

SEQ ID NO: 5604569 - DNA, 23 bp, Homo sapiens
ctgacaaggcacttcatgtaaag

SEQ ID NO: 5604570 - DNA, 12 bp, Homo sapiens
ctgacaaggcca

SEQ ID NO: 5604571 - DNA, 14 bp, Homo sapiens
ctgacaaggccagc

SEQ ID NO: 5604572 - DNA, 13 bp, Homo sapiens
ctgacaagggctg

SEQ ID NO: 5604573 - DNA, 19 bp, Homo sapiens
ctgacaagggctgacctgc

SEQ ID NO: 5604574 - DNA, 22 bp, Homo sapiens
ctgacaagggctgacctgcctc

SEQ ID NO: 5604575 - DNA, 17 bp, Homo sapiens
ctgacaatactgtatgt

SEQ ID NO: 5604576 - DNA, 21 bp, Homo sapiens
ctgacaatcaactctaatagt

SEQ ID NO: 5604577 - DNA, 21 bp, Homo sapiens
ctgacaatccttgagaatctt

SEQ ID NO: 5604578 - DNA, 21 bp, Homo sapiens
ctgacaatgctgccatgccca

SEQ ID NO: 5604579 - DNA, 16 bp, Homo sapiens
ctgacaatggcagcta

SEQ ID NO: 5604580 - DNA, 17 bp, Homo sapiens
ctgacaatggcagctag

SEQ ID NO: 5604581 - DNA, 23 bp, Homo sapiens
ctgacaatggcagctagactgga

SEQ ID NO: 5604582 - DNA, 14 bp, Homo sapiens
ctgacaatgtattt

SEQ ID NO: 5604583 - DNA, 16 bp, Homo sapiens
ctgacaattatgaaaa

SEQ ID NO: 5604584 - DNA, 14 bp, Homo sapiens
ctgacaattgcaaa

SEQ ID NO: 5604585 - DNA, 15 bp, Homo sapiens
ctgacaattgcaaat

SEQ ID NO: 5604586 - DNA, 18 bp, Homo sapiens
ctgacacaaaaagtagat

SEQ ID NO: 5604587 - DNA, 14 bp, Homo sapiens
ctgacacaaacctg

SEQ ID NO: 5604588 - DNA, 20 bp, Homo sapiens
ctgacacaaacctgcctggg

SEQ ID NO: 5604589 - DNA, 23 bp, Homo sapiens
ctgacacaatggtagctctgaag

SEQ ID NO: 5604590 - DNA, 18 bp, Homo sapiens
ctgacacacagctctgtc

SEQ ID NO: 5604591 - DNA, 19 bp, Homo sapiens
ctgacacacagctctgtcc

SEQ ID NO: 5604592 - DNA, 23 bp, Homo sapiens
ctgacacacctgcagcctccctc

SEQ ID NO: 5604593 - DNA, 13 bp, Homo sapiens
ctgacacactaac

SEQ ID NO: 5604594 - DNA, 20 bp, Homo sapiens
ctgacacactaaccaagctg

SEQ ID NO: 5604595 - DNA, 23 bp, Homo sapiens
ctgacacactaaccaagctgagt

SEQ ID NO: 5604596 - DNA, 21 bp, Homo sapiens
ctgacacagaggctggcactg

SEQ ID NO: 5604597 - DNA, 22 bp, Homo sapiens
ctgacacagaggctggcactga

SEQ ID NO: 5604598 - DNA, 13 bp, Homo sapiens
ctgacacaggaaa

SEQ ID NO: 5604599 - DNA, 21 bp, Homo sapiens
ctgacacaggaaaccaacacc

SEQ ID NO: 5604600 - DNA, 14 bp, Homo sapiens
ctgacacaggccag

SEQ ID NO: 5604601 - DNA, 18 bp, Homo sapiens
ctgacacaggggacactg

SEQ ID NO: 5604602 - DNA, 22 bp, Homo sapiens
ctgacacagtgctcgaccttga

SEQ ID NO: 5604603 - DNA, 14 bp, Homo sapiens
ctgacacatcagca

SEQ ID NO: 5604604 - DNA, 19 bp, Homo sapiens
ctgacacatcagcatgttt

SEQ ID NO: 5604605 - DNA, 18 bp, Homo sapiens
ctgacacattgctgatat

SEQ ID NO: 5604606 - DNA, 14 bp, Homo sapiens
ctgacaccacgctg

SEQ ID NO: 5604607 - DNA, 14 bp, Homo sapiens
ctgacacccatgtt

SEQ ID NO: 5604608 - DNA, 17 bp, Homo sapiens
ctgacaccctggtcctg

SEQ ID NO: 5604609 - DNA, 13 bp, Homo sapiens
ctgacacccttta

SEQ ID NO: 5604610 - DNA, 17 bp, Homo sapiens
ctgacaccgtccctcag

SEQ ID NO: 5604611 - DNA, 18 bp, Homo sapiens
ctgacaccgtccctcagt

SEQ ID NO: 5604612 - DNA, 17 bp, Homo sapiens
ctgacacctaccatgct

SEQ ID NO: 5604613 - DNA, 21 bp, Homo sapiens
ctgacacctaccatgctgctt

SEQ ID NO: 5604614 - DNA, 12 bp, Homo sapiens
ctgacacctcac

SEQ ID NO: 5604615 - DNA, 19 bp, Homo sapiens
ctgacacctcactgaggaa

SEQ ID NO: 5604616 - DNA, 15 bp, Homo sapiens
ctgacacctccaagt

SEQ ID NO: 5604617 - DNA, 13 bp, Homo sapiens
ctgacacctgccg

SEQ ID NO: 5604618 - DNA, 14 bp, Homo sapiens
ctgacacctttaaa

SEQ ID NO: 5604619 - DNA, 19 bp, Homo sapiens
ctgacacgcaagtgtgtga

SEQ ID NO: 5604620 - DNA, 16 bp, Homo sapiens
ctgacacgcagcctgc

SEQ ID NO: 5604621 - DNA, 19 bp, Homo sapiens
ctgacacgcagcctgctct

SEQ ID NO: 5604622 - DNA, 20 bp, Homo sapiens
ctgacacgcagcctgctctg

SEQ ID NO: 5604623 - DNA, 21 bp, Homo sapiens
ctgacacggggatcatctctg

SEQ ID NO: 5604624 - DNA, 17 bp, Homo sapiens
ctgacacgtccacccca

SEQ ID NO: 5604625 - DNA, 21 bp, Homo sapiens
ctgacacgtgatggaccaaag

SEQ ID NO: 5604626 - DNA, 18 bp, Homo sapiens
ctgacactaaccagagtc

SEQ ID NO: 5604627 - DNA, 15 bp, Homo sapiens
ctgacactcccaccc

SEQ ID NO: 5604628 - DNA, 19 bp, Homo sapiens
ctgacactcccacccagtc

SEQ ID NO: 5604629 - DNA, 17 bp, Homo sapiens
ctgacactcccttgggc

SEQ ID NO: 5604630 - DNA, 18 bp, Homo sapiens
ctgacactgacatttcac

SEQ ID NO: 5604631 - DNA, 16 bp, Homo sapiens
ctgacactgagcccca

SEQ ID NO: 5604632 - DNA, 17 bp, Homo sapiens
ctgacactgagccccac

SEQ ID NO: 5604633 - DNA, 23 bp, Homo sapiens
ctgacactgcggggcttggctga

SEQ ID NO: 5604634 - DNA, 15 bp, Homo sapiens
ctgacactgctggag

SEQ ID NO: 5604635 - DNA, 13 bp, Homo sapiens
ctgacactgtgac

SEQ ID NO: 5604636 - DNA, 14 bp, Homo sapiens
ctgacactgtgacc

SEQ ID NO: 5604637 - DNA, 19 bp, Homo sapiens
ctgacactgtgaccctggg

SEQ ID NO: 5604638 - DNA, 16 bp, Homo sapiens
ctgacacttcaaggtg

SEQ ID NO: 5604639 - DNA, 13 bp, Homo sapiens
ctgacacttcctg

SEQ ID NO: 5604640 - DNA, 17 bp, Homo sapiens
ctgacacttcctgtcct

SEQ ID NO: 5604641 - DNA, 13 bp, Homo sapiens
ctgacagaaacca

SEQ ID NO: 5604642 - DNA, 17 bp, Homo sapiens
ctgacagaagttatttc

SEQ ID NO: 5604643 - DNA, 14 bp, Homo sapiens
ctgacagacacagg

SEQ ID NO: 5604644 - DNA, 21 bp, Homo sapiens
ctgacagacacaggcccggct

SEQ ID NO: 5604645 - DNA, 23 bp, Homo sapiens
ctgacagagcaagcgaaagagca

SEQ ID NO: 5604646 - DNA, 17 bp, Homo sapiens
ctgacagagcaggtctg

SEQ ID NO: 5604647 - DNA, 23 bp, Homo sapiens
ctgacagagcaggtctgcaggcc

SEQ ID NO: 5604648 - DNA, 15 bp, Homo sapiens
ctgacagagccagag

SEQ ID NO: 5604649 - DNA, 17 bp, Homo sapiens
ctgacagagccagaggc

SEQ ID NO: 5604650 - DNA, 18 bp, Homo sapiens
ctgacagagccagaggca

SEQ ID NO: 5604651 - DNA, 14 bp, Homo sapiens
ctgacagagcccta

SEQ ID NO: 5604652 - DNA, 22 bp, Homo sapiens
ctgacagagccctatctatgtc

SEQ ID NO: 5604653 - DNA, 12 bp, Homo sapiens
ctgacagaggag

SEQ ID NO: 5604654 - DNA, 13 bp, Homo sapiens
ctgacagatacat

SEQ ID NO: 5604655 - DNA, 20 bp, Homo sapiens
ctgacagatgaccgcaataa

SEQ ID NO: 5604656 - DNA, 16 bp, Homo sapiens
ctgacagatgcctggt

SEQ ID NO: 5604657 - DNA, 22 bp, Homo sapiens
ctgacagatgcctggtgagcag

SEQ ID NO: 5604658 - DNA, 18 bp, Homo sapiens
ctgacagatgcttttgct

SEQ ID NO: 5604659 - DNA, 15 bp, Homo sapiens
ctgacagcaaacaca

SEQ ID NO: 5604660 - DNA, 16 bp, Homo sapiens
ctgacagcaaacacag

SEQ ID NO: 5604661 - DNA, 19 bp, Homo sapiens
ctgacagcaaacacagtca

SEQ ID NO: 5604662 - DNA, 11 bp, Homo sapiens
ctgacagcagc

SEQ ID NO: 5604663 - DNA, 17 bp, Homo sapiens
ctgacagcagcatctct

SEQ ID NO: 5604664 - DNA, 14 bp, Homo sapiens
ctgacagcagcctg

SEQ ID NO: 5604665 - DNA, 20 bp, Homo sapiens
ctgacagcagcctgtgaggg

SEQ ID NO: 5604666 - DNA, 21 bp, Homo sapiens
ctgacagcaggccactagtga

SEQ ID NO: 5604667 - DNA, 16 bp, Homo sapiens
ctgacagccagaactc

SEQ ID NO: 5604668 - DNA, 16 bp, Homo sapiens
ctgacagcccaacttc

SEQ ID NO: 5604669 - DNA, 20 bp, Homo sapiens
ctgacagccctgcggagacc

SEQ ID NO: 5604670 - DNA, 13 bp, Homo sapiens
ctgacagcctcct

SEQ ID NO: 5604671 - DNA, 21 bp, Homo sapiens
ctgacagcctcctaggctccc

SEQ ID NO: 5604672 - DNA, 18 bp, Homo sapiens
ctgacagccttccccagc

SEQ ID NO: 5604673 - DNA, 19 bp, Homo sapiens
ctgacagccttccccagct

SEQ ID NO: 5604674 - DNA, 21 bp, Homo sapiens
ctgacagccttccccagctcc

SEQ ID NO: 5604675 - DNA, 19 bp, Homo sapiens
ctgacagcgccatgtgtgt

SEQ ID NO: 5604676 - DNA, 22 bp, Homo sapiens
ctgagaagaggagccctcatct

SEQ ID NO: 5604677 - DNA, 15 bp, Homo sapiens
ctgagaagaggagga

SEQ ID NO: 5604678 - DNA, 16 bp, Homo sapiens
ctgagaagaggaggag

SEQ ID NO: 5604679 - DNA, 17 bp, Homo sapiens
ctgagaagatggcactg

SEQ ID NO: 5604680 - DNA, 18 bp, Homo sapiens
ctgagaagatggcactgt

SEQ ID NO: 5604681 - DNA, 15 bp, Homo sapiens
ctgagaagccaagcc

SEQ ID NO: 5604682 - DNA, 21 bp, Homo sapiens
ctgagaagccaagcctggagt

SEQ ID NO: 5604683 - DNA, 18 bp, Homo sapiens
ctgagaagccccgacaca

SEQ ID NO: 5604684 - DNA, 20 bp, Homo sapiens
ctgagaagccccgacacacg

SEQ ID NO: 5604685 - DNA, 19 bp, Homo sapiens
ctgagaagcctcatgggag

SEQ ID NO: 5604686 - DNA, 14 bp, Homo sapiens
ctgagaagcgctgc

SEQ ID NO: 5604687 - DNA, 17 bp, Homo sapiens
ctgagaagcgctgccct

SEQ ID NO: 5604688 - DNA, 16 bp, Homo sapiens
ctgagaagctctgaag

SEQ ID NO: 5604689 - DNA, 19 bp, Homo sapiens
ctgagaaggccagccctcc

SEQ ID NO: 5604690 - DNA, 22 bp, Homo sapiens
ctgagaaggccagccctccctg

SEQ ID NO: 5604691 - DNA, 17 bp, Homo sapiens
ctgagaaggccctgtgc

SEQ ID NO: 5604692 - DNA, 17 bp, Homo sapiens
ctgagaaggcgaggaga

SEQ ID NO: 5604693 - DNA, 20 bp, Homo sapiens
ctgagaaggctaaagaagac

SEQ ID NO: 5604694 - DNA, 16 bp, Homo sapiens
ctgagaaggggaggac

SEQ ID NO: 5604695 - DNA, 21 bp, Homo sapiens
ctgagaaggggaggacctctg

SEQ ID NO: 5604696 - DNA, 23 bp, Homo sapiens
ctgagaaggtttggtccagcctg

SEQ ID NO: 5604697 - DNA, 16 bp, Homo sapiens
ctgagaagtactttac

SEQ ID NO: 5604698 - DNA, 17 bp, Homo sapiens
ctgagaagtgtatatag

SEQ ID NO: 5604699 - DNA, 22 bp, Homo sapiens
ctgagaatcacggtggtaaaga

SEQ ID NO: 5604700 - DNA, 21 bp, Homo sapiens
ctgagaatccccgtgctcaca

SEQ ID NO: 5604701 - DNA, 21 bp, Homo sapiens
ctgagaatctaggccacccca

SEQ ID NO: 5604702 - DNA, 16 bp, Homo sapiens
ctgagaatgcctaggc

SEQ ID NO: 5604703 - DNA, 19 bp, Homo sapiens
ctgagaatgtaagaactac

SEQ ID NO: 5604704 - DNA, 12 bp, Homo sapiens
ctgagaatgtgc

SEQ ID NO: 5604705 - DNA, 19 bp, Homo sapiens
ctgagaatgttaccagact

SEQ ID NO: 5604706 - DNA, 20 bp, Homo sapiens
ctgagaatgttaccagactt

SEQ ID NO: 5604707 - DNA, 23 bp, Homo sapiens
ctgagaatgttaccagacttcaa

SEQ ID NO: 5604708 - DNA, 16 bp, Homo sapiens
ctgagaattccaagga

SEQ ID NO: 5604709 - DNA, 22 bp, Homo sapiens
ctgagaatttaaaaataagaaa

SEQ ID NO: 5604710 - DNA, 14 bp, Homo sapiens
ctgagaatttgtgt

SEQ ID NO: 5604711 - DNA, 16 bp, Homo sapiens
ctgagacaaaaaggaa

SEQ ID NO: 5604712 - DNA, 23 bp, Homo sapiens
ctgagacaaatcctaggctcctg

SEQ ID NO: 5604713 - DNA, 13 bp, Homo sapiens
ctgagacagatgg

SEQ ID NO: 5604714 - DNA, 22 bp, Homo sapiens
ctgagacagcaccactgctgag

SEQ ID NO: 5604715 - DNA, 19 bp, Homo sapiens
ctgagacagcccgggctct

SEQ ID NO: 5604716 - DNA, 22 bp, Homo sapiens
ctgagacaggcagtttcagaga

SEQ ID NO: 5604717 - DNA, 11 bp, Homo sapiens
ctgagacaggt

SEQ ID NO: 5604718 - DNA, 15 bp, Homo sapiens
ctgagacaggtgcct

SEQ ID NO: 5604719 - DNA, 17 bp, Homo sapiens
ctgagacatccctcatc

SEQ ID NO: 5604720 - DNA, 18 bp, Homo sapiens
ctgagacatccctcatct

SEQ ID NO: 5604721 - DNA, 20 bp, Homo sapiens
ctgagacatccctgattctc

SEQ ID NO: 5604722 - DNA, 12 bp, Homo sapiens
ctgagaccacag

SEQ ID NO: 5604723 - DNA, 16 bp, Homo sapiens
ctgagaccacagaggc

SEQ ID NO: 5604724 - DNA, 13 bp, Homo sapiens
ctgagaccactga

SEQ ID NO: 5604725 - DNA, 15 bp, Homo sapiens
ctgagaccagcctgg

SEQ ID NO: 5604726 - DNA, 12 bp, Homo sapiens
ctgagaccaggg

SEQ ID NO: 5604727 - DNA, 14 bp, Homo sapiens
ctgagaccagggtg

SEQ ID NO: 5604728 - DNA, 18 bp, Homo sapiens
ctgagaccagggtggcca

SEQ ID NO: 5604729 - DNA, 14 bp, Homo sapiens
ctgagaccagtgta

SEQ ID NO: 5604730 - DNA, 14 bp, Homo sapiens
ctgagaccagttgg

SEQ ID NO: 5604731 - DNA, 19 bp, Homo sapiens
ctgagaccagttgggagca

SEQ ID NO: 5604732 - DNA, 16 bp, Homo sapiens
ctgagaccatttaaca

SEQ ID NO: 5604733 - DNA, 17 bp, Homo sapiens
ctgagacccttatttaa

SEQ ID NO: 5604734 - DNA, 19 bp, Homo sapiens
ctgagacctctagagaaaa

SEQ ID NO: 5604735 - DNA, 20 bp, Homo sapiens
ctgagacctgacaagcactg

SEQ ID NO: 5604736 - DNA, 20 bp, Homo sapiens
ctgagacctgggatttgaga

SEQ ID NO: 5604737 - DNA, 23 bp, Homo sapiens
ctgagaccttgctttgagactcc

SEQ ID NO: 5604738 - DNA, 17 bp, Homo sapiens
ctgagacgcaaggatca

SEQ ID NO: 5604739 - DNA, 22 bp, Homo sapiens
ctgagacgccacggagggctgg

SEQ ID NO: 5604740 - DNA, 16 bp, Homo sapiens
ctgagacggatggaag

SEQ ID NO: 5604741 - DNA, 23 bp, Homo sapiens
ctgagacggcagagaccccagga

SEQ ID NO: 5604742 - DNA, 18 bp, Homo sapiens
ctgagacgtcatgaggag

SEQ ID NO: 5604743 - DNA, 18 bp, Homo sapiens
ctgagactaatcttattc

SEQ ID NO: 5604744 - DNA, 20 bp, Homo sapiens
ctgagactagattctcacct

SEQ ID NO: 5604745 - DNA, 21 bp, Homo sapiens
ctgagactagattctcacctg

SEQ ID NO: 5604746 - DNA, 16 bp, Homo sapiens
ctgagactccagacct

SEQ ID NO: 5604747 - DNA, 12 bp, Homo sapiens
ctgagactcccg

SEQ ID NO: 5604748 - DNA, 19 bp, Homo sapiens
ctgagactcccgcctttga

SEQ ID NO: 5604749 - DNA, 20 bp, Homo sapiens
ctgagactcgcgacaatgca

SEQ ID NO: 5604750 - DNA, 21 bp, Homo sapiens
ctgagactcgcgacaatgcaa

SEQ ID NO: 5604751 - DNA, 24 bp, Homo sapiens
ctgagactgcgccacggcactcca

SEQ ID NO: 5604752 - DNA, 20 bp, Homo sapiens
ctgagactgtcggagaggct

SEQ ID NO: 5604753 - DNA, 12 bp, Homo sapiens
ctgagactgtgc

SEQ ID NO: 5604754 - DNA, 15 bp, Homo sapiens
ctgagactgtgctgt

SEQ ID NO: 5604755 - DNA, 15 bp, Homo sapiens
ctgagacttgttctt

SEQ ID NO: 5604756 - DNA, 17 bp, Homo sapiens
ctgagacttgttcttgg

SEQ ID NO: 5604757 - DNA, 23 bp, Homo sapiens
ctgagacttgttcttggttcctg

SEQ ID NO: 5604758 - DNA, 21 bp, Homo sapiens
ctgagactttcagtgcactgt

SEQ ID NO: 5604759 - DNA, 19 bp, Homo sapiens
ctgagactttctttctgta

SEQ ID NO: 5604760 - DNA, 20 bp, Homo sapiens
ctgagagaaggtgaaataaa

SEQ ID NO: 5604761 - DNA, 19 bp, Homo sapiens
ctgagagaagttgggaggg

SEQ ID NO: 5604762 - DNA, 20 bp, Homo sapiens
ctgagagaattggctcaata

SEQ ID NO: 5604763 - DNA, 17 bp, Homo sapiens
ctgagagaccctggcct

SEQ ID NO: 5604764 - DNA, 19 bp, Homo sapiens
ctgagagaccctggcctca

SEQ ID NO: 5604765 - DNA, 21 bp, Homo sapiens
ctgagagaccctggcctcaag

SEQ ID NO: 5604766 - DNA, 16 bp, Homo sapiens
ctgagagagcgcagcc

SEQ ID NO: 5604767 - DNA, 21 bp, Homo sapiens
ctgagagaggccattctttcc

SEQ ID NO: 5604768 - DNA, 18 bp, Homo sapiens
ctgagagagtataaataa

SEQ ID NO: 5604769 - DNA, 24 bp, Homo sapiens
ctgagagagtggcattggcagcag

SEQ ID NO: 5604770 - DNA, 13 bp, Homo sapiens
ctgagagatctgc

SEQ ID NO: 5604771 - DNA, 16 bp, Homo sapiens
ctgagagatctgctgt

SEQ ID NO: 5604772 - DNA, 17 bp, Homo sapiens
ctgagagatggaaggcg

SEQ ID NO: 5604773 - DNA, 11 bp, Homo sapiens
ctgagagcaaa

SEQ ID NO: 5604774 - DNA, 16 bp, Homo sapiens
ctgagagcaaagggaa

SEQ ID NO: 5604775 - DNA, 17 bp, Homo sapiens
ctgagagcacagcgttt

SEQ ID NO: 5604776 - DNA, 22 bp, Homo sapiens
ctgagagcagatggtcctccat

SEQ ID NO: 5604777 - DNA, 19 bp, Homo sapiens
ctgagagcatctcaggagg

SEQ ID NO: 5604778 - DNA, 12 bp, Homo sapiens
ctgagagccaga

SEQ ID NO: 5604779 - DNA, 20 bp, Homo sapiens
ctgagagccagatgcctccc

SEQ ID NO: 5604780 - DNA, 16 bp, Homo sapiens
ctgagagccccagctg

SEQ ID NO: 5604781 - DNA, 19 bp, Homo sapiens
ctgagagccccaggactgg

SEQ ID NO: 5604782 - DNA, 19 bp, Homo sapiens
ctgagagccctgctgtggg

SEQ ID NO: 5604783 - DNA, 20 bp, Homo sapiens
ctgagagccctgctgtggga

SEQ ID NO: 5604784 - DNA, 15 bp, Homo sapiens
ctgagagcctgtgga

SEQ ID NO: 5604785 - DNA, 13 bp, Homo sapiens
ctgagagctggcc

SEQ ID NO: 5604786 - DNA, 14 bp, Homo sapiens
ctgagagctggccc

SEQ ID NO: 5604787 - DNA, 13 bp, Homo sapiens
ctgagagctgggc

SEQ ID NO: 5604788 - DNA, 17 bp, Homo sapiens
ctgagagctgggctttc

SEQ ID NO: 5604789 - DNA, 15 bp, Homo sapiens
ctgagaggaagcaag

SEQ ID NO: 5604790 - DNA, 17 bp, Homo sapiens
ctgagaggacagagaga

SEQ ID NO: 5604791 - DNA, 21 bp, Homo sapiens
ctgagaggacttttctttgtg

SEQ ID NO: 5604792 - DNA, 21 bp, Homo sapiens
ctgagaggaggggtaaatata

SEQ ID NO: 5604793 - DNA, 12 bp, Homo sapiens
ctgagaggcagg

SEQ ID NO: 5604794 - DNA, 13 bp, Homo sapiens
ctgagaggcaggc

SEQ ID NO: 5604795 - DNA, 14 bp, Homo sapiens
ctgagaggcaggca

SEQ ID NO: 5604796 - DNA, 16 bp, Homo sapiens
ctgagaggcctggagc

SEQ ID NO: 5604797 - DNA, 14 bp, Homo sapiens
ctgagaggctctcc

SEQ ID NO: 5604798 - DNA, 14 bp, Homo sapiens
ctgagaggctgtct

SEQ ID NO: 5604799 - DNA, 16 bp, Homo sapiens
ctgagagggcaaggaa

SEQ ID NO: 5604800 - DNA, 20 bp, Homo sapiens
ctgagagggctgtggctggg

SEQ ID NO: 5604801 - DNA, 23 bp, Homo sapiens
ctgagagggctgtggctgggtgg

SEQ ID NO: 5604802 - DNA, 17 bp, Homo sapiens
ctgagaggtaagaagta

SEQ ID NO: 5604803 - DNA, 17 bp, Homo sapiens
ctgagaggtgctgcagg

SEQ ID NO: 5604804 - DNA, 15 bp, Homo sapiens
ctgagagtctagatt

SEQ ID NO: 5604805 - DNA, 19 bp, Homo sapiens
ctgagagtctgaaagacag

SEQ ID NO: 5604806 - DNA, 13 bp, Homo sapiens
ctgagagtctgca

SEQ ID NO: 5604807 - DNA, 21 bp, Homo sapiens
ctgagagtctggtctgcgcct

SEQ ID NO: 5604808 - DNA, 14 bp, Homo sapiens
ctgagagtgcaaat

SEQ ID NO: 5604809 - DNA, 18 bp, Homo sapiens
ctgagagtgcaaattgta

SEQ ID NO: 5604810 - DNA, 18 bp, Homo sapiens
ctgagagttggctcaggc

SEQ ID NO: 5604811 - DNA, 15 bp, Homo sapiens
ctgagagtttcctca

SEQ ID NO: 5604812 - DNA, 16 bp, Homo sapiens
ctgagagtttcctcag

SEQ ID NO: 5604813 - DNA, 13 bp, Homo sapiens
ctgagataagaaa

SEQ ID NO: 5604814 - DNA, 15 bp, Homo sapiens
ctgagataagaaaag

SEQ ID NO: 5604815 - DNA, 17 bp, Homo sapiens
ctgagataagaaaagcc

SEQ ID NO: 5604816 - DNA, 18 bp, Homo sapiens
ctgagataagaaaagcct

SEQ ID NO: 5604817 - DNA, 21 bp, Homo sapiens
ctgagatacaaggcccagaag

SEQ ID NO: 5604818 - DNA, 18 bp, Homo sapiens
ctgagatactgaaatgtg

SEQ ID NO: 5604819 - DNA, 19 bp, Homo sapiens
ctgagatactgaagtgcag

SEQ ID NO: 5604820 - DNA, 19 bp, Homo sapiens
ctgagatatggcattgcac

SEQ ID NO: 5604821 - DNA, 18 bp, Homo sapiens
ctgagatcacaccactgc

SEQ ID NO: 5604822 - DNA, 13 bp, Homo sapiens
ctgagatcctgga

SEQ ID NO: 5604823 - DNA, 17 bp, Homo sapiens
ctgagatcctggactga

SEQ ID NO: 5604824 - DNA, 21 bp, Homo sapiens
ctgagatcctggactgagggg

SEQ ID NO: 5604825 - DNA, 19 bp, Homo sapiens
ctgagatcgtgctactgca

SEQ ID NO: 5604826 - DNA, 19 bp, Homo sapiens
ctgagatctccctccaggg

SEQ ID NO: 5604827 - DNA, 16 bp, Homo sapiens
ctgagatctctgcagg

SEQ ID NO: 5604828 - DNA, 17 bp, Homo sapiens
ctgagatctctgcagga

SEQ ID NO: 5604829 - DNA, 18 bp, Homo sapiens
ctgagatctctgcaggaa

SEQ ID NO: 5604830 - DNA, 14 bp, Homo sapiens
ctgagatgagcccc

SEQ ID NO: 5604831 - DNA, 16 bp, Homo sapiens
ctgagatgatgcatga

SEQ ID NO: 5604832 - DNA, 18 bp, Homo sapiens
ctgagatgatgcatgatg

SEQ ID NO: 5604833 - DNA, 18 bp, Homo sapiens
ctgagatgcaaatgtcac

SEQ ID NO: 5604834 - DNA, 21 bp, Homo sapiens
ctgagatgcaaatgtcacagt

SEQ ID NO: 5604835 - DNA, 16 bp, Homo sapiens
ctgagatgctgggagg

SEQ ID NO: 5604836 - DNA, 18 bp, Homo sapiens
ctgagatggagtgagctg

SEQ ID NO: 5604837 - DNA, 16 bp, Homo sapiens
ctgagatggctcccag

SEQ ID NO: 5604838 - DNA, 20 bp, Homo sapiens
ctgagatgggcttcccaagg

SEQ ID NO: 5604839 - DNA, 19 bp, Homo sapiens
ctgagatgtaggctccacc

SEQ ID NO: 5604840 - DNA, 16 bp, Homo sapiens
ctgagatgtgaacaca

SEQ ID NO: 5604841 - DNA, 20 bp, Homo sapiens
ctgagatgtgaacacatcag

SEQ ID NO: 5604842 - DNA, 21 bp, Homo sapiens
ctgagatgtgaacacatcagc

SEQ ID NO: 5604843 - DNA, 18 bp, Homo sapiens
ctgagatgttttaccatc

SEQ ID NO: 5604844 - DNA, 15 bp, Homo sapiens
ctgagattacaggtg

SEQ ID NO: 5604845 - DNA, 19 bp, Homo sapiens
ctgagattattttaatcta

SEQ ID NO: 5604846 - DNA, 18 bp, Homo sapiens
ctgagattcaatattgaa

SEQ ID NO: 5604847 - DNA, 23 bp, Homo sapiens
ctgagattccagaacgccctgtg

SEQ ID NO: 5604848 - DNA, 14 bp, Homo sapiens
ctgagattccctca

SEQ ID NO: 5604849 - DNA, 22 bp, Homo sapiens
ctgagattctgggaaaggtgct

SEQ ID NO: 5604850 - DNA, 13 bp, Homo sapiens
ctgagattcttca

SEQ ID NO: 5604851 - DNA, 18 bp, Homo sapiens
ctgagattctttaaggag

SEQ ID NO: 5604852 - DNA, 23 bp, Homo sapiens
ctgagattgtgtttgttcataat

SEQ ID NO: 5604853 - DNA, 21 bp, Homo sapiens
ctgaggctggatcctagcctt

SEQ ID NO: 5604854 - DNA, 17 bp, Homo sapiens
ctgaggctggcacagga

SEQ ID NO: 5604855 - DNA, 20 bp, Homo sapiens
ctgaggctggcacaggacat

SEQ ID NO: 5604856 - DNA, 16 bp, Homo sapiens
ctgaggctggcatcct

SEQ ID NO: 5604857 - DNA, 21 bp, Homo sapiens
ctgaggctggcatcctggctg

SEQ ID NO: 5604858 - DNA, 22 bp, Homo sapiens
ctgaggctggcatcctggctgg

SEQ ID NO: 5604859 - DNA, 14 bp, Homo sapiens
ctgaggctggctgg

SEQ ID NO: 5604860 - DNA, 20 bp, Homo sapiens
ctgaggctggctgggggcag

SEQ ID NO: 5604861 - DNA, 22 bp, Homo sapiens
ctgaggctggctgggggcagga

SEQ ID NO: 5604862 - DNA, 22 bp, Homo sapiens
ctgaggctgggggcgggggagc

SEQ ID NO: 5604863 - DNA, 18 bp, Homo sapiens
ctgaggctggtagcagaa

SEQ ID NO: 5604864 - DNA, 11 bp, Homo sapiens
ctgaggctgta

SEQ ID NO: 5604865 - DNA, 13 bp, Homo sapiens
ctgaggctgtggt

SEQ ID NO: 5604866 - DNA, 18 bp, Homo sapiens
ctgaggcttagagagagg

SEQ ID NO: 5604867 - DNA, 19 bp, Homo sapiens
ctgaggcttagagagagga

SEQ ID NO: 5604868 - DNA, 20 bp, Homo sapiens
ctgaggcttagagagaggag

SEQ ID NO: 5604869 - DNA, 23 bp, Homo sapiens
ctgaggcttagagagaggaggca

SEQ ID NO: 5604870 - DNA, 20 bp, Homo sapiens
ctgaggcttcacgccgggag

SEQ ID NO: 5604871 - DNA, 19 bp, Homo sapiens
ctgaggcttgggcccagta

SEQ ID NO: 5604872 - DNA, 14 bp, Homo sapiens
ctgaggctttggat

SEQ ID NO: 5604873 - DNA, 17 bp, Homo sapiens
ctgaggctttggatttg

SEQ ID NO: 5604874 - DNA, 20 bp, Homo sapiens
ctgagggaaaggccagcact

SEQ ID NO: 5604875 - DNA, 21 bp, Homo sapiens
ctgagggaaatgttttgtaaa

SEQ ID NO: 5604876 - DNA, 23 bp, Homo sapiens
ctgagggaaatgttttgtaaaca

SEQ ID NO: 5604877 - DNA, 16 bp, Homo sapiens
ctgagggaagcccacc

SEQ ID NO: 5604878 - DNA, 16 bp, Homo sapiens
ctgagggaccaactgg

SEQ ID NO: 5604879 - DNA, 21 bp, Homo sapiens
ctgagggaccaactgggccca

SEQ ID NO: 5604880 - DNA, 16 bp, Homo sapiens
ctgagggaccgagccc

SEQ ID NO: 5604881 - DNA, 21 bp, Homo sapiens
ctgagggacgagcagagcgca

SEQ ID NO: 5604882 - DNA, 17 bp, Homo sapiens
ctgagggacgtggtgcc

SEQ ID NO: 5604883 - DNA, 14 bp, Homo sapiens
ctgagggactctga

SEQ ID NO: 5604884 - DNA, 20 bp, Homo sapiens
ctgagggactctgaagcctc

SEQ ID NO: 5604885 - DNA, 22 bp, Homo sapiens
ctgagggactctgaagcctctg

SEQ ID NO: 5604886 - DNA, 12 bp, Homo sapiens
ctgagggagaga

SEQ ID NO: 5604887 - DNA, 16 bp, Homo sapiens
ctgagggagagactct

SEQ ID NO: 5604888 - DNA, 19 bp, Homo sapiens
ctgagggaggacctggggc

SEQ ID NO: 5604889 - DNA, 18 bp, Homo sapiens
ctgagggaggaggcagga

SEQ ID NO: 5604890 - DNA, 11 bp, Homo sapiens
ctgagggaggg

SEQ ID NO: 5604891 - DNA, 15 bp, Homo sapiens
ctgagggagggagcc

SEQ ID NO: 5604892 - DNA, 17 bp, Homo sapiens
ctgagggagggagccat

SEQ ID NO: 5604893 - DNA, 19 bp, Homo sapiens
ctgagggagggagccatgg

SEQ ID NO: 5604894 - DNA, 15 bp, Homo sapiens
ctgagggatctttac

SEQ ID NO: 5604895 - DNA, 18 bp, Homo sapiens
ctgagggattgaggggcc

SEQ ID NO: 5604896 - DNA, 19 bp, Homo sapiens
ctgagggattttagcctct

SEQ ID NO: 5604897 - DNA, 11 bp, Homo sapiens
ctgagggcact

SEQ ID NO: 5604898 - DNA, 23 bp, Homo sapiens
ctgagggcagaaaggttctgccc

SEQ ID NO: 5604899 - DNA, 21 bp, Homo sapiens
ctgagggcagggttctagaag

SEQ ID NO: 5604900 - DNA, 11 bp, Homo sapiens
ctgagggcagt

SEQ ID NO: 5604901 - DNA, 18 bp, Homo sapiens
ctgagggcagtgcccttt

SEQ ID NO: 5604902 - DNA, 19 bp, Homo sapiens
ctgagggcagtgccctttg

SEQ ID NO: 5604903 - DNA, 12 bp, Homo sapiens
ctgagggcagtt

SEQ ID NO: 5604904 - DNA, 15 bp, Homo sapiens
ctgagggcatctctg

SEQ ID NO: 5604905 - DNA, 23 bp, Homo sapiens
ctgagggccaataccctactgtg

SEQ ID NO: 5604906 - DNA, 16 bp, Homo sapiens
ctgagggccacactat

SEQ ID NO: 5604907 - DNA, 12 bp, Homo sapiens
ctgagggccagg

SEQ ID NO: 5604908 - DNA, 19 bp, Homo sapiens
ctgagggccagggacccag

SEQ ID NO: 5604909 - DNA, 21 bp, Homo sapiens
ctgagggccagggacccaggt

SEQ ID NO: 5604910 - DNA, 15 bp, Homo sapiens
ctgagggcccctctg

SEQ ID NO: 5604911 - DNA, 16 bp, Homo sapiens
ctgagggcccctctgc

SEQ ID NO: 5604912 - DNA, 14 bp, Homo sapiens
ctgagggccctgtg

SEQ ID NO: 5604913 - DNA, 21 bp, Homo sapiens
ctgagggcggagcgcctcctt

SEQ ID NO: 5604914 - DNA, 12 bp, Homo sapiens
ctgagggctgat

SEQ ID NO: 5604915 - DNA, 19 bp, Homo sapiens
ctgagggctgatctttaac

SEQ ID NO: 5604916 - DNA, 16 bp, Homo sapiens
ctgagggctgccagca

SEQ ID NO: 5604917 - DNA, 16 bp, Homo sapiens
ctgagggcttcctttg

SEQ ID NO: 5604918 - DNA, 14 bp, Homo sapiens
ctgagggcttgtag

SEQ ID NO: 5604919 - DNA, 17 bp, Homo sapiens
ctgagggcttgtagttc

SEQ ID NO: 5604920 - DNA, 15 bp, Homo sapiens
ctgaggggacgggca

SEQ ID NO: 5604921 - DNA, 24 bp, Homo sapiens
ctgaggggacgggcaagtgagagg

SEQ ID NO: 5604922 - DNA, 14 bp, Homo sapiens
ctgaggggagacag

SEQ ID NO: 5604923 - DNA, 17 bp, Homo sapiens
ctgaggggagacagagc

SEQ ID NO: 5604924 - DNA, 17 bp, Homo sapiens
ctgaggggaggcacctc

SEQ ID NO: 5604925 - DNA, 18 bp, Homo sapiens
ctgaggggaggcacctcc

SEQ ID NO: 5604926 - DNA, 20 bp, Homo sapiens
ctgaggggaggcacctccag

SEQ ID NO: 5604927 - DNA, 23 bp, Homo sapiens
ctgaggggaggcacctccaggca

SEQ ID NO: 5604928 - DNA, 18 bp, Homo sapiens
ctgaggggagggggtccg

SEQ ID NO: 5604929 - DNA, 18 bp, Homo sapiens
ctgaggggcactctcccc

SEQ ID NO: 5604930 - DNA, 15 bp, Homo sapiens
ctgaggggcagcctg

SEQ ID NO: 5604931 - DNA, 18 bp, Homo sapiens
ctgaggggcagcctgcct

SEQ ID NO: 5604932 - DNA, 14 bp, Homo sapiens
ctgaggggcaggga

SEQ ID NO: 5604933 - DNA, 18 bp, Homo sapiens
ctgaggggcagggagagc

SEQ ID NO: 5604934 - DNA, 18 bp, Homo sapiens
ctgaggggcatctgcccc

SEQ ID NO: 5604935 - DNA, 19 bp, Homo sapiens
ctgaggggcatctgcccct

SEQ ID NO: 5604936 - DNA, 14 bp, Homo sapiens
ctgaggggcctctt

SEQ ID NO: 5604937 - DNA, 15 bp, Homo sapiens
ctgaggggcctgcca

SEQ ID NO: 5604938 - DNA, 21 bp, Homo sapiens
ctgaggggcctgcgcccagag

SEQ ID NO: 5604939 - DNA, 18 bp, Homo sapiens
ctgaggggctggggaggg

SEQ ID NO: 5604940 - DNA, 15 bp, Homo sapiens
ctgaggggcttggga

SEQ ID NO: 5604941 - DNA, 20 bp, Homo sapiens
ctgaggggggccgtgcccag

SEQ ID NO: 5604942 - DNA, 21 bp, Homo sapiens
ctgagggggtgggggtgctgc

SEQ ID NO: 5604943 - DNA, 19 bp, Homo sapiens
ctgaggggtctataggttt

SEQ ID NO: 5604944 - DNA, 12 bp, Homo sapiens
ctgaggggtgga

SEQ ID NO: 5604945 - DNA, 13 bp, Homo sapiens
ctgaggggtgtcc

SEQ ID NO: 5604946 - DNA, 20 bp, Homo sapiens
ctgaggggtgtccgagaggc

SEQ ID NO: 5604947 - DNA, 21 bp, Homo sapiens
ctgaggggtgtccgagaggct

SEQ ID NO: 5604948 - DNA, 22 bp, Homo sapiens
ctgaggggtgtccgagaggctg

SEQ ID NO: 5604949 - DNA, 15 bp, Homo sapiens
ctgagggtccacctg

SEQ ID NO: 5604950 - DNA, 20 bp, Homo sapiens
ctgagggtccacctggagag

SEQ ID NO: 5604951 - DNA, 21 bp, Homo sapiens
ctgagggtccacctggagagt

SEQ ID NO: 5604952 - DNA, 14 bp, Homo sapiens
ctgagggtccagaa

SEQ ID NO: 5604953 - DNA, 17 bp, Homo sapiens
ctgagggtccagaagga

SEQ ID NO: 5604954 - DNA, 19 bp, Homo sapiens
ctgagggtcgtgggaaagg

SEQ ID NO: 5604955 - DNA, 23 bp, Homo sapiens
ctgagggtcgtgggaaaggggag

SEQ ID NO: 5604956 - DNA, 12 bp, Homo sapiens
ctgagggtctga

SEQ ID NO: 5604957 - DNA, 14 bp, Homo sapiens
ctgagggtctgtag

SEQ ID NO: 5604958 - DNA, 16 bp, Homo sapiens
ctgagggtctgtaggt

SEQ ID NO: 5604959 - DNA, 20 bp, Homo sapiens
ctgagggtggagactaagcc

SEQ ID NO: 5604960 - DNA, 17 bp, Homo sapiens
ctgagggtgggaggcaa

SEQ ID NO: 5604961 - DNA, 22 bp, Homo sapiens
ctgagggtgttagtacctagtg

SEQ ID NO: 5604962 - DNA, 19 bp, Homo sapiens
ctgagggtgtttcttcctg

SEQ ID NO: 5604963 - DNA, 22 bp, Homo sapiens
ctgaggtacctttccacccaga

SEQ ID NO: 5604964 - DNA, 14 bp, Homo sapiens
ctgaggtataaaga

SEQ ID NO: 5604965 - DNA, 16 bp, Homo sapiens
ctgaggtataaagaca

SEQ ID NO: 5604966 - DNA, 18 bp, Homo sapiens
ctgaggtataaagacaag

SEQ ID NO: 5604967 - DNA, 13 bp, Homo sapiens
ctgaggtcaataa

SEQ ID NO: 5604968 - DNA, 17 bp, Homo sapiens
ctgaggtcaataaagca

SEQ ID NO: 5604969 - DNA, 18 bp, Homo sapiens
ctgaggtcaataaagcag

SEQ ID NO: 5604970 - DNA, 15 bp, Homo sapiens
ctgaggtcacctgga

SEQ ID NO: 5604971 - DNA, 18 bp, Homo sapiens
ctgaggtcactgggttct

SEQ ID NO: 5604972 - DNA, 22 bp, Homo sapiens
ctgaggtcatcggcgtggccca

SEQ ID NO: 5604973 - DNA, 12 bp, Homo sapiens
ctgaggtccaag

SEQ ID NO: 5604974 - DNA, 21 bp, Homo sapiens
ctgaggtccaagattctggag

SEQ ID NO: 5604975 - DNA, 21 bp, Homo sapiens
ctgaggtcccttcaaggcctc

SEQ ID NO: 5604976 - DNA, 23 bp, Homo sapiens
ctgaggtccgatggcccgagagc

SEQ ID NO: 5604977 - DNA, 13 bp, Homo sapiens
ctgaggtcctgag

SEQ ID NO: 5604978 - DNA, 18 bp, Homo sapiens
ctgaggtcctgagcactg

SEQ ID NO: 5604979 - DNA, 16 bp, Homo sapiens
ctgaggtctcttgagg

SEQ ID NO: 5604980 - DNA, 19 bp, Homo sapiens
ctgaggtctcttgagggag

SEQ ID NO: 5604981 - DNA, 13 bp, Homo sapiens
ctgaggtctggct

SEQ ID NO: 5604982 - DNA, 16 bp, Homo sapiens
ctgaggtctggctgct

SEQ ID NO: 5604983 - DNA, 18 bp, Homo sapiens
ctgaggtgaacaaggtaa

SEQ ID NO: 5604984 - DNA, 22 bp, Homo sapiens
ctgaggtgatgaagacagcccg

SEQ ID NO: 5604985 - DNA, 17 bp, Homo sapiens
ctgaggtgcactgggag

SEQ ID NO: 5604986 - DNA, 21 bp, Homo sapiens
ctgaggtgcaggggaagacca

SEQ ID NO: 5604987 - DNA, 18 bp, Homo sapiens
ctgaggtgcccactccgc

SEQ ID NO: 5604988 - DNA, 13 bp, Homo sapiens
ctgaggtgcccag

SEQ ID NO: 5604989 - DNA, 20 bp, Homo sapiens
ctgaggtgcccaggagaaga

SEQ ID NO: 5604990 - DNA, 16 bp, Homo sapiens
ctgaggtgcctcccag

SEQ ID NO: 5604991 - DNA, 22 bp, Homo sapiens
ctgaggtgcctcccagtggcct

SEQ ID NO: 5604992 - DNA, 12 bp, Homo sapiens
ctgaggtgcctg

SEQ ID NO: 5604993 - DNA, 13 bp, Homo sapiens
ctgaggtgcctgc

SEQ ID NO: 5604994 - DNA, 16 bp, Homo sapiens
ctgaggtgcctgctca

SEQ ID NO: 5604995 - DNA, 17 bp, Homo sapiens
ctgaggtgcctgtccca

SEQ ID NO: 5604996 - DNA, 22 bp, Homo sapiens
ctgaggtgcctgtcccaccccc

SEQ ID NO: 5604997 - DNA, 21 bp, Homo sapiens
ctgaggtgggaggatcacttg

SEQ ID NO: 5604998 - DNA, 20 bp, Homo sapiens
ctgaggtgggcagatcacga

SEQ ID NO: 5604999 - DNA, 20 bp, Homo sapiens
ctgaggtgggcccaggacca

SEQ ID NO: 5605000 - DNA, 22 bp, Homo sapiens
ctgaggtgggcccaggaccagc

SEQ ID NO: 5605001 - DNA, 23 bp, Homo sapiens
ctgaggtgggcccaggaccagct

SEQ ID NO: 5605002 - DNA, 16 bp, Homo sapiens
ctgaggtggggaagga

SEQ ID NO: 5605003 - DNA, 21 bp, Homo sapiens
ctgaggtggtaggatcacctg

SEQ ID NO: 5605004 - DNA, 22 bp, Homo sapiens
ctgaggtgtctggcctgaggtc

SEQ ID NO: 5605005 - DNA, 13 bp, Homo sapiens
ctgaggtgtgggg

SEQ ID NO: 5605006 - DNA, 14 bp, Homo sapiens
ctgaggtgtggggg

SEQ ID NO: 5605007 - DNA, 21 bp, Homo sapiens
ctgaggtgtgggggctgcagc

SEQ ID NO: 5605008 - DNA, 20 bp, Homo sapiens
ctgaggtgttattttcaatg

SEQ ID NO: 5605009 - DNA, 15 bp, Homo sapiens
ctgaggttaagggga

SEQ ID NO: 5605010 - DNA, 16 bp, Homo sapiens
ctgaggttaaggggat

SEQ ID NO: 5605011 - DNA, 21 bp, Homo sapiens
ctgaggttactggaaattagg

SEQ ID NO: 5605012 - DNA, 23 bp, Homo sapiens
ctgaggttagcccaatggagaaa

SEQ ID NO: 5605013 - DNA, 18 bp, Homo sapiens
ctgaggttcctctgcctg

SEQ ID NO: 5605014 - DNA, 20 bp, Homo sapiens
ctgaggttgggaaggcacct

SEQ ID NO: 5605015 - DNA, 14 bp, Homo sapiens
ctgaggtttcaccc

SEQ ID NO: 5605016 - DNA, 17 bp, Homo sapiens
ctgaggttttgaataaa

SEQ ID NO: 5605017 - DNA, 20 bp, Homo sapiens
ctgaggttttgaataaaaag

SEQ ID NO: 5605018 - DNA, 23 bp, Homo sapiens
ctgaggttttgaataaaaagtga

SEQ ID NO: 5605019 - DNA, 20 bp, Homo sapiens
ctgagtaagaaatgctgccc

SEQ ID NO: 5605020 - DNA, 17 bp, Homo sapiens
ctgagtaattaataaag

SEQ ID NO: 5605021 - DNA, 22 bp, Homo sapiens
ctgagtaattaataaagaaaaa

SEQ ID NO: 5605022 - DNA, 13 bp, Homo sapiens
ctgagtacaaatg

SEQ ID NO: 5605023 - DNA, 16 bp, Homo sapiens
ctgagtacaaatgtgt

SEQ ID NO: 5605024 - DNA, 20 bp, Homo sapiens
ctgagtacattgtgcccttg

SEQ ID NO: 5605025 - DNA, 15 bp, Homo sapiens
ctgagtaccaggggc

SEQ ID NO: 5605026 - DNA, 16 bp, Homo sapiens
ctgagtaccaggggct

SEQ ID NO: 5605027 - DNA, 19 bp, Homo sapiens
ctgagtaccaggggctggg

SEQ ID NO: 5605028 - DNA, 20 bp, Homo sapiens
ctgagtaccaggggctgggc

SEQ ID NO: 5605029 - DNA, 15 bp, Homo sapiens
ctgatgggtcctgct

SEQ ID NO: 5605030 - DNA, 19 bp, Homo sapiens
ctgatgggtggacctgtgt

SEQ ID NO: 5605031 - DNA, 16 bp, Homo sapiens
ctgatggtacaggaaa

SEQ ID NO: 5605032 - DNA, 18 bp, Homo sapiens
ctgatggtgaaaccaaac

SEQ ID NO: 5605033 - DNA, 22 bp, Homo sapiens
ctgatggtgagcagtaactgtc

SEQ ID NO: 5605034 - DNA, 14 bp, Homo sapiens
ctgatggtgagctg

SEQ ID NO: 5605035 - DNA, 15 bp, Homo sapiens
ctgatggtgcaatga

SEQ ID NO: 5605036 - DNA, 16 bp, Homo sapiens
ctgatggtgcaatgac

SEQ ID NO: 5605037 - DNA, 17 bp, Homo sapiens
ctgatggtgcaatgacc

SEQ ID NO: 5605038 - DNA, 21 bp, Homo sapiens
ctgatggtgcaatgacctttc

SEQ ID NO: 5605039 - DNA, 20 bp, Homo sapiens
ctgatggtgtcattctgcct

SEQ ID NO: 5605040 - DNA, 21 bp, Homo sapiens
ctgatggtgtcattctgcctg

SEQ ID NO: 5605041 - DNA, 22 bp, Homo sapiens
ctgatggtgtcattctgcctgc

SEQ ID NO: 5605042 - DNA, 18 bp, Homo sapiens
ctgatggttgctttgagc

SEQ ID NO: 5605043 - DNA, 18 bp, Homo sapiens
ctgatgtacagttgggaa

SEQ ID NO: 5605044 - DNA, 15 bp, Homo sapiens
ctgatgtactctaaa

SEQ ID NO: 5605045 - DNA, 17 bp, Homo sapiens
ctgatgtataatgtaat

SEQ ID NO: 5605046 - DNA, 13 bp, Homo sapiens
ctgatgtattaca

SEQ ID NO: 5605047 - DNA, 14 bp, Homo sapiens
ctgatgtcaaagtg

SEQ ID NO: 5605048 - DNA, 18 bp, Homo sapiens
ctgatgtcaatttctgtg

SEQ ID NO: 5605049 - DNA, 21 bp, Homo sapiens
ctgatgtcagctgctgttgaa

SEQ ID NO: 5605050 - DNA, 14 bp, Homo sapiens
ctgatgtcatcttg

SEQ ID NO: 5605051 - DNA, 16 bp, Homo sapiens
ctgatgtcatcttgag

SEQ ID NO: 5605052 - DNA, 18 bp, Homo sapiens
ctgatgtcatcttgagct

SEQ ID NO: 5605053 - DNA, 12 bp, Homo sapiens
ctgatgtcccag

SEQ ID NO: 5605054 - DNA, 14 bp, Homo sapiens
ctgatgtcccagtg

SEQ ID NO: 5605055 - DNA, 19 bp, Homo sapiens
ctgatgtccctagaaaaca

SEQ ID NO: 5605056 - DNA, 13 bp, Homo sapiens
ctgatgtctccta

SEQ ID NO: 5605057 - DNA, 23 bp, Homo sapiens
ctgatgtcttaacgaataaaggt

SEQ ID NO: 5605058 - DNA, 18 bp, Homo sapiens
ctgatgtgacgctactaa

SEQ ID NO: 5605059 - DNA, 15 bp, Homo sapiens
ctgatgtgatattct

SEQ ID NO: 5605060 - DNA, 15 bp, Homo sapiens
ctgatgtggactgtc

SEQ ID NO: 5605061 - DNA, 16 bp, Homo sapiens
ctgatgtggcaaaagg

SEQ ID NO: 5605062 - DNA, 18 bp, Homo sapiens
ctgatgtgtcccttgatg

SEQ ID NO: 5605063 - DNA, 20 bp, Homo sapiens
ctgatgtgtcctcagggagc

SEQ ID NO: 5605064 - DNA, 24 bp, Homo sapiens
ctgatgtgtgcccagatcgttctg

SEQ ID NO: 5605065 - DNA, 20 bp, Homo sapiens
ctgatgttacatcacagtgt

SEQ ID NO: 5605066 - DNA, 13 bp, Homo sapiens
ctgatgttcagtg

SEQ ID NO: 5605067 - DNA, 16 bp, Homo sapiens
ctgatgttcagtgtaa

SEQ ID NO: 5605068 - DNA, 17 bp, Homo sapiens
ctgatgttccctccggt

SEQ ID NO: 5605069 - DNA, 22 bp, Homo sapiens
ctgatgttcctttggaagaaaa

SEQ ID NO: 5605070 - DNA, 18 bp, Homo sapiens
ctgatgttcttccagtga

SEQ ID NO: 5605071 - DNA, 18 bp, Homo sapiens
ctgatgttctttccatga

SEQ ID NO: 5605072 - DNA, 16 bp, Homo sapiens
ctgatgttgagctgag

SEQ ID NO: 5605073 - DNA, 17 bp, Homo sapiens
ctgatgttgagctgagt

SEQ ID NO: 5605074 - DNA, 12 bp, Homo sapiens
ctgatgttgtgt

SEQ ID NO: 5605075 - DNA, 16 bp, Homo sapiens
ctgatgtttacagtgt

SEQ ID NO: 5605076 - DNA, 15 bp, Homo sapiens
ctgatgtttataaac

SEQ ID NO: 5605077 - DNA, 23 bp, Homo sapiens
ctgatgtttatgtactgtaaaca

SEQ ID NO: 5605078 - DNA, 17 bp, Homo sapiens
ctgatgtttctcatcct

SEQ ID NO: 5605079 - DNA, 13 bp, Homo sapiens
ctgatgtttctgt

SEQ ID NO: 5605080 - DNA, 14 bp, Homo sapiens
ctgatgtttctgtg

SEQ ID NO: 5605081 - DNA, 15 bp, Homo sapiens
ctgatgtttctgtga

SEQ ID NO: 5605082 - DNA, 23 bp, Homo sapiens
ctgatgtttctgtgaaattctca

SEQ ID NO: 5605083 - DNA, 12 bp, Homo sapiens
ctgatgtttgtt

SEQ ID NO: 5605084 - DNA, 16 bp, Homo sapiens
ctgatgtttgttttcg

SEQ ID NO: 5605085 - DNA, 18 bp, Homo sapiens
ctgatgttttatttgcac

SEQ ID NO: 5605086 - DNA, 22 bp, Homo sapiens
ctgatgttttgatgccatttgt

SEQ ID NO: 5605087 - DNA, 15 bp, Homo sapiens
ctgatgtttttctgt

SEQ ID NO: 5605088 - DNA, 16 bp, Homo sapiens
ctgattaaagtgcctt

SEQ ID NO: 5605089 - DNA, 20 bp, Homo sapiens
ctgattaaatatttgaagag

SEQ ID NO: 5605090 - DNA, 16 bp, Homo sapiens
ctgattaagcattctt

SEQ ID NO: 5605091 - DNA, 21 bp, Homo sapiens
ctgattaagttgtctaaacaa

SEQ ID NO: 5605092 - DNA, 15 bp, Homo sapiens
ctgattaatatattt

SEQ ID NO: 5605093 - DNA, 20 bp, Homo sapiens
ctgattaatccattttaaca

SEQ ID NO: 5605094 - DNA, 16 bp, Homo sapiens
ctgattacctgccaat

SEQ ID NO: 5605095 - DNA, 20 bp, Homo sapiens
ctgattacgtttacattctt

SEQ ID NO: 5605096 - DNA, 13 bp, Homo sapiens
ctgattactgtca

SEQ ID NO: 5605097 - DNA, 14 bp, Homo sapiens
ctgattactgtcaa

SEQ ID NO: 5605098 - DNA, 16 bp, Homo sapiens
ctgattactgtcaata

SEQ ID NO: 5605099 - DNA, 19 bp, Homo sapiens
ctgattactgtcaataaac

SEQ ID NO: 5605100 - DNA, 21 bp, Homo sapiens
ctgattacttgtaattatgaa

SEQ ID NO: 5605101 - DNA, 21 bp, Homo sapiens
ctgattagaagtataaggtgc

SEQ ID NO: 5605102 - DNA, 23 bp, Homo sapiens
ctgattagataatcttttacatt

SEQ ID NO: 5605103 - DNA, 15 bp, Homo sapiens
ctgattagctttgtg

SEQ ID NO: 5605104 - DNA, 16 bp, Homo sapiens
ctgattagctttgtgt

SEQ ID NO: 5605105 - DNA, 13 bp, Homo sapiens
ctgattaggtaac

SEQ ID NO: 5605106 - DNA, 22 bp, Homo sapiens
ctgattagtaagtcttgcctat

SEQ ID NO: 5605107 - DNA, 18 bp, Homo sapiens
ctgattagtattcaggca

SEQ ID NO: 5605108 - DNA, 22 bp, Homo sapiens
ctgattagtattcaggcactga

SEQ ID NO: 5605109 - DNA, 16 bp, Homo sapiens
ctgattagttgacagt

SEQ ID NO: 5605110 - DNA, 19 bp, Homo sapiens
ctgattagttgacagtatt

SEQ ID NO: 5605111 - DNA, 21 bp, Homo sapiens
ctgattagttgacagtattaa

SEQ ID NO: 5605112 - DNA, 14 bp, Homo sapiens
ctgattatgaaatg

SEQ ID NO: 5605113 - DNA, 18 bp, Homo sapiens
ctgattatgtaagcattt

SEQ ID NO: 5605114 - DNA, 23 bp, Homo sapiens
ctgattatgtcttttatatttgt

SEQ ID NO: 5605115 - DNA, 16 bp, Homo sapiens
ctgattattcttctta

SEQ ID NO: 5605116 - DNA, 21 bp, Homo sapiens
ctgattattcttcttacatta

SEQ ID NO: 5605117 - DNA, 14 bp, Homo sapiens
ctgattattgaatg

SEQ ID NO: 5605118 - DNA, 18 bp, Homo sapiens
ctgattatttagagccat

SEQ ID NO: 5605119 - DNA, 12 bp, Homo sapiens
ctgattatttat

SEQ ID NO: 5605120 - DNA, 14 bp, Homo sapiens
ctgattatttgcag

SEQ ID NO: 5605121 - DNA, 18 bp, Homo sapiens
ctgattatttgcagctgc

SEQ ID NO: 5605122 - DNA, 23 bp, Homo sapiens
ctgattcaaaagtgaacttgatt

SEQ ID NO: 5605123 - DNA, 19 bp, Homo sapiens
ctgattcaaaccaaagctg

SEQ ID NO: 5605124 - DNA, 20 bp, Homo sapiens
ctgattcaaaccaaagctgc

SEQ ID NO: 5605125 - DNA, 24 bp, Homo sapiens
ctgattcaagtaagtagatgcctg

SEQ ID NO: 5605126 - DNA, 21 bp, Homo sapiens
ctgattcacatctcatttttc

SEQ ID NO: 5605127 - DNA, 15 bp, Homo sapiens
ctgattcacctcttc

SEQ ID NO: 5605128 - DNA, 16 bp, Homo sapiens
ctgattcacctcttcc

SEQ ID NO: 5605129 - DNA, 21 bp, Homo sapiens
ctgattcacctcttcctctgg

SEQ ID NO: 5605130 - DNA, 22 bp, Homo sapiens
ctgattcacctcttcctctggt

SEQ ID NO: 5605131 - DNA, 20 bp, Homo sapiens
ctgattcactgcatggctcc

SEQ ID NO: 5605132 - DNA, 23 bp, Homo sapiens
ctgattcagcatcactaaaccga

SEQ ID NO: 5605133 - DNA, 16 bp, Homo sapiens
ctgattcagcattttt

SEQ ID NO: 5605134 - DNA, 22 bp, Homo sapiens
ctgattcatcctgggatgtaaa

SEQ ID NO: 5605135 - DNA, 15 bp, Homo sapiens
ctgattccagcaaga

SEQ ID NO: 5605136 - DNA, 18 bp, Homo sapiens
ctgattcccaagctctgc

SEQ ID NO: 5605137 - DNA, 19 bp, Homo sapiens
ctgattcccaagctctgct

SEQ ID NO: 5605138 - DNA, 13 bp, Homo sapiens
ctgattccccact

SEQ ID NO: 5605139 - DNA, 20 bp, Homo sapiens
ctgattcctaaaactctgcc

SEQ ID NO: 5605140 - DNA, 18 bp, Homo sapiens
ctgattcctaaggcccag

SEQ ID NO: 5605141 - DNA, 21 bp, Homo sapiens
ctgattcctaaggcccagctg

SEQ ID NO: 5605142 - DNA, 22 bp, Homo sapiens
ctgattcctaaggcccagctgc

SEQ ID NO: 5605143 - DNA, 14 bp, Homo sapiens
ctgattcctctcat

SEQ ID NO: 5605144 - DNA, 16 bp, Homo sapiens
ctgattcctctcattt

SEQ ID NO: 5605145 - DNA, 15 bp, Homo sapiens
ctgattcctttaaaa

SEQ ID NO: 5605146 - DNA, 17 bp, Homo sapiens
ctgattcgaatgacact

SEQ ID NO: 5605147 - DNA, 19 bp, Homo sapiens
ctgattcgaatgacactgt

SEQ ID NO: 5605148 - DNA, 23 bp, Homo sapiens
ctgattcgaggtcctcctggcct

SEQ ID NO: 5605149 - DNA, 16 bp, Homo sapiens
ctgattcggctgtctc

SEQ ID NO: 5605150 - DNA, 19 bp, Homo sapiens
ctgattcggggctgacctt

SEQ ID NO: 5605151 - DNA, 19 bp, Homo sapiens
ctgattctaaaatgtctca

SEQ ID NO: 5605152 - DNA, 13 bp, Homo sapiens
ctgattctatgcc

SEQ ID NO: 5605153 - DNA, 19 bp, Homo sapiens
ctgattctatgcctgtatt

SEQ ID NO: 5605154 - DNA, 12 bp, Homo sapiens
ctgattctatgt

SEQ ID NO: 5605155 - DNA, 17 bp, Homo sapiens
ctgattctatgtaactt

SEQ ID NO: 5605156 - DNA, 18 bp, Homo sapiens
ctgattctatgtaacttg

SEQ ID NO: 5605157 - DNA, 21 bp, Homo sapiens
ctgattctatgtaacttgttg

SEQ ID NO: 5605158 - DNA, 18 bp, Homo sapiens
ctgattctcagggtctct

SEQ ID NO: 5605159 - DNA, 13 bp, Homo sapiens
ctgattctccctg

SEQ ID NO: 5605160 - DNA, 14 bp, Homo sapiens
ctgattctggcttt

SEQ ID NO: 5605161 - DNA, 18 bp, Homo sapiens
ctgattctgttgtgttca

SEQ ID NO: 5605162 - DNA, 19 bp, Homo sapiens
ctgattcttgattcctggc

SEQ ID NO: 5605163 - DNA, 22 bp, Homo sapiens
ctgattcttgattcctggctct

SEQ ID NO: 5605164 - DNA, 21 bp, Homo sapiens
ctgattcttgtaaatcttttt

SEQ ID NO: 5605165 - DNA, 16 bp, Homo sapiens
ctgattcttttttcag

SEQ ID NO: 5605166 - DNA, 23 bp, Homo sapiens
ctgattgaccgtgttggtctgta

SEQ ID NO: 5605167 - DNA, 15 bp, Homo sapiens
ctgattgacctgctc

SEQ ID NO: 5605168 - DNA, 16 bp, Homo sapiens
ctgattgacctgctcc

SEQ ID NO: 5605169 - DNA, 17 bp, Homo sapiens
ctgattgacctgctccg

SEQ ID NO: 5605170 - DNA, 20 bp, Homo sapiens
ctgattgacctgctccgctg

SEQ ID NO: 5605171 - DNA, 17 bp, Homo sapiens
ctgattgagaagttcat

SEQ ID NO: 5605172 - DNA, 19 bp, Homo sapiens
ctgattgagaagttcattg

SEQ ID NO: 5605173 - DNA, 17 bp, Homo sapiens
ctgattgatcacacagt

SEQ ID NO: 5605174 - DNA, 13 bp, Homo sapiens
ctgattgattttt

SEQ ID NO: 5605175 - DNA, 16 bp, Homo sapiens
ctgattgcagaaagga

SEQ ID NO: 5605176 - DNA, 18 bp, Homo sapiens
ctgattgctcccaggatc

SEQ ID NO: 5605177 - DNA, 21 bp, Homo sapiens
ctgattgctcccaggatctcc

SEQ ID NO: 5605178 - DNA, 13 bp, Homo sapiens
ctgattggaaaat

SEQ ID NO: 5605179 - DNA, 16 bp, Homo sapiens
ctgattggaaaataat

SEQ ID NO: 5605180 - DNA, 21 bp, Homo sapiens
ctgattggaatttctggcctc

SEQ ID NO: 5605181 - DNA, 18 bp, Homo sapiens
ctgattggacctggccca

SEQ ID NO: 5605182 - DNA, 12 bp, Homo sapiens
ctgattggccac

SEQ ID NO: 5605183 - DNA, 15 bp, Homo sapiens
ctgattggccagccg

SEQ ID NO: 5605184 - DNA, 16 bp, Homo sapiens
ctgattggctcaccca

SEQ ID NO: 5605185 - DNA, 17 bp, Homo sapiens
ctgattggtgcaaccct

SEQ ID NO: 5605186 - DNA, 23 bp, Homo sapiens
ctgattggtgttttatctcctgt

SEQ ID NO: 5605187 - DNA, 16 bp, Homo sapiens
ctgattggtttctctt

SEQ ID NO: 5605188 - DNA, 18 bp, Homo sapiens
ctgattggtttctcttct

SEQ ID NO: 5605189 - DNA, 13 bp, Homo sapiens
ctgattgtattta

SEQ ID NO: 5605190 - DNA, 21 bp, Homo sapiens
ctgattgtggatcttttcatt

SEQ ID NO: 5605191 - DNA, 17 bp, Homo sapiens
ctgattgtgtctcttgg

SEQ ID NO: 5605192 - DNA, 22 bp, Homo sapiens
ctgatttaaaaagtgagaaaga

SEQ ID NO: 5605193 - DNA, 16 bp, Homo sapiens
ctgatttaatatgcaa

SEQ ID NO: 5605194 - DNA, 15 bp, Homo sapiens
ctgatttaatgtttt

SEQ ID NO: 5605195 - DNA, 14 bp, Homo sapiens
ctgatttacatgta

SEQ ID NO: 5605196 - DNA, 19 bp, Homo sapiens
ctgatttacatgtatggtt

SEQ ID NO: 5605197 - DNA, 23 bp, Homo sapiens
ctgatttagaagcaaagatttca

SEQ ID NO: 5605198 - DNA, 21 bp, Homo sapiens
ctgatttagcaatgctgtgaa

SEQ ID NO: 5605199 - DNA, 22 bp, Homo sapiens
ctgatttagcaatgctgtgaat

SEQ ID NO: 5605200 - DNA, 17 bp, Homo sapiens
ctgatttaggagaagcc

SEQ ID NO: 5605201 - DNA, 17 bp, Homo sapiens
ctgatttaggcactgct

SEQ ID NO: 5605202 - DNA, 13 bp, Homo sapiens
ctgatttatacca

SEQ ID NO: 5605203 - DNA, 16 bp, Homo sapiens
ctgatttatggtcaga

SEQ ID NO: 5605204 - DNA, 14 bp, Homo sapiens
ctgatttattctgg

SEQ ID NO: 5605205 - DNA, 15 bp, Homo sapiens
ctgatttcaaatgca

SEQ ID NO: 5605206 - DNA, 20 bp, Homo sapiens
ctgcagaaaccctgagcaga

SEQ ID NO: 5605207 - DNA, 22 bp, Homo sapiens
ctgcagaaagcccttcaacttc

SEQ ID NO: 5605208 - DNA, 16 bp, Homo sapiens
ctgcagaacagtgaaa

SEQ ID NO: 5605209 - DNA, 16 bp, Homo sapiens
ctgcagaacccccagg

SEQ ID NO: 5605210 - DNA, 20 bp, Homo sapiens
ctgcagaacgtattggtcca

SEQ ID NO: 5605211 - DNA, 17 bp, Homo sapiens
ctgcagaagaagctggt

SEQ ID NO: 5605212 - DNA, 13 bp, Homo sapiens
ctgcagaagacag

SEQ ID NO: 5605213 - DNA, 14 bp, Homo sapiens
ctgcagaagccaag

SEQ ID NO: 5605214 - DNA, 23 bp, Homo sapiens
ctgcagaagccaagggaagacag

SEQ ID NO: 5605215 - DNA, 18 bp, Homo sapiens
ctgcagaagccagaaggt

SEQ ID NO: 5605216 - DNA, 15 bp, Homo sapiens
ctgcagaaggaaaaa

SEQ ID NO: 5605217 - DNA, 21 bp, Homo sapiens
ctgcagaaggaaaaatgtgta

SEQ ID NO: 5605218 - DNA, 15 bp, Homo sapiens
ctgcagaaggaaaga

SEQ ID NO: 5605219 - DNA, 20 bp, Homo sapiens
ctgcagaaggaaagaagggg

SEQ ID NO: 5605220 - DNA, 22 bp, Homo sapiens
ctgcagaaggaaagaagggggc

SEQ ID NO: 5605221 - DNA, 18 bp, Homo sapiens
ctgcagaataaaatctct

SEQ ID NO: 5605222 - DNA, 19 bp, Homo sapiens
ctgcagaatccctttgcac

SEQ ID NO: 5605223 - DNA, 24 bp, Homo sapiens
ctgcagaatgggccactgtagggg

SEQ ID NO: 5605224 - DNA, 18 bp, Homo sapiens
ctgcagacaagtcttgct

SEQ ID NO: 5605225 - DNA, 21 bp, Homo sapiens
ctgcagacaagtcttgctgtg

SEQ ID NO: 5605226 - DNA, 22 bp, Homo sapiens
ctgcagacaagtcttgctgtgc

SEQ ID NO: 5605227 - DNA, 13 bp, Homo sapiens
ctgcagacaggct

SEQ ID NO: 5605228 - DNA, 19 bp, Homo sapiens
ctgcagacattctcaaagc

SEQ ID NO: 5605229 - DNA, 15 bp, Homo sapiens
ctgcagaccccaggt

SEQ ID NO: 5605230 - DNA, 16 bp, Homo sapiens
ctgcagaccccaggtt

SEQ ID NO: 5605231 - DNA, 12 bp, Homo sapiens
ctgcagaccctg

SEQ ID NO: 5605232 - DNA, 15 bp, Homo sapiens
ctgcagaccctgccc

SEQ ID NO: 5605233 - DNA, 13 bp, Homo sapiens
ctgcagacctcaa

SEQ ID NO: 5605234 - DNA, 17 bp, Homo sapiens
ctgcagacctcaagcca

SEQ ID NO: 5605235 - DNA, 18 bp, Homo sapiens
ctgcagacctcaagccat

SEQ ID NO: 5605236 - DNA, 20 bp, Homo sapiens
ctgcagacctcaagccatca

SEQ ID NO: 5605237 - DNA, 14 bp, Homo sapiens
ctgcagacctcact

SEQ ID NO: 5605238 - DNA, 17 bp, Homo sapiens
ctgcagacctcactgtc

SEQ ID NO: 5605239 - DNA, 20 bp, Homo sapiens
ctgcagacctcactgtcagg

SEQ ID NO: 5605240 - DNA, 15 bp, Homo sapiens
ctgcagacctgtcct

SEQ ID NO: 5605241 - DNA, 20 bp, Homo sapiens
ctgcagacctgtcctcctgg

SEQ ID NO: 5605242 - DNA, 22 bp, Homo sapiens
ctgcagacctgtcctcctggtg

SEQ ID NO: 5605243 - DNA, 23 bp, Homo sapiens
ctgcagacggatgcccattcctg

SEQ ID NO: 5605244 - DNA, 16 bp, Homo sapiens
ctgcagacgggaatgc

SEQ ID NO: 5605245 - DNA, 17 bp, Homo sapiens
ctgcagacgggaatgcc

SEQ ID NO: 5605246 - DNA, 23 bp, Homo sapiens
ctgcagacgggaatgcctaggtc

SEQ ID NO: 5605247 - DNA, 22 bp, Homo sapiens
ctgcagacgtctggccctggcg

SEQ ID NO: 5605248 - DNA, 13 bp, Homo sapiens
ctgcagactgcta

SEQ ID NO: 5605249 - DNA, 23 bp, Homo sapiens
ctgcagagaaacttaagcaaagg

SEQ ID NO: 5605250 - DNA, 20 bp, Homo sapiens
ctgcagagaataaaaggacc

SEQ ID NO: 5605251 - DNA, 14 bp, Homo sapiens
ctgcagagaccttg

SEQ ID NO: 5605252 - DNA, 12 bp, Homo sapiens
ctgcagagactt

SEQ ID NO: 5605253 - DNA, 23 bp, Homo sapiens
ctgcagagatttctcattgactt

SEQ ID NO: 5605254 - DNA, 10 bp, Homo sapiens
ctgcagagca

SEQ ID NO: 5605255 - DNA, 14 bp, Homo sapiens
ctgcagagcaataa

SEQ ID NO: 5605256 - DNA, 21 bp, Homo sapiens
ctgcagagcaataacactata

SEQ ID NO: 5605257 - DNA, 15 bp, Homo sapiens
ctgcagagcaccttt

SEQ ID NO: 5605258 - DNA, 22 bp, Homo sapiens
ctgcagagcagatggcagatgc

SEQ ID NO: 5605259 - DNA, 18 bp, Homo sapiens
ctgcagagcagcagcacc

SEQ ID NO: 5605260 - DNA, 18 bp, Homo sapiens
ctgcagagcagtgggcct

SEQ ID NO: 5605261 - DNA, 19 bp, Homo sapiens
ctgcagagcccggccccac

SEQ ID NO: 5605262 - DNA, 22 bp, Homo sapiens
ctgcagagcccggccccacctc

SEQ ID NO: 5605263 - DNA, 15 bp, Homo sapiens
ctgcagagcctgcag

SEQ ID NO: 5605264 - DNA, 20 bp, Homo sapiens
ctgcagagctaggttgtcct

SEQ ID NO: 5605265 - DNA, 21 bp, Homo sapiens
ctgcagagctatggtgaggtg

SEQ ID NO: 5605266 - DNA, 16 bp, Homo sapiens
ctgcagagctgaccca

SEQ ID NO: 5605267 - DNA, 21 bp, Homo sapiens
ctgcagagctgcgggctgggt

SEQ ID NO: 5605268 - DNA, 13 bp, Homo sapiens
ctgcagagctggg

SEQ ID NO: 5605269 - DNA, 12 bp, Homo sapiens
ctgcagaggacg

SEQ ID NO: 5605270 - DNA, 20 bp, Homo sapiens
ctgcagaggagccacctggg

SEQ ID NO: 5605271 - DNA, 21 bp, Homo sapiens
ctgcagaggagccacctgggc

SEQ ID NO: 5605272 - DNA, 23 bp, Homo sapiens
ctgcagaggagccacctgggctg

SEQ ID NO: 5605273 - DNA, 14 bp, Homo sapiens
ctgcagaggcagca

SEQ ID NO: 5605274 - DNA, 20 bp, Homo sapiens
ctgcagaggcagcaggagcc

SEQ ID NO: 5605275 - DNA, 11 bp, Homo sapiens
ctgcagaggcc

SEQ ID NO: 5605276 - DNA, 13 bp, Homo sapiens
ctgcagaggccag

SEQ ID NO: 5605277 - DNA, 20 bp, Homo sapiens
ctgcagaggccagaggcccc

SEQ ID NO: 5605278 - DNA, 10 bp, Homo sapiens
ctgcagaggg

SEQ ID NO: 5605279 - DNA, 12 bp, Homo sapiens
ctgcagagggac

SEQ ID NO: 5605280 - DNA, 15 bp, Homo sapiens
ctgcagagggagacg

SEQ ID NO: 5605281 - DNA, 20 bp, Homo sapiens
ctgcagagggagacggccct

SEQ ID NO: 5605282 - DNA, 22 bp, Homo sapiens
ctgcagagggagacggccctgc

SEQ ID NO: 5605283 - DNA, 20 bp, Homo sapiens
ctgcagagggctccagagtg

SEQ ID NO: 5605284 - DNA, 21 bp, Homo sapiens
ctgcagaggggaaaccagtgt

SEQ ID NO: 5605285 - DNA, 15 bp, Homo sapiens
ctgcagaggggcagg

SEQ ID NO: 5605286 - DNA, 17 bp, Homo sapiens
ctgcagaggggcaggcc

SEQ ID NO: 5605287 - DNA, 22 bp, Homo sapiens
ctgcagaggggcaggccctgca

SEQ ID NO: 5605288 - DNA, 22 bp, Homo sapiens
ctgcagagggttaggagtgggt

SEQ ID NO: 5605289 - DNA, 19 bp, Homo sapiens
ctgcagaggtctgtgctga

SEQ ID NO: 5605290 - DNA, 21 bp, Homo sapiens
ctgcagaggtctgtgctgagg

SEQ ID NO: 5605291 - DNA, 22 bp, Homo sapiens
ctgcagaggtctgtgctgaggc

SEQ ID NO: 5605292 - DNA, 14 bp, Homo sapiens
ctgcagagtagtta

SEQ ID NO: 5605293 - DNA, 13 bp, Homo sapiens
ctgcagagtggtg

SEQ ID NO: 5605294 - DNA, 22 bp, Homo sapiens
ctgcagagttctcctggaggca

SEQ ID NO: 5605295 - DNA, 14 bp, Homo sapiens
ctgcagagtttgga

SEQ ID NO: 5605296 - DNA, 15 bp, Homo sapiens
ctgcagatagcccag

SEQ ID NO: 5605297 - DNA, 18 bp, Homo sapiens
ctgcagatagcccaggag

SEQ ID NO: 5605298 - DNA, 14 bp, Homo sapiens
ctgcagatcccgca

SEQ ID NO: 5605299 - DNA, 19 bp, Homo sapiens
ctgcagatcttccgtggtc

SEQ ID NO: 5605300 - DNA, 16 bp, Homo sapiens
ctgcagatgccaccct

SEQ ID NO: 5605301 - DNA, 21 bp, Homo sapiens
ctgcagatgtgcggagcggga

SEQ ID NO: 5605302 - DNA, 18 bp, Homo sapiens
ctgcagcaaacactccac

SEQ ID NO: 5605303 - DNA, 13 bp, Homo sapiens
ctgcagcaactcc

SEQ ID NO: 5605304 - DNA, 15 bp, Homo sapiens
ctgcagcaactccca

SEQ ID NO: 5605305 - DNA, 16 bp, Homo sapiens
ctgcagcaactcccac

SEQ ID NO: 5605306 - DNA, 17 bp, Homo sapiens
ctgcagcaactcccacg

SEQ ID NO: 5605307 - DNA, 17 bp, Homo sapiens
ctgcagcacaggaggct

SEQ ID NO: 5605308 - DNA, 21 bp, Homo sapiens
ctgcagcacatgcgggctcgc

SEQ ID NO: 5605309 - DNA, 21 bp, Homo sapiens
ctgcagcacattgccctgagg

SEQ ID NO: 5605310 - DNA, 15 bp, Homo sapiens
ctgcagcacctcacc

SEQ ID NO: 5605311 - DNA, 17 bp, Homo sapiens
ctgcagcacctcacctg

SEQ ID NO: 5605312 - DNA, 14 bp, Homo sapiens
ctgcagcacctcca

SEQ ID NO: 5605313 - DNA, 18 bp, Homo sapiens
ctgcagcacgcggccttg

SEQ ID NO: 5605314 - DNA, 19 bp, Homo sapiens
ctgcagcacgcggccttgt

SEQ ID NO: 5605315 - DNA, 12 bp, Homo sapiens
ctgcagcacttt

SEQ ID NO: 5605316 - DNA, 19 bp, Homo sapiens
ctgcagcactttaaccctc

SEQ ID NO: 5605317 - DNA, 15 bp, Homo sapiens
ctgcagcagaaaaca

SEQ ID NO: 5605318 - DNA, 14 bp, Homo sapiens
ctgcagcagagcct

SEQ ID NO: 5605319 - DNA, 14 bp, Homo sapiens
ctgcagcagagtga

SEQ ID NO: 5605320 - DNA, 22 bp, Homo sapiens
ctgcagcagccggaatagagcc

SEQ ID NO: 5605321 - DNA, 19 bp, Homo sapiens
ctgcagcagcggtggcctc

SEQ ID NO: 5605322 - DNA, 18 bp, Homo sapiens
ctgcagcaggaactctgg

SEQ ID NO: 5605323 - DNA, 13 bp, Homo sapiens
ctgcagcaggcag

SEQ ID NO: 5605324 - DNA, 18 bp, Homo sapiens
ctgcagcaggcagaggag

SEQ ID NO: 5605325 - DNA, 19 bp, Homo sapiens
ctgcagcaggcagaggaga

SEQ ID NO: 5605326 - DNA, 21 bp, Homo sapiens
ctgcagcaggcagaggagagt

SEQ ID NO: 5605327 - DNA, 14 bp, Homo sapiens
ctgcagcaggcagc

SEQ ID NO: 5605328 - DNA, 14 bp, Homo sapiens
ctgcagcagggcag

SEQ ID NO: 5605329 - DNA, 17 bp, Homo sapiens
ctgcagcaggtgctggg

SEQ ID NO: 5605330 - DNA, 18 bp, Homo sapiens
ctgcagcaggtgctgggc

SEQ ID NO: 5605331 - DNA, 19 bp, Homo sapiens
ctgcagcaggtgctgggct

SEQ ID NO: 5605332 - DNA, 22 bp, Homo sapiens
ctgcagcaggtgctgggctgga

SEQ ID NO: 5605333 - DNA, 11 bp, Homo sapiens
ctgcagcatga

SEQ ID NO: 5605334 - DNA, 15 bp, Homo sapiens
ctgcagcatgaaggc

SEQ ID NO: 5605335 - DNA, 22 bp, Homo sapiens
ctgcagcatgacctgtgaccag

SEQ ID NO: 5605336 - DNA, 22 bp, Homo sapiens
ctgcagcatgttgctgaggagt

SEQ ID NO: 5605337 - DNA, 22 bp, Homo sapiens
ctgcagccaaacagagccttca

SEQ ID NO: 5605338 - DNA, 19 bp, Homo sapiens
ctgcagccaagcaaatgcc

SEQ ID NO: 5605339 - DNA, 20 bp, Homo sapiens
ctgcagccaagcaaatgcct

SEQ ID NO: 5605340 - DNA, 15 bp, Homo sapiens
ctgcagccacatggg

SEQ ID NO: 5605341 - DNA, 16 bp, Homo sapiens
ctgcagccacatggga

SEQ ID NO: 5605342 - DNA, 12 bp, Homo sapiens
ctgcagccacca

SEQ ID NO: 5605343 - DNA, 16 bp, Homo sapiens
ctgcagccagaaagga

SEQ ID NO: 5605344 - DNA, 22 bp, Homo sapiens
ctgcagccagcagttgtaaaat

SEQ ID NO: 5605345 - DNA, 15 bp, Homo sapiens
ctgcagccagcccag

SEQ ID NO: 5605346 - DNA, 16 bp, Homo sapiens
ctgcagccagcccagc

SEQ ID NO: 5605347 - DNA, 12 bp, Homo sapiens
ctgcagccagct

SEQ ID NO: 5605348 - DNA, 13 bp, Homo sapiens
ctgcagccaggcc

SEQ ID NO: 5605349 - DNA, 16 bp, Homo sapiens
ctgcagccaggccact

SEQ ID NO: 5605350 - DNA, 14 bp, Homo sapiens
ctgcagccaggcct

SEQ ID NO: 5605351 - DNA, 18 bp, Homo sapiens
ctgcagccaggcctcgcc

SEQ ID NO: 5605352 - DNA, 19 bp, Homo sapiens
ctgcagccaggcctcgcct

SEQ ID NO: 5605353 - DNA, 12 bp, Homo sapiens
ctgcagccaggg

SEQ ID NO: 5605354 - DNA, 19 bp, Homo sapiens
ctgcagccagtcaggcagg

SEQ ID NO: 5605355 - DNA, 19 bp, Homo sapiens
ctgcagccatcccaaggct

SEQ ID NO: 5605356 - DNA, 14 bp, Homo sapiens
ctgcagccatcccg

SEQ ID NO: 5605357 - DNA, 19 bp, Homo sapiens
ctgcagcccacagaggaca

SEQ ID NO: 5605358 - DNA, 20 bp, Homo sapiens
ctgcagcccacagaggacag

SEQ ID NO: 5605359 - DNA, 21 bp, Homo sapiens
ctgcagcccacagaggacagt

SEQ ID NO: 5605360 - DNA, 14 bp, Homo sapiens
ctgcagcccagcct

SEQ ID NO: 5605361 - DNA, 17 bp, Homo sapiens
ctgcagcccctaagtgc

SEQ ID NO: 5605362 - DNA, 23 bp, Homo sapiens
ctgcagcccctaagtgcaaacac

SEQ ID NO: 5605363 - DNA, 15 bp, Homo sapiens
ctgcagcccctggga

SEQ ID NO: 5605364 - DNA, 18 bp, Homo sapiens
ctgcagcccgatgtccct

SEQ ID NO: 5605365 - DNA, 14 bp, Homo sapiens
ctgcagccctgcca

SEQ ID NO: 5605366 - DNA, 15 bp, Homo sapiens
ctgcagccctgccag

SEQ ID NO: 5605367 - DNA, 17 bp, Homo sapiens
ctgcagcccttgggcag

SEQ ID NO: 5605368 - DNA, 18 bp, Homo sapiens
ctgcagccgtgcaggact

SEQ ID NO: 5605369 - DNA, 19 bp, Homo sapiens
ctgcagccgtgcaggactc

SEQ ID NO: 5605370 - DNA, 24 bp, Homo sapiens
ctgcagcctcaacctcctgggcta

SEQ ID NO: 5605371 - DNA, 14 bp, Homo sapiens
ctgcagcctcagag

SEQ ID NO: 5605372 - DNA, 17 bp, Homo sapiens
ctgcagcctcaggactg

SEQ ID NO: 5605373 - DNA, 21 bp, Homo sapiens
ctgcagcctcaggactgggag

SEQ ID NO: 5605374 - DNA, 15 bp, Homo sapiens
ctgcagcctcatact

SEQ ID NO: 5605375 - DNA, 23 bp, Homo sapiens
ctgcagcctcatactcctgggct

SEQ ID NO: 5605376 - DNA, 12 bp, Homo sapiens
ctgcagcctcca

SEQ ID NO: 5605377 - DNA, 17 bp, Homo sapiens
ctgcagcctcccccaca

SEQ ID NO: 5605378 - DNA, 18 bp, Homo sapiens
ctgcagcctcccttccat

SEQ ID NO: 5605379 - DNA, 19 bp, Homo sapiens
ctgcagcctccgcctcccg

SEQ ID NO: 5605380 - DNA, 20 bp, Homo sapiens
ctgcagcctccgcttccctg

SEQ ID NO: 5605381 - DNA, 11 bp, Homo sapiens
ctgcagcctcg

SEQ ID NO: 5605382 - DNA, 20 bp, Homo sapiens
ctgcagcctcgaactcctgg

SEQ ID NO: 5605383 - DNA, 14 bp, Homo sapiens
ctgcatctactcag

SEQ ID NO: 5605384 - DNA, 15 bp, Homo sapiens
ctgcatctactccca

SEQ ID NO: 5605385 - DNA, 21 bp, Homo sapiens
ctgcatctagaggcttccttc

SEQ ID NO: 5605386 - DNA, 16 bp, Homo sapiens
ctgcatctagctggag

SEQ ID NO: 5605387 - DNA, 16 bp, Homo sapiens
ctgcatctcaagatgt

SEQ ID NO: 5605388 - DNA, 20 bp, Homo sapiens
ctgcatctcaagatgtttat

SEQ ID NO: 5605389 - DNA, 18 bp, Homo sapiens
ctgcatctgaccagcagc

SEQ ID NO: 5605390 - DNA, 14 bp, Homo sapiens
ctgcatctggggcc

SEQ ID NO: 5605391 - DNA, 14 bp, Homo sapiens
ctgcatctgtctgc

SEQ ID NO: 5605392 - DNA, 15 bp, Homo sapiens
ctgcatctgtctgct

SEQ ID NO: 5605393 - DNA, 17 bp, Homo sapiens
ctgcatctgtctgctct

SEQ ID NO: 5605394 - DNA, 21 bp, Homo sapiens
ctgcatctgtctgctctgcat

SEQ ID NO: 5605395 - DNA, 13 bp, Homo sapiens
ctgcatcttcttg

SEQ ID NO: 5605396 - DNA, 13 bp, Homo sapiens
ctgcatcttgggg

SEQ ID NO: 5605397 - DNA, 19 bp, Homo sapiens
ctgcatctttcatagttct

SEQ ID NO: 5605398 - DNA, 21 bp, Homo sapiens
ctgcatctttcatagttctgt

SEQ ID NO: 5605399 - DNA, 23 bp, Homo sapiens
ctgcatctttcatagttctgtta

SEQ ID NO: 5605400 - DNA, 19 bp, Homo sapiens
ctgcatctttctcttccca

SEQ ID NO: 5605401 - DNA, 13 bp, Homo sapiens
ctgcatgaaaaat

SEQ ID NO: 5605402 - DNA, 22 bp, Homo sapiens
ctgcatgaccaaagtgataaat

SEQ ID NO: 5605403 - DNA, 14 bp, Homo sapiens
ctgcatgagctggc

SEQ ID NO: 5605404 - DNA, 20 bp, Homo sapiens
ctgcatgatcttacacgaag

SEQ ID NO: 5605405 - DNA, 13 bp, Homo sapiens
ctgcatgatgttt

SEQ ID NO: 5605406 - DNA, 15 bp, Homo sapiens
ctgcatgatgtttgc

SEQ ID NO: 5605407 - DNA, 14 bp, Homo sapiens
ctgcatgcagcaac

SEQ ID NO: 5605408 - DNA, 18 bp, Homo sapiens
ctgcatgcagcaacaccc

SEQ ID NO: 5605409 - DNA, 14 bp, Homo sapiens
ctgcatgcccagag

SEQ ID NO: 5605410 - DNA, 17 bp, Homo sapiens
ctgcatgcccagagacc

SEQ ID NO: 5605411 - DNA, 22 bp, Homo sapiens
ctgcatgcccagagacccagcg

SEQ ID NO: 5605412 - DNA, 20 bp, Homo sapiens
ctgcatgccctccccacttc

SEQ ID NO: 5605413 - DNA, 17 bp, Homo sapiens
ctgcatgccctctcagg

SEQ ID NO: 5605414 - DNA, 20 bp, Homo sapiens
ctgcatgccctctcaggccg

SEQ ID NO: 5605415 - DNA, 19 bp, Homo sapiens
ctgcatgcctggcccctcc

SEQ ID NO: 5605416 - DNA, 18 bp, Homo sapiens
ctgcatgcgacagcgtcc

SEQ ID NO: 5605417 - DNA, 15 bp, Homo sapiens
ctgcatgcggcccag

SEQ ID NO: 5605418 - DNA, 21 bp, Homo sapiens
ctgcatgcggcccagcccggc

SEQ ID NO: 5605419 - DNA, 20 bp, Homo sapiens
ctgcatgctcctctgcctgt

SEQ ID NO: 5605420 - DNA, 21 bp, Homo sapiens
ctgcatgctctggaagcctgg

SEQ ID NO: 5605421 - DNA, 15 bp, Homo sapiens
ctgcatgctgaaaca

SEQ ID NO: 5605422 - DNA, 13 bp, Homo sapiens
ctgcatggacagt

SEQ ID NO: 5605423 - DNA, 12 bp, Homo sapiens
ctgcatggacct

SEQ ID NO: 5605424 - DNA, 22 bp, Homo sapiens
ctgcatggacctaacattcgat

SEQ ID NO: 5605425 - DNA, 15 bp, Homo sapiens
ctgcatggacgcctg

SEQ ID NO: 5605426 - DNA, 18 bp, Homo sapiens
ctgcatggacgcctggct

SEQ ID NO: 5605427 - DNA, 19 bp, Homo sapiens
ctgcatggacgcctggctc

SEQ ID NO: 5605428 - DNA, 23 bp, Homo sapiens
ctgcatggacgcctggctccagg

SEQ ID NO: 5605429 - DNA, 15 bp, Homo sapiens
ctgcatggattcagc

SEQ ID NO: 5605430 - DNA, 15 bp, Homo sapiens
ctgcatggcagaagc

SEQ ID NO: 5605431 - DNA, 13 bp, Homo sapiens
ctgcatggcaggg

SEQ ID NO: 5605432 - DNA, 14 bp, Homo sapiens
ctgcatggcagggg

SEQ ID NO: 5605433 - DNA, 17 bp, Homo sapiens
ctgcatggcagggggct

SEQ ID NO: 5605434 - DNA, 23 bp, Homo sapiens
ctgcatggcagggggctgctgct

SEQ ID NO: 5605435 - DNA, 16 bp, Homo sapiens
ctgcatggcatcctcc

SEQ ID NO: 5605436 - DNA, 18 bp, Homo sapiens
ctgcatggcatcctccag

SEQ ID NO: 5605437 - DNA, 16 bp, Homo sapiens
ctgcatgggccagccc

SEQ ID NO: 5605438 - DNA, 17 bp, Homo sapiens
ctgcatgggccagcccc

SEQ ID NO: 5605439 - DNA, 14 bp, Homo sapiens
ctgcatggggaggc

SEQ ID NO: 5605440 - DNA, 20 bp, Homo sapiens
ctgcatgggttaattgagaa

SEQ ID NO: 5605441 - DNA, 15 bp, Homo sapiens
ctgcatggtaattta

SEQ ID NO: 5605442 - DNA, 16 bp, Homo sapiens
ctgcatggtaatttat

SEQ ID NO: 5605443 - DNA, 17 bp, Homo sapiens
ctgcatggtaatttata

SEQ ID NO: 5605444 - DNA, 20 bp, Homo sapiens
ctgcatggtagggagagaca

SEQ ID NO: 5605445 - DNA, 17 bp, Homo sapiens
ctgcatggtcaagcctc

SEQ ID NO: 5605446 - DNA, 18 bp, Homo sapiens
ctgcatggtcaagcctct

SEQ ID NO: 5605447 - DNA, 23 bp, Homo sapiens
ctgcatggtgtttatgcacacag

SEQ ID NO: 5605448 - DNA, 18 bp, Homo sapiens
ctgcatgtaaaatcttca

SEQ ID NO: 5605449 - DNA, 20 bp, Homo sapiens
ctgcatgtaaaatcttcagc

SEQ ID NO: 5605450 - DNA, 12 bp, Homo sapiens
ctgcatgtacta

SEQ ID NO: 5605451 - DNA, 20 bp, Homo sapiens
ctgcatgtatgccatgtatg

SEQ ID NO: 5605452 - DNA, 21 bp, Homo sapiens
ctgcatgtatgccatgtatgt

SEQ ID NO: 5605453 - DNA, 15 bp, Homo sapiens
ctgcatgtcggggcc

SEQ ID NO: 5605454 - DNA, 20 bp, Homo sapiens
ctgcatgtcggggcccctgc

SEQ ID NO: 5605455 - DNA, 21 bp, Homo sapiens
ctgcatgtcggggcccctgcg

SEQ ID NO: 5605456 - DNA, 15 bp, Homo sapiens
ctgcatgtggcttct

SEQ ID NO: 5605457 - DNA, 22 bp, Homo sapiens
ctgcatgtggcttctctgtctc

SEQ ID NO: 5605458 - DNA, 24 bp, Homo sapiens
ctgcatgtggcttctctgtctctg

SEQ ID NO: 5605459 - DNA, 21 bp, Homo sapiens
ctgcatgtggcttttttaaaa

SEQ ID NO: 5605460 - DNA, 22 bp, Homo sapiens
ctgcatgtggcttttttaaaaa

SEQ ID NO: 5605461 - DNA, 14 bp, Homo sapiens
ctgcatgtgtatat

SEQ ID NO: 5605462 - DNA, 22 bp, Homo sapiens
ctgcatgtgtcatgaagaatgt

SEQ ID NO: 5605463 - DNA, 18 bp, Homo sapiens
ctgcatgttcctggacac

SEQ ID NO: 5605464 - DNA, 14 bp, Homo sapiens
ctgcatgttttcca

SEQ ID NO: 5605465 - DNA, 21 bp, Homo sapiens
ctgcattaccgcgttgtaaaa

SEQ ID NO: 5605466 - DNA, 14 bp, Homo sapiens
ctgcattagaaaaa

SEQ ID NO: 5605467 - DNA, 15 bp, Homo sapiens
ctgcattagaaatga

SEQ ID NO: 5605468 - DNA, 22 bp, Homo sapiens
ctgcattcacagcgcctcctgg

SEQ ID NO: 5605469 - DNA, 23 bp, Homo sapiens
ctgcattcacagcgcctcctgga

SEQ ID NO: 5605470 - DNA, 20 bp, Homo sapiens
ctgcattcacccagacagct

SEQ ID NO: 5605471 - DNA, 19 bp, Homo sapiens
ctgcattcattctgagccc

SEQ ID NO: 5605472 - DNA, 12 bp, Homo sapiens
ctgcattccgca

SEQ ID NO: 5605473 - DNA, 13 bp, Homo sapiens
ctgcattccgcag

SEQ ID NO: 5605474 - DNA, 13 bp, Homo sapiens
ctgcattcctgta

SEQ ID NO: 5605475 - DNA, 21 bp, Homo sapiens
ctgcattcctgtaacttttaa

SEQ ID NO: 5605476 - DNA, 19 bp, Homo sapiens
ctgcattcctttttcttca

SEQ ID NO: 5605477 - DNA, 16 bp, Homo sapiens
ctgcattcgcagcagc

SEQ ID NO: 5605478 - DNA, 14 bp, Homo sapiens
ctgcattctctccc

SEQ ID NO: 5605479 - DNA, 20 bp, Homo sapiens
ctgcattcttaacaaactct

SEQ ID NO: 5605480 - DNA, 14 bp, Homo sapiens
ctgcattctttctg

SEQ ID NO: 5605481 - DNA, 18 bp, Homo sapiens
ctgcattgaaaagagctg

SEQ ID NO: 5605482 - DNA, 14 bp, Homo sapiens
ctgcattgacctgg

SEQ ID NO: 5605483 - DNA, 15 bp, Homo sapiens
ctgcattgacctgga

SEQ ID NO: 5605484 - DNA, 16 bp, Homo sapiens
ctgcattgacctggag

SEQ ID NO: 5605485 - DNA, 20 bp, Homo sapiens
ctgcattgacctggagggga

SEQ ID NO: 5605486 - DNA, 16 bp, Homo sapiens
ctgcattgagtccagc

SEQ ID NO: 5605487 - DNA, 17 bp, Homo sapiens
ctgcattgagtccagct

SEQ ID NO: 5605488 - DNA, 17 bp, Homo sapiens
ctgcattgcccagtctt

SEQ ID NO: 5605489 - DNA, 22 bp, Homo sapiens
ctgcattgcctgcggtcaaggc

SEQ ID NO: 5605490 - DNA, 23 bp, Homo sapiens
ctgcattgcctgcggtcaaggcc

SEQ ID NO: 5605491 - DNA, 17 bp, Homo sapiens
ctgcattgctagataaa

SEQ ID NO: 5605492 - DNA, 19 bp, Homo sapiens
ctgcattgctagataaaag

SEQ ID NO: 5605493 - DNA, 16 bp, Homo sapiens
ctgcattggaactgga

SEQ ID NO: 5605494 - DNA, 22 bp, Homo sapiens
ctgcattggaactggaggcagg

SEQ ID NO: 5605495 - DNA, 13 bp, Homo sapiens
ctgcattggcctg

SEQ ID NO: 5605496 - DNA, 14 bp, Homo sapiens
ctgcattggcctgg

SEQ ID NO: 5605497 - DNA, 18 bp, Homo sapiens
ctgcattggcctggcctc

SEQ ID NO: 5605498 - DNA, 19 bp, Homo sapiens
ctgcattggcctggcctcc

SEQ ID NO: 5605499 - DNA, 20 bp, Homo sapiens
ctgcattggcctggcctcca

SEQ ID NO: 5605500 - DNA, 18 bp, Homo sapiens
ctgcattgggtgatcatt

SEQ ID NO: 5605501 - DNA, 20 bp, Homo sapiens
ctgcattgttattgtggaag

SEQ ID NO: 5605502 - DNA, 20 bp, Homo sapiens
ctgcatttaaaagatacagt

SEQ ID NO: 5605503 - DNA, 23 bp, Homo sapiens
ctgcatttaaatttgatttccat

SEQ ID NO: 5605504 - DNA, 18 bp, Homo sapiens
ctgcatttaagaacagaa

SEQ ID NO: 5605505 - DNA, 13 bp, Homo sapiens
ctgcatttagcac

SEQ ID NO: 5605506 - DNA, 22 bp, Homo sapiens
ctgcatttagggagtattctaa

SEQ ID NO: 5605507 - DNA, 19 bp, Homo sapiens
ctgcatttataaagaccgt

SEQ ID NO: 5605508 - DNA, 16 bp, Homo sapiens
ctgcatttataaatgt

SEQ ID NO: 5605509 - DNA, 22 bp, Homo sapiens
ctgcatttattagtattctaat

SEQ ID NO: 5605510 - DNA, 18 bp, Homo sapiens
ctgcatttcacatgcctt

SEQ ID NO: 5605511 - DNA, 21 bp, Homo sapiens
ctgcatttcacatgccttgca

SEQ ID NO: 5605512 - DNA, 16 bp, Homo sapiens
ctgcatttcatattat

SEQ ID NO: 5605513 - DNA, 19 bp, Homo sapiens
ctgcatttcctcgcagcct

SEQ ID NO: 5605514 - DNA, 11 bp, Homo sapiens
ctgcatttctc

SEQ ID NO: 5605515 - DNA, 15 bp, Homo sapiens
ctgcatttgatagca

SEQ ID NO: 5605516 - DNA, 18 bp, Homo sapiens
ctgcatttgcctgcttct

SEQ ID NO: 5605517 - DNA, 19 bp, Homo sapiens
ctgcatttgcctgcttctt

SEQ ID NO: 5605518 - DNA, 22 bp, Homo sapiens
ctgcatttgcctgcttctttcc

SEQ ID NO: 5605519 - DNA, 14 bp, Homo sapiens
ctgcatttggctgg

SEQ ID NO: 5605520 - DNA, 18 bp, Homo sapiens
ctgcatttggctggagcc

SEQ ID NO: 5605521 - DNA, 21 bp, Homo sapiens
ctgcattttaacaagcacccc

SEQ ID NO: 5605522 - DNA, 17 bp, Homo sapiens
ctgcattttaagcataa

SEQ ID NO: 5605523 - DNA, 20 bp, Homo sapiens
ctgcattttaattttaacca

SEQ ID NO: 5605524 - DNA, 23 bp, Homo sapiens
ctgcattttacgtctttggagga

SEQ ID NO: 5605525 - DNA, 14 bp, Homo sapiens
ctgcattttcctct

SEQ ID NO: 5605526 - DNA, 21 bp, Homo sapiens
ctgcattttcctcttgtcctg

SEQ ID NO: 5605527 - DNA, 17 bp, Homo sapiens
ctgcattttcttcactt

SEQ ID NO: 5605528 - DNA, 23 bp, Homo sapiens
ctgcatttttaaaggacaaacag

SEQ ID NO: 5605529 - DNA, 17 bp, Homo sapiens
ctgcattttttactttt

SEQ ID NO: 5605530 - DNA, 19 bp, Homo sapiens
ctgccaaaaatagaaagtg

SEQ ID NO: 5605531 - DNA, 18 bp, Homo sapiens
ctgccaaaaccacatggg

SEQ ID NO: 5605532 - DNA, 23 bp, Homo sapiens
ctgccaaaaccacatgggctggg

SEQ ID NO: 5605533 - DNA, 22 bp, Homo sapiens
ctgccaaaatgctctagtgcct

SEQ ID NO: 5605534 - DNA, 13 bp, Homo sapiens
ctgccaaacacat

SEQ ID NO: 5605535 - DNA, 17 bp, Homo sapiens
ctgccaaagtagtcctg

SEQ ID NO: 5605536 - DNA, 21 bp, Homo sapiens
ctgccaaataaaatgtttaca

SEQ ID NO: 5605537 - DNA, 16 bp, Homo sapiens
ctgccaaataaacagc

SEQ ID NO: 5605538 - DNA, 22 bp, Homo sapiens
ctgccaaatgctatactgtgtc

SEQ ID NO: 5605539 - DNA, 17 bp, Homo sapiens
ctgccaacatactttaa

SEQ ID NO: 5605540 - DNA, 17 bp, Homo sapiens
ctgccaacatgaggaca

SEQ ID NO: 5605541 - DNA, 19 bp, Homo sapiens
ctgccaacatgaggacaga

SEQ ID NO: 5605542 - DNA, 20 bp, Homo sapiens
ctgccaacatgaggacagaa

SEQ ID NO: 5605543 - DNA, 22 bp, Homo sapiens
ctgccaacatgaggacagaagg

SEQ ID NO: 5605544 - DNA, 24 bp, Homo sapiens
ctgccaacatgaggacagaaggac

SEQ ID NO: 5605545 - DNA, 17 bp, Homo sapiens
ctgccaacctcgctcca

SEQ ID NO: 5605546 - DNA, 17 bp, Homo sapiens
ctgccaactccatgacc

SEQ ID NO: 5605547 - DNA, 22 bp, Homo sapiens
ctgccaactccatgaccaggcc

SEQ ID NO: 5605548 - DNA, 23 bp, Homo sapiens
ctgccaactccatgaccaggcca

SEQ ID NO: 5605549 - DNA, 19 bp, Homo sapiens
ctgccaactgatctgttat

SEQ ID NO: 5605550 - DNA, 21 bp, Homo sapiens
ctgccaacttcttcagagctg

SEQ ID NO: 5605551 - DNA, 14 bp, Homo sapiens
ctgccaactttcca

SEQ ID NO: 5605552 - DNA, 15 bp, Homo sapiens
ctgccaactttccag

SEQ ID NO: 5605553 - DNA, 16 bp, Homo sapiens
ctgccaactttccaga

SEQ ID NO: 5605554 - DNA, 19 bp, Homo sapiens
ctgccaagactcctcaggc

SEQ ID NO: 5605555 - DNA, 20 bp, Homo sapiens
ctgccaagactgctgtggcc

SEQ ID NO: 5605556 - DNA, 15 bp, Homo sapiens
ctgccaagagtccaa

SEQ ID NO: 5605557 - DNA, 18 bp, Homo sapiens
ctgccaagagtccaagcc

SEQ ID NO: 5605558 - DNA, 17 bp, Homo sapiens
ctgccaagccagattct

SEQ ID NO: 5605559 - DNA, 13 bp, Homo sapiens
ctgcccatgccta

SEQ ID NO: 5605560 - DNA, 16 bp, Homo sapiens
ctgcccatggacaggc

SEQ ID NO: 5605561 - DNA, 20 bp, Homo sapiens
ctgcccatggacaggctggc

SEQ ID NO: 5605562 - DNA, 22 bp, Homo sapiens
ctgcccatgtgtcccctcactc

SEQ ID NO: 5605563 - DNA, 15 bp, Homo sapiens
ctgcccattccccag

SEQ ID NO: 5605564 - DNA, 19 bp, Homo sapiens
ctgcccattctgccctgtg

SEQ ID NO: 5605565 - DNA, 21 bp, Homo sapiens
ctgccccaaataacttcagtc

SEQ ID NO: 5605566 - DNA, 21 bp, Homo sapiens
ctgccccaactcctggaagct

SEQ ID NO: 5605567 - DNA, 22 bp, Homo sapiens
ctgccccaactccttccagcta

SEQ ID NO: 5605568 - DNA, 16 bp, Homo sapiens
ctgccccaactgcagg

SEQ ID NO: 5605569 - DNA, 17 bp, Homo sapiens
ctgccccaagcagccag

SEQ ID NO: 5605570 - DNA, 20 bp, Homo sapiens
ctgccccaagcagccagcca

SEQ ID NO: 5605571 - DNA, 19 bp, Homo sapiens
ctgccccaaggccccaggg

SEQ ID NO: 5605572 - DNA, 20 bp, Homo sapiens
ctgccccaagggcccagacc

SEQ ID NO: 5605573 - DNA, 15 bp, Homo sapiens
ctgccccaagttttg

SEQ ID NO: 5605574 - DNA, 19 bp, Homo sapiens
ctgccccaatcgggtccag

SEQ ID NO: 5605575 - DNA, 20 bp, Homo sapiens
ctgccccaatcgggtccaga

SEQ ID NO: 5605576 - DNA, 22 bp, Homo sapiens
ctgccccaatcgggtccagaga

SEQ ID NO: 5605577 - DNA, 16 bp, Homo sapiens
ctgccccacacaggcc

SEQ ID NO: 5605578 - DNA, 21 bp, Homo sapiens
ctgccccacacaggcctggcc

SEQ ID NO: 5605579 - DNA, 22 bp, Homo sapiens
ctgccccacacctcctctcact

SEQ ID NO: 5605580 - DNA, 21 bp, Homo sapiens
ctgccccacacggactcccgg

SEQ ID NO: 5605581 - DNA, 22 bp, Homo sapiens
ctgccccacacggactcccggg

SEQ ID NO: 5605582 - DNA, 12 bp, Homo sapiens
ctgccccacact

SEQ ID NO: 5605583 - DNA, 14 bp, Homo sapiens
ctgccccacactcc

SEQ ID NO: 5605584 - DNA, 13 bp, Homo sapiens
ctgccccacaggc

SEQ ID NO: 5605585 - DNA, 15 bp, Homo sapiens
ctgccccacaggcca

SEQ ID NO: 5605586 - DNA, 21 bp, Homo sapiens
ctgccccacaggccacacgct

SEQ ID NO: 5605587 - DNA, 15 bp, Homo sapiens
ctgccccacatgcat

SEQ ID NO: 5605588 - DNA, 21 bp, Homo sapiens
ctgccccacatgtggccatgg

SEQ ID NO: 5605589 - DNA, 22 bp, Homo sapiens
ctgccccaccacgcatgctcag

SEQ ID NO: 5605590 - DNA, 15 bp, Homo sapiens
ctgccccaccagcca

SEQ ID NO: 5605591 - DNA, 11 bp, Homo sapiens
ctgccccaccc

SEQ ID NO: 5605592 - DNA, 12 bp, Homo sapiens
ctgccccaccca

SEQ ID NO: 5605593 - DNA, 20 bp, Homo sapiens
ctgccccacccaactccaca

SEQ ID NO: 5605594 - DNA, 21 bp, Homo sapiens
ctgccccacccaactccacag

SEQ ID NO: 5605595 - DNA, 16 bp, Homo sapiens
ctgccccacccacccc

SEQ ID NO: 5605596 - DNA, 17 bp, Homo sapiens
ctgccccacccacccca

SEQ ID NO: 5605597 - DNA, 17 bp, Homo sapiens
ctgccccaccccacctc

SEQ ID NO: 5605598 - DNA, 17 bp, Homo sapiens
ctgccccacccctccat

SEQ ID NO: 5605599 - DNA, 18 bp, Homo sapiens
ctgccccacccctccatg

SEQ ID NO: 5605600 - DNA, 15 bp, Homo sapiens
ctgccccaccctaac

SEQ ID NO: 5605601 - DNA, 14 bp, Homo sapiens
ctgccccacctgcc

SEQ ID NO: 5605602 - DNA, 21 bp, Homo sapiens
ctgccccaccttgccagggca

SEQ ID NO: 5605603 - DNA, 20 bp, Homo sapiens
ctgccccacttgtccttagc

SEQ ID NO: 5605604 - DNA, 21 bp, Homo sapiens
ctgccccacttgtccttagcc

SEQ ID NO: 5605605 - DNA, 12 bp, Homo sapiens
ctgccccagaga

SEQ ID NO: 5605606 - DNA, 15 bp, Homo sapiens
ctgccccagagaagc

SEQ ID NO: 5605607 - DNA, 23 bp, Homo sapiens
ctgccccagagaagcctcagtcc

SEQ ID NO: 5605608 - DNA, 23 bp, Homo sapiens
ctgccccagaggtcgcagctacc

SEQ ID NO: 5605609 - DNA, 13 bp, Homo sapiens
ctgccccagccag

SEQ ID NO: 5605610 - DNA, 14 bp, Homo sapiens
ctgccccagccaga

SEQ ID NO: 5605611 - DNA, 13 bp, Homo sapiens
ctgccccagccca

SEQ ID NO: 5605612 - DNA, 16 bp, Homo sapiens
ctgccccagcccaagt

SEQ ID NO: 5605613 - DNA, 17 bp, Homo sapiens
ctgccccagcccaagtc

SEQ ID NO: 5605614 - DNA, 15 bp, Homo sapiens
ctgccccagcccaga

SEQ ID NO: 5605615 - DNA, 16 bp, Homo sapiens
ctgccccagcccagat

SEQ ID NO: 5605616 - DNA, 14 bp, Homo sapiens
ctgccccagccccg

SEQ ID NO: 5605617 - DNA, 13 bp, Homo sapiens
ctgccccagcgcg

SEQ ID NO: 5605618 - DNA, 19 bp, Homo sapiens
ctgccccagctactaaggt

SEQ ID NO: 5605619 - DNA, 22 bp, Homo sapiens
ctgccccagctctcttctggct

SEQ ID NO: 5605620 - DNA, 23 bp, Homo sapiens
ctgccccagctctcttctggctt

SEQ ID NO: 5605621 - DNA, 15 bp, Homo sapiens
ctgccccagctctgg

SEQ ID NO: 5605622 - DNA, 19 bp, Homo sapiens
ctgccccagctctggcttc

SEQ ID NO: 5605623 - DNA, 16 bp, Homo sapiens
ctgccccagctgactg

SEQ ID NO: 5605624 - DNA, 17 bp, Homo sapiens
ctgccccagctgggctg

SEQ ID NO: 5605625 - DNA, 18 bp, Homo sapiens
ctgccccagctgggctgt

SEQ ID NO: 5605626 - DNA, 24 bp, Homo sapiens
ctgccccagctttatctgtcacac

SEQ ID NO: 5605627 - DNA, 22 bp, Homo sapiens
ctgccccaggccggagcccaga

SEQ ID NO: 5605628 - DNA, 15 bp, Homo sapiens
ctgccccaggcctgg

SEQ ID NO: 5605629 - DNA, 19 bp, Homo sapiens
ctgccccaggcctggacgg

SEQ ID NO: 5605630 - DNA, 22 bp, Homo sapiens
ctgccccaggctcaggctgccc

SEQ ID NO: 5605631 - DNA, 19 bp, Homo sapiens
ctgccccagggctcccggc

SEQ ID NO: 5605632 - DNA, 13 bp, Homo sapiens
ctgccccaggtac

SEQ ID NO: 5605633 - DNA, 22 bp, Homo sapiens
ctgccccagtcagcctggctgg

SEQ ID NO: 5605634 - DNA, 20 bp, Homo sapiens
ctgccccatcacttacagaa

SEQ ID NO: 5605635 - DNA, 13 bp, Homo sapiens
ctgccccatcctc

SEQ ID NO: 5605636 - DNA, 18 bp, Homo sapiens
ctgccccatcctccagca

SEQ ID NO: 5605637 - DNA, 21 bp, Homo sapiens
ctgccccatcctccagcaggg

SEQ ID NO: 5605638 - DNA, 16 bp, Homo sapiens
ctgccccatctcccct

SEQ ID NO: 5605639 - DNA, 17 bp, Homo sapiens
ctgccccatctcccctc

SEQ ID NO: 5605640 - DNA, 19 bp, Homo sapiens
ctgccccatctcccctcag

SEQ ID NO: 5605641 - DNA, 16 bp, Homo sapiens
ctgccccatctcctcc

SEQ ID NO: 5605642 - DNA, 16 bp, Homo sapiens
ctgccccatctgggga

SEQ ID NO: 5605643 - DNA, 14 bp, Homo sapiens
ctgcccccaaataa

SEQ ID NO: 5605644 - DNA, 18 bp, Homo sapiens
ctgcccccaacactccag

SEQ ID NO: 5605645 - DNA, 20 bp, Homo sapiens
ctgcccccaactcccggagg

SEQ ID NO: 5605646 - DNA, 21 bp, Homo sapiens
ctgcccccaaggaggcagcct

SEQ ID NO: 5605647 - DNA, 12 bp, Homo sapiens
ctgcccccaagt

SEQ ID NO: 5605648 - DNA, 14 bp, Homo sapiens
ctgcccccacacct

SEQ ID NO: 5605649 - DNA, 20 bp, Homo sapiens
ctgcccccacacctggccct

SEQ ID NO: 5605650 - DNA, 12 bp, Homo sapiens
ctgcccccacag

SEQ ID NO: 5605651 - DNA, 14 bp, Homo sapiens
ctgcccccacagat

SEQ ID NO: 5605652 - DNA, 16 bp, Homo sapiens
ctgcccccacagatcc

SEQ ID NO: 5605653 - DNA, 23 bp, Homo sapiens
ctgcccccacagctccttgcaaa

SEQ ID NO: 5605654 - DNA, 17 bp, Homo sapiens
ctgcccccaccccaggc

SEQ ID NO: 5605655 - DNA, 18 bp, Homo sapiens
ctgcccccaccccaggct

SEQ ID NO: 5605656 - DNA, 19 bp, Homo sapiens
ctgcccccaccccaggctg

SEQ ID NO: 5605657 - DNA, 15 bp, Homo sapiens
ctgcccccacccctt

SEQ ID NO: 5605658 - DNA, 18 bp, Homo sapiens
ctgcccccaccccttcct

SEQ ID NO: 5605659 - DNA, 18 bp, Homo sapiens
ctgcccccacttcctgtt

SEQ ID NO: 5605660 - DNA, 23 bp, Homo sapiens
ctgcccccagaaagcctcctgcc

SEQ ID NO: 5605661 - DNA, 17 bp, Homo sapiens
ctgcccccagagccaca

SEQ ID NO: 5605662 - DNA, 20 bp, Homo sapiens
ctgcccccagagccacagtt

SEQ ID NO: 5605663 - DNA, 13 bp, Homo sapiens
ctgcccccagcca

SEQ ID NO: 5605664 - DNA, 15 bp, Homo sapiens
ctgcccccagcccaa

SEQ ID NO: 5605665 - DNA, 18 bp, Homo sapiens
ctgcccccagcgtggggg

SEQ ID NO: 5605666 - DNA, 16 bp, Homo sapiens
ctgcccccaggactgg

SEQ ID NO: 5605667 - DNA, 22 bp, Homo sapiens
ctgcccccatcacctctactgt

SEQ ID NO: 5605668 - DNA, 23 bp, Homo sapiens
ctgcccccatcacctctactgtc

SEQ ID NO: 5605669 - DNA, 12 bp, Homo sapiens
ctgcccccatcc

SEQ ID NO: 5605670 - DNA, 13 bp, Homo sapiens
ctgcccccatcca

SEQ ID NO: 5605671 - DNA, 18 bp, Homo sapiens
ctgcccccatccagccac

SEQ ID NO: 5605672 - DNA, 18 bp, Homo sapiens
ctgcccccatctccccag

SEQ ID NO: 5605673 - DNA, 19 bp, Homo sapiens
ctgcccccatctccccagg

SEQ ID NO: 5605674 - DNA, 20 bp, Homo sapiens
ctgcccccatctccccaggc

SEQ ID NO: 5605675 - DNA, 21 bp, Homo sapiens
ctgcccccatctccccaggcc

SEQ ID NO: 5605676 - DNA, 22 bp, Homo sapiens
ctgcccccatctccccaggcct

SEQ ID NO: 5605677 - DNA, 16 bp, Homo sapiens
ctgccccccacattct

SEQ ID NO: 5605678 - DNA, 22 bp, Homo sapiens
ctgccccccacattctggctcc

SEQ ID NO: 5605679 - DNA, 19 bp, Homo sapiens
ctgccccccagcctaggct

SEQ ID NO: 5605680 - DNA, 19 bp, Homo sapiens
ctgccccccagcctctggc

SEQ ID NO: 5605681 - DNA, 15 bp, Homo sapiens
ctgccccccagggct

SEQ ID NO: 5605682 - DNA, 19 bp, Homo sapiens
ctgccccccccccccatct

SEQ ID NO: 5605683 - DNA, 18 bp, Homo sapiens
ctgccccccctaagagac

SEQ ID NO: 5605684 - DNA, 13 bp, Homo sapiens
ctgccccccgagg

SEQ ID NO: 5605685 - DNA, 18 bp, Homo sapiens
ctgccccccgaggctgct

SEQ ID NO: 5605686 - DNA, 21 bp, Homo sapiens
ctgccccccgaggctgctaga

SEQ ID NO: 5605687 - DNA, 11 bp, Homo sapiens
ctgccccccgc

SEQ ID NO: 5605688 - DNA, 18 bp, Homo sapiens
ctgcccccctcctttcca

SEQ ID NO: 5605689 - DNA, 20 bp, Homo sapiens
ctgccccccttcccacccct

SEQ ID NO: 5605690 - DNA, 15 bp, Homo sapiens
ctgcccccgcatccc

SEQ ID NO: 5605691 - DNA, 17 bp, Homo sapiens
ctgcccccgctcatggg

SEQ ID NO: 5605692 - DNA, 20 bp, Homo sapiens
ctgcccccgtcttctctcca

SEQ ID NO: 5605693 - DNA, 21 bp, Homo sapiens
ctgccccctatcttgtcctgg

SEQ ID NO: 5605694 - DNA, 12 bp, Homo sapiens
ctgccccctccc

SEQ ID NO: 5605695 - DNA, 15 bp, Homo sapiens
ctgccccctcccact

SEQ ID NO: 5605696 - DNA, 16 bp, Homo sapiens
ctgccccctcccactc

SEQ ID NO: 5605697 - DNA, 15 bp, Homo sapiens
ctgccccctccccca

SEQ ID NO: 5605698 - DNA, 17 bp, Homo sapiens
ctgccccctcccccgca

SEQ ID NO: 5605699 - DNA, 18 bp, Homo sapiens
ctgccccctcccccgcag

SEQ ID NO: 5605700 - DNA, 23 bp, Homo sapiens
ctgccccctccccttcacaccat

SEQ ID NO: 5605701 - DNA, 13 bp, Homo sapiens
ctgccccctcctg

SEQ ID NO: 5605702 - DNA, 20 bp, Homo sapiens
ctgccccctcgggggcctgt

SEQ ID NO: 5605703 - DNA, 21 bp, Homo sapiens
ctgccccctcgggggcctgtg

SEQ ID NO: 5605704 - DNA, 15 bp, Homo sapiens
ctgccccctctgccc

SEQ ID NO: 5605705 - DNA, 17 bp, Homo sapiens
ctgccccctctgccctg

SEQ ID NO: 5605706 - DNA, 14 bp, Homo sapiens
ctgccccctctttg

SEQ ID NO: 5605707 - DNA, 15 bp, Homo sapiens
ctgccccctgcagaa

SEQ ID NO: 5605708 - DNA, 22 bp, Homo sapiens
ctgccccctgcaggaaggagct

SEQ ID NO: 5605709 - DNA, 13 bp, Homo sapiens
ctgccccctgcca

SEQ ID NO: 5605710 - DNA, 14 bp, Homo sapiens
ctgccccctgccag

SEQ ID NO: 5605711 - DNA, 15 bp, Homo sapiens
ctgccccctgccagc

SEQ ID NO: 5605712 - DNA, 15 bp, Homo sapiens
ctgccccctgctggc

SEQ ID NO: 5605713 - DNA, 17 bp, Homo sapiens
ctgccccctgctggctc

SEQ ID NO: 5605714 - DNA, 23 bp, Homo sapiens
ctgccccctggctgactggccag

SEQ ID NO: 5605715 - DNA, 14 bp, Homo sapiens
ctgccccctggctt

SEQ ID NO: 5605716 - DNA, 13 bp, Homo sapiens
ctgccccctgggg

SEQ ID NO: 5605717 - DNA, 15 bp, Homo sapiens
ctgccccctggggat

SEQ ID NO: 5605718 - DNA, 13 bp, Homo sapiens
ctgccccctggtg

SEQ ID NO: 5605719 - DNA, 22 bp, Homo sapiens
ctgccccctggtggacagtcct

SEQ ID NO: 5605720 - DNA, 17 bp, Homo sapiens
ctgcccccttccccagc

SEQ ID NO: 5605721 - DNA, 22 bp, Homo sapiens
ctgcccccttccccagccctta

SEQ ID NO: 5605722 - DNA, 18 bp, Homo sapiens
ctgcccccttctcccaca

SEQ ID NO: 5605723 - DNA, 17 bp, Homo sapiens
ctgccccgcccagctgc

SEQ ID NO: 5605724 - DNA, 14 bp, Homo sapiens
ctgccccgcccccc

SEQ ID NO: 5605725 - DNA, 21 bp, Homo sapiens
ctgccccgccttcgtgtgctg

SEQ ID NO: 5605726 - DNA, 19 bp, Homo sapiens
ctgccccgcttccccacag

SEQ ID NO: 5605727 - DNA, 20 bp, Homo sapiens
ctgccccgcttccccacaga

SEQ ID NO: 5605728 - DNA, 13 bp, Homo sapiens
ctgccccggacct

SEQ ID NO: 5605729 - DNA, 18 bp, Homo sapiens
ctgccccggacctacctc

SEQ ID NO: 5605730 - DNA, 19 bp, Homo sapiens
ctgccccggagctggagga

SEQ ID NO: 5605731 - DNA, 17 bp, Homo sapiens
ctgccccggccactctg

SEQ ID NO: 5605732 - DNA, 18 bp, Homo sapiens
ctgccccggccactctgt

SEQ ID NO: 5605733 - DNA, 14 bp, Homo sapiens
ctgccccggcccaa

SEQ ID NO: 5605734 - DNA, 20 bp, Homo sapiens
ctgccccggcccaacctcgc

SEQ ID NO: 5605735 - DNA, 14 bp, Homo sapiens
ctgccccggcctcc

SEQ ID NO: 5605736 - DNA, 23 bp, Homo sapiens
ctgcctccacccgtcctccctca

SEQ ID NO: 5605737 - DNA, 15 bp, Homo sapiens
ctgcctccaccctct

SEQ ID NO: 5605738 - DNA, 18 bp, Homo sapiens
ctgcctccaccctctgag

SEQ ID NO: 5605739 - DNA, 20 bp, Homo sapiens
ctgcctccaccctctgagct

SEQ ID NO: 5605740 - DNA, 13 bp, Homo sapiens
ctgcctccactcc

SEQ ID NO: 5605741 - DNA, 18 bp, Homo sapiens
ctgcctccactcccactt

SEQ ID NO: 5605742 - DNA, 19 bp, Homo sapiens
ctgcctccactcccacttc

SEQ ID NO: 5605743 - DNA, 14 bp, Homo sapiens
ctgcctccagaatg

SEQ ID NO: 5605744 - DNA, 22 bp, Homo sapiens
ctgcctccagaatggtctttct

SEQ ID NO: 5605745 - DNA, 23 bp, Homo sapiens
ctgcctccagccaaacgggagct

SEQ ID NO: 5605746 - DNA, 17 bp, Homo sapiens
ctgcctccagcctggtg

SEQ ID NO: 5605747 - DNA, 13 bp, Homo sapiens
ctgcctccaggaa

SEQ ID NO: 5605748 - DNA, 14 bp, Homo sapiens
ctgcctccagggct

SEQ ID NO: 5605749 - DNA, 13 bp, Homo sapiens
ctgcctccaggtt

SEQ ID NO: 5605750 - DNA, 12 bp, Homo sapiens
ctgcctccatgg

SEQ ID NO: 5605751 - DNA, 19 bp, Homo sapiens
ctgcctccatggcagcagc

SEQ ID NO: 5605752 - DNA, 22 bp, Homo sapiens
ctgcctccatggcagcagccag

SEQ ID NO: 5605753 - DNA, 23 bp, Homo sapiens
ctgcctccatggcagcagccagg

SEQ ID NO: 5605754 - DNA, 20 bp, Homo sapiens
ctgcctccattatccattcc

SEQ ID NO: 5605755 - DNA, 22 bp, Homo sapiens
ctgcctccattatccattccca

SEQ ID NO: 5605756 - DNA, 23 bp, Homo sapiens
ctgcctccattatccattcccaa

SEQ ID NO: 5605757 - DNA, 16 bp, Homo sapiens
ctgcctcccaagcagc

SEQ ID NO: 5605758 - DNA, 19 bp, Homo sapiens
ctgcctcccaagcagctga

SEQ ID NO: 5605759 - DNA, 22 bp, Homo sapiens
ctgcctcccacgctgggacaca

SEQ ID NO: 5605760 - DNA, 16 bp, Homo sapiens
ctgcctcccactccat

SEQ ID NO: 5605761 - DNA, 18 bp, Homo sapiens
ctgcctcccacttcactg

SEQ ID NO: 5605762 - DNA, 12 bp, Homo sapiens
ctgcctcccagc

SEQ ID NO: 5605763 - DNA, 11 bp, Homo sapiens
ctgcctcccat

SEQ ID NO: 5605764 - DNA, 14 bp, Homo sapiens
ctgcctcccatcac

SEQ ID NO: 5605765 - DNA, 16 bp, Homo sapiens
ctgcctcccatcaccc

SEQ ID NO: 5605766 - DNA, 16 bp, Homo sapiens
ctgcctcccatgcctg

SEQ ID NO: 5605767 - DNA, 13 bp, Homo sapiens
ctgcctcccccga

SEQ ID NO: 5605768 - DNA, 22 bp, Homo sapiens
ctgcctccccggaagtgcctta

SEQ ID NO: 5605769 - DNA, 13 bp, Homo sapiens
ctgcctcccctcc

SEQ ID NO: 5605770 - DNA, 17 bp, Homo sapiens
ctgcctcccctcctctg

SEQ ID NO: 5605771 - DNA, 21 bp, Homo sapiens
ctgcctcccgcccccttggct

SEQ ID NO: 5605772 - DNA, 17 bp, Homo sapiens
ctgcctccctaagttgc

SEQ ID NO: 5605773 - DNA, 18 bp, Homo sapiens
ctgcctccctctccatat

SEQ ID NO: 5605774 - DNA, 13 bp, Homo sapiens
ctgcctccctggg

SEQ ID NO: 5605775 - DNA, 23 bp, Homo sapiens
ctgcctccctggggaccaggagc

SEQ ID NO: 5605776 - DNA, 14 bp, Homo sapiens
ctgcctcccttcat

SEQ ID NO: 5605777 - DNA, 19 bp, Homo sapiens
ctgcctcccttcatgcatg

SEQ ID NO: 5605778 - DNA, 15 bp, Homo sapiens
ctgcctccggccctg

SEQ ID NO: 5605779 - DNA, 18 bp, Homo sapiens
ctgcctccggccctgccc

SEQ ID NO: 5605780 - DNA, 17 bp, Homo sapiens
ctgcctccgggaggtca

SEQ ID NO: 5605781 - DNA, 14 bp, Homo sapiens
ctgcctcctaggct

SEQ ID NO: 5605782 - DNA, 19 bp, Homo sapiens
ctgcctcctaggctggaag

SEQ ID NO: 5605783 - DNA, 17 bp, Homo sapiens
ctgcctcctcagcagcc

SEQ ID NO: 5605784 - DNA, 15 bp, Homo sapiens
ctgcctcctcagctt

SEQ ID NO: 5605785 - DNA, 22 bp, Homo sapiens
ctgcctcctcagctttgcttca

SEQ ID NO: 5605786 - DNA, 20 bp, Homo sapiens
ctgcctcctcatcagtgtgt

SEQ ID NO: 5605787 - DNA, 15 bp, Homo sapiens
ctgcctcctccctcc

SEQ ID NO: 5605788 - DNA, 23 bp, Homo sapiens
ctgcctcctccctcccagctgca

SEQ ID NO: 5605789 - DNA, 14 bp, Homo sapiens
ctgcctcctccctg

SEQ ID NO: 5605790 - DNA, 15 bp, Homo sapiens
ctgcctcctccctgg

SEQ ID NO: 5605791 - DNA, 20 bp, Homo sapiens
ctgcctcctccctggctgca

SEQ ID NO: 5605792 - DNA, 11 bp, Homo sapiens
ctgcctcctcg

SEQ ID NO: 5605793 - DNA, 15 bp, Homo sapiens
ctgcctcctcttcaa

SEQ ID NO: 5605794 - DNA, 11 bp, Homo sapiens
ctgcctcctgc

SEQ ID NO: 5605795 - DNA, 14 bp, Homo sapiens
ctgcctcctgccct

SEQ ID NO: 5605796 - DNA, 15 bp, Homo sapiens
ctgcctcctgccctt

SEQ ID NO: 5605797 - DNA, 23 bp, Homo sapiens
ctgcctcctgccggctccttggt

SEQ ID NO: 5605798 - DNA, 17 bp, Homo sapiens
ctgcctcctgcctgccc

SEQ ID NO: 5605799 - DNA, 12 bp, Homo sapiens
ctgcctcctgcg

SEQ ID NO: 5605800 - DNA, 15 bp, Homo sapiens
ctgcctcctgctctc

SEQ ID NO: 5605801 - DNA, 18 bp, Homo sapiens
ctgcctcctgctctctgg

SEQ ID NO: 5605802 - DNA, 14 bp, Homo sapiens
ctgcctcctgcttt

SEQ ID NO: 5605803 - DNA, 20 bp, Homo sapiens
ctgcctcctggaggaccaga

SEQ ID NO: 5605804 - DNA, 12 bp, Homo sapiens
ctgcctcctggc

SEQ ID NO: 5605805 - DNA, 14 bp, Homo sapiens
ctgcctcctggcca

SEQ ID NO: 5605806 - DNA, 13 bp, Homo sapiens
ctgcctcctggct

SEQ ID NO: 5605807 - DNA, 14 bp, Homo sapiens
ctgcctcctggctc

SEQ ID NO: 5605808 - DNA, 15 bp, Homo sapiens
ctgcctcctggctca

SEQ ID NO: 5605809 - DNA, 16 bp, Homo sapiens
ctgcctcctggctcag

SEQ ID NO: 5605810 - DNA, 13 bp, Homo sapiens
ctgcctcctggga

SEQ ID NO: 5605811 - DNA, 14 bp, Homo sapiens
ctgcctcctgggaa

SEQ ID NO: 5605812 - DNA, 15 bp, Homo sapiens
ctgcctcctgggaag

SEQ ID NO: 5605813 - DNA, 13 bp, Homo sapiens
ctgcctcctgggt

SEQ ID NO: 5605814 - DNA, 15 bp, Homo sapiens
ctgcctcctgggttc

SEQ ID NO: 5605815 - DNA, 19 bp, Homo sapiens
ctgcctccttgatatttgt

SEQ ID NO: 5605816 - DNA, 12 bp, Homo sapiens
ctgcctccttta

SEQ ID NO: 5605817 - DNA, 18 bp, Homo sapiens
ctgcctcctttgcacctg

SEQ ID NO: 5605818 - DNA, 14 bp, Homo sapiens
ctgcctcctttgtg

SEQ ID NO: 5605819 - DNA, 17 bp, Homo sapiens
ctgcctcctttgtgagg

SEQ ID NO: 5605820 - DNA, 15 bp, Homo sapiens
ctgcctcgaaacaca

SEQ ID NO: 5605821 - DNA, 15 bp, Homo sapiens
ctgcctcgaactggc

SEQ ID NO: 5605822 - DNA, 18 bp, Homo sapiens
ctgcctcgaactggctgc

SEQ ID NO: 5605823 - DNA, 12 bp, Homo sapiens
ctgcctcgaggg

SEQ ID NO: 5605824 - DNA, 16 bp, Homo sapiens
ctgcctcgagggccgc

SEQ ID NO: 5605825 - DNA, 19 bp, Homo sapiens
ctgcctcgagggccgcctg

SEQ ID NO: 5605826 - DNA, 22 bp, Homo sapiens
ctgcctcgagggccgcctgcct

SEQ ID NO: 5605827 - DNA, 14 bp, Homo sapiens
ctgcctcgctcacc

SEQ ID NO: 5605828 - DNA, 18 bp, Homo sapiens
ctgcctcgctcaccgctg

SEQ ID NO: 5605829 - DNA, 22 bp, Homo sapiens
ctgcctcgctcaccgctggccc

SEQ ID NO: 5605830 - DNA, 23 bp, Homo sapiens
ctgcctcgctcaccgctggccct

SEQ ID NO: 5605831 - DNA, 20 bp, Homo sapiens
ctgcctcggatccccttcct

SEQ ID NO: 5605832 - DNA, 17 bp, Homo sapiens
ctgcctcggcctcccaa

SEQ ID NO: 5605833 - DNA, 17 bp, Homo sapiens
ctgcctcgggaacctca

SEQ ID NO: 5605834 - DNA, 16 bp, Homo sapiens
ctgcctcgtagagtga

SEQ ID NO: 5605835 - DNA, 15 bp, Homo sapiens
ctgcctcgtttccct

SEQ ID NO: 5605836 - DNA, 14 bp, Homo sapiens
ctgcctctaactcc

SEQ ID NO: 5605837 - DNA, 22 bp, Homo sapiens
ctgcctctaactccctcctcac

SEQ ID NO: 5605838 - DNA, 16 bp, Homo sapiens
ctgcctctaagctgct

SEQ ID NO: 5605839 - DNA, 13 bp, Homo sapiens
ctgcctctaaggc

SEQ ID NO: 5605840 - DNA, 17 bp, Homo sapiens
ctgcctctaaggccaag

SEQ ID NO: 5605841 - DNA, 21 bp, Homo sapiens
ctgcctctaaggccaaggcct

SEQ ID NO: 5605842 - DNA, 15 bp, Homo sapiens
ctgcctctactggga

SEQ ID NO: 5605843 - DNA, 16 bp, Homo sapiens
ctgcctctatccctgg

SEQ ID NO: 5605844 - DNA, 17 bp, Homo sapiens
ctgcctctatccctggc

SEQ ID NO: 5605845 - DNA, 18 bp, Homo sapiens
ctgcctctatccctggcc

SEQ ID NO: 5605846 - DNA, 19 bp, Homo sapiens
ctgcctctcattggcacca

SEQ ID NO: 5605847 - DNA, 13 bp, Homo sapiens
ctgcctctcccag

SEQ ID NO: 5605848 - DNA, 15 bp, Homo sapiens
ctgcctctcccaggc

SEQ ID NO: 5605849 - DNA, 17 bp, Homo sapiens
ctgcctctcccaggcag

SEQ ID NO: 5605850 - DNA, 13 bp, Homo sapiens
ctgcctctccctc

SEQ ID NO: 5605851 - DNA, 16 bp, Homo sapiens
ctgcctctccctctgg

SEQ ID NO: 5605852 - DNA, 16 bp, Homo sapiens
ctgcctctccctggcc

SEQ ID NO: 5605853 - DNA, 17 bp, Homo sapiens
ctgcctctccctgggtc

SEQ ID NO: 5605854 - DNA, 18 bp, Homo sapiens
ctgcctctccctgggtct

SEQ ID NO: 5605855 - DNA, 19 bp, Homo sapiens
ctgcctctccgcccctgag

SEQ ID NO: 5605856 - DNA, 19 bp, Homo sapiens
ctgcctctcggtgacctcc

SEQ ID NO: 5605857 - DNA, 13 bp, Homo sapiens
ctgcctctctgca

SEQ ID NO: 5605858 - DNA, 15 bp, Homo sapiens
ctgcctctctgcagg

SEQ ID NO: 5605859 - DNA, 22 bp, Homo sapiens
ctgcctctctgcaggtccctaa

SEQ ID NO: 5605860 - DNA, 20 bp, Homo sapiens
ctgcctctctgctccagaga

SEQ ID NO: 5605861 - DNA, 19 bp, Homo sapiens
ctgcctctctttcacacaa

SEQ ID NO: 5605862 - DNA, 14 bp, Homo sapiens
ctgcctctgaaaat

SEQ ID NO: 5605863 - DNA, 15 bp, Homo sapiens
ctgcctctgaactgc

SEQ ID NO: 5605864 - DNA, 21 bp, Homo sapiens
ctgcctctgacacacagctct

SEQ ID NO: 5605865 - DNA, 23 bp, Homo sapiens
ctgcctctgacagcagcctgtga

SEQ ID NO: 5605866 - DNA, 14 bp, Homo sapiens
ctgcctctgacccc

SEQ ID NO: 5605867 - DNA, 18 bp, Homo sapiens
ctgcctctgaccccagca

SEQ ID NO: 5605868 - DNA, 11 bp, Homo sapiens
ctgcctctgag

SEQ ID NO: 5605869 - DNA, 19 bp, Homo sapiens
ctgcctctgagccactgga

SEQ ID NO: 5605870 - DNA, 15 bp, Homo sapiens
ctgcctctgagggaa

SEQ ID NO: 5605871 - DNA, 21 bp, Homo sapiens
ctgcctctgccacactctgac

SEQ ID NO: 5605872 - DNA, 13 bp, Homo sapiens
ctgcctctgcctt

SEQ ID NO: 5605873 - DNA, 13 bp, Homo sapiens
ctgcctctgctcc

SEQ ID NO: 5605874 - DNA, 14 bp, Homo sapiens
ctgcctctgggcag

SEQ ID NO: 5605875 - DNA, 16 bp, Homo sapiens
ctgcctctgggcagcc

SEQ ID NO: 5605876 - DNA, 12 bp, Homo sapiens
ctgcctctgggt

SEQ ID NO: 5605877 - DNA, 21 bp, Homo sapiens
ctgcctctgggtgagtggctg

SEQ ID NO: 5605878 - DNA, 21 bp, Homo sapiens
ctgcctctgtgtagccgccct

SEQ ID NO: 5605879 - DNA, 20 bp, Homo sapiens
ctgcctctgtttgacaaacc

SEQ ID NO: 5605880 - DNA, 22 bp, Homo sapiens
ctgcctcttagacttctgcttt

SEQ ID NO: 5605881 - DNA, 15 bp, Homo sapiens
ctgcctcttctctac

SEQ ID NO: 5605882 - DNA, 17 bp, Homo sapiens
ctgcctcttctgggagg

SEQ ID NO: 5605883 - DNA, 22 bp, Homo sapiens
ctgcctcttctgggagggcagc

SEQ ID NO: 5605884 - DNA, 14 bp, Homo sapiens
ctgcctcttggctt

SEQ ID NO: 5605885 - DNA, 21 bp, Homo sapiens
ctgcctcttggcttctcagcc

SEQ ID NO: 5605886 - DNA, 18 bp, Homo sapiens
ctgcctctttccctagga

SEQ ID NO: 5605887 - DNA, 19 bp, Homo sapiens
ctgcctctttgctgctttg

SEQ ID NO: 5605888 - DNA, 12 bp, Homo sapiens
ctgcctgaaagc

SEQ ID NO: 5605889 - DNA, 19 bp, Homo sapiens
ctgcctgaacactgcttct

SEQ ID NO: 5605890 - DNA, 19 bp, Homo sapiens
ctgcctgaacagccctctc

SEQ ID NO: 5605891 - DNA, 17 bp, Homo sapiens
ctgcctgaaccttccat

SEQ ID NO: 5605892 - DNA, 13 bp, Homo sapiens
ctgcctgaagaga

SEQ ID NO: 5605893 - DNA, 23 bp, Homo sapiens
ctgcctgaagagaggaaactggc

SEQ ID NO: 5605894 - DNA, 19 bp, Homo sapiens
ctgcctgaagtcacacagt

SEQ ID NO: 5605895 - DNA, 13 bp, Homo sapiens
ctgcctgaataaa

SEQ ID NO: 5605896 - DNA, 18 bp, Homo sapiens
ctgcctgaataaagagcc

SEQ ID NO: 5605897 - DNA, 16 bp, Homo sapiens
ctgcctgacaaggcca

SEQ ID NO: 5605898 - DNA, 18 bp, Homo sapiens
ctgcctgacaattatgaa

SEQ ID NO: 5605899 - DNA, 16 bp, Homo sapiens
ctgcctgacactgagc

SEQ ID NO: 5605900 - DNA, 18 bp, Homo sapiens
ctgcctgacactgagccc

SEQ ID NO: 5605901 - DNA, 20 bp, Homo sapiens
ctgcctgacactgagcccca

SEQ ID NO: 5605902 - DNA, 17 bp, Homo sapiens
ctgcctgacagcatcct

SEQ ID NO: 5605903 - DNA, 16 bp, Homo sapiens
ctgcctgacagccttc

SEQ ID NO: 5605904 - DNA, 15 bp, Homo sapiens
ctgcctgacaggctg

SEQ ID NO: 5605905 - DNA, 20 bp, Homo sapiens
ctgcctgacaggctgtgact

SEQ ID NO: 5605906 - DNA, 16 bp, Homo sapiens
ctgcctgagattcttt

SEQ ID NO: 5605907 - DNA, 22 bp, Homo sapiens
ctgcctgagattctttaaggag

SEQ ID NO: 5605908 - DNA, 20 bp, Homo sapiens
ctgcctgagcacctcccagc

SEQ ID NO: 5605909 - DNA, 21 bp, Homo sapiens
ctgcctgagcacctcccagcc

SEQ ID NO: 5605910 - DNA, 16 bp, Homo sapiens
ctgcctgagcccagga

SEQ ID NO: 5605911 - DNA, 19 bp, Homo sapiens
ctgcctgagcccaggagct

SEQ ID NO: 5605912 - DNA, 14 bp, Homo sapiens
ctgcctgaggagga

SEQ ID NO: 5605913 - DNA, 20 bp, Homo sapiens
ctgcctgaggaggaggacac

SEQ ID NO: 5605914 - DNA, 21 bp, Homo sapiens
ctgcctgaggaggaggacaca

SEQ ID NO: 5605915 - DNA, 13 bp, Homo sapiens
ctgcgaccgccag

SEQ ID NO: 5605916 - DNA, 15 bp, Homo sapiens
ctgcgactaaactta

SEQ ID NO: 5605917 - DNA, 14 bp, Homo sapiens
ctgcgactttctgc

SEQ ID NO: 5605918 - DNA, 22 bp, Homo sapiens
ctgcgagacgcacacagctgag

SEQ ID NO: 5605919 - DNA, 19 bp, Homo sapiens
ctgcgagatcgctggcaga

SEQ ID NO: 5605920 - DNA, 20 bp, Homo sapiens
ctgcgagcatttccctcccg

SEQ ID NO: 5605921 - DNA, 20 bp, Homo sapiens
ctgcgagctccttgggtcct

SEQ ID NO: 5605922 - DNA, 16 bp, Homo sapiens
ctgcgaggctatgagt

SEQ ID NO: 5605923 - DNA, 15 bp, Homo sapiens
ctgcgagggcagcgg

SEQ ID NO: 5605924 - DNA, 13 bp, Homo sapiens
ctgcgatgcagcg

SEQ ID NO: 5605925 - DNA, 19 bp, Homo sapiens
ctgcgcaaagggcgggcct

SEQ ID NO: 5605926 - DNA, 15 bp, Homo sapiens
ctgcgcaagtgcctg

SEQ ID NO: 5605927 - DNA, 16 bp, Homo sapiens
ctgcgcacagccccag

SEQ ID NO: 5605928 - DNA, 19 bp, Homo sapiens
ctgcgcaccaatgcccagc

SEQ ID NO: 5605929 - DNA, 21 bp, Homo sapiens
ctgcgcaccaatgcccagcag

SEQ ID NO: 5605930 - DNA, 19 bp, Homo sapiens
ctgcgcactgagtacaaat

SEQ ID NO: 5605931 - DNA, 18 bp, Homo sapiens
ctgcgcagcctccagggc

SEQ ID NO: 5605932 - DNA, 20 bp, Homo sapiens
ctgcgcagcctccagggccc

SEQ ID NO: 5605933 - DNA, 13 bp, Homo sapiens
ctgcgcaggccct

SEQ ID NO: 5605934 - DNA, 14 bp, Homo sapiens
ctgcgcaggccctc

SEQ ID NO: 5605935 - DNA, 16 bp, Homo sapiens
ctgcgcagggccctct

SEQ ID NO: 5605936 - DNA, 12 bp, Homo sapiens
ctgcgcagggct

SEQ ID NO: 5605937 - DNA, 16 bp, Homo sapiens
ctgcgcaggtctcttc

SEQ ID NO: 5605938 - DNA, 18 bp, Homo sapiens
ctgcgcaggtctcttctg

SEQ ID NO: 5605939 - DNA, 13 bp, Homo sapiens
ctgcgccacctgc

SEQ ID NO: 5605940 - DNA, 20 bp, Homo sapiens
ctgcgccactgctccgtgga

SEQ ID NO: 5605941 - DNA, 15 bp, Homo sapiens
ctgcgccacttcctt

SEQ ID NO: 5605942 - DNA, 13 bp, Homo sapiens
ctgcgccaggcag

SEQ ID NO: 5605943 - DNA, 15 bp, Homo sapiens
ctgcgccaggcagag

SEQ ID NO: 5605944 - DNA, 15 bp, Homo sapiens
ctgcgcccaccccgc

SEQ ID NO: 5605945 - DNA, 17 bp, Homo sapiens
ctgcgcccaccccgctc

SEQ ID NO: 5605946 - DNA, 22 bp, Homo sapiens
ctgcgcccaccccgctctgcat

SEQ ID NO: 5605947 - DNA, 15 bp, Homo sapiens
ctgcgcccagcctga

SEQ ID NO: 5605948 - DNA, 18 bp, Homo sapiens
ctgcgcccagtccttcca

SEQ ID NO: 5605949 - DNA, 23 bp, Homo sapiens
ctgcgcccagtccttccacctcg

SEQ ID NO: 5605950 - DNA, 15 bp, Homo sapiens
ctgcgccccagcgac

SEQ ID NO: 5605951 - DNA, 15 bp, Homo sapiens
ctgcgcccccagctt

SEQ ID NO: 5605952 - DNA, 16 bp, Homo sapiens
ctgcgcccccagcttc

SEQ ID NO: 5605953 - DNA, 17 bp, Homo sapiens
ctgcgccccccagtgga

SEQ ID NO: 5605954 - DNA, 18 bp, Homo sapiens
ctgcgccccccagtggac

SEQ ID NO: 5605955 - DNA, 17 bp, Homo sapiens
ctgcgcccctgcccagc

SEQ ID NO: 5605956 - DNA, 15 bp, Homo sapiens
ctgcgccctccctcc

SEQ ID NO: 5605957 - DNA, 16 bp, Homo sapiens
ctgcgccctccctccc

SEQ ID NO: 5605958 - DNA, 20 bp, Homo sapiens
ctgcgccctccctccctcca

SEQ ID NO: 5605959 - DNA, 13 bp, Homo sapiens
ctgcgccctgggc

SEQ ID NO: 5605960 - DNA, 14 bp, Homo sapiens
ctgcgccctgggct

SEQ ID NO: 5605961 - DNA, 12 bp, Homo sapiens
ctgcgccctgtg

SEQ ID NO: 5605962 - DNA, 22 bp, Homo sapiens
ctgcgcccttaactgcatccag

SEQ ID NO: 5605963 - DNA, 19 bp, Homo sapiens
ctgcgcccttgtgccctgc

SEQ ID NO: 5605964 - DNA, 19 bp, Homo sapiens
ctgcgccgccgccggagtc

SEQ ID NO: 5605965 - DNA, 14 bp, Homo sapiens
ctgcgcctccatcc

SEQ ID NO: 5605966 - DNA, 12 bp, Homo sapiens
ctgcgcctcctc

SEQ ID NO: 5605967 - DNA, 13 bp, Homo sapiens
ctgcgcctcctcc

SEQ ID NO: 5605968 - DNA, 23 bp, Homo sapiens
ctgcgcctgcaggcagagctgga

SEQ ID NO: 5605969 - DNA, 12 bp, Homo sapiens
ctgcgcctgccc

SEQ ID NO: 5605970 - DNA, 20 bp, Homo sapiens
ctgcgcctgctgcatgccct

SEQ ID NO: 5605971 - DNA, 17 bp, Homo sapiens
ctgcgcctgctgcctgc

SEQ ID NO: 5605972 - DNA, 13 bp, Homo sapiens
ctgcgcctttcct

SEQ ID NO: 5605973 - DNA, 19 bp, Homo sapiens
ctgcgcggactcgccccca

SEQ ID NO: 5605974 - DNA, 16 bp, Homo sapiens
ctgcgcggatgtagca

SEQ ID NO: 5605975 - DNA, 13 bp, Homo sapiens
ctgcgctagcagc

SEQ ID NO: 5605976 - DNA, 15 bp, Homo sapiens
ctgcgctagcagccc

SEQ ID NO: 5605977 - DNA, 19 bp, Homo sapiens
ctgcgctagcagcccttgt

SEQ ID NO: 5605978 - DNA, 13 bp, Homo sapiens
ctgcgctcctctg

SEQ ID NO: 5605979 - DNA, 16 bp, Homo sapiens
ctgcgctcctctgcag

SEQ ID NO: 5605980 - DNA, 18 bp, Homo sapiens
ctgcgctcctctgcagcc

SEQ ID NO: 5605981 - DNA, 14 bp, Homo sapiens
ctgcgctcggccct

SEQ ID NO: 5605982 - DNA, 17 bp, Homo sapiens
ctgcgctctctttgcaa

SEQ ID NO: 5605983 - DNA, 16 bp, Homo sapiens
ctgcgctgccctgcaa

SEQ ID NO: 5605984 - DNA, 16 bp, Homo sapiens
ctgcgctgcttggtgt

SEQ ID NO: 5605985 - DNA, 15 bp, Homo sapiens
ctgcgctgtgctggt

SEQ ID NO: 5605986 - DNA, 16 bp, Homo sapiens
ctgcgctgtgctggtc

SEQ ID NO: 5605987 - DNA, 17 bp, Homo sapiens
ctgcgcttccctgcagt

SEQ ID NO: 5605988 - DNA, 19 bp, Homo sapiens
ctgcgcttctgctggagga

SEQ ID NO: 5605989 - DNA, 21 bp, Homo sapiens
ctgcggaagccaaaggcagct

SEQ ID NO: 5605990 - DNA, 18 bp, Homo sapiens
ctgcggaagccacagggt

SEQ ID NO: 5605991 - DNA, 19 bp, Homo sapiens
ctgcggacaccgtggcctg

SEQ ID NO: 5605992 - DNA, 19 bp, Homo sapiens
ctgcggaccaagggactcc

SEQ ID NO: 5605993 - DNA, 23 bp, Homo sapiens
ctgcggaccccagctgtgagcct

SEQ ID NO: 5605994 - DNA, 18 bp, Homo sapiens
ctgcggagaccctgagtc

SEQ ID NO: 5605995 - DNA, 20 bp, Homo sapiens
ctgcggagagaggccttgtc

SEQ ID NO: 5605996 - DNA, 17 bp, Homo sapiens
ctgcggagcaagaggag

SEQ ID NO: 5605997 - DNA, 13 bp, Homo sapiens
ctgcggagcagcc

SEQ ID NO: 5605998 - DNA, 16 bp, Homo sapiens
ctgcggagcagcctcc

SEQ ID NO: 5605999 - DNA, 17 bp, Homo sapiens
ctgcggagcagcctcca

SEQ ID NO: 5606000 - DNA, 18 bp, Homo sapiens
ctgcggagcagcctccag

SEQ ID NO: 5606001 - DNA, 15 bp, Homo sapiens
ctgcggagccggcac

SEQ ID NO: 5606002 - DNA, 17 bp, Homo sapiens
ctgcggagctgcatgga

SEQ ID NO: 5606003 - DNA, 17 bp, Homo sapiens
ctgcggagcttctccag

SEQ ID NO: 5606004 - DNA, 18 bp, Homo sapiens
ctgcggagtgaagagggg

SEQ ID NO: 5606005 - DNA, 20 bp, Homo sapiens
ctgcggatagcatttggtag

SEQ ID NO: 5606006 - DNA, 21 bp, Homo sapiens
ctgcggcacccttgcgctttt

SEQ ID NO: 5606007 - DNA, 18 bp, Homo sapiens
ctgcggcagacgggaggg

SEQ ID NO: 5606008 - DNA, 13 bp, Homo sapiens
ctgcggcaggact

SEQ ID NO: 5606009 - DNA, 18 bp, Homo sapiens
ctgcggcaggactgcaga

SEQ ID NO: 5606010 - DNA, 20 bp, Homo sapiens
ctgcggcaggactgcagagc

SEQ ID NO: 5606011 - DNA, 23 bp, Homo sapiens
ctgcggcaggactgcagagcaga

SEQ ID NO: 5606012 - DNA, 14 bp, Homo sapiens
ctgcggccaggcct

SEQ ID NO: 5606013 - DNA, 20 bp, Homo sapiens
ctgcggccaggcctgcgggc

SEQ ID NO: 5606014 - DNA, 21 bp, Homo sapiens
ctgcggccgccccccgcccct

SEQ ID NO: 5606015 - DNA, 15 bp, Homo sapiens
ctgcggccgggctgc

SEQ ID NO: 5606016 - DNA, 16 bp, Homo sapiens
ctgcggccgggctgcc

SEQ ID NO: 5606017 - DNA, 17 bp, Homo sapiens
ctgcggcgtacaggctg

SEQ ID NO: 5606018 - DNA, 19 bp, Homo sapiens
ctgcggctcagccttgcac

SEQ ID NO: 5606019 - DNA, 16 bp, Homo sapiens
ctgcggctctggaaag

SEQ ID NO: 5606020 - DNA, 17 bp, Homo sapiens
ctgcggctctggaaagc

SEQ ID NO: 5606021 - DNA, 16 bp, Homo sapiens
ctgcggctgctgtgtg

SEQ ID NO: 5606022 - DNA, 19 bp, Homo sapiens
ctgcggctgctgtgtgcct

SEQ ID NO: 5606023 - DNA, 17 bp, Homo sapiens
ctgcggctgtgggcgag

SEQ ID NO: 5606024 - DNA, 13 bp, Homo sapiens
ctgcggctttaaa

SEQ ID NO: 5606025 - DNA, 19 bp, Homo sapiens
ctgcgggaagctgaccttt

SEQ ID NO: 5606026 - DNA, 22 bp, Homo sapiens
ctgcgggaagctgacctttaac

SEQ ID NO: 5606027 - DNA, 18 bp, Homo sapiens
ctgcgggacagaggacca

SEQ ID NO: 5606028 - DNA, 14 bp, Homo sapiens
ctgcgggagccaga

SEQ ID NO: 5606029 - DNA, 19 bp, Homo sapiens
ctgcgggaggccctggccc

SEQ ID NO: 5606030 - DNA, 20 bp, Homo sapiens
ctgcgggatggtcctggggc

SEQ ID NO: 5606031 - DNA, 22 bp, Homo sapiens
ctgcgggatggtcctggggctc

SEQ ID NO: 5606032 - DNA, 17 bp, Homo sapiens
ctgcgggcccagctgag

SEQ ID NO: 5606033 - DNA, 17 bp, Homo sapiens
ctgcgggcccctggtga

SEQ ID NO: 5606034 - DNA, 15 bp, Homo sapiens
ctgcgggctccctcc

SEQ ID NO: 5606035 - DNA, 17 bp, Homo sapiens
ctgcgggctccctcctc

SEQ ID NO: 5606036 - DNA, 20 bp, Homo sapiens
ctgcgggctccctcctctgg

SEQ ID NO: 5606037 - DNA, 22 bp, Homo sapiens
ctgcgggctgggtgtggtctcc

SEQ ID NO: 5606038 - DNA, 16 bp, Homo sapiens
ctgcgggggagccagt

SEQ ID NO: 5606039 - DNA, 15 bp, Homo sapiens
ctgcgggggcaggcc

SEQ ID NO: 5606040 - DNA, 16 bp, Homo sapiens
ctgcgggggcaggccg

SEQ ID NO: 5606041 - DNA, 22 bp, Homo sapiens
ctgcgggggcaggccgggcctg

SEQ ID NO: 5606042 - DNA, 15 bp, Homo sapiens
ctgcgggtcacagga

SEQ ID NO: 5606043 - DNA, 21 bp, Homo sapiens
ctgcgggtggggcttggggct

SEQ ID NO: 5606044 - DNA, 23 bp, Homo sapiens
ctgcgggtgggtatcccacctcc

SEQ ID NO: 5606045 - DNA, 14 bp, Homo sapiens
ctgcgggttttaat

SEQ ID NO: 5606046 - DNA, 15 bp, Homo sapiens
ctgcggtatacattt

SEQ ID NO: 5606047 - DNA, 17 bp, Homo sapiens
ctgcggtcaaggccagc

SEQ ID NO: 5606048 - DNA, 17 bp, Homo sapiens
ctgcggtccacccagga

SEQ ID NO: 5606049 - DNA, 18 bp, Homo sapiens
ctgcggtccacccaggag

SEQ ID NO: 5606050 - DNA, 20 bp, Homo sapiens
ctgcggtccacccaggagcc

SEQ ID NO: 5606051 - DNA, 20 bp, Homo sapiens
ctgcggtggtgccagaggtt

SEQ ID NO: 5606052 - DNA, 15 bp, Homo sapiens
ctgcggtgtctgcag

SEQ ID NO: 5606053 - DNA, 18 bp, Homo sapiens
ctgcggtgtctgcagctc

SEQ ID NO: 5606054 - DNA, 19 bp, Homo sapiens
ctgcggtgtttggcaatgc

SEQ ID NO: 5606055 - DNA, 22 bp, Homo sapiens
ctgcggtttgttggatcttcaa

SEQ ID NO: 5606056 - DNA, 18 bp, Homo sapiens
ctgcgtaaccctcgccct

SEQ ID NO: 5606057 - DNA, 14 bp, Homo sapiens
ctgcgtcatggctc

SEQ ID NO: 5606058 - DNA, 15 bp, Homo sapiens
ctgcgtccaccaggc

SEQ ID NO: 5606059 - DNA, 18 bp, Homo sapiens
ctgcgtcccactgagtct

SEQ ID NO: 5606060 - DNA, 17 bp, Homo sapiens
ctgcgtccccactccct

SEQ ID NO: 5606061 - DNA, 21 bp, Homo sapiens
ctgcgtcccccagccctcagg

SEQ ID NO: 5606062 - DNA, 23 bp, Homo sapiens
ctgcgtcccccagccctcaggcc

SEQ ID NO: 5606063 - DNA, 17 bp, Homo sapiens
ctgcgtccctccgagct

SEQ ID NO: 5606064 - DNA, 18 bp, Homo sapiens
ctgcgtccctgctcagcc

SEQ ID NO: 5606065 - DNA, 19 bp, Homo sapiens
ctgcgtcctcatttcccct

SEQ ID NO: 5606066 - DNA, 22 bp, Homo sapiens
ctgcgtcctgaggagtgtcctg

SEQ ID NO: 5606067 - DNA, 23 bp, Homo sapiens
ctgcgtcgagctgggaaggttcc

SEQ ID NO: 5606068 - DNA, 14 bp, Homo sapiens
ctgcgtcggccctg

SEQ ID NO: 5606069 - DNA, 17 bp, Homo sapiens
ctgcgtctcctgcccac

SEQ ID NO: 5606070 - DNA, 20 bp, Homo sapiens
ctgcgtctgacatcctgacc

SEQ ID NO: 5606071 - DNA, 17 bp, Homo sapiens
ctgcgtctgctcttctg

SEQ ID NO: 5606072 - DNA, 14 bp, Homo sapiens
ctgcgtctggaggg

SEQ ID NO: 5606073 - DNA, 23 bp, Homo sapiens
ctgcgtctggaggggcccctgct

SEQ ID NO: 5606074 - DNA, 17 bp, Homo sapiens
ctgcgtcttccgcccct

SEQ ID NO: 5606075 - DNA, 20 bp, Homo sapiens
ctgcgtcttttttctcttcc

SEQ ID NO: 5606076 - DNA, 24 bp, Homo sapiens
ctgcgtcttttttctcttcccttc

SEQ ID NO: 5606077 - DNA, 19 bp, Homo sapiens
ctgcgtgacatgtgcagtg

SEQ ID NO: 5606078 - DNA, 20 bp, Homo sapiens
ctgcgtgccagtcaagaaga

SEQ ID NO: 5606079 - DNA, 22 bp, Homo sapiens
ctgcgtgccagtcaagaagaaa

SEQ ID NO: 5606080 - DNA, 19 bp, Homo sapiens
ctgcgtgccagtgtcccca

SEQ ID NO: 5606081 - DNA, 15 bp, Homo sapiens
ctgcgtgcctgtgga

SEQ ID NO: 5606082 - DNA, 17 bp, Homo sapiens
ctgcgtgctttatttat

SEQ ID NO: 5606083 - DNA, 17 bp, Homo sapiens
ctgcgtggcctgagtcc

SEQ ID NO: 5606084 - DNA, 21 bp, Homo sapiens
ctgcgtggcctggggctgccg

SEQ ID NO: 5606085 - DNA, 18 bp, Homo sapiens
ctgcgtggcgcaggtgcc

SEQ ID NO: 5606086 - DNA, 16 bp, Homo sapiens
ctgcgtggctgacccc

SEQ ID NO: 5606087 - DNA, 18 bp, Homo sapiens
ctgcgtggggacagggct

SEQ ID NO: 5606088 - DNA, 20 bp, Homo sapiens
ctgcgtggggacagggctcg

SEQ ID NO: 5606089 - DNA, 19 bp, Homo sapiens
ctgcgtgtcacctgtgctt

SEQ ID NO: 5606090 - DNA, 23 bp, Homo sapiens
ctgcgtgtgatttgtctctgagc

SEQ ID NO: 5606091 - DNA, 14 bp, Homo sapiens
ctgcgtgtgggagg

SEQ ID NO: 5606092 - DNA, 19 bp, Homo sapiens
ctgctgaatttataaaaat

SEQ ID NO: 5606093 - DNA, 22 bp, Homo sapiens
ctgctgacacgcagcctgctct

SEQ ID NO: 5606094 - DNA, 19 bp, Homo sapiens
ctgctgacagacacaggcc

SEQ ID NO: 5606095 - DNA, 21 bp, Homo sapiens
ctgctgacagacacaggcccg

SEQ ID NO: 5606096 - DNA, 17 bp, Homo sapiens
ctgctgacagacactaa

SEQ ID NO: 5606097 - DNA, 14 bp, Homo sapiens
ctgctgacaggatg

SEQ ID NO: 5606098 - DNA, 9 bp, Homo sapiens
ctgctgacc

SEQ ID NO: 5606099 - DNA, 15 bp, Homo sapiens
ctgctgaccaaatgg

SEQ ID NO: 5606100 - DNA, 20 bp, Homo sapiens
ctgctgaccaattgtgctgc

SEQ ID NO: 5606101 - DNA, 22 bp, Homo sapiens
ctgctgaccaattgtgctgcca

SEQ ID NO: 5606102 - DNA, 15 bp, Homo sapiens
ctgctgacccaccaa

SEQ ID NO: 5606103 - DNA, 14 bp, Homo sapiens
ctgctgacccctgt

SEQ ID NO: 5606104 - DNA, 21 bp, Homo sapiens
ctgctgacccctgtgtgacat

SEQ ID NO: 5606105 - DNA, 20 bp, Homo sapiens
ctgctgacctcactgtcctg

SEQ ID NO: 5606106 - DNA, 23 bp, Homo sapiens
ctgctgacctcactgtcctgtga

SEQ ID NO: 5606107 - DNA, 18 bp, Homo sapiens
ctgctgacctccacagct

SEQ ID NO: 5606108 - DNA, 16 bp, Homo sapiens
ctgctgacctcccacc

SEQ ID NO: 5606109 - DNA, 13 bp, Homo sapiens
ctgctgacctgct

SEQ ID NO: 5606110 - DNA, 13 bp, Homo sapiens
ctgctgacctgtt

SEQ ID NO: 5606111 - DNA, 19 bp, Homo sapiens
ctgctgaccttctgcggct

SEQ ID NO: 5606112 - DNA, 20 bp, Homo sapiens
ctgctgactgtttcattcac

SEQ ID NO: 5606113 - DNA, 13 bp, Homo sapiens
ctgctgagaacct

SEQ ID NO: 5606114 - DNA, 17 bp, Homo sapiens
ctgctgagaacctggcc

SEQ ID NO: 5606115 - DNA, 19 bp, Homo sapiens
ctgctgagaacctggcctt

SEQ ID NO: 5606116 - DNA, 20 bp, Homo sapiens
ctgctgagaacctggccttc

SEQ ID NO: 5606117 - DNA, 15 bp, Homo sapiens
ctgctgagagaccca

SEQ ID NO: 5606118 - DNA, 16 bp, Homo sapiens
ctgctgagagacccaa

SEQ ID NO: 5606119 - DNA, 19 bp, Homo sapiens
ctgctgagatacatacaga

SEQ ID NO: 5606120 - DNA, 16 bp, Homo sapiens
ctgctgagatcctgga

SEQ ID NO: 5606121 - DNA, 17 bp, Homo sapiens
ctgctgagatcctggac

SEQ ID NO: 5606122 - DNA, 18 bp, Homo sapiens
ctgctgagatcctggact

SEQ ID NO: 5606123 - DNA, 23 bp, Homo sapiens
ctgctgagatcctggactgaggg

SEQ ID NO: 5606124 - DNA, 17 bp, Homo sapiens
ctgctgagatctgctgt

SEQ ID NO: 5606125 - DNA, 13 bp, Homo sapiens
ctgctgagcagcc

SEQ ID NO: 5606126 - DNA, 21 bp, Homo sapiens
ctgctgagcagcccagcacaa

SEQ ID NO: 5606127 - DNA, 13 bp, Homo sapiens
ctgctgagccact

SEQ ID NO: 5606128 - DNA, 13 bp, Homo sapiens
ctgctgagccgca

SEQ ID NO: 5606129 - DNA, 15 bp, Homo sapiens
ctgctgagctctgag

SEQ ID NO: 5606130 - DNA, 16 bp, Homo sapiens
ctgctgagctctgaga

SEQ ID NO: 5606131 - DNA, 18 bp, Homo sapiens
ctgctgagctctgagagg

SEQ ID NO: 5606132 - DNA, 13 bp, Homo sapiens
ctgctgagctgcc

SEQ ID NO: 5606133 - DNA, 20 bp, Homo sapiens
ctgctgagctgcccctgctg

SEQ ID NO: 5606134 - DNA, 22 bp, Homo sapiens
ctgctgagctgcccctgctgct

SEQ ID NO: 5606135 - DNA, 16 bp, Homo sapiens
ctgctgagctggccct

SEQ ID NO: 5606136 - DNA, 13 bp, Homo sapiens
ctgctgagctggg

SEQ ID NO: 5606137 - DNA, 14 bp, Homo sapiens
ctgctgagctgggc

SEQ ID NO: 5606138 - DNA, 18 bp, Homo sapiens
ctgctgagctgggcccag

SEQ ID NO: 5606139 - DNA, 15 bp, Homo sapiens
ctgctgaggagtctg

SEQ ID NO: 5606140 - DNA, 17 bp, Homo sapiens
ctgctgaggagtctgag

SEQ ID NO: 5606141 - DNA, 11 bp, Homo sapiens
ctgctgaggcc

SEQ ID NO: 5606142 - DNA, 14 bp, Homo sapiens
ctgctgaggccaga

SEQ ID NO: 5606143 - DNA, 17 bp, Homo sapiens
ctgctgaggccagagga

SEQ ID NO: 5606144 - DNA, 13 bp, Homo sapiens
ctgctgaggccca

SEQ ID NO: 5606145 - DNA, 17 bp, Homo sapiens
ctgctgaggcccagtgc

SEQ ID NO: 5606146 - DNA, 19 bp, Homo sapiens
ctgctgagggaccttggag

SEQ ID NO: 5606147 - DNA, 23 bp, Homo sapiens
ctgctgagggaccttggagagct

SEQ ID NO: 5606148 - DNA, 14 bp, Homo sapiens
ctgctgagggtcca

SEQ ID NO: 5606149 - DNA, 15 bp, Homo sapiens
ctgctgagggtctgg

SEQ ID NO: 5606150 - DNA, 13 bp, Homo sapiens
ctgctgagtaagg

SEQ ID NO: 5606151 - DNA, 19 bp, Homo sapiens
ctgctgagtcgctctcatg

SEQ ID NO: 5606152 - DNA, 13 bp, Homo sapiens
ctgctgagtgctg

SEQ ID NO: 5606153 - DNA, 17 bp, Homo sapiens
ctgctgagtgctgggca

SEQ ID NO: 5606154 - DNA, 18 bp, Homo sapiens
ctgctgagtgctgggcac

SEQ ID NO: 5606155 - DNA, 19 bp, Homo sapiens
ctgctgagtgctgggcact

SEQ ID NO: 5606156 - DNA, 16 bp, Homo sapiens
ctgctgagttggcctg

SEQ ID NO: 5606157 - DNA, 21 bp, Homo sapiens
ctgctgagttggcctggccat

SEQ ID NO: 5606158 - DNA, 13 bp, Homo sapiens
ctgctgataaaat

SEQ ID NO: 5606159 - DNA, 19 bp, Homo sapiens
ctgctgatactgggtctgc

SEQ ID NO: 5606160 - DNA, 20 bp, Homo sapiens
ctgctgatactgggtctgcg

SEQ ID NO: 5606161 - DNA, 17 bp, Homo sapiens
ctgctgatatcaacagc

SEQ ID NO: 5606162 - DNA, 20 bp, Homo sapiens
ctgctgatatcaacagcttc

SEQ ID NO: 5606163 - DNA, 17 bp, Homo sapiens
ctgctgatattttctct

SEQ ID NO: 5606164 - DNA, 18 bp, Homo sapiens
ctgctgatattttctcta

SEQ ID NO: 5606165 - DNA, 16 bp, Homo sapiens
ctgctgatgcgctggg

SEQ ID NO: 5606166 - DNA, 21 bp, Homo sapiens
ctgctgattcttgtaaatctt

SEQ ID NO: 5606167 - DNA, 22 bp, Homo sapiens
ctgctgatttaaacacattaaa

SEQ ID NO: 5606168 - DNA, 22 bp, Homo sapiens
ctgctgcaacaagctcatccct

SEQ ID NO: 5606169 - DNA, 13 bp, Homo sapiens
ctgctgcaaggcc

SEQ ID NO: 5606170 - DNA, 19 bp, Homo sapiens
ctgctgcaaggcctttctg

SEQ ID NO: 5606171 - DNA, 22 bp, Homo sapiens
ctgctgcaaggcctttctgtgt

SEQ ID NO: 5606172 - DNA, 16 bp, Homo sapiens
ctgctgcacacactca

SEQ ID NO: 5606173 - DNA, 19 bp, Homo sapiens
ctgctgcacaggccctggg

SEQ ID NO: 5606174 - DNA, 16 bp, Homo sapiens
ctgctgcacatagcag

SEQ ID NO: 5606175 - DNA, 18 bp, Homo sapiens
ctgctgcaccaacccagc

SEQ ID NO: 5606176 - DNA, 23 bp, Homo sapiens
ctgctgcaccaacccagccgctg

SEQ ID NO: 5606177 - DNA, 23 bp, Homo sapiens
ctgctgcaccaacctcactgccc

SEQ ID NO: 5606178 - DNA, 11 bp, Homo sapiens
ctgctgcaccc

SEQ ID NO: 5606179 - DNA, 24 bp, Homo sapiens
ctgctgcacccaactactgagctg

SEQ ID NO: 5606180 - DNA, 14 bp, Homo sapiens
ctgctgcaccctgc

SEQ ID NO: 5606181 - DNA, 18 bp, Homo sapiens
ctgctgcactaggacttg

SEQ ID NO: 5606182 - DNA, 17 bp, Homo sapiens
ctgctgcagaggggcag

SEQ ID NO: 5606183 - DNA, 11 bp, Homo sapiens
ctgctgcaggg

SEQ ID NO: 5606184 - DNA, 18 bp, Homo sapiens
ctgctgcaggggctctgg

SEQ ID NO: 5606185 - DNA, 21 bp, Homo sapiens
ctgctgcaggggctctggaga

SEQ ID NO: 5606186 - DNA, 10 bp, Homo sapiens
ctgctgcagt

SEQ ID NO: 5606187 - DNA, 20 bp, Homo sapiens
ctgctgcagttaccacagca

SEQ ID NO: 5606188 - DNA, 16 bp, Homo sapiens
ctgctgcatagctcta

SEQ ID NO: 5606189 - DNA, 21 bp, Homo sapiens
ctgctgcatgccctctcaggc

SEQ ID NO: 5606190 - DNA, 16 bp, Homo sapiens
ctgctgcatggggtgg

SEQ ID NO: 5606191 - DNA, 13 bp, Homo sapiens
ctgctgccacagc

SEQ ID NO: 5606192 - DNA, 17 bp, Homo sapiens
ctgctgccaccaaatct

SEQ ID NO: 5606193 - DNA, 19 bp, Homo sapiens
ctgctgccaccaaatctgt

SEQ ID NO: 5606194 - DNA, 21 bp, Homo sapiens
ctgctgccaccaaatctgtct

SEQ ID NO: 5606195 - DNA, 11 bp, Homo sapiens
ctgctgccact

SEQ ID NO: 5606196 - DNA, 14 bp, Homo sapiens
ctgctgccactctg

SEQ ID NO: 5606197 - DNA, 17 bp, Homo sapiens
ctgctgccactctgctg

SEQ ID NO: 5606198 - DNA, 17 bp, Homo sapiens
ctgctgccactgagggg

SEQ ID NO: 5606199 - DNA, 14 bp, Homo sapiens
ctgctgccagagaa

SEQ ID NO: 5606200 - DNA, 14 bp, Homo sapiens
ctgctgccagcaca

SEQ ID NO: 5606201 - DNA, 20 bp, Homo sapiens
ctgctgccagcacagtaggt

SEQ ID NO: 5606202 - DNA, 12 bp, Homo sapiens
ctgctgccagct

SEQ ID NO: 5606203 - DNA, 11 bp, Homo sapiens
ctgctgccagg

SEQ ID NO: 5606204 - DNA, 20 bp, Homo sapiens
ctgctgccaggcccggcatg

SEQ ID NO: 5606205 - DNA, 22 bp, Homo sapiens
ctgctgccaggctcccactgcc

SEQ ID NO: 5606206 - DNA, 17 bp, Homo sapiens
ctgctgccagggcttcc

SEQ ID NO: 5606207 - DNA, 19 bp, Homo sapiens
ctgctgccagtgcagccac

SEQ ID NO: 5606208 - DNA, 15 bp, Homo sapiens
ctgctgccatccatg

SEQ ID NO: 5606209 - DNA, 21 bp, Homo sapiens
ctgctgccatgattttggcca

SEQ ID NO: 5606210 - DNA, 22 bp, Homo sapiens
ctgctgcccacggccacccacc

SEQ ID NO: 5606211 - DNA, 14 bp, Homo sapiens
ctgctgcccaggcc

SEQ ID NO: 5606212 - DNA, 17 bp, Homo sapiens
ctgctgcccaggccaca

SEQ ID NO: 5606213 - DNA, 20 bp, Homo sapiens
ctgctgcccaggctagagtg

SEQ ID NO: 5606214 - DNA, 19 bp, Homo sapiens
ctgctgcccaggctgtgca

SEQ ID NO: 5606215 - DNA, 16 bp, Homo sapiens
ctgctgccccaaagga

SEQ ID NO: 5606216 - DNA, 13 bp, Homo sapiens
ctgctgccccagc

SEQ ID NO: 5606217 - DNA, 15 bp, Homo sapiens
ctgctgccccctggc

SEQ ID NO: 5606218 - DNA, 17 bp, Homo sapiens
ctgctgccccctggctt

SEQ ID NO: 5606219 - DNA, 20 bp, Homo sapiens
ctgctgcccccttccccagc

SEQ ID NO: 5606220 - DNA, 23 bp, Homo sapiens
ctgctgcccccttccccagccct

SEQ ID NO: 5606221 - DNA, 16 bp, Homo sapiens
ctgctgccccgcttcc

SEQ ID NO: 5606222 - DNA, 23 bp, Homo sapiens
ctgctgccccgcttccccacaga

SEQ ID NO: 5606223 - DNA, 18 bp, Homo sapiens
ctgctgcccctccctgcc

SEQ ID NO: 5606224 - DNA, 14 bp, Homo sapiens
ctgctgcccctgca

SEQ ID NO: 5606225 - DNA, 15 bp, Homo sapiens
ctgctgcccctgcag

SEQ ID NO: 5606226 - DNA, 23 bp, Homo sapiens
ctgctgcccgtgaggagggggag

SEQ ID NO: 5606227 - DNA, 23 bp, Homo sapiens
ctgctgccctagttttctttcct

SEQ ID NO: 5606228 - DNA, 13 bp, Homo sapiens
ctgctgccctcca

SEQ ID NO: 5606229 - DNA, 13 bp, Homo sapiens
ctgctgccctccc

SEQ ID NO: 5606230 - DNA, 16 bp, Homo sapiens
ctgctgccctcccaca

SEQ ID NO: 5606231 - DNA, 14 bp, Homo sapiens
ctgctgccctcccc

SEQ ID NO: 5606232 - DNA, 23 bp, Homo sapiens
ctgctgcccttaggccacatggg

SEQ ID NO: 5606233 - DNA, 15 bp, Homo sapiens
ctgctgccgcaggag

SEQ ID NO: 5606234 - DNA, 19 bp, Homo sapiens
ctgctgccgccactggctg

SEQ ID NO: 5606235 - DNA, 20 bp, Homo sapiens
ctgctgccgccccacccaga

SEQ ID NO: 5606236 - DNA, 17 bp, Homo sapiens
ctgctgccgcccttcct

SEQ ID NO: 5606237 - DNA, 19 bp, Homo sapiens
ctgctgccgcccttcctgg

SEQ ID NO: 5606238 - DNA, 24 bp, Homo sapiens
ctgctgccgcctcaccttccttga

SEQ ID NO: 5606239 - DNA, 17 bp, Homo sapiens
ctgctgccgcctcccag

SEQ ID NO: 5606240 - DNA, 21 bp, Homo sapiens
ctgctgccgcctcccagcctg

SEQ ID NO: 5606241 - DNA, 16 bp, Homo sapiens
ctgctgccggctctgg

SEQ ID NO: 5606242 - DNA, 14 bp, Homo sapiens
ctgctgcctaataa

SEQ ID NO: 5606243 - DNA, 17 bp, Homo sapiens
ctgctgcctaataaaga

SEQ ID NO: 5606244 - DNA, 13 bp, Homo sapiens
ctgctgcctcagc

SEQ ID NO: 5606245 - DNA, 16 bp, Homo sapiens
ctgctgcctcagctca

SEQ ID NO: 5606246 - DNA, 17 bp, Homo sapiens
ctgctgcctccaagtca

SEQ ID NO: 5606247 - DNA, 14 bp, Homo sapiens
ctgctgcctcccca

SEQ ID NO: 5606248 - DNA, 21 bp, Homo sapiens
ctgctgcctccctggggacca

SEQ ID NO: 5606249 - DNA, 23 bp, Homo sapiens
ctgctgcctccctggggaccagg

SEQ ID NO: 5606250 - DNA, 16 bp, Homo sapiens
ctgctgcctctctttc

SEQ ID NO: 5606251 - DNA, 15 bp, Homo sapiens
ctgctgcctctgaaa

SEQ ID NO: 5606252 - DNA, 16 bp, Homo sapiens
ctgctgcctctgtgga

SEQ ID NO: 5606253 - DNA, 20 bp, Homo sapiens
ctgctgcctctttccctagg

SEQ ID NO: 5606254 - DNA, 22 bp, Homo sapiens
ctgctgcctctttccctaggaa

SEQ ID NO: 5606255 - DNA, 11 bp, Homo sapiens
ctgctgcctgc

SEQ ID NO: 5606256 - DNA, 21 bp, Homo sapiens
ctgctgcctgcccgcacagca

SEQ ID NO: 5606257 - DNA, 15 bp, Homo sapiens
ctgctgcctgctcat

SEQ ID NO: 5606258 - DNA, 15 bp, Homo sapiens
ctgctgcctgctgag

SEQ ID NO: 5606259 - DNA, 19 bp, Homo sapiens
ctgctgcctggccactgct

SEQ ID NO: 5606260 - DNA, 21 bp, Homo sapiens
ctgctgcctggccactgctcc

SEQ ID NO: 5606261 - DNA, 23 bp, Homo sapiens
ctgctgccttctgacggccctgc

SEQ ID NO: 5606262 - DNA, 17 bp, Homo sapiens
ctgctgccttttctgga

SEQ ID NO: 5606263 - DNA, 18 bp, Homo sapiens
ctgctgcgccccaggccc

SEQ ID NO: 5606264 - DNA, 20 bp, Homo sapiens
ctgctgcgcccttaccttcc

SEQ ID NO: 5606265 - DNA, 21 bp, Homo sapiens
ctgctgcgcccttaccttccc

SEQ ID NO: 5606266 - DNA, 13 bp, Homo sapiens
ctgctgcgctgct

SEQ ID NO: 5606267 - DNA, 16 bp, Homo sapiens
ctgctgcgctgcttgg

SEQ ID NO: 5606268 - DNA, 17 bp, Homo sapiens
ctgctgcgtccccactc

SEQ ID NO: 5606269 - DNA, 19 bp, Homo sapiens
ctgctgcgtccccactccc

SEQ ID NO: 5606270 - DNA, 17 bp, Homo sapiens
ctgcttctcccaggcaa

SEQ ID NO: 5606271 - DNA, 18 bp, Homo sapiens
ctgcttctcccaggcaag

SEQ ID NO: 5606272 - DNA, 19 bp, Homo sapiens
ctgcttctcccaggcaagg

SEQ ID NO: 5606273 - DNA, 15 bp, Homo sapiens
ctgcttctcccccca

SEQ ID NO: 5606274 - DNA, 16 bp, Homo sapiens
ctgcttctcccgccat

SEQ ID NO: 5606275 - DNA, 20 bp, Homo sapiens
ctgcttctcccgccattggc

SEQ ID NO: 5606276 - DNA, 17 bp, Homo sapiens
ctgcttctcctcccagc

SEQ ID NO: 5606277 - DNA, 15 bp, Homo sapiens
ctgcttctcctggac

SEQ ID NO: 5606278 - DNA, 17 bp, Homo sapiens
ctgcttctcggaggcca

SEQ ID NO: 5606279 - DNA, 19 bp, Homo sapiens
ctgcttctcggaggccagg

SEQ ID NO: 5606280 - DNA, 23 bp, Homo sapiens
ctgcttctcggaggccaggccct

SEQ ID NO: 5606281 - DNA, 19 bp, Homo sapiens
ctgcttctcggccagcccg

SEQ ID NO: 5606282 - DNA, 15 bp, Homo sapiens
ctgcttctctgactt

SEQ ID NO: 5606283 - DNA, 16 bp, Homo sapiens
ctgcttctctgacttc

SEQ ID NO: 5606284 - DNA, 17 bp, Homo sapiens
ctgcttctctgacttct

SEQ ID NO: 5606285 - DNA, 14 bp, Homo sapiens
ctgcttctgaactc

SEQ ID NO: 5606286 - DNA, 15 bp, Homo sapiens
ctgcttctgaactca

SEQ ID NO: 5606287 - DNA, 15 bp, Homo sapiens
ctgcttctgaatgtg

SEQ ID NO: 5606288 - DNA, 19 bp, Homo sapiens
ctgcttctgacataatcca

SEQ ID NO: 5606289 - DNA, 20 bp, Homo sapiens
ctgcttctgcaccttatctt

SEQ ID NO: 5606290 - DNA, 14 bp, Homo sapiens
ctgcttctgcattc

SEQ ID NO: 5606291 - DNA, 14 bp, Homo sapiens
ctgcttctgcccac

SEQ ID NO: 5606292 - DNA, 12 bp, Homo sapiens
ctgcttctgctc

SEQ ID NO: 5606293 - DNA, 14 bp, Homo sapiens
ctgcttctgctcca

SEQ ID NO: 5606294 - DNA, 15 bp, Homo sapiens
ctgcttctgctccag

SEQ ID NO: 5606295 - DNA, 18 bp, Homo sapiens
ctgcttctgctccagccc

SEQ ID NO: 5606296 - DNA, 19 bp, Homo sapiens
ctgcttctgctccagcccc

SEQ ID NO: 5606297 - DNA, 13 bp, Homo sapiens
ctgcttctgggcc

SEQ ID NO: 5606298 - DNA, 23 bp, Homo sapiens
ctgcttcttcaagcacctgcaga

SEQ ID NO: 5606299 - DNA, 16 bp, Homo sapiens
ctgcttcttccccagg

SEQ ID NO: 5606300 - DNA, 19 bp, Homo sapiens
ctgcttcttccccagggtt

SEQ ID NO: 5606301 - DNA, 16 bp, Homo sapiens
ctgcttcttgctggtg

SEQ ID NO: 5606302 - DNA, 13 bp, Homo sapiens
ctgcttcttgctt

SEQ ID NO: 5606303 - DNA, 20 bp, Homo sapiens
ctgcttgaaacttcagccct

SEQ ID NO: 5606304 - DNA, 21 bp, Homo sapiens
ctgcttgaaacttcagccctg

SEQ ID NO: 5606305 - DNA, 18 bp, Homo sapiens
ctgcttgaactgctgcca

SEQ ID NO: 5606306 - DNA, 14 bp, Homo sapiens
ctgcttgaaggaac

SEQ ID NO: 5606307 - DNA, 18 bp, Homo sapiens
ctgcttgacagactcaag

SEQ ID NO: 5606308 - DNA, 23 bp, Homo sapiens
ctgcttgacctagctctttgggc

SEQ ID NO: 5606309 - DNA, 17 bp, Homo sapiens
ctgcttgactatcacat

SEQ ID NO: 5606310 - DNA, 18 bp, Homo sapiens
ctgcttgactatcacata

SEQ ID NO: 5606311 - DNA, 20 bp, Homo sapiens
ctgcttgactatcacataca

SEQ ID NO: 5606312 - DNA, 22 bp, Homo sapiens
ctgcttgactatcacatacaat

SEQ ID NO: 5606313 - DNA, 20 bp, Homo sapiens
ctgcttgagctcaggagttc

SEQ ID NO: 5606314 - DNA, 16 bp, Homo sapiens
ctgcttgaggaaaaca

SEQ ID NO: 5606315 - DNA, 22 bp, Homo sapiens
ctgcttgaggaggggcacctgc

SEQ ID NO: 5606316 - DNA, 21 bp, Homo sapiens
ctgcttgaggcaactcatctt

SEQ ID NO: 5606317 - DNA, 16 bp, Homo sapiens
ctgcttgagtggacag

SEQ ID NO: 5606318 - DNA, 16 bp, Homo sapiens
ctgcttgagttgcctg

SEQ ID NO: 5606319 - DNA, 17 bp, Homo sapiens
ctgcttgagttgcctga

SEQ ID NO: 5606320 - DNA, 21 bp, Homo sapiens
ctgcttgatgaagcaaggaag

SEQ ID NO: 5606321 - DNA, 18 bp, Homo sapiens
ctgcttgcacacttcccc

SEQ ID NO: 5606322 - DNA, 14 bp, Homo sapiens
ctgcttgcagccag

SEQ ID NO: 5606323 - DNA, 17 bp, Homo sapiens
ctgcttgcagccaggag

SEQ ID NO: 5606324 - DNA, 18 bp, Homo sapiens
ctgcttgcagccaggaga

SEQ ID NO: 5606325 - DNA, 23 bp, Homo sapiens
ctgcttgccaaggcagaggcctg

SEQ ID NO: 5606326 - DNA, 12 bp, Homo sapiens
ctgcttgccagc

SEQ ID NO: 5606327 - DNA, 14 bp, Homo sapiens
ctgcttgccagcca

SEQ ID NO: 5606328 - DNA, 16 bp, Homo sapiens
ctgcttgccagccagg

SEQ ID NO: 5606329 - DNA, 19 bp, Homo sapiens
ctgcttgccagccaggagt

SEQ ID NO: 5606330 - DNA, 16 bp, Homo sapiens
ctgcttgccatccctc

SEQ ID NO: 5606331 - DNA, 15 bp, Homo sapiens
ctgcttgccctaagc

SEQ ID NO: 5606332 - DNA, 19 bp, Homo sapiens
ctgcttgccctaagcagaa

SEQ ID NO: 5606333 - DNA, 22 bp, Homo sapiens
ctgcttgccctaagcagaaagt

SEQ ID NO: 5606334 - DNA, 21 bp, Homo sapiens
ctgcttgctaccaatctgtga

SEQ ID NO: 5606335 - DNA, 22 bp, Homo sapiens
ctgcttgctggaaaactgccac

SEQ ID NO: 5606336 - DNA, 11 bp, Homo sapiens
ctgcttgctta

SEQ ID NO: 5606337 - DNA, 11 bp, Homo sapiens
ctgcttgcttt

SEQ ID NO: 5606338 - DNA, 16 bp, Homo sapiens
ctgcttggagtgcccc

SEQ ID NO: 5606339 - DNA, 17 bp, Homo sapiens
ctgcttggagtgcccca

SEQ ID NO: 5606340 - DNA, 22 bp, Homo sapiens
ctgcttggatgcgagcttggcc

SEQ ID NO: 5606341 - DNA, 23 bp, Homo sapiens
ctgcttggatgcgagcttggcct

SEQ ID NO: 5606342 - DNA, 13 bp, Homo sapiens
ctgcttggccaga

SEQ ID NO: 5606343 - DNA, 16 bp, Homo sapiens
ctgcttggccagatgc

SEQ ID NO: 5606344 - DNA, 16 bp, Homo sapiens
ctgcttggcccagggg

SEQ ID NO: 5606345 - DNA, 21 bp, Homo sapiens
ctgcttggcttatgaaaacac

SEQ ID NO: 5606346 - DNA, 13 bp, Homo sapiens
ctgcttggcttcc

SEQ ID NO: 5606347 - DNA, 13 bp, Homo sapiens
ctgcttgggcttc

SEQ ID NO: 5606348 - DNA, 16 bp, Homo sapiens
ctgcttggggcctggc

SEQ ID NO: 5606349 - DNA, 21 bp, Homo sapiens
ctgcttggggggtgatgaggg

SEQ ID NO: 5606350 - DNA, 22 bp, Homo sapiens
ctgcttggggggtgatgagggc

SEQ ID NO: 5606351 - DNA, 18 bp, Homo sapiens
ctgcttgggtggagaagc

SEQ ID NO: 5606352 - DNA, 17 bp, Homo sapiens
ctgcttggtcaaatccc

SEQ ID NO: 5606353 - DNA, 23 bp, Homo sapiens
ctgcttggtctttcattgctaag

SEQ ID NO: 5606354 - DNA, 18 bp, Homo sapiens
ctgcttggtttagctgtg

SEQ ID NO: 5606355 - DNA, 18 bp, Homo sapiens
ctgcttgtactaagccag

SEQ ID NO: 5606356 - DNA, 20 bp, Homo sapiens
ctgcttgtactaagccagga

SEQ ID NO: 5606357 - DNA, 17 bp, Homo sapiens
ctgcttgtccctgccca

SEQ ID NO: 5606358 - DNA, 19 bp, Homo sapiens
ctgcttgtgaccttgactt

SEQ ID NO: 5606359 - DNA, 20 bp, Homo sapiens
ctgcttgtgaccttgacttg

SEQ ID NO: 5606360 - DNA, 21 bp, Homo sapiens
ctgcttgtgaccttgacttgc

SEQ ID NO: 5606361 - DNA, 20 bp, Homo sapiens
ctgcttgtgcctcccttccc

SEQ ID NO: 5606362 - DNA, 21 bp, Homo sapiens
ctgcttgtgcctcccttccca

SEQ ID NO: 5606363 - DNA, 19 bp, Homo sapiens
ctgcttgtgtccctcctgg

SEQ ID NO: 5606364 - DNA, 21 bp, Homo sapiens
ctgcttgtgttgggccccagg

SEQ ID NO: 5606365 - DNA, 14 bp, Homo sapiens
ctgcttgtttccta

SEQ ID NO: 5606366 - DNA, 23 bp, Homo sapiens
ctgctttaaaaaaaatccttcta

SEQ ID NO: 5606367 - DNA, 17 bp, Homo sapiens
ctgctttaaagggcctg

SEQ ID NO: 5606368 - DNA, 17 bp, Homo sapiens
ctgctttaaatctatct

SEQ ID NO: 5606369 - DNA, 18 bp, Homo sapiens
ctgctttaaatctatcta

SEQ ID NO: 5606370 - DNA, 17 bp, Homo sapiens
ctgctttaacagtggag

SEQ ID NO: 5606371 - DNA, 20 bp, Homo sapiens
ctgctttaattacctggtga

SEQ ID NO: 5606372 - DNA, 21 bp, Homo sapiens
ctgctttaattgtgaattgat

SEQ ID NO: 5606373 - DNA, 23 bp, Homo sapiens
ctgctttagaatgttttccttct

SEQ ID NO: 5606374 - DNA, 16 bp, Homo sapiens
ctgctttagacttgaa

SEQ ID NO: 5606375 - DNA, 16 bp, Homo sapiens
ctgctttagagctagg

SEQ ID NO: 5606376 - DNA, 22 bp, Homo sapiens
ctgctttagtttcacattgcag

SEQ ID NO: 5606377 - DNA, 13 bp, Homo sapiens
ctgctttattgcc

SEQ ID NO: 5606378 - DNA, 17 bp, Homo sapiens
ctgctttattgcctctg

SEQ ID NO: 5606379 - DNA, 21 bp, Homo sapiens
ctgctttcaacttaaatcact

SEQ ID NO: 5606380 - DNA, 18 bp, Homo sapiens
ctgctttcagatactgga

SEQ ID NO: 5606381 - DNA, 21 bp, Homo sapiens
ctgctttcagatactggattg

SEQ ID NO: 5606382 - DNA, 14 bp, Homo sapiens
ctgctttcagtgcc

SEQ ID NO: 5606383 - DNA, 15 bp, Homo sapiens
ctgctttcagtgcct

SEQ ID NO: 5606384 - DNA, 19 bp, Homo sapiens
ctgctttcagtgcctgctg

SEQ ID NO: 5606385 - DNA, 15 bp, Homo sapiens
ctgctttcatccagc

SEQ ID NO: 5606386 - DNA, 18 bp, Homo sapiens
ctgctttccagcctgggc

SEQ ID NO: 5606387 - DNA, 19 bp, Homo sapiens
ctgctttccatgggcccgc

SEQ ID NO: 5606388 - DNA, 19 bp, Homo sapiens
ctgctttcccctgtgggga

SEQ ID NO: 5606389 - DNA, 21 bp, Homo sapiens
ctgctttcccctgtggggatc

SEQ ID NO: 5606390 - DNA, 16 bp, Homo sapiens
ctgctttccctcccca

SEQ ID NO: 5606391 - DNA, 16 bp, Homo sapiens
ctgctttccttttctc

SEQ ID NO: 5606392 - DNA, 17 bp, Homo sapiens
ctgctttccttttctct

SEQ ID NO: 5606393 - DNA, 21 bp, Homo sapiens
ctgctttctattacccctcat

SEQ ID NO: 5606394 - DNA, 12 bp, Homo sapiens
ctgctttctcct

SEQ ID NO: 5606395 - DNA, 17 bp, Homo sapiens
ctgctttctgatacatc

SEQ ID NO: 5606396 - DNA, 19 bp, Homo sapiens
ctgctttctgatgttgcct

SEQ ID NO: 5606397 - DNA, 23 bp, Homo sapiens
ctgctttctgcctctcctccaca

SEQ ID NO: 5606398 - DNA, 14 bp, Homo sapiens
ctgctttctggtat

SEQ ID NO: 5606399 - DNA, 14 bp, Homo sapiens
ctgctttctgttca

SEQ ID NO: 5606400 - DNA, 15 bp, Homo sapiens
ctgctttctgttcat

SEQ ID NO: 5606401 - DNA, 16 bp, Homo sapiens
ctgctttctgttcatc

SEQ ID NO: 5606402 - DNA, 17 bp, Homo sapiens
ctgctttctgttcatct

SEQ ID NO: 5606403 - DNA, 16 bp, Homo sapiens
ctgctttctgttgtca

SEQ ID NO: 5606404 - DNA, 22 bp, Homo sapiens
ctgctttcttctctgcctcctc

SEQ ID NO: 5606405 - DNA, 18 bp, Homo sapiens
ctgctttcttgccacaca

SEQ ID NO: 5606406 - DNA, 19 bp, Homo sapiens
ctgctttgaataaatgtgt

SEQ ID NO: 5606407 - DNA, 16 bp, Homo sapiens
ctgctttgacgggcca

SEQ ID NO: 5606408 - DNA, 21 bp, Homo sapiens
ctgctttgacgggccaggccc

SEQ ID NO: 5606409 - DNA, 22 bp, Homo sapiens
ctgctttgacgggccaggccct

SEQ ID NO: 5606410 - DNA, 23 bp, Homo sapiens
ctgctttgacgggccaggccctg

SEQ ID NO: 5606411 - DNA, 21 bp, Homo sapiens
ctgctttgactgagcagactg

SEQ ID NO: 5606412 - DNA, 22 bp, Homo sapiens
ctgctttgattggttgtgcctt

SEQ ID NO: 5606413 - DNA, 21 bp, Homo sapiens
ctgctttgatttttgaagttg

SEQ ID NO: 5606414 - DNA, 22 bp, Homo sapiens
ctgctttgcaaacatcaacctg

SEQ ID NO: 5606415 - DNA, 14 bp, Homo sapiens
ctgctttgcatctt

SEQ ID NO: 5606416 - DNA, 19 bp, Homo sapiens
ctgctttgcatctttgtta

SEQ ID NO: 5606417 - DNA, 17 bp, Homo sapiens
ctgctttgccccactgg

SEQ ID NO: 5606418 - DNA, 17 bp, Homo sapiens
ctgctttgcgctggtgg

SEQ ID NO: 5606419 - DNA, 18 bp, Homo sapiens
ctgctttgcgtgcccggg

SEQ ID NO: 5606420 - DNA, 24 bp, Homo sapiens
ctgctttggatagtctcctacgca

SEQ ID NO: 5606421 - DNA, 15 bp, Homo sapiens
ctgctttggcagtgc

SEQ ID NO: 5606422 - DNA, 15 bp, Homo sapiens
ctgctttggcctttc

SEQ ID NO: 5606423 - DNA, 23 bp, Homo sapiens
ctgctttgggaagactgaggcat

SEQ ID NO: 5606424 - DNA, 22 bp, Homo sapiens
ctgctttgggatttaatttcca

SEQ ID NO: 5606425 - DNA, 16 bp, Homo sapiens
ctgctttgggctggga

SEQ ID NO: 5606426 - DNA, 23 bp, Homo sapiens
ctgctttggggcttatcagaact

SEQ ID NO: 5606427 - DNA, 20 bp, Homo sapiens
ctgctttgtagtttgcccag

SEQ ID NO: 5606428 - DNA, 23 bp, Homo sapiens
ctgctttgtagtttgcccagagt

SEQ ID NO: 5606429 - DNA, 17 bp, Homo sapiens
ctgctttgttaatgaaa

SEQ ID NO: 5606430 - DNA, 18 bp, Homo sapiens
ctgctttgttaatgaaaa

SEQ ID NO: 5606431 - DNA, 20 bp, Homo sapiens
ctgctttgttgttctgcctg

SEQ ID NO: 5606432 - DNA, 19 bp, Homo sapiens
ctgctttgttttggctgct

SEQ ID NO: 5606433 - DNA, 17 bp, Homo sapiens
ctgcttttaccatgccc

SEQ ID NO: 5606434 - DNA, 17 bp, Homo sapiens
ctgcttttagttcatat

SEQ ID NO: 5606435 - DNA, 22 bp, Homo sapiens
ctgcttttatgtagtttaggct

SEQ ID NO: 5606436 - DNA, 18 bp, Homo sapiens
ctgcttttcactgctgca

SEQ ID NO: 5606437 - DNA, 18 bp, Homo sapiens
ctgcttttcattagcagt

SEQ ID NO: 5606438 - DNA, 13 bp, Homo sapiens
ctgcttttccagg

SEQ ID NO: 5606439 - DNA, 20 bp, Homo sapiens
ctgcttttccaggatcctgc

SEQ ID NO: 5606440 - DNA, 22 bp, Homo sapiens
ctgcttttccaggatcctgcag

SEQ ID NO: 5606441 - DNA, 24 bp, Homo sapiens
ctgcttttccaggatcctgcagga

SEQ ID NO: 5606442 - DNA, 22 bp, Homo sapiens
ctgcttttccctttgtgagtca

SEQ ID NO: 5606443 - DNA, 20 bp, Homo sapiens
ctgcttttcctgtctgtata

SEQ ID NO: 5606444 - DNA, 23 bp, Homo sapiens
ctgcttttccttggggcaggcag

SEQ ID NO: 5606445 - DNA, 15 bp, Homo sapiens
ctggacttcctgtca

SEQ ID NO: 5606446 - DNA, 15 bp, Homo sapiens
ctggacttctacctg

SEQ ID NO: 5606447 - DNA, 19 bp, Homo sapiens
ctggacttctacctgccct

SEQ ID NO: 5606448 - DNA, 16 bp, Homo sapiens
ctggacttctgggaga

SEQ ID NO: 5606449 - DNA, 12 bp, Homo sapiens
ctggacttctgt

SEQ ID NO: 5606450 - DNA, 18 bp, Homo sapiens
ctggacttgagcttggca

SEQ ID NO: 5606451 - DNA, 15 bp, Homo sapiens
ctggacttgcctctg

SEQ ID NO: 5606452 - DNA, 17 bp, Homo sapiens
ctggacttggcccctgc

SEQ ID NO: 5606453 - DNA, 18 bp, Homo sapiens
ctggactttcctgttgtc

SEQ ID NO: 5606454 - DNA, 18 bp, Homo sapiens
ctggactttctctaataa

SEQ ID NO: 5606455 - DNA, 19 bp, Homo sapiens
ctggactttctctaataat

SEQ ID NO: 5606456 - DNA, 21 bp, Homo sapiens
ctggactttctctaataataa

SEQ ID NO: 5606457 - DNA, 18 bp, Homo sapiens
ctggactttgcttcccct

SEQ ID NO: 5606458 - DNA, 20 bp, Homo sapiens
ctggactttgcttcccctcc

SEQ ID NO: 5606459 - DNA, 22 bp, Homo sapiens
ctggactttgcttcccctccag

SEQ ID NO: 5606460 - DNA, 23 bp, Homo sapiens
ctggactttggttctctccagga

SEQ ID NO: 5606461 - DNA, 20 bp, Homo sapiens
ctggacttttgcagcttcct

SEQ ID NO: 5606462 - DNA, 17 bp, Homo sapiens
ctggagaaaaaaattgc

SEQ ID NO: 5606463 - DNA, 21 bp, Homo sapiens
ctggagaaaccttcactccag

SEQ ID NO: 5606464 - DNA, 14 bp, Homo sapiens
ctggagaaagagct

SEQ ID NO: 5606465 - DNA, 16 bp, Homo sapiens
ctggagaaagagctgc

SEQ ID NO: 5606466 - DNA, 19 bp, Homo sapiens
ctggagaaagagctgcctg

SEQ ID NO: 5606467 - DNA, 23 bp, Homo sapiens
ctggagaaagatgcagtcctcag

SEQ ID NO: 5606468 - DNA, 12 bp, Homo sapiens
ctggagaaagga

SEQ ID NO: 5606469 - DNA, 16 bp, Homo sapiens
ctggagaaaggatggc

SEQ ID NO: 5606470 - DNA, 23 bp, Homo sapiens
ctggagaaagggccctgggcctg

SEQ ID NO: 5606471 - DNA, 14 bp, Homo sapiens
ctggagaacagtgg

SEQ ID NO: 5606472 - DNA, 13 bp, Homo sapiens
ctggagaactaga

SEQ ID NO: 5606473 - DNA, 22 bp, Homo sapiens
ctggagaactagaacctggagg

SEQ ID NO: 5606474 - DNA, 14 bp, Homo sapiens
ctggagaactagag

SEQ ID NO: 5606475 - DNA, 15 bp, Homo sapiens
ctggagaactagaga

SEQ ID NO: 5606476 - DNA, 21 bp, Homo sapiens
ctggagaagaatatcaaataa

SEQ ID NO: 5606477 - DNA, 15 bp, Homo sapiens
ctggagaagctccca

SEQ ID NO: 5606478 - DNA, 20 bp, Homo sapiens
ctggagaagctcccaggaac

SEQ ID NO: 5606479 - DNA, 19 bp, Homo sapiens
ctggagaagctgatgcttt

SEQ ID NO: 5606480 - DNA, 12 bp, Homo sapiens
ctggagaaggac

SEQ ID NO: 5606481 - DNA, 17 bp, Homo sapiens
ctggagaaggacatgag

SEQ ID NO: 5606482 - DNA, 21 bp, Homo sapiens
ctggagaaggcctggaagagc

SEQ ID NO: 5606483 - DNA, 22 bp, Homo sapiens
ctggagaaggtattagcaaagc

SEQ ID NO: 5606484 - DNA, 13 bp, Homo sapiens
ctggagaataatt

SEQ ID NO: 5606485 - DNA, 22 bp, Homo sapiens
ctggagaattgaaaaggactct

SEQ ID NO: 5606486 - DNA, 14 bp, Homo sapiens
ctggagacagcccc

SEQ ID NO: 5606487 - DNA, 15 bp, Homo sapiens
ctggagacagcccca

SEQ ID NO: 5606488 - DNA, 16 bp, Homo sapiens
ctggagacagccccag

SEQ ID NO: 5606489 - DNA, 17 bp, Homo sapiens
ctggagacagccccaga

SEQ ID NO: 5606490 - DNA, 23 bp, Homo sapiens
ctggagaccagaacagcatggcc

SEQ ID NO: 5606491 - DNA, 18 bp, Homo sapiens
ctggagaccaggactctg

SEQ ID NO: 5606492 - DNA, 20 bp, Homo sapiens
ctggagaccatgcagagcgc

SEQ ID NO: 5606493 - DNA, 17 bp, Homo sapiens
ctggagacccaccccac

SEQ ID NO: 5606494 - DNA, 19 bp, Homo sapiens
ctggagaccccaccagcct

SEQ ID NO: 5606495 - DNA, 20 bp, Homo sapiens
ctggagacccccccccaact

SEQ ID NO: 5606496 - DNA, 15 bp, Homo sapiens
ctggagaccctgcgc

SEQ ID NO: 5606497 - DNA, 20 bp, Homo sapiens
ctggagaccctgcgcccctg

SEQ ID NO: 5606498 - DNA, 22 bp, Homo sapiens
ctggagaccctgcgcccctgcc

SEQ ID NO: 5606499 - DNA, 22 bp, Homo sapiens
ctggagacgtggaacctctgtc

SEQ ID NO: 5606500 - DNA, 19 bp, Homo sapiens
ctggagactcctaggcagg

SEQ ID NO: 5606501 - DNA, 23 bp, Homo sapiens
ctggagactgtgtgtgccctctg

SEQ ID NO: 5606502 - DNA, 14 bp, Homo sapiens
ctggagagaacagg

SEQ ID NO: 5606503 - DNA, 20 bp, Homo sapiens
ctggagagaagcaagccagc

SEQ ID NO: 5606504 - DNA, 22 bp, Homo sapiens
ctggagagccagaacctggagg

SEQ ID NO: 5606505 - DNA, 13 bp, Homo sapiens
ctggagagcgagg

SEQ ID NO: 5606506 - DNA, 14 bp, Homo sapiens
ctggagagcgagga

SEQ ID NO: 5606507 - DNA, 19 bp, Homo sapiens
ctggagagcgaggaggcgc

SEQ ID NO: 5606508 - DNA, 21 bp, Homo sapiens
ctggagagcgaggaggcgcgg

SEQ ID NO: 5606509 - DNA, 13 bp, Homo sapiens
ctggagagctaga

SEQ ID NO: 5606510 - DNA, 20 bp, Homo sapiens
ctggagagctagaacctgga

SEQ ID NO: 5606511 - DNA, 22 bp, Homo sapiens
ctggagagctagaacctggagg

SEQ ID NO: 5606512 - DNA, 20 bp, Homo sapiens
ctggagagctgtgtctattt

SEQ ID NO: 5606513 - DNA, 19 bp, Homo sapiens
ctggagaggaagccagtgg

SEQ ID NO: 5606514 - DNA, 22 bp, Homo sapiens
ctggagaggaagccagtggagc

SEQ ID NO: 5606515 - DNA, 19 bp, Homo sapiens
ctggagaggacggccctgc

SEQ ID NO: 5606516 - DNA, 20 bp, Homo sapiens
ctggagaggacggccctgcc

SEQ ID NO: 5606517 - DNA, 18 bp, Homo sapiens
ctggagaggagccctgcc

SEQ ID NO: 5606518 - DNA, 13 bp, Homo sapiens
ctggagaggcctg

SEQ ID NO: 5606519 - DNA, 17 bp, Homo sapiens
ctggagaggcctggggt

SEQ ID NO: 5606520 - DNA, 22 bp, Homo sapiens
ctggagaggggcctgggaaagg

SEQ ID NO: 5606521 - DNA, 19 bp, Homo sapiens
ctggagaggtggctgcgcc

SEQ ID NO: 5606522 - DNA, 16 bp, Homo sapiens
ctggagagtctcactc

SEQ ID NO: 5606523 - DNA, 20 bp, Homo sapiens
ctggagagttcaatggctgc

SEQ ID NO: 5606524 - DNA, 19 bp, Homo sapiens
ctggagataacagcctctt

SEQ ID NO: 5606525 - DNA, 22 bp, Homo sapiens
ctggagataacagcctcttgcc

SEQ ID NO: 5606526 - DNA, 22 bp, Homo sapiens
ctggagatactggtggaagttc

SEQ ID NO: 5606527 - DNA, 21 bp, Homo sapiens
ctggagatcctaactgagaat

SEQ ID NO: 5606528 - DNA, 18 bp, Homo sapiens
ctggagatcctcctgcag

SEQ ID NO: 5606529 - DNA, 23 bp, Homo sapiens
ctggagatcctcctgcagaccac

SEQ ID NO: 5606530 - DNA, 21 bp, Homo sapiens
ctggagatctgaacccagctg

SEQ ID NO: 5606531 - DNA, 17 bp, Homo sapiens
ctggagatgaggccaga

SEQ ID NO: 5606532 - DNA, 18 bp, Homo sapiens
ctggagatgaggccagac

SEQ ID NO: 5606533 - DNA, 14 bp, Homo sapiens
ctggagatgatgat

SEQ ID NO: 5606534 - DNA, 16 bp, Homo sapiens
ctggagatgatgatga

SEQ ID NO: 5606535 - DNA, 20 bp, Homo sapiens
ctggagatgcaaggtgctgg

SEQ ID NO: 5606536 - DNA, 21 bp, Homo sapiens
ctggagatgcagctactggaa

SEQ ID NO: 5606537 - DNA, 16 bp, Homo sapiens
ctggagatggaagctt

SEQ ID NO: 5606538 - DNA, 16 bp, Homo sapiens
ctggagatggctgctg

SEQ ID NO: 5606539 - DNA, 22 bp, Homo sapiens
ctggagatggctgctgctcacc

SEQ ID NO: 5606540 - DNA, 13 bp, Homo sapiens
ctggagcaaagca

SEQ ID NO: 5606541 - DNA, 19 bp, Homo sapiens
ctggagcaacctactgtct

SEQ ID NO: 5606542 - DNA, 17 bp, Homo sapiens
ctggagcaagctctgcc

SEQ ID NO: 5606543 - DNA, 18 bp, Homo sapiens
ctggagcaagctctgccc

SEQ ID NO: 5606544 - DNA, 21 bp, Homo sapiens
ctggagcaagctctgccctgg

SEQ ID NO: 5606545 - DNA, 19 bp, Homo sapiens
ctggagcaatcacagatga

SEQ ID NO: 5606546 - DNA, 16 bp, Homo sapiens
ctggagcacaaagacc

SEQ ID NO: 5606547 - DNA, 13 bp, Homo sapiens
ctggagcaccagg

SEQ ID NO: 5606548 - DNA, 23 bp, Homo sapiens
ctggagcaccaggcacgaaccca

SEQ ID NO: 5606549 - DNA, 20 bp, Homo sapiens
ctggagcactgggctcccgg

SEQ ID NO: 5606550 - DNA, 13 bp, Homo sapiens
ctggagcactgta

SEQ ID NO: 5606551 - DNA, 17 bp, Homo sapiens
ctggagcagaagcagca

SEQ ID NO: 5606552 - DNA, 13 bp, Homo sapiens
ctggagcagacca

SEQ ID NO: 5606553 - DNA, 23 bp, Homo sapiens
ctggagcagaggaggggaaagtc

SEQ ID NO: 5606554 - DNA, 13 bp, Homo sapiens
ctggagcagccaa

SEQ ID NO: 5606555 - DNA, 20 bp, Homo sapiens
ctggagcagccaaggccgcc

SEQ ID NO: 5606556 - DNA, 13 bp, Homo sapiens
ctggagcagccac

SEQ ID NO: 5606557 - DNA, 14 bp, Homo sapiens
ctggagcagccacc

SEQ ID NO: 5606558 - DNA, 17 bp, Homo sapiens
ctggagcagccacccca

SEQ ID NO: 5606559 - DNA, 21 bp, Homo sapiens
ctggagcagcggattgctctg

SEQ ID NO: 5606560 - DNA, 12 bp, Homo sapiens
ctggagcaggcc

SEQ ID NO: 5606561 - DNA, 15 bp, Homo sapiens
ctggagcaggcccaa

SEQ ID NO: 5606562 - DNA, 19 bp, Homo sapiens
ctggagcaggcccaatgct

SEQ ID NO: 5606563 - DNA, 22 bp, Homo sapiens
ctggagcaggcccaatgctgct

SEQ ID NO: 5606564 - DNA, 18 bp, Homo sapiens
ctggagcagtttggggca

SEQ ID NO: 5606565 - DNA, 20 bp, Homo sapiens
ctggagcagtttggggcagg

SEQ ID NO: 5606566 - DNA, 15 bp, Homo sapiens
ctggagcatcccagg

SEQ ID NO: 5606567 - DNA, 12 bp, Homo sapiens
ctggagcatctg

SEQ ID NO: 5606568 - DNA, 17 bp, Homo sapiens
ctggagcatggacagtg

SEQ ID NO: 5606569 - DNA, 14 bp, Homo sapiens
ctggagcatttctc

SEQ ID NO: 5606570 - DNA, 17 bp, Homo sapiens
ctggagccaactgctgc

SEQ ID NO: 5606571 - DNA, 17 bp, Homo sapiens
ctggagccaaggcagag

SEQ ID NO: 5606572 - DNA, 15 bp, Homo sapiens
ctggagccacaggca

SEQ ID NO: 5606573 - DNA, 15 bp, Homo sapiens
ctggagccacctgtc

SEQ ID NO: 5606574 - DNA, 18 bp, Homo sapiens
ctggagccacctgtccca

SEQ ID NO: 5606575 - DNA, 19 bp, Homo sapiens
ctggagccacctgtcccac

SEQ ID NO: 5606576 - DNA, 20 bp, Homo sapiens
ctggagccacctgtcccacc

SEQ ID NO: 5606577 - DNA, 15 bp, Homo sapiens
ctggagccactaact

SEQ ID NO: 5606578 - DNA, 16 bp, Homo sapiens
ctggagccagactctg

SEQ ID NO: 5606579 - DNA, 12 bp, Homo sapiens
ctggagccagag

SEQ ID NO: 5606580 - DNA, 15 bp, Homo sapiens
ctggagccagcaggg

SEQ ID NO: 5606581 - DNA, 21 bp, Homo sapiens
ctggagccagcagggctgtga

SEQ ID NO: 5606582 - DNA, 13 bp, Homo sapiens
ctggagccagggc

SEQ ID NO: 5606583 - DNA, 14 bp, Homo sapiens
ctggagccagggca

SEQ ID NO: 5606584 - DNA, 19 bp, Homo sapiens
ctggagccagggcagagga

SEQ ID NO: 5606585 - DNA, 21 bp, Homo sapiens
ctggagccagggcagaggaat

SEQ ID NO: 5606586 - DNA, 13 bp, Homo sapiens
ctggagccatccc

SEQ ID NO: 5606587 - DNA, 21 bp, Homo sapiens
ctggagccatgggcacaaagg

SEQ ID NO: 5606588 - DNA, 12 bp, Homo sapiens
ctggagcccaca

SEQ ID NO: 5606589 - DNA, 18 bp, Homo sapiens
ctggagcccacagcgagc

SEQ ID NO: 5606590 - DNA, 20 bp, Homo sapiens
ctggagcccacagcgagcct

SEQ ID NO: 5606591 - DNA, 21 bp, Homo sapiens
ctggagcccagcgtcagaagt

SEQ ID NO: 5606592 - DNA, 14 bp, Homo sapiens
ctggagcccaggga

SEQ ID NO: 5606593 - DNA, 16 bp, Homo sapiens
ctggagcccccagcag

SEQ ID NO: 5606594 - DNA, 12 bp, Homo sapiens
ctggagccccta

SEQ ID NO: 5606595 - DNA, 23 bp, Homo sapiens
ctggagcccctatcctgcaccct

SEQ ID NO: 5606596 - DNA, 17 bp, Homo sapiens
ctggagcccctcctccc

SEQ ID NO: 5606597 - DNA, 21 bp, Homo sapiens
ctggagcccctcctcccccgg

SEQ ID NO: 5606598 - DNA, 22 bp, Homo sapiens
ctggagcccctcctcccccggc

SEQ ID NO: 5606599 - DNA, 14 bp, Homo sapiens
ctggagcccctggg

SEQ ID NO: 5606600 - DNA, 15 bp, Homo sapiens
ctggagcccctgggt

SEQ ID NO: 5606601 - DNA, 12 bp, Homo sapiens
ctggagcccctt

SEQ ID NO: 5606602 - DNA, 20 bp, Homo sapiens
ctggagcccgaggcaccagt

SEQ ID NO: 5606603 - DNA, 18 bp, Homo sapiens
ctggagcccgcactgtcc

SEQ ID NO: 5606604 - DNA, 21 bp, Homo sapiens
ctggagcccgcctgcgccccc

SEQ ID NO: 5606605 - DNA, 22 bp, Homo sapiens
ctggagcccgcctgcgcccccc

SEQ ID NO: 5606606 - DNA, 20 bp, Homo sapiens
ctggagcccgcttcaagctc

SEQ ID NO: 5606607 - DNA, 19 bp, Homo sapiens
ctggagcccggcagtgcac

SEQ ID NO: 5606608 - DNA, 20 bp, Homo sapiens
ctggagcccggtgttcagtg

SEQ ID NO: 5606609 - DNA, 14 bp, Homo sapiens
ctggagccctaacc

SEQ ID NO: 5606610 - DNA, 20 bp, Homo sapiens
ctggagccctccgccttcac

SEQ ID NO: 5606611 - DNA, 18 bp, Homo sapiens
ctggagcctgagtcaggg

SEQ ID NO: 5606612 - DNA, 22 bp, Homo sapiens
ctggagcctgagtcagggccca

SEQ ID NO: 5606613 - DNA, 13 bp, Homo sapiens
ctggagcctgggc

SEQ ID NO: 5606614 - DNA, 14 bp, Homo sapiens
ctggagcctgggca

SEQ ID NO: 5606615 - DNA, 15 bp, Homo sapiens
ctggagcctggggtg

SEQ ID NO: 5606616 - DNA, 13 bp, Homo sapiens
ctggagcctgtgt

SEQ ID NO: 5606617 - DNA, 16 bp, Homo sapiens
ctggagcctgtgtaac

SEQ ID NO: 5606618 - DNA, 17 bp, Homo sapiens
ctggagcctgtgtaaca

SEQ ID NO: 5606619 - DNA, 19 bp, Homo sapiens
ctggagcctgtgtaacagc

SEQ ID NO: 5606620 - DNA, 22 bp, Homo sapiens
ctggagcctgtgtaacagctcc

SEQ ID NO: 5606621 - DNA, 15 bp, Homo sapiens
ctggcagcctcagga

SEQ ID NO: 5606622 - DNA, 18 bp, Homo sapiens
ctggcagcctccagtggg

SEQ ID NO: 5606623 - DNA, 20 bp, Homo sapiens
ctggcagcctcccatccagg

SEQ ID NO: 5606624 - DNA, 12 bp, Homo sapiens
ctggcagcctgc

SEQ ID NO: 5606625 - DNA, 16 bp, Homo sapiens
ctggcagcgagaacta

SEQ ID NO: 5606626 - DNA, 21 bp, Homo sapiens
ctggcagcgcctcccgccgcc

SEQ ID NO: 5606627 - DNA, 16 bp, Homo sapiens
ctggcagctcagagag

SEQ ID NO: 5606628 - DNA, 13 bp, Homo sapiens
ctggcagctctcc

SEQ ID NO: 5606629 - DNA, 15 bp, Homo sapiens
ctggcagctctccag

SEQ ID NO: 5606630 - DNA, 18 bp, Homo sapiens
ctggcagctctggacagc

SEQ ID NO: 5606631 - DNA, 20 bp, Homo sapiens
ctggcagctctggacagccc

SEQ ID NO: 5606632 - DNA, 12 bp, Homo sapiens
ctggcagctgag

SEQ ID NO: 5606633 - DNA, 11 bp, Homo sapiens
ctggcagctgc

SEQ ID NO: 5606634 - DNA, 13 bp, Homo sapiens
ctggcagctgccc

SEQ ID NO: 5606635 - DNA, 17 bp, Homo sapiens
ctggcagctgcccctcc

SEQ ID NO: 5606636 - DNA, 20 bp, Homo sapiens
ctggcagctgcccctcctgg

SEQ ID NO: 5606637 - DNA, 12 bp, Homo sapiens
ctggcagctgct

SEQ ID NO: 5606638 - DNA, 16 bp, Homo sapiens
ctggcagctggaccat

SEQ ID NO: 5606639 - DNA, 14 bp, Homo sapiens
ctggcagctgtcat

SEQ ID NO: 5606640 - DNA, 16 bp, Homo sapiens
ctggcaggagacactg

SEQ ID NO: 5606641 - DNA, 13 bp, Homo sapiens
ctggcaggagcct

SEQ ID NO: 5606642 - DNA, 19 bp, Homo sapiens
ctggcaggagcctcgtgtc

SEQ ID NO: 5606643 - DNA, 14 bp, Homo sapiens
ctggcaggatcaca

SEQ ID NO: 5606644 - DNA, 16 bp, Homo sapiens
ctggcaggatcacagc

SEQ ID NO: 5606645 - DNA, 17 bp, Homo sapiens
ctggcaggatcacagct

SEQ ID NO: 5606646 - DNA, 21 bp, Homo sapiens
ctggcaggattcttcccgctc

SEQ ID NO: 5606647 - DNA, 18 bp, Homo sapiens
ctggcaggcaggctccca

SEQ ID NO: 5606648 - DNA, 21 bp, Homo sapiens
ctggcaggcaggggccctgca

SEQ ID NO: 5606649 - DNA, 20 bp, Homo sapiens
ctggcaggcagttctagaag

SEQ ID NO: 5606650 - DNA, 11 bp, Homo sapiens
ctggcaggcca

SEQ ID NO: 5606651 - DNA, 15 bp, Homo sapiens
ctggcaggccctgcc

SEQ ID NO: 5606652 - DNA, 19 bp, Homo sapiens
ctggcaggccctgcccagc

SEQ ID NO: 5606653 - DNA, 20 bp, Homo sapiens
ctggcaggccctgcccagcc

SEQ ID NO: 5606654 - DNA, 21 bp, Homo sapiens
ctggcaggccctgcccagcca

SEQ ID NO: 5606655 - DNA, 23 bp, Homo sapiens
ctggcaggccctgcccagccagc

SEQ ID NO: 5606656 - DNA, 20 bp, Homo sapiens
ctggcaggcttcccccttga

SEQ ID NO: 5606657 - DNA, 16 bp, Homo sapiens
ctggcagggacctgag

SEQ ID NO: 5606658 - DNA, 17 bp, Homo sapiens
ctggcagggaggtcagg

SEQ ID NO: 5606659 - DNA, 13 bp, Homo sapiens
ctggcagggcagg

SEQ ID NO: 5606660 - DNA, 20 bp, Homo sapiens
ctggcagggcaggcagagct

SEQ ID NO: 5606661 - DNA, 21 bp, Homo sapiens
ctggcagggcaggcagagctc

SEQ ID NO: 5606662 - DNA, 15 bp, Homo sapiens
ctggcagggccacct

SEQ ID NO: 5606663 - DNA, 20 bp, Homo sapiens
ctggcagggccacctgcagg

SEQ ID NO: 5606664 - DNA, 13 bp, Homo sapiens
ctggcagggccag

SEQ ID NO: 5606665 - DNA, 18 bp, Homo sapiens
ctggcagggccagggcaa

SEQ ID NO: 5606666 - DNA, 20 bp, Homo sapiens
ctggcagggccagggcaatg

SEQ ID NO: 5606667 - DNA, 23 bp, Homo sapiens
ctggcagggccagggcaatgcca

SEQ ID NO: 5606668 - DNA, 16 bp, Homo sapiens
ctggcagggctcacac

SEQ ID NO: 5606669 - DNA, 20 bp, Homo sapiens
ctggcagggctcacactcct

SEQ ID NO: 5606670 - DNA, 23 bp, Homo sapiens
ctggcagggctggccccagggca

SEQ ID NO: 5606671 - DNA, 16 bp, Homo sapiens
ctggcagggctttggg

SEQ ID NO: 5606672 - DNA, 20 bp, Homo sapiens
ctggcaggggagacaggagc

SEQ ID NO: 5606673 - DNA, 15 bp, Homo sapiens
ctggcagggggcatg

SEQ ID NO: 5606674 - DNA, 16 bp, Homo sapiens
ctggcagggggtgaag

SEQ ID NO: 5606675 - DNA, 18 bp, Homo sapiens
ctggcagggtgggatgga

SEQ ID NO: 5606676 - DNA, 23 bp, Homo sapiens
ctggcaggtgcagatgggctgtt

SEQ ID NO: 5606677 - DNA, 18 bp, Homo sapiens
ctggcaggtggccagggc

SEQ ID NO: 5606678 - DNA, 19 bp, Homo sapiens
ctggcaggtggccagggct

SEQ ID NO: 5606679 - DNA, 23 bp, Homo sapiens
ctggcaggtgttgggacctgctg

SEQ ID NO: 5606680 - DNA, 16 bp, Homo sapiens
ctggcagtcgcacaca

SEQ ID NO: 5606681 - DNA, 18 bp, Homo sapiens
ctggcagtctggagcaaa

SEQ ID NO: 5606682 - DNA, 17 bp, Homo sapiens
ctggcagtgcaatgctt

SEQ ID NO: 5606683 - DNA, 24 bp, Homo sapiens
ctggcagtgcacctctcatcagcc

SEQ ID NO: 5606684 - DNA, 19 bp, Homo sapiens
ctggcagtggctctcagag

SEQ ID NO: 5606685 - DNA, 18 bp, Homo sapiens
ctggcagtgtgcggagct

SEQ ID NO: 5606686 - DNA, 17 bp, Homo sapiens
ctggcagttgaacagag

SEQ ID NO: 5606687 - DNA, 15 bp, Homo sapiens
ctggcagtttaaaaa

SEQ ID NO: 5606688 - DNA, 22 bp, Homo sapiens
ctggcagtttatatttaactct

SEQ ID NO: 5606689 - DNA, 20 bp, Homo sapiens
ctggcagtttgttgatcttt

SEQ ID NO: 5606690 - DNA, 13 bp, Homo sapiens
ctggcatagagta

SEQ ID NO: 5606691 - DNA, 17 bp, Homo sapiens
ctggcatagccctcctg

SEQ ID NO: 5606692 - DNA, 16 bp, Homo sapiens
ctggcataggactctt

SEQ ID NO: 5606693 - DNA, 18 bp, Homo sapiens
ctggcataggactctttg

SEQ ID NO: 5606694 - DNA, 17 bp, Homo sapiens
ctggcatatctctgttc

SEQ ID NO: 5606695 - DNA, 16 bp, Homo sapiens
ctggcatcaagggaga

SEQ ID NO: 5606696 - DNA, 22 bp, Homo sapiens
ctggcatcaagggagacaccag

SEQ ID NO: 5606697 - DNA, 21 bp, Homo sapiens
ctggcatcagtttaggccttg

SEQ ID NO: 5606698 - DNA, 22 bp, Homo sapiens
ctggcatcagtttaggccttgg

SEQ ID NO: 5606699 - DNA, 23 bp, Homo sapiens
ctggcatcagtttaggccttggc

SEQ ID NO: 5606700 - DNA, 20 bp, Homo sapiens
ctggcatccaaatggctgct

SEQ ID NO: 5606701 - DNA, 18 bp, Homo sapiens
ctggcatcctggctggct

SEQ ID NO: 5606702 - DNA, 19 bp, Homo sapiens
ctggcatcgcaccattctg

SEQ ID NO: 5606703 - DNA, 20 bp, Homo sapiens
ctggcatcgcaccattctga

SEQ ID NO: 5606704 - DNA, 23 bp, Homo sapiens
ctggcatcgcaccattctgactc

SEQ ID NO: 5606705 - DNA, 17 bp, Homo sapiens
ctggcatcgcagcttcc

SEQ ID NO: 5606706 - DNA, 20 bp, Homo sapiens
ctggcatcgcagcttcctgt

SEQ ID NO: 5606707 - DNA, 21 bp, Homo sapiens
ctggcatcgtgtattccatat

SEQ ID NO: 5606708 - DNA, 18 bp, Homo sapiens
ctggcatctcccccaccc

SEQ ID NO: 5606709 - DNA, 16 bp, Homo sapiens
ctggcatctccctgac

SEQ ID NO: 5606710 - DNA, 17 bp, Homo sapiens
ctggcatctctggagtg

SEQ ID NO: 5606711 - DNA, 17 bp, Homo sapiens
ctggcatctgacacaaa

SEQ ID NO: 5606712 - DNA, 17 bp, Homo sapiens
ctggcatctgctctaga

SEQ ID NO: 5606713 - DNA, 16 bp, Homo sapiens
ctggcatcttggaaat

SEQ ID NO: 5606714 - DNA, 14 bp, Homo sapiens
ctggcatctttgct

SEQ ID NO: 5606715 - DNA, 22 bp, Homo sapiens
ctggcatctttgctatggggac

SEQ ID NO: 5606716 - DNA, 17 bp, Homo sapiens
ctggcatgatccaagca

SEQ ID NO: 5606717 - DNA, 18 bp, Homo sapiens
ctggcatgctaaagcctt

SEQ ID NO: 5606718 - DNA, 17 bp, Homo sapiens
ctggcatggattaatag

SEQ ID NO: 5606719 - DNA, 17 bp, Homo sapiens
ctggcatggcacctgtc

SEQ ID NO: 5606720 - DNA, 19 bp, Homo sapiens
ctggcatgggaatgaatgt

SEQ ID NO: 5606721 - DNA, 13 bp, Homo sapiens
ctggcatgggaca

SEQ ID NO: 5606722 - DNA, 17 bp, Homo sapiens
ctggcatggggagggga

SEQ ID NO: 5606723 - DNA, 19 bp, Homo sapiens
ctggcatggtgcagggaga

SEQ ID NO: 5606724 - DNA, 14 bp, Homo sapiens
ctggcatgtctggg

SEQ ID NO: 5606725 - DNA, 15 bp, Homo sapiens
ctggcatgtctgggt

SEQ ID NO: 5606726 - DNA, 14 bp, Homo sapiens
ctggcatgttttct

SEQ ID NO: 5606727 - DNA, 21 bp, Homo sapiens
ctggcattaccctctgcagaa

SEQ ID NO: 5606728 - DNA, 20 bp, Homo sapiens
ctggcattagaattatttaa

SEQ ID NO: 5606729 - DNA, 20 bp, Homo sapiens
ctggcattggccagaccaca

SEQ ID NO: 5606730 - DNA, 16 bp, Homo sapiens
ctggcattggtctgct

SEQ ID NO: 5606731 - DNA, 23 bp, Homo sapiens
ctggcattttatagacaccctgg

SEQ ID NO: 5606732 - DNA, 18 bp, Homo sapiens
ctggcatttttagctcct

SEQ ID NO: 5606733 - DNA, 17 bp, Homo sapiens
ctggccaaatagcaaag

SEQ ID NO: 5606734 - DNA, 13 bp, Homo sapiens
ctggccaaatatg

SEQ ID NO: 5606735 - DNA, 20 bp, Homo sapiens
ctggccaaatatgcactttc

SEQ ID NO: 5606736 - DNA, 23 bp, Homo sapiens
ctggccaacatcgtgaaaccctg

SEQ ID NO: 5606737 - DNA, 13 bp, Homo sapiens
ctggccaagctga

SEQ ID NO: 5606738 - DNA, 14 bp, Homo sapiens
ctggccaagctgag

SEQ ID NO: 5606739 - DNA, 17 bp, Homo sapiens
ctggccaaggagaggag

SEQ ID NO: 5606740 - DNA, 14 bp, Homo sapiens
ctggccaaggggtg

SEQ ID NO: 5606741 - DNA, 12 bp, Homo sapiens
ctggccacacag

SEQ ID NO: 5606742 - DNA, 17 bp, Homo sapiens
ctggccacacagcagcg

SEQ ID NO: 5606743 - DNA, 13 bp, Homo sapiens
ctggccacactgg

SEQ ID NO: 5606744 - DNA, 17 bp, Homo sapiens
ctggccacagaccccca

SEQ ID NO: 5606745 - DNA, 21 bp, Homo sapiens
ctggccacagacccccagggc

SEQ ID NO: 5606746 - DNA, 21 bp, Homo sapiens
ctggccacatcagccccacag

SEQ ID NO: 5606747 - DNA, 23 bp, Homo sapiens
ctggccacatcagccccacagga

SEQ ID NO: 5606748 - DNA, 12 bp, Homo sapiens
ctggccaccacc

SEQ ID NO: 5606749 - DNA, 13 bp, Homo sapiens
ctggccaccaccc

SEQ ID NO: 5606750 - DNA, 19 bp, Homo sapiens
ctggccaccacccaacctg

SEQ ID NO: 5606751 - DNA, 22 bp, Homo sapiens
ctggccaccacccaacctgtcc

SEQ ID NO: 5606752 - DNA, 14 bp, Homo sapiens
ctggccaccacccc

SEQ ID NO: 5606753 - DNA, 19 bp, Homo sapiens
ctggccaccaccccccact

SEQ ID NO: 5606754 - DNA, 13 bp, Homo sapiens
ctggccaccaggc

SEQ ID NO: 5606755 - DNA, 22 bp, Homo sapiens
ctggccaccaggctggcgcagc

SEQ ID NO: 5606756 - DNA, 10 bp, Homo sapiens
ctggccaccc

SEQ ID NO: 5606757 - DNA, 13 bp, Homo sapiens
ctggccaccctgg

SEQ ID NO: 5606758 - DNA, 14 bp, Homo sapiens
ctggccaccctggc

SEQ ID NO: 5606759 - DNA, 17 bp, Homo sapiens
ctggccaccctggcccg

SEQ ID NO: 5606760 - DNA, 16 bp, Homo sapiens
ctggccacctctctcc

SEQ ID NO: 5606761 - DNA, 15 bp, Homo sapiens
ctggccacctgaggt

SEQ ID NO: 5606762 - DNA, 20 bp, Homo sapiens
ctggccacctgaggtgggcc

SEQ ID NO: 5606763 - DNA, 15 bp, Homo sapiens
ctggccacctgccag

SEQ ID NO: 5606764 - DNA, 18 bp, Homo sapiens
ctggccacctgccaggcc

SEQ ID NO: 5606765 - DNA, 19 bp, Homo sapiens
ctggccacctgccaggcct

SEQ ID NO: 5606766 - DNA, 14 bp, Homo sapiens
ctggccactaaagc

SEQ ID NO: 5606767 - DNA, 17 bp, Homo sapiens
ctggccactaaagcttc

SEQ ID NO: 5606768 - DNA, 19 bp, Homo sapiens
ctggccactaaagcttcag

SEQ ID NO: 5606769 - DNA, 21 bp, Homo sapiens
ctggccactaaagcttcagac

SEQ ID NO: 5606770 - DNA, 22 bp, Homo sapiens
ctggccactaaagcttcagact

SEQ ID NO: 5606771 - DNA, 20 bp, Homo sapiens
ctggccactgcacagagctc

SEQ ID NO: 5606772 - DNA, 16 bp, Homo sapiens
ctggccactggccctg

SEQ ID NO: 5606773 - DNA, 17 bp, Homo sapiens
ctggccactggccctgt

SEQ ID NO: 5606774 - DNA, 16 bp, Homo sapiens
ctggccactgtccctg

SEQ ID NO: 5606775 - DNA, 19 bp, Homo sapiens
ctggccactgtccctgtcc

SEQ ID NO: 5606776 - DNA, 20 bp, Homo sapiens
ctggccactgtccctgtcct

SEQ ID NO: 5606777 - DNA, 19 bp, Homo sapiens
ctggccagagagggcccag

SEQ ID NO: 5606778 - DNA, 21 bp, Homo sapiens
ctggccagagagggcccagct

SEQ ID NO: 5606779 - DNA, 14 bp, Homo sapiens
ctggccagaggcag

SEQ ID NO: 5606780 - DNA, 14 bp, Homo sapiens
ctggccagatgcac

SEQ ID NO: 5606781 - DNA, 18 bp, Homo sapiens
ctggccagatgcaccagc

SEQ ID NO: 5606782 - DNA, 16 bp, Homo sapiens
ctggccagatttcctc

SEQ ID NO: 5606783 - DNA, 17 bp, Homo sapiens
ctggccagcaaggcagg

SEQ ID NO: 5606784 - DNA, 19 bp, Homo sapiens
ctggccagcaaggcaggtt

SEQ ID NO: 5606785 - DNA, 15 bp, Homo sapiens
ctggccagcaccctc

SEQ ID NO: 5606786 - DNA, 16 bp, Homo sapiens
ctggccagcaccctct

SEQ ID NO: 5606787 - DNA, 21 bp, Homo sapiens
ctggccagcaccctctcctgg

SEQ ID NO: 5606788 - DNA, 16 bp, Homo sapiens
ctggccagcatggtga

SEQ ID NO: 5606789 - DNA, 15 bp, Homo sapiens
ctggccagccccaca

SEQ ID NO: 5606790 - DNA, 18 bp, Homo sapiens
ctggccagccccacagcc

SEQ ID NO: 5606791 - DNA, 20 bp, Homo sapiens
ctggccagccccacagccca

SEQ ID NO: 5606792 - DNA, 13 bp, Homo sapiens
ctggccagccctt

SEQ ID NO: 5606793 - DNA, 14 bp, Homo sapiens
ctggccagcccttc

SEQ ID NO: 5606794 - DNA, 15 bp, Homo sapiens
ctggccagcccttcc

SEQ ID NO: 5606795 - DNA, 16 bp, Homo sapiens
ctggccagcccttcct

SEQ ID NO: 5606796 - DNA, 19 bp, Homo sapiens
ctggccagcccttcctctc

SEQ ID NO: 5606797 - DNA, 20 bp, Homo sapiens
ctggccagccgctctcctgc

SEQ ID NO: 5606798 - DNA, 16 bp, Homo sapiens
ctggctcatgcccctt

SEQ ID NO: 5606799 - DNA, 18 bp, Homo sapiens
ctggctcattctgcacct

SEQ ID NO: 5606800 - DNA, 19 bp, Homo sapiens
ctggctcattctgcacctt

SEQ ID NO: 5606801 - DNA, 17 bp, Homo sapiens
ctggctccacgccctgg

SEQ ID NO: 5606802 - DNA, 19 bp, Homo sapiens
ctggctccacgccctgggg

SEQ ID NO: 5606803 - DNA, 20 bp, Homo sapiens
ctggctccacgccctgggga

SEQ ID NO: 5606804 - DNA, 23 bp, Homo sapiens
ctggctccacgccctggggagtg

SEQ ID NO: 5606805 - DNA, 16 bp, Homo sapiens
ctggctccactcttga

SEQ ID NO: 5606806 - DNA, 12 bp, Homo sapiens
ctggctccagaa

SEQ ID NO: 5606807 - DNA, 21 bp, Homo sapiens
ctggctccagatgcagggcag

SEQ ID NO: 5606808 - DNA, 15 bp, Homo sapiens
ctggctccaggcaga

SEQ ID NO: 5606809 - DNA, 18 bp, Homo sapiens
ctggctccaggcagaagg

SEQ ID NO: 5606810 - DNA, 15 bp, Homo sapiens
ctggctccaggctcc

SEQ ID NO: 5606811 - DNA, 14 bp, Homo sapiens
ctggctccagtctc

SEQ ID NO: 5606812 - DNA, 15 bp, Homo sapiens
ctggctccagtctca

SEQ ID NO: 5606813 - DNA, 15 bp, Homo sapiens
ctggctcccacaggc

SEQ ID NO: 5606814 - DNA, 19 bp, Homo sapiens
ctggctcccacaggcagct

SEQ ID NO: 5606815 - DNA, 20 bp, Homo sapiens
ctggctcccacctgtttctg

SEQ ID NO: 5606816 - DNA, 17 bp, Homo sapiens
ctggctcccagggtcct

SEQ ID NO: 5606817 - DNA, 16 bp, Homo sapiens
ctggctcccagggtgg

SEQ ID NO: 5606818 - DNA, 19 bp, Homo sapiens
ctggctccccaaggctgca

SEQ ID NO: 5606819 - DNA, 22 bp, Homo sapiens
ctggctccccacgagtcacctg

SEQ ID NO: 5606820 - DNA, 22 bp, Homo sapiens
ctggctccccctccccaggctg

SEQ ID NO: 5606821 - DNA, 23 bp, Homo sapiens
ctggctccccctccccaggctgg

SEQ ID NO: 5606822 - DNA, 24 bp, Homo sapiens
ctggctccccctccccaggctgga

SEQ ID NO: 5606823 - DNA, 15 bp, Homo sapiens
ctggctccccgaggg

SEQ ID NO: 5606824 - DNA, 13 bp, Homo sapiens
ctggctcccctgc

SEQ ID NO: 5606825 - DNA, 17 bp, Homo sapiens
ctggctcccctgcagcc

SEQ ID NO: 5606826 - DNA, 19 bp, Homo sapiens
ctggctccctcccacccaa

SEQ ID NO: 5606827 - DNA, 23 bp, Homo sapiens
ctggctccctcctccaggcctgc

SEQ ID NO: 5606828 - DNA, 13 bp, Homo sapiens
ctggctccctgcc

SEQ ID NO: 5606829 - DNA, 16 bp, Homo sapiens
ctggctccctgcccct

SEQ ID NO: 5606830 - DNA, 21 bp, Homo sapiens
ctggctccctgccccttaacc

SEQ ID NO: 5606831 - DNA, 20 bp, Homo sapiens
ctggctccgtccaggagcct

SEQ ID NO: 5606832 - DNA, 14 bp, Homo sapiens
ctggctcctccagc

SEQ ID NO: 5606833 - DNA, 16 bp, Homo sapiens
ctggctcctccagcaa

SEQ ID NO: 5606834 - DNA, 12 bp, Homo sapiens
ctggctcctcct

SEQ ID NO: 5606835 - DNA, 14 bp, Homo sapiens
ctggctcctccttc

SEQ ID NO: 5606836 - DNA, 16 bp, Homo sapiens
ctggctcctctgtggt

SEQ ID NO: 5606837 - DNA, 15 bp, Homo sapiens
ctggctcctgagggg

SEQ ID NO: 5606838 - DNA, 20 bp, Homo sapiens
ctggctcctggggatggcca

SEQ ID NO: 5606839 - DNA, 22 bp, Homo sapiens
ctggctcctggggatggccagg

SEQ ID NO: 5606840 - DNA, 13 bp, Homo sapiens
ctggctccttcac

SEQ ID NO: 5606841 - DNA, 18 bp, Homo sapiens
ctggctcctttgcctctg

SEQ ID NO: 5606842 - DNA, 20 bp, Homo sapiens
ctggctcctttgcctctgct

SEQ ID NO: 5606843 - DNA, 21 bp, Homo sapiens
ctggctcctttgcctctgcta

SEQ ID NO: 5606844 - DNA, 17 bp, Homo sapiens
ctggctcggacccaccc

SEQ ID NO: 5606845 - DNA, 15 bp, Homo sapiens
ctggctctaattcac

SEQ ID NO: 5606846 - DNA, 19 bp, Homo sapiens
ctggctctaattcacagtg

SEQ ID NO: 5606847 - DNA, 13 bp, Homo sapiens
ctggctctacaca

SEQ ID NO: 5606848 - DNA, 14 bp, Homo sapiens
ctggctctacacat

SEQ ID NO: 5606849 - DNA, 15 bp, Homo sapiens
ctggctctaccctgt

SEQ ID NO: 5606850 - DNA, 21 bp, Homo sapiens
ctggctctaggacccccagtg

SEQ ID NO: 5606851 - DNA, 13 bp, Homo sapiens
ctggctctcacct

SEQ ID NO: 5606852 - DNA, 19 bp, Homo sapiens
ctggctctcacctctaggt

SEQ ID NO: 5606853 - DNA, 12 bp, Homo sapiens
ctggctctccaa

SEQ ID NO: 5606854 - DNA, 13 bp, Homo sapiens
ctggctctccaag

SEQ ID NO: 5606855 - DNA, 14 bp, Homo sapiens
ctggctctccaagt

SEQ ID NO: 5606856 - DNA, 15 bp, Homo sapiens
ctggctctcctggcc

SEQ ID NO: 5606857 - DNA, 15 bp, Homo sapiens
ctggctctctccagg

SEQ ID NO: 5606858 - DNA, 14 bp, Homo sapiens
ctggctctgaagcc

SEQ ID NO: 5606859 - DNA, 16 bp, Homo sapiens
ctggctctgaagccaa

SEQ ID NO: 5606860 - DNA, 14 bp, Homo sapiens
ctggctctgcacta

SEQ ID NO: 5606861 - DNA, 23 bp, Homo sapiens
ctggctctgcactaagagaaaat

SEQ ID NO: 5606862 - DNA, 14 bp, Homo sapiens
ctggctctgccccc

SEQ ID NO: 5606863 - DNA, 15 bp, Homo sapiens
ctggctctgcccctc

SEQ ID NO: 5606864 - DNA, 17 bp, Homo sapiens
ctggctctgcccctcag

SEQ ID NO: 5606865 - DNA, 22 bp, Homo sapiens
ctggctctgcccctcagggggc

SEQ ID NO: 5606866 - DNA, 19 bp, Homo sapiens
ctggctctgcctcaggagg

SEQ ID NO: 5606867 - DNA, 15 bp, Homo sapiens
ctggctctgctgtcc

SEQ ID NO: 5606868 - DNA, 12 bp, Homo sapiens
ctggctctgggc

SEQ ID NO: 5606869 - DNA, 19 bp, Homo sapiens
ctggctctgggggacccag

SEQ ID NO: 5606870 - DNA, 16 bp, Homo sapiens
ctggctctgtcaccgc

SEQ ID NO: 5606871 - DNA, 21 bp, Homo sapiens
ctggctctgtcaccgccatgc

SEQ ID NO: 5606872 - DNA, 22 bp, Homo sapiens
ctggctctgtcaccgccatgca

SEQ ID NO: 5606873 - DNA, 12 bp, Homo sapiens
ctggctctgtgg

SEQ ID NO: 5606874 - DNA, 13 bp, Homo sapiens
ctggctctgtggc

SEQ ID NO: 5606875 - DNA, 13 bp, Homo sapiens
ctggctcttccag

SEQ ID NO: 5606876 - DNA, 15 bp, Homo sapiens
ctggctcttccaggc

SEQ ID NO: 5606877 - DNA, 14 bp, Homo sapiens
ctggctcttctctc

SEQ ID NO: 5606878 - DNA, 17 bp, Homo sapiens
ctggctcttctgcccaa

SEQ ID NO: 5606879 - DNA, 17 bp, Homo sapiens
ctggctcttgtgctgga

SEQ ID NO: 5606880 - DNA, 22 bp, Homo sapiens
ctggctctttagaatggaccac

SEQ ID NO: 5606881 - DNA, 22 bp, Homo sapiens
ctggctctttggagatcaagga

SEQ ID NO: 5606882 - DNA, 12 bp, Homo sapiens
ctggctgaaaat

SEQ ID NO: 5606883 - DNA, 17 bp, Homo sapiens
ctggctgaacagtgctc

SEQ ID NO: 5606884 - DNA, 22 bp, Homo sapiens
ctggctgaacagtgctctgcct

SEQ ID NO: 5606885 - DNA, 23 bp, Homo sapiens
ctggctgaacagtgctctgcctc

SEQ ID NO: 5606886 - DNA, 18 bp, Homo sapiens
ctggctgaaccctgtgct

SEQ ID NO: 5606887 - DNA, 19 bp, Homo sapiens
ctggctgaaccctgtgctg

SEQ ID NO: 5606888 - DNA, 16 bp, Homo sapiens
ctggctgaaggactgt

SEQ ID NO: 5606889 - DNA, 14 bp, Homo sapiens
ctggctgaccccgg

SEQ ID NO: 5606890 - DNA, 21 bp, Homo sapiens
ctggctgacccctccttgtaa

SEQ ID NO: 5606891 - DNA, 13 bp, Homo sapiens
ctggctgacctgg

SEQ ID NO: 5606892 - DNA, 16 bp, Homo sapiens
ctggctgacctgggcc

SEQ ID NO: 5606893 - DNA, 17 bp, Homo sapiens
ctggctgactaagcccc

SEQ ID NO: 5606894 - DNA, 22 bp, Homo sapiens
ctggctgactaagccccgtctg

SEQ ID NO: 5606895 - DNA, 13 bp, Homo sapiens
ctggctgactggc

SEQ ID NO: 5606896 - DNA, 21 bp, Homo sapiens
ctggctgagcagttcccctgg

SEQ ID NO: 5606897 - DNA, 23 bp, Homo sapiens
ctggctgagcagttcccctggag

SEQ ID NO: 5606898 - DNA, 16 bp, Homo sapiens
ctggctgagcccctgg

SEQ ID NO: 5606899 - DNA, 13 bp, Homo sapiens
ctggctgagctga

SEQ ID NO: 5606900 - DNA, 21 bp, Homo sapiens
ctggctgaggatttcaagcct

SEQ ID NO: 5606901 - DNA, 22 bp, Homo sapiens
ctggctgaggatttcaagcctg

SEQ ID NO: 5606902 - DNA, 15 bp, Homo sapiens
ctggctgagggcagt

SEQ ID NO: 5606903 - DNA, 23 bp, Homo sapiens
ctggctgagggcagttcgcagcc

SEQ ID NO: 5606904 - DNA, 19 bp, Homo sapiens
ctggctgaggttcctctgc

SEQ ID NO: 5606905 - DNA, 22 bp, Homo sapiens
ctggctgaggttcctctgcctg

SEQ ID NO: 5606906 - DNA, 11 bp, Homo sapiens
ctggctgagtg

SEQ ID NO: 5606907 - DNA, 20 bp, Homo sapiens
ctggctgagtgcgaccacca

SEQ ID NO: 5606908 - DNA, 22 bp, Homo sapiens
ctggctgagtgcgaccaccact

SEQ ID NO: 5606909 - DNA, 21 bp, Homo sapiens
ctggctgagtggaatgcaggg

SEQ ID NO: 5606910 - DNA, 22 bp, Homo sapiens
ctggctgagtggaatgcaggga

SEQ ID NO: 5606911 - DNA, 19 bp, Homo sapiens
ctggctgattcagcatttt

SEQ ID NO: 5606912 - DNA, 19 bp, Homo sapiens
ctggctgcaagggccagag

SEQ ID NO: 5606913 - DNA, 14 bp, Homo sapiens
ctggctgcacagcc

SEQ ID NO: 5606914 - DNA, 15 bp, Homo sapiens
ctggctgcacagccc

SEQ ID NO: 5606915 - DNA, 16 bp, Homo sapiens
ctggctgcacagccca

SEQ ID NO: 5606916 - DNA, 22 bp, Homo sapiens
ctggctgcacagcccaaccagg

SEQ ID NO: 5606917 - DNA, 14 bp, Homo sapiens
ctggctgcacaggc

SEQ ID NO: 5606918 - DNA, 16 bp, Homo sapiens
ctggctgcacaggctg

SEQ ID NO: 5606919 - DNA, 17 bp, Homo sapiens
ctggctgcacaggctga

SEQ ID NO: 5606920 - DNA, 18 bp, Homo sapiens
ctggctgcagcctccggg

SEQ ID NO: 5606921 - DNA, 13 bp, Homo sapiens
ctggctgcagctg

SEQ ID NO: 5606922 - DNA, 16 bp, Homo sapiens
ctggctgcagctgggc

SEQ ID NO: 5606923 - DNA, 13 bp, Homo sapiens
ctggctgcagtga

SEQ ID NO: 5606924 - DNA, 16 bp, Homo sapiens
ctggctgccaggcgtt

SEQ ID NO: 5606925 - DNA, 17 bp, Homo sapiens
ctggctgccaggcgttg

SEQ ID NO: 5606926 - DNA, 18 bp, Homo sapiens
ctggctgccccaacctgc

SEQ ID NO: 5606927 - DNA, 14 bp, Homo sapiens
ctggctgcccctca

SEQ ID NO: 5606928 - DNA, 17 bp, Homo sapiens
ctggctgcccctcacct

SEQ ID NO: 5606929 - DNA, 21 bp, Homo sapiens
ctggctgcccctcaccttggg

SEQ ID NO: 5606930 - DNA, 23 bp, Homo sapiens
ctggctgcccctcaccttgggct

SEQ ID NO: 5606931 - DNA, 15 bp, Homo sapiens
ctggctgccctggcc

SEQ ID NO: 5606932 - DNA, 19 bp, Homo sapiens
ctggctgccctggccctga

SEQ ID NO: 5606933 - DNA, 23 bp, Homo sapiens
ctggctgccctggccctgaggtg

SEQ ID NO: 5606934 - DNA, 19 bp, Homo sapiens
ctggctgccgttttctggg

SEQ ID NO: 5606935 - DNA, 21 bp, Homo sapiens
ctggctgccgttttctgggct

SEQ ID NO: 5606936 - DNA, 15 bp, Homo sapiens
ctggctgcctccact

SEQ ID NO: 5606937 - DNA, 21 bp, Homo sapiens
ctggctgcctccactcccact

SEQ ID NO: 5606938 - DNA, 11 bp, Homo sapiens
ctggctgcctg

SEQ ID NO: 5606939 - DNA, 18 bp, Homo sapiens
ctggctgccttctgcgga

SEQ ID NO: 5606940 - DNA, 18 bp, Homo sapiens
ctggctgcgaactgtgca

SEQ ID NO: 5606941 - DNA, 16 bp, Homo sapiens
ctggctgctaggccag

SEQ ID NO: 5606942 - DNA, 13 bp, Homo sapiens
ctggctgctccct

SEQ ID NO: 5606943 - DNA, 16 bp, Homo sapiens
ctggctgctccctgct

SEQ ID NO: 5606944 - DNA, 18 bp, Homo sapiens
ctggctgctccctgctcc

SEQ ID NO: 5606945 - DNA, 15 bp, Homo sapiens
ctggctgctcctaac

SEQ ID NO: 5606946 - DNA, 22 bp, Homo sapiens
ctggctgctcctaacctacctc

SEQ ID NO: 5606947 - DNA, 24 bp, Homo sapiens
ctggctgctctcatgcctgcctga

SEQ ID NO: 5606948 - DNA, 15 bp, Homo sapiens
ctggctgctctgtct

SEQ ID NO: 5606949 - DNA, 16 bp, Homo sapiens
ctggctgctctgtctt

SEQ ID NO: 5606950 - DNA, 12 bp, Homo sapiens
ctggctgctgac

SEQ ID NO: 5606951 - DNA, 13 bp, Homo sapiens
ctggctgctgccc

SEQ ID NO: 5606952 - DNA, 17 bp, Homo sapiens
ctggctgctgcccccac

SEQ ID NO: 5606953 - DNA, 19 bp, Homo sapiens
ctggctgctgcccccaccc

SEQ ID NO: 5606954 - DNA, 12 bp, Homo sapiens
ctggctgctgct

SEQ ID NO: 5606955 - DNA, 15 bp, Homo sapiens
ctggctgctggccca

SEQ ID NO: 5606956 - DNA, 19 bp, Homo sapiens
ctggctgcttgcagccagg

SEQ ID NO: 5606957 - DNA, 13 bp, Homo sapiens
ctggctgcttgcc

SEQ ID NO: 5606958 - DNA, 18 bp, Homo sapiens
ctggctggaaagcagagc

SEQ ID NO: 5606959 - DNA, 12 bp, Homo sapiens
ctggctggactg

SEQ ID NO: 5606960 - DNA, 17 bp, Homo sapiens
ctggctggactggaggc

SEQ ID NO: 5606961 - DNA, 20 bp, Homo sapiens
ctggctggagaccgaggcca

SEQ ID NO: 5606962 - DNA, 18 bp, Homo sapiens
ctggctggaggaaggaaa

SEQ ID NO: 5606963 - DNA, 17 bp, Homo sapiens
ctggctggaggagcagc

SEQ ID NO: 5606964 - DNA, 15 bp, Homo sapiens
ctggctggcacagaa

SEQ ID NO: 5606965 - DNA, 16 bp, Homo sapiens
ctggctggccagtctg

SEQ ID NO: 5606966 - DNA, 14 bp, Homo sapiens
ctggctggcctgag

SEQ ID NO: 5606967 - DNA, 21 bp, Homo sapiens
ctggctggccttgtggtccaa

SEQ ID NO: 5606968 - DNA, 15 bp, Homo sapiens
ctggctggctcctag

SEQ ID NO: 5606969 - DNA, 12 bp, Homo sapiens
ctggctgggaca

SEQ ID NO: 5606970 - DNA, 19 bp, Homo sapiens
ctggctgggacgtggctca

SEQ ID NO: 5606971 - DNA, 23 bp, Homo sapiens
ctggctgggacgtggctcagcca

SEQ ID NO: 5606972 - DNA, 17 bp, Homo sapiens
ctggctgggactgggaa

SEQ ID NO: 5606973 - DNA, 20 bp, Homo sapiens
ctggctgggagtccttacct

SEQ ID NO: 5606974 - DNA, 23 bp, Homo sapiens
ctggctgggagtggaagaaggga

SEQ ID NO: 5606975 - DNA, 14 bp, Homo sapiens
ctggctgggcccct

SEQ ID NO: 5606976 - DNA, 12 bp, Homo sapiens
ctgggagcagaa

SEQ ID NO: 5606977 - DNA, 21 bp, Homo sapiens
ctgggagcagaaacagccatt

SEQ ID NO: 5606978 - DNA, 15 bp, Homo sapiens
ctgggagcagaacag

SEQ ID NO: 5606979 - DNA, 20 bp, Homo sapiens
ctgggagcatagcagagggg

SEQ ID NO: 5606980 - DNA, 19 bp, Homo sapiens
ctgggagccacttctcccc

SEQ ID NO: 5606981 - DNA, 22 bp, Homo sapiens
ctgggagccacttctccccaga

SEQ ID NO: 5606982 - DNA, 20 bp, Homo sapiens
ctgggagccagagcctctgt

SEQ ID NO: 5606983 - DNA, 14 bp, Homo sapiens
ctgggagccaggct

SEQ ID NO: 5606984 - DNA, 16 bp, Homo sapiens
ctgggagccaggctct

SEQ ID NO: 5606985 - DNA, 20 bp, Homo sapiens
ctgggagccagtgtgcccaa

SEQ ID NO: 5606986 - DNA, 17 bp, Homo sapiens
ctgggagcccagaaccc

SEQ ID NO: 5606987 - DNA, 22 bp, Homo sapiens
ctgggagcccccaccacaaact

SEQ ID NO: 5606988 - DNA, 19 bp, Homo sapiens
ctgggagcctacccacccc

SEQ ID NO: 5606989 - DNA, 21 bp, Homo sapiens
ctgggagcctcgcccctccag

SEQ ID NO: 5606990 - DNA, 16 bp, Homo sapiens
ctgggagctcatgtgt

SEQ ID NO: 5606991 - DNA, 16 bp, Homo sapiens
ctgggagctccactct

SEQ ID NO: 5606992 - DNA, 14 bp, Homo sapiens
ctgggagctctgca

SEQ ID NO: 5606993 - DNA, 15 bp, Homo sapiens
ctgggagctctgcag

SEQ ID NO: 5606994 - DNA, 20 bp, Homo sapiens
ctgggagctgcgccggacag

SEQ ID NO: 5606995 - DNA, 16 bp, Homo sapiens
ctgggagcttttgtag

SEQ ID NO: 5606996 - DNA, 13 bp, Homo sapiens
ctgggaggaaaag

SEQ ID NO: 5606997 - DNA, 22 bp, Homo sapiens
ctgggaggaaaagaaaagaggg

SEQ ID NO: 5606998 - DNA, 17 bp, Homo sapiens
ctgggaggacaggcagg

SEQ ID NO: 5606999 - DNA, 23 bp, Homo sapiens
ctgggaggagcccctggacatgc

SEQ ID NO: 5607000 - DNA, 13 bp, Homo sapiens
ctgggaggaggaa

SEQ ID NO: 5607001 - DNA, 19 bp, Homo sapiens
ctgggaggagggagaggga

SEQ ID NO: 5607002 - DNA, 18 bp, Homo sapiens
ctgggaggagtggccctg

SEQ ID NO: 5607003 - DNA, 20 bp, Homo sapiens
ctgggaggcaagaggggtgg

SEQ ID NO: 5607004 - DNA, 12 bp, Homo sapiens
ctgggaggcaga

SEQ ID NO: 5607005 - DNA, 17 bp, Homo sapiens
ctgggaggcagaacagg

SEQ ID NO: 5607006 - DNA, 15 bp, Homo sapiens
ctgggaggccctggc

SEQ ID NO: 5607007 - DNA, 22 bp, Homo sapiens
ctgggaggcggagagtacagtg

SEQ ID NO: 5607008 - DNA, 22 bp, Homo sapiens
ctgggaggctcggggctcccca

SEQ ID NO: 5607009 - DNA, 21 bp, Homo sapiens
ctgggaggctctggagcccac

SEQ ID NO: 5607010 - DNA, 16 bp, Homo sapiens
ctgggaggctggtctc

SEQ ID NO: 5607011 - DNA, 12 bp, Homo sapiens
ctgggagggaag

SEQ ID NO: 5607012 - DNA, 18 bp, Homo sapiens
ctgggagggagggggagg

SEQ ID NO: 5607013 - DNA, 19 bp, Homo sapiens
ctgggagggcaagggtcct

SEQ ID NO: 5607014 - DNA, 13 bp, Homo sapiens
ctgggagggcagc

SEQ ID NO: 5607015 - DNA, 20 bp, Homo sapiens
ctgggagggcccacttcagg

SEQ ID NO: 5607016 - DNA, 16 bp, Homo sapiens
ctgggagggggccctt

SEQ ID NO: 5607017 - DNA, 19 bp, Homo sapiens
ctgggagggggcccttcca

SEQ ID NO: 5607018 - DNA, 15 bp, Homo sapiens
ctgggagggggtgag

SEQ ID NO: 5607019 - DNA, 15 bp, Homo sapiens
ctgggagggggtggg

SEQ ID NO: 5607020 - DNA, 22 bp, Homo sapiens
ctgggaggggttttcgaagctc

SEQ ID NO: 5607021 - DNA, 13 bp, Homo sapiens
ctgggagggtggt

SEQ ID NO: 5607022 - DNA, 16 bp, Homo sapiens
ctgggagggttcccct

SEQ ID NO: 5607023 - DNA, 18 bp, Homo sapiens
ctgggaggtattggaggg

SEQ ID NO: 5607024 - DNA, 19 bp, Homo sapiens
ctgggaggtcaaagctgca

SEQ ID NO: 5607025 - DNA, 20 bp, Homo sapiens
ctgggaggtcccagggccct

SEQ ID NO: 5607026 - DNA, 21 bp, Homo sapiens
ctgggaggttgggaggctgtg

SEQ ID NO: 5607027 - DNA, 16 bp, Homo sapiens
ctgggagtagctagtt

SEQ ID NO: 5607028 - DNA, 23 bp, Homo sapiens
ctgggagtagttgtctttcctgg

SEQ ID NO: 5607029 - DNA, 14 bp, Homo sapiens
ctgggagtcagagc

SEQ ID NO: 5607030 - DNA, 17 bp, Homo sapiens
ctgggagtcagagccct

SEQ ID NO: 5607031 - DNA, 21 bp, Homo sapiens
ctgggagtcagagccctggct

SEQ ID NO: 5607032 - DNA, 17 bp, Homo sapiens
ctgggagtccccatccc

SEQ ID NO: 5607033 - DNA, 18 bp, Homo sapiens
ctgggagtccccatccca

SEQ ID NO: 5607034 - DNA, 21 bp, Homo sapiens
ctgggagtcctgtcagcttcc

SEQ ID NO: 5607035 - DNA, 16 bp, Homo sapiens
ctgggagtccttacct

SEQ ID NO: 5607036 - DNA, 22 bp, Homo sapiens
ctgggagtccttacctcgggga

SEQ ID NO: 5607037 - DNA, 12 bp, Homo sapiens
ctgggagtgagc

SEQ ID NO: 5607038 - DNA, 21 bp, Homo sapiens
ctgggagtgttcccgtgcctg

SEQ ID NO: 5607039 - DNA, 19 bp, Homo sapiens
ctgggagttctagaaccac

SEQ ID NO: 5607040 - DNA, 22 bp, Homo sapiens
ctgggagttctagaaccacttc

SEQ ID NO: 5607041 - DNA, 22 bp, Homo sapiens
ctgggatacacacggctccccc

SEQ ID NO: 5607042 - DNA, 17 bp, Homo sapiens
ctgggataggggcagag

SEQ ID NO: 5607043 - DNA, 19 bp, Homo sapiens
ctgggatcacagctgcagg

SEQ ID NO: 5607044 - DNA, 17 bp, Homo sapiens
ctgggatcagagcagga

SEQ ID NO: 5607045 - DNA, 16 bp, Homo sapiens
ctgggatcccacagcc

SEQ ID NO: 5607046 - DNA, 20 bp, Homo sapiens
ctgggatcccacagccctag

SEQ ID NO: 5607047 - DNA, 21 bp, Homo sapiens
ctgggatcctgactaagcctt

SEQ ID NO: 5607048 - DNA, 23 bp, Homo sapiens
ctgggatcctgactaagcctttg

SEQ ID NO: 5607049 - DNA, 17 bp, Homo sapiens
ctgggatcgtgcatttg

SEQ ID NO: 5607050 - DNA, 23 bp, Homo sapiens
ctgggatcgtgcatttgaggggc

SEQ ID NO: 5607051 - DNA, 21 bp, Homo sapiens
ctgggatctactttccctctg

SEQ ID NO: 5607052 - DNA, 17 bp, Homo sapiens
ctgggatctgattgagg

SEQ ID NO: 5607053 - DNA, 20 bp, Homo sapiens
ctgggatctgttttctggaa

SEQ ID NO: 5607054 - DNA, 22 bp, Homo sapiens
ctgggatgacaggtgtgagcca

SEQ ID NO: 5607055 - DNA, 17 bp, Homo sapiens
ctgggatgagccgctgt

SEQ ID NO: 5607056 - DNA, 21 bp, Homo sapiens
ctgggatgagccgctgtgagc

SEQ ID NO: 5607057 - DNA, 22 bp, Homo sapiens
ctgggatgatgtgtgaaacctg

SEQ ID NO: 5607058 - DNA, 23 bp, Homo sapiens
ctgggatgatgtgtgaaacctga

SEQ ID NO: 5607059 - DNA, 15 bp, Homo sapiens
ctgggatgcccttcc

SEQ ID NO: 5607060 - DNA, 16 bp, Homo sapiens
ctgggatgcccttccc

SEQ ID NO: 5607061 - DNA, 19 bp, Homo sapiens
ctgggatgctagccccaga

SEQ ID NO: 5607062 - DNA, 19 bp, Homo sapiens
ctgggatgctgacccagga

SEQ ID NO: 5607063 - DNA, 21 bp, Homo sapiens
ctgggatgctgacccaggaat

SEQ ID NO: 5607064 - DNA, 22 bp, Homo sapiens
ctgggatgctgacccaggaata

SEQ ID NO: 5607065 - DNA, 16 bp, Homo sapiens
ctgggatggaccctcg

SEQ ID NO: 5607066 - DNA, 20 bp, Homo sapiens
ctgggatggaccctcgcagc

SEQ ID NO: 5607067 - DNA, 22 bp, Homo sapiens
ctgggatggaccctcgcagcag

SEQ ID NO: 5607068 - DNA, 15 bp, Homo sapiens
ctgggatgggcctgc

SEQ ID NO: 5607069 - DNA, 15 bp, Homo sapiens
ctgggatgggctccc

SEQ ID NO: 5607070 - DNA, 18 bp, Homo sapiens
ctgggatggtgactcctg

SEQ ID NO: 5607071 - DNA, 15 bp, Homo sapiens
ctgggatgtcacagt

SEQ ID NO: 5607072 - DNA, 21 bp, Homo sapiens
ctgggatgtccacagatgcct

SEQ ID NO: 5607073 - DNA, 20 bp, Homo sapiens
ctgggatgtggctgcagcag

SEQ ID NO: 5607074 - DNA, 22 bp, Homo sapiens
ctgggatgtggctgcagcagcg

SEQ ID NO: 5607075 - DNA, 18 bp, Homo sapiens
ctgggatgtgtgctttcc

SEQ ID NO: 5607076 - DNA, 19 bp, Homo sapiens
ctgggattaagaaaccttg

SEQ ID NO: 5607077 - DNA, 23 bp, Homo sapiens
ctgggattaagaaaccttgctct

SEQ ID NO: 5607078 - DNA, 21 bp, Homo sapiens
ctgggattaaggcgtgagcca

SEQ ID NO: 5607079 - DNA, 16 bp, Homo sapiens
ctgggattaaggggat

SEQ ID NO: 5607080 - DNA, 21 bp, Homo sapiens
ctgggattacagccgtgagcc

SEQ ID NO: 5607081 - DNA, 20 bp, Homo sapiens
ctgggattacaggcatgagc

SEQ ID NO: 5607082 - DNA, 21 bp, Homo sapiens
ctgggattacaggcatgagcc

SEQ ID NO: 5607083 - DNA, 23 bp, Homo sapiens
ctgggattacaggcatgtgccac

SEQ ID NO: 5607084 - DNA, 23 bp, Homo sapiens
ctgggattacaggcgcctgccac

SEQ ID NO: 5607085 - DNA, 20 bp, Homo sapiens
ctgggattacaggctcctgc

SEQ ID NO: 5607086 - DNA, 18 bp, Homo sapiens
ctgggattacaggtgtga

SEQ ID NO: 5607087 - DNA, 23 bp, Homo sapiens
ctgggattacaggtgtgagccac

SEQ ID NO: 5607088 - DNA, 11 bp, Homo sapiens
ctgggattagg

SEQ ID NO: 5607089 - DNA, 22 bp, Homo sapiens
ctgggattcaggaaaaggcctg

SEQ ID NO: 5607090 - DNA, 14 bp, Homo sapiens
ctgggattcatggc

SEQ ID NO: 5607091 - DNA, 15 bp, Homo sapiens
ctgggattcccacca

SEQ ID NO: 5607092 - DNA, 18 bp, Homo sapiens
ctgggattctactttaag

SEQ ID NO: 5607093 - DNA, 17 bp, Homo sapiens
ctgggattggctgtgaa

SEQ ID NO: 5607094 - DNA, 22 bp, Homo sapiens
ctgggattggggggtgggcttt

SEQ ID NO: 5607095 - DNA, 21 bp, Homo sapiens
ctgggatttatgctcatgaac

SEQ ID NO: 5607096 - DNA, 20 bp, Homo sapiens
ctgggatttcttcgctgctc

SEQ ID NO: 5607097 - DNA, 22 bp, Homo sapiens
ctgggattttaaactagatgac

SEQ ID NO: 5607098 - DNA, 17 bp, Homo sapiens
ctgggcaaacagagcta

SEQ ID NO: 5607099 - DNA, 16 bp, Homo sapiens
ctgggcaaagaggatc

SEQ ID NO: 5607100 - DNA, 19 bp, Homo sapiens
ctgggcaaagccacaaggc

SEQ ID NO: 5607101 - DNA, 21 bp, Homo sapiens
ctgggcaaagccacaaggctg

SEQ ID NO: 5607102 - DNA, 23 bp, Homo sapiens
ctgggcaaagccacaaggctggc

SEQ ID NO: 5607103 - DNA, 18 bp, Homo sapiens
ctgggcaaagcccctcac

SEQ ID NO: 5607104 - DNA, 20 bp, Homo sapiens
ctgggcaaagcccctcacac

SEQ ID NO: 5607105 - DNA, 15 bp, Homo sapiens
ctgggcaacactgca

SEQ ID NO: 5607106 - DNA, 16 bp, Homo sapiens
ctgggcaacactgcag

SEQ ID NO: 5607107 - DNA, 20 bp, Homo sapiens
ctgggcaacactgcaggaca

SEQ ID NO: 5607108 - DNA, 22 bp, Homo sapiens
ctgggcaacactgcaggacagt

SEQ ID NO: 5607109 - DNA, 15 bp, Homo sapiens
ctgggcaacagagca

SEQ ID NO: 5607110 - DNA, 18 bp, Homo sapiens
ctgggcaacagagcaaga

SEQ ID NO: 5607111 - DNA, 21 bp, Homo sapiens
ctgggcaagagatgggacaag

SEQ ID NO: 5607112 - DNA, 15 bp, Homo sapiens
ctgggcaagaggaaa

SEQ ID NO: 5607113 - DNA, 15 bp, Homo sapiens
ctgggcaagctggcg

SEQ ID NO: 5607114 - DNA, 19 bp, Homo sapiens
ctgggcaaggaaaaagaaa

SEQ ID NO: 5607115 - DNA, 21 bp, Homo sapiens
ctgggcaaggtgagggatgcc

SEQ ID NO: 5607116 - DNA, 19 bp, Homo sapiens
ctgggcaagtagcaggact

SEQ ID NO: 5607117 - DNA, 18 bp, Homo sapiens
ctgggcaagtgaggcaag

SEQ ID NO: 5607118 - DNA, 23 bp, Homo sapiens
ctgggcaagtgaggcaagagaaa

SEQ ID NO: 5607119 - DNA, 20 bp, Homo sapiens
ctgggcaatgaaaccaaagc

SEQ ID NO: 5607120 - DNA, 12 bp, Homo sapiens
ctgggcaatggc

SEQ ID NO: 5607121 - DNA, 17 bp, Homo sapiens
ctgggcaatggccaggg

SEQ ID NO: 5607122 - DNA, 22 bp, Homo sapiens
ctgggcaatggccaggggccag

SEQ ID NO: 5607123 - DNA, 15 bp, Homo sapiens
ctgggcacaaacaga

SEQ ID NO: 5607124 - DNA, 19 bp, Homo sapiens
ctgggcacaagcagggcac

SEQ ID NO: 5607125 - DNA, 15 bp, Homo sapiens
ctgggcacacgctgc

SEQ ID NO: 5607126 - DNA, 20 bp, Homo sapiens
ctgggcacacgctgctctgc

SEQ ID NO: 5607127 - DNA, 18 bp, Homo sapiens
ctgggcacactctgccag

SEQ ID NO: 5607128 - DNA, 22 bp, Homo sapiens
ctgggcacactctgccagcaaa

SEQ ID NO: 5607129 - DNA, 20 bp, Homo sapiens
ctgggcacagattgaagaat

SEQ ID NO: 5607130 - DNA, 14 bp, Homo sapiens
ctgggcacagctct

SEQ ID NO: 5607131 - DNA, 21 bp, Homo sapiens
ctgggcacagctcttcacacc

SEQ ID NO: 5607132 - DNA, 16 bp, Homo sapiens
ctgggcacagtgctgc

SEQ ID NO: 5607133 - DNA, 18 bp, Homo sapiens
ctgggcacagtgctgccc

SEQ ID NO: 5607134 - DNA, 17 bp, Homo sapiens
ctgggcacccacctcca

SEQ ID NO: 5607135 - DNA, 17 bp, Homo sapiens
ctgggcaccccaggcag

SEQ ID NO: 5607136 - DNA, 20 bp, Homo sapiens
ctgggcacccctgcctcctg

SEQ ID NO: 5607137 - DNA, 16 bp, Homo sapiens
ctgggcaccctcccac

SEQ ID NO: 5607138 - DNA, 13 bp, Homo sapiens
ctgggcaccctgc

SEQ ID NO: 5607139 - DNA, 15 bp, Homo sapiens
ctgggcaccctgcag

SEQ ID NO: 5607140 - DNA, 16 bp, Homo sapiens
ctgggcaccctgcagg

SEQ ID NO: 5607141 - DNA, 17 bp, Homo sapiens
ctgggcaccctgcaggc

SEQ ID NO: 5607142 - DNA, 18 bp, Homo sapiens
ctgggcaccctgcaggca

SEQ ID NO: 5607143 - DNA, 20 bp, Homo sapiens
ctgggcaccgggaccccctc

SEQ ID NO: 5607144 - DNA, 19 bp, Homo sapiens
ctgggcaccgtgtcctcct

SEQ ID NO: 5607145 - DNA, 21 bp, Homo sapiens
ctgggcaccgtgtcctcctct

SEQ ID NO: 5607146 - DNA, 13 bp, Homo sapiens
ctgggcacctgac

SEQ ID NO: 5607147 - DNA, 14 bp, Homo sapiens
ctgggcacctgact

SEQ ID NO: 5607148 - DNA, 15 bp, Homo sapiens
ctgggcacctgactt

SEQ ID NO: 5607149 - DNA, 16 bp, Homo sapiens
ctgggcacctgcgcac

SEQ ID NO: 5607150 - DNA, 21 bp, Homo sapiens
ctggggagggacacagaggac

SEQ ID NO: 5607151 - DNA, 14 bp, Homo sapiens
ctggggagggagag

SEQ ID NO: 5607152 - DNA, 23 bp, Homo sapiens
ctggggagggctgcagtcacatt

SEQ ID NO: 5607153 - DNA, 22 bp, Homo sapiens
ctggggagggtcaagggctggg

SEQ ID NO: 5607154 - DNA, 18 bp, Homo sapiens
ctggggaggtgggaggcc

SEQ ID NO: 5607155 - DNA, 20 bp, Homo sapiens
ctggggaggtgggaggccag

SEQ ID NO: 5607156 - DNA, 23 bp, Homo sapiens
ctggggaggtgggaggccaggcg

SEQ ID NO: 5607157 - DNA, 21 bp, Homo sapiens
ctggggagtaaacggcccagg

SEQ ID NO: 5607158 - DNA, 17 bp, Homo sapiens
ctggggagtgggacaga

SEQ ID NO: 5607159 - DNA, 20 bp, Homo sapiens
ctggggagtgggacagagtc

SEQ ID NO: 5607160 - DNA, 23 bp, Homo sapiens
ctggggagtttactacctgggga

SEQ ID NO: 5607161 - DNA, 18 bp, Homo sapiens
ctggggatactggcaaag

SEQ ID NO: 5607162 - DNA, 21 bp, Homo sapiens
ctggggatcacagcctcaccc

SEQ ID NO: 5607163 - DNA, 14 bp, Homo sapiens
ctggggatccccgc

SEQ ID NO: 5607164 - DNA, 20 bp, Homo sapiens
ctggggatccccgcctggcc

SEQ ID NO: 5607165 - DNA, 22 bp, Homo sapiens
ctggggatccccgcctggccag

SEQ ID NO: 5607166 - DNA, 23 bp, Homo sapiens
ctggggatccccgcctggccagg

SEQ ID NO: 5607167 - DNA, 19 bp, Homo sapiens
ctggggatcccgtgctgga

SEQ ID NO: 5607168 - DNA, 20 bp, Homo sapiens
ctggggatcttcccacagga

SEQ ID NO: 5607169 - DNA, 15 bp, Homo sapiens
ctggggatggccagg

SEQ ID NO: 5607170 - DNA, 12 bp, Homo sapiens
ctggggatgggt

SEQ ID NO: 5607171 - DNA, 20 bp, Homo sapiens
ctggggatgtcatagccaaa

SEQ ID NO: 5607172 - DNA, 17 bp, Homo sapiens
ctggggatgtgggaggg

SEQ ID NO: 5607173 - DNA, 13 bp, Homo sapiens
ctggggattcttg

SEQ ID NO: 5607174 - DNA, 23 bp, Homo sapiens
ctggggattcttgaacttgaaaa

SEQ ID NO: 5607175 - DNA, 16 bp, Homo sapiens
ctggggattgggaggg

SEQ ID NO: 5607176 - DNA, 16 bp, Homo sapiens
ctggggattgggcccc

SEQ ID NO: 5607177 - DNA, 15 bp, Homo sapiens
ctggggcaaggggca

SEQ ID NO: 5607178 - DNA, 17 bp, Homo sapiens
ctggggcacagtccagg

SEQ ID NO: 5607179 - DNA, 16 bp, Homo sapiens
ctggggcactccccca

SEQ ID NO: 5607180 - DNA, 17 bp, Homo sapiens
ctggggcactcccccag

SEQ ID NO: 5607181 - DNA, 20 bp, Homo sapiens
ctggggcactcccccaggat

SEQ ID NO: 5607182 - DNA, 12 bp, Homo sapiens
ctggggcagaga

SEQ ID NO: 5607183 - DNA, 14 bp, Homo sapiens
ctggggcagaggaa

SEQ ID NO: 5607184 - DNA, 15 bp, Homo sapiens
ctggggcagaggggc

SEQ ID NO: 5607185 - DNA, 17 bp, Homo sapiens
ctggggcagaggggcag

SEQ ID NO: 5607186 - DNA, 22 bp, Homo sapiens
ctggggcagaggggcagccgct

SEQ ID NO: 5607187 - DNA, 24 bp, Homo sapiens
ctggggcagaggggcagccgctag

SEQ ID NO: 5607188 - DNA, 12 bp, Homo sapiens
ctggggcagagt

SEQ ID NO: 5607189 - DNA, 20 bp, Homo sapiens
ctggggcagagtggagccca

SEQ ID NO: 5607190 - DNA, 21 bp, Homo sapiens
ctggggcagagtggagcccag

SEQ ID NO: 5607191 - DNA, 22 bp, Homo sapiens
ctggggcagcaccctataaatc

SEQ ID NO: 5607192 - DNA, 14 bp, Homo sapiens
ctggggcagcactc

SEQ ID NO: 5607193 - DNA, 14 bp, Homo sapiens
ctggggcagcctct

SEQ ID NO: 5607194 - DNA, 19 bp, Homo sapiens
ctggggcagcctctgggcc

SEQ ID NO: 5607195 - DNA, 12 bp, Homo sapiens
ctggggcaggac

SEQ ID NO: 5607196 - DNA, 14 bp, Homo sapiens
ctggggcaggacca

SEQ ID NO: 5607197 - DNA, 11 bp, Homo sapiens
ctggggcaggc

SEQ ID NO: 5607198 - DNA, 15 bp, Homo sapiens
ctggggcaggctctc

SEQ ID NO: 5607199 - DNA, 14 bp, Homo sapiens
ctggggcaggctgg

SEQ ID NO: 5607200 - DNA, 16 bp, Homo sapiens
ctggggcaggctgggc

SEQ ID NO: 5607201 - DNA, 19 bp, Homo sapiens
ctggggcaggctgggccat

SEQ ID NO: 5607202 - DNA, 16 bp, Homo sapiens
ctggggcagggcccag

SEQ ID NO: 5607203 - DNA, 14 bp, Homo sapiens
ctggggcaggggcc

SEQ ID NO: 5607204 - DNA, 17 bp, Homo sapiens
ctggggcagggggtgaa

SEQ ID NO: 5607205 - DNA, 12 bp, Homo sapiens
ctggggcagggt

SEQ ID NO: 5607206 - DNA, 13 bp, Homo sapiens
ctggggcagggtg

SEQ ID NO: 5607207 - DNA, 17 bp, Homo sapiens
ctggggcatcatgggca

SEQ ID NO: 5607208 - DNA, 14 bp, Homo sapiens
ctggggcatggcag

SEQ ID NO: 5607209 - DNA, 18 bp, Homo sapiens
ctggggcatgtgtgcctg

SEQ ID NO: 5607210 - DNA, 20 bp, Homo sapiens
ctggggcatgtgtgcctgtg

SEQ ID NO: 5607211 - DNA, 22 bp, Homo sapiens
ctggggcatgtgtgcctgtggc

SEQ ID NO: 5607212 - DNA, 23 bp, Homo sapiens
ctggggcatgtgtgcctgtggca

SEQ ID NO: 5607213 - DNA, 18 bp, Homo sapiens
ctggggccacatagctca

SEQ ID NO: 5607214 - DNA, 20 bp, Homo sapiens
ctggggccacctttgtgcag

SEQ ID NO: 5607215 - DNA, 17 bp, Homo sapiens
ctggggccagaggctgg

SEQ ID NO: 5607216 - DNA, 15 bp, Homo sapiens
ctggggccagcccct

SEQ ID NO: 5607217 - DNA, 21 bp, Homo sapiens
ctggggccagcccctccccgc

SEQ ID NO: 5607218 - DNA, 13 bp, Homo sapiens
ctggggccaggcc

SEQ ID NO: 5607219 - DNA, 14 bp, Homo sapiens
ctggggccaggccc

SEQ ID NO: 5607220 - DNA, 22 bp, Homo sapiens
ctggggccaggccccatggagg

SEQ ID NO: 5607221 - DNA, 18 bp, Homo sapiens
ctggggccaggctgggtc

SEQ ID NO: 5607222 - DNA, 12 bp, Homo sapiens
ctggggccaggg

SEQ ID NO: 5607223 - DNA, 14 bp, Homo sapiens
ctggggccagggca

SEQ ID NO: 5607224 - DNA, 16 bp, Homo sapiens
ctggggccagggcaga

SEQ ID NO: 5607225 - DNA, 13 bp, Homo sapiens
ctggggccagggg

SEQ ID NO: 5607226 - DNA, 22 bp, Homo sapiens
ctggggccagtgtaaggcatag

SEQ ID NO: 5607227 - DNA, 14 bp, Homo sapiens
ctggggcccagccc

SEQ ID NO: 5607228 - DNA, 16 bp, Homo sapiens
ctggggcccagcccct

SEQ ID NO: 5607229 - DNA, 12 bp, Homo sapiens
ctggggcccagg

SEQ ID NO: 5607230 - DNA, 14 bp, Homo sapiens
ctggggcccaggaa

SEQ ID NO: 5607231 - DNA, 22 bp, Homo sapiens
ctggggcccaggaagcccacac

SEQ ID NO: 5607232 - DNA, 15 bp, Homo sapiens
ctggggccccaccgt

SEQ ID NO: 5607233 - DNA, 18 bp, Homo sapiens
ctggggccccgctgggat

SEQ ID NO: 5607234 - DNA, 16 bp, Homo sapiens
ctggggcccctcggct

SEQ ID NO: 5607235 - DNA, 14 bp, Homo sapiens
ctggggccccttgg

SEQ ID NO: 5607236 - DNA, 16 bp, Homo sapiens
ctggggcccgcctgcc

SEQ ID NO: 5607237 - DNA, 16 bp, Homo sapiens
ctggggccctgggcct

SEQ ID NO: 5607238 - DNA, 20 bp, Homo sapiens
ctggggccctgggcctcagt

SEQ ID NO: 5607239 - DNA, 21 bp, Homo sapiens
ctggggccgccacggcctggc

SEQ ID NO: 5607240 - DNA, 19 bp, Homo sapiens
ctggggccgcctgccctgc

SEQ ID NO: 5607241 - DNA, 13 bp, Homo sapiens
ctggggccgggct

SEQ ID NO: 5607242 - DNA, 23 bp, Homo sapiens
ctggggcctagcgatctctcctg

SEQ ID NO: 5607243 - DNA, 11 bp, Homo sapiens
ctggggcctcc

SEQ ID NO: 5607244 - DNA, 12 bp, Homo sapiens
ctggggcctcca

SEQ ID NO: 5607245 - DNA, 15 bp, Homo sapiens
ctggggcctccagaa

SEQ ID NO: 5607246 - DNA, 23 bp, Homo sapiens
ctggggcctccagaagctgctcc

SEQ ID NO: 5607247 - DNA, 23 bp, Homo sapiens
ctggggcctcggagcctcatccg

SEQ ID NO: 5607248 - DNA, 15 bp, Homo sapiens
ctggggcctgactgc

SEQ ID NO: 5607249 - DNA, 18 bp, Homo sapiens
ctggggcctgactgctca

SEQ ID NO: 5607250 - DNA, 14 bp, Homo sapiens
ctggggcctgagag

SEQ ID NO: 5607251 - DNA, 15 bp, Homo sapiens
ctggggcctgagaga

SEQ ID NO: 5607252 - DNA, 14 bp, Homo sapiens
ctggggcctggacc

SEQ ID NO: 5607253 - DNA, 16 bp, Homo sapiens
ctggggcctggacctg

SEQ ID NO: 5607254 - DNA, 17 bp, Homo sapiens
ctggggcctggacctgc

SEQ ID NO: 5607255 - DNA, 19 bp, Homo sapiens
ctggggcctggacctgcct

SEQ ID NO: 5607256 - DNA, 12 bp, Homo sapiens
ctggggcctggc

SEQ ID NO: 5607257 - DNA, 12 bp, Homo sapiens
ctggggcctggg

SEQ ID NO: 5607258 - DNA, 15 bp, Homo sapiens
ctggggcctgggaca

SEQ ID NO: 5607259 - DNA, 16 bp, Homo sapiens
ctggggcctgggacaa

SEQ ID NO: 5607260 - DNA, 14 bp, Homo sapiens
ctggggcctgtact

SEQ ID NO: 5607261 - DNA, 16 bp, Homo sapiens
ctggggcctgtactgc

SEQ ID NO: 5607262 - DNA, 17 bp, Homo sapiens
ctggggcctgtactgcc

SEQ ID NO: 5607263 - DNA, 14 bp, Homo sapiens
ctggggccttcctg

SEQ ID NO: 5607264 - DNA, 15 bp, Homo sapiens
ctggggccttcctgg

SEQ ID NO: 5607265 - DNA, 17 bp, Homo sapiens
ctggggcgcgtgaggcc

SEQ ID NO: 5607266 - DNA, 13 bp, Homo sapiens
ctggggcggagct

SEQ ID NO: 5607267 - DNA, 18 bp, Homo sapiens
ctggggcgggcccctcat

SEQ ID NO: 5607268 - DNA, 20 bp, Homo sapiens
ctggggcgggctaggaggag

SEQ ID NO: 5607269 - DNA, 19 bp, Homo sapiens
ctggggcggggctggaggt

SEQ ID NO: 5607270 - DNA, 15 bp, Homo sapiens
ctggggcgtttccta

SEQ ID NO: 5607271 - DNA, 21 bp, Homo sapiens
ctggggctcacggggcctcca

SEQ ID NO: 5607272 - DNA, 12 bp, Homo sapiens
ctggggctcaga

SEQ ID NO: 5607273 - DNA, 13 bp, Homo sapiens
ctggggctcagcc

SEQ ID NO: 5607274 - DNA, 14 bp, Homo sapiens
ctggggctcagccc

SEQ ID NO: 5607275 - DNA, 14 bp, Homo sapiens
ctggggctccctct

SEQ ID NO: 5607276 - DNA, 18 bp, Homo sapiens
ctggggctccctgcctgg

SEQ ID NO: 5607277 - DNA, 14 bp, Homo sapiens
ctggggctcccttc

SEQ ID NO: 5607278 - DNA, 22 bp, Homo sapiens
ctggggctcccttcatctccag

SEQ ID NO: 5607279 - DNA, 22 bp, Homo sapiens
ctggggctctaacgcctgagcc

SEQ ID NO: 5607280 - DNA, 23 bp, Homo sapiens
ctggggctctaacgcctgagccc

SEQ ID NO: 5607281 - DNA, 17 bp, Homo sapiens
ctggggctctctgaccc

SEQ ID NO: 5607282 - DNA, 18 bp, Homo sapiens
ctggggctctctgacccg

SEQ ID NO: 5607283 - DNA, 15 bp, Homo sapiens
ctggggctctctgag

SEQ ID NO: 5607284 - DNA, 17 bp, Homo sapiens
ctggggctctctgagac

SEQ ID NO: 5607285 - DNA, 18 bp, Homo sapiens
ctggggctctctgagact

SEQ ID NO: 5607286 - DNA, 19 bp, Homo sapiens
ctggggctctgtgcaggga

SEQ ID NO: 5607287 - DNA, 22 bp, Homo sapiens
ctggggctgaacatgcctgcca

SEQ ID NO: 5607288 - DNA, 18 bp, Homo sapiens
ctggggctgaccttcctc

SEQ ID NO: 5607289 - DNA, 14 bp, Homo sapiens
ctggggctgagagt

SEQ ID NO: 5607290 - DNA, 16 bp, Homo sapiens
ctggggctgagagtgg

SEQ ID NO: 5607291 - DNA, 20 bp, Homo sapiens
ctggggctgagtctccaggg

SEQ ID NO: 5607292 - DNA, 16 bp, Homo sapiens
ctggggctgccagcct

SEQ ID NO: 5607293 - DNA, 15 bp, Homo sapiens
ctggggctgctggcc

SEQ ID NO: 5607294 - DNA, 13 bp, Homo sapiens
ctggggctggctg

SEQ ID NO: 5607295 - DNA, 14 bp, Homo sapiens
ctggggctggctgc

SEQ ID NO: 5607296 - DNA, 12 bp, Homo sapiens
ctggggctgggc

SEQ ID NO: 5607297 - DNA, 13 bp, Homo sapiens
ctggggctgggcc

SEQ ID NO: 5607298 - DNA, 14 bp, Homo sapiens
ctggggctgggccc

SEQ ID NO: 5607299 - DNA, 11 bp, Homo sapiens
ctggggctggt

SEQ ID NO: 5607300 - DNA, 14 bp, Homo sapiens
ctggggctggtcct

SEQ ID NO: 5607301 - DNA, 18 bp, Homo sapiens
ctggggctggtcctggga

SEQ ID NO: 5607302 - DNA, 19 bp, Homo sapiens
ctggggctggtcctgggag

SEQ ID NO: 5607303 - DNA, 16 bp, Homo sapiens
ctggggctggtgaggc

SEQ ID NO: 5607304 - DNA, 23 bp, Homo sapiens
ctggggctggtggattgggcaga

SEQ ID NO: 5607305 - DNA, 12 bp, Homo sapiens
ctggggctgtgc

SEQ ID NO: 5607306 - DNA, 14 bp, Homo sapiens
ctggggctgtgtta

SEQ ID NO: 5607307 - DNA, 15 bp, Homo sapiens
ctggggcttctcctg

SEQ ID NO: 5607308 - DNA, 19 bp, Homo sapiens
ctggggcttctcctgaccc

SEQ ID NO: 5607309 - DNA, 19 bp, Homo sapiens
ctggggcttctttctgctg

SEQ ID NO: 5607310 - DNA, 20 bp, Homo sapiens
ctggggcttctttctgctgg

SEQ ID NO: 5607311 - DNA, 15 bp, Homo sapiens
ctggggcttgaattt

SEQ ID NO: 5607312 - DNA, 16 bp, Homo sapiens
ctggggcttgaatttg

SEQ ID NO: 5607313 - DNA, 18 bp, Homo sapiens
ctggggcttgcaagagga

SEQ ID NO: 5607314 - DNA, 13 bp, Homo sapiens
ctggggcttgcta

SEQ ID NO: 5607315 - DNA, 14 bp, Homo sapiens
ctgggggaaaaagc

SEQ ID NO: 5607316 - DNA, 16 bp, Homo sapiens
ctgggggaaagggaac

SEQ ID NO: 5607317 - DNA, 13 bp, Homo sapiens
ctgggggaagaag

SEQ ID NO: 5607318 - DNA, 15 bp, Homo sapiens
ctgggggaagaggag

SEQ ID NO: 5607319 - DNA, 17 bp, Homo sapiens
ctgggggaagccctgga

SEQ ID NO: 5607320 - DNA, 21 bp, Homo sapiens
ctgggggaatgagcccagaga

SEQ ID NO: 5607321 - DNA, 19 bp, Homo sapiens
ctgggggacccctggctct

SEQ ID NO: 5607322 - DNA, 12 bp, Homo sapiens
ctgggggacctt

SEQ ID NO: 5607323 - DNA, 15 bp, Homo sapiens
ctgggggactgcttt

SEQ ID NO: 5607324 - DNA, 15 bp, Homo sapiens
ctgggggactgggag

SEQ ID NO: 5607325 - DNA, 16 bp, Homo sapiens
ctgggggactgggagt

SEQ ID NO: 5607326 - DNA, 17 bp, Homo sapiens
ctgggggactgggagtc

SEQ ID NO: 5607327 - DNA, 22 bp, Homo sapiens
ctgggggactgggagtcagagc

SEQ ID NO: 5607328 - DNA, 14 bp, Homo sapiens
ctgggggagagccg

SEQ ID NO: 5607329 - DNA, 19 bp, Homo sapiens
ctgggggaggcagggctgg

SEQ ID NO: 5607330 - DNA, 15 bp, Homo sapiens
ctggtccctcttctc

SEQ ID NO: 5607331 - DNA, 19 bp, Homo sapiens
ctggtccctcttctctcct

SEQ ID NO: 5607332 - DNA, 22 bp, Homo sapiens
ctggtccctcttctctcctcag

SEQ ID NO: 5607333 - DNA, 16 bp, Homo sapiens
ctggtccctgccctcc

SEQ ID NO: 5607334 - DNA, 17 bp, Homo sapiens
ctggtccctgccctccc

SEQ ID NO: 5607335 - DNA, 17 bp, Homo sapiens
ctggtccctggtccttc

SEQ ID NO: 5607336 - DNA, 23 bp, Homo sapiens
ctggtccctgttttcccacgagg

SEQ ID NO: 5607337 - DNA, 14 bp, Homo sapiens
ctggtcccttcagt

SEQ ID NO: 5607338 - DNA, 20 bp, Homo sapiens
ctggtccggacactcctaga

SEQ ID NO: 5607339 - DNA, 16 bp, Homo sapiens
ctggtccgtgggacgg

SEQ ID NO: 5607340 - DNA, 13 bp, Homo sapiens
ctggtcctaccca

SEQ ID NO: 5607341 - DNA, 19 bp, Homo sapiens
ctggtcctaggctggaagg

SEQ ID NO: 5607342 - DNA, 15 bp, Homo sapiens
ctggtcctaggtcct

SEQ ID NO: 5607343 - DNA, 21 bp, Homo sapiens
ctggtcctaggtcctctgagg

SEQ ID NO: 5607344 - DNA, 17 bp, Homo sapiens
ctggtcctccactttgc

SEQ ID NO: 5607345 - DNA, 12 bp, Homo sapiens
ctggtcctcgga

SEQ ID NO: 5607346 - DNA, 16 bp, Homo sapiens
ctggtcctcggagctg

SEQ ID NO: 5607347 - DNA, 21 bp, Homo sapiens
ctggtcctcggagctggttcc

SEQ ID NO: 5607348 - DNA, 23 bp, Homo sapiens
ctggtcctgcacatgagtggaaa

SEQ ID NO: 5607349 - DNA, 14 bp, Homo sapiens
ctggtcctgcactg

SEQ ID NO: 5607350 - DNA, 11 bp, Homo sapiens
ctggtcctgga

SEQ ID NO: 5607351 - DNA, 13 bp, Homo sapiens
ctggtcctggaca

SEQ ID NO: 5607352 - DNA, 19 bp, Homo sapiens
ctggtcctggacacctccc

SEQ ID NO: 5607353 - DNA, 21 bp, Homo sapiens
ctggtcctggacacctcccag

SEQ ID NO: 5607354 - DNA, 19 bp, Homo sapiens
ctggtcctggccgtcccta

SEQ ID NO: 5607355 - DNA, 13 bp, Homo sapiens
ctggtcctggcct

SEQ ID NO: 5607356 - DNA, 14 bp, Homo sapiens
ctggtcctggctgc

SEQ ID NO: 5607357 - DNA, 15 bp, Homo sapiens
ctggtcctggctgca

SEQ ID NO: 5607358 - DNA, 11 bp, Homo sapiens
ctggtcctgtt

SEQ ID NO: 5607359 - DNA, 22 bp, Homo sapiens
ctggtcctgttttctaaaaaaa

SEQ ID NO: 5607360 - DNA, 14 bp, Homo sapiens
ctggtccttattta

SEQ ID NO: 5607361 - DNA, 17 bp, Homo sapiens
ctggtccttctgacccc

SEQ ID NO: 5607362 - DNA, 15 bp, Homo sapiens
ctggtcctttttggt

SEQ ID NO: 5607363 - DNA, 21 bp, Homo sapiens
ctggtcgccaatccatgctct

SEQ ID NO: 5607364 - DNA, 15 bp, Homo sapiens
ctggtcgccttccac

SEQ ID NO: 5607365 - DNA, 15 bp, Homo sapiens
ctggtcggagaggga

SEQ ID NO: 5607366 - DNA, 16 bp, Homo sapiens
ctggtcgtttgaccac

SEQ ID NO: 5607367 - DNA, 22 bp, Homo sapiens
ctggtctaagaatgacgatgcc

SEQ ID NO: 5607368 - DNA, 15 bp, Homo sapiens
ctggtctaatttatt

SEQ ID NO: 5607369 - DNA, 20 bp, Homo sapiens
ctggtctatataaccacatt

SEQ ID NO: 5607370 - DNA, 21 bp, Homo sapiens
ctggtctatataaccacattt

SEQ ID NO: 5607371 - DNA, 23 bp, Homo sapiens
ctggtctcaaactcctgacctca

SEQ ID NO: 5607372 - DNA, 20 bp, Homo sapiens
ctggtctcaaactcctgggc

SEQ ID NO: 5607373 - DNA, 13 bp, Homo sapiens
ctggtctcaccct

SEQ ID NO: 5607374 - DNA, 21 bp, Homo sapiens
ctggtctcagcagcgaccacc

SEQ ID NO: 5607375 - DNA, 14 bp, Homo sapiens
ctggtctcccccag

SEQ ID NO: 5607376 - DNA, 17 bp, Homo sapiens
ctggtctccctccagct

SEQ ID NO: 5607377 - DNA, 18 bp, Homo sapiens
ctggtctccctccagctg

SEQ ID NO: 5607378 - DNA, 18 bp, Homo sapiens
ctggtctcctgcccccac

SEQ ID NO: 5607379 - DNA, 20 bp, Homo sapiens
ctggtctcctgcccccacac

SEQ ID NO: 5607380 - DNA, 18 bp, Homo sapiens
ctggtctcgaactcctga

SEQ ID NO: 5607381 - DNA, 21 bp, Homo sapiens
ctggtctcgaactcctgacct

SEQ ID NO: 5607382 - DNA, 21 bp, Homo sapiens
ctggtctcgaactcctggcct

SEQ ID NO: 5607383 - DNA, 16 bp, Homo sapiens
ctggtctctaggctgg

SEQ ID NO: 5607384 - DNA, 12 bp, Homo sapiens
ctggtctctggt

SEQ ID NO: 5607385 - DNA, 17 bp, Homo sapiens
ctggtctcttcaccact

SEQ ID NO: 5607386 - DNA, 20 bp, Homo sapiens
ctggtctgaactagttgaga

SEQ ID NO: 5607387 - DNA, 16 bp, Homo sapiens
ctggtctgccaggggc

SEQ ID NO: 5607388 - DNA, 14 bp, Homo sapiens
ctggtctgccctgg

SEQ ID NO: 5607389 - DNA, 16 bp, Homo sapiens
ctggtctgccctgggc

SEQ ID NO: 5607390 - DNA, 21 bp, Homo sapiens
ctggtctgcgccttgggatgg

SEQ ID NO: 5607391 - DNA, 15 bp, Homo sapiens
ctggtctgctcagga

SEQ ID NO: 5607392 - DNA, 19 bp, Homo sapiens
ctggtctgctgttccagtg

SEQ ID NO: 5607393 - DNA, 13 bp, Homo sapiens
ctggtctggagcc

SEQ ID NO: 5607394 - DNA, 16 bp, Homo sapiens
ctggtctggagcccct

SEQ ID NO: 5607395 - DNA, 21 bp, Homo sapiens
ctggtctggagcccctatcct

SEQ ID NO: 5607396 - DNA, 12 bp, Homo sapiens
ctggtctggagt

SEQ ID NO: 5607397 - DNA, 13 bp, Homo sapiens
ctggtctggagtc

SEQ ID NO: 5607398 - DNA, 16 bp, Homo sapiens
ctggtctggagtccca

SEQ ID NO: 5607399 - DNA, 20 bp, Homo sapiens
ctggtctggagtcccacccg

SEQ ID NO: 5607400 - DNA, 21 bp, Homo sapiens
ctggtctggagtcccacccgg

SEQ ID NO: 5607401 - DNA, 16 bp, Homo sapiens
ctggtctggtcaggca

SEQ ID NO: 5607402 - DNA, 14 bp, Homo sapiens
ctggtctgtaggga

SEQ ID NO: 5607403 - DNA, 17 bp, Homo sapiens
ctggtctgtgaagagcc

SEQ ID NO: 5607404 - DNA, 22 bp, Homo sapiens
ctggtctgtgaagagccggtgg

SEQ ID NO: 5607405 - DNA, 21 bp, Homo sapiens
ctggtctgtgcattgtggctg

SEQ ID NO: 5607406 - DNA, 17 bp, Homo sapiens
ctggtctgtgctgccct

SEQ ID NO: 5607407 - DNA, 18 bp, Homo sapiens
ctggtctgtgctgccctg

SEQ ID NO: 5607408 - DNA, 22 bp, Homo sapiens
ctggtctgtggagatggactca

SEQ ID NO: 5607409 - DNA, 16 bp, Homo sapiens
ctggtctgttaatctt

SEQ ID NO: 5607410 - DNA, 19 bp, Homo sapiens
ctggtctgttaatcttttt

SEQ ID NO: 5607411 - DNA, 18 bp, Homo sapiens
ctggtcttaaactcctgg

SEQ ID NO: 5607412 - DNA, 23 bp, Homo sapiens
ctggtcttccttacctggaaaaa

SEQ ID NO: 5607413 - DNA, 17 bp, Homo sapiens
ctggtcttcctttttgg

SEQ ID NO: 5607414 - DNA, 15 bp, Homo sapiens
ctggtcttctctaca

SEQ ID NO: 5607415 - DNA, 16 bp, Homo sapiens
ctggtcttctttgggt

SEQ ID NO: 5607416 - DNA, 21 bp, Homo sapiens
ctggtcttgaactcttggcct

SEQ ID NO: 5607417 - DNA, 19 bp, Homo sapiens
ctggtcttgaactgggctc

SEQ ID NO: 5607418 - DNA, 21 bp, Homo sapiens
ctggtcttgaagtcctggctt

SEQ ID NO: 5607419 - DNA, 18 bp, Homo sapiens
ctggtcttgtggaattgg

SEQ ID NO: 5607420 - DNA, 19 bp, Homo sapiens
ctggtcttgtttccaggag

SEQ ID NO: 5607421 - DNA, 22 bp, Homo sapiens
ctggtcttgtttccaggagcat

SEQ ID NO: 5607422 - DNA, 18 bp, Homo sapiens
ctggtctttagccccact

SEQ ID NO: 5607423 - DNA, 19 bp, Homo sapiens
ctggtctttgagctcccac

SEQ ID NO: 5607424 - DNA, 14 bp, Homo sapiens
ctggtgaaagagta

SEQ ID NO: 5607425 - DNA, 14 bp, Homo sapiens
ctggtgaagtgtga

SEQ ID NO: 5607426 - DNA, 16 bp, Homo sapiens
ctggtgaatcacctgg

SEQ ID NO: 5607427 - DNA, 17 bp, Homo sapiens
ctggtgaatcacctggc

SEQ ID NO: 5607428 - DNA, 15 bp, Homo sapiens
ctggtgacaggcaga

SEQ ID NO: 5607429 - DNA, 19 bp, Homo sapiens
ctggtgacaggcagacaca

SEQ ID NO: 5607430 - DNA, 23 bp, Homo sapiens
ctggtgacaggcagacacatgct

SEQ ID NO: 5607431 - DNA, 20 bp, Homo sapiens
ctggtgacatcaggtttttc

SEQ ID NO: 5607432 - DNA, 22 bp, Homo sapiens
ctggtgacatgtcttttcttgc

SEQ ID NO: 5607433 - DNA, 17 bp, Homo sapiens
ctggtgaccagaccaag

SEQ ID NO: 5607434 - DNA, 15 bp, Homo sapiens
ctggtgaccagactt

SEQ ID NO: 5607435 - DNA, 18 bp, Homo sapiens
ctggtgacctcctgtcac

SEQ ID NO: 5607436 - DNA, 19 bp, Homo sapiens
ctggtgacctcctgtcact

SEQ ID NO: 5607437 - DNA, 22 bp, Homo sapiens
ctggtgaccttccaagagcctg

SEQ ID NO: 5607438 - DNA, 23 bp, Homo sapiens
ctggtgaccttccaagagcctga

SEQ ID NO: 5607439 - DNA, 13 bp, Homo sapiens
ctggtgactcctg

SEQ ID NO: 5607440 - DNA, 21 bp, Homo sapiens
ctggtgactcgggggctgtct

SEQ ID NO: 5607441 - DNA, 15 bp, Homo sapiens
ctggtgactgattct

SEQ ID NO: 5607442 - DNA, 17 bp, Homo sapiens
ctggtgactgattcttc

SEQ ID NO: 5607443 - DNA, 18 bp, Homo sapiens
ctggtgactgattcttca

SEQ ID NO: 5607444 - DNA, 15 bp, Homo sapiens
ctggtgactgcagcc

SEQ ID NO: 5607445 - DNA, 21 bp, Homo sapiens
ctggtgactgcgatcttcaga

SEQ ID NO: 5607446 - DNA, 17 bp, Homo sapiens
ctggtgagaaaatatat

SEQ ID NO: 5607447 - DNA, 22 bp, Homo sapiens
ctggtgagaaaatatatgcctg

SEQ ID NO: 5607448 - DNA, 18 bp, Homo sapiens
ctggtgagaactgaggag

SEQ ID NO: 5607449 - DNA, 19 bp, Homo sapiens
ctggtgagaactgaggagc

SEQ ID NO: 5607450 - DNA, 13 bp, Homo sapiens
ctggtgagacagt

SEQ ID NO: 5607451 - DNA, 21 bp, Homo sapiens
ctggtgagaccccgcactgca

SEQ ID NO: 5607452 - DNA, 23 bp, Homo sapiens
ctggtgagaccccgcactgcaga

SEQ ID NO: 5607453 - DNA, 23 bp, Homo sapiens
ctggtgagagggccgggcagagg

SEQ ID NO: 5607454 - DNA, 23 bp, Homo sapiens
ctggtgagatacccagagagaaa

SEQ ID NO: 5607455 - DNA, 16 bp, Homo sapiens
ctggtgagcagactgg

SEQ ID NO: 5607456 - DNA, 14 bp, Homo sapiens
ctggtgagccaagc

SEQ ID NO: 5607457 - DNA, 12 bp, Homo sapiens
ctggtgaggaca

SEQ ID NO: 5607458 - DNA, 20 bp, Homo sapiens
ctggtgaggcccagcctgtc

SEQ ID NO: 5607459 - DNA, 19 bp, Homo sapiens
ctggtgaggccggccctgc

SEQ ID NO: 5607460 - DNA, 22 bp, Homo sapiens
ctggtgaggccggccctgcccc

SEQ ID NO: 5607461 - DNA, 14 bp, Homo sapiens
ctggtgagggcaag

SEQ ID NO: 5607462 - DNA, 17 bp, Homo sapiens
ctggtgagggcaagagg

SEQ ID NO: 5607463 - DNA, 15 bp, Homo sapiens
ctggtgaggtggccc

SEQ ID NO: 5607464 - DNA, 19 bp, Homo sapiens
ctggtgaggtggcccaggc

SEQ ID NO: 5607465 - DNA, 22 bp, Homo sapiens
ctggtgaggtggcccaggcccc

SEQ ID NO: 5607466 - DNA, 20 bp, Homo sapiens
ctggtgagtcttggcggcag

SEQ ID NO: 5607467 - DNA, 21 bp, Homo sapiens
ctggtgagtcttggcggcagc

SEQ ID NO: 5607468 - DNA, 23 bp, Homo sapiens
ctggtgagtcttggcggcagcag

SEQ ID NO: 5607469 - DNA, 21 bp, Homo sapiens
ctggtgataaaaataaagctg

SEQ ID NO: 5607470 - DNA, 18 bp, Homo sapiens
ctggtgatcactttatgt

SEQ ID NO: 5607471 - DNA, 14 bp, Homo sapiens
ctggtgatggtttc

SEQ ID NO: 5607472 - DNA, 17 bp, Homo sapiens
ctggtgatgttgaaata

SEQ ID NO: 5607473 - DNA, 22 bp, Homo sapiens
ctggtgcaattacagcaaaaag

SEQ ID NO: 5607474 - DNA, 19 bp, Homo sapiens
ctggtgcacagccactccc

SEQ ID NO: 5607475 - DNA, 14 bp, Homo sapiens
ctggtgcacgcctg

SEQ ID NO: 5607476 - DNA, 20 bp, Homo sapiens
ctggtgcacgcctgagcgtc

SEQ ID NO: 5607477 - DNA, 17 bp, Homo sapiens
ctggtgcactttgtaaa

SEQ ID NO: 5607478 - DNA, 18 bp, Homo sapiens
ctggtgcactttgtaaat

SEQ ID NO: 5607479 - DNA, 11 bp, Homo sapiens
ctggtgcagaa

SEQ ID NO: 5607480 - DNA, 19 bp, Homo sapiens
ctggtgcagaggtgagcag

SEQ ID NO: 5607481 - DNA, 20 bp, Homo sapiens
ctggtgcagaggtgagcaga

SEQ ID NO: 5607482 - DNA, 17 bp, Homo sapiens
ctggtgcaggtctccac

SEQ ID NO: 5607483 - DNA, 21 bp, Homo sapiens
ctggtgcaggtctccacctgc

SEQ ID NO: 5607484 - DNA, 22 bp, Homo sapiens
ctggtgcaggtctccacctgca

SEQ ID NO: 5607485 - DNA, 12 bp, Homo sapiens
ctggtgcagtgg

SEQ ID NO: 5607486 - DNA, 23 bp, Homo sapiens
ctggtgcatgttcttttctggaa

SEQ ID NO: 5607487 - DNA, 17 bp, Homo sapiens
ctggtgcattacagaga

SEQ ID NO: 5607488 - DNA, 19 bp, Homo sapiens
ctggtgcattacagagagg

SEQ ID NO: 5607489 - DNA, 14 bp, Homo sapiens
ctggtgcattgctg

SEQ ID NO: 5607490 - DNA, 17 bp, Homo sapiens
ctggtgcattgctgtgt

SEQ ID NO: 5607491 - DNA, 14 bp, Homo sapiens
ctggtgcatttaaa

SEQ ID NO: 5607492 - DNA, 20 bp, Homo sapiens
ctggtgccaaaaccaggcct

SEQ ID NO: 5607493 - DNA, 21 bp, Homo sapiens
ctggtgccaaaaccaggcctc

SEQ ID NO: 5607494 - DNA, 23 bp, Homo sapiens
ctggtgccaaatagccccagact

SEQ ID NO: 5607495 - DNA, 15 bp, Homo sapiens
ctggtgccaatttca

SEQ ID NO: 5607496 - DNA, 18 bp, Homo sapiens
ctggtgccaatttcaagt

SEQ ID NO: 5607497 - DNA, 20 bp, Homo sapiens
ctggtgccaatttcaagttc

SEQ ID NO: 5607498 - DNA, 23 bp, Homo sapiens
ctggtgccagatgtgggctcaga

SEQ ID NO: 5607499 - DNA, 17 bp, Homo sapiens
ctggtgccagccttcct

SEQ ID NO: 5607500 - DNA, 12 bp, Homo sapiens
ctggtgccaggc

SEQ ID NO: 5607501 - DNA, 22 bp, Homo sapiens
ctggtgccagggtgggtgtcca

SEQ ID NO: 5607502 - DNA, 14 bp, Homo sapiens
ctggtgcccacagc

SEQ ID NO: 5607503 - DNA, 17 bp, Homo sapiens
ctggtgcccaccagctg

SEQ ID NO: 5607504 - DNA, 20 bp, Homo sapiens
ctggtgcccaccagctggct

SEQ ID NO: 5607505 - DNA, 22 bp, Homo sapiens
ctggtgcccaccagctggctct

SEQ ID NO: 5607506 - DNA, 23 bp, Homo sapiens
ctgtaaaatacatggtatctctt

SEQ ID NO: 5607507 - DNA, 23 bp, Homo sapiens
ctgtaaaatactattggacagac

SEQ ID NO: 5607508 - DNA, 20 bp, Homo sapiens
ctgtaaaatagttttgcttt

SEQ ID NO: 5607509 - DNA, 23 bp, Homo sapiens
ctgtaaaatatacttaaatggaa

SEQ ID NO: 5607510 - DNA, 14 bp, Homo sapiens
ctgtaaaatgcaaa

SEQ ID NO: 5607511 - DNA, 22 bp, Homo sapiens
ctgtaaaatggagacaccacca

SEQ ID NO: 5607512 - DNA, 17 bp, Homo sapiens
ctgtaaacactcagctg

SEQ ID NO: 5607513 - DNA, 14 bp, Homo sapiens
ctgtaaacccctgg

SEQ ID NO: 5607514 - DNA, 18 bp, Homo sapiens
ctgtaaacggtgctattt

SEQ ID NO: 5607515 - DNA, 21 bp, Homo sapiens
ctgtaaacggtgctatttcta

SEQ ID NO: 5607516 - DNA, 13 bp, Homo sapiens
ctgtaaactataa

SEQ ID NO: 5607517 - DNA, 16 bp, Homo sapiens
ctgtaaactataaact

SEQ ID NO: 5607518 - DNA, 14 bp, Homo sapiens
ctgtaaactgtgta

SEQ ID NO: 5607519 - DNA, 13 bp, Homo sapiens
ctgtaaagaaaac

SEQ ID NO: 5607520 - DNA, 13 bp, Homo sapiens
ctgtaaagaaaga

SEQ ID NO: 5607521 - DNA, 14 bp, Homo sapiens
ctgtaaagaaagag

SEQ ID NO: 5607522 - DNA, 17 bp, Homo sapiens
ctgtaaagaaagagaga

SEQ ID NO: 5607523 - DNA, 21 bp, Homo sapiens
ctgtaaagaaagagagaaaat

SEQ ID NO: 5607524 - DNA, 22 bp, Homo sapiens
ctgtaaagaaagagagaaaata

SEQ ID NO: 5607525 - DNA, 12 bp, Homo sapiens
ctgtaaagaatt

SEQ ID NO: 5607526 - DNA, 22 bp, Homo sapiens
ctgtaaagagacctacctcagg

SEQ ID NO: 5607527 - DNA, 16 bp, Homo sapiens
ctgtaaagatgaatgt

SEQ ID NO: 5607528 - DNA, 16 bp, Homo sapiens
ctgtaaagcaaaagat

SEQ ID NO: 5607529 - DNA, 16 bp, Homo sapiens
ctgtaaagcgcagata

SEQ ID NO: 5607530 - DNA, 18 bp, Homo sapiens
ctgtaaagctaaaataaa

SEQ ID NO: 5607531 - DNA, 23 bp, Homo sapiens
ctgtaaagctaaaataaagaaat

SEQ ID NO: 5607532 - DNA, 21 bp, Homo sapiens
ctgtaaagttgaggggagagg

SEQ ID NO: 5607533 - DNA, 16 bp, Homo sapiens
ctgtaaataaaaatag

SEQ ID NO: 5607534 - DNA, 14 bp, Homo sapiens
ctgtaaataaaatg

SEQ ID NO: 5607535 - DNA, 18 bp, Homo sapiens
ctgtaaataaaatgtgta

SEQ ID NO: 5607536 - DNA, 20 bp, Homo sapiens
ctgtaaataaaatgtgtaca

SEQ ID NO: 5607537 - DNA, 17 bp, Homo sapiens
ctgtaaataagagttgc

SEQ ID NO: 5607538 - DNA, 22 bp, Homo sapiens
ctgtaaatacaaaataaaatta

SEQ ID NO: 5607539 - DNA, 16 bp, Homo sapiens
ctgtaaataccattga

SEQ ID NO: 5607540 - DNA, 13 bp, Homo sapiens
ctgtaaatagtga

SEQ ID NO: 5607541 - DNA, 20 bp, Homo sapiens
ctgtaaatagttttaaatat

SEQ ID NO: 5607542 - DNA, 23 bp, Homo sapiens
ctgtaaatagttttaaatatgaa

SEQ ID NO: 5607543 - DNA, 20 bp, Homo sapiens
ctgtaaatataaattttgtc

SEQ ID NO: 5607544 - DNA, 11 bp, Homo sapiens
ctgtaaatatc

SEQ ID NO: 5607545 - DNA, 22 bp, Homo sapiens
ctgtaaatatcccagagaacaa

SEQ ID NO: 5607546 - DNA, 21 bp, Homo sapiens
ctgtaaatatccctcccctct

SEQ ID NO: 5607547 - DNA, 16 bp, Homo sapiens
ctgtaaatatgtttgt

SEQ ID NO: 5607548 - DNA, 19 bp, Homo sapiens
ctgtaaatatgtttgtgcc

SEQ ID NO: 5607549 - DNA, 21 bp, Homo sapiens
ctgtaaatatgtttgtgcctt

SEQ ID NO: 5607550 - DNA, 18 bp, Homo sapiens
ctgtaaatcaagaccaaa

SEQ ID NO: 5607551 - DNA, 18 bp, Homo sapiens
ctgtaaatcacttgtaaa

SEQ ID NO: 5607552 - DNA, 21 bp, Homo sapiens
ctgtaaatcacttgtaaataa

SEQ ID NO: 5607553 - DNA, 22 bp, Homo sapiens
ctgtaaatcacttgtaaataaa

SEQ ID NO: 5607554 - DNA, 14 bp, Homo sapiens
ctgtaaatcataat

SEQ ID NO: 5607555 - DNA, 21 bp, Homo sapiens
ctgtaaatgccttgcttgtat

SEQ ID NO: 5607556 - DNA, 12 bp, Homo sapiens
ctgtaaatgctc

SEQ ID NO: 5607557 - DNA, 21 bp, Homo sapiens
ctgtaaatggtgtacataatg

SEQ ID NO: 5607558 - DNA, 15 bp, Homo sapiens
ctgtaaatgtattca

SEQ ID NO: 5607559 - DNA, 12 bp, Homo sapiens
ctgtaaatgtga

SEQ ID NO: 5607560 - DNA, 18 bp, Homo sapiens
ctgtaaattattttaaat

SEQ ID NO: 5607561 - DNA, 20 bp, Homo sapiens
ctgtaaattattttaaatta

SEQ ID NO: 5607562 - DNA, 16 bp, Homo sapiens
ctgtaaattgctggca

SEQ ID NO: 5607563 - DNA, 23 bp, Homo sapiens
ctgtaaattgctggcagatgctt

SEQ ID NO: 5607564 - DNA, 19 bp, Homo sapiens
ctgtaaatttaactgcata

SEQ ID NO: 5607565 - DNA, 21 bp, Homo sapiens
ctgtaaatttaactgcatata

SEQ ID NO: 5607566 - DNA, 17 bp, Homo sapiens
ctgtaaatttggcttct

SEQ ID NO: 5607567 - DNA, 18 bp, Homo sapiens
ctgtaaatttggcttctg

SEQ ID NO: 5607568 - DNA, 22 bp, Homo sapiens
ctgtaacaagttccattatgaa

SEQ ID NO: 5607569 - DNA, 19 bp, Homo sapiens
ctgtaacaatgtaataaaa

SEQ ID NO: 5607570 - DNA, 17 bp, Homo sapiens
ctgtaacacaagccaca

SEQ ID NO: 5607571 - DNA, 19 bp, Homo sapiens
ctgtaacacaagccacaga

SEQ ID NO: 5607572 - DNA, 15 bp, Homo sapiens
ctgtaacacagctga

SEQ ID NO: 5607573 - DNA, 15 bp, Homo sapiens
ctgtaacactattac

SEQ ID NO: 5607574 - DNA, 18 bp, Homo sapiens
ctgtaacaggtattttgt

SEQ ID NO: 5607575 - DNA, 14 bp, Homo sapiens
ctgtaacagttctt

SEQ ID NO: 5607576 - DNA, 22 bp, Homo sapiens
ctgtaacatcactatccatgca

SEQ ID NO: 5607577 - DNA, 20 bp, Homo sapiens
ctgtaacatcgcacagttta

SEQ ID NO: 5607578 - DNA, 15 bp, Homo sapiens
ctgtaacattcagga

SEQ ID NO: 5607579 - DNA, 15 bp, Homo sapiens
ctgtaaccacctctc

SEQ ID NO: 5607580 - DNA, 20 bp, Homo sapiens
ctgtaacctcttcagaggcc

SEQ ID NO: 5607581 - DNA, 16 bp, Homo sapiens
ctgtaacgtgtgctgt

SEQ ID NO: 5607582 - DNA, 18 bp, Homo sapiens
ctgtaactacaatgatgg

SEQ ID NO: 5607583 - DNA, 19 bp, Homo sapiens
ctgtaactacaatgatggt

SEQ ID NO: 5607584 - DNA, 19 bp, Homo sapiens
ctgtaactgcccagcccct

SEQ ID NO: 5607585 - DNA, 21 bp, Homo sapiens
ctgtaactgcccagccccttt

SEQ ID NO: 5607586 - DNA, 15 bp, Homo sapiens
ctgtaactgctcaga

SEQ ID NO: 5607587 - DNA, 16 bp, Homo sapiens
ctgtaactgctgagcc

SEQ ID NO: 5607588 - DNA, 18 bp, Homo sapiens
ctgtaactgctgagccac

SEQ ID NO: 5607589 - DNA, 21 bp, Homo sapiens
ctgtaactggtagtgttcagt

SEQ ID NO: 5607590 - DNA, 17 bp, Homo sapiens
ctgtaacttaattttgt

SEQ ID NO: 5607591 - DNA, 20 bp, Homo sapiens
ctgtaacttccaaataaata

SEQ ID NO: 5607592 - DNA, 19 bp, Homo sapiens
ctgtaactttttttcagtt

SEQ ID NO: 5607593 - DNA, 15 bp, Homo sapiens
ctgtaagaaaatgct

SEQ ID NO: 5607594 - DNA, 11 bp, Homo sapiens
ctgtaagaaat

SEQ ID NO: 5607595 - DNA, 21 bp, Homo sapiens
ctgtaagaagcggcatagcac

SEQ ID NO: 5607596 - DNA, 19 bp, Homo sapiens
ctgtaagaataatttatag

SEQ ID NO: 5607597 - DNA, 16 bp, Homo sapiens
ctgtaagacattagta

SEQ ID NO: 5607598 - DNA, 16 bp, Homo sapiens
ctgtaagacggccttg

SEQ ID NO: 5607599 - DNA, 18 bp, Homo sapiens
ctgtaagacggccttgga

SEQ ID NO: 5607600 - DNA, 16 bp, Homo sapiens
ctgtaagagaaaatat

SEQ ID NO: 5607601 - DNA, 17 bp, Homo sapiens
ctgtaagagacatgaat

SEQ ID NO: 5607602 - DNA, 13 bp, Homo sapiens
ctgtaagagcttg

SEQ ID NO: 5607603 - DNA, 18 bp, Homo sapiens
ctgtaagaggtactaaaa

SEQ ID NO: 5607604 - DNA, 15 bp, Homo sapiens
ctgtaagatgtctgt

SEQ ID NO: 5607605 - DNA, 19 bp, Homo sapiens
ctgtaagattgctttaaga

SEQ ID NO: 5607606 - DNA, 15 bp, Homo sapiens
ctgtaagccaaagaa

SEQ ID NO: 5607607 - DNA, 22 bp, Homo sapiens
ctgtaagccaaagaaatgaaca

SEQ ID NO: 5607608 - DNA, 23 bp, Homo sapiens
ctgtaagccaaagaaatgaacat

SEQ ID NO: 5607609 - DNA, 17 bp, Homo sapiens
ctgtaagcctgcaagcc

SEQ ID NO: 5607610 - DNA, 18 bp, Homo sapiens
ctgtaagcctgcaagcct

SEQ ID NO: 5607611 - DNA, 17 bp, Homo sapiens
ctgtaagctctttgaaa

SEQ ID NO: 5607612 - DNA, 17 bp, Homo sapiens
ctgtaaggaactggaac

SEQ ID NO: 5607613 - DNA, 18 bp, Homo sapiens
ctgtaaggcaatcatggt

SEQ ID NO: 5607614 - DNA, 14 bp, Homo sapiens
ctgtaaggctctag

SEQ ID NO: 5607615 - DNA, 16 bp, Homo sapiens
ctgtaaggctctagat

SEQ ID NO: 5607616 - DNA, 18 bp, Homo sapiens
ctgtaaggctctagatca

SEQ ID NO: 5607617 - DNA, 22 bp, Homo sapiens
ctgtaaggctctagatcataag

SEQ ID NO: 5607618 - DNA, 14 bp, Homo sapiens
ctgtaagggcagtg

SEQ ID NO: 5607619 - DNA, 17 bp, Homo sapiens
ctgtaagggcagtgccc

SEQ ID NO: 5607620 - DNA, 13 bp, Homo sapiens
ctgtaaggttcca

SEQ ID NO: 5607621 - DNA, 24 bp, Homo sapiens
ctgtaagttgggcttgctattctg

SEQ ID NO: 5607622 - DNA, 14 bp, Homo sapiens
ctgtaagtttattt

SEQ ID NO: 5607623 - DNA, 16 bp, Homo sapiens
ctgtaagtttattttt

SEQ ID NO: 5607624 - DNA, 17 bp, Homo sapiens
ctgtaataaagctcttt

SEQ ID NO: 5607625 - DNA, 12 bp, Homo sapiens
ctgtaataaata

SEQ ID NO: 5607626 - DNA, 23 bp, Homo sapiens
ctgtaataaataaatatactcaa

SEQ ID NO: 5607627 - DNA, 14 bp, Homo sapiens
ctgtaataaatgta

SEQ ID NO: 5607628 - DNA, 21 bp, Homo sapiens
ctgtaatacgtagctctctta

SEQ ID NO: 5607629 - DNA, 20 bp, Homo sapiens
ctgtaatataaagtattcaa

SEQ ID NO: 5607630 - DNA, 23 bp, Homo sapiens
ctgtaatatattgccagtatata

SEQ ID NO: 5607631 - DNA, 14 bp, Homo sapiens
ctgtaatatgtaca

SEQ ID NO: 5607632 - DNA, 16 bp, Homo sapiens
ctgtaatattgtaaat

SEQ ID NO: 5607633 - DNA, 17 bp, Homo sapiens
ctgtaatattgtaaata

SEQ ID NO: 5607634 - DNA, 18 bp, Homo sapiens
ctgtaatatttacaatgt

SEQ ID NO: 5607635 - DNA, 20 bp, Homo sapiens
ctgtaatcacactctcttct

SEQ ID NO: 5607636 - DNA, 17 bp, Homo sapiens
ctgtaatcagcaataaa

SEQ ID NO: 5607637 - DNA, 19 bp, Homo sapiens
ctgtaatcagctctcctgg

SEQ ID NO: 5607638 - DNA, 20 bp, Homo sapiens
ctgtaatcagctctcctggc

SEQ ID NO: 5607639 - DNA, 21 bp, Homo sapiens
ctgtaatcagctctcctggct

SEQ ID NO: 5607640 - DNA, 22 bp, Homo sapiens
ctgtaatcagctctcctggctc

SEQ ID NO: 5607641 - DNA, 14 bp, Homo sapiens
ctgtaatcaggcaa

SEQ ID NO: 5607642 - DNA, 20 bp, Homo sapiens
ctgtaatcatttgtttacat

SEQ ID NO: 5607643 - DNA, 15 bp, Homo sapiens
ctgtaatcccagcac

SEQ ID NO: 5607644 - DNA, 22 bp, Homo sapiens
ctgtaatcccagcactttgaga

SEQ ID NO: 5607645 - DNA, 20 bp, Homo sapiens
ctgtaatcccagcactttgg

SEQ ID NO: 5607646 - DNA, 22 bp, Homo sapiens
ctgtaatcccagcactttggga

SEQ ID NO: 5607647 - DNA, 15 bp, Homo sapiens
ctgtaatcccagcag

SEQ ID NO: 5607648 - DNA, 20 bp, Homo sapiens
ctgtaatcccagctacacct

SEQ ID NO: 5607649 - DNA, 19 bp, Homo sapiens
ctgtaatcccagctactcg

SEQ ID NO: 5607650 - DNA, 21 bp, Homo sapiens
ctgtaatcccagtactttgga

SEQ ID NO: 5607651 - DNA, 21 bp, Homo sapiens
ctgtaatgaaacaccttctct

SEQ ID NO: 5607652 - DNA, 19 bp, Homo sapiens
ctgtaatgagaacttcaat

SEQ ID NO: 5607653 - DNA, 18 bp, Homo sapiens
ctgtaatgatactgatta

SEQ ID NO: 5607654 - DNA, 22 bp, Homo sapiens
ctgtaatgatactgattatgaa

SEQ ID NO: 5607655 - DNA, 23 bp, Homo sapiens
ctgtaatgatactgattatgaaa

SEQ ID NO: 5607656 - DNA, 19 bp, Homo sapiens
ctgtaatgcactcctgccc

SEQ ID NO: 5607657 - DNA, 23 bp, Homo sapiens
ctgtaatgctgcctcaggaccca

SEQ ID NO: 5607658 - DNA, 17 bp, Homo sapiens
ctgtaatgggatctatt

SEQ ID NO: 5607659 - DNA, 14 bp, Homo sapiens
ctgtaatggttggg

SEQ ID NO: 5607660 - DNA, 23 bp, Homo sapiens
ctgtaatggttgggaccaggcca

SEQ ID NO: 5607661 - DNA, 22 bp, Homo sapiens
ctgtaatgtaactatctcacct

SEQ ID NO: 5607662 - DNA, 21 bp, Homo sapiens
ctgtaatgtaggcacttttat

SEQ ID NO: 5607663 - DNA, 21 bp, Homo sapiens
ctgtaatgtgaatctatgctg

SEQ ID NO: 5607664 - DNA, 12 bp, Homo sapiens
ctgtaatgtgta

SEQ ID NO: 5607665 - DNA, 21 bp, Homo sapiens
ctgtaattaaactagtttaag

SEQ ID NO: 5607666 - DNA, 15 bp, Homo sapiens
ctgtaattaagtgca

SEQ ID NO: 5607667 - DNA, 17 bp, Homo sapiens
ctgtaattaagtgcaat

SEQ ID NO: 5607668 - DNA, 12 bp, Homo sapiens
ctgtaattacat

SEQ ID NO: 5607669 - DNA, 15 bp, Homo sapiens
ctgtaattatttgaa

SEQ ID NO: 5607670 - DNA, 16 bp, Homo sapiens
ctgtaattatttgaat

SEQ ID NO: 5607671 - DNA, 16 bp, Homo sapiens
ctgtaattcctacctc

SEQ ID NO: 5607672 - DNA, 18 bp, Homo sapiens
ctgtaattcttctccttt

SEQ ID NO: 5607673 - DNA, 18 bp, Homo sapiens
ctgtaattgaatattatt

SEQ ID NO: 5607674 - DNA, 16 bp, Homo sapiens
ctgtaattgataatag

SEQ ID NO: 5607675 - DNA, 15 bp, Homo sapiens
ctgtaatttaattcc

SEQ ID NO: 5607676 - DNA, 16 bp, Homo sapiens
ctgtaatttagttatt

SEQ ID NO: 5607677 - DNA, 18 bp, Homo sapiens
ctgtaatttcgccttaaa

SEQ ID NO: 5607678 - DNA, 18 bp, Homo sapiens
ctgtaatttgcttgtttg

SEQ ID NO: 5607679 - DNA, 15 bp, Homo sapiens
ctgtaatttgtgata

SEQ ID NO: 5607680 - DNA, 18 bp, Homo sapiens
ctgtaattttgtttgtaa

SEQ ID NO: 5607681 - DNA, 19 bp, Homo sapiens
ctgtaattttgtttgtaat

SEQ ID NO: 5607682 - DNA, 16 bp, Homo sapiens
ctgtcacgtgaaatat

SEQ ID NO: 5607683 - DNA, 22 bp, Homo sapiens
ctgtcacgtggcttcatcagct

SEQ ID NO: 5607684 - DNA, 20 bp, Homo sapiens
ctgtcactaaatggcagtga

SEQ ID NO: 5607685 - DNA, 14 bp, Homo sapiens
ctgtcactcactga

SEQ ID NO: 5607686 - DNA, 16 bp, Homo sapiens
ctgtcactcactgagg

SEQ ID NO: 5607687 - DNA, 17 bp, Homo sapiens
ctgtcactcactgaggc

SEQ ID NO: 5607688 - DNA, 19 bp, Homo sapiens
ctgtcactcactgaggcca

SEQ ID NO: 5607689 - DNA, 13 bp, Homo sapiens
ctgtcactcagct

SEQ ID NO: 5607690 - DNA, 15 bp, Homo sapiens
ctgtcactcagctga

SEQ ID NO: 5607691 - DNA, 18 bp, Homo sapiens
ctgtcactcaggctggag

SEQ ID NO: 5607692 - DNA, 22 bp, Homo sapiens
ctgtcactcattgctgagcctc

SEQ ID NO: 5607693 - DNA, 12 bp, Homo sapiens
ctgtcactgccg

SEQ ID NO: 5607694 - DNA, 17 bp, Homo sapiens
ctgtcactggctggctc

SEQ ID NO: 5607695 - DNA, 13 bp, Homo sapiens
ctgtcactgtggg

SEQ ID NO: 5607696 - DNA, 14 bp, Homo sapiens
ctgtcactgtttct

SEQ ID NO: 5607697 - DNA, 19 bp, Homo sapiens
ctgtcacttgcattccact

SEQ ID NO: 5607698 - DNA, 15 bp, Homo sapiens
ctgtcacttgctgct

SEQ ID NO: 5607699 - DNA, 21 bp, Homo sapiens
ctgtcacttgctggctgtgaa

SEQ ID NO: 5607700 - DNA, 20 bp, Homo sapiens
ctgtcacttgtcgggggccc

SEQ ID NO: 5607701 - DNA, 18 bp, Homo sapiens
ctgtcactttctctctta

SEQ ID NO: 5607702 - DNA, 14 bp, Homo sapiens
ctgtcactttgctc

SEQ ID NO: 5607703 - DNA, 18 bp, Homo sapiens
ctgtcactttgctctggg

SEQ ID NO: 5607704 - DNA, 16 bp, Homo sapiens
ctgtcagaagtttcta

SEQ ID NO: 5607705 - DNA, 17 bp, Homo sapiens
ctgtcagaataaagaac

SEQ ID NO: 5607706 - DNA, 18 bp, Homo sapiens
ctgtcagaataaagaaca

SEQ ID NO: 5607707 - DNA, 17 bp, Homo sapiens
ctgtcagaatcatgctg

SEQ ID NO: 5607708 - DNA, 12 bp, Homo sapiens
ctgtcagaatgc

SEQ ID NO: 5607709 - DNA, 21 bp, Homo sapiens
ctgtcagaccttcttccacag

SEQ ID NO: 5607710 - DNA, 19 bp, Homo sapiens
ctgtcagacgttggtccca

SEQ ID NO: 5607711 - DNA, 21 bp, Homo sapiens
ctgtcagacgttggtcccaag

SEQ ID NO: 5607712 - DNA, 22 bp, Homo sapiens
ctgtcagacgttggtcccaagt

SEQ ID NO: 5607713 - DNA, 13 bp, Homo sapiens
ctgtcagagctgt

SEQ ID NO: 5607714 - DNA, 19 bp, Homo sapiens
ctgtcagagctgttggcct

SEQ ID NO: 5607715 - DNA, 20 bp, Homo sapiens
ctgtcagagctgttggcctc

SEQ ID NO: 5607716 - DNA, 22 bp, Homo sapiens
ctgtcagagctgttggcctcgc

SEQ ID NO: 5607717 - DNA, 13 bp, Homo sapiens
ctgtcagagcttt

SEQ ID NO: 5607718 - DNA, 12 bp, Homo sapiens
ctgtcagaggct

SEQ ID NO: 5607719 - DNA, 15 bp, Homo sapiens
ctgtcagaggctaag

SEQ ID NO: 5607720 - DNA, 21 bp, Homo sapiens
ctgtcagatccaggagctcca

SEQ ID NO: 5607721 - DNA, 18 bp, Homo sapiens
ctgtcagatgagaacaaa

SEQ ID NO: 5607722 - DNA, 21 bp, Homo sapiens
ctgtcagatgagaacaaagct

SEQ ID NO: 5607723 - DNA, 21 bp, Homo sapiens
ctgtcagatgggaagacatga

SEQ ID NO: 5607724 - DNA, 12 bp, Homo sapiens
ctgtcagattaa

SEQ ID NO: 5607725 - DNA, 15 bp, Homo sapiens
ctgtcagattaaatt

SEQ ID NO: 5607726 - DNA, 17 bp, Homo sapiens
ctgtcagattaaattac

SEQ ID NO: 5607727 - DNA, 19 bp, Homo sapiens
ctgtcagattaaattacag

SEQ ID NO: 5607728 - DNA, 21 bp, Homo sapiens
ctgtcagcaagactgaagatg

SEQ ID NO: 5607729 - DNA, 20 bp, Homo sapiens
ctgtcagccaacattgcctt

SEQ ID NO: 5607730 - DNA, 12 bp, Homo sapiens
ctgtcagccagc

SEQ ID NO: 5607731 - DNA, 23 bp, Homo sapiens
ctgtcagccagccgccctgggct

SEQ ID NO: 5607732 - DNA, 17 bp, Homo sapiens
ctgtcagcccacagcag

SEQ ID NO: 5607733 - DNA, 22 bp, Homo sapiens
ctgtcagcccctcatcagcctt

SEQ ID NO: 5607734 - DNA, 23 bp, Homo sapiens
ctgtcagcccctcatcagccttt

SEQ ID NO: 5607735 - DNA, 22 bp, Homo sapiens
ctgtcagccgggccctgagtaa

SEQ ID NO: 5607736 - DNA, 13 bp, Homo sapiens
ctgtcagcctggc

SEQ ID NO: 5607737 - DNA, 23 bp, Homo sapiens
ctgtcagcgcctcaagggtaggg

SEQ ID NO: 5607738 - DNA, 14 bp, Homo sapiens
ctgtcagctgagct

SEQ ID NO: 5607739 - DNA, 16 bp, Homo sapiens
ctgtcagctgagcttg

SEQ ID NO: 5607740 - DNA, 20 bp, Homo sapiens
ctgtcagcttcccaacaata

SEQ ID NO: 5607741 - DNA, 20 bp, Homo sapiens
ctgtcagcttccccaggagc

SEQ ID NO: 5607742 - DNA, 17 bp, Homo sapiens
ctgtcaggaccatttta

SEQ ID NO: 5607743 - DNA, 16 bp, Homo sapiens
ctgtcaggagagcagc

SEQ ID NO: 5607744 - DNA, 23 bp, Homo sapiens
ctgtcaggagatggaagagtcat

SEQ ID NO: 5607745 - DNA, 15 bp, Homo sapiens
ctgtcaggaggcaga

SEQ ID NO: 5607746 - DNA, 21 bp, Homo sapiens
ctgtcaggattgcgagagatg

SEQ ID NO: 5607747 - DNA, 24 bp, Homo sapiens
ctgtcaggattgcgagagatgtgt

SEQ ID NO: 5607748 - DNA, 16 bp, Homo sapiens
ctgtcaggcctctgag

SEQ ID NO: 5607749 - DNA, 20 bp, Homo sapiens
ctgtcaggcctctgagccca

SEQ ID NO: 5607750 - DNA, 16 bp, Homo sapiens
ctgtcaggccttcagg

SEQ ID NO: 5607751 - DNA, 14 bp, Homo sapiens
ctgtcagggagggc

SEQ ID NO: 5607752 - DNA, 20 bp, Homo sapiens
ctgtcagggcagtacaatgt

SEQ ID NO: 5607753 - DNA, 16 bp, Homo sapiens
ctgtcagtatgacatt

SEQ ID NO: 5607754 - DNA, 18 bp, Homo sapiens
ctgtcagtcacagccacc

SEQ ID NO: 5607755 - DNA, 17 bp, Homo sapiens
ctgtcagtcccactgca

SEQ ID NO: 5607756 - DNA, 14 bp, Homo sapiens
ctgtcagtctgctt

SEQ ID NO: 5607757 - DNA, 13 bp, Homo sapiens
ctgtcagtgagga

SEQ ID NO: 5607758 - DNA, 17 bp, Homo sapiens
ctgtcagtgccgccgcc

SEQ ID NO: 5607759 - DNA, 22 bp, Homo sapiens
ctgtcagtgggcctcatggtaa

SEQ ID NO: 5607760 - DNA, 20 bp, Homo sapiens
ctgtcagtgtacacgtctgg

SEQ ID NO: 5607761 - DNA, 17 bp, Homo sapiens
ctgtcagtgtttttgaa

SEQ ID NO: 5607762 - DNA, 18 bp, Homo sapiens
ctgtcagtgtttttgaaa

SEQ ID NO: 5607763 - DNA, 19 bp, Homo sapiens
ctgtcagttcagaaaaaat

SEQ ID NO: 5607764 - DNA, 19 bp, Homo sapiens
ctgtcagttctaacctcct

SEQ ID NO: 5607765 - DNA, 18 bp, Homo sapiens
ctgtcagtttcccctctc

SEQ ID NO: 5607766 - DNA, 22 bp, Homo sapiens
ctgtcagtttcccctctcggcc

SEQ ID NO: 5607767 - DNA, 18 bp, Homo sapiens
ctgtcataagcattactt

SEQ ID NO: 5607768 - DNA, 14 bp, Homo sapiens
ctgtcatagaaagt

SEQ ID NO: 5607769 - DNA, 22 bp, Homo sapiens
ctgtcatagggattgtccctgt

SEQ ID NO: 5607770 - DNA, 15 bp, Homo sapiens
ctgtcataggtttta

SEQ ID NO: 5607771 - DNA, 22 bp, Homo sapiens
ctgtcataggttttaaatctgc

SEQ ID NO: 5607772 - DNA, 16 bp, Homo sapiens
ctgtcatatcttcaca

SEQ ID NO: 5607773 - DNA, 23 bp, Homo sapiens
ctgtcatcaattaaaggcaaagg

SEQ ID NO: 5607774 - DNA, 15 bp, Homo sapiens
ctgtcatcaattgaa

SEQ ID NO: 5607775 - DNA, 16 bp, Homo sapiens
ctgtcatcactccctg

SEQ ID NO: 5607776 - DNA, 17 bp, Homo sapiens
ctgtcatcactccctgg

SEQ ID NO: 5607777 - DNA, 21 bp, Homo sapiens
ctgtcatcactccctggatgt

SEQ ID NO: 5607778 - DNA, 21 bp, Homo sapiens
ctgtcatcatcatggccagct

SEQ ID NO: 5607779 - DNA, 16 bp, Homo sapiens
ctgtcatccagaaaat

SEQ ID NO: 5607780 - DNA, 13 bp, Homo sapiens
ctgtcatcccgct

SEQ ID NO: 5607781 - DNA, 18 bp, Homo sapiens
ctgtcatcccgctcctgc

SEQ ID NO: 5607782 - DNA, 20 bp, Homo sapiens
ctgtcatcctcaaagaaagt

SEQ ID NO: 5607783 - DNA, 18 bp, Homo sapiens
ctgtcatctaccttttct

SEQ ID NO: 5607784 - DNA, 14 bp, Homo sapiens
ctgtcatctgggcc

SEQ ID NO: 5607785 - DNA, 13 bp, Homo sapiens
ctgtcatctgtag

SEQ ID NO: 5607786 - DNA, 14 bp, Homo sapiens
ctgtcatctgtgca

SEQ ID NO: 5607787 - DNA, 21 bp, Homo sapiens
ctgtcatctgtgcactgccca

SEQ ID NO: 5607788 - DNA, 15 bp, Homo sapiens
ctgtcatgaacatgt

SEQ ID NO: 5607789 - DNA, 19 bp, Homo sapiens
ctgtcatgaacatgttcct

SEQ ID NO: 5607790 - DNA, 22 bp, Homo sapiens
ctgtcatgatacgcttaaggtg

SEQ ID NO: 5607791 - DNA, 13 bp, Homo sapiens
ctgtcatgccaaa

SEQ ID NO: 5607792 - DNA, 14 bp, Homo sapiens
ctgtcatgcttcat

SEQ ID NO: 5607793 - DNA, 18 bp, Homo sapiens
ctgtcatggtcctttctg

SEQ ID NO: 5607794 - DNA, 20 bp, Homo sapiens
ctgtcatggtcctttctgga

SEQ ID NO: 5607795 - DNA, 19 bp, Homo sapiens
ctgtcatgtgcgaacacag

SEQ ID NO: 5607796 - DNA, 19 bp, Homo sapiens
ctgtcattatattctaatt

SEQ ID NO: 5607797 - DNA, 22 bp, Homo sapiens
ctgtcattcccctcttttgtct

SEQ ID NO: 5607798 - DNA, 23 bp, Homo sapiens
ctgtcattcctaaaacacccttc

SEQ ID NO: 5607799 - DNA, 12 bp, Homo sapiens
ctgtcattcctc

SEQ ID NO: 5607800 - DNA, 16 bp, Homo sapiens
ctgtcattgcccctcc

SEQ ID NO: 5607801 - DNA, 18 bp, Homo sapiens
ctgtcattgcttcttctg

SEQ ID NO: 5607802 - DNA, 15 bp, Homo sapiens
ctgtcattgtattca

SEQ ID NO: 5607803 - DNA, 14 bp, Homo sapiens
ctgtcattgtccat

SEQ ID NO: 5607804 - DNA, 23 bp, Homo sapiens
ctgtcattgtccatgcctacaga

SEQ ID NO: 5607805 - DNA, 18 bp, Homo sapiens
ctgtcattgttaaataca

SEQ ID NO: 5607806 - DNA, 18 bp, Homo sapiens
ctgtcatttctctttcaa

SEQ ID NO: 5607807 - DNA, 18 bp, Homo sapiens
ctgtcatttgagcagggc

SEQ ID NO: 5607808 - DNA, 22 bp, Homo sapiens
ctgtcatttgagcagggctcag

SEQ ID NO: 5607809 - DNA, 18 bp, Homo sapiens
ctgtcatttgttgtgatg

SEQ ID NO: 5607810 - DNA, 19 bp, Homo sapiens
ctgtccaaaagcgccctca

SEQ ID NO: 5607811 - DNA, 20 bp, Homo sapiens
ctgtccaaaagcgccctcac

SEQ ID NO: 5607812 - DNA, 18 bp, Homo sapiens
ctgtccaaacatttcatc

SEQ ID NO: 5607813 - DNA, 15 bp, Homo sapiens
ctgtccaaactgcct

SEQ ID NO: 5607814 - DNA, 15 bp, Homo sapiens
ctgtccaacatgttt

SEQ ID NO: 5607815 - DNA, 15 bp, Homo sapiens
ctgtccaacccctcc

SEQ ID NO: 5607816 - DNA, 23 bp, Homo sapiens
ctgtccaacccctcccccacgtc

SEQ ID NO: 5607817 - DNA, 17 bp, Homo sapiens
ctgtccaagtgtttctt

SEQ ID NO: 5607818 - DNA, 19 bp, Homo sapiens
ctgtccaatatgaaaaccg

SEQ ID NO: 5607819 - DNA, 16 bp, Homo sapiens
ctgtccaatctgcaag

SEQ ID NO: 5607820 - DNA, 18 bp, Homo sapiens
ctgtccaatttctgctgt

SEQ ID NO: 5607821 - DNA, 15 bp, Homo sapiens
ctgtccacacccagc

SEQ ID NO: 5607822 - DNA, 17 bp, Homo sapiens
ctgtccacaggcttctg

SEQ ID NO: 5607823 - DNA, 17 bp, Homo sapiens
ctgtccacatccccaga

SEQ ID NO: 5607824 - DNA, 21 bp, Homo sapiens
ctgtccacatccccagagccc

SEQ ID NO: 5607825 - DNA, 22 bp, Homo sapiens
ctgtccacatgacctccatttc

SEQ ID NO: 5607826 - DNA, 15 bp, Homo sapiens
ctgtccaccagaccc

SEQ ID NO: 5607827 - DNA, 16 bp, Homo sapiens
ctgtccaccagaccca

SEQ ID NO: 5607828 - DNA, 13 bp, Homo sapiens
ctgtccaccctgc

SEQ ID NO: 5607829 - DNA, 16 bp, Homo sapiens
ctgtccaccctgccaa

SEQ ID NO: 5607830 - DNA, 15 bp, Homo sapiens
ctgtccacctgtgct

SEQ ID NO: 5607831 - DNA, 22 bp, Homo sapiens
ctgtccactctgctcagggccg

SEQ ID NO: 5607832 - DNA, 23 bp, Homo sapiens
ctgtccacttgtgggtcctgggg

SEQ ID NO: 5607833 - DNA, 13 bp, Homo sapiens
ctgtccagaaaat

SEQ ID NO: 5607834 - DNA, 20 bp, Homo sapiens
ctgtccagacaagccctgct

SEQ ID NO: 5607835 - DNA, 17 bp, Homo sapiens
ctgtccagacagcctgt

SEQ ID NO: 5607836 - DNA, 17 bp, Homo sapiens
ctgtccagccagctcct

SEQ ID NO: 5607837 - DNA, 17 bp, Homo sapiens
ctgtccagcctgggcag

SEQ ID NO: 5607838 - DNA, 18 bp, Homo sapiens
ctgtccagcctgggcagc

SEQ ID NO: 5607839 - DNA, 19 bp, Homo sapiens
ctgtccagcgcggctcccg

SEQ ID NO: 5607840 - DNA, 17 bp, Homo sapiens
ctgtccagctccaacct

SEQ ID NO: 5607841 - DNA, 15 bp, Homo sapiens
ctgtccagctggggc

SEQ ID NO: 5607842 - DNA, 21 bp, Homo sapiens
ctgtccagctggggccagagg

SEQ ID NO: 5607843 - DNA, 22 bp, Homo sapiens
ctgtccagctggggccagaggc

SEQ ID NO: 5607844 - DNA, 12 bp, Homo sapiens
ctgtccaggaca

SEQ ID NO: 5607845 - DNA, 19 bp, Homo sapiens
ctgtccaggcactgagata

SEQ ID NO: 5607846 - DNA, 20 bp, Homo sapiens
ctgtccaggcactgctgccc

SEQ ID NO: 5607847 - DNA, 23 bp, Homo sapiens
ctgtccaggcactgctgcccagc

SEQ ID NO: 5607848 - DNA, 22 bp, Homo sapiens
ctgtccaggcagctccctcctg

SEQ ID NO: 5607849 - DNA, 15 bp, Homo sapiens
ctgtccaggccactg

SEQ ID NO: 5607850 - DNA, 20 bp, Homo sapiens
ctgtccaggccactgtggcc

SEQ ID NO: 5607851 - DNA, 12 bp, Homo sapiens
ctgtccaggctc

SEQ ID NO: 5607852 - DNA, 16 bp, Homo sapiens
ctgtccagggaaacag

SEQ ID NO: 5607853 - DNA, 17 bp, Homo sapiens
ctgtccagggaaacagc

SEQ ID NO: 5607854 - DNA, 18 bp, Homo sapiens
ctgtccagggccctgagc

SEQ ID NO: 5607855 - DNA, 20 bp, Homo sapiens
ctgtccagggccctgagctc

SEQ ID NO: 5607856 - DNA, 17 bp, Homo sapiens
ctgtccagggcttcaga

SEQ ID NO: 5607857 - DNA, 15 bp, Homo sapiens
ctgtccaggtagaaa

SEQ ID NO: 5607858 - DNA, 18 bp, Homo sapiens
ctgtcgggaccacatctg

SEQ ID NO: 5607859 - DNA, 19 bp, Homo sapiens
ctgtcgggaccacatctgt

SEQ ID NO: 5607860 - DNA, 21 bp, Homo sapiens
ctgtcgggcccgcactcagga

SEQ ID NO: 5607861 - DNA, 15 bp, Homo sapiens
ctgtcgggctttgtg

SEQ ID NO: 5607862 - DNA, 17 bp, Homo sapiens
ctgtcgggggccactgt

SEQ ID NO: 5607863 - DNA, 19 bp, Homo sapiens
ctgtcgggggccactgtgt

SEQ ID NO: 5607864 - DNA, 20 bp, Homo sapiens
ctgtcgggggccactgtgtt

SEQ ID NO: 5607865 - DNA, 16 bp, Homo sapiens
ctgtcggtgtcccctt

SEQ ID NO: 5607866 - DNA, 19 bp, Homo sapiens
ctgtcggtgtttggaggct

SEQ ID NO: 5607867 - DNA, 20 bp, Homo sapiens
ctgtcggtgtttggaggctg

SEQ ID NO: 5607868 - DNA, 16 bp, Homo sapiens
ctgtcgtccccagacc

SEQ ID NO: 5607869 - DNA, 17 bp, Homo sapiens
ctgtcgtccccagacca

SEQ ID NO: 5607870 - DNA, 18 bp, Homo sapiens
ctgtcgtccccagaccag

SEQ ID NO: 5607871 - DNA, 22 bp, Homo sapiens
ctgtcgtctctcccaccccctc

SEQ ID NO: 5607872 - DNA, 19 bp, Homo sapiens
ctgtcgtctgactctgggt

SEQ ID NO: 5607873 - DNA, 21 bp, Homo sapiens
ctgtcgtctgactctgggttc

SEQ ID NO: 5607874 - DNA, 23 bp, Homo sapiens
ctgtcgtctttttccaaacaatt

SEQ ID NO: 5607875 - DNA, 12 bp, Homo sapiens
ctgtcgtgccag

SEQ ID NO: 5607876 - DNA, 15 bp, Homo sapiens
ctgtcgtgccagtcc

SEQ ID NO: 5607877 - DNA, 17 bp, Homo sapiens
ctgtcgtgccagtcctg

SEQ ID NO: 5607878 - DNA, 21 bp, Homo sapiens
ctgtcgtgtttacaaaaggca

SEQ ID NO: 5607879 - DNA, 22 bp, Homo sapiens
ctgtcgttctccacccaccagt

SEQ ID NO: 5607880 - DNA, 23 bp, Homo sapiens
ctgtcgttgttgtggaagcatgt

SEQ ID NO: 5607881 - DNA, 14 bp, Homo sapiens
ctgtctaaaaaaca

SEQ ID NO: 5607882 - DNA, 14 bp, Homo sapiens
ctgtctaaccccca

SEQ ID NO: 5607883 - DNA, 19 bp, Homo sapiens
ctgtctaacccccagctgg

SEQ ID NO: 5607884 - DNA, 21 bp, Homo sapiens
ctgtctaacccccagctgggt

SEQ ID NO: 5607885 - DNA, 16 bp, Homo sapiens
ctgtctaacctgtgac

SEQ ID NO: 5607886 - DNA, 22 bp, Homo sapiens
ctgtctaagcagttttgtaaat

SEQ ID NO: 5607887 - DNA, 23 bp, Homo sapiens
ctgtctaagcagttttgtaaatg

SEQ ID NO: 5607888 - DNA, 19 bp, Homo sapiens
ctgtctaatttgcaccttt

SEQ ID NO: 5607889 - DNA, 13 bp, Homo sapiens
ctgtctacaaata

SEQ ID NO: 5607890 - DNA, 14 bp, Homo sapiens
ctgtctacaggaaa

SEQ ID NO: 5607891 - DNA, 14 bp, Homo sapiens
ctgtctaccatctc

SEQ ID NO: 5607892 - DNA, 14 bp, Homo sapiens
ctgtctacctggtc

SEQ ID NO: 5607893 - DNA, 13 bp, Homo sapiens
ctgtctactgtgg

SEQ ID NO: 5607894 - DNA, 16 bp, Homo sapiens
ctgtctactgtggtga

SEQ ID NO: 5607895 - DNA, 17 bp, Homo sapiens
ctgtctactttctcttg

SEQ ID NO: 5607896 - DNA, 16 bp, Homo sapiens
ctgtctagagagggag

SEQ ID NO: 5607897 - DNA, 12 bp, Homo sapiens
ctgtctagagta

SEQ ID NO: 5607898 - DNA, 17 bp, Homo sapiens
ctgtctagcacttcctt

SEQ ID NO: 5607899 - DNA, 14 bp, Homo sapiens
ctgtctagcatgcc

SEQ ID NO: 5607900 - DNA, 17 bp, Homo sapiens
ctgtctagccactccct

SEQ ID NO: 5607901 - DNA, 21 bp, Homo sapiens
ctgtctagccactccctccca

SEQ ID NO: 5607902 - DNA, 22 bp, Homo sapiens
ctgtctagccactccctcccag

SEQ ID NO: 5607903 - DNA, 23 bp, Homo sapiens
ctgtctagccactccctcccaga

SEQ ID NO: 5607904 - DNA, 15 bp, Homo sapiens
ctgtctagccttagt

SEQ ID NO: 5607905 - DNA, 15 bp, Homo sapiens
ctgtctagctgtttc

SEQ ID NO: 5607906 - DNA, 13 bp, Homo sapiens
ctgtctaggactg

SEQ ID NO: 5607907 - DNA, 21 bp, Homo sapiens
ctgtctaggactgcagtgtgg

SEQ ID NO: 5607908 - DNA, 12 bp, Homo sapiens
ctgtctaggcta

SEQ ID NO: 5607909 - DNA, 23 bp, Homo sapiens
ctgtctaggtcagtacccacctg

SEQ ID NO: 5607910 - DNA, 17 bp, Homo sapiens
ctgtctaggttaaagct

SEQ ID NO: 5607911 - DNA, 18 bp, Homo sapiens
ctgtctagtctctcctgt

SEQ ID NO: 5607912 - DNA, 14 bp, Homo sapiens
ctgtctagtgtctg

SEQ ID NO: 5607913 - DNA, 20 bp, Homo sapiens
ctgtctatactacagtagtt

SEQ ID NO: 5607914 - DNA, 19 bp, Homo sapiens
ctgtctataggacttaatt

SEQ ID NO: 5607915 - DNA, 14 bp, Homo sapiens
ctgtctatatatat

SEQ ID NO: 5607916 - DNA, 19 bp, Homo sapiens
ctgtctatatcataactat

SEQ ID NO: 5607917 - DNA, 19 bp, Homo sapiens
ctgtctatgttgtgatcct

SEQ ID NO: 5607918 - DNA, 16 bp, Homo sapiens
ctgtctattaaaattc

SEQ ID NO: 5607919 - DNA, 17 bp, Homo sapiens
ctgtctattaaaattct

SEQ ID NO: 5607920 - DNA, 19 bp, Homo sapiens
ctgtctattaaaattctga

SEQ ID NO: 5607921 - DNA, 17 bp, Homo sapiens
ctgtctattgtcacatg

SEQ ID NO: 5607922 - DNA, 23 bp, Homo sapiens
ctgtctcaaaaaaaaaaagaaaa

SEQ ID NO: 5607923 - DNA, 18 bp, Homo sapiens
ctgtctcaagagggcact

SEQ ID NO: 5607924 - DNA, 20 bp, Homo sapiens
ctgtctcaagctcttcctta

SEQ ID NO: 5607925 - DNA, 14 bp, Homo sapiens
ctgtctcaatagct

SEQ ID NO: 5607926 - DNA, 15 bp, Homo sapiens
ctgtctcaatagctc

SEQ ID NO: 5607927 - DNA, 12 bp, Homo sapiens
ctgtctcagcct

SEQ ID NO: 5607928 - DNA, 14 bp, Homo sapiens
ctgtctcagcctcc

SEQ ID NO: 5607929 - DNA, 17 bp, Homo sapiens
ctgtctcagcctcccag

SEQ ID NO: 5607930 - DNA, 19 bp, Homo sapiens
ctgtctcagcctcctgagt

SEQ ID NO: 5607931 - DNA, 19 bp, Homo sapiens
ctgtctcaggagcaccctg

SEQ ID NO: 5607932 - DNA, 13 bp, Homo sapiens
ctgtctcagggtg

SEQ ID NO: 5607933 - DNA, 12 bp, Homo sapiens
ctgtctcagtga

SEQ ID NO: 5607934 - DNA, 16 bp, Homo sapiens
ctgtctcatccatcat

SEQ ID NO: 5607935 - DNA, 20 bp, Homo sapiens
ctgtctcatccatcatcatg

SEQ ID NO: 5607936 - DNA, 21 bp, Homo sapiens
ctgtctcatccatcatcatgt

SEQ ID NO: 5607937 - DNA, 15 bp, Homo sapiens
ctgtctcatccccag

SEQ ID NO: 5607938 - DNA, 14 bp, Homo sapiens
ctgtctcatcctcc

SEQ ID NO: 5607939 - DNA, 15 bp, Homo sapiens
ctgtctcatcctcct

SEQ ID NO: 5607940 - DNA, 17 bp, Homo sapiens
ctgtctcatcctcctgg

SEQ ID NO: 5607941 - DNA, 19 bp, Homo sapiens
ctgtctcatcttctgaaga

SEQ ID NO: 5607942 - DNA, 12 bp, Homo sapiens
ctgtctccagac

SEQ ID NO: 5607943 - DNA, 12 bp, Homo sapiens
ctgtctccagct

SEQ ID NO: 5607944 - DNA, 17 bp, Homo sapiens
ctgtctccagctgcctg

SEQ ID NO: 5607945 - DNA, 18 bp, Homo sapiens
ctgtctccaggcagttct

SEQ ID NO: 5607946 - DNA, 19 bp, Homo sapiens
ctgtctccaggcagttctc

SEQ ID NO: 5607947 - DNA, 21 bp, Homo sapiens
ctgtctccagggcccccaccg

SEQ ID NO: 5607948 - DNA, 23 bp, Homo sapiens
ctgtctccatgataactgcattt

SEQ ID NO: 5607949 - DNA, 16 bp, Homo sapiens
ctgtctcccaggctgg

SEQ ID NO: 5607950 - DNA, 20 bp, Homo sapiens
ctgtctccctataatgctgg

SEQ ID NO: 5607951 - DNA, 19 bp, Homo sapiens
ctgtctccctccccaaatg

SEQ ID NO: 5607952 - DNA, 23 bp, Homo sapiens
ctgtctccctccccaaatggctg

SEQ ID NO: 5607953 - DNA, 22 bp, Homo sapiens
ctgtctccctcccctctcagaa

SEQ ID NO: 5607954 - DNA, 23 bp, Homo sapiens
ctgtctccctcccctctcagaac

SEQ ID NO: 5607955 - DNA, 16 bp, Homo sapiens
ctgtctccctgaagag

SEQ ID NO: 5607956 - DNA, 19 bp, Homo sapiens
ctgtctcctacctctgctc

SEQ ID NO: 5607957 - DNA, 14 bp, Homo sapiens
ctgtctcctccctg

SEQ ID NO: 5607958 - DNA, 13 bp, Homo sapiens
ctgtctccttccc

SEQ ID NO: 5607959 - DNA, 17 bp, Homo sapiens
ctgtctccttcccactg

SEQ ID NO: 5607960 - DNA, 23 bp, Homo sapiens
ctgtctccttcccactgtccttt

SEQ ID NO: 5607961 - DNA, 15 bp, Homo sapiens
ctgtctcgagcgccc

SEQ ID NO: 5607962 - DNA, 21 bp, Homo sapiens
ctgtctcgagcgccctgcaga

SEQ ID NO: 5607963 - DNA, 22 bp, Homo sapiens
ctgtctcgagcgccctgcagac

SEQ ID NO: 5607964 - DNA, 23 bp, Homo sapiens
ctgtctcgagcgccctgcagacc

SEQ ID NO: 5607965 - DNA, 15 bp, Homo sapiens
ctgtctcgatgcctg

SEQ ID NO: 5607966 - DNA, 19 bp, Homo sapiens
ctgtctcgatgcctgattc

SEQ ID NO: 5607967 - DNA, 14 bp, Homo sapiens
ctgtctcggcagag

SEQ ID NO: 5607968 - DNA, 17 bp, Homo sapiens
ctgtctcggctctgcat

SEQ ID NO: 5607969 - DNA, 14 bp, Homo sapiens
ctgtctcgggctga

SEQ ID NO: 5607970 - DNA, 18 bp, Homo sapiens
ctgtctcgggctgaccct

SEQ ID NO: 5607971 - DNA, 22 bp, Homo sapiens
ctgtctcgggctgacccttttc

SEQ ID NO: 5607972 - DNA, 24 bp, Homo sapiens
ctgtctcgggggggttttcatcta

SEQ ID NO: 5607973 - DNA, 22 bp, Homo sapiens
ctgtctctaaaaagaagccaca

SEQ ID NO: 5607974 - DNA, 23 bp, Homo sapiens
ctgtctctaaaaagaagccacag

SEQ ID NO: 5607975 - DNA, 18 bp, Homo sapiens
ctgtctctaaccattcaa

SEQ ID NO: 5607976 - DNA, 20 bp, Homo sapiens
ctgtctctaaccattcaaat

SEQ ID NO: 5607977 - DNA, 21 bp, Homo sapiens
ctgtctctaaggagcagcggg

SEQ ID NO: 5607978 - DNA, 23 bp, Homo sapiens
ctgtctctaccaaaaaaaggaag

SEQ ID NO: 5607979 - DNA, 14 bp, Homo sapiens
ctgtctctactaaa

SEQ ID NO: 5607980 - DNA, 18 bp, Homo sapiens
ctgtctctactaaaaata

SEQ ID NO: 5607981 - DNA, 15 bp, Homo sapiens
ctgtctctagccact

SEQ ID NO: 5607982 - DNA, 16 bp, Homo sapiens
ctgtctctccatctgt

SEQ ID NO: 5607983 - DNA, 23 bp, Homo sapiens
ctgtctctccctaccctcttctc

SEQ ID NO: 5607984 - DNA, 18 bp, Homo sapiens
ctgtctctcctagcccct

SEQ ID NO: 5607985 - DNA, 20 bp, Homo sapiens
ctgtctctcctagcccctct

SEQ ID NO: 5607986 - DNA, 22 bp, Homo sapiens
ctgtctctcctagcccctctct

SEQ ID NO: 5607987 - DNA, 24 bp, Homo sapiens
ctgtctctcctagcccctctctca

SEQ ID NO: 5607988 - DNA, 22 bp, Homo sapiens
ctgtctctccttgttgccccca

SEQ ID NO: 5607989 - DNA, 18 bp, Homo sapiens
ctgtctctctctcttttt

SEQ ID NO: 5607990 - DNA, 15 bp, Homo sapiens
ctgtctctctgggct

SEQ ID NO: 5607991 - DNA, 11 bp, Homo sapiens
ctgtctctctt

SEQ ID NO: 5607992 - DNA, 21 bp, Homo sapiens
ctgtctctcttctcagagtgg

SEQ ID NO: 5607993 - DNA, 12 bp, Homo sapiens
ctgtctctcttg

SEQ ID NO: 5607994 - DNA, 19 bp, Homo sapiens
ctgtctctcttgctttgtt

SEQ ID NO: 5607995 - DNA, 13 bp, Homo sapiens
ctgtctctcttgt

SEQ ID NO: 5607996 - DNA, 22 bp, Homo sapiens
ctgtctctcttgtcacatggaa

SEQ ID NO: 5607997 - DNA, 15 bp, Homo sapiens
ctgtctctgcacaga

SEQ ID NO: 5607998 - DNA, 15 bp, Homo sapiens
ctgtctctgcatctg

SEQ ID NO: 5607999 - DNA, 18 bp, Homo sapiens
ctgtctctgcctccctca

SEQ ID NO: 5608000 - DNA, 12 bp, Homo sapiens
ctgtctctgctc

SEQ ID NO: 5608001 - DNA, 21 bp, Homo sapiens
ctgtctctgctcgccctcctt

SEQ ID NO: 5608002 - DNA, 11 bp, Homo sapiens
ctgtctctgga

SEQ ID NO: 5608003 - DNA, 17 bp, Homo sapiens
ctgtctctggcatttgt

SEQ ID NO: 5608004 - DNA, 20 bp, Homo sapiens
ctgtctctggctactccctg

SEQ ID NO: 5608005 - DNA, 11 bp, Homo sapiens
ctgtctctgtc

SEQ ID NO: 5608006 - DNA, 12 bp, Homo sapiens
ctgtctctgtcc

SEQ ID NO: 5608007 - DNA, 15 bp, Homo sapiens
ctgtctcttccatgc

SEQ ID NO: 5608008 - DNA, 22 bp, Homo sapiens
ctgtctcttcttaaccctgaac

SEQ ID NO: 5608009 - DNA, 15 bp, Homo sapiens
ctgtctcttgaaaaa

SEQ ID NO: 5608010 - DNA, 18 bp, Homo sapiens
ctgtctcttgaaaaatgc

SEQ ID NO: 5608011 - DNA, 14 bp, Homo sapiens
ctgtctcttggctt

SEQ ID NO: 5608012 - DNA, 16 bp, Homo sapiens
ctgtctcttggctttg

SEQ ID NO: 5608013 - DNA, 21 bp, Homo sapiens
ctgtctcttgggaagcagttt

SEQ ID NO: 5608014 - DNA, 15 bp, Homo sapiens
ctgtctcttttctct

SEQ ID NO: 5608015 - DNA, 13 bp, Homo sapiens
ctgtctgaaaaag

SEQ ID NO: 5608016 - DNA, 19 bp, Homo sapiens
ctgtctgaaaccagaagac

SEQ ID NO: 5608017 - DNA, 20 bp, Homo sapiens
ctgtctgaaaccagaagact

SEQ ID NO: 5608018 - DNA, 16 bp, Homo sapiens
ctgtctgaagccaatg

SEQ ID NO: 5608019 - DNA, 20 bp, Homo sapiens
ctgtctgaagcccaaagcct

SEQ ID NO: 5608020 - DNA, 19 bp, Homo sapiens
ctgtctgaaggacacttcc

SEQ ID NO: 5608021 - DNA, 20 bp, Homo sapiens
ctgtctgaatattctagaac

SEQ ID NO: 5608022 - DNA, 17 bp, Homo sapiens
ctgtctgagacaggtgc

SEQ ID NO: 5608023 - DNA, 18 bp, Homo sapiens
ctgtctgagacaggtgcc

SEQ ID NO: 5608024 - DNA, 22 bp, Homo sapiens
ctgtctgagactcacaggaagg

SEQ ID NO: 5608025 - DNA, 12 bp, Homo sapiens
ctgtctgagccc

SEQ ID NO: 5608026 - DNA, 17 bp, Homo sapiens
ctgtctgagccctgccc

SEQ ID NO: 5608027 - DNA, 20 bp, Homo sapiens
ctgtctgagccctgccctca

SEQ ID NO: 5608028 - DNA, 21 bp, Homo sapiens
ctgtctgaggagtaagtgtac

SEQ ID NO: 5608029 - DNA, 20 bp, Homo sapiens
ctgtctgagtagtggccact

SEQ ID NO: 5608030 - DNA, 22 bp, Homo sapiens
ctgtctgagtagtggccactgg

SEQ ID NO: 5608031 - DNA, 16 bp, Homo sapiens
ctgtctgatctgtgct

SEQ ID NO: 5608032 - DNA, 13 bp, Homo sapiens
ctgtctgattcta

SEQ ID NO: 5608033 - DNA, 14 bp, Homo sapiens
ctgtctgattctat

SEQ ID NO: 5608034 - DNA, 14 bp, Homo sapiens
ctgtctgcacagag

SEQ ID NO: 5608035 - DNA, 14 bp, Homo sapiens
ctgtgaggcttgcc

SEQ ID NO: 5608036 - DNA, 17 bp, Homo sapiens
ctgtgaggcttgcccag

SEQ ID NO: 5608037 - DNA, 19 bp, Homo sapiens
ctgtgaggcttgcccagga

SEQ ID NO: 5608038 - DNA, 22 bp, Homo sapiens
ctgtgaggcttgcccaggagca

SEQ ID NO: 5608039 - DNA, 14 bp, Homo sapiens
ctgtgagggagggg

SEQ ID NO: 5608040 - DNA, 23 bp, Homo sapiens
ctgtgagggccaccggtgggcag

SEQ ID NO: 5608041 - DNA, 22 bp, Homo sapiens
ctgtgagggcgagcggcaaagg

SEQ ID NO: 5608042 - DNA, 15 bp, Homo sapiens
ctgtgaggggcccct

SEQ ID NO: 5608043 - DNA, 20 bp, Homo sapiens
ctgtgaggggcccctggccc

SEQ ID NO: 5608044 - DNA, 23 bp, Homo sapiens
ctgtgaggtgcagagtgcccaga

SEQ ID NO: 5608045 - DNA, 16 bp, Homo sapiens
ctgtgaggtttcccaa

SEQ ID NO: 5608046 - DNA, 23 bp, Homo sapiens
ctgtgagtactacagtcctccca

SEQ ID NO: 5608047 - DNA, 20 bp, Homo sapiens
ctgtgagtctccccttgcag

SEQ ID NO: 5608048 - DNA, 20 bp, Homo sapiens
ctgtgagtctgtcctttccc

SEQ ID NO: 5608049 - DNA, 21 bp, Homo sapiens
ctgtgagtgaaagttgccatt

SEQ ID NO: 5608050 - DNA, 18 bp, Homo sapiens
ctgtgagtgcgcctcacc

SEQ ID NO: 5608051 - DNA, 20 bp, Homo sapiens
ctgtgagtgtaagtgtgagt

SEQ ID NO: 5608052 - DNA, 17 bp, Homo sapiens
ctgtgagttctccctgt

SEQ ID NO: 5608053 - DNA, 17 bp, Homo sapiens
ctgtgataactctgcaa

SEQ ID NO: 5608054 - DNA, 18 bp, Homo sapiens
ctgtgataactctgcaaa

SEQ ID NO: 5608055 - DNA, 21 bp, Homo sapiens
ctgtgatacagaactcttaaa

SEQ ID NO: 5608056 - DNA, 20 bp, Homo sapiens
ctgtgatatggcggcctgca

SEQ ID NO: 5608057 - DNA, 14 bp, Homo sapiens
ctgtgatcaagcaa

SEQ ID NO: 5608058 - DNA, 19 bp, Homo sapiens
ctgtgatcatttattttaa

SEQ ID NO: 5608059 - DNA, 20 bp, Homo sapiens
ctgtgatccttggtgctgtg

SEQ ID NO: 5608060 - DNA, 19 bp, Homo sapiens
ctgtgatcgtgtgttgcca

SEQ ID NO: 5608061 - DNA, 13 bp, Homo sapiens
ctgtgatctaagc

SEQ ID NO: 5608062 - DNA, 18 bp, Homo sapiens
ctgtgatctaagcagttg

SEQ ID NO: 5608063 - DNA, 21 bp, Homo sapiens
ctgtgatctaagcagttgcaa

SEQ ID NO: 5608064 - DNA, 14 bp, Homo sapiens
ctgtgatctgtgta

SEQ ID NO: 5608065 - DNA, 17 bp, Homo sapiens
ctgtgatcttaaaataa

SEQ ID NO: 5608066 - DNA, 15 bp, Homo sapiens
ctgtgatcttatttt

SEQ ID NO: 5608067 - DNA, 14 bp, Homo sapiens
ctgtgatgagctga

SEQ ID NO: 5608068 - DNA, 21 bp, Homo sapiens
ctgtgatgcatgagctccctc

SEQ ID NO: 5608069 - DNA, 14 bp, Homo sapiens
ctgtgatgccacac

SEQ ID NO: 5608070 - DNA, 17 bp, Homo sapiens
ctgtgatgccacacaga

SEQ ID NO: 5608071 - DNA, 16 bp, Homo sapiens
ctgtgatgccgtcctg

SEQ ID NO: 5608072 - DNA, 15 bp, Homo sapiens
ctgtgatgctcccaa

SEQ ID NO: 5608073 - DNA, 14 bp, Homo sapiens
ctgtgatgctgggc

SEQ ID NO: 5608074 - DNA, 19 bp, Homo sapiens
ctgtgatgctgtgtgccca

SEQ ID NO: 5608075 - DNA, 22 bp, Homo sapiens
ctgtgatggatggacacaaaaa

SEQ ID NO: 5608076 - DNA, 13 bp, Homo sapiens
ctgtgatggccag

SEQ ID NO: 5608077 - DNA, 19 bp, Homo sapiens
ctgtgatggccaggccagg

SEQ ID NO: 5608078 - DNA, 17 bp, Homo sapiens
ctgtgatggggccctgc

SEQ ID NO: 5608079 - DNA, 20 bp, Homo sapiens
ctgtgatggggccctgcctc

SEQ ID NO: 5608080 - DNA, 23 bp, Homo sapiens
ctgtgatggggccctgcctcctt

SEQ ID NO: 5608081 - DNA, 22 bp, Homo sapiens
ctgtgatgtcatgaaagcacct

SEQ ID NO: 5608082 - DNA, 21 bp, Homo sapiens
ctgtgatgttgggaagctatt

SEQ ID NO: 5608083 - DNA, 16 bp, Homo sapiens
ctgtgattacatagat

SEQ ID NO: 5608084 - DNA, 21 bp, Homo sapiens
ctgtgattacatagatcagcc

SEQ ID NO: 5608085 - DNA, 23 bp, Homo sapiens
ctgtgattacatagatcagccat

SEQ ID NO: 5608086 - DNA, 16 bp, Homo sapiens
ctgtgattactgcaat

SEQ ID NO: 5608087 - DNA, 17 bp, Homo sapiens
ctgtgattactgcaatc

SEQ ID NO: 5608088 - DNA, 22 bp, Homo sapiens
ctgtgattaggtgaagggatgg

SEQ ID NO: 5608089 - DNA, 19 bp, Homo sapiens
ctgtgattatgccattgca

SEQ ID NO: 5608090 - DNA, 21 bp, Homo sapiens
ctgtgattatgccattgcact

SEQ ID NO: 5608091 - DNA, 16 bp, Homo sapiens
ctgtgattcagaaaat

SEQ ID NO: 5608092 - DNA, 22 bp, Homo sapiens
ctgtgattccactacacctggc

SEQ ID NO: 5608093 - DNA, 19 bp, Homo sapiens
ctgtgattgccatttcttc

SEQ ID NO: 5608094 - DNA, 20 bp, Homo sapiens
ctgtgattgccatttcttcc

SEQ ID NO: 5608095 - DNA, 15 bp, Homo sapiens
ctgtgattggctggt

SEQ ID NO: 5608096 - DNA, 22 bp, Homo sapiens
ctgtgattgggtgggatttttt

SEQ ID NO: 5608097 - DNA, 16 bp, Homo sapiens
ctgtgattgtgcctac

SEQ ID NO: 5608098 - DNA, 17 bp, Homo sapiens
ctgtgatttatttggag

SEQ ID NO: 5608099 - DNA, 14 bp, Homo sapiens
ctgtgatttctgtg

SEQ ID NO: 5608100 - DNA, 16 bp, Homo sapiens
ctgtgatttctgtgcc

SEQ ID NO: 5608101 - DNA, 23 bp, Homo sapiens
ctgtgatttctgtgccattttct

SEQ ID NO: 5608102 - DNA, 15 bp, Homo sapiens
ctgtgattttgccct

SEQ ID NO: 5608103 - DNA, 18 bp, Homo sapiens
ctgtgattttgccctcct

SEQ ID NO: 5608104 - DNA, 15 bp, Homo sapiens
ctgtgatttttatca

SEQ ID NO: 5608105 - DNA, 17 bp, Homo sapiens
ctgtgatttttatcaca

SEQ ID NO: 5608106 - DNA, 22 bp, Homo sapiens
ctgtgatttttggtatttgaaa

SEQ ID NO: 5608107 - DNA, 21 bp, Homo sapiens
ctgtgcaaagcagagtgaaat

SEQ ID NO: 5608108 - DNA, 16 bp, Homo sapiens
ctgtgcaaagggctgc

SEQ ID NO: 5608109 - DNA, 19 bp, Homo sapiens
ctgtgcaaagggctgcctt

SEQ ID NO: 5608110 - DNA, 20 bp, Homo sapiens
ctgtgcaaagggctgccttg

SEQ ID NO: 5608111 - DNA, 16 bp, Homo sapiens
ctgtgcaaatccttga

SEQ ID NO: 5608112 - DNA, 21 bp, Homo sapiens
ctgtgcaacctcttggcctga

SEQ ID NO: 5608113 - DNA, 17 bp, Homo sapiens
ctgtgcaacgccgtggg

SEQ ID NO: 5608114 - DNA, 18 bp, Homo sapiens
ctgtgcaacggtctcctg

SEQ ID NO: 5608115 - DNA, 22 bp, Homo sapiens
ctgtgcaacggtctcctgactg

SEQ ID NO: 5608116 - DNA, 16 bp, Homo sapiens
ctgtgcaactttttaa

SEQ ID NO: 5608117 - DNA, 20 bp, Homo sapiens
ctgtgcaatggaatataaat

SEQ ID NO: 5608118 - DNA, 19 bp, Homo sapiens
ctgtgcaattactgcctgc

SEQ ID NO: 5608119 - DNA, 20 bp, Homo sapiens
ctgtgcaattactgcctgca

SEQ ID NO: 5608120 - DNA, 19 bp, Homo sapiens
ctgtgcacaaaacccagac

SEQ ID NO: 5608121 - DNA, 15 bp, Homo sapiens
ctgtgcacacccacc

SEQ ID NO: 5608122 - DNA, 21 bp, Homo sapiens
ctgtgcacaccccactcccac

SEQ ID NO: 5608123 - DNA, 13 bp, Homo sapiens
ctgtgcacagccc

SEQ ID NO: 5608124 - DNA, 14 bp, Homo sapiens
ctgtgcacagtggc

SEQ ID NO: 5608125 - DNA, 18 bp, Homo sapiens
ctgtgcacagtggcttct

SEQ ID NO: 5608126 - DNA, 18 bp, Homo sapiens
ctgtgcacatctgtgtct

SEQ ID NO: 5608127 - DNA, 19 bp, Homo sapiens
ctgtgcacatctgtgtctt

SEQ ID NO: 5608128 - DNA, 20 bp, Homo sapiens
ctgtgcacatctgtgtcttg

SEQ ID NO: 5608129 - DNA, 20 bp, Homo sapiens
ctgtgcacccgtgccacgcg

SEQ ID NO: 5608130 - DNA, 13 bp, Homo sapiens
ctgtgcacctacc

SEQ ID NO: 5608131 - DNA, 23 bp, Homo sapiens
ctgtgcacctaccccttggaaat

SEQ ID NO: 5608132 - DNA, 12 bp, Homo sapiens
ctgtgcacgcag

SEQ ID NO: 5608133 - DNA, 17 bp, Homo sapiens
ctgtgcacgcagtggcc

SEQ ID NO: 5608134 - DNA, 20 bp, Homo sapiens
ctgtgcactagcctgtgatt

SEQ ID NO: 5608135 - DNA, 14 bp, Homo sapiens
ctgtgcactctact

SEQ ID NO: 5608136 - DNA, 13 bp, Homo sapiens
ctgtgcactgccc

SEQ ID NO: 5608137 - DNA, 19 bp, Homo sapiens
ctgtgcactgccctgttca

SEQ ID NO: 5608138 - DNA, 14 bp, Homo sapiens
ctgtgcactgggca

SEQ ID NO: 5608139 - DNA, 14 bp, Homo sapiens
ctgtgcacttagcc

SEQ ID NO: 5608140 - DNA, 22 bp, Homo sapiens
ctgtgcacttagccatgatggc

SEQ ID NO: 5608141 - DNA, 13 bp, Homo sapiens
ctgtgcagaaggt

SEQ ID NO: 5608142 - DNA, 15 bp, Homo sapiens
ctgtgcagaataatg

SEQ ID NO: 5608143 - DNA, 21 bp, Homo sapiens
ctgtgcagaataatggaaaca

SEQ ID NO: 5608144 - DNA, 15 bp, Homo sapiens
ctgtgcagacagtgt

SEQ ID NO: 5608145 - DNA, 17 bp, Homo sapiens
ctgtgcagataaacaga

SEQ ID NO: 5608146 - DNA, 17 bp, Homo sapiens
ctgtgcagatgagcagt

SEQ ID NO: 5608147 - DNA, 23 bp, Homo sapiens
ctgtgcagatgagcagtcacact

SEQ ID NO: 5608148 - DNA, 19 bp, Homo sapiens
ctgtgcagatgctgctgaa

SEQ ID NO: 5608149 - DNA, 18 bp, Homo sapiens
ctgtgcagatgctttgcc

SEQ ID NO: 5608150 - DNA, 20 bp, Homo sapiens
ctgtgcagatgctttgccca

SEQ ID NO: 5608151 - DNA, 23 bp, Homo sapiens
ctgtgcagatgctttgcccaggc

SEQ ID NO: 5608152 - DNA, 13 bp, Homo sapiens
ctgtgcagcaccc

SEQ ID NO: 5608153 - DNA, 21 bp, Homo sapiens
ctgtgcagcacgtctcagaga

SEQ ID NO: 5608154 - DNA, 14 bp, Homo sapiens
ctgtgcagcagccc

SEQ ID NO: 5608155 - DNA, 18 bp, Homo sapiens
ctgtgcagcagcccagct

SEQ ID NO: 5608156 - DNA, 20 bp, Homo sapiens
ctgtgcagcagcccagcttc

SEQ ID NO: 5608157 - DNA, 24 bp, Homo sapiens
ctgtgcagcagcccagcttcctgg

SEQ ID NO: 5608158 - DNA, 22 bp, Homo sapiens
ctgtgcagccccgcctccaggc

SEQ ID NO: 5608159 - DNA, 16 bp, Homo sapiens
ctgtgcagccgctgag

SEQ ID NO: 5608160 - DNA, 17 bp, Homo sapiens
ctgtgcagccgctgagc

SEQ ID NO: 5608161 - DNA, 21 bp, Homo sapiens
ctgtgcagccgctgagcgagg

SEQ ID NO: 5608162 - DNA, 19 bp, Homo sapiens
ctgtgcagccggggagctg

SEQ ID NO: 5608163 - DNA, 21 bp, Homo sapiens
ctgtgcagccggggagctgag

SEQ ID NO: 5608164 - DNA, 15 bp, Homo sapiens
ctgtgcagcgcagct

SEQ ID NO: 5608165 - DNA, 13 bp, Homo sapiens
ctgtgcagctctc

SEQ ID NO: 5608166 - DNA, 15 bp, Homo sapiens
ctgtgcaggatattt

SEQ ID NO: 5608167 - DNA, 13 bp, Homo sapiens
ctgtgcaggccca

SEQ ID NO: 5608168 - DNA, 23 bp, Homo sapiens
ctgtgcaggcccaggcaggccca

SEQ ID NO: 5608169 - DNA, 16 bp, Homo sapiens
ctgtgcaggctgcagt

SEQ ID NO: 5608170 - DNA, 20 bp, Homo sapiens
ctgtgcaggctgcagtggct

SEQ ID NO: 5608171 - DNA, 21 bp, Homo sapiens
ctgtgcaggctgcagtggctc

SEQ ID NO: 5608172 - DNA, 19 bp, Homo sapiens
ctgtgcagggaaagggatg

SEQ ID NO: 5608173 - DNA, 13 bp, Homo sapiens
ctgtgcagggcac

SEQ ID NO: 5608174 - DNA, 15 bp, Homo sapiens
ctgtgcagggctggt

SEQ ID NO: 5608175 - DNA, 19 bp, Homo sapiens
ctgtgcaggtgctgccttg

SEQ ID NO: 5608176 - DNA, 17 bp, Homo sapiens
ctgtgcagtagagagcc

SEQ ID NO: 5608177 - DNA, 18 bp, Homo sapiens
ctgtgcagtcctgggtcc

SEQ ID NO: 5608178 - DNA, 23 bp, Homo sapiens
ctgtgcagtggagcagaaggcag

SEQ ID NO: 5608179 - DNA, 15 bp, Homo sapiens
ctgtgcataaaagtt

SEQ ID NO: 5608180 - DNA, 18 bp, Homo sapiens
ctgtgcatagtgctggga

SEQ ID NO: 5608181 - DNA, 22 bp, Homo sapiens
ctgtgcatccgcctgaaagtgt

SEQ ID NO: 5608182 - DNA, 21 bp, Homo sapiens
ctgtgcatctagcctcaagct

SEQ ID NO: 5608183 - DNA, 16 bp, Homo sapiens
ctgtgcatctggcctg

SEQ ID NO: 5608184 - DNA, 14 bp, Homo sapiens
ctgtgcatgggtga

SEQ ID NO: 5608185 - DNA, 17 bp, Homo sapiens
ctgtgcatgggtgaagg

SEQ ID NO: 5608186 - DNA, 20 bp, Homo sapiens
ctgtgcatgggtgaagggag

SEQ ID NO: 5608187 - DNA, 22 bp, Homo sapiens
ctgtgcatgggtgaagggagag

SEQ ID NO: 5608188 - DNA, 16 bp, Homo sapiens
ctgtgcatgtatgtct

SEQ ID NO: 5608189 - DNA, 15 bp, Homo sapiens
ctgtgcattgtggct

SEQ ID NO: 5608190 - DNA, 16 bp, Homo sapiens
ctgtgcattgtggctg

SEQ ID NO: 5608191 - DNA, 16 bp, Homo sapiens
ctgtgccaacctgatg

SEQ ID NO: 5608192 - DNA, 21 bp, Homo sapiens
ctgtgccaactactactggtg

SEQ ID NO: 5608193 - DNA, 23 bp, Homo sapiens
ctgtgccacacttcgctcttgag

SEQ ID NO: 5608194 - DNA, 13 bp, Homo sapiens
ctgtgccacaggc

SEQ ID NO: 5608195 - DNA, 16 bp, Homo sapiens
ctgtgccaccacccct

SEQ ID NO: 5608196 - DNA, 18 bp, Homo sapiens
ctgtgccaccacccctcc

SEQ ID NO: 5608197 - DNA, 11 bp, Homo sapiens
ctgtgccaccc

SEQ ID NO: 5608198 - DNA, 18 bp, Homo sapiens
ctgtgccacccaccaggg

SEQ ID NO: 5608199 - DNA, 24 bp, Homo sapiens
ctgtgccaccccttcctcagcctg

SEQ ID NO: 5608200 - DNA, 18 bp, Homo sapiens
ctgtgccaccctgggctc

SEQ ID NO: 5608201 - DNA, 20 bp, Homo sapiens
ctgtgccaccctgggctctg

SEQ ID NO: 5608202 - DNA, 23 bp, Homo sapiens
ctgtgccaccctgggctctgtgg

SEQ ID NO: 5608203 - DNA, 14 bp, Homo sapiens
ctgtgccacctgca

SEQ ID NO: 5608204 - DNA, 14 bp, Homo sapiens
ctgtgccactgact

SEQ ID NO: 5608205 - DNA, 19 bp, Homo sapiens
ctgtgccactttgactcag

SEQ ID NO: 5608206 - DNA, 23 bp, Homo sapiens
ctgtgccactttgactcagaggc

SEQ ID NO: 5608207 - DNA, 22 bp, Homo sapiens
ctgtgccagaaacagtgggagc

SEQ ID NO: 5608208 - DNA, 21 bp, Homo sapiens
ctgtgccagagcctggggctc

SEQ ID NO: 5608209 - DNA, 14 bp, Homo sapiens
ctgtgccagctcag

SEQ ID NO: 5608210 - DNA, 18 bp, Homo sapiens
ctgtggccccctgtcccc

SEQ ID NO: 5608211 - DNA, 12 bp, Homo sapiens
ctgtggcccctc

SEQ ID NO: 5608212 - DNA, 13 bp, Homo sapiens
ctgtggcccctcc

SEQ ID NO: 5608213 - DNA, 14 bp, Homo sapiens
ctgtggcccctcct

SEQ ID NO: 5608214 - DNA, 16 bp, Homo sapiens
ctgtggcccctccttc

SEQ ID NO: 5608215 - DNA, 13 bp, Homo sapiens
ctgtggccctctc

SEQ ID NO: 5608216 - DNA, 15 bp, Homo sapiens
ctgtggccctgccct

SEQ ID NO: 5608217 - DNA, 16 bp, Homo sapiens
ctgtggccctggccac

SEQ ID NO: 5608218 - DNA, 17 bp, Homo sapiens
ctgtggcccttctgtcc

SEQ ID NO: 5608219 - DNA, 17 bp, Homo sapiens
ctgtggccgactctgca

SEQ ID NO: 5608220 - DNA, 15 bp, Homo sapiens
ctgtggccgcacgcc

SEQ ID NO: 5608221 - DNA, 22 bp, Homo sapiens
ctgtggccgcacgcctctccct

SEQ ID NO: 5608222 - DNA, 21 bp, Homo sapiens
ctgtggccgccatctgcgcag

SEQ ID NO: 5608223 - DNA, 15 bp, Homo sapiens
ctgtggccggtgcca

SEQ ID NO: 5608224 - DNA, 16 bp, Homo sapiens
ctgtggccggtgccag

SEQ ID NO: 5608225 - DNA, 20 bp, Homo sapiens
ctgtggccggtgccagctgc

SEQ ID NO: 5608226 - DNA, 17 bp, Homo sapiens
ctgtggccgtctcctcc

SEQ ID NO: 5608227 - DNA, 20 bp, Homo sapiens
ctgtggccgtctcctccctc

SEQ ID NO: 5608228 - DNA, 14 bp, Homo sapiens
ctgtggcctcaccc

SEQ ID NO: 5608229 - DNA, 20 bp, Homo sapiens
ctgtggcctcacttccctgg

SEQ ID NO: 5608230 - DNA, 15 bp, Homo sapiens
ctgtggcctcagcat

SEQ ID NO: 5608231 - DNA, 17 bp, Homo sapiens
ctgtggcctcagcatct

SEQ ID NO: 5608232 - DNA, 19 bp, Homo sapiens
ctgtggcctcagcatctca

SEQ ID NO: 5608233 - DNA, 19 bp, Homo sapiens
ctgtggcctcaggaggcag

SEQ ID NO: 5608234 - DNA, 18 bp, Homo sapiens
ctgtggcctctcagtcaa

SEQ ID NO: 5608235 - DNA, 14 bp, Homo sapiens
ctgtggcctgcagg

SEQ ID NO: 5608236 - DNA, 13 bp, Homo sapiens
ctgtggcctgggc

SEQ ID NO: 5608237 - DNA, 14 bp, Homo sapiens
ctgtggcctgggca

SEQ ID NO: 5608238 - DNA, 16 bp, Homo sapiens
ctgtggcctgggcaag

SEQ ID NO: 5608239 - DNA, 20 bp, Homo sapiens
ctgtggcctgtgtccagcag

SEQ ID NO: 5608240 - DNA, 21 bp, Homo sapiens
ctgtggcctgtgtccagcagc

SEQ ID NO: 5608241 - DNA, 15 bp, Homo sapiens
ctgtggccttctcag

SEQ ID NO: 5608242 - DNA, 22 bp, Homo sapiens
ctgtggccttggccctgacccc

SEQ ID NO: 5608243 - DNA, 22 bp, Homo sapiens
ctgtggcgactctgcagagtca

SEQ ID NO: 5608244 - DNA, 21 bp, Homo sapiens
ctgtggcgatatgagagggat

SEQ ID NO: 5608245 - DNA, 17 bp, Homo sapiens
ctgtggcgccgtctcca

SEQ ID NO: 5608246 - DNA, 20 bp, Homo sapiens
ctgtggcgccgtctccaggg

SEQ ID NO: 5608247 - DNA, 21 bp, Homo sapiens
ctgtggcgccgtctccagggg

SEQ ID NO: 5608248 - DNA, 21 bp, Homo sapiens
ctgtggcgggtaggcaggaag

SEQ ID NO: 5608249 - DNA, 18 bp, Homo sapiens
ctgtggcggtgcagtggc

SEQ ID NO: 5608250 - DNA, 19 bp, Homo sapiens
ctgtggcgttctgctgccc

SEQ ID NO: 5608251 - DNA, 15 bp, Homo sapiens
ctgtggctagtgaca

SEQ ID NO: 5608252 - DNA, 23 bp, Homo sapiens
ctgtggctcacagtggggccagc

SEQ ID NO: 5608253 - DNA, 12 bp, Homo sapiens
ctgtggctccag

SEQ ID NO: 5608254 - DNA, 14 bp, Homo sapiens
ctgtggctcctgcc

SEQ ID NO: 5608255 - DNA, 18 bp, Homo sapiens
ctgtggctcctgccttga

SEQ ID NO: 5608256 - DNA, 14 bp, Homo sapiens
ctgtggctctgggt

SEQ ID NO: 5608257 - DNA, 16 bp, Homo sapiens
ctgtggctctgggtgg

SEQ ID NO: 5608258 - DNA, 24 bp, Homo sapiens
ctgtggctgcagagaccttgcgac

SEQ ID NO: 5608259 - DNA, 21 bp, Homo sapiens
ctgtggctggaggagctggcc

SEQ ID NO: 5608260 - DNA, 24 bp, Homo sapiens
ctgtggctggaggagctggcctgt

SEQ ID NO: 5608261 - DNA, 11 bp, Homo sapiens
ctgtggctggg

SEQ ID NO: 5608262 - DNA, 18 bp, Homo sapiens
ctgtggctgggtggtcag

SEQ ID NO: 5608263 - DNA, 20 bp, Homo sapiens
ctgtggctgggtggtcagca

SEQ ID NO: 5608264 - DNA, 15 bp, Homo sapiens
ctgtggctgtctgga

SEQ ID NO: 5608265 - DNA, 21 bp, Homo sapiens
ctgtggctgtgtgtctgcttg

SEQ ID NO: 5608266 - DNA, 22 bp, Homo sapiens
ctgtggcttcttaatcttttca

SEQ ID NO: 5608267 - DNA, 19 bp, Homo sapiens
ctgtggctttcagcctctg

SEQ ID NO: 5608268 - DNA, 18 bp, Homo sapiens
ctgtggctttttgttcag

SEQ ID NO: 5608269 - DNA, 16 bp, Homo sapiens
ctgtgggaaaaaagaa

SEQ ID NO: 5608270 - DNA, 18 bp, Homo sapiens
ctgtgggaaaaaagaaaa

SEQ ID NO: 5608271 - DNA, 13 bp, Homo sapiens
ctgtgggaaaaat

SEQ ID NO: 5608272 - DNA, 11 bp, Homo sapiens
ctgtgggaaat

SEQ ID NO: 5608273 - DNA, 19 bp, Homo sapiens
ctgtgggaaatcccagggc

SEQ ID NO: 5608274 - DNA, 12 bp, Homo sapiens
ctgtgggaagat

SEQ ID NO: 5608275 - DNA, 16 bp, Homo sapiens
ctgtgggaaggccagc

SEQ ID NO: 5608276 - DNA, 15 bp, Homo sapiens
ctgtgggaccccagg

SEQ ID NO: 5608277 - DNA, 21 bp, Homo sapiens
ctgtgggaccgcctggccctc

SEQ ID NO: 5608278 - DNA, 17 bp, Homo sapiens
ctgtgggacctgggcca

SEQ ID NO: 5608279 - DNA, 18 bp, Homo sapiens
ctgtgggactcatccttg

SEQ ID NO: 5608280 - DNA, 22 bp, Homo sapiens
ctgtgggagaagggacagcggg

SEQ ID NO: 5608281 - DNA, 17 bp, Homo sapiens
ctgtgggagagcaactg

SEQ ID NO: 5608282 - DNA, 17 bp, Homo sapiens
ctgtgggagccgcagag

SEQ ID NO: 5608283 - DNA, 20 bp, Homo sapiens
ctgtgggagccgcagagcct

SEQ ID NO: 5608284 - DNA, 16 bp, Homo sapiens
ctgtgggagcctcgca

SEQ ID NO: 5608285 - DNA, 14 bp, Homo sapiens
ctgtgggagctcag

SEQ ID NO: 5608286 - DNA, 15 bp, Homo sapiens
ctgtgggagctcagc

SEQ ID NO: 5608287 - DNA, 22 bp, Homo sapiens
ctgtgggatccctctgggcact

SEQ ID NO: 5608288 - DNA, 14 bp, Homo sapiens
ctgtgggatgggat

SEQ ID NO: 5608289 - DNA, 15 bp, Homo sapiens
ctgtgggatgtgcca

SEQ ID NO: 5608290 - DNA, 16 bp, Homo sapiens
ctgtgggatgtgccag

SEQ ID NO: 5608291 - DNA, 16 bp, Homo sapiens
ctgtgggattctgatt

SEQ ID NO: 5608292 - DNA, 13 bp, Homo sapiens
ctgtgggcaaagt

SEQ ID NO: 5608293 - DNA, 14 bp, Homo sapiens
ctgtgggcaaagtc

SEQ ID NO: 5608294 - DNA, 14 bp, Homo sapiens
ctgtgggcagcatg

SEQ ID NO: 5608295 - DNA, 18 bp, Homo sapiens
ctgtgggcagctggctct

SEQ ID NO: 5608296 - DNA, 20 bp, Homo sapiens
ctgtgggcagctggctctga

SEQ ID NO: 5608297 - DNA, 15 bp, Homo sapiens
ctgtgggcatggccg

SEQ ID NO: 5608298 - DNA, 19 bp, Homo sapiens
ctgtgggcatggccgcttc

SEQ ID NO: 5608299 - DNA, 13 bp, Homo sapiens
ctgtgggccagcc

SEQ ID NO: 5608300 - DNA, 14 bp, Homo sapiens
ctgtgggccaggag

SEQ ID NO: 5608301 - DNA, 19 bp, Homo sapiens
ctgtgggcccctcaacagc

SEQ ID NO: 5608302 - DNA, 24 bp, Homo sapiens
ctgtgggcccctcaacagccaagt

SEQ ID NO: 5608303 - DNA, 15 bp, Homo sapiens
ctgtgggccctaccc

SEQ ID NO: 5608304 - DNA, 22 bp, Homo sapiens
ctgtgggccctaccctcctgct

SEQ ID NO: 5608305 - DNA, 19 bp, Homo sapiens
ctgtgggcggctcctggtg

SEQ ID NO: 5608306 - DNA, 16 bp, Homo sapiens
ctgtgggcgggcccag

SEQ ID NO: 5608307 - DNA, 17 bp, Homo sapiens
ctgtgggcgggcccagc

SEQ ID NO: 5608308 - DNA, 18 bp, Homo sapiens
ctgtgggcgggcccagca

SEQ ID NO: 5608309 - DNA, 23 bp, Homo sapiens
ctgtgggcgtgagacctgcccct

SEQ ID NO: 5608310 - DNA, 12 bp, Homo sapiens
ctgtgggctcac

SEQ ID NO: 5608311 - DNA, 15 bp, Homo sapiens
ctgtgggctcacacc

SEQ ID NO: 5608312 - DNA, 14 bp, Homo sapiens
ctgtgggctccctt

SEQ ID NO: 5608313 - DNA, 15 bp, Homo sapiens
ctgtgggctgcactc

SEQ ID NO: 5608314 - DNA, 21 bp, Homo sapiens
ctgtgggctgcactctgtgcc

SEQ ID NO: 5608315 - DNA, 22 bp, Homo sapiens
ctgtgggctgcactctgtgccc

SEQ ID NO: 5608316 - DNA, 15 bp, Homo sapiens
ctgtgggctggcagt

SEQ ID NO: 5608317 - DNA, 16 bp, Homo sapiens
ctgtgggcttggcctt

SEQ ID NO: 5608318 - DNA, 21 bp, Homo sapiens
ctgtggggaaccaattgcttt

SEQ ID NO: 5608319 - DNA, 13 bp, Homo sapiens
ctgtggggagccg

SEQ ID NO: 5608320 - DNA, 13 bp, Homo sapiens
ctgtggggagctg

SEQ ID NO: 5608321 - DNA, 15 bp, Homo sapiens
ctgtggggagctggt

SEQ ID NO: 5608322 - DNA, 16 bp, Homo sapiens
ctgtggggagctggtg

SEQ ID NO: 5608323 - DNA, 17 bp, Homo sapiens
ctgtggggagctggtgg

SEQ ID NO: 5608324 - DNA, 17 bp, Homo sapiens
ctgtggggatttctccc

SEQ ID NO: 5608325 - DNA, 19 bp, Homo sapiens
ctgtggggatttctcccag

SEQ ID NO: 5608326 - DNA, 20 bp, Homo sapiens
ctgtggggatttctcccagc

SEQ ID NO: 5608327 - DNA, 14 bp, Homo sapiens
ctgtggggcaagcc

SEQ ID NO: 5608328 - DNA, 17 bp, Homo sapiens
ctgtggggcaagcctga

SEQ ID NO: 5608329 - DNA, 14 bp, Homo sapiens
ctgtggggcaggag

SEQ ID NO: 5608330 - DNA, 13 bp, Homo sapiens
ctgtggggccaca

SEQ ID NO: 5608331 - DNA, 14 bp, Homo sapiens
ctgtggggccacac

SEQ ID NO: 5608332 - DNA, 15 bp, Homo sapiens
ctgtggggccccaga

SEQ ID NO: 5608333 - DNA, 13 bp, Homo sapiens
ctgtggggcctga

SEQ ID NO: 5608334 - DNA, 13 bp, Homo sapiens
ctgtggggctggg

SEQ ID NO: 5608335 - DNA, 14 bp, Homo sapiens
ctgtggggctgggc

SEQ ID NO: 5608336 - DNA, 17 bp, Homo sapiens
ctgtggggctgggcacc

SEQ ID NO: 5608337 - DNA, 21 bp, Homo sapiens
ctgtggggctggtagctcagg

SEQ ID NO: 5608338 - DNA, 19 bp, Homo sapiens
ctgtgggggaagagcacag

SEQ ID NO: 5608339 - DNA, 22 bp, Homo sapiens
ctgtgggggaagagcacagccc

SEQ ID NO: 5608340 - DNA, 17 bp, Homo sapiens
ctgtgggggaggtccct

SEQ ID NO: 5608341 - DNA, 21 bp, Homo sapiens
ctgtgggggaggtccctgcca

SEQ ID NO: 5608342 - DNA, 23 bp, Homo sapiens
ctgtgggggaggtccctgccagt

SEQ ID NO: 5608343 - DNA, 19 bp, Homo sapiens
ctgtgggggcccctcaggt

SEQ ID NO: 5608344 - DNA, 19 bp, Homo sapiens
ctgtgggggcggctgtggg

SEQ ID NO: 5608345 - DNA, 21 bp, Homo sapiens
ctgtggggggtaatccctgct

SEQ ID NO: 5608346 - DNA, 23 bp, Homo sapiens
ctgtgggggtgagggtcccatgt

SEQ ID NO: 5608347 - DNA, 19 bp, Homo sapiens
ctgtgggggtgtgccccct

SEQ ID NO: 5608348 - DNA, 17 bp, Homo sapiens
ctgtggggtctggctgt

SEQ ID NO: 5608349 - DNA, 15 bp, Homo sapiens
ctgtggggtggacct

SEQ ID NO: 5608350 - DNA, 18 bp, Homo sapiens
ctgtggggtgggctggag

SEQ ID NO: 5608351 - DNA, 18 bp, Homo sapiens
ctgtgggtatcaggactg

SEQ ID NO: 5608352 - DNA, 20 bp, Homo sapiens
ctgtgggtattcaccaccct

SEQ ID NO: 5608353 - DNA, 17 bp, Homo sapiens
ctgtgggtccctgcgtc

SEQ ID NO: 5608354 - DNA, 16 bp, Homo sapiens
ctgtgggtctctgaag

SEQ ID NO: 5608355 - DNA, 19 bp, Homo sapiens
ctgtgggtctgactttctc

SEQ ID NO: 5608356 - DNA, 16 bp, Homo sapiens
ctgtgggtctgggagt

SEQ ID NO: 5608357 - DNA, 21 bp, Homo sapiens
ctgtgggtggggaaggaaggc

SEQ ID NO: 5608358 - DNA, 14 bp, Homo sapiens
ctgtgggtggggct

SEQ ID NO: 5608359 - DNA, 15 bp, Homo sapiens
ctgtgggtggggctt

SEQ ID NO: 5608360 - DNA, 17 bp, Homo sapiens
ctgtgggtggggcttct

SEQ ID NO: 5608361 - DNA, 20 bp, Homo sapiens
ctgtgggtggggcttctctg

SEQ ID NO: 5608362 - DNA, 23 bp, Homo sapiens
ctgtgggtggtgatttggtcagc

SEQ ID NO: 5608363 - DNA, 19 bp, Homo sapiens
ctgtgggtgtctccctcgg

SEQ ID NO: 5608364 - DNA, 20 bp, Homo sapiens
ctgtgggtgtgggtgggagt

SEQ ID NO: 5608365 - DNA, 22 bp, Homo sapiens
ctgtgggtgttctttcctgccc

SEQ ID NO: 5608366 - DNA, 21 bp, Homo sapiens
ctgtgggttttaacattttta

SEQ ID NO: 5608367 - DNA, 16 bp, Homo sapiens
ctgtggtaagagatat

SEQ ID NO: 5608368 - DNA, 19 bp, Homo sapiens
ctgtggtacaaatgtgata

SEQ ID NO: 5608369 - DNA, 12 bp, Homo sapiens
ctgtggtaccct

SEQ ID NO: 5608370 - DNA, 15 bp, Homo sapiens
ctgtggtaccctggc

SEQ ID NO: 5608371 - DNA, 24 bp, Homo sapiens
ctgtggtaccctggcagagaagag

SEQ ID NO: 5608372 - DNA, 19 bp, Homo sapiens
ctgtggtagtcctcccaag

SEQ ID NO: 5608373 - DNA, 12 bp, Homo sapiens
ctgtggtcacag

SEQ ID NO: 5608374 - DNA, 15 bp, Homo sapiens
ctgtggtcacagtga

SEQ ID NO: 5608375 - DNA, 20 bp, Homo sapiens
ctgtggtcagagagggaagc

SEQ ID NO: 5608376 - DNA, 14 bp, Homo sapiens
ctgtggtcaggccc

SEQ ID NO: 5608377 - DNA, 17 bp, Homo sapiens
ctgtggtcaggcccagc

SEQ ID NO: 5608378 - DNA, 24 bp, Homo sapiens
ctgtggtcaggcccagcctctctg

SEQ ID NO: 5608379 - DNA, 14 bp, Homo sapiens
ctgtggtcatgtaa

SEQ ID NO: 5608380 - DNA, 14 bp, Homo sapiens
ctgtggtcatgtga

SEQ ID NO: 5608381 - DNA, 22 bp, Homo sapiens
ctgtggtcatgtgagtctggga

SEQ ID NO: 5608382 - DNA, 18 bp, Homo sapiens
ctgtggtccagaagaaat

SEQ ID NO: 5608383 - DNA, 14 bp, Homo sapiens
ctgtggtcccaccc

SEQ ID NO: 5608384 - DNA, 20 bp, Homo sapiens
ctgtggtcccacccaggaag

SEQ ID NO: 5608385 - DNA, 13 bp, Homo sapiens
ctgtggtcccttc

SEQ ID NO: 5608386 - DNA, 22 bp, Homo sapiens
ctgtggtcctgaattctttccc

SEQ ID NO: 5608387 - DNA, 20 bp, Homo sapiens
ctgtggtcgtcaactttcct

SEQ ID NO: 5608388 - DNA, 14 bp, Homo sapiens
ctgtgttctcaaca

SEQ ID NO: 5608389 - DNA, 20 bp, Homo sapiens
ctgtgttctcaacacacagt

SEQ ID NO: 5608390 - DNA, 21 bp, Homo sapiens
ctgtgttctcaacacacagta

SEQ ID NO: 5608391 - DNA, 22 bp, Homo sapiens
ctgtgttcttgccactgcactc

SEQ ID NO: 5608392 - DNA, 13 bp, Homo sapiens
ctgtgttgaaaca

SEQ ID NO: 5608393 - DNA, 22 bp, Homo sapiens
ctgtgttgaaatatagttgaaa

SEQ ID NO: 5608394 - DNA, 17 bp, Homo sapiens
ctgtgttgactgctgct

SEQ ID NO: 5608395 - DNA, 20 bp, Homo sapiens
ctgtgttgactgctgctccc

SEQ ID NO: 5608396 - DNA, 23 bp, Homo sapiens
ctgtgttgcattattcatttagt

SEQ ID NO: 5608397 - DNA, 19 bp, Homo sapiens
ctgtgttgccaagctccaa

SEQ ID NO: 5608398 - DNA, 16 bp, Homo sapiens
ctgtgttgctgtttag

SEQ ID NO: 5608399 - DNA, 14 bp, Homo sapiens
ctgtgttgcttcaa

SEQ ID NO: 5608400 - DNA, 19 bp, Homo sapiens
ctgtgttgggcaagacctc

SEQ ID NO: 5608401 - DNA, 15 bp, Homo sapiens
ctgtgttgtattaac

SEQ ID NO: 5608402 - DNA, 21 bp, Homo sapiens
ctgtgttgtattaacaaaagt

SEQ ID NO: 5608403 - DNA, 23 bp, Homo sapiens
ctgtgttgtgattccccggagct

SEQ ID NO: 5608404 - DNA, 19 bp, Homo sapiens
ctgtgttgttgcttcttgt

SEQ ID NO: 5608405 - DNA, 13 bp, Homo sapiens
ctgtgtttaatca

SEQ ID NO: 5608406 - DNA, 18 bp, Homo sapiens
ctgtgtttaatttcttca

SEQ ID NO: 5608407 - DNA, 21 bp, Homo sapiens
ctgtgtttaatttcttcaaaa

SEQ ID NO: 5608408 - DNA, 14 bp, Homo sapiens
ctgtgtttaatttg

SEQ ID NO: 5608409 - DNA, 16 bp, Homo sapiens
ctgtgtttacagacag

SEQ ID NO: 5608410 - DNA, 19 bp, Homo sapiens
ctgtgtttagattgtatta

SEQ ID NO: 5608411 - DNA, 12 bp, Homo sapiens
ctgtgtttagct

SEQ ID NO: 5608412 - DNA, 16 bp, Homo sapiens
ctgtgtttatatggaa

SEQ ID NO: 5608413 - DNA, 22 bp, Homo sapiens
ctgtgtttatatggaagaaagt

SEQ ID NO: 5608414 - DNA, 11 bp, Homo sapiens
ctgtgtttcaa

SEQ ID NO: 5608415 - DNA, 18 bp, Homo sapiens
ctgtgtttcacttaatgt

SEQ ID NO: 5608416 - DNA, 14 bp, Homo sapiens
ctgtgtttcagcat

SEQ ID NO: 5608417 - DNA, 16 bp, Homo sapiens
ctgtgtttcatgttct

SEQ ID NO: 5608418 - DNA, 19 bp, Homo sapiens
ctgtgtttcatgttctgtg

SEQ ID NO: 5608419 - DNA, 21 bp, Homo sapiens
ctgtgtttcatgttctgtgtc

SEQ ID NO: 5608420 - DNA, 22 bp, Homo sapiens
ctgtgtttcatgttctgtgtca

SEQ ID NO: 5608421 - DNA, 14 bp, Homo sapiens
ctgtgtttccaaag

SEQ ID NO: 5608422 - DNA, 22 bp, Homo sapiens
ctgtgtttccatcctttgcatt

SEQ ID NO: 5608423 - DNA, 22 bp, Homo sapiens
ctgtgtttcgtgaactgcagtg

SEQ ID NO: 5608424 - DNA, 14 bp, Homo sapiens
ctgtgtttctggag

SEQ ID NO: 5608425 - DNA, 15 bp, Homo sapiens
ctgtgtttctggagt

SEQ ID NO: 5608426 - DNA, 20 bp, Homo sapiens
ctgtgtttctgtgctccaag

SEQ ID NO: 5608427 - DNA, 15 bp, Homo sapiens
ctgtgtttcttgcct

SEQ ID NO: 5608428 - DNA, 18 bp, Homo sapiens
ctgtgtttcttgcctcat

SEQ ID NO: 5608429 - DNA, 23 bp, Homo sapiens
ctgtgtttgaccttcacatttgt

SEQ ID NO: 5608430 - DNA, 22 bp, Homo sapiens
ctgtgtttgagctctgcagccc

SEQ ID NO: 5608431 - DNA, 17 bp, Homo sapiens
ctgtgtttgatatttgt

SEQ ID NO: 5608432 - DNA, 21 bp, Homo sapiens
ctgtgtttgatttgtctcata

SEQ ID NO: 5608433 - DNA, 15 bp, Homo sapiens
ctgtgtttgcagcct

SEQ ID NO: 5608434 - DNA, 20 bp, Homo sapiens
ctgtgtttgcagcctgctct

SEQ ID NO: 5608435 - DNA, 14 bp, Homo sapiens
ctgtgtttgctccc

SEQ ID NO: 5608436 - DNA, 18 bp, Homo sapiens
ctgtgtttgtcctgggtt

SEQ ID NO: 5608437 - DNA, 18 bp, Homo sapiens
ctgtgttttcagactgcc

SEQ ID NO: 5608438 - DNA, 11 bp, Homo sapiens
ctgtgttttcg

SEQ ID NO: 5608439 - DNA, 20 bp, Homo sapiens
ctgtgttttcgatgatgatg

SEQ ID NO: 5608440 - DNA, 18 bp, Homo sapiens
ctgtgttttgaaagaata

SEQ ID NO: 5608441 - DNA, 18 bp, Homo sapiens
ctgtgttttgtctgagcc

SEQ ID NO: 5608442 - DNA, 20 bp, Homo sapiens
ctgtgttttgtctgagcctc

SEQ ID NO: 5608443 - DNA, 15 bp, Homo sapiens
ctgtgttttgtgagg

SEQ ID NO: 5608444 - DNA, 16 bp, Homo sapiens
ctgtgtttttgccact

SEQ ID NO: 5608445 - DNA, 15 bp, Homo sapiens
ctgttaaaagatgaa

SEQ ID NO: 5608446 - DNA, 16 bp, Homo sapiens
ctgttaaaataaagct

SEQ ID NO: 5608447 - DNA, 18 bp, Homo sapiens
ctgttaaaatgtacactg

SEQ ID NO: 5608448 - DNA, 22 bp, Homo sapiens
ctgttaaacagtagttgtattc

SEQ ID NO: 5608449 - DNA, 22 bp, Homo sapiens
ctgttaaagatatttttattca

SEQ ID NO: 5608450 - DNA, 16 bp, Homo sapiens
ctgttaaatacaggaa

SEQ ID NO: 5608451 - DNA, 17 bp, Homo sapiens
ctgttaaatacaggaaa

SEQ ID NO: 5608452 - DNA, 19 bp, Homo sapiens
ctgttaaatacaggaaaca

SEQ ID NO: 5608453 - DNA, 14 bp, Homo sapiens
ctgttaaatataca

SEQ ID NO: 5608454 - DNA, 19 bp, Homo sapiens
ctgttaaatatttttgtac

SEQ ID NO: 5608455 - DNA, 16 bp, Homo sapiens
ctgttaaattgctgtg

SEQ ID NO: 5608456 - DNA, 18 bp, Homo sapiens
ctgttaaattgctgtgta

SEQ ID NO: 5608457 - DNA, 22 bp, Homo sapiens
ctgttaaattgctgtgtatctg

SEQ ID NO: 5608458 - DNA, 17 bp, Homo sapiens
ctgttaaattttctcta

SEQ ID NO: 5608459 - DNA, 17 bp, Homo sapiens
ctgttaacagctgtcaa

SEQ ID NO: 5608460 - DNA, 13 bp, Homo sapiens
ctgttaacatcta

SEQ ID NO: 5608461 - DNA, 17 bp, Homo sapiens
ctgttaacccagtgttc

SEQ ID NO: 5608462 - DNA, 19 bp, Homo sapiens
ctgttaaccctccacctcc

SEQ ID NO: 5608463 - DNA, 20 bp, Homo sapiens
ctgttaaccctccacctcct

SEQ ID NO: 5608464 - DNA, 20 bp, Homo sapiens
ctgttaacgtcatctcaggg

SEQ ID NO: 5608465 - DNA, 17 bp, Homo sapiens
ctgttaactgaatacca

SEQ ID NO: 5608466 - DNA, 22 bp, Homo sapiens
ctgttaactgaataccactctg

SEQ ID NO: 5608467 - DNA, 19 bp, Homo sapiens
ctgttaacttattcaaaga

SEQ ID NO: 5608468 - DNA, 22 bp, Homo sapiens
ctgttaaggacccttttaagca

SEQ ID NO: 5608469 - DNA, 18 bp, Homo sapiens
ctgttaagggaagctgat

SEQ ID NO: 5608470 - DNA, 19 bp, Homo sapiens
ctgttaagggaagctgata

SEQ ID NO: 5608471 - DNA, 19 bp, Homo sapiens
ctgttaaggtggaaaatgg

SEQ ID NO: 5608472 - DNA, 22 bp, Homo sapiens
ctgttaaggttgaactttgcca

SEQ ID NO: 5608473 - DNA, 15 bp, Homo sapiens
ctgttaataaacagc

SEQ ID NO: 5608474 - DNA, 15 bp, Homo sapiens
ctgttaatatttcta

SEQ ID NO: 5608475 - DNA, 13 bp, Homo sapiens
ctgttaatctgat

SEQ ID NO: 5608476 - DNA, 15 bp, Homo sapiens
ctgttaatctgatgt

SEQ ID NO: 5608477 - DNA, 16 bp, Homo sapiens
ctgttaatctgatgta

SEQ ID NO: 5608478 - DNA, 22 bp, Homo sapiens
ctgttaatctgatgtataatgt

SEQ ID NO: 5608479 - DNA, 18 bp, Homo sapiens
ctgttaatgtatttgttc

SEQ ID NO: 5608480 - DNA, 15 bp, Homo sapiens
ctgttaatgttaatt

SEQ ID NO: 5608481 - DNA, 15 bp, Homo sapiens
ctgttaattctagat

SEQ ID NO: 5608482 - DNA, 18 bp, Homo sapiens
ctgttaatttttatactg

SEQ ID NO: 5608483 - DNA, 12 bp, Homo sapiens
ctgttacaaaag

SEQ ID NO: 5608484 - DNA, 15 bp, Homo sapiens
ctgttacaaaatgta

SEQ ID NO: 5608485 - DNA, 20 bp, Homo sapiens
ctgttacacactaacatcaa

SEQ ID NO: 5608486 - DNA, 17 bp, Homo sapiens
ctgttacacgtgcctgt

SEQ ID NO: 5608487 - DNA, 18 bp, Homo sapiens
ctgttacacgtgcctgta

SEQ ID NO: 5608488 - DNA, 13 bp, Homo sapiens
ctgttacactgga

SEQ ID NO: 5608489 - DNA, 15 bp, Homo sapiens
ctgttacactgggct

SEQ ID NO: 5608490 - DNA, 17 bp, Homo sapiens
ctgttacactgggctgg

SEQ ID NO: 5608491 - DNA, 14 bp, Homo sapiens
ctgttacagtaatg

SEQ ID NO: 5608492 - DNA, 21 bp, Homo sapiens
ctgttacattctaagtgtgtt

SEQ ID NO: 5608493 - DNA, 15 bp, Homo sapiens
ctgttaccacattgg

SEQ ID NO: 5608494 - DNA, 15 bp, Homo sapiens
ctgttaccatgtcac

SEQ ID NO: 5608495 - DNA, 18 bp, Homo sapiens
ctgttaccatgtcactgt

SEQ ID NO: 5608496 - DNA, 19 bp, Homo sapiens
ctgttaccatgtcactgtg

SEQ ID NO: 5608497 - DNA, 20 bp, Homo sapiens
ctgttaccatgtcactgtgg

SEQ ID NO: 5608498 - DNA, 15 bp, Homo sapiens
ctgttaccattcaca

SEQ ID NO: 5608499 - DNA, 16 bp, Homo sapiens
ctgttaccattggaaa

SEQ ID NO: 5608500 - DNA, 21 bp, Homo sapiens
ctgttaccattggaaatttca

SEQ ID NO: 5608501 - DNA, 17 bp, Homo sapiens
ctgttacccaggctgga

SEQ ID NO: 5608502 - DNA, 21 bp, Homo sapiens
ctgttacccagggctctgcag

SEQ ID NO: 5608503 - DNA, 23 bp, Homo sapiens
ctgttacccagggctctgcagca

SEQ ID NO: 5608504 - DNA, 21 bp, Homo sapiens
ctgttacccgcagatcctgtc

SEQ ID NO: 5608505 - DNA, 21 bp, Homo sapiens
ctgttacctcaacaagaagaa

SEQ ID NO: 5608506 - DNA, 20 bp, Homo sapiens
ctgttacctgatcaatgaca

SEQ ID NO: 5608507 - DNA, 22 bp, Homo sapiens
ctgttacctgtcttgctcctgg

SEQ ID NO: 5608508 - DNA, 16 bp, Homo sapiens
ctgttacgtttgaagt

SEQ ID NO: 5608509 - DNA, 13 bp, Homo sapiens
ctgttactccaca

SEQ ID NO: 5608510 - DNA, 14 bp, Homo sapiens
ctgttactccacag

SEQ ID NO: 5608511 - DNA, 17 bp, Homo sapiens
ctgttactccacagcgg

SEQ ID NO: 5608512 - DNA, 20 bp, Homo sapiens
ctgttactccattactgtga

SEQ ID NO: 5608513 - DNA, 13 bp, Homo sapiens
ctgttactgaaat

SEQ ID NO: 5608514 - DNA, 14 bp, Homo sapiens
ctgttactgaaatg

SEQ ID NO: 5608515 - DNA, 18 bp, Homo sapiens
ctgttactgagatgtctt

SEQ ID NO: 5608516 - DNA, 20 bp, Homo sapiens
ctgttactgcttctctttgt

SEQ ID NO: 5608517 - DNA, 15 bp, Homo sapiens
ctgttactgggccct

SEQ ID NO: 5608518 - DNA, 15 bp, Homo sapiens
ctgttacttaaatag

SEQ ID NO: 5608519 - DNA, 15 bp, Homo sapiens
ctgttacttacctaa

SEQ ID NO: 5608520 - DNA, 21 bp, Homo sapiens
ctgttacttatgtagaaactg

SEQ ID NO: 5608521 - DNA, 23 bp, Homo sapiens
ctgttacttatgtagaaactgag

SEQ ID NO: 5608522 - DNA, 23 bp, Homo sapiens
ctgttactttctttcagatgttt

SEQ ID NO: 5608523 - DNA, 20 bp, Homo sapiens
ctgttactttttagtctttt

SEQ ID NO: 5608524 - DNA, 13 bp, Homo sapiens
ctgttagaacact

SEQ ID NO: 5608525 - DNA, 15 bp, Homo sapiens
ctgttagaacactat

SEQ ID NO: 5608526 - DNA, 16 bp, Homo sapiens
ctgttagaacactatt

SEQ ID NO: 5608527 - DNA, 23 bp, Homo sapiens
ctgttagaacactattttcagaa

SEQ ID NO: 5608528 - DNA, 17 bp, Homo sapiens
ctgttagaattaggtaa

SEQ ID NO: 5608529 - DNA, 13 bp, Homo sapiens
ctgttagatgctg

SEQ ID NO: 5608530 - DNA, 14 bp, Homo sapiens
ctgttagcactgtt

SEQ ID NO: 5608531 - DNA, 13 bp, Homo sapiens
ctgttagcagaca

SEQ ID NO: 5608532 - DNA, 15 bp, Homo sapiens
ctgttagcagagtct

SEQ ID NO: 5608533 - DNA, 22 bp, Homo sapiens
ctgttagcagagtctgtctctt

SEQ ID NO: 5608534 - DNA, 23 bp, Homo sapiens
ctgttagcagagtctgtctcttg

SEQ ID NO: 5608535 - DNA, 18 bp, Homo sapiens
ctgttagcattattgcca

SEQ ID NO: 5608536 - DNA, 17 bp, Homo sapiens
ctgttagccatgtggct

SEQ ID NO: 5608537 - DNA, 16 bp, Homo sapiens
ctgttagctgctcact

SEQ ID NO: 5608538 - DNA, 16 bp, Homo sapiens
ctgttagctgttattt

SEQ ID NO: 5608539 - DNA, 20 bp, Homo sapiens
ctgttaggaacagcagtgtt

SEQ ID NO: 5608540 - DNA, 19 bp, Homo sapiens
ctgttaggccaactgcctc

SEQ ID NO: 5608541 - DNA, 16 bp, Homo sapiens
ctgttaggtccatttt

SEQ ID NO: 5608542 - DNA, 17 bp, Homo sapiens
ctgttagtagcagaaat

SEQ ID NO: 5608543 - DNA, 15 bp, Homo sapiens
ctgttagtattgatt

SEQ ID NO: 5608544 - DNA, 18 bp, Homo sapiens
ctgttagtcatttgctga

SEQ ID NO: 5608545 - DNA, 16 bp, Homo sapiens
ctgttagtctccccac

SEQ ID NO: 5608546 - DNA, 15 bp, Homo sapiens
ctgttataaattttg

SEQ ID NO: 5608547 - DNA, 18 bp, Homo sapiens
ctgttataaattttgtac

SEQ ID NO: 5608548 - DNA, 21 bp, Homo sapiens
ctgttataaattttgtacatt

SEQ ID NO: 5608549 - DNA, 13 bp, Homo sapiens
ctgttatacacag

SEQ ID NO: 5608550 - DNA, 21 bp, Homo sapiens
ctgttataggtcctttagaaa

SEQ ID NO: 5608551 - DNA, 17 bp, Homo sapiens
ctgttatatatctcttt

SEQ ID NO: 5608552 - DNA, 23 bp, Homo sapiens
ctgttatatatttactcagtctt

SEQ ID NO: 5608553 - DNA, 18 bp, Homo sapiens
ctgttatatcccctgcta

SEQ ID NO: 5608554 - DNA, 17 bp, Homo sapiens
ctgttatatttcatcat

SEQ ID NO: 5608555 - DNA, 23 bp, Homo sapiens
ctgttatcaaacaccaacataaa

SEQ ID NO: 5608556 - DNA, 13 bp, Homo sapiens
ctgttatcaaata

SEQ ID NO: 5608557 - DNA, 19 bp, Homo sapiens
ctgttatcaaatagcgatg

SEQ ID NO: 5608558 - DNA, 22 bp, Homo sapiens
ctgttatcaattcacattcatc

SEQ ID NO: 5608559 - DNA, 18 bp, Homo sapiens
ctgttatcagctgggcag

SEQ ID NO: 5608560 - DNA, 17 bp, Homo sapiens
ctgttatcagtaatgct

SEQ ID NO: 5608561 - DNA, 19 bp, Homo sapiens
ctgttatgatttccttcaa

SEQ ID NO: 5608562 - DNA, 21 bp, Homo sapiens
ctgttatgcactgtggtttca

SEQ ID NO: 5608563 - DNA, 19 bp, Homo sapiens
ctgttatgctgtgacacat

SEQ ID NO: 5608564 - DNA, 21 bp, Homo sapiens
ctgtttgatataccaaattaa

SEQ ID NO: 5608565 - DNA, 23 bp, Homo sapiens
ctgtttgatgctatttatgcaag

SEQ ID NO: 5608566 - DNA, 11 bp, Homo sapiens
ctgtttgatgt

SEQ ID NO: 5608567 - DNA, 17 bp, Homo sapiens
ctgtttgatgtatgtgt

SEQ ID NO: 5608568 - DNA, 22 bp, Homo sapiens
ctgtttgatgtatgtgtgaaac

SEQ ID NO: 5608569 - DNA, 20 bp, Homo sapiens
ctgtttgcaggcccagagga

SEQ ID NO: 5608570 - DNA, 14 bp, Homo sapiens
ctgtttgcatgaga

SEQ ID NO: 5608571 - DNA, 16 bp, Homo sapiens
ctgtttgcatgcgccc

SEQ ID NO: 5608572 - DNA, 22 bp, Homo sapiens
ctgtttgccacacccaggtgat

SEQ ID NO: 5608573 - DNA, 12 bp, Homo sapiens
ctgtttgcctat

SEQ ID NO: 5608574 - DNA, 17 bp, Homo sapiens
ctgtttgctaagtgagg

SEQ ID NO: 5608575 - DNA, 17 bp, Homo sapiens
ctgtttgctcacccagg

SEQ ID NO: 5608576 - DNA, 18 bp, Homo sapiens
ctgtttgctcacccagga

SEQ ID NO: 5608577 - DNA, 21 bp, Homo sapiens
ctgtttgctgatccccaacct

SEQ ID NO: 5608578 - DNA, 15 bp, Homo sapiens
ctgtttgctgttgct

SEQ ID NO: 5608579 - DNA, 17 bp, Homo sapiens
ctgtttgcttcaccgtg

SEQ ID NO: 5608580 - DNA, 18 bp, Homo sapiens
ctgtttgcttcaccgtgg

SEQ ID NO: 5608581 - DNA, 12 bp, Homo sapiens
ctgtttgctttt

SEQ ID NO: 5608582 - DNA, 15 bp, Homo sapiens
ctgtttgcttttgaa

SEQ ID NO: 5608583 - DNA, 19 bp, Homo sapiens
ctgtttggaaatggggagc

SEQ ID NO: 5608584 - DNA, 22 bp, Homo sapiens
ctgtttggaaattgattttgaa

SEQ ID NO: 5608585 - DNA, 16 bp, Homo sapiens
ctgtttggacccatgg

SEQ ID NO: 5608586 - DNA, 23 bp, Homo sapiens
ctgtttggaggagcaaaggctga

SEQ ID NO: 5608587 - DNA, 21 bp, Homo sapiens
ctgtttggatttttaattaaa

SEQ ID NO: 5608588 - DNA, 14 bp, Homo sapiens
ctgtttggcacttg

SEQ ID NO: 5608589 - DNA, 18 bp, Homo sapiens
ctgtttggcttataaaca

SEQ ID NO: 5608590 - DNA, 13 bp, Homo sapiens
ctgtttgggcagg

SEQ ID NO: 5608591 - DNA, 15 bp, Homo sapiens
ctgtttggggagggg

SEQ ID NO: 5608592 - DNA, 20 bp, Homo sapiens
ctgtttgggttgttggtctg

SEQ ID NO: 5608593 - DNA, 23 bp, Homo sapiens
ctgtttgggttgttggtctgtgt

SEQ ID NO: 5608594 - DNA, 15 bp, Homo sapiens
ctgtttggtgaggac

SEQ ID NO: 5608595 - DNA, 16 bp, Homo sapiens
ctgtttggtgaggacc

SEQ ID NO: 5608596 - DNA, 18 bp, Homo sapiens
ctgtttggtttgtttata

SEQ ID NO: 5608597 - DNA, 17 bp, Homo sapiens
ctgtttggttttaaaat

SEQ ID NO: 5608598 - DNA, 21 bp, Homo sapiens
ctgtttggttttaaaatactg

SEQ ID NO: 5608599 - DNA, 16 bp, Homo sapiens
ctgtttgtaaattatt

SEQ ID NO: 5608600 - DNA, 12 bp, Homo sapiens
ctgtttgtattt

SEQ ID NO: 5608601 - DNA, 20 bp, Homo sapiens
ctgtttgtatttttttccaa

SEQ ID NO: 5608602 - DNA, 21 bp, Homo sapiens
ctgtttgtatttttttccaag

SEQ ID NO: 5608603 - DNA, 22 bp, Homo sapiens
ctgtttgtcctgagatggaaaa

SEQ ID NO: 5608604 - DNA, 19 bp, Homo sapiens
ctgtttgtgcaaacataat

SEQ ID NO: 5608605 - DNA, 20 bp, Homo sapiens
ctgtttgttatctcttgtta

SEQ ID NO: 5608606 - DNA, 23 bp, Homo sapiens
ctgtttgttgagtgcactgactg

SEQ ID NO: 5608607 - DNA, 20 bp, Homo sapiens
ctgtttgtttaagctgagcc

SEQ ID NO: 5608608 - DNA, 23 bp, Homo sapiens
ctgtttgtttctgaaagggacgc

SEQ ID NO: 5608609 - DNA, 20 bp, Homo sapiens
ctgtttgtttgacaaagaaa

SEQ ID NO: 5608610 - DNA, 18 bp, Homo sapiens
ctgtttgttttgttttct

SEQ ID NO: 5608611 - DNA, 22 bp, Homo sapiens
ctgtttgtttttaaaaagcaaa

SEQ ID NO: 5608612 - DNA, 19 bp, Homo sapiens
ctgttttaaaaaatacagt

SEQ ID NO: 5608613 - DNA, 13 bp, Homo sapiens
ctgttttaaatta

SEQ ID NO: 5608614 - DNA, 21 bp, Homo sapiens
ctgttttaaattgcatttcta

SEQ ID NO: 5608615 - DNA, 22 bp, Homo sapiens
ctgttttaaattgcatttctat

SEQ ID NO: 5608616 - DNA, 13 bp, Homo sapiens
ctgttttaataat

SEQ ID NO: 5608617 - DNA, 13 bp, Homo sapiens
ctgttttaattgt

SEQ ID NO: 5608618 - DNA, 14 bp, Homo sapiens
ctgttttaattgta

SEQ ID NO: 5608619 - DNA, 15 bp, Homo sapiens
ctgttttaattgtag

SEQ ID NO: 5608620 - DNA, 18 bp, Homo sapiens
ctgttttaatttgtattt

SEQ ID NO: 5608621 - DNA, 17 bp, Homo sapiens
ctgttttacaagttgga

SEQ ID NO: 5608622 - DNA, 15 bp, Homo sapiens
ctgttttactgtttt

SEQ ID NO: 5608623 - DNA, 18 bp, Homo sapiens
ctgttttaggttaaaaaa

SEQ ID NO: 5608624 - DNA, 18 bp, Homo sapiens
ctgttttagtttctgaac

SEQ ID NO: 5608625 - DNA, 19 bp, Homo sapiens
ctgttttagtttctgaact

SEQ ID NO: 5608626 - DNA, 17 bp, Homo sapiens
ctgttttataattagtc

SEQ ID NO: 5608627 - DNA, 15 bp, Homo sapiens
ctgttttataatttt

SEQ ID NO: 5608628 - DNA, 16 bp, Homo sapiens
ctgttttatatattat

SEQ ID NO: 5608629 - DNA, 12 bp, Homo sapiens
ctgttttatgac

SEQ ID NO: 5608630 - DNA, 14 bp, Homo sapiens
ctgttttatgactt

SEQ ID NO: 5608631 - DNA, 19 bp, Homo sapiens
ctgttttatgtcatactct

SEQ ID NO: 5608632 - DNA, 22 bp, Homo sapiens
ctgttttatgtcatactctgtg

SEQ ID NO: 5608633 - DNA, 14 bp, Homo sapiens
ctgttttatgttga

SEQ ID NO: 5608634 - DNA, 17 bp, Homo sapiens
ctgttttattactgttt

SEQ ID NO: 5608635 - DNA, 19 bp, Homo sapiens
ctgttttattactgtttct

SEQ ID NO: 5608636 - DNA, 22 bp, Homo sapiens
ctgttttattgagttctgaagg

SEQ ID NO: 5608637 - DNA, 11 bp, Homo sapiens
ctgttttcaag

SEQ ID NO: 5608638 - DNA, 15 bp, Homo sapiens
ctgttttcaagtgta

SEQ ID NO: 5608639 - DNA, 17 bp, Homo sapiens
ctgttttcaataacaaa

SEQ ID NO: 5608640 - DNA, 14 bp, Homo sapiens
ctgttttcacacct

SEQ ID NO: 5608641 - DNA, 21 bp, Homo sapiens
ctgttttcaccatctttctaa

SEQ ID NO: 5608642 - DNA, 20 bp, Homo sapiens
ctgttttcatggacagctga

SEQ ID NO: 5608643 - DNA, 14 bp, Homo sapiens
ctgttttccaaagg

SEQ ID NO: 5608644 - DNA, 12 bp, Homo sapiens
ctgttttccccc

SEQ ID NO: 5608645 - DNA, 16 bp, Homo sapiens
ctgttttcccccagca

SEQ ID NO: 5608646 - DNA, 20 bp, Homo sapiens
ctgttttccctctgctgctt

SEQ ID NO: 5608647 - DNA, 19 bp, Homo sapiens
ctgttttcctcccttctgc

SEQ ID NO: 5608648 - DNA, 20 bp, Homo sapiens
ctgttttcctcccttctgct

SEQ ID NO: 5608649 - DNA, 21 bp, Homo sapiens
ctgttttcctcccttctgcta

SEQ ID NO: 5608650 - DNA, 16 bp, Homo sapiens
ctgttttcctttctca

SEQ ID NO: 5608651 - DNA, 18 bp, Homo sapiens
ctgttttcctttctcacc

SEQ ID NO: 5608652 - DNA, 23 bp, Homo sapiens
ctgttttcctttctcaccgcagt

SEQ ID NO: 5608653 - DNA, 15 bp, Homo sapiens
ctgttttctagtgta

SEQ ID NO: 5608654 - DNA, 17 bp, Homo sapiens
ctgttttctagtgtatc

SEQ ID NO: 5608655 - DNA, 22 bp, Homo sapiens
ctgttttctagtgtatcaaaat

SEQ ID NO: 5608656 - DNA, 16 bp, Homo sapiens
ctgttttctccctctc

SEQ ID NO: 5608657 - DNA, 17 bp, Homo sapiens
ctgttttctccctctca

SEQ ID NO: 5608658 - DNA, 16 bp, Homo sapiens
ctgttttctctgtgac

SEQ ID NO: 5608659 - DNA, 17 bp, Homo sapiens
ctgttttctcttgagag

SEQ ID NO: 5608660 - DNA, 15 bp, Homo sapiens
ctgttttctgagccc

SEQ ID NO: 5608661 - DNA, 19 bp, Homo sapiens
ctgttttctgagcccgggc

SEQ ID NO: 5608662 - DNA, 20 bp, Homo sapiens
ctgttttctgagcccgggct

SEQ ID NO: 5608663 - DNA, 12 bp, Homo sapiens
ctgttttctgct

SEQ ID NO: 5608664 - DNA, 19 bp, Homo sapiens
ctgttttctgctgtttaca

SEQ ID NO: 5608665 - DNA, 13 bp, Homo sapiens
ctgttttctggaa

SEQ ID NO: 5608666 - DNA, 14 bp, Homo sapiens
ctgttttctggaag

SEQ ID NO: 5608667 - DNA, 17 bp, Homo sapiens
ctgttttctgtaaattc

SEQ ID NO: 5608668 - DNA, 16 bp, Homo sapiens
ctgttttctgtttctt

SEQ ID NO: 5608669 - DNA, 17 bp, Homo sapiens
ctgttttctgtttgtaa

SEQ ID NO: 5608670 - DNA, 18 bp, Homo sapiens
ctgttttcttctattcca

SEQ ID NO: 5608671 - DNA, 20 bp, Homo sapiens
ctgttttgaataaattttca

SEQ ID NO: 5608672 - DNA, 17 bp, Homo sapiens
ctgttttgagttcctat

SEQ ID NO: 5608673 - DNA, 12 bp, Homo sapiens
ctgttttgatag

SEQ ID NO: 5608674 - DNA, 16 bp, Homo sapiens
ctgttttgcacagtta

SEQ ID NO: 5608675 - DNA, 22 bp, Homo sapiens
ctgttttgcctgaagttggagt

SEQ ID NO: 5608676 - DNA, 17 bp, Homo sapiens
ctgttttgcttttgtaa

SEQ ID NO: 5608677 - DNA, 13 bp, Homo sapiens
ctgttttgggcct

SEQ ID NO: 5608678 - DNA, 22 bp, Homo sapiens
ctgttttgggcctccatgcccc

SEQ ID NO: 5608679 - DNA, 17 bp, Homo sapiens
ctgttttgggtagctgc

SEQ ID NO: 5608680 - DNA, 19 bp, Homo sapiens
ctgttttggtcccctccct

SEQ ID NO: 5608681 - DNA, 20 bp, Homo sapiens
ctgttttggtcccctccctc

SEQ ID NO: 5608682 - DNA, 16 bp, Homo sapiens
ctgttttgtaaagtcc

SEQ ID NO: 5608683 - DNA, 23 bp, Homo sapiens
ctgttttgtatcaaaatcactat

SEQ ID NO: 5608684 - DNA, 20 bp, Homo sapiens
ctgttttgtcctttgagaaa

SEQ ID NO: 5608685 - DNA, 13 bp, Homo sapiens
ctgttttgttata

SEQ ID NO: 5608686 - DNA, 17 bp, Homo sapiens
ctgttttgttgacattc

SEQ ID NO: 5608687 - DNA, 19 bp, Homo sapiens
ctgttttgttgacattctg

SEQ ID NO: 5608688 - DNA, 15 bp, Homo sapiens
ctgttttgttggccc

SEQ ID NO: 5608689 - DNA, 23 bp, Homo sapiens
ctgttttgtttcgctctttgaga

SEQ ID NO: 5608690 - DNA, 22 bp, Homo sapiens
ctgttttgtttggcaaggaaag

SEQ ID NO: 5608691 - DNA, 14 bp, Homo sapiens
ctgtttttaaaaat

SEQ ID NO: 5608692 - DNA, 17 bp, Homo sapiens
ctgtttttaaaaatcat

SEQ ID NO: 5608693 - DNA, 16 bp, Homo sapiens
ctgtttttaacatgtg

SEQ ID NO: 5608694 - DNA, 14 bp, Homo sapiens
ctgtttttactctg

SEQ ID NO: 5608695 - DNA, 18 bp, Homo sapiens
ctgtttttattagccaat

SEQ ID NO: 5608696 - DNA, 12 bp, Homo sapiens
ctgtttttattc

SEQ ID NO: 5608697 - DNA, 16 bp, Homo sapiens
ctgtttttattccttc

SEQ ID NO: 5608698 - DNA, 18 bp, Homo sapiens
ctgtttttattccttcca

SEQ ID NO: 5608699 - DNA, 12 bp, Homo sapiens
ctgtttttcaca

SEQ ID NO: 5608700 - DNA, 18 bp, Homo sapiens
ctgtttttccatagtttt

SEQ ID NO: 5608701 - DNA, 12 bp, Homo sapiens
ctgtttttctca

SEQ ID NO: 5608702 - DNA, 21 bp, Homo sapiens
ctgtttttctgggtggcctcg

SEQ ID NO: 5608703 - DNA, 19 bp, Homo sapiens
ctgtttttcttctgaaata

SEQ ID NO: 5608704 - DNA, 14 bp, Homo sapiens
ctgtttttgaagaa

SEQ ID NO: 5608705 - DNA, 12 bp, Homo sapiens
ctgtttttggac

SEQ ID NO: 5608706 - DNA, 14 bp, Homo sapiens
ctgtttttgtagtg

SEQ ID NO: 5608707 - DNA, 16 bp, Homo sapiens
ctgtttttgtgagaga

SEQ ID NO: 5608708 - DNA, 15 bp, Homo sapiens
ctgtttttgtttctt

SEQ ID NO: 5608709 - DNA, 12 bp, Homo sapiens
ctgttttttaaa

SEQ ID NO: 5608710 - DNA, 22 bp, Homo sapiens
ctgtttttttcaggctcctaaa

SEQ ID NO: 5608711 - DNA, 19 bp, Homo sapiens
ctgttttttttttttgtat

SEQ ID NO: 5608712 - DNA, 23 bp, Homo sapiens
ctgttttttttttttgtatttct

SEQ ID NO: 5608713 - DNA, 24 bp, Homo sapiens
ctgttttttttttttgtatttctt

SEQ ID NO: 5608714 - DNA, 22 bp, Homo sapiens
cttaaaaaaaaaaaaaaaagac

SEQ ID NO: 5608715 - DNA, 19 bp, Homo sapiens
cttaaaaaaaaaaaaaagc

SEQ ID NO: 5608716 - DNA, 23 bp, Homo sapiens
cttaaaaaaacaaattggacagc

SEQ ID NO: 5608717 - DNA, 18 bp, Homo sapiens
cttaaaaaaataaaatat

SEQ ID NO: 5608718 - DNA, 17 bp, Homo sapiens
cttaaaaaaatgacaga

SEQ ID NO: 5608719 - DNA, 13 bp, Homo sapiens
cttaaaaaaatgg

SEQ ID NO: 5608720 - DNA, 20 bp, Homo sapiens
cttaaaaaagcaacagtagc

SEQ ID NO: 5608721 - DNA, 17 bp, Homo sapiens
cttaaaaaataaaaact

SEQ ID NO: 5608722 - DNA, 13 bp, Homo sapiens
cttaaaaactgtg

SEQ ID NO: 5608723 - DNA, 19 bp, Homo sapiens
cttaaaaactgtgtatcat

SEQ ID NO: 5608724 - DNA, 14 bp, Homo sapiens
cttaaaaaggacta

SEQ ID NO: 5608725 - DNA, 16 bp, Homo sapiens
cttaaaaagtggaaaa

SEQ ID NO: 5608726 - DNA, 12 bp, Homo sapiens
cttaaaaagtta

SEQ ID NO: 5608727 - DNA, 12 bp, Homo sapiens
cttaaaaatatg

SEQ ID NO: 5608728 - DNA, 17 bp, Homo sapiens
cttaaaaatcattctaa

SEQ ID NO: 5608729 - DNA, 16 bp, Homo sapiens
cttaaaaatgcattta

SEQ ID NO: 5608730 - DNA, 22 bp, Homo sapiens
cttaaaaatgcatttaagttgt

SEQ ID NO: 5608731 - DNA, 20 bp, Homo sapiens
cttaaaaatggtttaaatgg

SEQ ID NO: 5608732 - DNA, 12 bp, Homo sapiens
cttaaaaatgta

SEQ ID NO: 5608733 - DNA, 15 bp, Homo sapiens
cttaaaaatgtaaat

SEQ ID NO: 5608734 - DNA, 22 bp, Homo sapiens
cttaaaaattaaattctctcta

SEQ ID NO: 5608735 - DNA, 13 bp, Homo sapiens
cttaaaaattaat

SEQ ID NO: 5608736 - DNA, 13 bp, Homo sapiens
cttaaaaattaga

SEQ ID NO: 5608737 - DNA, 15 bp, Homo sapiens
cttaaaaattagaac

SEQ ID NO: 5608738 - DNA, 14 bp, Homo sapiens
cttaaaacacatga

SEQ ID NO: 5608739 - DNA, 17 bp, Homo sapiens
cttaaaacatcattcct

SEQ ID NO: 5608740 - DNA, 13 bp, Homo sapiens
cttaaaacatggt

SEQ ID NO: 5608741 - DNA, 13 bp, Homo sapiens
cttaaaaccaaag

SEQ ID NO: 5608742 - DNA, 14 bp, Homo sapiens
cttaataaatatgt

SEQ ID NO: 5608743 - DNA, 18 bp, Homo sapiens
cttaataaattcagatat

SEQ ID NO: 5608744 - DNA, 19 bp, Homo sapiens
cttaataactatggtaaat

SEQ ID NO: 5608745 - DNA, 13 bp, Homo sapiens
cttaataataatg

SEQ ID NO: 5608746 - DNA, 19 bp, Homo sapiens
cttaataataattgaagaa

SEQ ID NO: 5608747 - DNA, 13 bp, Homo sapiens
cttaataatcaag

SEQ ID NO: 5608748 - DNA, 17 bp, Homo sapiens
cttaatacacacagtta

SEQ ID NO: 5608749 - DNA, 18 bp, Homo sapiens
cttaatactaccttgaaa

SEQ ID NO: 5608750 - DNA, 22 bp, Homo sapiens
cttaatactcaaatgagtaaca

SEQ ID NO: 5608751 - DNA, 16 bp, Homo sapiens
cttaatactgaatttc

SEQ ID NO: 5608752 - DNA, 19 bp, Homo sapiens
cttaatactgttattcttt

SEQ ID NO: 5608753 - DNA, 16 bp, Homo sapiens
cttaatagacttctct

SEQ ID NO: 5608754 - DNA, 20 bp, Homo sapiens
cttaatagacttctcttaca

SEQ ID NO: 5608755 - DNA, 14 bp, Homo sapiens
cttaatagaggagc

SEQ ID NO: 5608756 - DNA, 15 bp, Homo sapiens
cttaatagctgtagt

SEQ ID NO: 5608757 - DNA, 13 bp, Homo sapiens
cttaataggcttt

SEQ ID NO: 5608758 - DNA, 19 bp, Homo sapiens
cttaatagtagttagctta

SEQ ID NO: 5608759 - DNA, 23 bp, Homo sapiens
cttaatagtagttagcttaagta

SEQ ID NO: 5608760 - DNA, 14 bp, Homo sapiens
cttaatataaattc

SEQ ID NO: 5608761 - DNA, 19 bp, Homo sapiens
cttaatatatatatccaga

SEQ ID NO: 5608762 - DNA, 13 bp, Homo sapiens
cttaatatattcc

SEQ ID NO: 5608763 - DNA, 14 bp, Homo sapiens
cttaatatattccc

SEQ ID NO: 5608764 - DNA, 23 bp, Homo sapiens
cttaatatatttctaaatgtttg

SEQ ID NO: 5608765 - DNA, 22 bp, Homo sapiens
cttaatatgtgctgaacattgt

SEQ ID NO: 5608766 - DNA, 18 bp, Homo sapiens
cttaatattagcttgctt

SEQ ID NO: 5608767 - DNA, 14 bp, Homo sapiens
cttaatattctgga

SEQ ID NO: 5608768 - DNA, 19 bp, Homo sapiens
cttaatattgaggctgcag

SEQ ID NO: 5608769 - DNA, 19 bp, Homo sapiens
cttaatatttcttcaaata

SEQ ID NO: 5608770 - DNA, 20 bp, Homo sapiens
cttaatatttcttcaaatat

SEQ ID NO: 5608771 - DNA, 22 bp, Homo sapiens
cttaatcaagaatattcaaatg

SEQ ID NO: 5608772 - DNA, 14 bp, Homo sapiens
cttaatcactactg

SEQ ID NO: 5608773 - DNA, 12 bp, Homo sapiens
cttaatcatttt

SEQ ID NO: 5608774 - DNA, 13 bp, Homo sapiens
cttaatcatttta

SEQ ID NO: 5608775 - DNA, 18 bp, Homo sapiens
cttaatcattttttatat

SEQ ID NO: 5608776 - DNA, 23 bp, Homo sapiens
cttaatccgtagttattttgcac

SEQ ID NO: 5608777 - DNA, 16 bp, Homo sapiens
cttaatcgatgaatgt

SEQ ID NO: 5608778 - DNA, 17 bp, Homo sapiens
cttaatcgatgaatgta

SEQ ID NO: 5608779 - DNA, 14 bp, Homo sapiens
cttaatctaaatgg

SEQ ID NO: 5608780 - DNA, 16 bp, Homo sapiens
cttaatctaagaaaca

SEQ ID NO: 5608781 - DNA, 17 bp, Homo sapiens
cttaatctaagaaacaa

SEQ ID NO: 5608782 - DNA, 22 bp, Homo sapiens
cttaatcttctctcttgattga

SEQ ID NO: 5608783 - DNA, 17 bp, Homo sapiens
cttaatcttgctttctt

SEQ ID NO: 5608784 - DNA, 13 bp, Homo sapiens
cttaatctttatt

SEQ ID NO: 5608785 - DNA, 14 bp, Homo sapiens
cttaatctttgaaa

SEQ ID NO: 5608786 - DNA, 17 bp, Homo sapiens
cttaatcttttcacaaa

SEQ ID NO: 5608787 - DNA, 19 bp, Homo sapiens
cttaatcttttcacaaata

SEQ ID NO: 5608788 - DNA, 20 bp, Homo sapiens
cttaatcttttcacaaataa

SEQ ID NO: 5608789 - DNA, 16 bp, Homo sapiens
cttaatgaagagccag

SEQ ID NO: 5608790 - DNA, 12 bp, Homo sapiens
cttaatgaagtt

SEQ ID NO: 5608791 - DNA, 20 bp, Homo sapiens
cttaatgaagtttgaatgtt

SEQ ID NO: 5608792 - DNA, 18 bp, Homo sapiens
cttaatgacattcccctc

SEQ ID NO: 5608793 - DNA, 14 bp, Homo sapiens
cttaatgaccatgt

SEQ ID NO: 5608794 - DNA, 18 bp, Homo sapiens
cttaatgaccatgttata

SEQ ID NO: 5608795 - DNA, 15 bp, Homo sapiens
cttaatgagaacatt

SEQ ID NO: 5608796 - DNA, 21 bp, Homo sapiens
cttaatgccacggcagccacc

SEQ ID NO: 5608797 - DNA, 14 bp, Homo sapiens
cttaatgctttcct

SEQ ID NO: 5608798 - DNA, 20 bp, Homo sapiens
cttaatgctttcctccctgg

SEQ ID NO: 5608799 - DNA, 18 bp, Homo sapiens
cttaatggaaacacgaga

SEQ ID NO: 5608800 - DNA, 14 bp, Homo sapiens
cttaatggatgaaa

SEQ ID NO: 5608801 - DNA, 11 bp, Homo sapiens
cttaatggcac

SEQ ID NO: 5608802 - DNA, 20 bp, Homo sapiens
cttaatggccttaattaatt

SEQ ID NO: 5608803 - DNA, 23 bp, Homo sapiens
cttaatggtatcatattaacata

SEQ ID NO: 5608804 - DNA, 17 bp, Homo sapiens
cttaatgtaacatgttt

SEQ ID NO: 5608805 - DNA, 15 bp, Homo sapiens
cttaatgtaattcag

SEQ ID NO: 5608806 - DNA, 16 bp, Homo sapiens
cttaatgtaattcagg

SEQ ID NO: 5608807 - DNA, 15 bp, Homo sapiens
cttaatgtacatagt

SEQ ID NO: 5608808 - DNA, 19 bp, Homo sapiens
cttaatgtagttactgtga

SEQ ID NO: 5608809 - DNA, 14 bp, Homo sapiens
cttaatgtatcaaa

SEQ ID NO: 5608810 - DNA, 16 bp, Homo sapiens
cttaatgtatcaaact

SEQ ID NO: 5608811 - DNA, 23 bp, Homo sapiens
cttaatgtatcaaactgtataac

SEQ ID NO: 5608812 - DNA, 17 bp, Homo sapiens
cttaatgtatgttacca

SEQ ID NO: 5608813 - DNA, 12 bp, Homo sapiens
cttaatgtattt

SEQ ID NO: 5608814 - DNA, 13 bp, Homo sapiens
cttaatgtctggt

SEQ ID NO: 5608815 - DNA, 20 bp, Homo sapiens
cttaatgtctggtgtttgtc

SEQ ID NO: 5608816 - DNA, 22 bp, Homo sapiens
cttaatgtctggtgtttgtcat

SEQ ID NO: 5608817 - DNA, 17 bp, Homo sapiens
cttaatgtctgtcagaa

SEQ ID NO: 5608818 - DNA, 16 bp, Homo sapiens
cttaatgtctttgagc

SEQ ID NO: 5608819 - DNA, 13 bp, Homo sapiens
cttaatgttactc

SEQ ID NO: 5608820 - DNA, 13 bp, Homo sapiens
cttaatgttgaat

SEQ ID NO: 5608821 - DNA, 12 bp, Homo sapiens
cttaattaaaga

SEQ ID NO: 5608822 - DNA, 17 bp, Homo sapiens
cttaattaaagaattta

SEQ ID NO: 5608823 - DNA, 13 bp, Homo sapiens
cttaattaagtaa

SEQ ID NO: 5608824 - DNA, 15 bp, Homo sapiens
cttaattaagtaaac

SEQ ID NO: 5608825 - DNA, 15 bp, Homo sapiens
cttaattaatttgat

SEQ ID NO: 5608826 - DNA, 12 bp, Homo sapiens
cttaattactta

SEQ ID NO: 5608827 - DNA, 16 bp, Homo sapiens
cttaattacttaaaaa

SEQ ID NO: 5608828 - DNA, 22 bp, Homo sapiens
cttaattagacctaggcctcag

SEQ ID NO: 5608829 - DNA, 16 bp, Homo sapiens
cttaattataagctat

SEQ ID NO: 5608830 - DNA, 22 bp, Homo sapiens
cttaattatgctaacaaactga

SEQ ID NO: 5608831 - DNA, 14 bp, Homo sapiens
cttaattattataa

SEQ ID NO: 5608832 - DNA, 21 bp, Homo sapiens
cttaattattataaaaatatt

SEQ ID NO: 5608833 - DNA, 19 bp, Homo sapiens
cttaattattatttgtgtt

SEQ ID NO: 5608834 - DNA, 17 bp, Homo sapiens
cttaattcctttctcat

SEQ ID NO: 5608835 - DNA, 22 bp, Homo sapiens
cttaattctcattatgaagatg

SEQ ID NO: 5608836 - DNA, 17 bp, Homo sapiens
cttaattctccttccca

SEQ ID NO: 5608837 - DNA, 14 bp, Homo sapiens
cttaattctgacca

SEQ ID NO: 5608838 - DNA, 12 bp, Homo sapiens
cttaattctgat

SEQ ID NO: 5608839 - DNA, 15 bp, Homo sapiens
cttaattctgataaa

SEQ ID NO: 5608840 - DNA, 23 bp, Homo sapiens
cttaattcttacctcatttgcat

SEQ ID NO: 5608841 - DNA, 18 bp, Homo sapiens
cttaattctttgtttcct

SEQ ID NO: 5608842 - DNA, 15 bp, Homo sapiens
cttaattgactgaaa

SEQ ID NO: 5608843 - DNA, 16 bp, Homo sapiens
cttaattgactgaaat

SEQ ID NO: 5608844 - DNA, 15 bp, Homo sapiens
cttaattgcaagtct

SEQ ID NO: 5608845 - DNA, 15 bp, Homo sapiens
cttaattgcactcta

SEQ ID NO: 5608846 - DNA, 21 bp, Homo sapiens
cttaattgctttcctgcctcc

SEQ ID NO: 5608847 - DNA, 23 bp, Homo sapiens
cttaattgttcattttgagctga

SEQ ID NO: 5608848 - DNA, 12 bp, Homo sapiens
cttaatttaagt

SEQ ID NO: 5608849 - DNA, 13 bp, Homo sapiens
cttaatttactta

SEQ ID NO: 5608850 - DNA, 14 bp, Homo sapiens
cttaatttagaaac

SEQ ID NO: 5608851 - DNA, 21 bp, Homo sapiens
cttaatttagcagtccatttt

SEQ ID NO: 5608852 - DNA, 18 bp, Homo sapiens
cttaatttccttctgtta

SEQ ID NO: 5608853 - DNA, 17 bp, Homo sapiens
cttaatttcctttttga

SEQ ID NO: 5608854 - DNA, 20 bp, Homo sapiens
cttaatttcctttttgacac

SEQ ID NO: 5608855 - DNA, 17 bp, Homo sapiens
cttaatttctgcctttc

SEQ ID NO: 5608856 - DNA, 19 bp, Homo sapiens
cttaatttctgcctttccc

SEQ ID NO: 5608857 - DNA, 22 bp, Homo sapiens
cttaatttctgcctttcccccc

SEQ ID NO: 5608858 - DNA, 13 bp, Homo sapiens
cttaatttgcaca

SEQ ID NO: 5608859 - DNA, 16 bp, Homo sapiens
cttaatttggaaacta

SEQ ID NO: 5608860 - DNA, 21 bp, Homo sapiens
cttaatttggaaactaataaa

SEQ ID NO: 5608861 - DNA, 23 bp, Homo sapiens
cttaatttggaaactaataaaat

SEQ ID NO: 5608862 - DNA, 16 bp, Homo sapiens
cttaatttggataata

SEQ ID NO: 5608863 - DNA, 17 bp, Homo sapiens
cttaatttggatctatt

SEQ ID NO: 5608864 - DNA, 18 bp, Homo sapiens
cttaatttggatctattt

SEQ ID NO: 5608865 - DNA, 15 bp, Homo sapiens
cttaatttgtaaact

SEQ ID NO: 5608866 - DNA, 16 bp, Homo sapiens
cttaatttgtaaactt

SEQ ID NO: 5608867 - DNA, 18 bp, Homo sapiens
cttaatttgtaaacttct

SEQ ID NO: 5608868 - DNA, 14 bp, Homo sapiens
cttaattttacagc

SEQ ID NO: 5608869 - DNA, 18 bp, Homo sapiens
cttaattttagaaagaaa

SEQ ID NO: 5608870 - DNA, 11 bp, Homo sapiens
cttaattttgg

SEQ ID NO: 5608871 - DNA, 16 bp, Homo sapiens
cttaattttggttgta

SEQ ID NO: 5608872 - DNA, 19 bp, Homo sapiens
cttaatttttttgttgttg

SEQ ID NO: 5608873 - DNA, 19 bp, Homo sapiens
cttaatttttttttcatag

SEQ ID NO: 5608874 - DNA, 20 bp, Homo sapiens
cttaatttttttttcataga

SEQ ID NO: 5608875 - DNA, 14 bp, Homo sapiens
cttacaaaaacact

SEQ ID NO: 5608876 - DNA, 15 bp, Homo sapiens
cttacaaaaacactt

SEQ ID NO: 5608877 - DNA, 17 bp, Homo sapiens
cttacaaaagcagcttt

SEQ ID NO: 5608878 - DNA, 19 bp, Homo sapiens
cttacaaaatcctggaaga

SEQ ID NO: 5608879 - DNA, 13 bp, Homo sapiens
cttacaaaatgcc

SEQ ID NO: 5608880 - DNA, 14 bp, Homo sapiens
cttacaaaatgcca

SEQ ID NO: 5608881 - DNA, 20 bp, Homo sapiens
cttacaaactggtttgaaat

SEQ ID NO: 5608882 - DNA, 18 bp, Homo sapiens
cttacaaagaaagcactt

SEQ ID NO: 5608883 - DNA, 17 bp, Homo sapiens
cttacaaagccttacac

SEQ ID NO: 5608884 - DNA, 18 bp, Homo sapiens
cttacaaagccttacaca

SEQ ID NO: 5608885 - DNA, 21 bp, Homo sapiens
cttacaaagccttacacaggg

SEQ ID NO: 5608886 - DNA, 23 bp, Homo sapiens
cttacaaagggaaagcctctggc

SEQ ID NO: 5608887 - DNA, 18 bp, Homo sapiens
cttacaaccacatttctg

SEQ ID NO: 5608888 - DNA, 18 bp, Homo sapiens
cttacaactgactgactt

SEQ ID NO: 5608889 - DNA, 18 bp, Homo sapiens
cttacaagaaaggcctga

SEQ ID NO: 5608890 - DNA, 14 bp, Homo sapiens
cttacaagacctct

SEQ ID NO: 5608891 - DNA, 20 bp, Homo sapiens
cttacaagaggattgtaaaa

SEQ ID NO: 5608892 - DNA, 17 bp, Homo sapiens
cttacaagcttaaagct

SEQ ID NO: 5608893 - DNA, 19 bp, Homo sapiens
cttacaagcttaaagcttg

SEQ ID NO: 5608894 - DNA, 20 bp, Homo sapiens
cttacaagcttaaagcttga

SEQ ID NO: 5608895 - DNA, 23 bp, Homo sapiens
cttacaaggcaggcctttcctac

SEQ ID NO: 5608896 - DNA, 15 bp, Homo sapiens
cttacaatattgatt

SEQ ID NO: 5608897 - DNA, 14 bp, Homo sapiens
cttacaatctttat

SEQ ID NO: 5608898 - DNA, 20 bp, Homo sapiens
cttacaatgtgcactgaatc

SEQ ID NO: 5608899 - DNA, 19 bp, Homo sapiens
cttacaattccctgctgtc

SEQ ID NO: 5608900 - DNA, 20 bp, Homo sapiens
cttacaattgcactgctgtt

SEQ ID NO: 5608901 - DNA, 20 bp, Homo sapiens
cttacaatttttttaatttt

SEQ ID NO: 5608902 - DNA, 20 bp, Homo sapiens
cttacacaagactttcccca

SEQ ID NO: 5608903 - DNA, 13 bp, Homo sapiens
cttacacaatggt

SEQ ID NO: 5608904 - DNA, 17 bp, Homo sapiens
cttacacattaagcaaa

SEQ ID NO: 5608905 - DNA, 15 bp, Homo sapiens
cttacaccagtttga

SEQ ID NO: 5608906 - DNA, 11 bp, Homo sapiens
cttacacccac

SEQ ID NO: 5608907 - DNA, 19 bp, Homo sapiens
cttacaccgtgaggccaag

SEQ ID NO: 5608908 - DNA, 20 bp, Homo sapiens
cttacacctcgttagggaag

SEQ ID NO: 5608909 - DNA, 16 bp, Homo sapiens
cttacacgaagaaata

SEQ ID NO: 5608910 - DNA, 21 bp, Homo sapiens
cttacacgaagaaatagaata

SEQ ID NO: 5608911 - DNA, 16 bp, Homo sapiens
cttacactgaaatcca

SEQ ID NO: 5608912 - DNA, 19 bp, Homo sapiens
cttacactgcctgtatact

SEQ ID NO: 5608913 - DNA, 14 bp, Homo sapiens
cttacacttataaa

SEQ ID NO: 5608914 - DNA, 15 bp, Homo sapiens
cttacagaaatgact

SEQ ID NO: 5608915 - DNA, 18 bp, Homo sapiens
cttacagaaccaattcac

SEQ ID NO: 5608916 - DNA, 22 bp, Homo sapiens
cttacagaaccaattcacttta

SEQ ID NO: 5608917 - DNA, 18 bp, Homo sapiens
cttacagcaaatcctttg

SEQ ID NO: 5608918 - DNA, 20 bp, Homo sapiens
cttacagcacatcacctctt

SEQ ID NO: 5608919 - DNA, 12 bp, Homo sapiens
cttacagcaggc

SEQ ID NO: 5608920 - DNA, 16 bp, Homo sapiens
cttacagcctctgact

SEQ ID NO: 5608921 - DNA, 18 bp, Homo sapiens
cttataaatcatattgat

SEQ ID NO: 5608922 - DNA, 12 bp, Homo sapiens
cttataaatgtg

SEQ ID NO: 5608923 - DNA, 14 bp, Homo sapiens
cttataaatgtgta

SEQ ID NO: 5608924 - DNA, 22 bp, Homo sapiens
cttataaatgtgtattctggct

SEQ ID NO: 5608925 - DNA, 19 bp, Homo sapiens
cttataaattctgttagct

SEQ ID NO: 5608926 - DNA, 13 bp, Homo sapiens
cttataaatttca

SEQ ID NO: 5608927 - DNA, 14 bp, Homo sapiens
cttataacattgta

SEQ ID NO: 5608928 - DNA, 15 bp, Homo sapiens
cttataacattgtat

SEQ ID NO: 5608929 - DNA, 15 bp, Homo sapiens
cttataactgtctgt

SEQ ID NO: 5608930 - DNA, 13 bp, Homo sapiens
cttataacttctg

SEQ ID NO: 5608931 - DNA, 17 bp, Homo sapiens
cttataagcaacatgaa

SEQ ID NO: 5608932 - DNA, 17 bp, Homo sapiens
cttataaggtgttttct

SEQ ID NO: 5608933 - DNA, 20 bp, Homo sapiens
cttataaggtgttttctgtg

SEQ ID NO: 5608934 - DNA, 22 bp, Homo sapiens
cttataaggtgttttctgtgta

SEQ ID NO: 5608935 - DNA, 20 bp, Homo sapiens
cttataaggttcgtattgct

SEQ ID NO: 5608936 - DNA, 23 bp, Homo sapiens
cttataagttaaaacaaaggaac

SEQ ID NO: 5608937 - DNA, 16 bp, Homo sapiens
cttataataaaggact

SEQ ID NO: 5608938 - DNA, 16 bp, Homo sapiens
cttataatactctgtt

SEQ ID NO: 5608939 - DNA, 22 bp, Homo sapiens
cttataatctcctctaaaacaa

SEQ ID NO: 5608940 - DNA, 19 bp, Homo sapiens
cttataatgaaatctgttt

SEQ ID NO: 5608941 - DNA, 13 bp, Homo sapiens
cttataatgatta

SEQ ID NO: 5608942 - DNA, 21 bp, Homo sapiens
cttataatgtgtgttgtgtga

SEQ ID NO: 5608943 - DNA, 21 bp, Homo sapiens
cttataattgttctcagaatc

SEQ ID NO: 5608944 - DNA, 14 bp, Homo sapiens
cttataatttccaa

SEQ ID NO: 5608945 - DNA, 17 bp, Homo sapiens
cttatacaaatttaact

SEQ ID NO: 5608946 - DNA, 15 bp, Homo sapiens
cttatacatttgata

SEQ ID NO: 5608947 - DNA, 23 bp, Homo sapiens
cttatacccccattaaattcact

SEQ ID NO: 5608948 - DNA, 16 bp, Homo sapiens
cttatacgaaataatt

SEQ ID NO: 5608949 - DNA, 17 bp, Homo sapiens
cttatacgaaataattg

SEQ ID NO: 5608950 - DNA, 18 bp, Homo sapiens
cttatacgaaataattgt

SEQ ID NO: 5608951 - DNA, 19 bp, Homo sapiens
cttatactgtacaataaaa

SEQ ID NO: 5608952 - DNA, 16 bp, Homo sapiens
cttatactgtatatga

SEQ ID NO: 5608953 - DNA, 17 bp, Homo sapiens
cttatacttttctcaat

SEQ ID NO: 5608954 - DNA, 18 bp, Homo sapiens
cttatagaagcttcagca

SEQ ID NO: 5608955 - DNA, 12 bp, Homo sapiens
cttatagaataa

SEQ ID NO: 5608956 - DNA, 17 bp, Homo sapiens
cttatagaataaaagct

SEQ ID NO: 5608957 - DNA, 21 bp, Homo sapiens
cttatagaataaaagctataa

SEQ ID NO: 5608958 - DNA, 23 bp, Homo sapiens
cttatagaataaaagctgtggaa

SEQ ID NO: 5608959 - DNA, 16 bp, Homo sapiens
cttatagaatatttat

SEQ ID NO: 5608960 - DNA, 12 bp, Homo sapiens
cttatagagcac

SEQ ID NO: 5608961 - DNA, 12 bp, Homo sapiens
cttatagatgca

SEQ ID NO: 5608962 - DNA, 19 bp, Homo sapiens
cttatagatgcaaagtatt

SEQ ID NO: 5608963 - DNA, 21 bp, Homo sapiens
cttatagattttttaaaaaaa

SEQ ID NO: 5608964 - DNA, 13 bp, Homo sapiens
cttatagcaagaa

SEQ ID NO: 5608965 - DNA, 22 bp, Homo sapiens
cttatagcactttgaaatacct

SEQ ID NO: 5608966 - DNA, 16 bp, Homo sapiens
cttatagcctctgtct

SEQ ID NO: 5608967 - DNA, 21 bp, Homo sapiens
cttataggaaagcttgagtaa

SEQ ID NO: 5608968 - DNA, 19 bp, Homo sapiens
cttataggaattgacccac

SEQ ID NO: 5608969 - DNA, 17 bp, Homo sapiens
cttatagggaaaaatgc

SEQ ID NO: 5608970 - DNA, 17 bp, Homo sapiens
cttataggtaacgtgat

SEQ ID NO: 5608971 - DNA, 13 bp, Homo sapiens
cttataggtggcc

SEQ ID NO: 5608972 - DNA, 19 bp, Homo sapiens
cttatagtacatgataaat

SEQ ID NO: 5608973 - DNA, 23 bp, Homo sapiens
cttatagtcaatgtttcttttat

SEQ ID NO: 5608974 - DNA, 22 bp, Homo sapiens
cttatagtgtttggacagctga

SEQ ID NO: 5608975 - DNA, 15 bp, Homo sapiens
cttatagttactgtg

SEQ ID NO: 5608976 - DNA, 21 bp, Homo sapiens
cttatagttactgtgtaatta

SEQ ID NO: 5608977 - DNA, 16 bp, Homo sapiens
cttatagtttgggctt

SEQ ID NO: 5608978 - DNA, 17 bp, Homo sapiens
cttatataaaatagact

SEQ ID NO: 5608979 - DNA, 15 bp, Homo sapiens
cttatataattgcca

SEQ ID NO: 5608980 - DNA, 19 bp, Homo sapiens
cttatatagcagcaaaaat

SEQ ID NO: 5608981 - DNA, 13 bp, Homo sapiens
cttatatataata

SEQ ID NO: 5608982 - DNA, 23 bp, Homo sapiens
cttatatatgcacttaatttgtt

SEQ ID NO: 5608983 - DNA, 21 bp, Homo sapiens
cttatatcatcagcatacctt

SEQ ID NO: 5608984 - DNA, 20 bp, Homo sapiens
cttatatctaaatctgtcca

SEQ ID NO: 5608985 - DNA, 19 bp, Homo sapiens
cttatatctatattttaca

SEQ ID NO: 5608986 - DNA, 15 bp, Homo sapiens
cttatatctgaagat

SEQ ID NO: 5608987 - DNA, 18 bp, Homo sapiens
cttatatgccagaatgta

SEQ ID NO: 5608988 - DNA, 14 bp, Homo sapiens
cttatatgtccttg

SEQ ID NO: 5608989 - DNA, 22 bp, Homo sapiens
cttatatgtccttgggttgctg

SEQ ID NO: 5608990 - DNA, 19 bp, Homo sapiens
cttatattcaaccatggac

SEQ ID NO: 5608991 - DNA, 13 bp, Homo sapiens
cttatattctgca

SEQ ID NO: 5608992 - DNA, 16 bp, Homo sapiens
cttatattgaagacaa

SEQ ID NO: 5608993 - DNA, 16 bp, Homo sapiens
cttatattgttcactt

SEQ ID NO: 5608994 - DNA, 17 bp, Homo sapiens
cttatatttacaataaa

SEQ ID NO: 5608995 - DNA, 19 bp, Homo sapiens
cttatatttacaataaatg

SEQ ID NO: 5608996 - DNA, 18 bp, Homo sapiens
cttatatttctgtgtaca

SEQ ID NO: 5608997 - DNA, 16 bp, Homo sapiens
cttatattttatgaac

SEQ ID NO: 5608998 - DNA, 16 bp, Homo sapiens
cttatcaaaggacacc

SEQ ID NO: 5608999 - DNA, 19 bp, Homo sapiens
cttatcaagagttgtgaca

SEQ ID NO: 5609000 - DNA, 11 bp, Homo sapiens
cttatcaagtg

SEQ ID NO: 5609001 - DNA, 17 bp, Homo sapiens
cttatcaagtgtcttcc

SEQ ID NO: 5609002 - DNA, 21 bp, Homo sapiens
cttatcaatttgtcattttga

SEQ ID NO: 5609003 - DNA, 17 bp, Homo sapiens
cttatcacacttgcaaa

SEQ ID NO: 5609004 - DNA, 22 bp, Homo sapiens
cttatcacacttgcaaatgaat

SEQ ID NO: 5609005 - DNA, 23 bp, Homo sapiens
cttatcagctacttaagagaaat

SEQ ID NO: 5609006 - DNA, 17 bp, Homo sapiens
cttatcagtttgctaat

SEQ ID NO: 5609007 - DNA, 20 bp, Homo sapiens
cttatcatgctgtctttaca

SEQ ID NO: 5609008 - DNA, 15 bp, Homo sapiens
cttatcattcattct

SEQ ID NO: 5609009 - DNA, 14 bp, Homo sapiens
cttatcatttttgt

SEQ ID NO: 5609010 - DNA, 21 bp, Homo sapiens
cttatccacgagagcgcagca

SEQ ID NO: 5609011 - DNA, 19 bp, Homo sapiens
cttatccaggactctgtca

SEQ ID NO: 5609012 - DNA, 13 bp, Homo sapiens
cttatccaggttg

SEQ ID NO: 5609013 - DNA, 21 bp, Homo sapiens
cttatccaggttggttttgct

SEQ ID NO: 5609014 - DNA, 23 bp, Homo sapiens
cttatccaggttggttttgctgt

SEQ ID NO: 5609015 - DNA, 21 bp, Homo sapiens
cttatccataaaaaaaaatag

SEQ ID NO: 5609016 - DNA, 14 bp, Homo sapiens
cttatccctctctt

SEQ ID NO: 5609017 - DNA, 15 bp, Homo sapiens
cttatccctctcttc

SEQ ID NO: 5609018 - DNA, 16 bp, Homo sapiens
cttatccctctcttcc

SEQ ID NO: 5609019 - DNA, 16 bp, Homo sapiens
cttatccctgcccatt

SEQ ID NO: 5609020 - DNA, 23 bp, Homo sapiens
cttatcctctctctcttctaggc

SEQ ID NO: 5609021 - DNA, 14 bp, Homo sapiens
cttatcctgcattg

SEQ ID NO: 5609022 - DNA, 19 bp, Homo sapiens
cttatccttcatcttttaa

SEQ ID NO: 5609023 - DNA, 22 bp, Homo sapiens
cttatccttcatcttttaaaga

SEQ ID NO: 5609024 - DNA, 21 bp, Homo sapiens
cttatccttccacggactcaa

SEQ ID NO: 5609025 - DNA, 16 bp, Homo sapiens
cttatcgggctccagc

SEQ ID NO: 5609026 - DNA, 23 bp, Homo sapiens
cttatctaatcatgaaactccct

SEQ ID NO: 5609027 - DNA, 18 bp, Homo sapiens
cttatctacttccaaact

SEQ ID NO: 5609028 - DNA, 17 bp, Homo sapiens
cttatctagccaaagag

SEQ ID NO: 5609029 - DNA, 14 bp, Homo sapiens
cttatctataaaag

SEQ ID NO: 5609030 - DNA, 22 bp, Homo sapiens
cttatctatatccataacctct

SEQ ID NO: 5609031 - DNA, 15 bp, Homo sapiens
cttatctcagatatt

SEQ ID NO: 5609032 - DNA, 22 bp, Homo sapiens
cttatctcagtcatgcataaat

SEQ ID NO: 5609033 - DNA, 18 bp, Homo sapiens
cttatctcatcctttcct

SEQ ID NO: 5609034 - DNA, 14 bp, Homo sapiens
cttatctcatttct

SEQ ID NO: 5609035 - DNA, 13 bp, Homo sapiens
cttatctccaaga

SEQ ID NO: 5609036 - DNA, 16 bp, Homo sapiens
cttatctccaagacca

SEQ ID NO: 5609037 - DNA, 22 bp, Homo sapiens
cttatctctagctcagacatct

SEQ ID NO: 5609038 - DNA, 13 bp, Homo sapiens
cttatctctctgt

SEQ ID NO: 5609039 - DNA, 15 bp, Homo sapiens
cttatctctctgtgc

SEQ ID NO: 5609040 - DNA, 21 bp, Homo sapiens
cttatctctctgtgctgtgga

SEQ ID NO: 5609041 - DNA, 22 bp, Homo sapiens
cttatctgatcagaacaaatgt

SEQ ID NO: 5609042 - DNA, 13 bp, Homo sapiens
cttatctgcccct

SEQ ID NO: 5609043 - DNA, 19 bp, Homo sapiens
cttatctgcccctccccca

SEQ ID NO: 5609044 - DNA, 20 bp, Homo sapiens
cttatctgcccctcccccac

SEQ ID NO: 5609045 - DNA, 22 bp, Homo sapiens
cttatctgtgctcaggactcag

SEQ ID NO: 5609046 - DNA, 14 bp, Homo sapiens
cttatcttatgcca

SEQ ID NO: 5609047 - DNA, 15 bp, Homo sapiens
cttatcttgaaaaga

SEQ ID NO: 5609048 - DNA, 22 bp, Homo sapiens
cttatcttgaccatactaataa

SEQ ID NO: 5609049 - DNA, 14 bp, Homo sapiens
cttatctttctttc

SEQ ID NO: 5609050 - DNA, 17 bp, Homo sapiens
cttatcttttacttttt

SEQ ID NO: 5609051 - DNA, 23 bp, Homo sapiens
cttatcttttactttttttctgt

SEQ ID NO: 5609052 - DNA, 18 bp, Homo sapiens
cttatgaaaagaattgtt

SEQ ID NO: 5609053 - DNA, 15 bp, Homo sapiens
cttatgaaaagtact

SEQ ID NO: 5609054 - DNA, 19 bp, Homo sapiens
cttatgaaaagtactaata

SEQ ID NO: 5609055 - DNA, 20 bp, Homo sapiens
cttatgaaaagtactaatag

SEQ ID NO: 5609056 - DNA, 15 bp, Homo sapiens
cttatgaaaattata

SEQ ID NO: 5609057 - DNA, 12 bp, Homo sapiens
cttatgaaatgg

SEQ ID NO: 5609058 - DNA, 17 bp, Homo sapiens
cttatgaaatgggcttt

SEQ ID NO: 5609059 - DNA, 13 bp, Homo sapiens
cttatgaaatgtg

SEQ ID NO: 5609060 - DNA, 15 bp, Homo sapiens
cttatgaatagacat

SEQ ID NO: 5609061 - DNA, 18 bp, Homo sapiens
cttatgaatagacataaa

SEQ ID NO: 5609062 - DNA, 19 bp, Homo sapiens
cttatgaatagacataaat

SEQ ID NO: 5609063 - DNA, 23 bp, Homo sapiens
cttatgaatagacataaattgta

SEQ ID NO: 5609064 - DNA, 20 bp, Homo sapiens
cttatgaatgatttgcatat

SEQ ID NO: 5609065 - DNA, 14 bp, Homo sapiens
cttatgaatgtttc

SEQ ID NO: 5609066 - DNA, 21 bp, Homo sapiens
cttatgacatcacttgtacaa

SEQ ID NO: 5609067 - DNA, 20 bp, Homo sapiens
cttatgagactcttaaatat

SEQ ID NO: 5609068 - DNA, 20 bp, Homo sapiens
cttatgagatctaatgtgaa

SEQ ID NO: 5609069 - DNA, 13 bp, Homo sapiens
cttatgagatggg

SEQ ID NO: 5609070 - DNA, 19 bp, Homo sapiens
cttatgagcgtcactgccc

SEQ ID NO: 5609071 - DNA, 14 bp, Homo sapiens
cttatgaggagggg

SEQ ID NO: 5609072 - DNA, 15 bp, Homo sapiens
cttatgaggagggga

SEQ ID NO: 5609073 - DNA, 20 bp, Homo sapiens
cttatgagggtcctctactt

SEQ ID NO: 5609074 - DNA, 22 bp, Homo sapiens
cttatgagtataatgaacactc

SEQ ID NO: 5609075 - DNA, 22 bp, Homo sapiens
cttatgatacttgaggtaccag

SEQ ID NO: 5609076 - DNA, 23 bp, Homo sapiens
cttatgatattctcattatttca

SEQ ID NO: 5609077 - DNA, 17 bp, Homo sapiens
cttatgatgttttccct

SEQ ID NO: 5609078 - DNA, 18 bp, Homo sapiens
cttatgatgttttccctt

SEQ ID NO: 5609079 - DNA, 20 bp, Homo sapiens
cttatgattaaacttccttc

SEQ ID NO: 5609080 - DNA, 16 bp, Homo sapiens
cttatgattttattac

SEQ ID NO: 5609081 - DNA, 17 bp, Homo sapiens
cttatgattttattaca

SEQ ID NO: 5609082 - DNA, 16 bp, Homo sapiens
cttatgcaaaactttt

SEQ ID NO: 5609083 - DNA, 16 bp, Homo sapiens
cttatgcaaaatggaa

SEQ ID NO: 5609084 - DNA, 20 bp, Homo sapiens
cttatgcaggacatgtgctc

SEQ ID NO: 5609085 - DNA, 16 bp, Homo sapiens
cttatgcggttaattt

SEQ ID NO: 5609086 - DNA, 15 bp, Homo sapiens
cttatgctacacaga

SEQ ID NO: 5609087 - DNA, 12 bp, Homo sapiens
cttatgctctta

SEQ ID NO: 5609088 - DNA, 15 bp, Homo sapiens
cttatgctcttaatt

SEQ ID NO: 5609089 - DNA, 15 bp, Homo sapiens
cttatgcttaaaatg

SEQ ID NO: 5609090 - DNA, 18 bp, Homo sapiens
cttatgcttaaaatgcca

SEQ ID NO: 5609091 - DNA, 16 bp, Homo sapiens
cttatgcttccagaaa

SEQ ID NO: 5609092 - DNA, 21 bp, Homo sapiens
cttatggaacactctgagact

SEQ ID NO: 5609093 - DNA, 20 bp, Homo sapiens
cttatggaattgatttgcat

SEQ ID NO: 5609094 - DNA, 23 bp, Homo sapiens
cttatggaattgatttgcattga

SEQ ID NO: 5609095 - DNA, 16 bp, Homo sapiens
cttatggagtgtgcct

SEQ ID NO: 5609096 - DNA, 20 bp, Homo sapiens
cttatggatgtccccagcag

SEQ ID NO: 5609097 - DNA, 17 bp, Homo sapiens
cttatggcacaaaaaat

SEQ ID NO: 5609098 - DNA, 11 bp, Homo sapiens
cttcagagagc

SEQ ID NO: 5609099 - DNA, 18 bp, Homo sapiens
cttcagagagcagtgctt

SEQ ID NO: 5609100 - DNA, 20 bp, Homo sapiens
cttcagagagcagtgctttt

SEQ ID NO: 5609101 - DNA, 16 bp, Homo sapiens
cttcagagagctggta

SEQ ID NO: 5609102 - DNA, 18 bp, Homo sapiens
cttcagagataggcctgt

SEQ ID NO: 5609103 - DNA, 12 bp, Homo sapiens
cttcagagccta

SEQ ID NO: 5609104 - DNA, 14 bp, Homo sapiens
cttcagagcctagc

SEQ ID NO: 5609105 - DNA, 11 bp, Homo sapiens
cttcagagctc

SEQ ID NO: 5609106 - DNA, 14 bp, Homo sapiens
cttcagagctgaca

SEQ ID NO: 5609107 - DNA, 18 bp, Homo sapiens
cttcagagctgacacagg

SEQ ID NO: 5609108 - DNA, 21 bp, Homo sapiens
cttcagaggagcatcagctgt

SEQ ID NO: 5609109 - DNA, 23 bp, Homo sapiens
cttcagaggccctcgctgccagc

SEQ ID NO: 5609110 - DNA, 20 bp, Homo sapiens
cttcagaggctcatctaact

SEQ ID NO: 5609111 - DNA, 19 bp, Homo sapiens
cttcagagggtttggacca

SEQ ID NO: 5609112 - DNA, 22 bp, Homo sapiens
cttcagaggtctaatttagtag

SEQ ID NO: 5609113 - DNA, 18 bp, Homo sapiens
cttcagagtacgtcctgc

SEQ ID NO: 5609114 - DNA, 22 bp, Homo sapiens
cttcagagtacgtcctgcctgg

SEQ ID NO: 5609115 - DNA, 18 bp, Homo sapiens
cttcagagtccgccagtg

SEQ ID NO: 5609116 - DNA, 19 bp, Homo sapiens
cttcagagtgaagaatctt

SEQ ID NO: 5609117 - DNA, 21 bp, Homo sapiens
cttcagagtttgtgtgtattt

SEQ ID NO: 5609118 - DNA, 16 bp, Homo sapiens
cttcagatattttgca

SEQ ID NO: 5609119 - DNA, 17 bp, Homo sapiens
cttcagatattttgcac

SEQ ID NO: 5609120 - DNA, 14 bp, Homo sapiens
cttcagatcctgct

SEQ ID NO: 5609121 - DNA, 18 bp, Homo sapiens
cttcagatcctgctgccg

SEQ ID NO: 5609122 - DNA, 21 bp, Homo sapiens
cttcagatgggaggaaagaga

SEQ ID NO: 5609123 - DNA, 21 bp, Homo sapiens
cttcagatgtggagccaggcg

SEQ ID NO: 5609124 - DNA, 19 bp, Homo sapiens
cttcagatgtttccaagat

SEQ ID NO: 5609125 - DNA, 14 bp, Homo sapiens
cttcagattattaa

SEQ ID NO: 5609126 - DNA, 16 bp, Homo sapiens
cttcagattattaaaa

SEQ ID NO: 5609127 - DNA, 17 bp, Homo sapiens
cttcagattattaaaat

SEQ ID NO: 5609128 - DNA, 11 bp, Homo sapiens
cttcagatttc

SEQ ID NO: 5609129 - DNA, 14 bp, Homo sapiens
cttcagatttcaaa

SEQ ID NO: 5609130 - DNA, 16 bp, Homo sapiens
cttcagatttcaaatt

SEQ ID NO: 5609131 - DNA, 18 bp, Homo sapiens
cttcagatttgtgttata

SEQ ID NO: 5609132 - DNA, 20 bp, Homo sapiens
cttcagcaaaaatattttat

SEQ ID NO: 5609133 - DNA, 13 bp, Homo sapiens
cttcagcaaccct

SEQ ID NO: 5609134 - DNA, 23 bp, Homo sapiens
cttcagcaaccctacagtatata

SEQ ID NO: 5609135 - DNA, 13 bp, Homo sapiens
cttcagcacttta

SEQ ID NO: 5609136 - DNA, 15 bp, Homo sapiens
cttcagcactttaga

SEQ ID NO: 5609137 - DNA, 16 bp, Homo sapiens
cttcagcactttagaa

SEQ ID NO: 5609138 - DNA, 18 bp, Homo sapiens
cttcagcagcatctactc

SEQ ID NO: 5609139 - DNA, 13 bp, Homo sapiens
cttcagcaggaag

SEQ ID NO: 5609140 - DNA, 21 bp, Homo sapiens
cttcagcaggggtgggaggct

SEQ ID NO: 5609141 - DNA, 21 bp, Homo sapiens
cttcagcagtacctataaagt

SEQ ID NO: 5609142 - DNA, 14 bp, Homo sapiens
cttcagccaagacc

SEQ ID NO: 5609143 - DNA, 16 bp, Homo sapiens
cttcagccaagaccat

SEQ ID NO: 5609144 - DNA, 22 bp, Homo sapiens
cttcagccaccctttctggcac

SEQ ID NO: 5609145 - DNA, 23 bp, Homo sapiens
cttcagccaccctttctggcacg

SEQ ID NO: 5609146 - DNA, 15 bp, Homo sapiens
cttcagccacctctc

SEQ ID NO: 5609147 - DNA, 15 bp, Homo sapiens
cttcagccaggagct

SEQ ID NO: 5609148 - DNA, 15 bp, Homo sapiens
cttcagccaggcaag

SEQ ID NO: 5609149 - DNA, 18 bp, Homo sapiens
cttcagccaggtctgact

SEQ ID NO: 5609150 - DNA, 22 bp, Homo sapiens
cttcagccaggtctgactccaa

SEQ ID NO: 5609151 - DNA, 18 bp, Homo sapiens
cttcagcccaccaccctg

SEQ ID NO: 5609152 - DNA, 22 bp, Homo sapiens
cttcagcccaggcttttgctag

SEQ ID NO: 5609153 - DNA, 15 bp, Homo sapiens
cttcagcccccacca

SEQ ID NO: 5609154 - DNA, 15 bp, Homo sapiens
cttcagcccccagcc

SEQ ID NO: 5609155 - DNA, 18 bp, Homo sapiens
cttcagcccccagcccct

SEQ ID NO: 5609156 - DNA, 20 bp, Homo sapiens
cttcagcccccagcccctcc

SEQ ID NO: 5609157 - DNA, 13 bp, Homo sapiens
cttcagccctggc

SEQ ID NO: 5609158 - DNA, 21 bp, Homo sapiens
cttcagcctagccgacctcag

SEQ ID NO: 5609159 - DNA, 16 bp, Homo sapiens
cttcagcctagtggct

SEQ ID NO: 5609160 - DNA, 14 bp, Homo sapiens
cttcagcctcccga

SEQ ID NO: 5609161 - DNA, 16 bp, Homo sapiens
cttcagcctcccgagt

SEQ ID NO: 5609162 - DNA, 15 bp, Homo sapiens
cttcagcctgaggct

SEQ ID NO: 5609163 - DNA, 16 bp, Homo sapiens
cttcagcctgaggctg

SEQ ID NO: 5609164 - DNA, 22 bp, Homo sapiens
cttcagcctgctgggcagccag

SEQ ID NO: 5609165 - DNA, 23 bp, Homo sapiens
cttcagcggatttggggattagg

SEQ ID NO: 5609166 - DNA, 18 bp, Homo sapiens
cttcagcggtttatataa

SEQ ID NO: 5609167 - DNA, 21 bp, Homo sapiens
cttcagctagcttttaggaaa

SEQ ID NO: 5609168 - DNA, 15 bp, Homo sapiens
cttcagctccaggga

SEQ ID NO: 5609169 - DNA, 11 bp, Homo sapiens
cttcagctccc

SEQ ID NO: 5609170 - DNA, 13 bp, Homo sapiens
cttcagctcccat

SEQ ID NO: 5609171 - DNA, 22 bp, Homo sapiens
cttcagctcccatagcgctggc

SEQ ID NO: 5609172 - DNA, 12 bp, Homo sapiens
cttcagctcctg

SEQ ID NO: 5609173 - DNA, 13 bp, Homo sapiens
cttcagctcctga

SEQ ID NO: 5609174 - DNA, 23 bp, Homo sapiens
cttcagctcctgagtagctgggc

SEQ ID NO: 5609175 - DNA, 22 bp, Homo sapiens
cttcagctctggggcagaggaa

SEQ ID NO: 5609176 - DNA, 15 bp, Homo sapiens
cttcagctctttttg

SEQ ID NO: 5609177 - DNA, 19 bp, Homo sapiens
cttcagctgacttttctgt

SEQ ID NO: 5609178 - DNA, 13 bp, Homo sapiens
cttcagctgcctg

SEQ ID NO: 5609179 - DNA, 19 bp, Homo sapiens
cttcagctgtacttcgtct

SEQ ID NO: 5609180 - DNA, 15 bp, Homo sapiens
cttcagctgttgcag

SEQ ID NO: 5609181 - DNA, 19 bp, Homo sapiens
cttcagctgtttcgcatcc

SEQ ID NO: 5609182 - DNA, 22 bp, Homo sapiens
cttcagctttatttttctttaa

SEQ ID NO: 5609183 - DNA, 17 bp, Homo sapiens
cttcagctttggatgtg

SEQ ID NO: 5609184 - DNA, 21 bp, Homo sapiens
cttcagctttggatgtggtta

SEQ ID NO: 5609185 - DNA, 14 bp, Homo sapiens
cttcagctttggtg

SEQ ID NO: 5609186 - DNA, 14 bp, Homo sapiens
cttcagctttgtgt

SEQ ID NO: 5609187 - DNA, 16 bp, Homo sapiens
cttcagctttgtgtat

SEQ ID NO: 5609188 - DNA, 16 bp, Homo sapiens
cttcaggaaaataaat

SEQ ID NO: 5609189 - DNA, 23 bp, Homo sapiens
cttcaggaacacccccatgacat

SEQ ID NO: 5609190 - DNA, 16 bp, Homo sapiens
cttcaggacccttcta

SEQ ID NO: 5609191 - DNA, 19 bp, Homo sapiens
cttcaggacccttctactt

SEQ ID NO: 5609192 - DNA, 13 bp, Homo sapiens
cttcaggactctg

SEQ ID NO: 5609193 - DNA, 18 bp, Homo sapiens
cttcaggagcctggccag

SEQ ID NO: 5609194 - DNA, 23 bp, Homo sapiens
cttcaggagcctggccaggcagg

SEQ ID NO: 5609195 - DNA, 19 bp, Homo sapiens
cttcaggagtttcatgttg

SEQ ID NO: 5609196 - DNA, 21 bp, Homo sapiens
cttcaggatattggttcttcc

SEQ ID NO: 5609197 - DNA, 23 bp, Homo sapiens
cttcaggatattggttcttcccc

SEQ ID NO: 5609198 - DNA, 17 bp, Homo sapiens
cttcaggatcaagtcct

SEQ ID NO: 5609199 - DNA, 21 bp, Homo sapiens
cttcaggatgcacggtttctg

SEQ ID NO: 5609200 - DNA, 22 bp, Homo sapiens
cttcaggatgcacggtttctgt

SEQ ID NO: 5609201 - DNA, 16 bp, Homo sapiens
cttcaggcaattctcc

SEQ ID NO: 5609202 - DNA, 16 bp, Homo sapiens
cttcaggcaccacaga

SEQ ID NO: 5609203 - DNA, 19 bp, Homo sapiens
cttcaggcaccagcatcca

SEQ ID NO: 5609204 - DNA, 18 bp, Homo sapiens
cttcaggcagctgaaatt

SEQ ID NO: 5609205 - DNA, 21 bp, Homo sapiens
cttcaggcatggggggtgggg

SEQ ID NO: 5609206 - DNA, 17 bp, Homo sapiens
cttcaggccaggtagca

SEQ ID NO: 5609207 - DNA, 17 bp, Homo sapiens
cttcaggcccgctgccc

SEQ ID NO: 5609208 - DNA, 12 bp, Homo sapiens
cttcaggcctcc

SEQ ID NO: 5609209 - DNA, 19 bp, Homo sapiens
cttcaggccttgcctggga

SEQ ID NO: 5609210 - DNA, 16 bp, Homo sapiens
cttcaggctcttctcc

SEQ ID NO: 5609211 - DNA, 17 bp, Homo sapiens
cttcaggctcttctcct

SEQ ID NO: 5609212 - DNA, 17 bp, Homo sapiens
cttcagggagtcagctg

SEQ ID NO: 5609213 - DNA, 17 bp, Homo sapiens
cttcagggattccctgt

SEQ ID NO: 5609214 - DNA, 22 bp, Homo sapiens
cttcagggattccctgtcccca

SEQ ID NO: 5609215 - DNA, 9 bp, Homo sapiens
cttcagggc

SEQ ID NO: 5609216 - DNA, 17 bp, Homo sapiens
cttcagggcagatttta

SEQ ID NO: 5609217 - DNA, 18 bp, Homo sapiens
cttcagggcagggctctg

SEQ ID NO: 5609218 - DNA, 16 bp, Homo sapiens
cttcagggcaggtggg

SEQ ID NO: 5609219 - DNA, 21 bp, Homo sapiens
cttcagggccagaaggagggc

SEQ ID NO: 5609220 - DNA, 23 bp, Homo sapiens
cttcagggccagaaggagggcag

SEQ ID NO: 5609221 - DNA, 13 bp, Homo sapiens
cttcagggcctgg

SEQ ID NO: 5609222 - DNA, 19 bp, Homo sapiens
cttcagggctgagttctgg

SEQ ID NO: 5609223 - DNA, 16 bp, Homo sapiens
cttcagggctgctggg

SEQ ID NO: 5609224 - DNA, 16 bp, Homo sapiens
cttcagggctgggcag

SEQ ID NO: 5609225 - DNA, 18 bp, Homo sapiens
cttcaggggaagagaaga

SEQ ID NO: 5609226 - DNA, 18 bp, Homo sapiens
cttcaggggctgcccgct

SEQ ID NO: 5609227 - DNA, 23 bp, Homo sapiens
cttcaggggctgcccgctcccag

SEQ ID NO: 5609228 - DNA, 15 bp, Homo sapiens
cttcagggggccagg

SEQ ID NO: 5609229 - DNA, 23 bp, Homo sapiens
cttcagggggccaggtgcacaga

SEQ ID NO: 5609230 - DNA, 16 bp, Homo sapiens
cttcagggtaaactag

SEQ ID NO: 5609231 - DNA, 21 bp, Homo sapiens
cttcagggtaaactagcaatg

SEQ ID NO: 5609232 - DNA, 20 bp, Homo sapiens
cttcagggtatcccagaccc

SEQ ID NO: 5609233 - DNA, 19 bp, Homo sapiens
cttcagggttctaaccttt

SEQ ID NO: 5609234 - DNA, 14 bp, Homo sapiens
cttcagggttctcc

SEQ ID NO: 5609235 - DNA, 15 bp, Homo sapiens
cttcaggtaacacta

SEQ ID NO: 5609236 - DNA, 18 bp, Homo sapiens
cttcaggtcaggagttcg

SEQ ID NO: 5609237 - DNA, 19 bp, Homo sapiens
cttcaggtcaggtggctgt

SEQ ID NO: 5609238 - DNA, 17 bp, Homo sapiens
cttcaggtcgtagcatt

SEQ ID NO: 5609239 - DNA, 18 bp, Homo sapiens
cttcaggtcgtagcattt

SEQ ID NO: 5609240 - DNA, 14 bp, Homo sapiens
cttcaggtgagcca

SEQ ID NO: 5609241 - DNA, 13 bp, Homo sapiens
cttcaggtgcttt

SEQ ID NO: 5609242 - DNA, 20 bp, Homo sapiens
cttcaggttatcgaaataac

SEQ ID NO: 5609243 - DNA, 14 bp, Homo sapiens
cttcaggttcctcc

SEQ ID NO: 5609244 - DNA, 17 bp, Homo sapiens
cttcaggttcctcctag

SEQ ID NO: 5609245 - DNA, 19 bp, Homo sapiens
cttcaggttcctcctaggc

SEQ ID NO: 5609246 - DNA, 24 bp, Homo sapiens
cttcaggttcctcctaggcgctca

SEQ ID NO: 5609247 - DNA, 19 bp, Homo sapiens
cttcaggttcttagtgtca

SEQ ID NO: 5609248 - DNA, 18 bp, Homo sapiens
cttcaggttgttctgtat

SEQ ID NO: 5609249 - DNA, 22 bp, Homo sapiens
cttcagtaaatgtgattcacct

SEQ ID NO: 5609250 - DNA, 16 bp, Homo sapiens
cttcagtaagccgtga

SEQ ID NO: 5609251 - DNA, 23 bp, Homo sapiens
cttcagtaagccgtgattttcat

SEQ ID NO: 5609252 - DNA, 19 bp, Homo sapiens
cttcagtaccctctcagct

SEQ ID NO: 5609253 - DNA, 22 bp, Homo sapiens
cttcagtaccctctcagctcca

SEQ ID NO: 5609254 - DNA, 21 bp, Homo sapiens
cttcagtaggaacaagctggc

SEQ ID NO: 5609255 - DNA, 16 bp, Homo sapiens
cttcagtaggatttat

SEQ ID NO: 5609256 - DNA, 14 bp, Homo sapiens
cttcagtatgttgt

SEQ ID NO: 5609257 - DNA, 18 bp, Homo sapiens
cttcagtatgttgtcaaa

SEQ ID NO: 5609258 - DNA, 16 bp, Homo sapiens
cttcagtattttctcc

SEQ ID NO: 5609259 - DNA, 17 bp, Homo sapiens
cttcagtattttctcca

SEQ ID NO: 5609260 - DNA, 22 bp, Homo sapiens
cttcagtattttctccacttca

SEQ ID NO: 5609261 - DNA, 16 bp, Homo sapiens
cttcagtcagaaaact

SEQ ID NO: 5609262 - DNA, 15 bp, Homo sapiens
cttcagtcagggttt

SEQ ID NO: 5609263 - DNA, 21 bp, Homo sapiens
cttcagtcagggtttgtcaga

SEQ ID NO: 5609264 - DNA, 15 bp, Homo sapiens
cttcagtcattaaat

SEQ ID NO: 5609265 - DNA, 15 bp, Homo sapiens
cttcagtcctgggag

SEQ ID NO: 5609266 - DNA, 16 bp, Homo sapiens
cttcagtcctggtctg

SEQ ID NO: 5609267 - DNA, 14 bp, Homo sapiens
cttcagtcctttgt

SEQ ID NO: 5609268 - DNA, 16 bp, Homo sapiens
cttcagtcctttgtct

SEQ ID NO: 5609269 - DNA, 21 bp, Homo sapiens
cttcagtcctttgtctttctt

SEQ ID NO: 5609270 - DNA, 14 bp, Homo sapiens
cttcagtctcacag

SEQ ID NO: 5609271 - DNA, 19 bp, Homo sapiens
cttcagtctcacagagaag

SEQ ID NO: 5609272 - DNA, 17 bp, Homo sapiens
cttcagtctctatacca

SEQ ID NO: 5609273 - DNA, 15 bp, Homo sapiens
cttcagtctctgcag

SEQ ID NO: 5609274 - DNA, 18 bp, Homo sapiens
cttcagtctctgcagtgt

SEQ ID NO: 5609275 - DNA, 12 bp, Homo sapiens
cttccagctcct

SEQ ID NO: 5609276 - DNA, 13 bp, Homo sapiens
cttccagctgctg

SEQ ID NO: 5609277 - DNA, 20 bp, Homo sapiens
cttccagcttcaggcaccag

SEQ ID NO: 5609278 - DNA, 17 bp, Homo sapiens
cttccagcttcctctga

SEQ ID NO: 5609279 - DNA, 18 bp, Homo sapiens
cttccagcttcctctgag

SEQ ID NO: 5609280 - DNA, 20 bp, Homo sapiens
cttccagcttcctctgagcc

SEQ ID NO: 5609281 - DNA, 16 bp, Homo sapiens
cttccagcttcttttg

SEQ ID NO: 5609282 - DNA, 13 bp, Homo sapiens
cttccaggaaact

SEQ ID NO: 5609283 - DNA, 17 bp, Homo sapiens
cttccaggaaactccac

SEQ ID NO: 5609284 - DNA, 21 bp, Homo sapiens
cttccaggaaactccacatct

SEQ ID NO: 5609285 - DNA, 17 bp, Homo sapiens
cttccaggaagcacagg

SEQ ID NO: 5609286 - DNA, 22 bp, Homo sapiens
cttccaggaagcacaggccagg

SEQ ID NO: 5609287 - DNA, 17 bp, Homo sapiens
cttccaggaatgctggg

SEQ ID NO: 5609288 - DNA, 15 bp, Homo sapiens
cttccaggacccctg

SEQ ID NO: 5609289 - DNA, 17 bp, Homo sapiens
cttccaggacccctggg

SEQ ID NO: 5609290 - DNA, 18 bp, Homo sapiens
cttccaggagcccagagg

SEQ ID NO: 5609291 - DNA, 22 bp, Homo sapiens
cttccaggatggatgcatcaca

SEQ ID NO: 5609292 - DNA, 12 bp, Homo sapiens
cttccaggcagc

SEQ ID NO: 5609293 - DNA, 14 bp, Homo sapiens
cttccaggccatca

SEQ ID NO: 5609294 - DNA, 19 bp, Homo sapiens
cttccaggccccaggctgg

SEQ ID NO: 5609295 - DNA, 19 bp, Homo sapiens
cttccaggcccccaccact

SEQ ID NO: 5609296 - DNA, 23 bp, Homo sapiens
cttccaggccgggcacagtggct

SEQ ID NO: 5609297 - DNA, 22 bp, Homo sapiens
cttccaggctcttcctggacct

SEQ ID NO: 5609298 - DNA, 17 bp, Homo sapiens
cttccaggctgagagcc

SEQ ID NO: 5609299 - DNA, 19 bp, Homo sapiens
cttccaggctgggagagcc

SEQ ID NO: 5609300 - DNA, 15 bp, Homo sapiens
cttccaggctgggca

SEQ ID NO: 5609301 - DNA, 19 bp, Homo sapiens
cttccaggggtcaccttga

SEQ ID NO: 5609302 - DNA, 14 bp, Homo sapiens
cttccaggtccaaa

SEQ ID NO: 5609303 - DNA, 19 bp, Homo sapiens
cttccaggtgcccagctat

SEQ ID NO: 5609304 - DNA, 22 bp, Homo sapiens
cttccaggtgggtgtgggacac

SEQ ID NO: 5609305 - DNA, 19 bp, Homo sapiens
cttccaggtgttactgtaa

SEQ ID NO: 5609306 - DNA, 20 bp, Homo sapiens
cttccagtcttcctgacact

SEQ ID NO: 5609307 - DNA, 17 bp, Homo sapiens
cttccagtgaggctctg

SEQ ID NO: 5609308 - DNA, 18 bp, Homo sapiens
cttccagtgaggctctgc

SEQ ID NO: 5609309 - DNA, 23 bp, Homo sapiens
cttccagtgaggctctgcccttg

SEQ ID NO: 5609310 - DNA, 22 bp, Homo sapiens
cttccagtggctcgctccctgt

SEQ ID NO: 5609311 - DNA, 15 bp, Homo sapiens
cttccagtggcttct

SEQ ID NO: 5609312 - DNA, 21 bp, Homo sapiens
cttccagtggtaccagctcac

SEQ ID NO: 5609313 - DNA, 22 bp, Homo sapiens
cttccagtggtaccagctcact

SEQ ID NO: 5609314 - DNA, 17 bp, Homo sapiens
cttccagtgtcatttct

SEQ ID NO: 5609315 - DNA, 18 bp, Homo sapiens
cttccagtgtccttagaa

SEQ ID NO: 5609316 - DNA, 21 bp, Homo sapiens
cttccagttggactgtggcct

SEQ ID NO: 5609317 - DNA, 19 bp, Homo sapiens
cttccagtttattccagag

SEQ ID NO: 5609318 - DNA, 21 bp, Homo sapiens
cttccagtttattccagagct

SEQ ID NO: 5609319 - DNA, 14 bp, Homo sapiens
cttccagtttgctt

SEQ ID NO: 5609320 - DNA, 12 bp, Homo sapiens
cttccagttttg

SEQ ID NO: 5609321 - DNA, 20 bp, Homo sapiens
cttccataacattgatgact

SEQ ID NO: 5609322 - DNA, 13 bp, Homo sapiens
cttccataataat

SEQ ID NO: 5609323 - DNA, 11 bp, Homo sapiens
cttccataatc

SEQ ID NO: 5609324 - DNA, 16 bp, Homo sapiens
cttccataattcagat

SEQ ID NO: 5609325 - DNA, 16 bp, Homo sapiens
cttccatacagctcta

SEQ ID NO: 5609326 - DNA, 15 bp, Homo sapiens
cttccatatccctgc

SEQ ID NO: 5609327 - DNA, 16 bp, Homo sapiens
cttccatatccctgcc

SEQ ID NO: 5609328 - DNA, 17 bp, Homo sapiens
cttccatatccgggtgc

SEQ ID NO: 5609329 - DNA, 21 bp, Homo sapiens
cttccatatgacctcatgcat

SEQ ID NO: 5609330 - DNA, 21 bp, Homo sapiens
cttccatcagcgggtctcctc

SEQ ID NO: 5609331 - DNA, 22 bp, Homo sapiens
cttccatcagcgggtctcctcc

SEQ ID NO: 5609332 - DNA, 19 bp, Homo sapiens
cttccatcatcactgtaaa

SEQ ID NO: 5609333 - DNA, 13 bp, Homo sapiens
cttccatcatgtc

SEQ ID NO: 5609334 - DNA, 17 bp, Homo sapiens
cttccatccatctttcc

SEQ ID NO: 5609335 - DNA, 17 bp, Homo sapiens
cttccatcccaggacac

SEQ ID NO: 5609336 - DNA, 21 bp, Homo sapiens
cttccatccccaaactgtgcc

SEQ ID NO: 5609337 - DNA, 17 bp, Homo sapiens
cttccatcctgaggacc

SEQ ID NO: 5609338 - DNA, 20 bp, Homo sapiens
cttccatcctgaggaccgcc

SEQ ID NO: 5609339 - DNA, 19 bp, Homo sapiens
cttccatctagcagctggc

SEQ ID NO: 5609340 - DNA, 20 bp, Homo sapiens
cttccatctagcagctggcc

SEQ ID NO: 5609341 - DNA, 19 bp, Homo sapiens
cttccatctcaacctacct

SEQ ID NO: 5609342 - DNA, 15 bp, Homo sapiens
cttccatctcgccac

SEQ ID NO: 5609343 - DNA, 16 bp, Homo sapiens
cttccatctctgactt

SEQ ID NO: 5609344 - DNA, 12 bp, Homo sapiens
cttccatctctt

SEQ ID NO: 5609345 - DNA, 14 bp, Homo sapiens
cttccatctcttcc

SEQ ID NO: 5609346 - DNA, 17 bp, Homo sapiens
cttccatctcttccttt

SEQ ID NO: 5609347 - DNA, 21 bp, Homo sapiens
cttccatctgtgccatacttg

SEQ ID NO: 5609348 - DNA, 17 bp, Homo sapiens
cttccatcttcacactg

SEQ ID NO: 5609349 - DNA, 17 bp, Homo sapiens
cttccatcttgtggggc

SEQ ID NO: 5609350 - DNA, 20 bp, Homo sapiens
cttccatcttgtggggccag

SEQ ID NO: 5609351 - DNA, 23 bp, Homo sapiens
cttccatcttgtggggccaggac

SEQ ID NO: 5609352 - DNA, 22 bp, Homo sapiens
cttccatctttcctgatggcag

SEQ ID NO: 5609353 - DNA, 18 bp, Homo sapiens
cttccatgaattttaaaa

SEQ ID NO: 5609354 - DNA, 17 bp, Homo sapiens
cttccatgatgcacagt

SEQ ID NO: 5609355 - DNA, 22 bp, Homo sapiens
cttccatgatgcacagtatctg

SEQ ID NO: 5609356 - DNA, 17 bp, Homo sapiens
cttccatgattctattt

SEQ ID NO: 5609357 - DNA, 23 bp, Homo sapiens
cttccatgcactcttcatgtaat

SEQ ID NO: 5609358 - DNA, 19 bp, Homo sapiens
cttccatgccccaggatca

SEQ ID NO: 5609359 - DNA, 20 bp, Homo sapiens
cttccatgccgtcctgcagt

SEQ ID NO: 5609360 - DNA, 11 bp, Homo sapiens
cttccatgcct

SEQ ID NO: 5609361 - DNA, 17 bp, Homo sapiens
cttccatgcctgtagct

SEQ ID NO: 5609362 - DNA, 13 bp, Homo sapiens
cttccatgcctta

SEQ ID NO: 5609363 - DNA, 17 bp, Homo sapiens
cttccatgctcccaact

SEQ ID NO: 5609364 - DNA, 18 bp, Homo sapiens
cttccatgctcccaactc

SEQ ID NO: 5609365 - DNA, 14 bp, Homo sapiens
cttccatgctgtgc

SEQ ID NO: 5609366 - DNA, 16 bp, Homo sapiens
cttccatggccctcat

SEQ ID NO: 5609367 - DNA, 19 bp, Homo sapiens
cttccatggccctcattaa

SEQ ID NO: 5609368 - DNA, 19 bp, Homo sapiens
cttccatggcttcctgaga

SEQ ID NO: 5609369 - DNA, 23 bp, Homo sapiens
cttccatggcttcctgagaaagc

SEQ ID NO: 5609370 - DNA, 16 bp, Homo sapiens
cttccatgtgcctttc

SEQ ID NO: 5609371 - DNA, 18 bp, Homo sapiens
cttccatgtgcctttctt

SEQ ID NO: 5609372 - DNA, 15 bp, Homo sapiens
cttccattaacaaat

SEQ ID NO: 5609373 - DNA, 20 bp, Homo sapiens
cttccattcccagacagcag

SEQ ID NO: 5609374 - DNA, 14 bp, Homo sapiens
cttccattcccttt

SEQ ID NO: 5609375 - DNA, 15 bp, Homo sapiens
cttccattccctttc

SEQ ID NO: 5609376 - DNA, 15 bp, Homo sapiens
cttccattctttctt

SEQ ID NO: 5609377 - DNA, 17 bp, Homo sapiens
cttccattctttcttcc

SEQ ID NO: 5609378 - DNA, 18 bp, Homo sapiens
cttccattctttcttcct

SEQ ID NO: 5609379 - DNA, 20 bp, Homo sapiens
cttccattgctcccagtgcc

SEQ ID NO: 5609380 - DNA, 22 bp, Homo sapiens
cttccattgtttaaaaatacac

SEQ ID NO: 5609381 - DNA, 16 bp, Homo sapiens
cttccatttctgcctt

SEQ ID NO: 5609382 - DNA, 19 bp, Homo sapiens
cttccatttgtattcaaat

SEQ ID NO: 5609383 - DNA, 18 bp, Homo sapiens
cttccattttcattctgt

SEQ ID NO: 5609384 - DNA, 22 bp, Homo sapiens
cttccattttcccccactactg

SEQ ID NO: 5609385 - DNA, 24 bp, Homo sapiens
cttccattttgccacctttcctgt

SEQ ID NO: 5609386 - DNA, 16 bp, Homo sapiens
cttcccaaaaacagcc

SEQ ID NO: 5609387 - DNA, 21 bp, Homo sapiens
cttcccaaacccagtctcctc

SEQ ID NO: 5609388 - DNA, 19 bp, Homo sapiens
cttcccaaactcccaggac

SEQ ID NO: 5609389 - DNA, 22 bp, Homo sapiens
cttcccaaactcccaggacctg

SEQ ID NO: 5609390 - DNA, 16 bp, Homo sapiens
cttcccaaagcaagca

SEQ ID NO: 5609391 - DNA, 23 bp, Homo sapiens
cttcccaaatacattaacaagct

SEQ ID NO: 5609392 - DNA, 15 bp, Homo sapiens
cttcccaaatcaaaa

SEQ ID NO: 5609393 - DNA, 19 bp, Homo sapiens
cttcccaacagccttagct

SEQ ID NO: 5609394 - DNA, 22 bp, Homo sapiens
cttcccaacagccttagctgcc

SEQ ID NO: 5609395 - DNA, 21 bp, Homo sapiens
cttcccaacgtactcctcaga

SEQ ID NO: 5609396 - DNA, 22 bp, Homo sapiens
cttcccaacgtactcctcagac

SEQ ID NO: 5609397 - DNA, 22 bp, Homo sapiens
cttcccaactcactgtgctcct

SEQ ID NO: 5609398 - DNA, 14 bp, Homo sapiens
cttcccaactgcaa

SEQ ID NO: 5609399 - DNA, 22 bp, Homo sapiens
cttcccaagaagagagaacttt

SEQ ID NO: 5609400 - DNA, 16 bp, Homo sapiens
cttcccaaggcagctg

SEQ ID NO: 5609401 - DNA, 18 bp, Homo sapiens
cttcccaaggcagctgga

SEQ ID NO: 5609402 - DNA, 17 bp, Homo sapiens
cttcccaagggctgccg

SEQ ID NO: 5609403 - DNA, 17 bp, Homo sapiens
cttcccaagtaagaggc

SEQ ID NO: 5609404 - DNA, 23 bp, Homo sapiens
cttcccaagtaagaggctggagt

SEQ ID NO: 5609405 - DNA, 18 bp, Homo sapiens
cttcccaagtagctgaga

SEQ ID NO: 5609406 - DNA, 21 bp, Homo sapiens
cttcccaagtcctcgcccccc

SEQ ID NO: 5609407 - DNA, 23 bp, Homo sapiens
cttcccaagtgagtctctctggg

SEQ ID NO: 5609408 - DNA, 15 bp, Homo sapiens
cttcccaatcagcac

SEQ ID NO: 5609409 - DNA, 17 bp, Homo sapiens
cttcccaattgccacat

SEQ ID NO: 5609410 - DNA, 20 bp, Homo sapiens
cttcccacaaaagacagacc

SEQ ID NO: 5609411 - DNA, 16 bp, Homo sapiens
cttcccacacctgcct

SEQ ID NO: 5609412 - DNA, 17 bp, Homo sapiens
cttcccacacctgcctg

SEQ ID NO: 5609413 - DNA, 11 bp, Homo sapiens
cttcccacacg

SEQ ID NO: 5609414 - DNA, 16 bp, Homo sapiens
cttcccacagcctctt

SEQ ID NO: 5609415 - DNA, 12 bp, Homo sapiens
cttcccacagga

SEQ ID NO: 5609416 - DNA, 20 bp, Homo sapiens
cttcccacccctacacacac

SEQ ID NO: 5609417 - DNA, 23 bp, Homo sapiens
cttcccacccctacacacacact

SEQ ID NO: 5609418 - DNA, 13 bp, Homo sapiens
cttcccaccctgc

SEQ ID NO: 5609419 - DNA, 19 bp, Homo sapiens
cttcccaccctgcccctca

SEQ ID NO: 5609420 - DNA, 18 bp, Homo sapiens
cttcccacctactgcact

SEQ ID NO: 5609421 - DNA, 17 bp, Homo sapiens
cttcccacctccctgcc

SEQ ID NO: 5609422 - DNA, 23 bp, Homo sapiens
cttcccacctctctcactccttg

SEQ ID NO: 5609423 - DNA, 17 bp, Homo sapiens
cttcccacctgtcaacc

SEQ ID NO: 5609424 - DNA, 19 bp, Homo sapiens
cttcccacggccactgcag

SEQ ID NO: 5609425 - DNA, 13 bp, Homo sapiens
cttcccactccag

SEQ ID NO: 5609426 - DNA, 14 bp, Homo sapiens
cttcccactcttct

SEQ ID NO: 5609427 - DNA, 16 bp, Homo sapiens
cttcccactcttctca

SEQ ID NO: 5609428 - DNA, 16 bp, Homo sapiens
cttcccactggggccg

SEQ ID NO: 5609429 - DNA, 12 bp, Homo sapiens
cttcccactgtc

SEQ ID NO: 5609430 - DNA, 14 bp, Homo sapiens
cttcccactgtcct

SEQ ID NO: 5609431 - DNA, 12 bp, Homo sapiens
cttcccacttgc

SEQ ID NO: 5609432 - DNA, 18 bp, Homo sapiens
cttcccagaatctctgag

SEQ ID NO: 5609433 - DNA, 19 bp, Homo sapiens
cttcccagaatgttactga

SEQ ID NO: 5609434 - DNA, 14 bp, Homo sapiens
cttcccagaccagg

SEQ ID NO: 5609435 - DNA, 11 bp, Homo sapiens
cttcccagagg

SEQ ID NO: 5609436 - DNA, 17 bp, Homo sapiens
cttcccagagggagcag

SEQ ID NO: 5609437 - DNA, 15 bp, Homo sapiens
cttcccagcacatcg

SEQ ID NO: 5609438 - DNA, 21 bp, Homo sapiens
cttcccagcagggccactccc

SEQ ID NO: 5609439 - DNA, 15 bp, Homo sapiens
cttcccagccagccc

SEQ ID NO: 5609440 - DNA, 13 bp, Homo sapiens
cttcccagccatg

SEQ ID NO: 5609441 - DNA, 16 bp, Homo sapiens
cttcccagccatgccc

SEQ ID NO: 5609442 - DNA, 19 bp, Homo sapiens
cttcccagccatgcccagg

SEQ ID NO: 5609443 - DNA, 19 bp, Homo sapiens
cttcccagcggttcctgtg

SEQ ID NO: 5609444 - DNA, 23 bp, Homo sapiens
cttcccagcggttcctgtgcaga

SEQ ID NO: 5609445 - DNA, 18 bp, Homo sapiens
cttcccagctgcccctcc

SEQ ID NO: 5609446 - DNA, 22 bp, Homo sapiens
cttcccagctggcagcgcctcc

SEQ ID NO: 5609447 - DNA, 12 bp, Homo sapiens
cttcccaggagg

SEQ ID NO: 5609448 - DNA, 19 bp, Homo sapiens
cttcccaggatctgctcca

SEQ ID NO: 5609449 - DNA, 23 bp, Homo sapiens
cttcccaggatctgctccaacag

SEQ ID NO: 5609450 - DNA, 11 bp, Homo sapiens
cttcccaggcc

SEQ ID NO: 5609451 - DNA, 17 bp, Homo sapiens
cttcctgctgagtccct

SEQ ID NO: 5609452 - DNA, 14 bp, Homo sapiens
cttcctgctgcacc

SEQ ID NO: 5609453 - DNA, 17 bp, Homo sapiens
cttcctgctgctgctac

SEQ ID NO: 5609454 - DNA, 15 bp, Homo sapiens
cttcctgctgctgta

SEQ ID NO: 5609455 - DNA, 22 bp, Homo sapiens
cttcctgctgctgtaactgctg

SEQ ID NO: 5609456 - DNA, 11 bp, Homo sapiens
cttcctgctgg

SEQ ID NO: 5609457 - DNA, 16 bp, Homo sapiens
cttcctgctggacaga

SEQ ID NO: 5609458 - DNA, 18 bp, Homo sapiens
cttcctgctggacagaga

SEQ ID NO: 5609459 - DNA, 16 bp, Homo sapiens
cttcctgcttgccaag

SEQ ID NO: 5609460 - DNA, 13 bp, Homo sapiens
cttcctgctttcc

SEQ ID NO: 5609461 - DNA, 15 bp, Homo sapiens
cttcctgctttccat

SEQ ID NO: 5609462 - DNA, 18 bp, Homo sapiens
cttcctggaaacagcatg

SEQ ID NO: 5609463 - DNA, 20 bp, Homo sapiens
cttcctggaaacagcatgaa

SEQ ID NO: 5609464 - DNA, 21 bp, Homo sapiens
cttcctggaataaacatctgt

SEQ ID NO: 5609465 - DNA, 12 bp, Homo sapiens
cttcctggacac

SEQ ID NO: 5609466 - DNA, 18 bp, Homo sapiens
cttcctggacacactctc

SEQ ID NO: 5609467 - DNA, 21 bp, Homo sapiens
cttcctggacagctgtgcctc

SEQ ID NO: 5609468 - DNA, 23 bp, Homo sapiens
cttcctggacagctgtgcctcgc

SEQ ID NO: 5609469 - DNA, 24 bp, Homo sapiens
cttcctggacagctgtgcctcgct

SEQ ID NO: 5609470 - DNA, 22 bp, Homo sapiens
cttcctggaccggggccttggt

SEQ ID NO: 5609471 - DNA, 13 bp, Homo sapiens
cttcctggacctg

SEQ ID NO: 5609472 - DNA, 17 bp, Homo sapiens
cttcctggacctgagtc

SEQ ID NO: 5609473 - DNA, 16 bp, Homo sapiens
cttcctggactggccc

SEQ ID NO: 5609474 - DNA, 13 bp, Homo sapiens
cttcctggagcag

SEQ ID NO: 5609475 - DNA, 21 bp, Homo sapiens
cttcctggagcagaagcagca

SEQ ID NO: 5609476 - DNA, 22 bp, Homo sapiens
cttcctggagcagaagcagcaa

SEQ ID NO: 5609477 - DNA, 12 bp, Homo sapiens
cttcctggcaca

SEQ ID NO: 5609478 - DNA, 20 bp, Homo sapiens
cttcctggcacattgcccct

SEQ ID NO: 5609479 - DNA, 12 bp, Homo sapiens
cttcctggccca

SEQ ID NO: 5609480 - DNA, 14 bp, Homo sapiens
cttcctggcccagg

SEQ ID NO: 5609481 - DNA, 16 bp, Homo sapiens
cttcctggcccaggcc

SEQ ID NO: 5609482 - DNA, 17 bp, Homo sapiens
cttcctggcccaggcct

SEQ ID NO: 5609483 - DNA, 11 bp, Homo sapiens
cttcctggcct

SEQ ID NO: 5609484 - DNA, 15 bp, Homo sapiens
cttcctggcctaatc

SEQ ID NO: 5609485 - DNA, 14 bp, Homo sapiens
cttcctggcctcac

SEQ ID NO: 5609486 - DNA, 13 bp, Homo sapiens
cttcctggcctcc

SEQ ID NO: 5609487 - DNA, 14 bp, Homo sapiens
cttcctggcctccc

SEQ ID NO: 5609488 - DNA, 19 bp, Homo sapiens
cttcctggcctcttctggg

SEQ ID NO: 5609489 - DNA, 12 bp, Homo sapiens
cttcctggcctg

SEQ ID NO: 5609490 - DNA, 15 bp, Homo sapiens
cttcctggcgccccc

SEQ ID NO: 5609491 - DNA, 13 bp, Homo sapiens
cttcctggctctg

SEQ ID NO: 5609492 - DNA, 15 bp, Homo sapiens
cttcctggctctggg

SEQ ID NO: 5609493 - DNA, 11 bp, Homo sapiens
cttcctggctt

SEQ ID NO: 5609494 - DNA, 13 bp, Homo sapiens
cttcctggctttg

SEQ ID NO: 5609495 - DNA, 14 bp, Homo sapiens
cttcctggctttgg

SEQ ID NO: 5609496 - DNA, 10 bp, Homo sapiens
cttcctggga

SEQ ID NO: 5609497 - DNA, 16 bp, Homo sapiens
cttcctgggaccccct

SEQ ID NO: 5609498 - DNA, 22 bp, Homo sapiens
cttcctgggaccccctcgccag

SEQ ID NO: 5609499 - DNA, 23 bp, Homo sapiens
cttcctgggaccccctcgccagc

SEQ ID NO: 5609500 - DNA, 16 bp, Homo sapiens
cttcctgggaggacag

SEQ ID NO: 5609501 - DNA, 17 bp, Homo sapiens
cttcctgggaggacagg

SEQ ID NO: 5609502 - DNA, 22 bp, Homo sapiens
cttcctgggaggacaggcaggc

SEQ ID NO: 5609503 - DNA, 17 bp, Homo sapiens
cttcctgggatgatgtg

SEQ ID NO: 5609504 - DNA, 19 bp, Homo sapiens
cttcctgggcacacgctgc

SEQ ID NO: 5609505 - DNA, 20 bp, Homo sapiens
cttcctgggcacacgctgct

SEQ ID NO: 5609506 - DNA, 22 bp, Homo sapiens
cttcctgggcacacgctgctct

SEQ ID NO: 5609507 - DNA, 17 bp, Homo sapiens
cttcctgggcagttggg

SEQ ID NO: 5609508 - DNA, 16 bp, Homo sapiens
cttcctggggatgtca

SEQ ID NO: 5609509 - DNA, 12 bp, Homo sapiens
cttcctggggct

SEQ ID NO: 5609510 - DNA, 22 bp, Homo sapiens
cttcctgggtcctgcctggtcc

SEQ ID NO: 5609511 - DNA, 22 bp, Homo sapiens
cttcctgggtcttcagcattcc

SEQ ID NO: 5609512 - DNA, 15 bp, Homo sapiens
cttcctggtgctgga

SEQ ID NO: 5609513 - DNA, 20 bp, Homo sapiens
cttcctggttttgtacactg

SEQ ID NO: 5609514 - DNA, 24 bp, Homo sapiens
cttcctggttttgtacactgctgt

SEQ ID NO: 5609515 - DNA, 20 bp, Homo sapiens
cttcctgtagtgcccctccc

SEQ ID NO: 5609516 - DNA, 23 bp, Homo sapiens
cttcctgtagtggcaaaaaagaa

SEQ ID NO: 5609517 - DNA, 16 bp, Homo sapiens
cttcctgtccactctc

SEQ ID NO: 5609518 - DNA, 17 bp, Homo sapiens
cttcctgtccagagaga

SEQ ID NO: 5609519 - DNA, 18 bp, Homo sapiens
cttcctgtccagctccaa

SEQ ID NO: 5609520 - DNA, 21 bp, Homo sapiens
cttcctgtcccacctcttctc

SEQ ID NO: 5609521 - DNA, 13 bp, Homo sapiens
cttcctgtcccca

SEQ ID NO: 5609522 - DNA, 14 bp, Homo sapiens
cttcctgtccccat

SEQ ID NO: 5609523 - DNA, 19 bp, Homo sapiens
cttcctgtccccatctgtc

SEQ ID NO: 5609524 - DNA, 15 bp, Homo sapiens
cttcctgtccctgag

SEQ ID NO: 5609525 - DNA, 16 bp, Homo sapiens
cttcctgtccctgagg

SEQ ID NO: 5609526 - DNA, 22 bp, Homo sapiens
cttcctgtccgccctcttcccc

SEQ ID NO: 5609527 - DNA, 12 bp, Homo sapiens
cttcctgtcctg

SEQ ID NO: 5609528 - DNA, 14 bp, Homo sapiens
cttcctgtcctgct

SEQ ID NO: 5609529 - DNA, 17 bp, Homo sapiens
cttcctgtcctgctcac

SEQ ID NO: 5609530 - DNA, 16 bp, Homo sapiens
cttcctgtctagtctc

SEQ ID NO: 5609531 - DNA, 20 bp, Homo sapiens
cttcctgtctagtctctcct

SEQ ID NO: 5609532 - DNA, 12 bp, Homo sapiens
cttcctgtctca

SEQ ID NO: 5609533 - DNA, 16 bp, Homo sapiens
cttcctgtctgtttat

SEQ ID NO: 5609534 - DNA, 17 bp, Homo sapiens
cttcctgtctgtttata

SEQ ID NO: 5609535 - DNA, 21 bp, Homo sapiens
cttcctgtgaagtttaattgt

SEQ ID NO: 5609536 - DNA, 14 bp, Homo sapiens
cttcctgtgccctc

SEQ ID NO: 5609537 - DNA, 17 bp, Homo sapiens
cttcctgtgccctcacc

SEQ ID NO: 5609538 - DNA, 19 bp, Homo sapiens
cttcctgtgccctcacccc

SEQ ID NO: 5609539 - DNA, 20 bp, Homo sapiens
cttcctgtgccctcacccca

SEQ ID NO: 5609540 - DNA, 21 bp, Homo sapiens
cttcctgtgccctcaccccaa

SEQ ID NO: 5609541 - DNA, 23 bp, Homo sapiens
cttcctgtgccctcaccccaatc

SEQ ID NO: 5609542 - DNA, 18 bp, Homo sapiens
cttcctgtgcctttccta

SEQ ID NO: 5609543 - DNA, 21 bp, Homo sapiens
cttcctgtgctaagtctttcc

SEQ ID NO: 5609544 - DNA, 12 bp, Homo sapiens
cttcctgtggat

SEQ ID NO: 5609545 - DNA, 17 bp, Homo sapiens
cttcctgtggcctgaag

SEQ ID NO: 5609546 - DNA, 14 bp, Homo sapiens
cttcctgtggctcc

SEQ ID NO: 5609547 - DNA, 17 bp, Homo sapiens
cttcctgtggctccctc

SEQ ID NO: 5609548 - DNA, 16 bp, Homo sapiens
cttcctgtggctttgt

SEQ ID NO: 5609549 - DNA, 23 bp, Homo sapiens
cttcctgtggctttgttttctta

SEQ ID NO: 5609550 - DNA, 15 bp, Homo sapiens
cttcctgtgggagca

SEQ ID NO: 5609551 - DNA, 18 bp, Homo sapiens
cttcctgtgggccaggag

SEQ ID NO: 5609552 - DNA, 19 bp, Homo sapiens
cttcctgtgtaacatctgc

SEQ ID NO: 5609553 - DNA, 21 bp, Homo sapiens
cttcctgtgtaacatctgcca

SEQ ID NO: 5609554 - DNA, 22 bp, Homo sapiens
cttcctgtgtactctttatttc

SEQ ID NO: 5609555 - DNA, 15 bp, Homo sapiens
cttcctgtgtcctga

SEQ ID NO: 5609556 - DNA, 23 bp, Homo sapiens
cttcctgtgtgtccaaaactgcc

SEQ ID NO: 5609557 - DNA, 15 bp, Homo sapiens
cttcctgttccctcc

SEQ ID NO: 5609558 - DNA, 18 bp, Homo sapiens
cttcctgttccctcctgg

SEQ ID NO: 5609559 - DNA, 20 bp, Homo sapiens
cttcctgttccctcctggtc

SEQ ID NO: 5609560 - DNA, 22 bp, Homo sapiens
cttcctgttccctcctggtcct

SEQ ID NO: 5609561 - DNA, 16 bp, Homo sapiens
cttcctgttctgtgtc

SEQ ID NO: 5609562 - DNA, 21 bp, Homo sapiens
cttcctgttctgtgtctgctg

SEQ ID NO: 5609563 - DNA, 18 bp, Homo sapiens
cttcctgttcttccttcc

SEQ ID NO: 5609564 - DNA, 21 bp, Homo sapiens
cttcctgttcttccttcctag

SEQ ID NO: 5609565 - DNA, 22 bp, Homo sapiens
cttcctgttcttccttcctaga

SEQ ID NO: 5609566 - DNA, 13 bp, Homo sapiens
cttcctgtttctc

SEQ ID NO: 5609567 - DNA, 16 bp, Homo sapiens
cttcctgtttgggccc

SEQ ID NO: 5609568 - DNA, 15 bp, Homo sapiens
cttccttaacagctg

SEQ ID NO: 5609569 - DNA, 17 bp, Homo sapiens
cttccttacctggaaaa

SEQ ID NO: 5609570 - DNA, 19 bp, Homo sapiens
cttccttagaacttctaca

SEQ ID NO: 5609571 - DNA, 22 bp, Homo sapiens
cttccttagtttcaaagtgtct

SEQ ID NO: 5609572 - DNA, 17 bp, Homo sapiens
cttccttataaaaattc

SEQ ID NO: 5609573 - DNA, 17 bp, Homo sapiens
cttccttatgcttcttt

SEQ ID NO: 5609574 - DNA, 11 bp, Homo sapiens
cttccttcaac

SEQ ID NO: 5609575 - DNA, 13 bp, Homo sapiens
cttccttcagaga

SEQ ID NO: 5609576 - DNA, 22 bp, Homo sapiens
cttccttcagagagcagtgctt

SEQ ID NO: 5609577 - DNA, 12 bp, Homo sapiens
cttccttcagga

SEQ ID NO: 5609578 - DNA, 15 bp, Homo sapiens
cttccttcaggactc

SEQ ID NO: 5609579 - DNA, 17 bp, Homo sapiens
cttccttcaggactctg

SEQ ID NO: 5609580 - DNA, 22 bp, Homo sapiens
cttccttcaggactctgcggga

SEQ ID NO: 5609581 - DNA, 23 bp, Homo sapiens
cttccttcagggtttaatagact

SEQ ID NO: 5609582 - DNA, 22 bp, Homo sapiens
cttccttccaagtcttcctgac

SEQ ID NO: 5609583 - DNA, 23 bp, Homo sapiens
cttccttcccaactcactgtgct

SEQ ID NO: 5609584 - DNA, 15 bp, Homo sapiens
cttccttccctggct

SEQ ID NO: 5609585 - DNA, 17 bp, Homo sapiens
cttccttccctggcttg

SEQ ID NO: 5609586 - DNA, 18 bp, Homo sapiens
cttccttccctgggctgt

SEQ ID NO: 5609587 - DNA, 18 bp, Homo sapiens
cttccttccgctccttta

SEQ ID NO: 5609588 - DNA, 17 bp, Homo sapiens
cttccttccgctctgag

SEQ ID NO: 5609589 - DNA, 18 bp, Homo sapiens
cttccttcggtcttttgt

SEQ ID NO: 5609590 - DNA, 15 bp, Homo sapiens
cttccttctacccca

SEQ ID NO: 5609591 - DNA, 22 bp, Homo sapiens
cttccttctaccccaaggccag

SEQ ID NO: 5609592 - DNA, 17 bp, Homo sapiens
cttccttctcagccttg

SEQ ID NO: 5609593 - DNA, 12 bp, Homo sapiens
cttccttctcat

SEQ ID NO: 5609594 - DNA, 17 bp, Homo sapiens
cttccttctgtaaatac

SEQ ID NO: 5609595 - DNA, 15 bp, Homo sapiens
cttccttctttctct

SEQ ID NO: 5609596 - DNA, 20 bp, Homo sapiens
cttccttgaaatttctcagc

SEQ ID NO: 5609597 - DNA, 20 bp, Homo sapiens
cttccttgaccaaagctctc

SEQ ID NO: 5609598 - DNA, 23 bp, Homo sapiens
cttccttgacctgcattgtaaat

SEQ ID NO: 5609599 - DNA, 21 bp, Homo sapiens
cttccttgactgtctagccac

SEQ ID NO: 5609600 - DNA, 23 bp, Homo sapiens
cttccttgagacacggagcccag

SEQ ID NO: 5609601 - DNA, 11 bp, Homo sapiens
cttccttgccc

SEQ ID NO: 5609602 - DNA, 18 bp, Homo sapiens
cttccttgcccctgctct

SEQ ID NO: 5609603 - DNA, 20 bp, Homo sapiens
cttccttgcccctgctctgt

SEQ ID NO: 5609604 - DNA, 22 bp, Homo sapiens
cttccttgcccctgctctgtag

SEQ ID NO: 5609605 - DNA, 14 bp, Homo sapiens
cttccttgcgacca

SEQ ID NO: 5609606 - DNA, 19 bp, Homo sapiens
cttccttgctaatgcacca

SEQ ID NO: 5609607 - DNA, 16 bp, Homo sapiens
cttccttgctctgcac

SEQ ID NO: 5609608 - DNA, 19 bp, Homo sapiens
cttccttggactcatttta

SEQ ID NO: 5609609 - DNA, 13 bp, Homo sapiens
cttccttggcttt

SEQ ID NO: 5609610 - DNA, 12 bp, Homo sapiens
cttccttgggcg

SEQ ID NO: 5609611 - DNA, 22 bp, Homo sapiens
cttccttgggcgtctcccccag

SEQ ID NO: 5609612 - DNA, 17 bp, Homo sapiens
cttccttggttcatgct

SEQ ID NO: 5609613 - DNA, 17 bp, Homo sapiens
cttccttgtagcctttt

SEQ ID NO: 5609614 - DNA, 21 bp, Homo sapiens
cttccttgtagccttttgact

SEQ ID NO: 5609615 - DNA, 14 bp, Homo sapiens
cttccttgtgagga

SEQ ID NO: 5609616 - DNA, 20 bp, Homo sapiens
cttccttgttgtttgctttg

SEQ ID NO: 5609617 - DNA, 15 bp, Homo sapiens
cttcctttaaaaaac

SEQ ID NO: 5609618 - DNA, 16 bp, Homo sapiens
cttcctttaaaaaact

SEQ ID NO: 5609619 - DNA, 16 bp, Homo sapiens
cttcctttactttccc

SEQ ID NO: 5609620 - DNA, 21 bp, Homo sapiens
cttcctttactttcccttgct

SEQ ID NO: 5609621 - DNA, 13 bp, Homo sapiens
cttcctttataat

SEQ ID NO: 5609622 - DNA, 14 bp, Homo sapiens
cttcctttataata

SEQ ID NO: 5609623 - DNA, 18 bp, Homo sapiens
cttcctttatcccctcct

SEQ ID NO: 5609624 - DNA, 14 bp, Homo sapiens
cttcctttcaggcc

SEQ ID NO: 5609625 - DNA, 16 bp, Homo sapiens
cttcctttcaggccaa

SEQ ID NO: 5609626 - DNA, 18 bp, Homo sapiens
cttcctttcaggccaagg

SEQ ID NO: 5609627 - DNA, 19 bp, Homo sapiens
cttcctttcaggccaaggc

SEQ ID NO: 5609628 - DNA, 15 bp, Homo sapiens
cttcctttcattcta

SEQ ID NO: 5609629 - DNA, 21 bp, Homo sapiens
cttctcttacgctctctgtct

SEQ ID NO: 5609630 - DNA, 13 bp, Homo sapiens
cttctcttagatt

SEQ ID NO: 5609631 - DNA, 23 bp, Homo sapiens
cttctcttagattatgttcaatg

SEQ ID NO: 5609632 - DNA, 18 bp, Homo sapiens
cttctcttcctagatctg

SEQ ID NO: 5609633 - DNA, 23 bp, Homo sapiens
cttctcttcctagatctgcaggc

SEQ ID NO: 5609634 - DNA, 13 bp, Homo sapiens
cttctcttcctgt

SEQ ID NO: 5609635 - DNA, 16 bp, Homo sapiens
cttctcttctcttctt

SEQ ID NO: 5609636 - DNA, 14 bp, Homo sapiens
cttctcttctttcc

SEQ ID NO: 5609637 - DNA, 14 bp, Homo sapiens
cttctcttctttgg

SEQ ID NO: 5609638 - DNA, 12 bp, Homo sapiens
cttctcttgaat

SEQ ID NO: 5609639 - DNA, 13 bp, Homo sapiens
cttctcttgaatt

SEQ ID NO: 5609640 - DNA, 16 bp, Homo sapiens
cttctcttgctttata

SEQ ID NO: 5609641 - DNA, 17 bp, Homo sapiens
cttctcttgctttatac

SEQ ID NO: 5609642 - DNA, 17 bp, Homo sapiens
cttctcttgctttctat

SEQ ID NO: 5609643 - DNA, 12 bp, Homo sapiens
cttctcttgtga

SEQ ID NO: 5609644 - DNA, 18 bp, Homo sapiens
cttctctttcaatgtgtt

SEQ ID NO: 5609645 - DNA, 13 bp, Homo sapiens
cttctctttctta

SEQ ID NO: 5609646 - DNA, 15 bp, Homo sapiens
cttctctttgactta

SEQ ID NO: 5609647 - DNA, 14 bp, Homo sapiens
cttctctttttcca

SEQ ID NO: 5609648 - DNA, 14 bp, Homo sapiens
cttctgaaaaatga

SEQ ID NO: 5609649 - DNA, 15 bp, Homo sapiens
cttctgaaaaatgaa

SEQ ID NO: 5609650 - DNA, 17 bp, Homo sapiens
cttctgaaacttcataa

SEQ ID NO: 5609651 - DNA, 15 bp, Homo sapiens
cttctgaaatacaac

SEQ ID NO: 5609652 - DNA, 12 bp, Homo sapiens
cttctgaaatgt

SEQ ID NO: 5609653 - DNA, 18 bp, Homo sapiens
cttctgaaccgcaaggag

SEQ ID NO: 5609654 - DNA, 18 bp, Homo sapiens
cttctgaactcaaactga

SEQ ID NO: 5609655 - DNA, 22 bp, Homo sapiens
cttctgaacttggcgctgcccc

SEQ ID NO: 5609656 - DNA, 12 bp, Homo sapiens
cttctgaagact

SEQ ID NO: 5609657 - DNA, 15 bp, Homo sapiens
cttctgaagaggaaa

SEQ ID NO: 5609658 - DNA, 12 bp, Homo sapiens
cttctgaagatt

SEQ ID NO: 5609659 - DNA, 15 bp, Homo sapiens
cttctgaagctgctg

SEQ ID NO: 5609660 - DNA, 20 bp, Homo sapiens
cttctgaagtaatttgtaaa

SEQ ID NO: 5609661 - DNA, 16 bp, Homo sapiens
cttctgaagtgtgtcc

SEQ ID NO: 5609662 - DNA, 15 bp, Homo sapiens
cttctgaataaagca

SEQ ID NO: 5609663 - DNA, 16 bp, Homo sapiens
cttctgaataaagcaa

SEQ ID NO: 5609664 - DNA, 18 bp, Homo sapiens
cttctgaataaagcaatt

SEQ ID NO: 5609665 - DNA, 14 bp, Homo sapiens
cttctgaatatttt

SEQ ID NO: 5609666 - DNA, 13 bp, Homo sapiens
cttctgacaaagg

SEQ ID NO: 5609667 - DNA, 19 bp, Homo sapiens
cttctgacataatccagta

SEQ ID NO: 5609668 - DNA, 18 bp, Homo sapiens
cttctgaccacagcatca

SEQ ID NO: 5609669 - DNA, 18 bp, Homo sapiens
cttctgacccaaagcaaa

SEQ ID NO: 5609670 - DNA, 16 bp, Homo sapiens
cttctgacccatgctg

SEQ ID NO: 5609671 - DNA, 17 bp, Homo sapiens
cttctgacccatgctgc

SEQ ID NO: 5609672 - DNA, 23 bp, Homo sapiens
cttctgaccccacttatgctgct

SEQ ID NO: 5609673 - DNA, 13 bp, Homo sapiens
cttctgacctccc

SEQ ID NO: 5609674 - DNA, 18 bp, Homo sapiens
cttctgacgcagcctgag

SEQ ID NO: 5609675 - DNA, 16 bp, Homo sapiens
cttctgacggccctgc

SEQ ID NO: 5609676 - DNA, 17 bp, Homo sapiens
cttctgacggccctgca

SEQ ID NO: 5609677 - DNA, 19 bp, Homo sapiens
cttctgacgtgccttttgc

SEQ ID NO: 5609678 - DNA, 17 bp, Homo sapiens
cttctgactcttcccca

SEQ ID NO: 5609679 - DNA, 15 bp, Homo sapiens
cttctgactgccccc

SEQ ID NO: 5609680 - DNA, 20 bp, Homo sapiens
cttctgactgccccctcctg

SEQ ID NO: 5609681 - DNA, 13 bp, Homo sapiens
cttctgactgctg

SEQ ID NO: 5609682 - DNA, 11 bp, Homo sapiens
cttctgactgt

SEQ ID NO: 5609683 - DNA, 15 bp, Homo sapiens
cttctgactgtttac

SEQ ID NO: 5609684 - DNA, 20 bp, Homo sapiens
cttctgactgtttatttaag

SEQ ID NO: 5609685 - DNA, 22 bp, Homo sapiens
cttctgactgtttatttaagga

SEQ ID NO: 5609686 - DNA, 16 bp, Homo sapiens
cttctgactttacttg

SEQ ID NO: 5609687 - DNA, 22 bp, Homo sapiens
cttctgagacatccctgattct

SEQ ID NO: 5609688 - DNA, 17 bp, Homo sapiens
cttctgagcaaactatt

SEQ ID NO: 5609689 - DNA, 23 bp, Homo sapiens
cttctgagcactgtttatacact

SEQ ID NO: 5609690 - DNA, 18 bp, Homo sapiens
cttctgagcagcgagcct

SEQ ID NO: 5609691 - DNA, 14 bp, Homo sapiens
cttctgagccccag

SEQ ID NO: 5609692 - DNA, 15 bp, Homo sapiens
cttctgagccccagc

SEQ ID NO: 5609693 - DNA, 22 bp, Homo sapiens
cttctgagcccggtaagagcaa

SEQ ID NO: 5609694 - DNA, 19 bp, Homo sapiens
cttctgagccttctactta

SEQ ID NO: 5609695 - DNA, 14 bp, Homo sapiens
cttctgagctccac

SEQ ID NO: 5609696 - DNA, 15 bp, Homo sapiens
cttctgagctccacc

SEQ ID NO: 5609697 - DNA, 21 bp, Homo sapiens
cttctgagctccacctctggt

SEQ ID NO: 5609698 - DNA, 23 bp, Homo sapiens
cttctgagctccacctctggtgg

SEQ ID NO: 5609699 - DNA, 17 bp, Homo sapiens
cttctgagctggcctct

SEQ ID NO: 5609700 - DNA, 15 bp, Homo sapiens
cttctgagctgtcta

SEQ ID NO: 5609701 - DNA, 15 bp, Homo sapiens
cttctgaggacattc

SEQ ID NO: 5609702 - DNA, 23 bp, Homo sapiens
cttctgagtaattaataaagaaa

SEQ ID NO: 5609703 - DNA, 10 bp, Homo sapiens
cttctgagtt

SEQ ID NO: 5609704 - DNA, 18 bp, Homo sapiens
cttctgattcccctccac

SEQ ID NO: 5609705 - DNA, 16 bp, Homo sapiens
cttctgatttttctct

SEQ ID NO: 5609706 - DNA, 22 bp, Homo sapiens
cttctgcaaaaatggatattat

SEQ ID NO: 5609707 - DNA, 17 bp, Homo sapiens
cttctgcaaagtggcag

SEQ ID NO: 5609708 - DNA, 18 bp, Homo sapiens
cttctgcaacaagcatgc

SEQ ID NO: 5609709 - DNA, 21 bp, Homo sapiens
cttctgcacccagaaattcct

SEQ ID NO: 5609710 - DNA, 15 bp, Homo sapiens
cttctgcaccctcca

SEQ ID NO: 5609711 - DNA, 21 bp, Homo sapiens
cttctgcaccctccaccctgt

SEQ ID NO: 5609712 - DNA, 22 bp, Homo sapiens
cttctgcaccctccaccctgtc

SEQ ID NO: 5609713 - DNA, 17 bp, Homo sapiens
cttctgcaccttatctt

SEQ ID NO: 5609714 - DNA, 18 bp, Homo sapiens
cttctgcaccttatctta

SEQ ID NO: 5609715 - DNA, 14 bp, Homo sapiens
cttctgcagcaact

SEQ ID NO: 5609716 - DNA, 17 bp, Homo sapiens
cttctgcagcaactccc

SEQ ID NO: 5609717 - DNA, 15 bp, Homo sapiens
cttctgcagcctcgg

SEQ ID NO: 5609718 - DNA, 14 bp, Homo sapiens
cttctgcagctttg

SEQ ID NO: 5609719 - DNA, 18 bp, Homo sapiens
cttctgcattactattaa

SEQ ID NO: 5609720 - DNA, 15 bp, Homo sapiens
cttctgcattcacag

SEQ ID NO: 5609721 - DNA, 20 bp, Homo sapiens
cttctgccaacgcctcctgt

SEQ ID NO: 5609722 - DNA, 14 bp, Homo sapiens
cttctgccaaggcc

SEQ ID NO: 5609723 - DNA, 17 bp, Homo sapiens
cttctgccaccagcccc

SEQ ID NO: 5609724 - DNA, 16 bp, Homo sapiens
cttctgccacctgcct

SEQ ID NO: 5609725 - DNA, 16 bp, Homo sapiens
cttctgccacttccca

SEQ ID NO: 5609726 - DNA, 20 bp, Homo sapiens
cttctgccacttcccaggta

SEQ ID NO: 5609727 - DNA, 21 bp, Homo sapiens
cttctgccatattctgttggc

SEQ ID NO: 5609728 - DNA, 16 bp, Homo sapiens
cttctgcccaccccgc

SEQ ID NO: 5609729 - DNA, 22 bp, Homo sapiens
cttctgcccaccccgcctctgg

SEQ ID NO: 5609730 - DNA, 19 bp, Homo sapiens
cttctgccccagctttatc

SEQ ID NO: 5609731 - DNA, 16 bp, Homo sapiens
cttctgccccctgcag

SEQ ID NO: 5609732 - DNA, 18 bp, Homo sapiens
cttctgccctccctggag

SEQ ID NO: 5609733 - DNA, 13 bp, Homo sapiens
cttctgccctcct

SEQ ID NO: 5609734 - DNA, 11 bp, Homo sapiens
cttctgccctt

SEQ ID NO: 5609735 - DNA, 18 bp, Homo sapiens
cttctgcccttcctccag

SEQ ID NO: 5609736 - DNA, 20 bp, Homo sapiens
cttctgcccttcctccagga

SEQ ID NO: 5609737 - DNA, 15 bp, Homo sapiens
cttctgcccttgcca

SEQ ID NO: 5609738 - DNA, 19 bp, Homo sapiens
cttctgccggccctggggc

SEQ ID NO: 5609739 - DNA, 18 bp, Homo sapiens
cttctgcctaacttgtaa

SEQ ID NO: 5609740 - DNA, 15 bp, Homo sapiens
cttctgcctcagctt

SEQ ID NO: 5609741 - DNA, 21 bp, Homo sapiens
cttctgcctctaagctgctct

SEQ ID NO: 5609742 - DNA, 14 bp, Homo sapiens
cttctgcctggaga

SEQ ID NO: 5609743 - DNA, 14 bp, Homo sapiens
cttctgcctgttat

SEQ ID NO: 5609744 - DNA, 18 bp, Homo sapiens
cttctgccttagtctcag

SEQ ID NO: 5609745 - DNA, 19 bp, Homo sapiens
cttctgcggagcttctcca

SEQ ID NO: 5609746 - DNA, 18 bp, Homo sapiens
cttctgcgggctccctcc

SEQ ID NO: 5609747 - DNA, 22 bp, Homo sapiens
cttctgcgggctccctcctctg

SEQ ID NO: 5609748 - DNA, 17 bp, Homo sapiens
cttctgcggggctgaga

SEQ ID NO: 5609749 - DNA, 17 bp, Homo sapiens
cttctgcggtgaggcag

SEQ ID NO: 5609750 - DNA, 14 bp, Homo sapiens
cttctgcgtccacc

SEQ ID NO: 5609751 - DNA, 15 bp, Homo sapiens
cttctgcgtccacca

SEQ ID NO: 5609752 - DNA, 17 bp, Homo sapiens
cttctgcgtccaccagg

SEQ ID NO: 5609753 - DNA, 13 bp, Homo sapiens
cttctgctcacat

SEQ ID NO: 5609754 - DNA, 10 bp, Homo sapiens
cttctgctcc

SEQ ID NO: 5609755 - DNA, 12 bp, Homo sapiens
cttctgctccag

SEQ ID NO: 5609756 - DNA, 14 bp, Homo sapiens
cttctgctccagcc

SEQ ID NO: 5609757 - DNA, 22 bp, Homo sapiens
cttctgctccagcccctttgcc

SEQ ID NO: 5609758 - DNA, 19 bp, Homo sapiens
cttctgctcccaccccaga

SEQ ID NO: 5609759 - DNA, 12 bp, Homo sapiens
cttctgctcctt

SEQ ID NO: 5609760 - DNA, 13 bp, Homo sapiens
cttctgctgaaag

SEQ ID NO: 5609761 - DNA, 13 bp, Homo sapiens
cttctgctgcatc

SEQ ID NO: 5609762 - DNA, 17 bp, Homo sapiens
cttctgctgcccaggcc

SEQ ID NO: 5609763 - DNA, 19 bp, Homo sapiens
cttctgctgcccaggccac

SEQ ID NO: 5609764 - DNA, 19 bp, Homo sapiens
cttctgctggataaaatga

SEQ ID NO: 5609765 - DNA, 15 bp, Homo sapiens
cttctgctgggctgg

SEQ ID NO: 5609766 - DNA, 16 bp, Homo sapiens
cttctgctgggctggg

SEQ ID NO: 5609767 - DNA, 17 bp, Homo sapiens
cttctgctgggctgggg

SEQ ID NO: 5609768 - DNA, 18 bp, Homo sapiens
cttctgctggggcctggg

SEQ ID NO: 5609769 - DNA, 19 bp, Homo sapiens
cttctgctggggcctggga

SEQ ID NO: 5609770 - DNA, 16 bp, Homo sapiens
cttctgctgtacagat

SEQ ID NO: 5609771 - DNA, 15 bp, Homo sapiens
cttctgcttaggaga

SEQ ID NO: 5609772 - DNA, 13 bp, Homo sapiens
cttctgcttcagc

SEQ ID NO: 5609773 - DNA, 16 bp, Homo sapiens
cttctgcttcagcctc

SEQ ID NO: 5609774 - DNA, 16 bp, Homo sapiens
cttctgcttcatcctg

SEQ ID NO: 5609775 - DNA, 12 bp, Homo sapiens
cttctgcttcca

SEQ ID NO: 5609776 - DNA, 15 bp, Homo sapiens
cttctgcttgtccca

SEQ ID NO: 5609777 - DNA, 15 bp, Homo sapiens
cttctgctttgttgt

SEQ ID NO: 5609778 - DNA, 22 bp, Homo sapiens
cttctgcttttctgccctggct

SEQ ID NO: 5609779 - DNA, 14 bp, Homo sapiens
cttctggaaactgt

SEQ ID NO: 5609780 - DNA, 14 bp, Homo sapiens
cttctggaaggctg

SEQ ID NO: 5609781 - DNA, 18 bp, Homo sapiens
cttctggaaggctggctg

SEQ ID NO: 5609782 - DNA, 15 bp, Homo sapiens
cttctggacactgag

SEQ ID NO: 5609783 - DNA, 17 bp, Homo sapiens
cttctggagatggatcc

SEQ ID NO: 5609784 - DNA, 22 bp, Homo sapiens
cttctggagcagaactttccag

SEQ ID NO: 5609785 - DNA, 11 bp, Homo sapiens
cttctggagcc

SEQ ID NO: 5609786 - DNA, 15 bp, Homo sapiens
cttctggagctggga

SEQ ID NO: 5609787 - DNA, 22 bp, Homo sapiens
cttctggaggtggggagggcct

SEQ ID NO: 5609788 - DNA, 18 bp, Homo sapiens
cttctggagtctccagtg

SEQ ID NO: 5609789 - DNA, 20 bp, Homo sapiens
cttctggagtctccagtggt

SEQ ID NO: 5609790 - DNA, 17 bp, Homo sapiens
cttctggagtttctcta

SEQ ID NO: 5609791 - DNA, 18 bp, Homo sapiens
cttctggagtttctctaa

SEQ ID NO: 5609792 - DNA, 16 bp, Homo sapiens
cttctggatccatggg

SEQ ID NO: 5609793 - DNA, 18 bp, Homo sapiens
cttctggatggattttat

SEQ ID NO: 5609794 - DNA, 16 bp, Homo sapiens
cttctggattcttggc

SEQ ID NO: 5609795 - DNA, 18 bp, Homo sapiens
cttctggattcttggccc

SEQ ID NO: 5609796 - DNA, 21 bp, Homo sapiens
cttctggccggtgctgggttc

SEQ ID NO: 5609797 - DNA, 22 bp, Homo sapiens
cttctggccggtgctgggttcc

SEQ ID NO: 5609798 - DNA, 23 bp, Homo sapiens
cttctggccggtgctgggttccc

SEQ ID NO: 5609799 - DNA, 14 bp, Homo sapiens
cttctggcctccag

SEQ ID NO: 5609800 - DNA, 19 bp, Homo sapiens
cttctggcctcccacagac

SEQ ID NO: 5609801 - DNA, 11 bp, Homo sapiens
cttctggctcc

SEQ ID NO: 5609802 - DNA, 13 bp, Homo sapiens
cttctggctcctc

SEQ ID NO: 5609803 - DNA, 22 bp, Homo sapiens
cttctggctcctccttcccctg

SEQ ID NO: 5609804 - DNA, 14 bp, Homo sapiens
cttctggctgctgc

SEQ ID NO: 5609805 - DNA, 18 bp, Homo sapiens
cttctggcttatgctcag

SEQ ID NO: 5609806 - DNA, 22 bp, Homo sapiens
cttctggcttatgctcagaagc

SEQ ID NO: 5609807 - DNA, 24 bp, Homo sapiens
cttctggcttatgctcagaagcca

SEQ ID NO: 5609808 - DNA, 16 bp, Homo sapiens
cttctgggaaaaacaa

SEQ ID NO: 5609809 - DNA, 15 bp, Homo sapiens
cttgaaaccagtatt

SEQ ID NO: 5609810 - DNA, 20 bp, Homo sapiens
cttgaaacctgttaaaacaa

SEQ ID NO: 5609811 - DNA, 15 bp, Homo sapiens
cttgaaacctttcta

SEQ ID NO: 5609812 - DNA, 17 bp, Homo sapiens
cttgaaacctttctact

SEQ ID NO: 5609813 - DNA, 21 bp, Homo sapiens
cttgaaacctttctacttttt

SEQ ID NO: 5609814 - DNA, 16 bp, Homo sapiens
cttgaaacttcagccc

SEQ ID NO: 5609815 - DNA, 16 bp, Homo sapiens
cttgaaactttgggaa

SEQ ID NO: 5609816 - DNA, 13 bp, Homo sapiens
cttgaaagatttt

SEQ ID NO: 5609817 - DNA, 22 bp, Homo sapiens
cttgaaagcagttaaactgatt

SEQ ID NO: 5609818 - DNA, 23 bp, Homo sapiens
cttgaaagccaagtgttttgtat

SEQ ID NO: 5609819 - DNA, 13 bp, Homo sapiens
cttgaaagctgtg

SEQ ID NO: 5609820 - DNA, 16 bp, Homo sapiens
cttgaaaggggaaacg

SEQ ID NO: 5609821 - DNA, 23 bp, Homo sapiens
cttgaaaggggaaacgtctccca

SEQ ID NO: 5609822 - DNA, 23 bp, Homo sapiens
cttgaaagttttccagtattgaa

SEQ ID NO: 5609823 - DNA, 15 bp, Homo sapiens
cttgaaagttttcta

SEQ ID NO: 5609824 - DNA, 22 bp, Homo sapiens
cttgaaatatataatattcagc

SEQ ID NO: 5609825 - DNA, 19 bp, Homo sapiens
cttgaaatatcctgcttga

SEQ ID NO: 5609826 - DNA, 16 bp, Homo sapiens
cttgaaatattcagaa

SEQ ID NO: 5609827 - DNA, 15 bp, Homo sapiens
cttgaaatcaagaga

SEQ ID NO: 5609828 - DNA, 13 bp, Homo sapiens
cttgaaatgaaag

SEQ ID NO: 5609829 - DNA, 14 bp, Homo sapiens
cttgaaatgaaagg

SEQ ID NO: 5609830 - DNA, 19 bp, Homo sapiens
cttgaaatgaaagggaaac

SEQ ID NO: 5609831 - DNA, 20 bp, Homo sapiens
cttgaaatgaaagggaaact

SEQ ID NO: 5609832 - DNA, 21 bp, Homo sapiens
cttgaaatgaaagggaaactg

SEQ ID NO: 5609833 - DNA, 15 bp, Homo sapiens
cttgaaatgagtaaa

SEQ ID NO: 5609834 - DNA, 18 bp, Homo sapiens
cttgaaattactgtgtaa

SEQ ID NO: 5609835 - DNA, 24 bp, Homo sapiens
cttgaaattatatctgtggtcttc

SEQ ID NO: 5609836 - DNA, 11 bp, Homo sapiens
cttgaaattga

SEQ ID NO: 5609837 - DNA, 14 bp, Homo sapiens
cttgaaattgaaga

SEQ ID NO: 5609838 - DNA, 20 bp, Homo sapiens
cttgaaattgattaacttat

SEQ ID NO: 5609839 - DNA, 14 bp, Homo sapiens
cttgaaatttacac

SEQ ID NO: 5609840 - DNA, 17 bp, Homo sapiens
cttgaaatttacacagt

SEQ ID NO: 5609841 - DNA, 18 bp, Homo sapiens
cttgaaatttacacagtg

SEQ ID NO: 5609842 - DNA, 14 bp, Homo sapiens
cttgaaattttaac

SEQ ID NO: 5609843 - DNA, 16 bp, Homo sapiens
cttgaaattttaacct

SEQ ID NO: 5609844 - DNA, 23 bp, Homo sapiens
cttgaacaacccaatctggctgg

SEQ ID NO: 5609845 - DNA, 15 bp, Homo sapiens
cttgaacaccacgct

SEQ ID NO: 5609846 - DNA, 19 bp, Homo sapiens
cttgaacactcatgctgaa

SEQ ID NO: 5609847 - DNA, 23 bp, Homo sapiens
cttgaacactcatgctgaaagcc

SEQ ID NO: 5609848 - DNA, 14 bp, Homo sapiens
cttgaaccacttcc

SEQ ID NO: 5609849 - DNA, 15 bp, Homo sapiens
cttgaaccacttccc

SEQ ID NO: 5609850 - DNA, 14 bp, Homo sapiens
cttgaaccataaaa

SEQ ID NO: 5609851 - DNA, 17 bp, Homo sapiens
cttgaaccataaaatgt

SEQ ID NO: 5609852 - DNA, 23 bp, Homo sapiens
cttgaacccaggccatgtggtta

SEQ ID NO: 5609853 - DNA, 22 bp, Homo sapiens
cttgaaccccaaatgctctctc

SEQ ID NO: 5609854 - DNA, 14 bp, Homo sapiens
cttgaacccccctc

SEQ ID NO: 5609855 - DNA, 24 bp, Homo sapiens
cttgaaccccctccctgtcccagg

SEQ ID NO: 5609856 - DNA, 19 bp, Homo sapiens
cttgaacccgggggacaga

SEQ ID NO: 5609857 - DNA, 20 bp, Homo sapiens
cttgaacctcattaaatggt

SEQ ID NO: 5609858 - DNA, 18 bp, Homo sapiens
cttgaacctgggaagtgg

SEQ ID NO: 5609859 - DNA, 19 bp, Homo sapiens
cttgaacctgggaggcaga

SEQ ID NO: 5609860 - DNA, 14 bp, Homo sapiens
cttgaaccttcaaa

SEQ ID NO: 5609861 - DNA, 15 bp, Homo sapiens
cttgaacgagcagcc

SEQ ID NO: 5609862 - DNA, 16 bp, Homo sapiens
cttgaacgttttctaa

SEQ ID NO: 5609863 - DNA, 19 bp, Homo sapiens
cttgaacgttttctaattg

SEQ ID NO: 5609864 - DNA, 21 bp, Homo sapiens
cttgaacgttttctaattgct

SEQ ID NO: 5609865 - DNA, 17 bp, Homo sapiens
cttgaactcctgacctc

SEQ ID NO: 5609866 - DNA, 21 bp, Homo sapiens
cttgaactcctgacctcaggt

SEQ ID NO: 5609867 - DNA, 23 bp, Homo sapiens
cttgaactcctgacgtcaagtga

SEQ ID NO: 5609868 - DNA, 18 bp, Homo sapiens
cttgaactcctggactca

SEQ ID NO: 5609869 - DNA, 17 bp, Homo sapiens
cttgaactcctggcctc

SEQ ID NO: 5609870 - DNA, 14 bp, Homo sapiens
cttgaactctgggc

SEQ ID NO: 5609871 - DNA, 19 bp, Homo sapiens
cttgaactctgttccccca

SEQ ID NO: 5609872 - DNA, 18 bp, Homo sapiens
cttgaactcttggcctca

SEQ ID NO: 5609873 - DNA, 19 bp, Homo sapiens
cttgaactgagcttggaag

SEQ ID NO: 5609874 - DNA, 20 bp, Homo sapiens
cttgaactgaggccctgtga

SEQ ID NO: 5609875 - DNA, 20 bp, Homo sapiens
cttgaactgggtacttgtgg

SEQ ID NO: 5609876 - DNA, 12 bp, Homo sapiens
cttgaactgttg

SEQ ID NO: 5609877 - DNA, 20 bp, Homo sapiens
cttgaactgttgcccttctg

SEQ ID NO: 5609878 - DNA, 15 bp, Homo sapiens
cttgaacttgaaaaa

SEQ ID NO: 5609879 - DNA, 17 bp, Homo sapiens
cttgaacttgaaaaaaa

SEQ ID NO: 5609880 - DNA, 19 bp, Homo sapiens
cttgaacttgcaggcaagc

SEQ ID NO: 5609881 - DNA, 19 bp, Homo sapiens
cttgaactttcctggatgt

SEQ ID NO: 5609882 - DNA, 10 bp, Homo sapiens
cttgaagaaa

SEQ ID NO: 5609883 - DNA, 20 bp, Homo sapiens
cttgaagaaaatgactttat

SEQ ID NO: 5609884 - DNA, 12 bp, Homo sapiens
cttgaagaaacg

SEQ ID NO: 5609885 - DNA, 20 bp, Homo sapiens
cttgaagaactgcaggccct

SEQ ID NO: 5609886 - DNA, 15 bp, Homo sapiens
cttgaagaaggaaag

SEQ ID NO: 5609887 - DNA, 18 bp, Homo sapiens
cttgaagaatttgttctt

SEQ ID NO: 5609888 - DNA, 16 bp, Homo sapiens
cttgaagacttttctt

SEQ ID NO: 5609889 - DNA, 19 bp, Homo sapiens
cttgaagagaaaaaagtca

SEQ ID NO: 5609890 - DNA, 13 bp, Homo sapiens
cttgaagatcgtt

SEQ ID NO: 5609891 - DNA, 17 bp, Homo sapiens
cttgaagattcaggctt

SEQ ID NO: 5609892 - DNA, 18 bp, Homo sapiens
cttgaagattcaggcttg

SEQ ID NO: 5609893 - DNA, 15 bp, Homo sapiens
cttgaagcaacttgg

SEQ ID NO: 5609894 - DNA, 17 bp, Homo sapiens
cttgaagcaagaaagag

SEQ ID NO: 5609895 - DNA, 18 bp, Homo sapiens
cttgaagcacagagggct

SEQ ID NO: 5609896 - DNA, 12 bp, Homo sapiens
cttgaagcagtc

SEQ ID NO: 5609897 - DNA, 19 bp, Homo sapiens
cttgaagcatttcaaagcc

SEQ ID NO: 5609898 - DNA, 23 bp, Homo sapiens
cttgaagcatttcaaagccctgc

SEQ ID NO: 5609899 - DNA, 24 bp, Homo sapiens
cttgaagcatttcaaagccctgcc

SEQ ID NO: 5609900 - DNA, 12 bp, Homo sapiens
cttgaagccaaa

SEQ ID NO: 5609901 - DNA, 15 bp, Homo sapiens
cttgaagccaaagaa

SEQ ID NO: 5609902 - DNA, 18 bp, Homo sapiens
cttgaagccactgaagct

SEQ ID NO: 5609903 - DNA, 18 bp, Homo sapiens
cttgaagcctccacacca

SEQ ID NO: 5609904 - DNA, 22 bp, Homo sapiens
cttgaagcctccacaccagctg

SEQ ID NO: 5609905 - DNA, 17 bp, Homo sapiens
cttgaagcttgtatctg

SEQ ID NO: 5609906 - DNA, 15 bp, Homo sapiens
cttgaaggaaaaatt

SEQ ID NO: 5609907 - DNA, 14 bp, Homo sapiens
cttgaaggaacagt

SEQ ID NO: 5609908 - DNA, 16 bp, Homo sapiens
cttgaaggaacagtgc

SEQ ID NO: 5609909 - DNA, 13 bp, Homo sapiens
cttgaaggactgc

SEQ ID NO: 5609910 - DNA, 19 bp, Homo sapiens
cttgaaggattgcatcctg

SEQ ID NO: 5609911 - DNA, 23 bp, Homo sapiens
cttgaaggattgcatcctgctgg

SEQ ID NO: 5609912 - DNA, 17 bp, Homo sapiens
cttgaaggccctgctga

SEQ ID NO: 5609913 - DNA, 18 bp, Homo sapiens
cttgaaggccctgctgag

SEQ ID NO: 5609914 - DNA, 13 bp, Homo sapiens
cttgaagggccag

SEQ ID NO: 5609915 - DNA, 15 bp, Homo sapiens
cttgaagggccagag

SEQ ID NO: 5609916 - DNA, 16 bp, Homo sapiens
cttgaagggccagagc

SEQ ID NO: 5609917 - DNA, 19 bp, Homo sapiens
cttgaagggccagagccag

SEQ ID NO: 5609918 - DNA, 20 bp, Homo sapiens
cttgaagggccagagccagg

SEQ ID NO: 5609919 - DNA, 13 bp, Homo sapiens
cttgaagggccca

SEQ ID NO: 5609920 - DNA, 16 bp, Homo sapiens
cttgaagggcccagga

SEQ ID NO: 5609921 - DNA, 14 bp, Homo sapiens
cttgaagggttact

SEQ ID NO: 5609922 - DNA, 16 bp, Homo sapiens
cttgaaggtacacccc

SEQ ID NO: 5609923 - DNA, 17 bp, Homo sapiens
cttgaagtaggaagtag

SEQ ID NO: 5609924 - DNA, 11 bp, Homo sapiens
cttgaagtcag

SEQ ID NO: 5609925 - DNA, 20 bp, Homo sapiens
cttgaagtcagccacactgg

SEQ ID NO: 5609926 - DNA, 19 bp, Homo sapiens
cttgaagtctaaaagcaga

SEQ ID NO: 5609927 - DNA, 20 bp, Homo sapiens
cttgaagtggtttctaagat

SEQ ID NO: 5609928 - DNA, 18 bp, Homo sapiens
cttgaagttctgaaattt

SEQ ID NO: 5609929 - DNA, 10 bp, Homo sapiens
cttgaagttg

SEQ ID NO: 5609930 - DNA, 11 bp, Homo sapiens
cttgaataaag

SEQ ID NO: 5609931 - DNA, 19 bp, Homo sapiens
cttgaatactctgccctct

SEQ ID NO: 5609932 - DNA, 22 bp, Homo sapiens
cttgaatactttgagtaaactt

SEQ ID NO: 5609933 - DNA, 17 bp, Homo sapiens
cttgaatagtattgtgt

SEQ ID NO: 5609934 - DNA, 18 bp, Homo sapiens
cttgaatagtattgtgtt

SEQ ID NO: 5609935 - DNA, 13 bp, Homo sapiens
cttgaatataaaa

SEQ ID NO: 5609936 - DNA, 24 bp, Homo sapiens
cttgaatatctgccccagtagtca

SEQ ID NO: 5609937 - DNA, 14 bp, Homo sapiens
cttgaatatgtagc

SEQ ID NO: 5609938 - DNA, 16 bp, Homo sapiens
cttgaatattcctgga

SEQ ID NO: 5609939 - DNA, 21 bp, Homo sapiens
cttgaatcagcatctcttctt

SEQ ID NO: 5609940 - DNA, 21 bp, Homo sapiens
cttgaatcaggaggagattaa

SEQ ID NO: 5609941 - DNA, 20 bp, Homo sapiens
cttgaatcagtttttaaaat

SEQ ID NO: 5609942 - DNA, 18 bp, Homo sapiens
cttgaatcctagggcctg

SEQ ID NO: 5609943 - DNA, 16 bp, Homo sapiens
cttgaatcctatgtat

SEQ ID NO: 5609944 - DNA, 15 bp, Homo sapiens
cttgaatcctctatt

SEQ ID NO: 5609945 - DNA, 12 bp, Homo sapiens
cttgaatgaaaa

SEQ ID NO: 5609946 - DNA, 20 bp, Homo sapiens
cttgaatgatgccatgagga

SEQ ID NO: 5609947 - DNA, 14 bp, Homo sapiens
cttgaatgctgcca

SEQ ID NO: 5609948 - DNA, 13 bp, Homo sapiens
cttgaatgcttaa

SEQ ID NO: 5609949 - DNA, 18 bp, Homo sapiens
cttgaatgcttaaatgat

SEQ ID NO: 5609950 - DNA, 23 bp, Homo sapiens
cttgaatgggcatgaatggagat

SEQ ID NO: 5609951 - DNA, 15 bp, Homo sapiens
cttgaatgtacaaag

SEQ ID NO: 5609952 - DNA, 16 bp, Homo sapiens
cttgaatgtacaaaga

SEQ ID NO: 5609953 - DNA, 17 bp, Homo sapiens
cttgaatgtacaaagat

SEQ ID NO: 5609954 - DNA, 21 bp, Homo sapiens
cttgaatgtacaaagatactt

SEQ ID NO: 5609955 - DNA, 21 bp, Homo sapiens
cttgaatgtagcagccccggg

SEQ ID NO: 5609956 - DNA, 20 bp, Homo sapiens
cttgaatgtccccattctat

SEQ ID NO: 5609957 - DNA, 19 bp, Homo sapiens
cttgaatgtggcttgagaa

SEQ ID NO: 5609958 - DNA, 14 bp, Homo sapiens
cttgaattattttg

SEQ ID NO: 5609959 - DNA, 20 bp, Homo sapiens
cttgaattgtaactgttctt

SEQ ID NO: 5609960 - DNA, 21 bp, Homo sapiens
cttgaattgtaactgttcttg

SEQ ID NO: 5609961 - DNA, 18 bp, Homo sapiens
cttgaattgtaaggaatg

SEQ ID NO: 5609962 - DNA, 14 bp, Homo sapiens
cttgaattgtctag

SEQ ID NO: 5609963 - DNA, 13 bp, Homo sapiens
cttgaattgtgta

SEQ ID NO: 5609964 - DNA, 20 bp, Homo sapiens
cttgaattgttatgaaaatc

SEQ ID NO: 5609965 - DNA, 13 bp, Homo sapiens
cttgaatttctag

SEQ ID NO: 5609966 - DNA, 16 bp, Homo sapiens
cttgaatttctagaca

SEQ ID NO: 5609967 - DNA, 18 bp, Homo sapiens
cttgaatttctggaagat

SEQ ID NO: 5609968 - DNA, 13 bp, Homo sapiens
cttgaatttgcat

SEQ ID NO: 5609969 - DNA, 23 bp, Homo sapiens
cttgaatttgcatgtctaattca

SEQ ID NO: 5609970 - DNA, 17 bp, Homo sapiens
cttgaattttcccactg

SEQ ID NO: 5609971 - DNA, 19 bp, Homo sapiens
cttgaattttcccactgca

SEQ ID NO: 5609972 - DNA, 11 bp, Homo sapiens
cttgaattttt

SEQ ID NO: 5609973 - DNA, 13 bp, Homo sapiens
cttgaatttttga

SEQ ID NO: 5609974 - DNA, 21 bp, Homo sapiens
cttgaattttttgaaatgggc

SEQ ID NO: 5609975 - DNA, 22 bp, Homo sapiens
cttgaatttttttctgcacagc

SEQ ID NO: 5609976 - DNA, 19 bp, Homo sapiens
cttgacaaaacctaacttg

SEQ ID NO: 5609977 - DNA, 22 bp, Homo sapiens
cttgacaaagtcaagccacatg

SEQ ID NO: 5609978 - DNA, 16 bp, Homo sapiens
cttgacaacagactga

SEQ ID NO: 5609979 - DNA, 14 bp, Homo sapiens
cttgacaactggca

SEQ ID NO: 5609980 - DNA, 20 bp, Homo sapiens
cttgacaactggcaggcagg

SEQ ID NO: 5609981 - DNA, 11 bp, Homo sapiens
cttgacaagct

SEQ ID NO: 5609982 - DNA, 23 bp, Homo sapiens
cttgacaagctgacttggcactt

SEQ ID NO: 5609983 - DNA, 17 bp, Homo sapiens
cttgacaatagaacatt

SEQ ID NO: 5609984 - DNA, 16 bp, Homo sapiens
cttgacaatcatctcc

SEQ ID NO: 5609985 - DNA, 18 bp, Homo sapiens
cttgacaatcatctccaa

SEQ ID NO: 5609986 - DNA, 22 bp, Homo sapiens
cttgacaattcccgggcccttc

SEQ ID NO: 5609987 - DNA, 17 bp, Homo sapiens
cttgccatcctgatgga

SEQ ID NO: 5609988 - DNA, 23 bp, Homo sapiens
cttgccatgaaggcacctgcccc

SEQ ID NO: 5609989 - DNA, 13 bp, Homo sapiens
cttgccatgcagg

SEQ ID NO: 5609990 - DNA, 23 bp, Homo sapiens
cttgccatgcttcagtgaacata

SEQ ID NO: 5609991 - DNA, 21 bp, Homo sapiens
cttgccatgtgactctggctt

SEQ ID NO: 5609992 - DNA, 15 bp, Homo sapiens
cttgccattctcttg

SEQ ID NO: 5609993 - DNA, 19 bp, Homo sapiens
cttgccattctcttgcatt

SEQ ID NO: 5609994 - DNA, 16 bp, Homo sapiens
cttgccattgccagga

SEQ ID NO: 5609995 - DNA, 20 bp, Homo sapiens
cttgccattgccaggagatg

SEQ ID NO: 5609996 - DNA, 17 bp, Homo sapiens
cttgccatttctttata

SEQ ID NO: 5609997 - DNA, 18 bp, Homo sapiens
cttgccatttgtagcttt

SEQ ID NO: 5609998 - DNA, 15 bp, Homo sapiens
cttgcccaactccca

SEQ ID NO: 5609999 - DNA, 21 bp, Homo sapiens
cttgcccaactcccagccacc

SEQ ID NO: 5610000 - DNA, 18 bp, Homo sapiens
cttgcccaagtcacacag

SEQ ID NO: 5610001 - DNA, 19 bp, Homo sapiens
cttgcccaagtcacacagc

SEQ ID NO: 5610002 - DNA, 20 bp, Homo sapiens
cttgcccaagtcacacagct

SEQ ID NO: 5610003 - DNA, 22 bp, Homo sapiens
cttgcccaagtcacacagctag

SEQ ID NO: 5610004 - DNA, 14 bp, Homo sapiens
cttgcccacaccga

SEQ ID NO: 5610005 - DNA, 21 bp, Homo sapiens
cttgcccactggccgctgagc

SEQ ID NO: 5610006 - DNA, 21 bp, Homo sapiens
cttgcccagagatgcctccac

SEQ ID NO: 5610007 - DNA, 23 bp, Homo sapiens
cttgcccagagatgcctccaccg

SEQ ID NO: 5610008 - DNA, 13 bp, Homo sapiens
cttgcccagcttt

SEQ ID NO: 5610009 - DNA, 13 bp, Homo sapiens
cttgcccaggagc

SEQ ID NO: 5610010 - DNA, 13 bp, Homo sapiens
cttgcccagggct

SEQ ID NO: 5610011 - DNA, 14 bp, Homo sapiens
cttgcccagggctc

SEQ ID NO: 5610012 - DNA, 18 bp, Homo sapiens
cttgcccagggctcagcc

SEQ ID NO: 5610013 - DNA, 20 bp, Homo sapiens
cttgcccagggctcagcctg

SEQ ID NO: 5610014 - DNA, 21 bp, Homo sapiens
cttgcccagggctcagcctgg

SEQ ID NO: 5610015 - DNA, 23 bp, Homo sapiens
cttgcccagggctcagcctggtg

SEQ ID NO: 5610016 - DNA, 20 bp, Homo sapiens
cttgcccaggtcaccaagca

SEQ ID NO: 5610017 - DNA, 23 bp, Homo sapiens
cttgcccaggtcaccaagcagtg

SEQ ID NO: 5610018 - DNA, 20 bp, Homo sapiens
cttgcccagtttcagggcta

SEQ ID NO: 5610019 - DNA, 18 bp, Homo sapiens
cttgccccaacccccagc

SEQ ID NO: 5610020 - DNA, 19 bp, Homo sapiens
cttgccccaacccccagca

SEQ ID NO: 5610021 - DNA, 20 bp, Homo sapiens
cttgccccacagttgtgttc

SEQ ID NO: 5610022 - DNA, 21 bp, Homo sapiens
cttgccccacagttgtgttca

SEQ ID NO: 5610023 - DNA, 21 bp, Homo sapiens
cttgccccactcctctccacc

SEQ ID NO: 5610024 - DNA, 19 bp, Homo sapiens
cttgccccaggactctggc

SEQ ID NO: 5610025 - DNA, 12 bp, Homo sapiens
cttgccccaggc

SEQ ID NO: 5610026 - DNA, 16 bp, Homo sapiens
cttgccccaggccagg

SEQ ID NO: 5610027 - DNA, 16 bp, Homo sapiens
cttgccccagtcctgg

SEQ ID NO: 5610028 - DNA, 14 bp, Homo sapiens
cttgccccagtttg

SEQ ID NO: 5610029 - DNA, 17 bp, Homo sapiens
cttgccccatcactgcg

SEQ ID NO: 5610030 - DNA, 14 bp, Homo sapiens
cttgcccccatccc

SEQ ID NO: 5610031 - DNA, 16 bp, Homo sapiens
cttgcccccatccctc

SEQ ID NO: 5610032 - DNA, 19 bp, Homo sapiens
cttgccccccaccccagcc

SEQ ID NO: 5610033 - DNA, 20 bp, Homo sapiens
cttgccccccgccctcatgg

SEQ ID NO: 5610034 - DNA, 23 bp, Homo sapiens
cttgccccctgcccgtgtacata

SEQ ID NO: 5610035 - DNA, 22 bp, Homo sapiens
cttgccccctttgaccttcccc

SEQ ID NO: 5610036 - DNA, 23 bp, Homo sapiens
cttgccccctttgaccttcccca

SEQ ID NO: 5610037 - DNA, 21 bp, Homo sapiens
cttgccccggccccggcccca

SEQ ID NO: 5610038 - DNA, 21 bp, Homo sapiens
cttgcccctccagagacagga

SEQ ID NO: 5610039 - DNA, 14 bp, Homo sapiens
cttgccccttgggc

SEQ ID NO: 5610040 - DNA, 18 bp, Homo sapiens
cttgccccttgggcctcc

SEQ ID NO: 5610041 - DNA, 20 bp, Homo sapiens
cttgcccgcacccctccctg

SEQ ID NO: 5610042 - DNA, 15 bp, Homo sapiens
cttgcccgccagcct

SEQ ID NO: 5610043 - DNA, 16 bp, Homo sapiens
cttgcccgccagcctc

SEQ ID NO: 5610044 - DNA, 12 bp, Homo sapiens
cttgcccggctg

SEQ ID NO: 5610045 - DNA, 16 bp, Homo sapiens
cttgcccgtcgtgtgc

SEQ ID NO: 5610046 - DNA, 14 bp, Homo sapiens
cttgccctccgcct

SEQ ID NO: 5610047 - DNA, 19 bp, Homo sapiens
cttgccctccgcctgggat

SEQ ID NO: 5610048 - DNA, 21 bp, Homo sapiens
cttgccctccgcctgggatct

SEQ ID NO: 5610049 - DNA, 15 bp, Homo sapiens
cttgccctcctgggc

SEQ ID NO: 5610050 - DNA, 16 bp, Homo sapiens
cttgccctcctgggcc

SEQ ID NO: 5610051 - DNA, 18 bp, Homo sapiens
cttgccctgacctcccag

SEQ ID NO: 5610052 - DNA, 19 bp, Homo sapiens
cttgccctgacctcccagc

SEQ ID NO: 5610053 - DNA, 21 bp, Homo sapiens
cttgccctgagcactcctggt

SEQ ID NO: 5610054 - DNA, 20 bp, Homo sapiens
cttgccctgagctttccggg

SEQ ID NO: 5610055 - DNA, 23 bp, Homo sapiens
cttgccctgccgccgcctcccgg

SEQ ID NO: 5610056 - DNA, 15 bp, Homo sapiens
cttgccctgggccag

SEQ ID NO: 5610057 - DNA, 16 bp, Homo sapiens
cttgccctgggctgcc

SEQ ID NO: 5610058 - DNA, 19 bp, Homo sapiens
cttgccctgtgttctttcc

SEQ ID NO: 5610059 - DNA, 20 bp, Homo sapiens
cttgccctgtgttctttccc

SEQ ID NO: 5610060 - DNA, 14 bp, Homo sapiens
cttgccctgttaaa

SEQ ID NO: 5610061 - DNA, 18 bp, Homo sapiens
cttgccctgttctcttca

SEQ ID NO: 5610062 - DNA, 15 bp, Homo sapiens
cttgcccttccctgt

SEQ ID NO: 5610063 - DNA, 15 bp, Homo sapiens
cttgcccttgccctg

SEQ ID NO: 5610064 - DNA, 17 bp, Homo sapiens
cttgcccttgccctgac

SEQ ID NO: 5610065 - DNA, 12 bp, Homo sapiens
cttgcccttgga

SEQ ID NO: 5610066 - DNA, 14 bp, Homo sapiens
cttgcccttggagc

SEQ ID NO: 5610067 - DNA, 18 bp, Homo sapiens
cttgcccttggagctgcc

SEQ ID NO: 5610068 - DNA, 18 bp, Homo sapiens
cttgcccttgggtgctat

SEQ ID NO: 5610069 - DNA, 15 bp, Homo sapiens
cttgccgaaactgga

SEQ ID NO: 5610070 - DNA, 19 bp, Homo sapiens
cttgccgactggctgtgag

SEQ ID NO: 5610071 - DNA, 18 bp, Homo sapiens
cttgccgaggagccaggc

SEQ ID NO: 5610072 - DNA, 21 bp, Homo sapiens
cttgccgggcctgggcctcct

SEQ ID NO: 5610073 - DNA, 15 bp, Homo sapiens
cttgccgtcactatt

SEQ ID NO: 5610074 - DNA, 21 bp, Homo sapiens
cttgcctaactaactggcagg

SEQ ID NO: 5610075 - DNA, 18 bp, Homo sapiens
cttgcctacttttcttta

SEQ ID NO: 5610076 - DNA, 20 bp, Homo sapiens
cttgcctagggcctggtcca

SEQ ID NO: 5610077 - DNA, 20 bp, Homo sapiens
cttgcctatgatactgtctc

SEQ ID NO: 5610078 - DNA, 17 bp, Homo sapiens
cttgcctcaacctccca

SEQ ID NO: 5610079 - DNA, 20 bp, Homo sapiens
cttgcctcaagttccatgct

SEQ ID NO: 5610080 - DNA, 17 bp, Homo sapiens
cttgcctcaatgccagt

SEQ ID NO: 5610081 - DNA, 17 bp, Homo sapiens
cttgcctcagggccaag

SEQ ID NO: 5610082 - DNA, 23 bp, Homo sapiens
cttgcctcatttttttccttgca

SEQ ID NO: 5610083 - DNA, 14 bp, Homo sapiens
cttgcctccatctt

SEQ ID NO: 5610084 - DNA, 21 bp, Homo sapiens
cttgcctccatggtgcctctg

SEQ ID NO: 5610085 - DNA, 14 bp, Homo sapiens
cttgcctccccatt

SEQ ID NO: 5610086 - DNA, 20 bp, Homo sapiens
cttgcctccccatttcccat

SEQ ID NO: 5610087 - DNA, 14 bp, Homo sapiens
cttgcctcctcagt

SEQ ID NO: 5610088 - DNA, 12 bp, Homo sapiens
cttgcctcctgt

SEQ ID NO: 5610089 - DNA, 15 bp, Homo sapiens
cttgcctcctgtgta

SEQ ID NO: 5610090 - DNA, 18 bp, Homo sapiens
cttgcctcggctcctgct

SEQ ID NO: 5610091 - DNA, 20 bp, Homo sapiens
cttgcctcggctcctgctgc

SEQ ID NO: 5610092 - DNA, 21 bp, Homo sapiens
cttgcctctaaatagcacttt

SEQ ID NO: 5610093 - DNA, 17 bp, Homo sapiens
cttgcctctgccctgga

SEQ ID NO: 5610094 - DNA, 23 bp, Homo sapiens
cttgcctctgtccccttctctca

SEQ ID NO: 5610095 - DNA, 14 bp, Homo sapiens
cttgcctctgtgct

SEQ ID NO: 5610096 - DNA, 12 bp, Homo sapiens
cttgcctcttcc

SEQ ID NO: 5610097 - DNA, 18 bp, Homo sapiens
cttgcctcttccttgaag

SEQ ID NO: 5610098 - DNA, 23 bp, Homo sapiens
cttgcctctttcctcctcatgaa

SEQ ID NO: 5610099 - DNA, 17 bp, Homo sapiens
cttgcctgaactccaga

SEQ ID NO: 5610100 - DNA, 19 bp, Homo sapiens
cttgcctgaactccagagg

SEQ ID NO: 5610101 - DNA, 18 bp, Homo sapiens
cttgcctgaatccatcag

SEQ ID NO: 5610102 - DNA, 23 bp, Homo sapiens
cttgcctgaatccatcaggactt

SEQ ID NO: 5610103 - DNA, 19 bp, Homo sapiens
cttgcctgaggctcaagag

SEQ ID NO: 5610104 - DNA, 24 bp, Homo sapiens
cttgcctgaggctcaagaggccca

SEQ ID NO: 5610105 - DNA, 14 bp, Homo sapiens
cttgcctgagggga

SEQ ID NO: 5610106 - DNA, 21 bp, Homo sapiens
cttgcctgaggggaaagagag

SEQ ID NO: 5610107 - DNA, 14 bp, Homo sapiens
cttgcctgatataa

SEQ ID NO: 5610108 - DNA, 16 bp, Homo sapiens
cttgcctgcacaaact

SEQ ID NO: 5610109 - DNA, 20 bp, Homo sapiens
cttgcctgcacccttcctcc

SEQ ID NO: 5610110 - DNA, 12 bp, Homo sapiens
cttgcctgcagg

SEQ ID NO: 5610111 - DNA, 13 bp, Homo sapiens
cttgcctgcaggg

SEQ ID NO: 5610112 - DNA, 17 bp, Homo sapiens
cttgcctgcagggccat

SEQ ID NO: 5610113 - DNA, 19 bp, Homo sapiens
cttgcctgccactgtgtga

SEQ ID NO: 5610114 - DNA, 12 bp, Homo sapiens
cttgcctgcctc

SEQ ID NO: 5610115 - DNA, 14 bp, Homo sapiens
cttgcctgcctcct

SEQ ID NO: 5610116 - DNA, 15 bp, Homo sapiens
cttgcctgcctttcc

SEQ ID NO: 5610117 - DNA, 14 bp, Homo sapiens
cttgcctgctgggc

SEQ ID NO: 5610118 - DNA, 11 bp, Homo sapiens
cttgcctggaa

SEQ ID NO: 5610119 - DNA, 12 bp, Homo sapiens
cttgcctggaat

SEQ ID NO: 5610120 - DNA, 17 bp, Homo sapiens
cttgcctggaataaaat

SEQ ID NO: 5610121 - DNA, 13 bp, Homo sapiens
cttgcctggggcc

SEQ ID NO: 5610122 - DNA, 18 bp, Homo sapiens
cttgcctggggtctgagc

SEQ ID NO: 5610123 - DNA, 17 bp, Homo sapiens
cttgcctgtctaaagcc

SEQ ID NO: 5610124 - DNA, 15 bp, Homo sapiens
cttgcctgtgccagg

SEQ ID NO: 5610125 - DNA, 20 bp, Homo sapiens
cttgcctgttggctgctgcg

SEQ ID NO: 5610126 - DNA, 22 bp, Homo sapiens
cttgcctgtttcccaggcccac

SEQ ID NO: 5610127 - DNA, 17 bp, Homo sapiens
cttgccttaataaatat

SEQ ID NO: 5610128 - DNA, 19 bp, Homo sapiens
cttgccttaataaatatgt

SEQ ID NO: 5610129 - DNA, 15 bp, Homo sapiens
cttgccttacacaaa

SEQ ID NO: 5610130 - DNA, 22 bp, Homo sapiens
cttgccttagaaacacataaat

SEQ ID NO: 5610131 - DNA, 15 bp, Homo sapiens
cttgccttcccctgt

SEQ ID NO: 5610132 - DNA, 18 bp, Homo sapiens
cttgccttcccctgtctt

SEQ ID NO: 5610133 - DNA, 20 bp, Homo sapiens
cttgccttcctaagcctgtg

SEQ ID NO: 5610134 - DNA, 22 bp, Homo sapiens
cttgccttcctaagcctgtggc

SEQ ID NO: 5610135 - DNA, 13 bp, Homo sapiens
cttgccttcctgc

SEQ ID NO: 5610136 - DNA, 20 bp, Homo sapiens
cttgccttgaaatttacaca

SEQ ID NO: 5610137 - DNA, 12 bp, Homo sapiens
cttgccttgctt

SEQ ID NO: 5610138 - DNA, 15 bp, Homo sapiens
cttgccttgcttctc

SEQ ID NO: 5610139 - DNA, 16 bp, Homo sapiens
cttgccttgcttctcc

SEQ ID NO: 5610140 - DNA, 18 bp, Homo sapiens
cttgccttgcttctccca

SEQ ID NO: 5610141 - DNA, 21 bp, Homo sapiens
cttgccttgcttctcccattt

SEQ ID NO: 5610142 - DNA, 15 bp, Homo sapiens
cttgcctttcagtat

SEQ ID NO: 5610143 - DNA, 17 bp, Homo sapiens
cttgccttttaaaagaa

SEQ ID NO: 5610144 - DNA, 16 bp, Homo sapiens
cttgccttttgttaat

SEQ ID NO: 5610145 - DNA, 14 bp, Homo sapiens
cttgcctttttcat

SEQ ID NO: 5610146 - DNA, 23 bp, Homo sapiens
cttgcctttttcattattttatt

SEQ ID NO: 5610147 - DNA, 20 bp, Homo sapiens
cttgcgaatccaagctccct

SEQ ID NO: 5610148 - DNA, 14 bp, Homo sapiens
cttgcgaccaccaa

SEQ ID NO: 5610149 - DNA, 15 bp, Homo sapiens
cttgcgagtccaagg

SEQ ID NO: 5610150 - DNA, 22 bp, Homo sapiens
cttgcgccgagaccgcagaggg

SEQ ID NO: 5610151 - DNA, 20 bp, Homo sapiens
cttgcgcctcagccctcagt

SEQ ID NO: 5610152 - DNA, 16 bp, Homo sapiens
cttgcgctgtcccagg

SEQ ID NO: 5610153 - DNA, 19 bp, Homo sapiens
cttgcgcttttgctggtca

SEQ ID NO: 5610154 - DNA, 15 bp, Homo sapiens
cttgcggaagccata

SEQ ID NO: 5610155 - DNA, 17 bp, Homo sapiens
cttgcggaagccatagg

SEQ ID NO: 5610156 - DNA, 22 bp, Homo sapiens
cttgcggaagccatagggggct

SEQ ID NO: 5610157 - DNA, 18 bp, Homo sapiens
cttgcggcaccgcccacc

SEQ ID NO: 5610158 - DNA, 21 bp, Homo sapiens
cttgcggcaccgcccacccac

SEQ ID NO: 5610159 - DNA, 14 bp, Homo sapiens
cttgcggccacagc

SEQ ID NO: 5610160 - DNA, 16 bp, Homo sapiens
cttgcggccacagcac

SEQ ID NO: 5610161 - DNA, 14 bp, Homo sapiens
cttgcgtcctgcag

SEQ ID NO: 5610162 - DNA, 15 bp, Homo sapiens
cttgcgtcctgcaga

SEQ ID NO: 5610163 - DNA, 14 bp, Homo sapiens
cttgctaagttttc

SEQ ID NO: 5610164 - DNA, 17 bp, Homo sapiens
cttggagggaagggaga

SEQ ID NO: 5610165 - DNA, 20 bp, Homo sapiens
cttggagggagaggtggcag

SEQ ID NO: 5610166 - DNA, 22 bp, Homo sapiens
cttggagggagaggtggcagga

SEQ ID NO: 5610167 - DNA, 18 bp, Homo sapiens
cttggagggctcagggca

SEQ ID NO: 5610168 - DNA, 17 bp, Homo sapiens
cttggagggggaagaga

SEQ ID NO: 5610169 - DNA, 14 bp, Homo sapiens
cttggagggtctgg

SEQ ID NO: 5610170 - DNA, 16 bp, Homo sapiens
cttggagggtctgggg

SEQ ID NO: 5610171 - DNA, 17 bp, Homo sapiens
cttggagggtctggggg

SEQ ID NO: 5610172 - DNA, 19 bp, Homo sapiens
cttggagggtctgggggca

SEQ ID NO: 5610173 - DNA, 23 bp, Homo sapiens
cttggagggtctgggggcagctg

SEQ ID NO: 5610174 - DNA, 18 bp, Homo sapiens
cttggaggtcacagctgg

SEQ ID NO: 5610175 - DNA, 22 bp, Homo sapiens
cttggagtattggggtctgacc

SEQ ID NO: 5610176 - DNA, 20 bp, Homo sapiens
cttggagtgccaagtttgca

SEQ ID NO: 5610177 - DNA, 13 bp, Homo sapiens
cttggagtgcccc

SEQ ID NO: 5610178 - DNA, 16 bp, Homo sapiens
cttggagtgctgcagc

SEQ ID NO: 5610179 - DNA, 23 bp, Homo sapiens
cttggataagccccaagcgaatt

SEQ ID NO: 5610180 - DNA, 19 bp, Homo sapiens
cttggataccagctcaggg

SEQ ID NO: 5610181 - DNA, 23 bp, Homo sapiens
cttggatacctagaccgttataa

SEQ ID NO: 5610182 - DNA, 22 bp, Homo sapiens
cttggatactccatggggtggg

SEQ ID NO: 5610183 - DNA, 21 bp, Homo sapiens
cttggataggagcttccagat

SEQ ID NO: 5610184 - DNA, 23 bp, Homo sapiens
cttggatattcaagcctttggat

SEQ ID NO: 5610185 - DNA, 15 bp, Homo sapiens
cttggatcctcagaa

SEQ ID NO: 5610186 - DNA, 16 bp, Homo sapiens
cttggatcgtggaaga

SEQ ID NO: 5610187 - DNA, 17 bp, Homo sapiens
cttggatcgtggaagaa

SEQ ID NO: 5610188 - DNA, 11 bp, Homo sapiens
cttggatgagg

SEQ ID NO: 5610189 - DNA, 15 bp, Homo sapiens
cttggatgcatgagc

SEQ ID NO: 5610190 - DNA, 14 bp, Homo sapiens
cttggatgcgagct

SEQ ID NO: 5610191 - DNA, 20 bp, Homo sapiens
cttggatgcgagcttggcct

SEQ ID NO: 5610192 - DNA, 22 bp, Homo sapiens
cttggatgcgagcttggccttg

SEQ ID NO: 5610193 - DNA, 15 bp, Homo sapiens
cttggatgtatatgt

SEQ ID NO: 5610194 - DNA, 16 bp, Homo sapiens
cttggatgtcatatct

SEQ ID NO: 5610195 - DNA, 15 bp, Homo sapiens
cttggattcaatttt

SEQ ID NO: 5610196 - DNA, 14 bp, Homo sapiens
cttggattcactaa

SEQ ID NO: 5610197 - DNA, 13 bp, Homo sapiens
cttggattcctgc

SEQ ID NO: 5610198 - DNA, 15 bp, Homo sapiens
cttggattctctaac

SEQ ID NO: 5610199 - DNA, 22 bp, Homo sapiens
cttggattggacaggagatcag

SEQ ID NO: 5610200 - DNA, 15 bp, Homo sapiens
cttggattgtccccg

SEQ ID NO: 5610201 - DNA, 23 bp, Homo sapiens
cttggattgtccccgacccttgc

SEQ ID NO: 5610202 - DNA, 24 bp, Homo sapiens
cttggattgtccccgacccttgcc

SEQ ID NO: 5610203 - DNA, 15 bp, Homo sapiens
cttggatttcgtgtg

SEQ ID NO: 5610204 - DNA, 20 bp, Homo sapiens
cttggatttcgtgtgccgct

SEQ ID NO: 5610205 - DNA, 19 bp, Homo sapiens
cttggatttgcatttttgt

SEQ ID NO: 5610206 - DNA, 16 bp, Homo sapiens
cttggattttcctgaa

SEQ ID NO: 5610207 - DNA, 15 bp, Homo sapiens
cttggcaaaagcctt

SEQ ID NO: 5610208 - DNA, 16 bp, Homo sapiens
cttggcaaaagccttg

SEQ ID NO: 5610209 - DNA, 21 bp, Homo sapiens
cttggcaaaagccttgtgtat

SEQ ID NO: 5610210 - DNA, 15 bp, Homo sapiens
cttggcaaattctga

SEQ ID NO: 5610211 - DNA, 14 bp, Homo sapiens
cttggcaaatttta

SEQ ID NO: 5610212 - DNA, 18 bp, Homo sapiens
cttggcaaattttaaaac

SEQ ID NO: 5610213 - DNA, 14 bp, Homo sapiens
cttggcaactttct

SEQ ID NO: 5610214 - DNA, 19 bp, Homo sapiens
cttggcaaggtcatagaca

SEQ ID NO: 5610215 - DNA, 22 bp, Homo sapiens
cttggcaataaattttgaaaag

SEQ ID NO: 5610216 - DNA, 18 bp, Homo sapiens
cttggcaatattccttag

SEQ ID NO: 5610217 - DNA, 21 bp, Homo sapiens
cttggcacatagtgggccttc

SEQ ID NO: 5610218 - DNA, 23 bp, Homo sapiens
cttggcacatagtgggccttcat

SEQ ID NO: 5610219 - DNA, 16 bp, Homo sapiens
cttggcaccaccaggg

SEQ ID NO: 5610220 - DNA, 18 bp, Homo sapiens
cttggcacccccatgctg

SEQ ID NO: 5610221 - DNA, 20 bp, Homo sapiens
cttggcacccccatgctgcc

SEQ ID NO: 5610222 - DNA, 17 bp, Homo sapiens
cttggcacctgcctagc

SEQ ID NO: 5610223 - DNA, 16 bp, Homo sapiens
cttggcacgagggggg

SEQ ID NO: 5610224 - DNA, 12 bp, Homo sapiens
cttggcacttaa

SEQ ID NO: 5610225 - DNA, 11 bp, Homo sapiens
cttggcacttt

SEQ ID NO: 5610226 - DNA, 12 bp, Homo sapiens
cttggcactttt

SEQ ID NO: 5610227 - DNA, 16 bp, Homo sapiens
cttggcagagaggacc

SEQ ID NO: 5610228 - DNA, 20 bp, Homo sapiens
cttggcagcacctgtctcct

SEQ ID NO: 5610229 - DNA, 18 bp, Homo sapiens
cttggcagccgagctcgt

SEQ ID NO: 5610230 - DNA, 14 bp, Homo sapiens
cttggcagcctact

SEQ ID NO: 5610231 - DNA, 10 bp, Homo sapiens
cttggcagct

SEQ ID NO: 5610232 - DNA, 15 bp, Homo sapiens
cttggcagctgaact

SEQ ID NO: 5610233 - DNA, 15 bp, Homo sapiens
cttggcagctttttc

SEQ ID NO: 5610234 - DNA, 20 bp, Homo sapiens
cttggcagctttttctgtgg

SEQ ID NO: 5610235 - DNA, 11 bp, Homo sapiens
cttggcaggct

SEQ ID NO: 5610236 - DNA, 23 bp, Homo sapiens
cttggcaggtaggaatattatat

SEQ ID NO: 5610237 - DNA, 20 bp, Homo sapiens
cttggcagttgcagtgctgc

SEQ ID NO: 5610238 - DNA, 16 bp, Homo sapiens
cttggcatacaaaata

SEQ ID NO: 5610239 - DNA, 23 bp, Homo sapiens
cttggcatcgaccacaccagcct

SEQ ID NO: 5610240 - DNA, 20 bp, Homo sapiens
cttggcatgccttccagcac

SEQ ID NO: 5610241 - DNA, 12 bp, Homo sapiens
cttggcattaaa

SEQ ID NO: 5610242 - DNA, 22 bp, Homo sapiens
cttggcattccgcatccctacc

SEQ ID NO: 5610243 - DNA, 16 bp, Homo sapiens
cttggcattgaccttc

SEQ ID NO: 5610244 - DNA, 19 bp, Homo sapiens
cttggcattgaccttcatg

SEQ ID NO: 5610245 - DNA, 16 bp, Homo sapiens
cttggcattggaattc

SEQ ID NO: 5610246 - DNA, 13 bp, Homo sapiens
cttggcatttcta

SEQ ID NO: 5610247 - DNA, 17 bp, Homo sapiens
cttggccaagcagggag

SEQ ID NO: 5610248 - DNA, 13 bp, Homo sapiens
cttggccacagac

SEQ ID NO: 5610249 - DNA, 19 bp, Homo sapiens
cttggccacagactgaact

SEQ ID NO: 5610250 - DNA, 16 bp, Homo sapiens
cttggccacagccagg

SEQ ID NO: 5610251 - DNA, 18 bp, Homo sapiens
cttggccacagccagggg

SEQ ID NO: 5610252 - DNA, 20 bp, Homo sapiens
cttggccaccaggactcctt

SEQ ID NO: 5610253 - DNA, 22 bp, Homo sapiens
cttggccagaagggggccatga

SEQ ID NO: 5610254 - DNA, 16 bp, Homo sapiens
cttggccagcgctgtt

SEQ ID NO: 5610255 - DNA, 15 bp, Homo sapiens
cttggccagttttct

SEQ ID NO: 5610256 - DNA, 15 bp, Homo sapiens
cttggccatgcagaa

SEQ ID NO: 5610257 - DNA, 16 bp, Homo sapiens
cttggccatgggaggc

SEQ ID NO: 5610258 - DNA, 20 bp, Homo sapiens
cttggccatgggaggccttt

SEQ ID NO: 5610259 - DNA, 18 bp, Homo sapiens
cttggcccacctgaggcc

SEQ ID NO: 5610260 - DNA, 11 bp, Homo sapiens
cttggcccagg

SEQ ID NO: 5610261 - DNA, 22 bp, Homo sapiens
cttggcccaggagctctgcgcc

SEQ ID NO: 5610262 - DNA, 14 bp, Homo sapiens
cttggcccaggagt

SEQ ID NO: 5610263 - DNA, 23 bp, Homo sapiens
cttggcccagggggcttcctgag

SEQ ID NO: 5610264 - DNA, 22 bp, Homo sapiens
cttggcccatcccgccttctcc

SEQ ID NO: 5610265 - DNA, 23 bp, Homo sapiens
cttggcccatcccgccttctcca

SEQ ID NO: 5610266 - DNA, 17 bp, Homo sapiens
cttggcccccttcagga

SEQ ID NO: 5610267 - DNA, 19 bp, Homo sapiens
cttggcccccttcaggagc

SEQ ID NO: 5610268 - DNA, 22 bp, Homo sapiens
cttggcccccttcaggagcctg

SEQ ID NO: 5610269 - DNA, 23 bp, Homo sapiens
cttggcccccttcaggagcctgg

SEQ ID NO: 5610270 - DNA, 18 bp, Homo sapiens
cttggcccgcacagagct

SEQ ID NO: 5610271 - DNA, 16 bp, Homo sapiens
cttggccctacagccc

SEQ ID NO: 5610272 - DNA, 15 bp, Homo sapiens
cttggccctcctcag

SEQ ID NO: 5610273 - DNA, 17 bp, Homo sapiens
cttggccctcctcagct

SEQ ID NO: 5610274 - DNA, 19 bp, Homo sapiens
cttggccctcctcagctcc

SEQ ID NO: 5610275 - DNA, 21 bp, Homo sapiens
cttggccctcctcagctccct

SEQ ID NO: 5610276 - DNA, 23 bp, Homo sapiens
cttggccctcctcagctccctgc

SEQ ID NO: 5610277 - DNA, 10 bp, Homo sapiens
cttggccctg

SEQ ID NO: 5610278 - DNA, 12 bp, Homo sapiens
cttggccctgcg

SEQ ID NO: 5610279 - DNA, 13 bp, Homo sapiens
cttggccctggca

SEQ ID NO: 5610280 - DNA, 14 bp, Homo sapiens
cttggcccttcaag

SEQ ID NO: 5610281 - DNA, 14 bp, Homo sapiens
cttggccctttcct

SEQ ID NO: 5610282 - DNA, 15 bp, Homo sapiens
cttggccctttcctt

SEQ ID NO: 5610283 - DNA, 15 bp, Homo sapiens
cttggccgactcagg

SEQ ID NO: 5610284 - DNA, 19 bp, Homo sapiens
cttggccgactcagggacc

SEQ ID NO: 5610285 - DNA, 21 bp, Homo sapiens
cttggccgcacctaaagcagc

SEQ ID NO: 5610286 - DNA, 15 bp, Homo sapiens
cttggccgtggcatt

SEQ ID NO: 5610287 - DNA, 21 bp, Homo sapiens
cttggcctagcccaccctgct

SEQ ID NO: 5610288 - DNA, 13 bp, Homo sapiens
cttggcctatctc

SEQ ID NO: 5610289 - DNA, 21 bp, Homo sapiens
cttggcctatctcctagggct

SEQ ID NO: 5610290 - DNA, 17 bp, Homo sapiens
cttggcctcaagttcaa

SEQ ID NO: 5610291 - DNA, 14 bp, Homo sapiens
cttggcctcacggg

SEQ ID NO: 5610292 - DNA, 16 bp, Homo sapiens
cttggcctcagctggc

SEQ ID NO: 5610293 - DNA, 19 bp, Homo sapiens
cttggcctcagctggctgt

SEQ ID NO: 5610294 - DNA, 15 bp, Homo sapiens
cttggcctcatgctg

SEQ ID NO: 5610295 - DNA, 15 bp, Homo sapiens
cttggcctcccaaag

SEQ ID NO: 5610296 - DNA, 23 bp, Homo sapiens
cttggcctcccaaagtgctggga

SEQ ID NO: 5610297 - DNA, 14 bp, Homo sapiens
cttggcctcccaga

SEQ ID NO: 5610298 - DNA, 13 bp, Homo sapiens
cttggcctctgct

SEQ ID NO: 5610299 - DNA, 19 bp, Homo sapiens
cttggcctgacctggcaca

SEQ ID NO: 5610300 - DNA, 13 bp, Homo sapiens
cttggcctgctgt

SEQ ID NO: 5610301 - DNA, 13 bp, Homo sapiens
cttggcctggagc

SEQ ID NO: 5610302 - DNA, 23 bp, Homo sapiens
cttggcctgtctcatccccaggg

SEQ ID NO: 5610303 - DNA, 17 bp, Homo sapiens
cttggccttctcccctc

SEQ ID NO: 5610304 - DNA, 19 bp, Homo sapiens
cttggccttgcagctggcc

SEQ ID NO: 5610305 - DNA, 16 bp, Homo sapiens
cttggccttggggcca

SEQ ID NO: 5610306 - DNA, 16 bp, Homo sapiens
cttggcctttcctgga

SEQ ID NO: 5610307 - DNA, 14 bp, Homo sapiens
cttggcgatgccag

SEQ ID NO: 5610308 - DNA, 18 bp, Homo sapiens
cttggcgatgccagccaa

SEQ ID NO: 5610309 - DNA, 20 bp, Homo sapiens
cttggcgctgcccctggcag

SEQ ID NO: 5610310 - DNA, 21 bp, Homo sapiens
cttggcgctgcccctggcagc

SEQ ID NO: 5610311 - DNA, 13 bp, Homo sapiens
cttggcggaggga

SEQ ID NO: 5610312 - DNA, 18 bp, Homo sapiens
cttggcggcagcagccat

SEQ ID NO: 5610313 - DNA, 19 bp, Homo sapiens
cttggcggcagcagccatc

SEQ ID NO: 5610314 - DNA, 19 bp, Homo sapiens
cttggcgggcagcccagcc

SEQ ID NO: 5610315 - DNA, 17 bp, Homo sapiens
cttggcgtggagccagg

SEQ ID NO: 5610316 - DNA, 15 bp, Homo sapiens
cttggcgttcctgcc

SEQ ID NO: 5610317 - DNA, 20 bp, Homo sapiens
cttggcgttcctgccaggct

SEQ ID NO: 5610318 - DNA, 22 bp, Homo sapiens
cttggctaacatagcacagtat

SEQ ID NO: 5610319 - DNA, 15 bp, Homo sapiens
cttggctaaggaaat

SEQ ID NO: 5610320 - DNA, 22 bp, Homo sapiens
cttggctagagtttgaaaaact

SEQ ID NO: 5610321 - DNA, 19 bp, Homo sapiens
cttggctatgaaaatgagc

SEQ ID NO: 5610322 - DNA, 21 bp, Homo sapiens
cttggctatgaaaatgagccc

SEQ ID NO: 5610323 - DNA, 20 bp, Homo sapiens
cttggctcacaaggcccagg

SEQ ID NO: 5610324 - DNA, 24 bp, Homo sapiens
cttggctcactgcaacttctgcct

SEQ ID NO: 5610325 - DNA, 16 bp, Homo sapiens
cttggctcagacatgt

SEQ ID NO: 5610326 - DNA, 19 bp, Homo sapiens
cttggctcgaatctctgtg

SEQ ID NO: 5610327 - DNA, 20 bp, Homo sapiens
cttggctcgaatctctgtgc

SEQ ID NO: 5610328 - DNA, 21 bp, Homo sapiens
cttggctcgaatctctgtgcc

SEQ ID NO: 5610329 - DNA, 23 bp, Homo sapiens
cttggctcgatgctgtgggggac

SEQ ID NO: 5610330 - DNA, 16 bp, Homo sapiens
cttggctcgttctctt

SEQ ID NO: 5610331 - DNA, 18 bp, Homo sapiens
cttggctctgccagtgga

SEQ ID NO: 5610332 - DNA, 13 bp, Homo sapiens
cttggctgacccc

SEQ ID NO: 5610333 - DNA, 14 bp, Homo sapiens
cttggctgacccct

SEQ ID NO: 5610334 - DNA, 15 bp, Homo sapiens
cttggctgacccctc

SEQ ID NO: 5610335 - DNA, 21 bp, Homo sapiens
cttggctgagccccctctcct

SEQ ID NO: 5610336 - DNA, 23 bp, Homo sapiens
cttggctgcaaataaggacagca

SEQ ID NO: 5610337 - DNA, 16 bp, Homo sapiens
cttggctgcagggagt

SEQ ID NO: 5610338 - DNA, 15 bp, Homo sapiens
cttggctgccccaca

SEQ ID NO: 5610339 - DNA, 23 bp, Homo sapiens
cttggctgccccattccagctct

SEQ ID NO: 5610340 - DNA, 14 bp, Homo sapiens
cttggctgccctgt

SEQ ID NO: 5610341 - DNA, 21 bp, Homo sapiens
cttgtaaatacataaaacaaa

SEQ ID NO: 5610342 - DNA, 12 bp, Homo sapiens
cttgtaaatacc

SEQ ID NO: 5610343 - DNA, 18 bp, Homo sapiens
cttgtaaatagctcaggt

SEQ ID NO: 5610344 - DNA, 17 bp, Homo sapiens
cttgtaaatataaagac

SEQ ID NO: 5610345 - DNA, 12 bp, Homo sapiens
cttgtaaatatc

SEQ ID NO: 5610346 - DNA, 15 bp, Homo sapiens
cttgtaaatattgtt

SEQ ID NO: 5610347 - DNA, 16 bp, Homo sapiens
cttgtaaatattgttt

SEQ ID NO: 5610348 - DNA, 13 bp, Homo sapiens
cttgtaaatcttt

SEQ ID NO: 5610349 - DNA, 22 bp, Homo sapiens
cttgtaaatgggaaaatatata

SEQ ID NO: 5610350 - DNA, 19 bp, Homo sapiens
cttgtaaatgtttcttttc

SEQ ID NO: 5610351 - DNA, 18 bp, Homo sapiens
cttgtaaattccccttcc

SEQ ID NO: 5610352 - DNA, 24 bp, Homo sapiens
cttgtaaattgatgggagaaatga

SEQ ID NO: 5610353 - DNA, 16 bp, Homo sapiens
cttgtaactaaaataa

SEQ ID NO: 5610354 - DNA, 23 bp, Homo sapiens
cttgtaactcaccgtgctgtctt

SEQ ID NO: 5610355 - DNA, 23 bp, Homo sapiens
cttgtaactgggttcaaaaagaa

SEQ ID NO: 5610356 - DNA, 16 bp, Homo sapiens
cttgtaactttcttca

SEQ ID NO: 5610357 - DNA, 15 bp, Homo sapiens
cttgtaagattttga

SEQ ID NO: 5610358 - DNA, 15 bp, Homo sapiens
cttgtaagccatcag

SEQ ID NO: 5610359 - DNA, 16 bp, Homo sapiens
cttgtaataaatactg

SEQ ID NO: 5610360 - DNA, 22 bp, Homo sapiens
cttgtaatgatatagccagaaa

SEQ ID NO: 5610361 - DNA, 14 bp, Homo sapiens
cttgtaatgtaact

SEQ ID NO: 5610362 - DNA, 22 bp, Homo sapiens
cttgtaatttaaacaggcccag

SEQ ID NO: 5610363 - DNA, 14 bp, Homo sapiens
cttgtaatttccag

SEQ ID NO: 5610364 - DNA, 22 bp, Homo sapiens
cttgtaattttacacgcttttg

SEQ ID NO: 5610365 - DNA, 22 bp, Homo sapiens
cttgtaatttttttaatttaca

SEQ ID NO: 5610366 - DNA, 13 bp, Homo sapiens
cttgtacaaactt

SEQ ID NO: 5610367 - DNA, 20 bp, Homo sapiens
cttgtacaattaattatctt

SEQ ID NO: 5610368 - DNA, 16 bp, Homo sapiens
cttgtacactcattca

SEQ ID NO: 5610369 - DNA, 21 bp, Homo sapiens
cttgtacagaaccagcactcc

SEQ ID NO: 5610370 - DNA, 12 bp, Homo sapiens
cttgtacataat

SEQ ID NO: 5610371 - DNA, 15 bp, Homo sapiens
cttgtacataatgcg

SEQ ID NO: 5610372 - DNA, 12 bp, Homo sapiens
cttgtacatatt

SEQ ID NO: 5610373 - DNA, 13 bp, Homo sapiens
cttgtacatgtgt

SEQ ID NO: 5610374 - DNA, 14 bp, Homo sapiens
cttgtacatgtgta

SEQ ID NO: 5610375 - DNA, 22 bp, Homo sapiens
cttgtacatgtgtagcctgtgc

SEQ ID NO: 5610376 - DNA, 16 bp, Homo sapiens
cttgtaccagcccagg

SEQ ID NO: 5610377 - DNA, 17 bp, Homo sapiens
cttgtaccatagaaaaa

SEQ ID NO: 5610378 - DNA, 19 bp, Homo sapiens
cttgtaccatagaaaaatg

SEQ ID NO: 5610379 - DNA, 19 bp, Homo sapiens
cttgtacccaccatacaga

SEQ ID NO: 5610380 - DNA, 14 bp, Homo sapiens
cttgtaccccatcc

SEQ ID NO: 5610381 - DNA, 17 bp, Homo sapiens
cttgtaccccatccctt

SEQ ID NO: 5610382 - DNA, 19 bp, Homo sapiens
cttgtacctatggctgcct

SEQ ID NO: 5610383 - DNA, 18 bp, Homo sapiens
cttgtacctctggctgac

SEQ ID NO: 5610384 - DNA, 18 bp, Homo sapiens
cttgtactaagccaggag

SEQ ID NO: 5610385 - DNA, 19 bp, Homo sapiens
cttgtactaagccaggagg

SEQ ID NO: 5610386 - DNA, 16 bp, Homo sapiens
cttgtactgtgaccta

SEQ ID NO: 5610387 - DNA, 22 bp, Homo sapiens
cttgtactgtgacctaagaaca

SEQ ID NO: 5610388 - DNA, 19 bp, Homo sapiens
cttgtacttacactgaaat

SEQ ID NO: 5610389 - DNA, 22 bp, Homo sapiens
cttgtacttctgtgttcatttt

SEQ ID NO: 5610390 - DNA, 23 bp, Homo sapiens
cttgtactttatttttctgatag

SEQ ID NO: 5610391 - DNA, 17 bp, Homo sapiens
cttgtagaaacgaagcc

SEQ ID NO: 5610392 - DNA, 21 bp, Homo sapiens
cttgtagaactcactctgggc

SEQ ID NO: 5610393 - DNA, 16 bp, Homo sapiens
cttgtagacacttact

SEQ ID NO: 5610394 - DNA, 21 bp, Homo sapiens
cttgtagaccactgtcctggc

SEQ ID NO: 5610395 - DNA, 18 bp, Homo sapiens
cttgtagacgcacctgct

SEQ ID NO: 5610396 - DNA, 15 bp, Homo sapiens
cttgtagatttgatt

SEQ ID NO: 5610397 - DNA, 13 bp, Homo sapiens
cttgtagcagtgt

SEQ ID NO: 5610398 - DNA, 13 bp, Homo sapiens
cttgtagccagcc

SEQ ID NO: 5610399 - DNA, 14 bp, Homo sapiens
cttgtagccagccg

SEQ ID NO: 5610400 - DNA, 16 bp, Homo sapiens
cttgtagccatggctg

SEQ ID NO: 5610401 - DNA, 18 bp, Homo sapiens
cttgtagcccaggctgga

SEQ ID NO: 5610402 - DNA, 16 bp, Homo sapiens
cttgtagccttttgac

SEQ ID NO: 5610403 - DNA, 17 bp, Homo sapiens
cttgtagcgactaaact

SEQ ID NO: 5610404 - DNA, 23 bp, Homo sapiens
cttgtagcggatgattcttcaag

SEQ ID NO: 5610405 - DNA, 16 bp, Homo sapiens
cttgtagctcctcccc

SEQ ID NO: 5610406 - DNA, 17 bp, Homo sapiens
cttgtaggaatctgcct

SEQ ID NO: 5610407 - DNA, 19 bp, Homo sapiens
cttgtaggaatctgccttc

SEQ ID NO: 5610408 - DNA, 21 bp, Homo sapiens
cttgtaggagctgaggtttca

SEQ ID NO: 5610409 - DNA, 17 bp, Homo sapiens
cttgtagggatgccttt

SEQ ID NO: 5610410 - DNA, 15 bp, Homo sapiens
cttgtaggtttctct

SEQ ID NO: 5610411 - DNA, 18 bp, Homo sapiens
cttgtaggtttctctgcc

SEQ ID NO: 5610412 - DNA, 16 bp, Homo sapiens
cttgtagtcttggcta

SEQ ID NO: 5610413 - DNA, 20 bp, Homo sapiens
cttgtagttctttaaactgt

SEQ ID NO: 5610414 - DNA, 21 bp, Homo sapiens
cttgtataaaatccaaaatga

SEQ ID NO: 5610415 - DNA, 21 bp, Homo sapiens
cttgtatagcatgaaataaaa

SEQ ID NO: 5610416 - DNA, 17 bp, Homo sapiens
cttgtatatacatatta

SEQ ID NO: 5610417 - DNA, 18 bp, Homo sapiens
cttgtatatacttcactc

SEQ ID NO: 5610418 - DNA, 17 bp, Homo sapiens
cttgtatatcttgtttt

SEQ ID NO: 5610419 - DNA, 17 bp, Homo sapiens
cttgtatatttgtacaa

SEQ ID NO: 5610420 - DNA, 19 bp, Homo sapiens
cttgtatatttgtacaaaa

SEQ ID NO: 5610421 - DNA, 23 bp, Homo sapiens
cttgtatattttaagaaataaca

SEQ ID NO: 5610422 - DNA, 18 bp, Homo sapiens
cttgtatcaaatgttaca

SEQ ID NO: 5610423 - DNA, 20 bp, Homo sapiens
cttgtatcaacactgttact

SEQ ID NO: 5610424 - DNA, 17 bp, Homo sapiens
cttgtatccaggcctgg

SEQ ID NO: 5610425 - DNA, 18 bp, Homo sapiens
cttgtatcccctgcaggc

SEQ ID NO: 5610426 - DNA, 13 bp, Homo sapiens
cttgtatctgaag

SEQ ID NO: 5610427 - DNA, 18 bp, Homo sapiens
cttgtatctgatatcagc

SEQ ID NO: 5610428 - DNA, 19 bp, Homo sapiens
cttgtatctggattcaaat

SEQ ID NO: 5610429 - DNA, 21 bp, Homo sapiens
cttgtatgatctccgtatgat

SEQ ID NO: 5610430 - DNA, 14 bp, Homo sapiens
cttgtatgctgccc

SEQ ID NO: 5610431 - DNA, 21 bp, Homo sapiens
cttgtatggctctcaagtgaa

SEQ ID NO: 5610432 - DNA, 23 bp, Homo sapiens
cttgtatggctctcaagtgaaag

SEQ ID NO: 5610433 - DNA, 21 bp, Homo sapiens
cttgtatgtaaggaggtttgt

SEQ ID NO: 5610434 - DNA, 23 bp, Homo sapiens
cttgtattaaactcttcacaaaa

SEQ ID NO: 5610435 - DNA, 15 bp, Homo sapiens
cttgtattaagaatg

SEQ ID NO: 5610436 - DNA, 14 bp, Homo sapiens
cttgtattccctta

SEQ ID NO: 5610437 - DNA, 19 bp, Homo sapiens
cttgtattgaagttaactg

SEQ ID NO: 5610438 - DNA, 12 bp, Homo sapiens
cttgtattggaa

SEQ ID NO: 5610439 - DNA, 15 bp, Homo sapiens
cttgtattggaagta

SEQ ID NO: 5610440 - DNA, 14 bp, Homo sapiens
cttgtattggtgaa

SEQ ID NO: 5610441 - DNA, 16 bp, Homo sapiens
cttgtattgtaaatgt

SEQ ID NO: 5610442 - DNA, 12 bp, Homo sapiens
cttgtatttaaa

SEQ ID NO: 5610443 - DNA, 17 bp, Homo sapiens
cttgtatttaaaaacat

SEQ ID NO: 5610444 - DNA, 19 bp, Homo sapiens
cttgtatttaaaaacattt

SEQ ID NO: 5610445 - DNA, 15 bp, Homo sapiens
cttgtatttaattct

SEQ ID NO: 5610446 - DNA, 15 bp, Homo sapiens
cttgtattttccata

SEQ ID NO: 5610447 - DNA, 19 bp, Homo sapiens
cttgtattttcttcccatt

SEQ ID NO: 5610448 - DNA, 23 bp, Homo sapiens
cttgtattttcttcccatttgta

SEQ ID NO: 5610449 - DNA, 13 bp, Homo sapiens
cttgtcaaagaag

SEQ ID NO: 5610450 - DNA, 23 bp, Homo sapiens
cttgtcaagcctgtgcaaaaaaa

SEQ ID NO: 5610451 - DNA, 18 bp, Homo sapiens
cttgtcaatactgagcca

SEQ ID NO: 5610452 - DNA, 19 bp, Homo sapiens
cttgtcaatactgagccat

SEQ ID NO: 5610453 - DNA, 20 bp, Homo sapiens
cttgtcaatggaagaaaccc

SEQ ID NO: 5610454 - DNA, 22 bp, Homo sapiens
cttgtcaccaggcaaccaggaa

SEQ ID NO: 5610455 - DNA, 20 bp, Homo sapiens
cttgtcacccaaagcctgtc

SEQ ID NO: 5610456 - DNA, 17 bp, Homo sapiens
cttgtcacccaggctgg

SEQ ID NO: 5610457 - DNA, 13 bp, Homo sapiens
cttgtcacgccag

SEQ ID NO: 5610458 - DNA, 22 bp, Homo sapiens
cttgtcactacaaaaatacaat

SEQ ID NO: 5610459 - DNA, 17 bp, Homo sapiens
cttgtcactagcagctg

SEQ ID NO: 5610460 - DNA, 18 bp, Homo sapiens
cttgtcactagcagctgc

SEQ ID NO: 5610461 - DNA, 21 bp, Homo sapiens
cttgtcactatgctatttctg

SEQ ID NO: 5610462 - DNA, 17 bp, Homo sapiens
cttgtcactgacacaaa

SEQ ID NO: 5610463 - DNA, 11 bp, Homo sapiens
cttgtcacttg

SEQ ID NO: 5610464 - DNA, 17 bp, Homo sapiens
cttgtcagacataaagc

SEQ ID NO: 5610465 - DNA, 15 bp, Homo sapiens
cttgtcaggacccag

SEQ ID NO: 5610466 - DNA, 16 bp, Homo sapiens
cttgtcaggacccagg

SEQ ID NO: 5610467 - DNA, 20 bp, Homo sapiens
cttgtcaggacccaggccgc

SEQ ID NO: 5610468 - DNA, 22 bp, Homo sapiens
cttgtcaggacccaggccgcct

SEQ ID NO: 5610469 - DNA, 20 bp, Homo sapiens
cttgtcaggagtgtgtgtga

SEQ ID NO: 5610470 - DNA, 18 bp, Homo sapiens
cttgtcaggcatggctca

SEQ ID NO: 5610471 - DNA, 23 bp, Homo sapiens
cttgtcaggtggaccctgtaaat

SEQ ID NO: 5610472 - DNA, 23 bp, Homo sapiens
cttgtcagtgtagacacaggtca

SEQ ID NO: 5610473 - DNA, 13 bp, Homo sapiens
cttgtcagtgtgt

SEQ ID NO: 5610474 - DNA, 20 bp, Homo sapiens
cttgtcagttccaaacagac

SEQ ID NO: 5610475 - DNA, 22 bp, Homo sapiens
cttgtcatagactcctttgcta

SEQ ID NO: 5610476 - DNA, 16 bp, Homo sapiens
cttgtcatagccagtg

SEQ ID NO: 5610477 - DNA, 20 bp, Homo sapiens
cttgtcatatgtagccttca

SEQ ID NO: 5610478 - DNA, 23 bp, Homo sapiens
cttgtcatcagtaagtataacaa

SEQ ID NO: 5610479 - DNA, 15 bp, Homo sapiens
cttgtcatgtgtata

SEQ ID NO: 5610480 - DNA, 18 bp, Homo sapiens
cttgtcatgtgtataaaa

SEQ ID NO: 5610481 - DNA, 19 bp, Homo sapiens
cttgtcatgtgtataaaaa

SEQ ID NO: 5610482 - DNA, 18 bp, Homo sapiens
cttgtcattccagagtgc

SEQ ID NO: 5610483 - DNA, 17 bp, Homo sapiens
cttgtcattctcatcca

SEQ ID NO: 5610484 - DNA, 17 bp, Homo sapiens
cttgtcattgagcctgg

SEQ ID NO: 5610485 - DNA, 21 bp, Homo sapiens
cttgtcattgccttcgctcca

SEQ ID NO: 5610486 - DNA, 22 bp, Homo sapiens
cttgtcattgttatataatcat

SEQ ID NO: 5610487 - DNA, 13 bp, Homo sapiens
cttgtcattttga

SEQ ID NO: 5610488 - DNA, 19 bp, Homo sapiens
cttgtccaagacaggggcc

SEQ ID NO: 5610489 - DNA, 21 bp, Homo sapiens
cttgtccaattaatgaagttg

SEQ ID NO: 5610490 - DNA, 15 bp, Homo sapiens
cttgtccacattcta

SEQ ID NO: 5610491 - DNA, 13 bp, Homo sapiens
cttgtccagctga

SEQ ID NO: 5610492 - DNA, 14 bp, Homo sapiens
cttgtccaggaact

SEQ ID NO: 5610493 - DNA, 15 bp, Homo sapiens
cttgtccaggaactg

SEQ ID NO: 5610494 - DNA, 22 bp, Homo sapiens
cttgtccaggtctcactgcttt

SEQ ID NO: 5610495 - DNA, 10 bp, Homo sapiens
cttgtcccaa

SEQ ID NO: 5610496 - DNA, 21 bp, Homo sapiens
cttgtcccaaatccgccagtg

SEQ ID NO: 5610497 - DNA, 12 bp, Homo sapiens
cttgtcccaagt

SEQ ID NO: 5610498 - DNA, 18 bp, Homo sapiens
cttgtcccaagtctgaca

SEQ ID NO: 5610499 - DNA, 20 bp, Homo sapiens
cttgtcccaattaaaatact

SEQ ID NO: 5610500 - DNA, 18 bp, Homo sapiens
cttgtcccactatctggg

SEQ ID NO: 5610501 - DNA, 21 bp, Homo sapiens
cttgtcccactcaagccaagc

SEQ ID NO: 5610502 - DNA, 15 bp, Homo sapiens
cttgtcccagaggct

SEQ ID NO: 5610503 - DNA, 23 bp, Homo sapiens
cttgtcccccgtgatctcccctc

SEQ ID NO: 5610504 - DNA, 21 bp, Homo sapiens
cttgtcccgtctggacctggg

SEQ ID NO: 5610505 - DNA, 15 bp, Homo sapiens
cttgtccctgcccag

SEQ ID NO: 5610506 - DNA, 16 bp, Homo sapiens
cttgtccctgcccaga

SEQ ID NO: 5610507 - DNA, 20 bp, Homo sapiens
cttgtccctggggcactccc

SEQ ID NO: 5610508 - DNA, 21 bp, Homo sapiens
cttgtccctggggcactcccc

SEQ ID NO: 5610509 - DNA, 21 bp, Homo sapiens
cttgtcccttttaatataaaa

SEQ ID NO: 5610510 - DNA, 21 bp, Homo sapiens
cttgtccggaggatattaaaa

SEQ ID NO: 5610511 - DNA, 18 bp, Homo sapiens
cttgtcctacgtccaagg

SEQ ID NO: 5610512 - DNA, 16 bp, Homo sapiens
cttgtcctagcacaga

SEQ ID NO: 5610513 - DNA, 17 bp, Homo sapiens
cttgtcctagcacagat

SEQ ID NO: 5610514 - DNA, 18 bp, Homo sapiens
cttgtcctagcttgggag

SEQ ID NO: 5610515 - DNA, 12 bp, Homo sapiens
cttgtcctcagc

SEQ ID NO: 5610516 - DNA, 13 bp, Homo sapiens
cttgtcctcagct

SEQ ID NO: 5610517 - DNA, 16 bp, Homo sapiens
ctttaacattttggaa

SEQ ID NO: 5610518 - DNA, 17 bp, Homo sapiens
ctttaacattttggaaa

SEQ ID NO: 5610519 - DNA, 19 bp, Homo sapiens
ctttaacattttggaaatt

SEQ ID NO: 5610520 - DNA, 19 bp, Homo sapiens
ctttaacattttgtttcca

SEQ ID NO: 5610521 - DNA, 22 bp, Homo sapiens
ctttaaccactcctcaggaaca

SEQ ID NO: 5610522 - DNA, 19 bp, Homo sapiens
ctttaaccaggaatattaa

SEQ ID NO: 5610523 - DNA, 18 bp, Homo sapiens
ctttaaccctctcttccc

SEQ ID NO: 5610524 - DNA, 15 bp, Homo sapiens
ctttaaccctttctg

SEQ ID NO: 5610525 - DNA, 21 bp, Homo sapiens
ctttaaccgtttttcaagaaa

SEQ ID NO: 5610526 - DNA, 22 bp, Homo sapiens
ctttaaccgtttttcaagaaaa

SEQ ID NO: 5610527 - DNA, 18 bp, Homo sapiens
ctttaacctatgataatt

SEQ ID NO: 5610528 - DNA, 19 bp, Homo sapiens
ctttaacctccctcaacaa

SEQ ID NO: 5610529 - DNA, 20 bp, Homo sapiens
ctttaactcaggactccagc

SEQ ID NO: 5610530 - DNA, 15 bp, Homo sapiens
ctttaactcaggagg

SEQ ID NO: 5610531 - DNA, 19 bp, Homo sapiens
ctttaactccctttttaca

SEQ ID NO: 5610532 - DNA, 20 bp, Homo sapiens
ctttaactccctttttacac

SEQ ID NO: 5610533 - DNA, 21 bp, Homo sapiens
ctttaactccctttttacact

SEQ ID NO: 5610534 - DNA, 22 bp, Homo sapiens
ctttaactccctttttacactt

SEQ ID NO: 5610535 - DNA, 20 bp, Homo sapiens
ctttaactgagggctgatct

SEQ ID NO: 5610536 - DNA, 21 bp, Homo sapiens
ctttaactgccgtaatttaac

SEQ ID NO: 5610537 - DNA, 23 bp, Homo sapiens
ctttaactgtgtgaccagcggaa

SEQ ID NO: 5610538 - DNA, 18 bp, Homo sapiens
ctttaacttagttttgca

SEQ ID NO: 5610539 - DNA, 19 bp, Homo sapiens
ctttaacttttttttctct

SEQ ID NO: 5610540 - DNA, 15 bp, Homo sapiens
ctttaagaaaaatga

SEQ ID NO: 5610541 - DNA, 18 bp, Homo sapiens
ctttaagaaccttaatga

SEQ ID NO: 5610542 - DNA, 19 bp, Homo sapiens
ctttaagaaccttaatgac

SEQ ID NO: 5610543 - DNA, 21 bp, Homo sapiens
ctttaagaactaaaatgttct

SEQ ID NO: 5610544 - DNA, 16 bp, Homo sapiens
ctttaagaatagttct

SEQ ID NO: 5610545 - DNA, 21 bp, Homo sapiens
ctttaagaatgtcctcttgga

SEQ ID NO: 5610546 - DNA, 23 bp, Homo sapiens
ctttaagacatactccttccatc

SEQ ID NO: 5610547 - DNA, 20 bp, Homo sapiens
ctttaagagtttaaaatcat

SEQ ID NO: 5610548 - DNA, 22 bp, Homo sapiens
ctttaagagtttaaaatcatca

SEQ ID NO: 5610549 - DNA, 17 bp, Homo sapiens
ctttaagatatccatct

SEQ ID NO: 5610550 - DNA, 20 bp, Homo sapiens
ctttaagatatccatctttt

SEQ ID NO: 5610551 - DNA, 17 bp, Homo sapiens
ctttaagccaaagaaac

SEQ ID NO: 5610552 - DNA, 19 bp, Homo sapiens
ctttaagccaaagaaacaa

SEQ ID NO: 5610553 - DNA, 21 bp, Homo sapiens
ctttaagccaaagaaacaagc

SEQ ID NO: 5610554 - DNA, 12 bp, Homo sapiens
ctttaagccata

SEQ ID NO: 5610555 - DNA, 22 bp, Homo sapiens
ctttaagccatagaccctgagg

SEQ ID NO: 5610556 - DNA, 23 bp, Homo sapiens
ctttaagccatagaccctgaggc

SEQ ID NO: 5610557 - DNA, 20 bp, Homo sapiens
ctttaagcgaggcagaatgg

SEQ ID NO: 5610558 - DNA, 14 bp, Homo sapiens
ctttaaggagaaga

SEQ ID NO: 5610559 - DNA, 16 bp, Homo sapiens
ctttaaggagaagaga

SEQ ID NO: 5610560 - DNA, 17 bp, Homo sapiens
ctttaaggagatggact

SEQ ID NO: 5610561 - DNA, 20 bp, Homo sapiens
ctttaaggatttgaaccatg

SEQ ID NO: 5610562 - DNA, 20 bp, Homo sapiens
ctttaagggcatgccttgtg

SEQ ID NO: 5610563 - DNA, 19 bp, Homo sapiens
ctttaaggggaagataaga

SEQ ID NO: 5610564 - DNA, 20 bp, Homo sapiens
ctttaaggggaggaaccaga

SEQ ID NO: 5610565 - DNA, 15 bp, Homo sapiens
ctttaagtaaaaatc

SEQ ID NO: 5610566 - DNA, 16 bp, Homo sapiens
ctttaagtattgtttt

SEQ ID NO: 5610567 - DNA, 19 bp, Homo sapiens
ctttaagtcttacaggaag

SEQ ID NO: 5610568 - DNA, 20 bp, Homo sapiens
ctttaagtcttacaggaagc

SEQ ID NO: 5610569 - DNA, 17 bp, Homo sapiens
ctttaagttaaatatgt

SEQ ID NO: 5610570 - DNA, 17 bp, Homo sapiens
ctttaagtttcaggata

SEQ ID NO: 5610571 - DNA, 20 bp, Homo sapiens
ctttaagttttatttaactt

SEQ ID NO: 5610572 - DNA, 23 bp, Homo sapiens
ctttaataacaaggagatttctt

SEQ ID NO: 5610573 - DNA, 23 bp, Homo sapiens
ctttaatagtcaccttcatgatt

SEQ ID NO: 5610574 - DNA, 21 bp, Homo sapiens
ctttaatatactccttaaaaa

SEQ ID NO: 5610575 - DNA, 21 bp, Homo sapiens
ctttaatatcatcagtattga

SEQ ID NO: 5610576 - DNA, 14 bp, Homo sapiens
ctttaatatgaaat

SEQ ID NO: 5610577 - DNA, 15 bp, Homo sapiens
ctttaatatgtattt

SEQ ID NO: 5610578 - DNA, 20 bp, Homo sapiens
ctttaatatttccaatgtga

SEQ ID NO: 5610579 - DNA, 19 bp, Homo sapiens
ctttaatattttgtaatat

SEQ ID NO: 5610580 - DNA, 22 bp, Homo sapiens
ctttaatcacttaacattccta

SEQ ID NO: 5610581 - DNA, 22 bp, Homo sapiens
ctttaatctgttgtttgaagaa

SEQ ID NO: 5610582 - DNA, 14 bp, Homo sapiens
ctttaatcttcagt

SEQ ID NO: 5610583 - DNA, 22 bp, Homo sapiens
ctttaatcttcagttttatctt

SEQ ID NO: 5610584 - DNA, 20 bp, Homo sapiens
ctttaatgagtgcacctgcc

SEQ ID NO: 5610585 - DNA, 23 bp, Homo sapiens
ctttaatgagtgcacctgcctcc

SEQ ID NO: 5610586 - DNA, 21 bp, Homo sapiens
ctttaatgatatgcttgtaac

SEQ ID NO: 5610587 - DNA, 22 bp, Homo sapiens
ctttaatgatatgcttgtaact

SEQ ID NO: 5610588 - DNA, 22 bp, Homo sapiens
ctttaatgcaatgcatatctgt

SEQ ID NO: 5610589 - DNA, 12 bp, Homo sapiens
ctttaatgcatc

SEQ ID NO: 5610590 - DNA, 17 bp, Homo sapiens
ctttaatgctgtctttg

SEQ ID NO: 5610591 - DNA, 19 bp, Homo sapiens
ctttaatggacttatttct

SEQ ID NO: 5610592 - DNA, 23 bp, Homo sapiens
ctttaatgtcacaggcaggtcca

SEQ ID NO: 5610593 - DNA, 18 bp, Homo sapiens
ctttaatgtctaagaaat

SEQ ID NO: 5610594 - DNA, 20 bp, Homo sapiens
ctttaatgtgtattgaagaa

SEQ ID NO: 5610595 - DNA, 14 bp, Homo sapiens
ctttaatgttctat

SEQ ID NO: 5610596 - DNA, 21 bp, Homo sapiens
ctttaatgttttttgccacag

SEQ ID NO: 5610597 - DNA, 16 bp, Homo sapiens
ctttaattaagctctc

SEQ ID NO: 5610598 - DNA, 21 bp, Homo sapiens
ctttaattacctggtgagtaa

SEQ ID NO: 5610599 - DNA, 14 bp, Homo sapiens
ctttaattatatat

SEQ ID NO: 5610600 - DNA, 16 bp, Homo sapiens
ctttaattccatgaat

SEQ ID NO: 5610601 - DNA, 17 bp, Homo sapiens
ctttaattctcatgtga

SEQ ID NO: 5610602 - DNA, 19 bp, Homo sapiens
ctttaattctctttcaaag

SEQ ID NO: 5610603 - DNA, 16 bp, Homo sapiens
ctttaattcttttccc

SEQ ID NO: 5610604 - DNA, 19 bp, Homo sapiens
ctttaattgctttaaatct

SEQ ID NO: 5610605 - DNA, 13 bp, Homo sapiens
ctttaattgtata

SEQ ID NO: 5610606 - DNA, 16 bp, Homo sapiens
ctttaattgtataagt

SEQ ID NO: 5610607 - DNA, 15 bp, Homo sapiens
ctttaattgtatctc

SEQ ID NO: 5610608 - DNA, 22 bp, Homo sapiens
ctttaattgtgtggtgctttta

SEQ ID NO: 5610609 - DNA, 18 bp, Homo sapiens
ctttaattgttgctttta

SEQ ID NO: 5610610 - DNA, 12 bp, Homo sapiens
ctttaatttatg

SEQ ID NO: 5610611 - DNA, 19 bp, Homo sapiens
ctttaatttatttttgcat

SEQ ID NO: 5610612 - DNA, 22 bp, Homo sapiens
ctttaatttatttttgcatggc

SEQ ID NO: 5610613 - DNA, 15 bp, Homo sapiens
ctttaattttcttgt

SEQ ID NO: 5610614 - DNA, 16 bp, Homo sapiens
ctttaattttcttgtt

SEQ ID NO: 5610615 - DNA, 13 bp, Homo sapiens
ctttaattttgga

SEQ ID NO: 5610616 - DNA, 15 bp, Homo sapiens
ctttaattttggaat

SEQ ID NO: 5610617 - DNA, 20 bp, Homo sapiens
ctttaatttttttaaccaaa

SEQ ID NO: 5610618 - DNA, 21 bp, Homo sapiens
ctttaatttttttaaccaaag

SEQ ID NO: 5610619 - DNA, 12 bp, Homo sapiens
ctttacaaaaag

SEQ ID NO: 5610620 - DNA, 13 bp, Homo sapiens
ctttacaaaaaga

SEQ ID NO: 5610621 - DNA, 16 bp, Homo sapiens
ctttacaaaacaaact

SEQ ID NO: 5610622 - DNA, 18 bp, Homo sapiens
ctttacaaacaaaagcat

SEQ ID NO: 5610623 - DNA, 21 bp, Homo sapiens
ctttacaaaccattacctgta

SEQ ID NO: 5610624 - DNA, 21 bp, Homo sapiens
ctttacaaataattttttgca

SEQ ID NO: 5610625 - DNA, 17 bp, Homo sapiens
ctttacaactaaataac

SEQ ID NO: 5610626 - DNA, 21 bp, Homo sapiens
ctttacaagcaggcactgtat

SEQ ID NO: 5610627 - DNA, 12 bp, Homo sapiens
ctttacaatgtg

SEQ ID NO: 5610628 - DNA, 19 bp, Homo sapiens
ctttacaatgttcatccca

SEQ ID NO: 5610629 - DNA, 16 bp, Homo sapiens
ctttacacaagaatct

SEQ ID NO: 5610630 - DNA, 20 bp, Homo sapiens
ctttacacaatagaattata

SEQ ID NO: 5610631 - DNA, 14 bp, Homo sapiens
ctttacacctcgct

SEQ ID NO: 5610632 - DNA, 23 bp, Homo sapiens
ctttacacggagcggattgcaaa

SEQ ID NO: 5610633 - DNA, 19 bp, Homo sapiens
ctttacactcggctttgga

SEQ ID NO: 5610634 - DNA, 20 bp, Homo sapiens
ctttacagatgagattccct

SEQ ID NO: 5610635 - DNA, 22 bp, Homo sapiens
ctttacagatgagattccctct

SEQ ID NO: 5610636 - DNA, 17 bp, Homo sapiens
ctttacagctctcctcc

SEQ ID NO: 5610637 - DNA, 23 bp, Homo sapiens
ctttacaggatcatgtaaatgct

SEQ ID NO: 5610638 - DNA, 23 bp, Homo sapiens
ctttacagttagcagggatgttc

SEQ ID NO: 5610639 - DNA, 18 bp, Homo sapiens
ctttacataattgcaata

SEQ ID NO: 5610640 - DNA, 18 bp, Homo sapiens
ctttacatactttatcaa

SEQ ID NO: 5610641 - DNA, 14 bp, Homo sapiens
ctttacatatgatt

SEQ ID NO: 5610642 - DNA, 18 bp, Homo sapiens
ctttacatatgattgtat

SEQ ID NO: 5610643 - DNA, 17 bp, Homo sapiens
ctttacatgaggactct

SEQ ID NO: 5610644 - DNA, 20 bp, Homo sapiens
ctttacatggggttttcaat

SEQ ID NO: 5610645 - DNA, 17 bp, Homo sapiens
ctttacattcaactttt

SEQ ID NO: 5610646 - DNA, 18 bp, Homo sapiens
ctttacatttcttttaaa

SEQ ID NO: 5610647 - DNA, 16 bp, Homo sapiens
ctttacattttcagta

SEQ ID NO: 5610648 - DNA, 22 bp, Homo sapiens
ctttacattttcagtaccaaag

SEQ ID NO: 5610649 - DNA, 23 bp, Homo sapiens
ctttacattttcagtaccaaaga

SEQ ID NO: 5610650 - DNA, 14 bp, Homo sapiens
ctttaccaaacagc

SEQ ID NO: 5610651 - DNA, 18 bp, Homo sapiens
ctttaccaaacagcaaac

SEQ ID NO: 5610652 - DNA, 23 bp, Homo sapiens
ctttaccaaacagcaaaccaaga

SEQ ID NO: 5610653 - DNA, 23 bp, Homo sapiens
ctttaccaaaggtttttaaagta

SEQ ID NO: 5610654 - DNA, 23 bp, Homo sapiens
ctttaccaaatgaaatgccaaag

SEQ ID NO: 5610655 - DNA, 16 bp, Homo sapiens
ctttaccaattgaagt

SEQ ID NO: 5610656 - DNA, 19 bp, Homo sapiens
ctttaccaattgaagtaaa

SEQ ID NO: 5610657 - DNA, 20 bp, Homo sapiens
ctttaccaattgaagtaaaa

SEQ ID NO: 5610658 - DNA, 17 bp, Homo sapiens
ctttaccataaagcctt

SEQ ID NO: 5610659 - DNA, 14 bp, Homo sapiens
ctttaccatgctca

SEQ ID NO: 5610660 - DNA, 15 bp, Homo sapiens
ctttaccctcatctg

SEQ ID NO: 5610661 - DNA, 16 bp, Homo sapiens
ctttacccttgagccc

SEQ ID NO: 5610662 - DNA, 19 bp, Homo sapiens
ctttaccgaggacagcctg

SEQ ID NO: 5610663 - DNA, 23 bp, Homo sapiens
ctttaccgaggacagcctgcctc

SEQ ID NO: 5610664 - DNA, 22 bp, Homo sapiens
ctttacctaccaccttccctct

SEQ ID NO: 5610665 - DNA, 16 bp, Homo sapiens
ctttacctgagaccag

SEQ ID NO: 5610666 - DNA, 13 bp, Homo sapiens
ctttacctgcagg

SEQ ID NO: 5610667 - DNA, 19 bp, Homo sapiens
ctttaccttctaaaagcca

SEQ ID NO: 5610668 - DNA, 11 bp, Homo sapiens
ctttaccttta

SEQ ID NO: 5610669 - DNA, 17 bp, Homo sapiens
ctttaccttttcagggc

SEQ ID NO: 5610670 - DNA, 20 bp, Homo sapiens
ctttaccttttcagggctgg

SEQ ID NO: 5610671 - DNA, 21 bp, Homo sapiens
ctttacctttttgtatgtgaa

SEQ ID NO: 5610672 - DNA, 22 bp, Homo sapiens
ctttacgcccatctcaggacac

SEQ ID NO: 5610673 - DNA, 17 bp, Homo sapiens
ctttacgtactgtaact

SEQ ID NO: 5610674 - DNA, 22 bp, Homo sapiens
ctttacgtgtttaaaaaaaagc

SEQ ID NO: 5610675 - DNA, 18 bp, Homo sapiens
ctttactaagatgacatt

SEQ ID NO: 5610676 - DNA, 16 bp, Homo sapiens
ctttactaagtaatct

SEQ ID NO: 5610677 - DNA, 14 bp, Homo sapiens
ctttactactgtgg

SEQ ID NO: 5610678 - DNA, 13 bp, Homo sapiens
ctttactatggcc

SEQ ID NO: 5610679 - DNA, 13 bp, Homo sapiens
ctttactcagccc

SEQ ID NO: 5610680 - DNA, 16 bp, Homo sapiens
ctttactcccttcctg

SEQ ID NO: 5610681 - DNA, 17 bp, Homo sapiens
ctttactcccttcctgg

SEQ ID NO: 5610682 - DNA, 21 bp, Homo sapiens
ctttactcccttcctggcctc

SEQ ID NO: 5610683 - DNA, 19 bp, Homo sapiens
ctttactcctcacacttac

SEQ ID NO: 5610684 - DNA, 12 bp, Homo sapiens
ctttactcctgg

SEQ ID NO: 5610685 - DNA, 15 bp, Homo sapiens
ctttactcctggctc

SEQ ID NO: 5610686 - DNA, 23 bp, Homo sapiens
ctttactctgctctatgccaggc

SEQ ID NO: 5610687 - DNA, 14 bp, Homo sapiens
ctttactctgtgtt

SEQ ID NO: 5610688 - DNA, 19 bp, Homo sapiens
ctttactctgtgtttaaaa

SEQ ID NO: 5610689 - DNA, 17 bp, Homo sapiens
ctttactggacctgaaa

SEQ ID NO: 5610690 - DNA, 13 bp, Homo sapiens
ctttactggccat

SEQ ID NO: 5610691 - DNA, 15 bp, Homo sapiens
ctttccatgcagtta

SEQ ID NO: 5610692 - DNA, 22 bp, Homo sapiens
ctttccatgggagccagctgct

SEQ ID NO: 5610693 - DNA, 23 bp, Homo sapiens
ctttccatgggagccagctgctt

SEQ ID NO: 5610694 - DNA, 24 bp, Homo sapiens
ctttccatgggagccagctgcttt

SEQ ID NO: 5610695 - DNA, 21 bp, Homo sapiens
ctttccatgggcccgctgcct

SEQ ID NO: 5610696 - DNA, 17 bp, Homo sapiens
ctttccatgttgctgcc

SEQ ID NO: 5610697 - DNA, 16 bp, Homo sapiens
ctttccatttggtatt

SEQ ID NO: 5610698 - DNA, 12 bp, Homo sapiens
ctttccattttg

SEQ ID NO: 5610699 - DNA, 21 bp, Homo sapiens
ctttccatttttttctttact

SEQ ID NO: 5610700 - DNA, 21 bp, Homo sapiens
ctttcccaaaattagggagct

SEQ ID NO: 5610701 - DNA, 17 bp, Homo sapiens
ctttcccaacacctctt

SEQ ID NO: 5610702 - DNA, 21 bp, Homo sapiens
ctttcccaacacttcagactg

SEQ ID NO: 5610703 - DNA, 22 bp, Homo sapiens
ctttcccaacacttcagactgc

SEQ ID NO: 5610704 - DNA, 15 bp, Homo sapiens
ctttcccaacagctc

SEQ ID NO: 5610705 - DNA, 15 bp, Homo sapiens
ctttcccaagccttc

SEQ ID NO: 5610706 - DNA, 14 bp, Homo sapiens
ctttcccacactgt

SEQ ID NO: 5610707 - DNA, 23 bp, Homo sapiens
ctttcccacagtctctccctggg

SEQ ID NO: 5610708 - DNA, 16 bp, Homo sapiens
ctttcccacccaggaa

SEQ ID NO: 5610709 - DNA, 21 bp, Homo sapiens
ctttcccacccaggaaaggag

SEQ ID NO: 5610710 - DNA, 22 bp, Homo sapiens
ctttcccaccctccacctctca

SEQ ID NO: 5610711 - DNA, 19 bp, Homo sapiens
ctttcccaccgccctccct

SEQ ID NO: 5610712 - DNA, 19 bp, Homo sapiens
ctttcccagaagcgccctg

SEQ ID NO: 5610713 - DNA, 16 bp, Homo sapiens
ctttcccagagacccg

SEQ ID NO: 5610714 - DNA, 15 bp, Homo sapiens
ctttcccaggagaaa

SEQ ID NO: 5610715 - DNA, 19 bp, Homo sapiens
ctttcccaggagaaagatg

SEQ ID NO: 5610716 - DNA, 15 bp, Homo sapiens
ctttcccaggccgca

SEQ ID NO: 5610717 - DNA, 21 bp, Homo sapiens
ctttcccaggtaatttaaatt

SEQ ID NO: 5610718 - DNA, 15 bp, Homo sapiens
ctttcccatcttaaa

SEQ ID NO: 5610719 - DNA, 17 bp, Homo sapiens
ctttcccatgatccaga

SEQ ID NO: 5610720 - DNA, 19 bp, Homo sapiens
ctttcccatgatccagaac

SEQ ID NO: 5610721 - DNA, 20 bp, Homo sapiens
ctttcccatgatccagaact

SEQ ID NO: 5610722 - DNA, 15 bp, Homo sapiens
ctttcccatgctgaa

SEQ ID NO: 5610723 - DNA, 21 bp, Homo sapiens
ctttcccattggtctgcatgt

SEQ ID NO: 5610724 - DNA, 21 bp, Homo sapiens
ctttcccatttcgtgtaatat

SEQ ID NO: 5610725 - DNA, 14 bp, Homo sapiens
ctttccccacctct

SEQ ID NO: 5610726 - DNA, 15 bp, Homo sapiens
ctttccccacctctt

SEQ ID NO: 5610727 - DNA, 16 bp, Homo sapiens
ctttccccacctcttc

SEQ ID NO: 5610728 - DNA, 21 bp, Homo sapiens
ctttccccacctcttccttcc

SEQ ID NO: 5610729 - DNA, 14 bp, Homo sapiens
ctttccccactgaa

SEQ ID NO: 5610730 - DNA, 11 bp, Homo sapiens
ctttccccaga

SEQ ID NO: 5610731 - DNA, 14 bp, Homo sapiens
ctttccccagacac

SEQ ID NO: 5610732 - DNA, 21 bp, Homo sapiens
ctttccccagaggctcccaat

SEQ ID NO: 5610733 - DNA, 22 bp, Homo sapiens
ctttccccagcagtttctgtcc

SEQ ID NO: 5610734 - DNA, 23 bp, Homo sapiens
ctttccccagcagtttctgtcct

SEQ ID NO: 5610735 - DNA, 13 bp, Homo sapiens
ctttccccagcct

SEQ ID NO: 5610736 - DNA, 17 bp, Homo sapiens
ctttccccagcctctcc

SEQ ID NO: 5610737 - DNA, 18 bp, Homo sapiens
ctttccccagcctctcct

SEQ ID NO: 5610738 - DNA, 20 bp, Homo sapiens
ctttccccagcctctcctcc

SEQ ID NO: 5610739 - DNA, 23 bp, Homo sapiens
ctttccccagctgattagtgtct

SEQ ID NO: 5610740 - DNA, 14 bp, Homo sapiens
ctttccccaggggc

SEQ ID NO: 5610741 - DNA, 13 bp, Homo sapiens
ctttccccagtgt

SEQ ID NO: 5610742 - DNA, 17 bp, Homo sapiens
ctttccccattcagtga

SEQ ID NO: 5610743 - DNA, 19 bp, Homo sapiens
ctttccccattcagtgaca

SEQ ID NO: 5610744 - DNA, 23 bp, Homo sapiens
ctttccccattcagtgacatgtc

SEQ ID NO: 5610745 - DNA, 19 bp, Homo sapiens
ctttcccccaccccagagt

SEQ ID NO: 5610746 - DNA, 20 bp, Homo sapiens
ctttcccccaccccagagtt

SEQ ID NO: 5610747 - DNA, 21 bp, Homo sapiens
ctttcccccaccccagagttg

SEQ ID NO: 5610748 - DNA, 15 bp, Homo sapiens
ctttcccccctcaca

SEQ ID NO: 5610749 - DNA, 18 bp, Homo sapiens
ctttcccccctccctcca

SEQ ID NO: 5610750 - DNA, 15 bp, Homo sapiens
ctttcccccttcccg

SEQ ID NO: 5610751 - DNA, 13 bp, Homo sapiens
ctttcccctagat

SEQ ID NO: 5610752 - DNA, 13 bp, Homo sapiens
ctttcccctctct

SEQ ID NO: 5610753 - DNA, 15 bp, Homo sapiens
ctttcccctctctgc

SEQ ID NO: 5610754 - DNA, 13 bp, Homo sapiens
ctttcccctgtgg

SEQ ID NO: 5610755 - DNA, 15 bp, Homo sapiens
ctttcccctgtgggg

SEQ ID NO: 5610756 - DNA, 13 bp, Homo sapiens
ctttccccttccc

SEQ ID NO: 5610757 - DNA, 18 bp, Homo sapiens
ctttccccttcccctccc

SEQ ID NO: 5610758 - DNA, 18 bp, Homo sapiens
ctttccccttccttttaa

SEQ ID NO: 5610759 - DNA, 15 bp, Homo sapiens
ctttcccctttctct

SEQ ID NO: 5610760 - DNA, 14 bp, Homo sapiens
ctttcccgggccct

SEQ ID NO: 5610761 - DNA, 17 bp, Homo sapiens
ctttccctaaagaccct

SEQ ID NO: 5610762 - DNA, 23 bp, Homo sapiens
ctttccctaagaggcgacttcct

SEQ ID NO: 5610763 - DNA, 18 bp, Homo sapiens
ctttccctaagccagctg

SEQ ID NO: 5610764 - DNA, 18 bp, Homo sapiens
ctttccctaccctctaga

SEQ ID NO: 5610765 - DNA, 11 bp, Homo sapiens
ctttccctcac

SEQ ID NO: 5610766 - DNA, 14 bp, Homo sapiens
ctttccctcacccc

SEQ ID NO: 5610767 - DNA, 14 bp, Homo sapiens
ctttccctcccttc

SEQ ID NO: 5610768 - DNA, 22 bp, Homo sapiens
ctttccctcctaaagctgaatc

SEQ ID NO: 5610769 - DNA, 14 bp, Homo sapiens
ctttccctctctgg

SEQ ID NO: 5610770 - DNA, 13 bp, Homo sapiens
ctttccctctggg

SEQ ID NO: 5610771 - DNA, 18 bp, Homo sapiens
ctttccctgaagccctag

SEQ ID NO: 5610772 - DNA, 15 bp, Homo sapiens
ctttccctgcatccc

SEQ ID NO: 5610773 - DNA, 16 bp, Homo sapiens
ctttccctgcatccct

SEQ ID NO: 5610774 - DNA, 13 bp, Homo sapiens
ctttccctgcctc

SEQ ID NO: 5610775 - DNA, 14 bp, Homo sapiens
ctttccctggacag

SEQ ID NO: 5610776 - DNA, 13 bp, Homo sapiens
ctttccctggagt

SEQ ID NO: 5610777 - DNA, 14 bp, Homo sapiens
ctttccctggctca

SEQ ID NO: 5610778 - DNA, 15 bp, Homo sapiens
ctttccctggctcag

SEQ ID NO: 5610779 - DNA, 16 bp, Homo sapiens
ctttccctggctcagg

SEQ ID NO: 5610780 - DNA, 14 bp, Homo sapiens
ctttccctgtgcca

SEQ ID NO: 5610781 - DNA, 22 bp, Homo sapiens
ctttcccttattgcctcccagg

SEQ ID NO: 5610782 - DNA, 14 bp, Homo sapiens
ctttcccttcctcc

SEQ ID NO: 5610783 - DNA, 17 bp, Homo sapiens
ctttcccttcctcttcg

SEQ ID NO: 5610784 - DNA, 13 bp, Homo sapiens
ctttcccttcttt

SEQ ID NO: 5610785 - DNA, 16 bp, Homo sapiens
ctttcccttgcttttc

SEQ ID NO: 5610786 - DNA, 15 bp, Homo sapiens
ctttcccttggctgt

SEQ ID NO: 5610787 - DNA, 16 bp, Homo sapiens
ctttccgactgcccag

SEQ ID NO: 5610788 - DNA, 17 bp, Homo sapiens
ctttccgactgcccaga

SEQ ID NO: 5610789 - DNA, 18 bp, Homo sapiens
ctttccggcacactgcca

SEQ ID NO: 5610790 - DNA, 21 bp, Homo sapiens
ctttccggcacactgccaaat

SEQ ID NO: 5610791 - DNA, 22 bp, Homo sapiens
ctttccggccaaggtgccacca

SEQ ID NO: 5610792 - DNA, 19 bp, Homo sapiens
ctttccggggaggagcctt

SEQ ID NO: 5610793 - DNA, 16 bp, Homo sapiens
ctttccggggctgctg

SEQ ID NO: 5610794 - DNA, 17 bp, Homo sapiens
ctttccgtggcactgca

SEQ ID NO: 5610795 - DNA, 19 bp, Homo sapiens
ctttccgtggcactgcata

SEQ ID NO: 5610796 - DNA, 21 bp, Homo sapiens
ctttcctaaagtctctgctgc

SEQ ID NO: 5610797 - DNA, 18 bp, Homo sapiens
ctttcctaacttccttta

SEQ ID NO: 5610798 - DNA, 16 bp, Homo sapiens
ctttcctaaggctgca

SEQ ID NO: 5610799 - DNA, 18 bp, Homo sapiens
ctttcctacagttgggta

SEQ ID NO: 5610800 - DNA, 19 bp, Homo sapiens
ctttcctatctttacatct

SEQ ID NO: 5610801 - DNA, 22 bp, Homo sapiens
ctttcctcaagtatcttctatt

SEQ ID NO: 5610802 - DNA, 18 bp, Homo sapiens
ctttcctcattaaattac

SEQ ID NO: 5610803 - DNA, 12 bp, Homo sapiens
ctttcctccacc

SEQ ID NO: 5610804 - DNA, 11 bp, Homo sapiens
ctttcctcccc

SEQ ID NO: 5610805 - DNA, 15 bp, Homo sapiens
ctttcctccccacct

SEQ ID NO: 5610806 - DNA, 21 bp, Homo sapiens
ctttcctccccaccttcccca

SEQ ID NO: 5610807 - DNA, 17 bp, Homo sapiens
ctttcctccccatacac

SEQ ID NO: 5610808 - DNA, 13 bp, Homo sapiens
ctttcctccctgg

SEQ ID NO: 5610809 - DNA, 13 bp, Homo sapiens
ctttcctcccttc

SEQ ID NO: 5610810 - DNA, 16 bp, Homo sapiens
ctttcctcccttcttt

SEQ ID NO: 5610811 - DNA, 18 bp, Homo sapiens
ctttcctcccttctttgc

SEQ ID NO: 5610812 - DNA, 14 bp, Homo sapiens
ctttcctccgcctg

SEQ ID NO: 5610813 - DNA, 12 bp, Homo sapiens
ctttcctccgga

SEQ ID NO: 5610814 - DNA, 18 bp, Homo sapiens
ctttcctccggagcctca

SEQ ID NO: 5610815 - DNA, 20 bp, Homo sapiens
ctttcctccggagcctcatg

SEQ ID NO: 5610816 - DNA, 14 bp, Homo sapiens
ctttcctcctacct

SEQ ID NO: 5610817 - DNA, 23 bp, Homo sapiens
ctttcctcctaccttttgtctct

SEQ ID NO: 5610818 - DNA, 21 bp, Homo sapiens
ctttcctcctcatgaaagcag

SEQ ID NO: 5610819 - DNA, 14 bp, Homo sapiens
ctttcctcctctga

SEQ ID NO: 5610820 - DNA, 16 bp, Homo sapiens
ctttcctcctggcaga

SEQ ID NO: 5610821 - DNA, 19 bp, Homo sapiens
ctttcctccttcactgttt

SEQ ID NO: 5610822 - DNA, 16 bp, Homo sapiens
ctttcctccttccatg

SEQ ID NO: 5610823 - DNA, 19 bp, Homo sapiens
ctttcctcggtctcccttc

SEQ ID NO: 5610824 - DNA, 16 bp, Homo sapiens
ctttcctcgtgaagga

SEQ ID NO: 5610825 - DNA, 22 bp, Homo sapiens
ctttcctctaactcactgccta

SEQ ID NO: 5610826 - DNA, 17 bp, Homo sapiens
ctttcctctccctcagg

SEQ ID NO: 5610827 - DNA, 19 bp, Homo sapiens
ctttcctctcctgggtact

SEQ ID NO: 5610828 - DNA, 17 bp, Homo sapiens
ctttcctctctatattt

SEQ ID NO: 5610829 - DNA, 18 bp, Homo sapiens
ctttcctctctatatttc

SEQ ID NO: 5610830 - DNA, 12 bp, Homo sapiens
ctttcctctctg

SEQ ID NO: 5610831 - DNA, 23 bp, Homo sapiens
ctttcctctgcacgctcaatgcc

SEQ ID NO: 5610832 - DNA, 16 bp, Homo sapiens
ctttcctctgcagcac

SEQ ID NO: 5610833 - DNA, 14 bp, Homo sapiens
ctttcctcttcccc

SEQ ID NO: 5610834 - DNA, 15 bp, Homo sapiens
ctttcctctttctgc

SEQ ID NO: 5610835 - DNA, 19 bp, Homo sapiens
ctttcctctttctgctctg

SEQ ID NO: 5610836 - DNA, 15 bp, Homo sapiens
ctttcctgagctgtc

SEQ ID NO: 5610837 - DNA, 19 bp, Homo sapiens
ctttcctgatggcaggatg

SEQ ID NO: 5610838 - DNA, 22 bp, Homo sapiens
ctttcctgatggtacaggaaag

SEQ ID NO: 5610839 - DNA, 13 bp, Homo sapiens
ctttcctgatgtt

SEQ ID NO: 5610840 - DNA, 16 bp, Homo sapiens
ctttcctgatgttgat

SEQ ID NO: 5610841 - DNA, 20 bp, Homo sapiens
ctttcctgatgttgataata

SEQ ID NO: 5610842 - DNA, 14 bp, Homo sapiens
ctttcctgccctgt

SEQ ID NO: 5610843 - DNA, 12 bp, Homo sapiens
ctttcctgctgt

SEQ ID NO: 5610844 - DNA, 18 bp, Homo sapiens
ctttcctgctgtcttctc

SEQ ID NO: 5610845 - DNA, 14 bp, Homo sapiens
ctttcctggaagcc

SEQ ID NO: 5610846 - DNA, 22 bp, Homo sapiens
ctttcctggataaaaaagaaaa

SEQ ID NO: 5610847 - DNA, 21 bp, Homo sapiens
ctttcctggatccaggataat

SEQ ID NO: 5610848 - DNA, 13 bp, Homo sapiens
ctttcctggatgt

SEQ ID NO: 5610849 - DNA, 18 bp, Homo sapiens
ctttcctgggcctttgca

SEQ ID NO: 5610850 - DNA, 13 bp, Homo sapiens
ctttcctggtttc

SEQ ID NO: 5610851 - DNA, 15 bp, Homo sapiens
ctttcctgtgccagg

SEQ ID NO: 5610852 - DNA, 13 bp, Homo sapiens
ctttcctgttcag

SEQ ID NO: 5610853 - DNA, 16 bp, Homo sapiens
ctttcctgttcagcat

SEQ ID NO: 5610854 - DNA, 19 bp, Homo sapiens
ctttcctgttcagcattct

SEQ ID NO: 5610855 - DNA, 13 bp, Homo sapiens
ctttcctgtttcc

SEQ ID NO: 5610856 - DNA, 17 bp, Homo sapiens
ctttcctgtttccaggg

SEQ ID NO: 5610857 - DNA, 20 bp, Homo sapiens
ctttcctgtttccagggtct

SEQ ID NO: 5610858 - DNA, 14 bp, Homo sapiens
ctttccttcatctc

SEQ ID NO: 5610859 - DNA, 14 bp, Homo sapiens
ctttccttcccaat

SEQ ID NO: 5610860 - DNA, 15 bp, Homo sapiens
ctttccttcccaggc

SEQ ID NO: 5610861 - DNA, 23 bp, Homo sapiens
ctttccttcccaggccctttggc

SEQ ID NO: 5610862 - DNA, 16 bp, Homo sapiens
ctttccttccctctcc

SEQ ID NO: 5610863 - DNA, 17 bp, Homo sapiens
ctttccttccctctcct

SEQ ID NO: 5610864 - DNA, 13 bp, Homo sapiens
ctttccttcctaa

SEQ ID NO: 5610865 - DNA, 13 bp, Homo sapiens
ctttccttcctcc

SEQ ID NO: 5610866 - DNA, 16 bp, Homo sapiens
ctttccttccttccct

SEQ ID NO: 5610867 - DNA, 21 bp, Homo sapiens
ctttccttccttttttccttt

SEQ ID NO: 5610868 - DNA, 22 bp, Homo sapiens
ctttccttcggaatccagtgct

SEQ ID NO: 5610869 - DNA, 16 bp, Homo sapiens
ctttccttctccagga

SEQ ID NO: 5610870 - DNA, 21 bp, Homo sapiens
ctttctttgcctctgcagtct

SEQ ID NO: 5610871 - DNA, 21 bp, Homo sapiens
ctttctttgggaatatttgaa

SEQ ID NO: 5610872 - DNA, 23 bp, Homo sapiens
ctttctttgggaatatttgaatc

SEQ ID NO: 5610873 - DNA, 19 bp, Homo sapiens
ctttctttggggaaaaatt

SEQ ID NO: 5610874 - DNA, 13 bp, Homo sapiens
ctttctttggtgc

SEQ ID NO: 5610875 - DNA, 15 bp, Homo sapiens
ctttctttggtgcct

SEQ ID NO: 5610876 - DNA, 13 bp, Homo sapiens
ctttctttgtcat

SEQ ID NO: 5610877 - DNA, 22 bp, Homo sapiens
ctttctttgtttctttcttcct

SEQ ID NO: 5610878 - DNA, 23 bp, Homo sapiens
ctttctttgtttctttcttcctc

SEQ ID NO: 5610879 - DNA, 21 bp, Homo sapiens
ctttctttgttttattttaat

SEQ ID NO: 5610880 - DNA, 14 bp, Homo sapiens
ctttcttttaatga

SEQ ID NO: 5610881 - DNA, 11 bp, Homo sapiens
ctttcttttct

SEQ ID NO: 5610882 - DNA, 17 bp, Homo sapiens
ctttcttttctctatga

SEQ ID NO: 5610883 - DNA, 17 bp, Homo sapiens
ctttcttttgtaaagag

SEQ ID NO: 5610884 - DNA, 15 bp, Homo sapiens
ctttcttttgtatta

SEQ ID NO: 5610885 - DNA, 20 bp, Homo sapiens
ctttctttttattttaaatc

SEQ ID NO: 5610886 - DNA, 13 bp, Homo sapiens
ctttctttttcct

SEQ ID NO: 5610887 - DNA, 20 bp, Homo sapiens
ctttctttttctgtctctct

SEQ ID NO: 5610888 - DNA, 21 bp, Homo sapiens
ctttctttttgtagctggggc

SEQ ID NO: 5610889 - DNA, 15 bp, Homo sapiens
ctttcttttttgata

SEQ ID NO: 5610890 - DNA, 16 bp, Homo sapiens
ctttcttttttgatat

SEQ ID NO: 5610891 - DNA, 19 bp, Homo sapiens
ctttcttttttggccatct

SEQ ID NO: 5610892 - DNA, 16 bp, Homo sapiens
ctttctttttttcccc

SEQ ID NO: 5610893 - DNA, 19 bp, Homo sapiens
ctttcttttttttttttga

SEQ ID NO: 5610894 - DNA, 15 bp, Homo sapiens
ctttgaaaaaaagtt

SEQ ID NO: 5610895 - DNA, 13 bp, Homo sapiens
ctttgaaaagttg

SEQ ID NO: 5610896 - DNA, 14 bp, Homo sapiens
ctttgaaacctcag

SEQ ID NO: 5610897 - DNA, 16 bp, Homo sapiens
ctttgaaacctcaggg

SEQ ID NO: 5610898 - DNA, 13 bp, Homo sapiens
ctttgaaactgta

SEQ ID NO: 5610899 - DNA, 15 bp, Homo sapiens
ctttgaaagaagcaa

SEQ ID NO: 5610900 - DNA, 10 bp, Homo sapiens
ctttgaaagt

SEQ ID NO: 5610901 - DNA, 14 bp, Homo sapiens
ctttgaaataaaaa

SEQ ID NO: 5610902 - DNA, 16 bp, Homo sapiens
ctttgaaataaaataa

SEQ ID NO: 5610903 - DNA, 14 bp, Homo sapiens
ctttgaaatacctc

SEQ ID NO: 5610904 - DNA, 18 bp, Homo sapiens
ctttgaaatacctcatgt

SEQ ID NO: 5610905 - DNA, 19 bp, Homo sapiens
ctttgaaatacctcatgtt

SEQ ID NO: 5610906 - DNA, 21 bp, Homo sapiens
ctttgaaatagtctgtgtgaa

SEQ ID NO: 5610907 - DNA, 18 bp, Homo sapiens
ctttgaaatatgcatgta

SEQ ID NO: 5610908 - DNA, 17 bp, Homo sapiens
ctttgaaatattaaaat

SEQ ID NO: 5610909 - DNA, 14 bp, Homo sapiens
ctttgaaatgtgtt

SEQ ID NO: 5610910 - DNA, 20 bp, Homo sapiens
ctttgaaattgaacctttgt

SEQ ID NO: 5610911 - DNA, 23 bp, Homo sapiens
ctttgaaattgaacctttgtgcc

SEQ ID NO: 5610912 - DNA, 15 bp, Homo sapiens
ctttgaacctcagca

SEQ ID NO: 5610913 - DNA, 22 bp, Homo sapiens
ctttgaactaatgataaagtaa

SEQ ID NO: 5610914 - DNA, 19 bp, Homo sapiens
ctttgaactactagaaaat

SEQ ID NO: 5610915 - DNA, 23 bp, Homo sapiens
ctttgaagaaaagaaaaaacaac

SEQ ID NO: 5610916 - DNA, 11 bp, Homo sapiens
ctttgaagaag

SEQ ID NO: 5610917 - DNA, 23 bp, Homo sapiens
ctttgaagaaggaatcttttata

SEQ ID NO: 5610918 - DNA, 11 bp, Homo sapiens
ctttgaagaat

SEQ ID NO: 5610919 - DNA, 20 bp, Homo sapiens
ctttgaagaggaaaatgaat

SEQ ID NO: 5610920 - DNA, 19 bp, Homo sapiens
ctttgaagcaaatacaatt

SEQ ID NO: 5610921 - DNA, 19 bp, Homo sapiens
ctttgaagcagttgtgtca

SEQ ID NO: 5610922 - DNA, 22 bp, Homo sapiens
ctttgaagcatagctacaattt

SEQ ID NO: 5610923 - DNA, 17 bp, Homo sapiens
ctttgaagctgaaaata

SEQ ID NO: 5610924 - DNA, 12 bp, Homo sapiens
ctttgaagggca

SEQ ID NO: 5610925 - DNA, 16 bp, Homo sapiens
ctttgaaggggcctca

SEQ ID NO: 5610926 - DNA, 20 bp, Homo sapiens
ctttgaaggtaataaataca

SEQ ID NO: 5610927 - DNA, 17 bp, Homo sapiens
ctttgaagtagctcttt

SEQ ID NO: 5610928 - DNA, 21 bp, Homo sapiens
ctttgaagtgcctctgattct

SEQ ID NO: 5610929 - DNA, 18 bp, Homo sapiens
ctttgaagtgggaaagca

SEQ ID NO: 5610930 - DNA, 20 bp, Homo sapiens
ctttgaagtgggaaagcatt

SEQ ID NO: 5610931 - DNA, 22 bp, Homo sapiens
ctttgaagtgggaaagcatttt

SEQ ID NO: 5610932 - DNA, 16 bp, Homo sapiens
ctttgaataaaagaat

SEQ ID NO: 5610933 - DNA, 22 bp, Homo sapiens
ctttgaataaagaatacttgaa

SEQ ID NO: 5610934 - DNA, 13 bp, Homo sapiens
ctttgaataaagt

SEQ ID NO: 5610935 - DNA, 12 bp, Homo sapiens
ctttgaataaat

SEQ ID NO: 5610936 - DNA, 16 bp, Homo sapiens
ctttgaataaatgtca

SEQ ID NO: 5610937 - DNA, 17 bp, Homo sapiens
ctttgaatacccccaga

SEQ ID NO: 5610938 - DNA, 22 bp, Homo sapiens
ctttgaatacccccagagacct

SEQ ID NO: 5610939 - DNA, 17 bp, Homo sapiens
ctttgaatagtcctaaa

SEQ ID NO: 5610940 - DNA, 23 bp, Homo sapiens
ctttgaatgctaagaatgcatta

SEQ ID NO: 5610941 - DNA, 16 bp, Homo sapiens
ctttgaatgtaaccaa

SEQ ID NO: 5610942 - DNA, 18 bp, Homo sapiens
ctttgaatgtattgttct

SEQ ID NO: 5610943 - DNA, 13 bp, Homo sapiens
ctttgaatttata

SEQ ID NO: 5610944 - DNA, 19 bp, Homo sapiens
ctttgaatttatataaagt

SEQ ID NO: 5610945 - DNA, 19 bp, Homo sapiens
ctttgaatttcctatctgt

SEQ ID NO: 5610946 - DNA, 13 bp, Homo sapiens
ctttgaattttca

SEQ ID NO: 5610947 - DNA, 19 bp, Homo sapiens
ctttgaattttcattttac

SEQ ID NO: 5610948 - DNA, 21 bp, Homo sapiens
ctttgaattttcattttacag

SEQ ID NO: 5610949 - DNA, 17 bp, Homo sapiens
ctttgaattttctgtgt

SEQ ID NO: 5610950 - DNA, 19 bp, Homo sapiens
ctttgacaaaagtaaatgg

SEQ ID NO: 5610951 - DNA, 23 bp, Homo sapiens
ctttgacaaaatgactggctcct

SEQ ID NO: 5610952 - DNA, 14 bp, Homo sapiens
ctttgacaaggaaa

SEQ ID NO: 5610953 - DNA, 17 bp, Homo sapiens
ctttgacaattctgggt

SEQ ID NO: 5610954 - DNA, 18 bp, Homo sapiens
ctttgacaattgggagct

SEQ ID NO: 5610955 - DNA, 22 bp, Homo sapiens
ctttgacaattgggagctgcca

SEQ ID NO: 5610956 - DNA, 14 bp, Homo sapiens
ctttgacactctgc

SEQ ID NO: 5610957 - DNA, 19 bp, Homo sapiens
ctttgacatggtgccttag

SEQ ID NO: 5610958 - DNA, 18 bp, Homo sapiens
ctttgaccagatctttct

SEQ ID NO: 5610959 - DNA, 23 bp, Homo sapiens
ctttgaccagatctttctcttcc

SEQ ID NO: 5610960 - DNA, 15 bp, Homo sapiens
ctttgaccagcacat

SEQ ID NO: 5610961 - DNA, 19 bp, Homo sapiens
ctttgaccatggaaagaaa

SEQ ID NO: 5610962 - DNA, 18 bp, Homo sapiens
ctttgacctctgcagcaa

SEQ ID NO: 5610963 - DNA, 20 bp, Homo sapiens
ctttgacctctgcagcaata

SEQ ID NO: 5610964 - DNA, 15 bp, Homo sapiens
ctttgacctgcctcc

SEQ ID NO: 5610965 - DNA, 18 bp, Homo sapiens
ctttgacctgcctccctt

SEQ ID NO: 5610966 - DNA, 14 bp, Homo sapiens
ctttgaccttcccc

SEQ ID NO: 5610967 - DNA, 21 bp, Homo sapiens
ctttgacgagtcaccttccag

SEQ ID NO: 5610968 - DNA, 19 bp, Homo sapiens
ctttgacgccatcccagcc

SEQ ID NO: 5610969 - DNA, 19 bp, Homo sapiens
ctttgacgggaggcctcag

SEQ ID NO: 5610970 - DNA, 21 bp, Homo sapiens
ctttgacgggaggcctcagtt

SEQ ID NO: 5610971 - DNA, 18 bp, Homo sapiens
ctttgacgtattatctgt

SEQ ID NO: 5610972 - DNA, 19 bp, Homo sapiens
ctttgactctataagcaaa

SEQ ID NO: 5610973 - DNA, 16 bp, Homo sapiens
ctttgactgagcagac

SEQ ID NO: 5610974 - DNA, 17 bp, Homo sapiens
ctttgactgtcagcaag

SEQ ID NO: 5610975 - DNA, 23 bp, Homo sapiens
ctttgacttaagggttgcttgct

SEQ ID NO: 5610976 - DNA, 14 bp, Homo sapiens
ctttgacttcagct

SEQ ID NO: 5610977 - DNA, 22 bp, Homo sapiens
ctttgacttcttgcttcagtca

SEQ ID NO: 5610978 - DNA, 14 bp, Homo sapiens
ctttgactttcttc

SEQ ID NO: 5610979 - DNA, 14 bp, Homo sapiens
ctttgactttttgc

SEQ ID NO: 5610980 - DNA, 17 bp, Homo sapiens
ctttgactttttgcatt

SEQ ID NO: 5610981 - DNA, 13 bp, Homo sapiens
ctttgagaaagaa

SEQ ID NO: 5610982 - DNA, 15 bp, Homo sapiens
ctttgagaaagaaat

SEQ ID NO: 5610983 - DNA, 16 bp, Homo sapiens
ctttgagaaagaaata

SEQ ID NO: 5610984 - DNA, 19 bp, Homo sapiens
ctttgagaaagggctttta

SEQ ID NO: 5610985 - DNA, 17 bp, Homo sapiens
ctttgagaagccttcag

SEQ ID NO: 5610986 - DNA, 23 bp, Homo sapiens
ctttgagaatacaagatattatg

SEQ ID NO: 5610987 - DNA, 16 bp, Homo sapiens
ctttgagacaggtgcc

SEQ ID NO: 5610988 - DNA, 22 bp, Homo sapiens
ctttgagacaggtgcctggggc

SEQ ID NO: 5610989 - DNA, 13 bp, Homo sapiens
ctttgagacagtt

SEQ ID NO: 5610990 - DNA, 16 bp, Homo sapiens
ctttgagacagtttct

SEQ ID NO: 5610991 - DNA, 20 bp, Homo sapiens
ctttgagaccagaagaaaag

SEQ ID NO: 5610992 - DNA, 17 bp, Homo sapiens
ctttgagactgggtctc

SEQ ID NO: 5610993 - DNA, 18 bp, Homo sapiens
ctttgagagagaaaggac

SEQ ID NO: 5610994 - DNA, 13 bp, Homo sapiens
ctttgagagaggg

SEQ ID NO: 5610995 - DNA, 21 bp, Homo sapiens
ctttgagataatttaaccctg

SEQ ID NO: 5610996 - DNA, 18 bp, Homo sapiens
ctttgagatagaagaact

SEQ ID NO: 5610997 - DNA, 20 bp, Homo sapiens
ctttgagatagcccatcttc

SEQ ID NO: 5610998 - DNA, 17 bp, Homo sapiens
ctttgagatctggggag

SEQ ID NO: 5610999 - DNA, 19 bp, Homo sapiens
ctttgagatctggggaggc

SEQ ID NO: 5611000 - DNA, 20 bp, Homo sapiens
ctttgagatgtgttcctcct

SEQ ID NO: 5611001 - DNA, 11 bp, Homo sapiens
ctttgagccca

SEQ ID NO: 5611002 - DNA, 22 bp, Homo sapiens
ctttgagcccattcttctgggt

SEQ ID NO: 5611003 - DNA, 23 bp, Homo sapiens
ctttgagcccattcttctgggtg

SEQ ID NO: 5611004 - DNA, 12 bp, Homo sapiens
ctttgagcctga

SEQ ID NO: 5611005 - DNA, 16 bp, Homo sapiens
ctttgagccttggccc

SEQ ID NO: 5611006 - DNA, 21 bp, Homo sapiens
ctttgagcttaatctttgaaa

SEQ ID NO: 5611007 - DNA, 13 bp, Homo sapiens
ctttgagcttctc

SEQ ID NO: 5611008 - DNA, 22 bp, Homo sapiens
ctttgagcttctcctctgctcc

SEQ ID NO: 5611009 - DNA, 13 bp, Homo sapiens
ctttgaggaacat

SEQ ID NO: 5611010 - DNA, 16 bp, Homo sapiens
ctttgaggaggaagca

SEQ ID NO: 5611011 - DNA, 17 bp, Homo sapiens
ctttgaggataactttt

SEQ ID NO: 5611012 - DNA, 20 bp, Homo sapiens
ctttgaggataactttttaa

SEQ ID NO: 5611013 - DNA, 21 bp, Homo sapiens
ctttgaggcagcgcattgttt

SEQ ID NO: 5611014 - DNA, 18 bp, Homo sapiens
ctttgaggccccaactca

SEQ ID NO: 5611015 - DNA, 21 bp, Homo sapiens
ctttgaggccccaactcaagt

SEQ ID NO: 5611016 - DNA, 22 bp, Homo sapiens
ctttgagggacgatctttgaat

SEQ ID NO: 5611017 - DNA, 23 bp, Homo sapiens
ctttgagggacgatctttgaata

SEQ ID NO: 5611018 - DNA, 18 bp, Homo sapiens
ctttgagggactgcctct

SEQ ID NO: 5611019 - DNA, 17 bp, Homo sapiens
ctttgaggtgagggtgg

SEQ ID NO: 5611020 - DNA, 21 bp, Homo sapiens
ctttgagtacagatactgtga

SEQ ID NO: 5611021 - DNA, 15 bp, Homo sapiens
ctttgagtccagtgt

SEQ ID NO: 5611022 - DNA, 20 bp, Homo sapiens
ctttgagtgccaatttctta

SEQ ID NO: 5611023 - DNA, 23 bp, Homo sapiens
ctttgagtgtattctatttgtgt

SEQ ID NO: 5611024 - DNA, 21 bp, Homo sapiens
ctttgagtgtcaggctctgaa

SEQ ID NO: 5611025 - DNA, 19 bp, Homo sapiens
ctttgagttaagtctatct

SEQ ID NO: 5611026 - DNA, 22 bp, Homo sapiens
ctttgagtttcctcaggctgct

SEQ ID NO: 5611027 - DNA, 15 bp, Homo sapiens
ctttgataaaatatt

SEQ ID NO: 5611028 - DNA, 17 bp, Homo sapiens
ctttgataaagtaaaaa

SEQ ID NO: 5611029 - DNA, 18 bp, Homo sapiens
ctttgataacaaaaaata

SEQ ID NO: 5611030 - DNA, 22 bp, Homo sapiens
ctttgataacaaaaaataaatt

SEQ ID NO: 5611031 - DNA, 21 bp, Homo sapiens
ctttgataatgtccaaatact

SEQ ID NO: 5611032 - DNA, 14 bp, Homo sapiens
ctttgataatgtta

SEQ ID NO: 5611033 - DNA, 22 bp, Homo sapiens
ctttgataatgttaaatttgta

SEQ ID NO: 5611034 - DNA, 17 bp, Homo sapiens
ctttgatactaccaggg

SEQ ID NO: 5611035 - DNA, 22 bp, Homo sapiens
ctttgatatgccaccagcgaac

SEQ ID NO: 5611036 - DNA, 22 bp, Homo sapiens
ctttgatatgtgagcaacattt

SEQ ID NO: 5611037 - DNA, 22 bp, Homo sapiens
ctttgatattatgtggctttta

SEQ ID NO: 5611038 - DNA, 15 bp, Homo sapiens
ctttgatcccagaaa

SEQ ID NO: 5611039 - DNA, 19 bp, Homo sapiens
ctttgatcccagaaagtat

SEQ ID NO: 5611040 - DNA, 15 bp, Homo sapiens
ctttgatccttctga

SEQ ID NO: 5611041 - DNA, 16 bp, Homo sapiens
ctttgatccttctgag

SEQ ID NO: 5611042 - DNA, 17 bp, Homo sapiens
ctttgatccttctgagc

SEQ ID NO: 5611043 - DNA, 21 bp, Homo sapiens
ctttgatccttctgagctcca

SEQ ID NO: 5611044 - DNA, 18 bp, Homo sapiens
ctttgatccttggaaacc

SEQ ID NO: 5611045 - DNA, 16 bp, Homo sapiens
ctttgatctggacaga

SEQ ID NO: 5611046 - DNA, 14 bp, Homo sapiens
ctttgtgaccagaa

SEQ ID NO: 5611047 - DNA, 22 bp, Homo sapiens
ctttgtgacttcttcttctttg

SEQ ID NO: 5611048 - DNA, 13 bp, Homo sapiens
ctttgtgagagag

SEQ ID NO: 5611049 - DNA, 24 bp, Homo sapiens
ctttgtgagagaggacctccatgc

SEQ ID NO: 5611050 - DNA, 19 bp, Homo sapiens
ctttgtgaggaagccgctg

SEQ ID NO: 5611051 - DNA, 16 bp, Homo sapiens
ctttgtgataatttaa

SEQ ID NO: 5611052 - DNA, 22 bp, Homo sapiens
ctttgtgatgagggtgagaaaa

SEQ ID NO: 5611053 - DNA, 22 bp, Homo sapiens
ctttgtgattcaatctgtaaac

SEQ ID NO: 5611054 - DNA, 14 bp, Homo sapiens
ctttgtgattccat

SEQ ID NO: 5611055 - DNA, 15 bp, Homo sapiens
ctttgtgattccatg

SEQ ID NO: 5611056 - DNA, 19 bp, Homo sapiens
ctttgtgatttttgtaatt

SEQ ID NO: 5611057 - DNA, 16 bp, Homo sapiens
ctttgtgcaaaagcag

SEQ ID NO: 5611058 - DNA, 17 bp, Homo sapiens
ctttgtgcaaaagcagg

SEQ ID NO: 5611059 - DNA, 12 bp, Homo sapiens
ctttgtgccagc

SEQ ID NO: 5611060 - DNA, 14 bp, Homo sapiens
ctttgtgcctttga

SEQ ID NO: 5611061 - DNA, 18 bp, Homo sapiens
ctttgtgcctttgggcac

SEQ ID NO: 5611062 - DNA, 20 bp, Homo sapiens
ctttgtgctacatgacgaca

SEQ ID NO: 5611063 - DNA, 17 bp, Homo sapiens
ctttgtgctcataaatt

SEQ ID NO: 5611064 - DNA, 16 bp, Homo sapiens
ctttgtgctgcgcctg

SEQ ID NO: 5611065 - DNA, 17 bp, Homo sapiens
ctttgtgcttggggcta

SEQ ID NO: 5611066 - DNA, 21 bp, Homo sapiens
ctttgtgcttgtcattccaga

SEQ ID NO: 5611067 - DNA, 19 bp, Homo sapiens
ctttgtggaccaattattg

SEQ ID NO: 5611068 - DNA, 15 bp, Homo sapiens
ctttgtggactttat

SEQ ID NO: 5611069 - DNA, 23 bp, Homo sapiens
ctttgtggatatatttaaaattc

SEQ ID NO: 5611070 - DNA, 16 bp, Homo sapiens
ctttgtggatgtcttc

SEQ ID NO: 5611071 - DNA, 17 bp, Homo sapiens
ctttgtggatgtcttcc

SEQ ID NO: 5611072 - DNA, 22 bp, Homo sapiens
ctttgtggcagtggccaggcag

SEQ ID NO: 5611073 - DNA, 11 bp, Homo sapiens
ctttgtggcca

SEQ ID NO: 5611074 - DNA, 14 bp, Homo sapiens
ctttgtggccaagg

SEQ ID NO: 5611075 - DNA, 14 bp, Homo sapiens
ctttgtggccttcc

SEQ ID NO: 5611076 - DNA, 13 bp, Homo sapiens
ctttgtggcttcc

SEQ ID NO: 5611077 - DNA, 14 bp, Homo sapiens
ctttgtggcttctc

SEQ ID NO: 5611078 - DNA, 19 bp, Homo sapiens
ctttgtggggaagaggggc

SEQ ID NO: 5611079 - DNA, 13 bp, Homo sapiens
ctttgtggggctt

SEQ ID NO: 5611080 - DNA, 20 bp, Homo sapiens
ctttgtgggttggccaggag

SEQ ID NO: 5611081 - DNA, 13 bp, Homo sapiens
ctttgtggtaact

SEQ ID NO: 5611082 - DNA, 20 bp, Homo sapiens
ctttgtggtgggcgctgggg

SEQ ID NO: 5611083 - DNA, 15 bp, Homo sapiens
ctttgtggtttagtt

SEQ ID NO: 5611084 - DNA, 23 bp, Homo sapiens
ctttgtggtttagttataaaagg

SEQ ID NO: 5611085 - DNA, 16 bp, Homo sapiens
ctttgtggttttatgg

SEQ ID NO: 5611086 - DNA, 13 bp, Homo sapiens
ctttgtgtaatct

SEQ ID NO: 5611087 - DNA, 17 bp, Homo sapiens
ctttgtgtaatctaagt

SEQ ID NO: 5611088 - DNA, 17 bp, Homo sapiens
ctttgtgtagctttgct

SEQ ID NO: 5611089 - DNA, 21 bp, Homo sapiens
ctttgtgtagtatcttgaaat

SEQ ID NO: 5611090 - DNA, 12 bp, Homo sapiens
ctttgtgtatct

SEQ ID NO: 5611091 - DNA, 22 bp, Homo sapiens
ctttgtgtatttttcaataata

SEQ ID NO: 5611092 - DNA, 18 bp, Homo sapiens
ctttgtgtctggccagct

SEQ ID NO: 5611093 - DNA, 19 bp, Homo sapiens
ctttgtgtcttttgttctc

SEQ ID NO: 5611094 - DNA, 13 bp, Homo sapiens
ctttgtgtgctgt

SEQ ID NO: 5611095 - DNA, 15 bp, Homo sapiens
ctttgtgtggctcct

SEQ ID NO: 5611096 - DNA, 21 bp, Homo sapiens
ctttgtgtgttatattccaag

SEQ ID NO: 5611097 - DNA, 16 bp, Homo sapiens
ctttgtgttcatttca

SEQ ID NO: 5611098 - DNA, 17 bp, Homo sapiens
ctttgtgttcatttcat

SEQ ID NO: 5611099 - DNA, 18 bp, Homo sapiens
ctttgtgttcatttcatt

SEQ ID NO: 5611100 - DNA, 16 bp, Homo sapiens
ctttgtgtttactttt

SEQ ID NO: 5611101 - DNA, 18 bp, Homo sapiens
ctttgtgtttggtttaca

SEQ ID NO: 5611102 - DNA, 23 bp, Homo sapiens
ctttgttaaccttaaatacactg

SEQ ID NO: 5611103 - DNA, 15 bp, Homo sapiens
ctttgttaacttcag

SEQ ID NO: 5611104 - DNA, 15 bp, Homo sapiens
ctttgttaatttgga

SEQ ID NO: 5611105 - DNA, 15 bp, Homo sapiens
ctttgttacaggcac

SEQ ID NO: 5611106 - DNA, 22 bp, Homo sapiens
ctttgttactgaaatgagcctc

SEQ ID NO: 5611107 - DNA, 15 bp, Homo sapiens
ctttgttatgacagt

SEQ ID NO: 5611108 - DNA, 24 bp, Homo sapiens
ctttgttattataacataaaagca

SEQ ID NO: 5611109 - DNA, 22 bp, Homo sapiens
ctttgttattgtacctaagtaa

SEQ ID NO: 5611110 - DNA, 15 bp, Homo sapiens
ctttgttcagcctgc

SEQ ID NO: 5611111 - DNA, 18 bp, Homo sapiens
ctttgttccactggaaac

SEQ ID NO: 5611112 - DNA, 12 bp, Homo sapiens
ctttgttcccca

SEQ ID NO: 5611113 - DNA, 16 bp, Homo sapiens
ctttgttccccactgg

SEQ ID NO: 5611114 - DNA, 11 bp, Homo sapiens
ctttgttccct

SEQ ID NO: 5611115 - DNA, 13 bp, Homo sapiens
ctttgttcctgct

SEQ ID NO: 5611116 - DNA, 15 bp, Homo sapiens
ctttgttcctgcttt

SEQ ID NO: 5611117 - DNA, 17 bp, Homo sapiens
ctttgttcctgctttct

SEQ ID NO: 5611118 - DNA, 18 bp, Homo sapiens
ctttgttcctgctttctc

SEQ ID NO: 5611119 - DNA, 20 bp, Homo sapiens
ctttgttcctgctttctctt

SEQ ID NO: 5611120 - DNA, 17 bp, Homo sapiens
ctttgttctcagctccc

SEQ ID NO: 5611121 - DNA, 14 bp, Homo sapiens
ctttgttctgctgt

SEQ ID NO: 5611122 - DNA, 20 bp, Homo sapiens
ctttgttctgctgttctcta

SEQ ID NO: 5611123 - DNA, 21 bp, Homo sapiens
ctttgttctggctcttccagg

SEQ ID NO: 5611124 - DNA, 17 bp, Homo sapiens
ctttgttcttcaatgtg

SEQ ID NO: 5611125 - DNA, 23 bp, Homo sapiens
ctttgttcttcaatgtgaaactg

SEQ ID NO: 5611126 - DNA, 17 bp, Homo sapiens
ctttgttctttatttgt

SEQ ID NO: 5611127 - DNA, 16 bp, Homo sapiens
ctttgttgaaaaatgt

SEQ ID NO: 5611128 - DNA, 17 bp, Homo sapiens
ctttgttgaactgttag

SEQ ID NO: 5611129 - DNA, 15 bp, Homo sapiens
ctttgttgaagtttg

SEQ ID NO: 5611130 - DNA, 20 bp, Homo sapiens
ctttgttgcaagatgtgaat

SEQ ID NO: 5611131 - DNA, 21 bp, Homo sapiens
ctttgttgcaagtactgctgt

SEQ ID NO: 5611132 - DNA, 20 bp, Homo sapiens
ctttgttgctcagcaagggg

SEQ ID NO: 5611133 - DNA, 21 bp, Homo sapiens
ctttgttgcttaatctagagc

SEQ ID NO: 5611134 - DNA, 22 bp, Homo sapiens
ctttgttgcttaatctagagct

SEQ ID NO: 5611135 - DNA, 22 bp, Homo sapiens
ctttgttggagtgaagcattta

SEQ ID NO: 5611136 - DNA, 17 bp, Homo sapiens
ctttgttggcccttcca

SEQ ID NO: 5611137 - DNA, 18 bp, Homo sapiens
ctttgttggctcagaaaa

SEQ ID NO: 5611138 - DNA, 15 bp, Homo sapiens
ctttgttgtacgcag

SEQ ID NO: 5611139 - DNA, 16 bp, Homo sapiens
ctttgttgtcctccca

SEQ ID NO: 5611140 - DNA, 18 bp, Homo sapiens
ctttgttgtctacattaa

SEQ ID NO: 5611141 - DNA, 17 bp, Homo sapiens
ctttgttgtgtgcctct

SEQ ID NO: 5611142 - DNA, 13 bp, Homo sapiens
ctttgtttaagca

SEQ ID NO: 5611143 - DNA, 23 bp, Homo sapiens
ctttgtttacatgagttcaaata

SEQ ID NO: 5611144 - DNA, 13 bp, Homo sapiens
ctttgtttatgca

SEQ ID NO: 5611145 - DNA, 14 bp, Homo sapiens
ctttgtttatgcat

SEQ ID NO: 5611146 - DNA, 16 bp, Homo sapiens
ctttgtttcaactgga

SEQ ID NO: 5611147 - DNA, 21 bp, Homo sapiens
ctttgtttcctccttgtcact

SEQ ID NO: 5611148 - DNA, 23 bp, Homo sapiens
ctttgtttcctccttgtcactga

SEQ ID NO: 5611149 - DNA, 14 bp, Homo sapiens
ctttgtttctcccc

SEQ ID NO: 5611150 - DNA, 21 bp, Homo sapiens
ctttgtttctgcatcagttca

SEQ ID NO: 5611151 - DNA, 21 bp, Homo sapiens
ctttgtttctgtttcttgctc

SEQ ID NO: 5611152 - DNA, 15 bp, Homo sapiens
ctttgtttcttgttt

SEQ ID NO: 5611153 - DNA, 17 bp, Homo sapiens
ctttgtttcttgtttat

SEQ ID NO: 5611154 - DNA, 21 bp, Homo sapiens
ctttgtttggatgtaatttag

SEQ ID NO: 5611155 - DNA, 20 bp, Homo sapiens
ctttgtttgttgtcagctga

SEQ ID NO: 5611156 - DNA, 19 bp, Homo sapiens
ctttgttttaaaaagcatc

SEQ ID NO: 5611157 - DNA, 18 bp, Homo sapiens
ctttgttttattttaata

SEQ ID NO: 5611158 - DNA, 15 bp, Homo sapiens
ctttgttttattttc

SEQ ID NO: 5611159 - DNA, 23 bp, Homo sapiens
ctttgttttcttagttacttttt

SEQ ID NO: 5611160 - DNA, 23 bp, Homo sapiens
ctttgttttgatgtttgtggcct

SEQ ID NO: 5611161 - DNA, 24 bp, Homo sapiens
ctttgttttgatgtttgtggcctc

SEQ ID NO: 5611162 - DNA, 21 bp, Homo sapiens
ctttgttttggctgctctcca

SEQ ID NO: 5611163 - DNA, 22 bp, Homo sapiens
ctttgttttgggttttcttccc

SEQ ID NO: 5611164 - DNA, 11 bp, Homo sapiens
ctttgttttgt

SEQ ID NO: 5611165 - DNA, 14 bp, Homo sapiens
ctttgttttgtgtc

SEQ ID NO: 5611166 - DNA, 15 bp, Homo sapiens
ctttgtttttattct

SEQ ID NO: 5611167 - DNA, 13 bp, Homo sapiens
ctttgtttttcca

SEQ ID NO: 5611168 - DNA, 18 bp, Homo sapiens
ctttgttttttgttttca

SEQ ID NO: 5611169 - DNA, 21 bp, Homo sapiens
ctttgtttttttttcctgtcc

SEQ ID NO: 5611170 - DNA, 15 bp, Homo sapiens
cttttaaaaaaattt

SEQ ID NO: 5611171 - DNA, 19 bp, Homo sapiens
cttttaaaaaaatttttat

SEQ ID NO: 5611172 - DNA, 15 bp, Homo sapiens
cttttaaaaaacaaa

SEQ ID NO: 5611173 - DNA, 18 bp, Homo sapiens
cttttaaaaaacaaaaaa

SEQ ID NO: 5611174 - DNA, 21 bp, Homo sapiens
cttttaaaaaacaaaaaaaga

SEQ ID NO: 5611175 - DNA, 22 bp, Homo sapiens
cttttaaaaaacaaaaaaagac

SEQ ID NO: 5611176 - DNA, 12 bp, Homo sapiens
cttttaaaaaat

SEQ ID NO: 5611177 - DNA, 21 bp, Homo sapiens
cttttaaaaagtattgccaaa

SEQ ID NO: 5611178 - DNA, 22 bp, Homo sapiens
cttttaaaaatacaattattgt

SEQ ID NO: 5611179 - DNA, 14 bp, Homo sapiens
cttttaaaaatgat

SEQ ID NO: 5611180 - DNA, 22 bp, Homo sapiens
cttttaaaaatgtagaaattct

SEQ ID NO: 5611181 - DNA, 22 bp, Homo sapiens
cttttaaaaatgtttggtttca

SEQ ID NO: 5611182 - DNA, 14 bp, Homo sapiens
cttttaaaaatttt

SEQ ID NO: 5611183 - DNA, 20 bp, Homo sapiens
cttttaaaaattttgtcctt

SEQ ID NO: 5611184 - DNA, 21 bp, Homo sapiens
cttttaaaaattttgtccttt

SEQ ID NO: 5611185 - DNA, 14 bp, Homo sapiens
cttttaaaagacaa

SEQ ID NO: 5611186 - DNA, 13 bp, Homo sapiens
cttttaaaagact

SEQ ID NO: 5611187 - DNA, 15 bp, Homo sapiens
cttttaaaagatttt

SEQ ID NO: 5611188 - DNA, 20 bp, Homo sapiens
cttttaaaagggaagttatt

SEQ ID NO: 5611189 - DNA, 12 bp, Homo sapiens
cttttaaaataa

SEQ ID NO: 5611190 - DNA, 17 bp, Homo sapiens
cttttaaaataaaattt

SEQ ID NO: 5611191 - DNA, 14 bp, Homo sapiens
cttttaaaataaat

SEQ ID NO: 5611192 - DNA, 21 bp, Homo sapiens
cttttaaaatatcctgtaact

SEQ ID NO: 5611193 - DNA, 18 bp, Homo sapiens
cttttaaaatcagtgatt

SEQ ID NO: 5611194 - DNA, 11 bp, Homo sapiens
cttttaaaatg

SEQ ID NO: 5611195 - DNA, 16 bp, Homo sapiens
cttttaaaattcaaaa

SEQ ID NO: 5611196 - DNA, 14 bp, Homo sapiens
cttttaaaattgaa

SEQ ID NO: 5611197 - DNA, 17 bp, Homo sapiens
cttttaaaatttgtaga

SEQ ID NO: 5611198 - DNA, 21 bp, Homo sapiens
cttttaaactactatttttct

SEQ ID NO: 5611199 - DNA, 14 bp, Homo sapiens
cttttaaactggaa

SEQ ID NO: 5611200 - DNA, 19 bp, Homo sapiens
cttttaaactggagaggct

SEQ ID NO: 5611201 - DNA, 12 bp, Homo sapiens
cttttaaactgt

SEQ ID NO: 5611202 - DNA, 13 bp, Homo sapiens
cttttaaactgtg

SEQ ID NO: 5611203 - DNA, 13 bp, Homo sapiens
cttttaaagaagc

SEQ ID NO: 5611204 - DNA, 12 bp, Homo sapiens
cttttaaagacc

SEQ ID NO: 5611205 - DNA, 14 bp, Homo sapiens
cttttaaagatttg

SEQ ID NO: 5611206 - DNA, 13 bp, Homo sapiens
cttttaaagtatt

SEQ ID NO: 5611207 - DNA, 20 bp, Homo sapiens
cttttaaagtgttacttttt

SEQ ID NO: 5611208 - DNA, 16 bp, Homo sapiens
cttttaaagttgatat

SEQ ID NO: 5611209 - DNA, 17 bp, Homo sapiens
cttttaaatatttgtga

SEQ ID NO: 5611210 - DNA, 13 bp, Homo sapiens
cttttaaatctct

SEQ ID NO: 5611211 - DNA, 10 bp, Homo sapiens
cttttaaatg

SEQ ID NO: 5611212 - DNA, 16 bp, Homo sapiens
cttttaaatgctctct

SEQ ID NO: 5611213 - DNA, 19 bp, Homo sapiens
cttttaaatggcagtattt

SEQ ID NO: 5611214 - DNA, 17 bp, Homo sapiens
cttttaaattagaaaat

SEQ ID NO: 5611215 - DNA, 20 bp, Homo sapiens
cttttaacacctgatgtgta

SEQ ID NO: 5611216 - DNA, 10 bp, Homo sapiens
cttttaacat

SEQ ID NO: 5611217 - DNA, 20 bp, Homo sapiens
cttttaacatttatctaaaa

SEQ ID NO: 5611218 - DNA, 18 bp, Homo sapiens
cttttaacattttgttct

SEQ ID NO: 5611219 - DNA, 20 bp, Homo sapiens
cttttaacattttgttctta

SEQ ID NO: 5611220 - DNA, 16 bp, Homo sapiens
cttttaaccatctgat

SEQ ID NO: 5611221 - DNA, 17 bp, Homo sapiens
cttttaaccatctgata

SEQ ID NO: 5611222 - DNA, 18 bp, Homo sapiens
cttttaactatgtaataa

SEQ ID NO: 5611223 - DNA, 14 bp, Homo sapiens
cttttaactatttt

SEQ ID NO: 5611224 - DNA, 15 bp, Homo sapiens
cttttgataaattta

SEQ ID NO: 5611225 - DNA, 23 bp, Homo sapiens
cttttgataaatttaaaatgtta

SEQ ID NO: 5611226 - DNA, 22 bp, Homo sapiens
cttttgataatcaactgggctg

SEQ ID NO: 5611227 - DNA, 23 bp, Homo sapiens
cttttgataatcaactgggctga

SEQ ID NO: 5611228 - DNA, 12 bp, Homo sapiens
cttttgatacat

SEQ ID NO: 5611229 - DNA, 14 bp, Homo sapiens
cttttgatacattt

SEQ ID NO: 5611230 - DNA, 13 bp, Homo sapiens
cttttgatattaa

SEQ ID NO: 5611231 - DNA, 14 bp, Homo sapiens
cttttgatcacatt

SEQ ID NO: 5611232 - DNA, 22 bp, Homo sapiens
cttttgatgatgtctacagaaa

SEQ ID NO: 5611233 - DNA, 23 bp, Homo sapiens
cttttgatgatgtctacagaaaa

SEQ ID NO: 5611234 - DNA, 13 bp, Homo sapiens
cttttgatggcta

SEQ ID NO: 5611235 - DNA, 16 bp, Homo sapiens
cttttgatggggagaa

SEQ ID NO: 5611236 - DNA, 17 bp, Homo sapiens
cttttgatggggagaaa

SEQ ID NO: 5611237 - DNA, 18 bp, Homo sapiens
cttttgatggggagaaag

SEQ ID NO: 5611238 - DNA, 23 bp, Homo sapiens
cttttgatgttcagagtggctca

SEQ ID NO: 5611239 - DNA, 21 bp, Homo sapiens
cttttgatttataaaactttg

SEQ ID NO: 5611240 - DNA, 22 bp, Homo sapiens
cttttgcaaaataagtaaataa

SEQ ID NO: 5611241 - DNA, 15 bp, Homo sapiens
cttttgcaaacagaa

SEQ ID NO: 5611242 - DNA, 16 bp, Homo sapiens
cttttgcaaataactt

SEQ ID NO: 5611243 - DNA, 16 bp, Homo sapiens
cttttgcaaccaggaa

SEQ ID NO: 5611244 - DNA, 17 bp, Homo sapiens
cttttgcaaccaggaac

SEQ ID NO: 5611245 - DNA, 21 bp, Homo sapiens
cttttgcacaaggaaataaag

SEQ ID NO: 5611246 - DNA, 22 bp, Homo sapiens
cttttgcacattccaaaattca

SEQ ID NO: 5611247 - DNA, 14 bp, Homo sapiens
cttttgcacccctc

SEQ ID NO: 5611248 - DNA, 15 bp, Homo sapiens
cttttgcacccctcc

SEQ ID NO: 5611249 - DNA, 16 bp, Homo sapiens
cttttgcacccctccc

SEQ ID NO: 5611250 - DNA, 22 bp, Homo sapiens
cttttgcacctgctctcttgta

SEQ ID NO: 5611251 - DNA, 14 bp, Homo sapiens
cttttgcagaaatc

SEQ ID NO: 5611252 - DNA, 18 bp, Homo sapiens
cttttgcagaagagggtg

SEQ ID NO: 5611253 - DNA, 19 bp, Homo sapiens
cttttgcataatgcaatca

SEQ ID NO: 5611254 - DNA, 17 bp, Homo sapiens
cttttgcatagaataat

SEQ ID NO: 5611255 - DNA, 12 bp, Homo sapiens
cttttgcatttc

SEQ ID NO: 5611256 - DNA, 21 bp, Homo sapiens
cttttgcatttcctgtgtttg

SEQ ID NO: 5611257 - DNA, 13 bp, Homo sapiens
cttttgccactcc

SEQ ID NO: 5611258 - DNA, 18 bp, Homo sapiens
cttttgccactgctgtgt

SEQ ID NO: 5611259 - DNA, 17 bp, Homo sapiens
cttttgccattaaactt

SEQ ID NO: 5611260 - DNA, 13 bp, Homo sapiens
cttttgccattga

SEQ ID NO: 5611261 - DNA, 16 bp, Homo sapiens
cttttgcccattttga

SEQ ID NO: 5611262 - DNA, 17 bp, Homo sapiens
cttttgcccattttgaa

SEQ ID NO: 5611263 - DNA, 21 bp, Homo sapiens
cttttgcccttcacagtgttt

SEQ ID NO: 5611264 - DNA, 15 bp, Homo sapiens
cttttgccctttgat

SEQ ID NO: 5611265 - DNA, 13 bp, Homo sapiens
cttttgcctggct

SEQ ID NO: 5611266 - DNA, 14 bp, Homo sapiens
cttttgcctggctg

SEQ ID NO: 5611267 - DNA, 15 bp, Homo sapiens
cttttgcctggctgt

SEQ ID NO: 5611268 - DNA, 16 bp, Homo sapiens
cttttgcctgtaagaa

SEQ ID NO: 5611269 - DNA, 15 bp, Homo sapiens
cttttgctactaagt

SEQ ID NO: 5611270 - DNA, 23 bp, Homo sapiens
cttttgctactaagttcacatta

SEQ ID NO: 5611271 - DNA, 21 bp, Homo sapiens
cttttgctgaacaggaaagag

SEQ ID NO: 5611272 - DNA, 24 bp, Homo sapiens
cttttgctgcgcaccaatgcccag

SEQ ID NO: 5611273 - DNA, 11 bp, Homo sapiens
cttttgctgct

SEQ ID NO: 5611274 - DNA, 14 bp, Homo sapiens
cttttgctgtcttt

SEQ ID NO: 5611275 - DNA, 18 bp, Homo sapiens
cttttgctgtctttctct

SEQ ID NO: 5611276 - DNA, 17 bp, Homo sapiens
cttttgctgtttatact

SEQ ID NO: 5611277 - DNA, 17 bp, Homo sapiens
cttttgcttgatccaga

SEQ ID NO: 5611278 - DNA, 18 bp, Homo sapiens
cttttgcttggcagagag

SEQ ID NO: 5611279 - DNA, 16 bp, Homo sapiens
cttttgctttcctttc

SEQ ID NO: 5611280 - DNA, 17 bp, Homo sapiens
cttttgctttcctttcc

SEQ ID NO: 5611281 - DNA, 16 bp, Homo sapiens
cttttgcttttgccca

SEQ ID NO: 5611282 - DNA, 11 bp, Homo sapiens
cttttggaaag

SEQ ID NO: 5611283 - DNA, 17 bp, Homo sapiens
cttttggaaataattac

SEQ ID NO: 5611284 - DNA, 20 bp, Homo sapiens
cttttggaacatttctttct

SEQ ID NO: 5611285 - DNA, 12 bp, Homo sapiens
cttttggaatca

SEQ ID NO: 5611286 - DNA, 15 bp, Homo sapiens
cttttggaatcatac

SEQ ID NO: 5611287 - DNA, 23 bp, Homo sapiens
cttttggaatcatactgcctact

SEQ ID NO: 5611288 - DNA, 16 bp, Homo sapiens
cttttggaatctagaa

SEQ ID NO: 5611289 - DNA, 18 bp, Homo sapiens
cttttggaatctagaaga

SEQ ID NO: 5611290 - DNA, 22 bp, Homo sapiens
cttttggaatctagaagaaatg

SEQ ID NO: 5611291 - DNA, 23 bp, Homo sapiens
cttttggcaatgactcaaagtct

SEQ ID NO: 5611292 - DNA, 19 bp, Homo sapiens
cttttggcagttctgataa

SEQ ID NO: 5611293 - DNA, 13 bp, Homo sapiens
cttttggccccag

SEQ ID NO: 5611294 - DNA, 15 bp, Homo sapiens
cttttggcctttgta

SEQ ID NO: 5611295 - DNA, 16 bp, Homo sapiens
cttttgggaagccagg

SEQ ID NO: 5611296 - DNA, 11 bp, Homo sapiens
cttttgggagg

SEQ ID NO: 5611297 - DNA, 17 bp, Homo sapiens
cttttgggaggatttga

SEQ ID NO: 5611298 - DNA, 18 bp, Homo sapiens
cttttgggctcaaagccc

SEQ ID NO: 5611299 - DNA, 23 bp, Homo sapiens
cttttggggaggagttgtctgtc

SEQ ID NO: 5611300 - DNA, 21 bp, Homo sapiens
cttttggggctcttgatcagt

SEQ ID NO: 5611301 - DNA, 15 bp, Homo sapiens
cttttgggggaaact

SEQ ID NO: 5611302 - DNA, 19 bp, Homo sapiens
cttttgggggttggatggg

SEQ ID NO: 5611303 - DNA, 19 bp, Homo sapiens
cttttgggtttctgccctg

SEQ ID NO: 5611304 - DNA, 24 bp, Homo sapiens
cttttggtatttgtttgtagcttt

SEQ ID NO: 5611305 - DNA, 15 bp, Homo sapiens
cttttggtctgtgtg

SEQ ID NO: 5611306 - DNA, 24 bp, Homo sapiens
cttttggtcttcagcctccctcag

SEQ ID NO: 5611307 - DNA, 15 bp, Homo sapiens
cttttggtggagtca

SEQ ID NO: 5611308 - DNA, 17 bp, Homo sapiens
cttttggtgtgttggac

SEQ ID NO: 5611309 - DNA, 21 bp, Homo sapiens
cttttggtgtttgagtgttca

SEQ ID NO: 5611310 - DNA, 22 bp, Homo sapiens
cttttggtgtttgagtgttcat

SEQ ID NO: 5611311 - DNA, 21 bp, Homo sapiens
cttttggttaatatgtctttt

SEQ ID NO: 5611312 - DNA, 21 bp, Homo sapiens
cttttggtttcaccttccctc

SEQ ID NO: 5611313 - DNA, 14 bp, Homo sapiens
cttttgtaaaatca

SEQ ID NO: 5611314 - DNA, 15 bp, Homo sapiens
cttttgtaaagaaat

SEQ ID NO: 5611315 - DNA, 22 bp, Homo sapiens
cttttgtaaagagaccatcttc

SEQ ID NO: 5611316 - DNA, 20 bp, Homo sapiens
cttttgtaaagtaaaatatg

SEQ ID NO: 5611317 - DNA, 21 bp, Homo sapiens
cttttgtaaagttaattcatt

SEQ ID NO: 5611318 - DNA, 11 bp, Homo sapiens
cttttgtaaat

SEQ ID NO: 5611319 - DNA, 15 bp, Homo sapiens
cttttgtaaatattc

SEQ ID NO: 5611320 - DNA, 13 bp, Homo sapiens
cttttgtaaatgt

SEQ ID NO: 5611321 - DNA, 13 bp, Homo sapiens
cttttgtaacttg

SEQ ID NO: 5611322 - DNA, 13 bp, Homo sapiens
cttttgtaagaca

SEQ ID NO: 5611323 - DNA, 12 bp, Homo sapiens
cttttgtaataa

SEQ ID NO: 5611324 - DNA, 19 bp, Homo sapiens
cttttgtaatttgaattgg

SEQ ID NO: 5611325 - DNA, 14 bp, Homo sapiens
cttttgtacatctg

SEQ ID NO: 5611326 - DNA, 21 bp, Homo sapiens
cttttgtacgttaattaaaca

SEQ ID NO: 5611327 - DNA, 12 bp, Homo sapiens
cttttgtactga

SEQ ID NO: 5611328 - DNA, 21 bp, Homo sapiens
cttttgtagatggcactttag

SEQ ID NO: 5611329 - DNA, 22 bp, Homo sapiens
cttttgtagatggcgatgtgtt

SEQ ID NO: 5611330 - DNA, 15 bp, Homo sapiens
cttttgtagctgtca

SEQ ID NO: 5611331 - DNA, 23 bp, Homo sapiens
cttttgtaggctgttccctttgc

SEQ ID NO: 5611332 - DNA, 18 bp, Homo sapiens
cttttgtagtcttatgaa

SEQ ID NO: 5611333 - DNA, 19 bp, Homo sapiens
cttttgtagtcttatgaat

SEQ ID NO: 5611334 - DNA, 12 bp, Homo sapiens
cttttgtataca

SEQ ID NO: 5611335 - DNA, 23 bp, Homo sapiens
cttttgtatacatcctgggtaat

SEQ ID NO: 5611336 - DNA, 20 bp, Homo sapiens
cttttgtatcttcctttctt

SEQ ID NO: 5611337 - DNA, 17 bp, Homo sapiens
cttttgtatgtaaatgt

SEQ ID NO: 5611338 - DNA, 18 bp, Homo sapiens
cttttgtatgtaaatgtg

SEQ ID NO: 5611339 - DNA, 13 bp, Homo sapiens
cttttgtattaag

SEQ ID NO: 5611340 - DNA, 14 bp, Homo sapiens
cttttgtattaaga

SEQ ID NO: 5611341 - DNA, 17 bp, Homo sapiens
cttttgtattaagaaag

SEQ ID NO: 5611342 - DNA, 24 bp, Homo sapiens
cttttgtccacttgtaagaatgtc

SEQ ID NO: 5611343 - DNA, 14 bp, Homo sapiens
cttttgtcccagaa

SEQ ID NO: 5611344 - DNA, 15 bp, Homo sapiens
cttttgtccccaggg

SEQ ID NO: 5611345 - DNA, 19 bp, Homo sapiens
cttttgtctacacaccctg

SEQ ID NO: 5611346 - DNA, 12 bp, Homo sapiens
cttttgtgaaag

SEQ ID NO: 5611347 - DNA, 17 bp, Homo sapiens
cttttgtgaaatcagta

SEQ ID NO: 5611348 - DNA, 14 bp, Homo sapiens
cttttgtgaacttt

SEQ ID NO: 5611349 - DNA, 21 bp, Homo sapiens
cttttgtgatggagtgctgtt

SEQ ID NO: 5611350 - DNA, 19 bp, Homo sapiens
cttttgtgggtttctctgt

SEQ ID NO: 5611351 - DNA, 21 bp, Homo sapiens
cttttgtggttctcaataaaa

SEQ ID NO: 5611352 - DNA, 20 bp, Homo sapiens
cttttgtgtaattttaaagt

SEQ ID NO: 5611353 - DNA, 14 bp, Homo sapiens
cttttgtgtacagt

SEQ ID NO: 5611354 - DNA, 23 bp, Homo sapiens
cttttgtgtcacttttttctgcc

SEQ ID NO: 5611355 - DNA, 14 bp, Homo sapiens
cttttgtgtcccat

SEQ ID NO: 5611356 - DNA, 23 bp, Homo sapiens
cttttgtgtcctgctctgtttgg

SEQ ID NO: 5611357 - DNA, 14 bp, Homo sapiens
cttttgtgtcctgt

SEQ ID NO: 5611358 - DNA, 12 bp, Homo sapiens
cttttgtgtcta

SEQ ID NO: 5611359 - DNA, 13 bp, Homo sapiens
cttttgtgtctta

SEQ ID NO: 5611360 - DNA, 17 bp, Homo sapiens
cttttgtgtgaattgac

SEQ ID NO: 5611361 - DNA, 18 bp, Homo sapiens
cttttgttaaaagttatt

SEQ ID NO: 5611362 - DNA, 18 bp, Homo sapiens
cttttgttaaataatatg

SEQ ID NO: 5611363 - DNA, 17 bp, Homo sapiens
cttttgttaagttcacc

SEQ ID NO: 5611364 - DNA, 15 bp, Homo sapiens
cttttgttaatgcat

SEQ ID NO: 5611365 - DNA, 16 bp, Homo sapiens
cttttgttaatgcatt

SEQ ID NO: 5611366 - DNA, 17 bp, Homo sapiens
cttttgttaatgcattg

SEQ ID NO: 5611367 - DNA, 23 bp, Homo sapiens
cttttgttaatgcattgttgtaa

SEQ ID NO: 5611368 - DNA, 16 bp, Homo sapiens
cttttgttactgttct

SEQ ID NO: 5611369 - DNA, 17 bp, Homo sapiens
cttttgttactgttctt

SEQ ID NO: 5611370 - DNA, 20 bp, Homo sapiens
cttttgttactgttcttgct

SEQ ID NO: 5611371 - DNA, 23 bp, Homo sapiens
cttttgttactgttcttgctgct

SEQ ID NO: 5611372 - DNA, 18 bp, Homo sapiens
cttttgttagggctgctt

SEQ ID NO: 5611373 - DNA, 14 bp, Homo sapiens
cttttgttattcca

SEQ ID NO: 5611374 - DNA, 17 bp, Homo sapiens
cttttgttattccatca

SEQ ID NO: 5611375 - DNA, 22 bp, Homo sapiens
cttttgttcatttcatcctttc

SEQ ID NO: 5611376 - DNA, 13 bp, Homo sapiens
cttttgttcgcat

SEQ ID NO: 5611377 - DNA, 20 bp, Homo sapiens
cttttgttctactccttccc

SEQ ID NO: 5611378 - DNA, 13 bp, Homo sapiens
cttttgttctaga

SEQ ID NO: 5611379 - DNA, 14 bp, Homo sapiens
cttttgttctctct

SEQ ID NO: 5611380 - DNA, 16 bp, Homo sapiens
cttttgttctctcttg

SEQ ID NO: 5611381 - DNA, 23 bp, Homo sapiens
cttttgttctctcttggtctctt

SEQ ID NO: 5611382 - DNA, 20 bp, Homo sapiens
cttttgttctcttctgcgta

SEQ ID NO: 5611383 - DNA, 20 bp, Homo sapiens
cttttgttcttaaactttca

SEQ ID NO: 5611384 - DNA, 20 bp, Homo sapiens
cttttgttgcccaggctgga

SEQ ID NO: 5611385 - DNA, 22 bp, Homo sapiens
cttttgttgcccaggctggagt

SEQ ID NO: 5611386 - DNA, 23 bp, Homo sapiens
cttttgttgtactttatatcttg

SEQ ID NO: 5611387 - DNA, 13 bp, Homo sapiens
cttttgttgtatg

SEQ ID NO: 5611388 - DNA, 13 bp, Homo sapiens
cttttgttgtgac

SEQ ID NO: 5611389 - DNA, 14 bp, Homo sapiens
cttttgttgtgact

SEQ ID NO: 5611390 - DNA, 17 bp, Homo sapiens
cttttgttgtttcttaa

SEQ ID NO: 5611391 - DNA, 19 bp, Homo sapiens
cttttgtttagagccctcc

SEQ ID NO: 5611392 - DNA, 21 bp, Homo sapiens
cttttgtttcccttgctttgt

SEQ ID NO: 5611393 - DNA, 19 bp, Homo sapiens
cttttgtttccttttttcc

SEQ ID NO: 5611394 - DNA, 16 bp, Homo sapiens
cttttgtttggtaaat

SEQ ID NO: 5611395 - DNA, 18 bp, Homo sapiens
cttttgtttggtaaatgt

SEQ ID NO: 5611396 - DNA, 18 bp, Homo sapiens
cttttgttttcctgctgg

SEQ ID NO: 5611397 - DNA, 21 bp, Homo sapiens
cttttgtttttccagttccag

SEQ ID NO: 5611398 - DNA, 23 bp, Homo sapiens
cttttgtttttggctttcctggt

SEQ ID NO: 5611399 - DNA, 13 bp, Homo sapiens
cttttgttttttg

SEQ ID NO: 5611400 - DNA, 19 bp, Homo sapiens
cttttgtttttttcctcat

SEQ ID NO: 5611401 - DNA, 18 bp, Homo sapiens
gaaaacaacaaaaaataa

SEQ ID NO: 5611402 - DNA, 15 bp, Homo sapiens
gaaaacaacaaaaga

SEQ ID NO: 5611403 - DNA, 15 bp, Homo sapiens
gaaaacaagtgctgg

SEQ ID NO: 5611404 - DNA, 22 bp, Homo sapiens
gaaaacaataacgataaaagac

SEQ ID NO: 5611405 - DNA, 13 bp, Homo sapiens
gaaaacaatatgt

SEQ ID NO: 5611406 - DNA, 12 bp, Homo sapiens
gaaaacaatgca

SEQ ID NO: 5611407 - DNA, 17 bp, Homo sapiens
gaaaacacacaaaagat

SEQ ID NO: 5611408 - DNA, 17 bp, Homo sapiens
gaaaacacacgctcctc

SEQ ID NO: 5611409 - DNA, 16 bp, Homo sapiens
gaaaacacactcaaaa

SEQ ID NO: 5611410 - DNA, 14 bp, Homo sapiens
gaaaacacagatgt

SEQ ID NO: 5611411 - DNA, 14 bp, Homo sapiens
gaaaacacagcctc

SEQ ID NO: 5611412 - DNA, 19 bp, Homo sapiens
gaaaacacatttttcttag

SEQ ID NO: 5611413 - DNA, 22 bp, Homo sapiens
gaaaacaccagctgtatatatt

SEQ ID NO: 5611414 - DNA, 14 bp, Homo sapiens
gaaaacactgtgca

SEQ ID NO: 5611415 - DNA, 22 bp, Homo sapiens
gaaaacactgttctctgccctc

SEQ ID NO: 5611416 - DNA, 14 bp, Homo sapiens
gaaaacagaaaacc

SEQ ID NO: 5611417 - DNA, 20 bp, Homo sapiens
gaaaacagaaattggtacct

SEQ ID NO: 5611418 - DNA, 21 bp, Homo sapiens
gaaaacagaacatcattagaa

SEQ ID NO: 5611419 - DNA, 14 bp, Homo sapiens
gaaaacagaagcaa

SEQ ID NO: 5611420 - DNA, 21 bp, Homo sapiens
gaaaacagacctaatgctcct

SEQ ID NO: 5611421 - DNA, 17 bp, Homo sapiens
gaaaacagagcctgcct

SEQ ID NO: 5611422 - DNA, 14 bp, Homo sapiens
gaaaacagaggaat

SEQ ID NO: 5611423 - DNA, 22 bp, Homo sapiens
gaaaacagaggccacactttct

SEQ ID NO: 5611424 - DNA, 19 bp, Homo sapiens
gaaaacagagtatttctgg

SEQ ID NO: 5611425 - DNA, 16 bp, Homo sapiens
gaaaacagatgaccat

SEQ ID NO: 5611426 - DNA, 17 bp, Homo sapiens
gaaaacagatgcccccg

SEQ ID NO: 5611427 - DNA, 18 bp, Homo sapiens
gaaaacagcaagggagag

SEQ ID NO: 5611428 - DNA, 22 bp, Homo sapiens
gaaaacagcgaacagccttaga

SEQ ID NO: 5611429 - DNA, 18 bp, Homo sapiens
gaaaacagctagcttgaa

SEQ ID NO: 5611430 - DNA, 15 bp, Homo sapiens
gaaaacagctagtag

SEQ ID NO: 5611431 - DNA, 21 bp, Homo sapiens
gaaaacagctagtagacatga

SEQ ID NO: 5611432 - DNA, 21 bp, Homo sapiens
gaaaacaggaaaaaaactttt

SEQ ID NO: 5611433 - DNA, 18 bp, Homo sapiens
gaaaacaggcactgccct

SEQ ID NO: 5611434 - DNA, 17 bp, Homo sapiens
gaaaacagtacagaagg

SEQ ID NO: 5611435 - DNA, 16 bp, Homo sapiens
gaaaacagtgaatctt

SEQ ID NO: 5611436 - DNA, 21 bp, Homo sapiens
gaaaacataatataagaatca

SEQ ID NO: 5611437 - DNA, 17 bp, Homo sapiens
gaaaacataatatagct

SEQ ID NO: 5611438 - DNA, 22 bp, Homo sapiens
gaaaacatagagtagacctgag

SEQ ID NO: 5611439 - DNA, 17 bp, Homo sapiens
gaaaacatatgaaatat

SEQ ID NO: 5611440 - DNA, 19 bp, Homo sapiens
gaaaacatatgaaatataa

SEQ ID NO: 5611441 - DNA, 19 bp, Homo sapiens
gaaaacatcactgaaatgc

SEQ ID NO: 5611442 - DNA, 23 bp, Homo sapiens
gaaaacatctcatcatgtctatt

SEQ ID NO: 5611443 - DNA, 12 bp, Homo sapiens
gaaaacatctgg

SEQ ID NO: 5611444 - DNA, 14 bp, Homo sapiens
gaaaacatgcagaa

SEQ ID NO: 5611445 - DNA, 12 bp, Homo sapiens
gaaaacatgcta

SEQ ID NO: 5611446 - DNA, 14 bp, Homo sapiens
gaaaacatgctaca

SEQ ID NO: 5611447 - DNA, 16 bp, Homo sapiens
gaaaacatgtactaca

SEQ ID NO: 5611448 - DNA, 19 bp, Homo sapiens
gaaaacatgtactacagct

SEQ ID NO: 5611449 - DNA, 16 bp, Homo sapiens
gaaaacatgtttaaat

SEQ ID NO: 5611450 - DNA, 19 bp, Homo sapiens
gaaaacattacatgctcag

SEQ ID NO: 5611451 - DNA, 16 bp, Homo sapiens
gaaaacattccagatg

SEQ ID NO: 5611452 - DNA, 17 bp, Homo sapiens
gaaaacattgatgaatg

SEQ ID NO: 5611453 - DNA, 11 bp, Homo sapiens
gaaaacattgt

SEQ ID NO: 5611454 - DNA, 12 bp, Homo sapiens
gaaaacattgtt

SEQ ID NO: 5611455 - DNA, 14 bp, Homo sapiens
gaaaacatttaaca

SEQ ID NO: 5611456 - DNA, 16 bp, Homo sapiens
gaaaacatttaacata

SEQ ID NO: 5611457 - DNA, 11 bp, Homo sapiens
gaaaacatttc

SEQ ID NO: 5611458 - DNA, 19 bp, Homo sapiens
gaaaacattttatttttaa

SEQ ID NO: 5611459 - DNA, 17 bp, Homo sapiens
gaaaaccaaaatgacat

SEQ ID NO: 5611460 - DNA, 21 bp, Homo sapiens
gaaaaccaaaatgacatcttt

SEQ ID NO: 5611461 - DNA, 21 bp, Homo sapiens
gaaaaccaacaccatcacagc

SEQ ID NO: 5611462 - DNA, 22 bp, Homo sapiens
gaaaaccaaccctgtgggctta

SEQ ID NO: 5611463 - DNA, 15 bp, Homo sapiens
gaaaaccacagtcag

SEQ ID NO: 5611464 - DNA, 13 bp, Homo sapiens
gaaaaccacttta

SEQ ID NO: 5611465 - DNA, 14 bp, Homo sapiens
gaaaaccactttat

SEQ ID NO: 5611466 - DNA, 14 bp, Homo sapiens
gaaaaccagagcct

SEQ ID NO: 5611467 - DNA, 20 bp, Homo sapiens
gaaaaccagctcagcactgc

SEQ ID NO: 5611468 - DNA, 20 bp, Homo sapiens
gaaaaccaggaaaagggagc

SEQ ID NO: 5611469 - DNA, 18 bp, Homo sapiens
gaaaaccataatgtcttt

SEQ ID NO: 5611470 - DNA, 16 bp, Homo sapiens
gaaaaccatctggcct

SEQ ID NO: 5611471 - DNA, 18 bp, Homo sapiens
gaaaaccatctggcctgg

SEQ ID NO: 5611472 - DNA, 19 bp, Homo sapiens
gaaaaccatctggcctggc

SEQ ID NO: 5611473 - DNA, 15 bp, Homo sapiens
gaaaacccccagcat

SEQ ID NO: 5611474 - DNA, 15 bp, Homo sapiens
gaaaaccccttccca

SEQ ID NO: 5611475 - DNA, 20 bp, Homo sapiens
gaaaacccgacaacatttct

SEQ ID NO: 5611476 - DNA, 22 bp, Homo sapiens
gaaaacccgacaacatttctgc

SEQ ID NO: 5611477 - DNA, 13 bp, Homo sapiens
gaaaacccgaggg

SEQ ID NO: 5611478 - DNA, 16 bp, Homo sapiens
gaaaaccctaagtgtg

SEQ ID NO: 5611479 - DNA, 22 bp, Homo sapiens
gaaaaccctcgatgttcatgga

SEQ ID NO: 5611480 - DNA, 17 bp, Homo sapiens
gaaaacccttgggccag

SEQ ID NO: 5611481 - DNA, 21 bp, Homo sapiens
gaaaacccttgggccagaagt

SEQ ID NO: 5611482 - DNA, 16 bp, Homo sapiens
gaaaacctcaagggct

SEQ ID NO: 5611483 - DNA, 13 bp, Homo sapiens
gaaaacctcatgg

SEQ ID NO: 5611484 - DNA, 19 bp, Homo sapiens
gaaaacctcatttaccata

SEQ ID NO: 5611485 - DNA, 17 bp, Homo sapiens
gaaaacctctcctgacc

SEQ ID NO: 5611486 - DNA, 20 bp, Homo sapiens
gaaaacctgaggccaaatat

SEQ ID NO: 5611487 - DNA, 22 bp, Homo sapiens
gaaaacctgtttttaacatgtg

SEQ ID NO: 5611488 - DNA, 21 bp, Homo sapiens
gaaaaccttaaaagtaataaa

SEQ ID NO: 5611489 - DNA, 23 bp, Homo sapiens
gaaaaccttaaaagtaataaaga

SEQ ID NO: 5611490 - DNA, 23 bp, Homo sapiens
gaaaacctttactagcatttaga

SEQ ID NO: 5611491 - DNA, 21 bp, Homo sapiens
gaaaacgaagtctttttcatt

SEQ ID NO: 5611492 - DNA, 18 bp, Homo sapiens
gaaaacgatttaatttat

SEQ ID NO: 5611493 - DNA, 16 bp, Homo sapiens
gaaaacgccagtgtgt

SEQ ID NO: 5611494 - DNA, 14 bp, Homo sapiens
gaaaacggagctga

SEQ ID NO: 5611495 - DNA, 19 bp, Homo sapiens
gaaaacgtcttgcttggga

SEQ ID NO: 5611496 - DNA, 20 bp, Homo sapiens
gaaaacgtggcacacactga

SEQ ID NO: 5611497 - DNA, 19 bp, Homo sapiens
gaaaacgtggctgcttcaa

SEQ ID NO: 5611498 - DNA, 23 bp, Homo sapiens
gaaaacgttgacccctttccccc

SEQ ID NO: 5611499 - DNA, 14 bp, Homo sapiens
gaaaacgttttatt

SEQ ID NO: 5611500 - DNA, 19 bp, Homo sapiens
gaaaacgttttattgtgtt

SEQ ID NO: 5611501 - DNA, 21 bp, Homo sapiens
gaaaactaatgtactgtacat

SEQ ID NO: 5611502 - DNA, 16 bp, Homo sapiens
gaaaactaattaatta

SEQ ID NO: 5611503 - DNA, 14 bp, Homo sapiens
gaaaactacaaacg

SEQ ID NO: 5611504 - DNA, 21 bp, Homo sapiens
gaaaactacatgtaaaatctt

SEQ ID NO: 5611505 - DNA, 14 bp, Homo sapiens
gaaaactacatttt

SEQ ID NO: 5611506 - DNA, 19 bp, Homo sapiens
gaaaactactttttggtca

SEQ ID NO: 5611507 - DNA, 22 bp, Homo sapiens
gaaaactagcattacattatta

SEQ ID NO: 5611508 - DNA, 22 bp, Homo sapiens
gaaaactatcctgcgggtttta

SEQ ID NO: 5611509 - DNA, 13 bp, Homo sapiens
gaaaactattcca

SEQ ID NO: 5611510 - DNA, 24 bp, Homo sapiens
gaaaactattttaaagctgacttt

SEQ ID NO: 5611511 - DNA, 9 bp, Homo sapiens
gaaaactca

SEQ ID NO: 5611512 - DNA, 19 bp, Homo sapiens
gaaaactcaaagaatgtgt

SEQ ID NO: 5611513 - DNA, 15 bp, Homo sapiens
gaaaactcaccattt

SEQ ID NO: 5611514 - DNA, 17 bp, Homo sapiens
gaaaactcaccatttca

SEQ ID NO: 5611515 - DNA, 17 bp, Homo sapiens
gaaaactcattactttt

SEQ ID NO: 5611516 - DNA, 14 bp, Homo sapiens
gaaaactccagggt

SEQ ID NO: 5611517 - DNA, 20 bp, Homo sapiens
gaaaactcctttagcaggtg

SEQ ID NO: 5611518 - DNA, 23 bp, Homo sapiens
gaaaactctcagtcagtgtcatg

SEQ ID NO: 5611519 - DNA, 19 bp, Homo sapiens
gaaaactcttggcctctgc

SEQ ID NO: 5611520 - DNA, 19 bp, Homo sapiens
gaaaactgacatcagattt

SEQ ID NO: 5611521 - DNA, 13 bp, Homo sapiens
gaaaactgagagg

SEQ ID NO: 5611522 - DNA, 19 bp, Homo sapiens
gaaaactgcaacttgtaaa

SEQ ID NO: 5611523 - DNA, 16 bp, Homo sapiens
gaaaactgcacaataa

SEQ ID NO: 5611524 - DNA, 21 bp, Homo sapiens
gaaaactgccacaagcacaat

SEQ ID NO: 5611525 - DNA, 19 bp, Homo sapiens
gaaaactgcctgttccttg

SEQ ID NO: 5611526 - DNA, 12 bp, Homo sapiens
gaaaactggaaa

SEQ ID NO: 5611527 - DNA, 13 bp, Homo sapiens
gaaaactgtaaat

SEQ ID NO: 5611528 - DNA, 12 bp, Homo sapiens
gaaaactgtgtt

SEQ ID NO: 5611529 - DNA, 18 bp, Homo sapiens
gaaaactgttgaggttcc

SEQ ID NO: 5611530 - DNA, 15 bp, Homo sapiens
gaaaacttaataaaa

SEQ ID NO: 5611531 - DNA, 13 bp, Homo sapiens
gaaaacttagcca

SEQ ID NO: 5611532 - DNA, 17 bp, Homo sapiens
gaaaacttagccagagt

SEQ ID NO: 5611533 - DNA, 13 bp, Homo sapiens
gaaaacttcaaag

SEQ ID NO: 5611534 - DNA, 18 bp, Homo sapiens
gaaaacttcactccaaag

SEQ ID NO: 5611535 - DNA, 13 bp, Homo sapiens
gaaaacttctcat

SEQ ID NO: 5611536 - DNA, 21 bp, Homo sapiens
gaaaacttctcttctgagcct

SEQ ID NO: 5611537 - DNA, 23 bp, Homo sapiens
gaaaacttctcttctgagcctct

SEQ ID NO: 5611538 - DNA, 20 bp, Homo sapiens
gaaaacttgaattcatagaa

SEQ ID NO: 5611539 - DNA, 15 bp, Homo sapiens
gaaaacttgctgaaa

SEQ ID NO: 5611540 - DNA, 18 bp, Homo sapiens
gaaaacttgtattatgtg

SEQ ID NO: 5611541 - DNA, 22 bp, Homo sapiens
gaaaacttgtattatgtgtgtt

SEQ ID NO: 5611542 - DNA, 13 bp, Homo sapiens
gaaaactttaaaa

SEQ ID NO: 5611543 - DNA, 16 bp, Homo sapiens
gaaaactttaaagcgt

SEQ ID NO: 5611544 - DNA, 11 bp, Homo sapiens
gaaaactttgt

SEQ ID NO: 5611545 - DNA, 16 bp, Homo sapiens
gaaaacttttctcaga

SEQ ID NO: 5611546 - DNA, 15 bp, Homo sapiens
gaaaacttttgtaaa

SEQ ID NO: 5611547 - DNA, 16 bp, Homo sapiens
gaaaacttttgtaaat

SEQ ID NO: 5611548 - DNA, 22 bp, Homo sapiens
gaaaacttttgtaaattattga

SEQ ID NO: 5611549 - DNA, 16 bp, Homo sapiens
gaaaactttttaatgg

SEQ ID NO: 5611550 - DNA, 21 bp, Homo sapiens
gaaaactttttaatggcaata

SEQ ID NO: 5611551 - DNA, 9 bp, Homo sapiens
gaaaagaaa

SEQ ID NO: 5611552 - DNA, 10 bp, Homo sapiens
gaaaagaaaa

SEQ ID NO: 5611553 - DNA, 23 bp, Homo sapiens
gaaaagaaaaaaaaaagaagaag

SEQ ID NO: 5611554 - DNA, 17 bp, Homo sapiens
gaaaagaaaaaaaaaga

SEQ ID NO: 5611555 - DNA, 20 bp, Homo sapiens
gaaaagaaaaaaaaagaaaa

SEQ ID NO: 5611556 - DNA, 12 bp, Homo sapiens
gaaaagaaaaag

SEQ ID NO: 5611557 - DNA, 14 bp, Homo sapiens
gaaaagaaaacatt

SEQ ID NO: 5611558 - DNA, 13 bp, Homo sapiens
gaaaagaaacaag

SEQ ID NO: 5611559 - DNA, 23 bp, Homo sapiens
gaaaagaaacctggggtgaatac

SEQ ID NO: 5611560 - DNA, 22 bp, Homo sapiens
gaaaagaaactctatggtctta

SEQ ID NO: 5611561 - DNA, 13 bp, Homo sapiens
gaaaagaaagaaa

SEQ ID NO: 5611562 - DNA, 14 bp, Homo sapiens
gaaaagaaagaaga

SEQ ID NO: 5611563 - DNA, 11 bp, Homo sapiens
gaaaagaaata

SEQ ID NO: 5611564 - DNA, 24 bp, Homo sapiens
gaaaagaaatctatagaaagtgtt

SEQ ID NO: 5611565 - DNA, 12 bp, Homo sapiens
gaaaagaaatgg

SEQ ID NO: 5611566 - DNA, 19 bp, Homo sapiens
gaaaagaaattgtccttga

SEQ ID NO: 5611567 - DNA, 19 bp, Homo sapiens
gaaaagaacgtattttaaa

SEQ ID NO: 5611568 - DNA, 22 bp, Homo sapiens
gaaaagaactgcttgcatttct

SEQ ID NO: 5611569 - DNA, 20 bp, Homo sapiens
gaaaagaagaaagtctatgc

SEQ ID NO: 5611570 - DNA, 14 bp, Homo sapiens
gaaaagaagctgtc

SEQ ID NO: 5611571 - DNA, 17 bp, Homo sapiens
gaaaagaagctgtcaga

SEQ ID NO: 5611572 - DNA, 15 bp, Homo sapiens
gaaaagaagtagtgt

SEQ ID NO: 5611573 - DNA, 11 bp, Homo sapiens
gaaaagaattt

SEQ ID NO: 5611574 - DNA, 14 bp, Homo sapiens
gaaaagaatttttt

SEQ ID NO: 5611575 - DNA, 19 bp, Homo sapiens
gaaaagacaaacagtagag

SEQ ID NO: 5611576 - DNA, 24 bp, Homo sapiens
gaaaagacagggtgggagggagga

SEQ ID NO: 5611577 - DNA, 18 bp, Homo sapiens
gaaaagacattgaaagct

SEQ ID NO: 5611578 - DNA, 21 bp, Homo sapiens
gaaaagacggatggcaggatc

SEQ ID NO: 5611579 - DNA, 17 bp, Homo sapiens
gaaaattccctggggtc

SEQ ID NO: 5611580 - DNA, 17 bp, Homo sapiens
gaaaattctacctggct

SEQ ID NO: 5611581 - DNA, 20 bp, Homo sapiens
gaaaattctgtgccttgttt

SEQ ID NO: 5611582 - DNA, 13 bp, Homo sapiens
gaaaattcttgag

SEQ ID NO: 5611583 - DNA, 16 bp, Homo sapiens
gaaaattgcactaaat

SEQ ID NO: 5611584 - DNA, 16 bp, Homo sapiens
gaaaattgcatgaaac

SEQ ID NO: 5611585 - DNA, 12 bp, Homo sapiens
gaaaattgccaa

SEQ ID NO: 5611586 - DNA, 16 bp, Homo sapiens
gaaaattgccaaaata

SEQ ID NO: 5611587 - DNA, 18 bp, Homo sapiens
gaaaattgccaaaatata

SEQ ID NO: 5611588 - DNA, 20 bp, Homo sapiens
gaaaattgccaaaatatatt

SEQ ID NO: 5611589 - DNA, 16 bp, Homo sapiens
gaaaattgcctttaaa

SEQ ID NO: 5611590 - DNA, 19 bp, Homo sapiens
gaaaattgcctttctgtgt

SEQ ID NO: 5611591 - DNA, 15 bp, Homo sapiens
gaaaattgctgtgcc

SEQ ID NO: 5611592 - DNA, 16 bp, Homo sapiens
gaaaattgctgtgcct

SEQ ID NO: 5611593 - DNA, 22 bp, Homo sapiens
gaaaattgctgtgcctcccaaa

SEQ ID NO: 5611594 - DNA, 23 bp, Homo sapiens
gaaaattgtgctggaaatggaca

SEQ ID NO: 5611595 - DNA, 18 bp, Homo sapiens
gaaaattgttgtgcttag

SEQ ID NO: 5611596 - DNA, 22 bp, Homo sapiens
gaaaattgtttttaatttgaat

SEQ ID NO: 5611597 - DNA, 15 bp, Homo sapiens
gaaaatttaaaacga

SEQ ID NO: 5611598 - DNA, 18 bp, Homo sapiens
gaaaatttagccctttaa

SEQ ID NO: 5611599 - DNA, 15 bp, Homo sapiens
gaaaatttgccaatc

SEQ ID NO: 5611600 - DNA, 21 bp, Homo sapiens
gaaaatttgttattttgcaac

SEQ ID NO: 5611601 - DNA, 19 bp, Homo sapiens
gaaaattttaccagcagaa

SEQ ID NO: 5611602 - DNA, 19 bp, Homo sapiens
gaaaattttattgaatata

SEQ ID NO: 5611603 - DNA, 14 bp, Homo sapiens
gaaaattttctcct

SEQ ID NO: 5611604 - DNA, 17 bp, Homo sapiens
gaaaattttctccttgg

SEQ ID NO: 5611605 - DNA, 18 bp, Homo sapiens
gaaaattttgtaaaacaa

SEQ ID NO: 5611606 - DNA, 23 bp, Homo sapiens
gaaaattttgtaaaacaatgcca

SEQ ID NO: 5611607 - DNA, 11 bp, Homo sapiens
gaaaatttttt

SEQ ID NO: 5611608 - DNA, 22 bp, Homo sapiens
gaaacaaaaaatattcatctgt

SEQ ID NO: 5611609 - DNA, 14 bp, Homo sapiens
gaaacaaaatataa

SEQ ID NO: 5611610 - DNA, 21 bp, Homo sapiens
gaaacaaaatgaaaaaaaaag

SEQ ID NO: 5611611 - DNA, 14 bp, Homo sapiens
gaaacaaacaaaac

SEQ ID NO: 5611612 - DNA, 21 bp, Homo sapiens
gaaacaaaccttgccttgaaa

SEQ ID NO: 5611613 - DNA, 15 bp, Homo sapiens
gaaacaaagaaagag

SEQ ID NO: 5611614 - DNA, 13 bp, Homo sapiens
gaaacaaagaagt

SEQ ID NO: 5611615 - DNA, 20 bp, Homo sapiens
gaaacaaagtaatctactgt

SEQ ID NO: 5611616 - DNA, 20 bp, Homo sapiens
gaaacaaagtggaaggaaag

SEQ ID NO: 5611617 - DNA, 19 bp, Homo sapiens
gaaacaaataatcacattg

SEQ ID NO: 5611618 - DNA, 14 bp, Homo sapiens
gaaacaacactgta

SEQ ID NO: 5611619 - DNA, 15 bp, Homo sapiens
gaaacaacagcttta

SEQ ID NO: 5611620 - DNA, 11 bp, Homo sapiens
gaaacaacatt

SEQ ID NO: 5611621 - DNA, 18 bp, Homo sapiens
gaaacaacatttatatgt

SEQ ID NO: 5611622 - DNA, 13 bp, Homo sapiens
gaaacaagctgtg

SEQ ID NO: 5611623 - DNA, 14 bp, Homo sapiens
gaaacaagctgtgc

SEQ ID NO: 5611624 - DNA, 16 bp, Homo sapiens
gaaacaaggaaggaca

SEQ ID NO: 5611625 - DNA, 16 bp, Homo sapiens
gaaacaagtctagtct

SEQ ID NO: 5611626 - DNA, 21 bp, Homo sapiens
gaaacaagtctagtcttctgg

SEQ ID NO: 5611627 - DNA, 22 bp, Homo sapiens
gaaacaatactcataatgtgaa

SEQ ID NO: 5611628 - DNA, 14 bp, Homo sapiens
gaaacaatcctgtt

SEQ ID NO: 5611629 - DNA, 16 bp, Homo sapiens
gaaacaatcctgttac

SEQ ID NO: 5611630 - DNA, 14 bp, Homo sapiens
gaaacaatgaaaac

SEQ ID NO: 5611631 - DNA, 23 bp, Homo sapiens
gaaacaatgcctacagctgtctt

SEQ ID NO: 5611632 - DNA, 14 bp, Homo sapiens
gaaacaatttctgt

SEQ ID NO: 5611633 - DNA, 22 bp, Homo sapiens
gaaacacaagagacttaaagga

SEQ ID NO: 5611634 - DNA, 15 bp, Homo sapiens
gaaacacaataccta

SEQ ID NO: 5611635 - DNA, 19 bp, Homo sapiens
gaaacacacacacattctt

SEQ ID NO: 5611636 - DNA, 23 bp, Homo sapiens
gaaacacaccaggctgtgggcct

SEQ ID NO: 5611637 - DNA, 21 bp, Homo sapiens
gaaacacactgaggcagggaa

SEQ ID NO: 5611638 - DNA, 23 bp, Homo sapiens
gaaacacactgaggcagggaagt

SEQ ID NO: 5611639 - DNA, 13 bp, Homo sapiens
gaaacacagctgt

SEQ ID NO: 5611640 - DNA, 14 bp, Homo sapiens
gaaacacagctgtt

SEQ ID NO: 5611641 - DNA, 14 bp, Homo sapiens
gaaacacagggttt

SEQ ID NO: 5611642 - DNA, 21 bp, Homo sapiens
gaaacacataacaaagggcag

SEQ ID NO: 5611643 - DNA, 13 bp, Homo sapiens
gaaacaccactta

SEQ ID NO: 5611644 - DNA, 18 bp, Homo sapiens
gaaacaccacttaatctt

SEQ ID NO: 5611645 - DNA, 15 bp, Homo sapiens
gaaacaccagtgtta

SEQ ID NO: 5611646 - DNA, 16 bp, Homo sapiens
gaaacaccagtgttag

SEQ ID NO: 5611647 - DNA, 17 bp, Homo sapiens
gaaacacccacaggcat

SEQ ID NO: 5611648 - DNA, 17 bp, Homo sapiens
gaaacacccctctgtct

SEQ ID NO: 5611649 - DNA, 14 bp, Homo sapiens
gaaacaccttctct

SEQ ID NO: 5611650 - DNA, 21 bp, Homo sapiens
gaaacaccttctctggagcca

SEQ ID NO: 5611651 - DNA, 18 bp, Homo sapiens
gaaacacgaaacttgtta

SEQ ID NO: 5611652 - DNA, 19 bp, Homo sapiens
gaaacacgtttagaaatga

SEQ ID NO: 5611653 - DNA, 15 bp, Homo sapiens
gaaacactaaatgtt

SEQ ID NO: 5611654 - DNA, 13 bp, Homo sapiens
gaaacactaaatt

SEQ ID NO: 5611655 - DNA, 17 bp, Homo sapiens
gaaacactccttgcatc

SEQ ID NO: 5611656 - DNA, 18 bp, Homo sapiens
gaaacactcgtgtgcatg

SEQ ID NO: 5611657 - DNA, 23 bp, Homo sapiens
gaaacactgaaatgaaatcttcc

SEQ ID NO: 5611658 - DNA, 17 bp, Homo sapiens
gaaacactgactcctgt

SEQ ID NO: 5611659 - DNA, 15 bp, Homo sapiens
gaaacactgcctgcc

SEQ ID NO: 5611660 - DNA, 13 bp, Homo sapiens
gaaacactgcctt

SEQ ID NO: 5611661 - DNA, 16 bp, Homo sapiens
gaaacactgccttttt

SEQ ID NO: 5611662 - DNA, 20 bp, Homo sapiens
gaaacactggacctgggggt

SEQ ID NO: 5611663 - DNA, 15 bp, Homo sapiens
gaaacactggggctg

SEQ ID NO: 5611664 - DNA, 18 bp, Homo sapiens
gaaacactggggctggca

SEQ ID NO: 5611665 - DNA, 13 bp, Homo sapiens
gaaacacttgctt

SEQ ID NO: 5611666 - DNA, 11 bp, Homo sapiens
gaaacagaaaa

SEQ ID NO: 5611667 - DNA, 17 bp, Homo sapiens
gaaacagaaaaataagt

SEQ ID NO: 5611668 - DNA, 20 bp, Homo sapiens
gaaacagaaaagagaagaaa

SEQ ID NO: 5611669 - DNA, 13 bp, Homo sapiens
gaaacagaagaaa

SEQ ID NO: 5611670 - DNA, 15 bp, Homo sapiens
gaaacagaagtagaa

SEQ ID NO: 5611671 - DNA, 18 bp, Homo sapiens
gaaacagacagggagaag

SEQ ID NO: 5611672 - DNA, 14 bp, Homo sapiens
gaaacagagaaaga

SEQ ID NO: 5611673 - DNA, 15 bp, Homo sapiens
gaaacagagaaagaa

SEQ ID NO: 5611674 - DNA, 16 bp, Homo sapiens
gaaacagagacaggcc

SEQ ID NO: 5611675 - DNA, 19 bp, Homo sapiens
gaaacagagacaggcccaa

SEQ ID NO: 5611676 - DNA, 18 bp, Homo sapiens
gaaacagagagagacaga

SEQ ID NO: 5611677 - DNA, 19 bp, Homo sapiens
gaaacagaggagagtccca

SEQ ID NO: 5611678 - DNA, 17 bp, Homo sapiens
gaaacagaggtaaaaaa

SEQ ID NO: 5611679 - DNA, 22 bp, Homo sapiens
gaaacagaggtaaaaaaaagaa

SEQ ID NO: 5611680 - DNA, 15 bp, Homo sapiens
gaaacagatgataaa

SEQ ID NO: 5611681 - DNA, 22 bp, Homo sapiens
gaaacagatgataaatatttat

SEQ ID NO: 5611682 - DNA, 16 bp, Homo sapiens
gaaacagatttcatac

SEQ ID NO: 5611683 - DNA, 13 bp, Homo sapiens
gaaacagcatctc

SEQ ID NO: 5611684 - DNA, 17 bp, Homo sapiens
gaaacagcatctccaag

SEQ ID NO: 5611685 - DNA, 17 bp, Homo sapiens
gaaacagcatgaataaa

SEQ ID NO: 5611686 - DNA, 16 bp, Homo sapiens
gaaacagcctctctct

SEQ ID NO: 5611687 - DNA, 12 bp, Homo sapiens
gaaacagcctgg

SEQ ID NO: 5611688 - DNA, 16 bp, Homo sapiens
gaaacagctcagccag

SEQ ID NO: 5611689 - DNA, 12 bp, Homo sapiens
gaaacagctgcc

SEQ ID NO: 5611690 - DNA, 13 bp, Homo sapiens
gaaacagctgcct

SEQ ID NO: 5611691 - DNA, 14 bp, Homo sapiens
gaaacagctgcctt

SEQ ID NO: 5611692 - DNA, 19 bp, Homo sapiens
gaaacagctgccttagctt

SEQ ID NO: 5611693 - DNA, 20 bp, Homo sapiens
gaaacagctgccttagcttc

SEQ ID NO: 5611694 - DNA, 13 bp, Homo sapiens
gaaacagctgctt

SEQ ID NO: 5611695 - DNA, 20 bp, Homo sapiens
gaaacagctgcttctccccc

SEQ ID NO: 5611696 - DNA, 12 bp, Homo sapiens
gaaacagctttc

SEQ ID NO: 5611697 - DNA, 15 bp, Homo sapiens
gaaacagctttcaag

SEQ ID NO: 5611698 - DNA, 20 bp, Homo sapiens
gaaacagctttcaagtgcct

SEQ ID NO: 5611699 - DNA, 17 bp, Homo sapiens
gaaacaggagagaaagg

SEQ ID NO: 5611700 - DNA, 17 bp, Homo sapiens
gaaacagggacaaagaa

SEQ ID NO: 5611701 - DNA, 12 bp, Homo sapiens
gaaacagggagc

SEQ ID NO: 5611702 - DNA, 22 bp, Homo sapiens
gaaacaggggatcaaagttcct

SEQ ID NO: 5611703 - DNA, 20 bp, Homo sapiens
gaaacagggggaaaatgttt

SEQ ID NO: 5611704 - DNA, 21 bp, Homo sapiens
gaaacagggggaaaatgtttg

SEQ ID NO: 5611705 - DNA, 21 bp, Homo sapiens
gaaacaggttgggatgggata

SEQ ID NO: 5611706 - DNA, 17 bp, Homo sapiens
gaaacagtacttaggta

SEQ ID NO: 5611707 - DNA, 19 bp, Homo sapiens
gaaacagtataatttgaca

SEQ ID NO: 5611708 - DNA, 17 bp, Homo sapiens
gaaacagttccatttat

SEQ ID NO: 5611709 - DNA, 23 bp, Homo sapiens
gaaacagttgcatgtagtaacac

SEQ ID NO: 5611710 - DNA, 15 bp, Homo sapiens
gaaacagttggcact

SEQ ID NO: 5611711 - DNA, 21 bp, Homo sapiens
gaaacagttggtaacttttgt

SEQ ID NO: 5611712 - DNA, 23 bp, Homo sapiens
gaaacagttggtaacttttgtga

SEQ ID NO: 5611713 - DNA, 14 bp, Homo sapiens
gaaacagtttaaca

SEQ ID NO: 5611714 - DNA, 16 bp, Homo sapiens
gaaacagtttaacaga

SEQ ID NO: 5611715 - DNA, 22 bp, Homo sapiens
gaaacataaataaaatgaccag

SEQ ID NO: 5611716 - DNA, 12 bp, Homo sapiens
gaaacatacaga

SEQ ID NO: 5611717 - DNA, 15 bp, Homo sapiens
gaaacatagaaacat

SEQ ID NO: 5611718 - DNA, 14 bp, Homo sapiens
gaaacatatcatgg

SEQ ID NO: 5611719 - DNA, 16 bp, Homo sapiens
gaaacatcattacaga

SEQ ID NO: 5611720 - DNA, 19 bp, Homo sapiens
gaaacatccatattgcaca

SEQ ID NO: 5611721 - DNA, 20 bp, Homo sapiens
gaaacatcctatgaaatact

SEQ ID NO: 5611722 - DNA, 12 bp, Homo sapiens
gaaacatctgat

SEQ ID NO: 5611723 - DNA, 20 bp, Homo sapiens
gaaacatctgatttctgaac

SEQ ID NO: 5611724 - DNA, 17 bp, Homo sapiens
gaaacatgaagcataat

SEQ ID NO: 5611725 - DNA, 13 bp, Homo sapiens
gaaacatgacact

SEQ ID NO: 5611726 - DNA, 23 bp, Homo sapiens
gaaacatgggctgtgattactgc

SEQ ID NO: 5611727 - DNA, 15 bp, Homo sapiens
gaaacatggttttga

SEQ ID NO: 5611728 - DNA, 17 bp, Homo sapiens
gaaacatgtgcccctgc

SEQ ID NO: 5611729 - DNA, 22 bp, Homo sapiens
gaaacatgtggagtgtattaag

SEQ ID NO: 5611730 - DNA, 18 bp, Homo sapiens
gaaacattattttaattg

SEQ ID NO: 5611731 - DNA, 19 bp, Homo sapiens
gaaacattccgaagaggga

SEQ ID NO: 5611732 - DNA, 13 bp, Homo sapiens
gaaacattgcttt

SEQ ID NO: 5611733 - DNA, 22 bp, Homo sapiens
gaaacattgctttagacaaatt

SEQ ID NO: 5611734 - DNA, 17 bp, Homo sapiens
gaaacattgcttttaaa

SEQ ID NO: 5611735 - DNA, 18 bp, Homo sapiens
gaaacattgcttttaaaa

SEQ ID NO: 5611736 - DNA, 13 bp, Homo sapiens
gaaacattggaag

SEQ ID NO: 5611737 - DNA, 18 bp, Homo sapiens
gaaacattggaagcaggt

SEQ ID NO: 5611738 - DNA, 12 bp, Homo sapiens
gaaacattgtaa

SEQ ID NO: 5611739 - DNA, 19 bp, Homo sapiens
gaaacatttacaataaata

SEQ ID NO: 5611740 - DNA, 15 bp, Homo sapiens
gaaacatttataaac

SEQ ID NO: 5611741 - DNA, 13 bp, Homo sapiens
gaaacatttatat

SEQ ID NO: 5611742 - DNA, 19 bp, Homo sapiens
gaaacatttatatttttat

SEQ ID NO: 5611743 - DNA, 15 bp, Homo sapiens
gaaacatttatggaa

SEQ ID NO: 5611744 - DNA, 20 bp, Homo sapiens
gaaacatttcagaaggtatc

SEQ ID NO: 5611745 - DNA, 20 bp, Homo sapiens
gaaacattttatcattaaaa

SEQ ID NO: 5611746 - DNA, 22 bp, Homo sapiens
gaaacatttttgagatattaaa

SEQ ID NO: 5611747 - DNA, 16 bp, Homo sapiens
gaaacattttttaaaa

SEQ ID NO: 5611748 - DNA, 15 bp, Homo sapiens
gaaaccaaaacataa

SEQ ID NO: 5611749 - DNA, 22 bp, Homo sapiens
gaaaccaaagatatatacacag

SEQ ID NO: 5611750 - DNA, 16 bp, Homo sapiens
gaaaccaaagtctgcc

SEQ ID NO: 5611751 - DNA, 14 bp, Homo sapiens
gaaaccaagagaca

SEQ ID NO: 5611752 - DNA, 20 bp, Homo sapiens
gaaaccaagccaatgttata

SEQ ID NO: 5611753 - DNA, 23 bp, Homo sapiens
gaaaccaatcaagataaaggaca

SEQ ID NO: 5611754 - DNA, 20 bp, Homo sapiens
gaaaccacagctgctggaga

SEQ ID NO: 5611755 - DNA, 14 bp, Homo sapiens
gaaaccacagtcag

SEQ ID NO: 5611756 - DNA, 18 bp, Homo sapiens
gaaaccacagtgagcctg

SEQ ID NO: 5611757 - DNA, 17 bp, Homo sapiens
gaaaccacagtttcatt

SEQ ID NO: 5611758 - DNA, 16 bp, Homo sapiens
gaaagggctggctgca

SEQ ID NO: 5611759 - DNA, 15 bp, Homo sapiens
gaaaggggaaacgtc

SEQ ID NO: 5611760 - DNA, 22 bp, Homo sapiens
gaaaggggaaacgtctcccaga

SEQ ID NO: 5611761 - DNA, 15 bp, Homo sapiens
gaaaggggagagcct

SEQ ID NO: 5611762 - DNA, 21 bp, Homo sapiens
gaaaggggagagcctgctggc

SEQ ID NO: 5611763 - DNA, 13 bp, Homo sapiens
gaaaggggagccc

SEQ ID NO: 5611764 - DNA, 21 bp, Homo sapiens
gaaaggggagtaggtggggga

SEQ ID NO: 5611765 - DNA, 20 bp, Homo sapiens
gaaaggggcagtttaaagca

SEQ ID NO: 5611766 - DNA, 21 bp, Homo sapiens
gaaaggggcccattcagcctc

SEQ ID NO: 5611767 - DNA, 23 bp, Homo sapiens
gaaaggggcccattcagcctcgt

SEQ ID NO: 5611768 - DNA, 16 bp, Homo sapiens
gaaagggggtcccagt

SEQ ID NO: 5611769 - DNA, 18 bp, Homo sapiens
gaaagggggtcccagtgg

SEQ ID NO: 5611770 - DNA, 23 bp, Homo sapiens
gaaagggggtcccagtgggaggg

SEQ ID NO: 5611771 - DNA, 14 bp, Homo sapiens
gaaaggggtgcttt

SEQ ID NO: 5611772 - DNA, 16 bp, Homo sapiens
gaaaggggttggggtg

SEQ ID NO: 5611773 - DNA, 19 bp, Homo sapiens
gaaagggtgctgcttccct

SEQ ID NO: 5611774 - DNA, 19 bp, Homo sapiens
gaaagggttaatcatattt

SEQ ID NO: 5611775 - DNA, 17 bp, Homo sapiens
gaaagggttctgtaaaa

SEQ ID NO: 5611776 - DNA, 16 bp, Homo sapiens
gaaaggtaatctgaaa

SEQ ID NO: 5611777 - DNA, 14 bp, Homo sapiens
gaaaggtcacctca

SEQ ID NO: 5611778 - DNA, 18 bp, Homo sapiens
gaaaggtcacctcactca

SEQ ID NO: 5611779 - DNA, 20 bp, Homo sapiens
gaaaggtcacctcactcagc

SEQ ID NO: 5611780 - DNA, 18 bp, Homo sapiens
gaaaggtgccatggaaga

SEQ ID NO: 5611781 - DNA, 19 bp, Homo sapiens
gaaaggtgccatgtcttta

SEQ ID NO: 5611782 - DNA, 12 bp, Homo sapiens
gaaaggtgctca

SEQ ID NO: 5611783 - DNA, 13 bp, Homo sapiens
gaaaggtgctcaa

SEQ ID NO: 5611784 - DNA, 16 bp, Homo sapiens
gaaaggtggtgtttct

SEQ ID NO: 5611785 - DNA, 17 bp, Homo sapiens
gaaaggtggtgtttctg

SEQ ID NO: 5611786 - DNA, 18 bp, Homo sapiens
gaaaggttaccctgtaac

SEQ ID NO: 5611787 - DNA, 14 bp, Homo sapiens
gaaaggttgcgttt

SEQ ID NO: 5611788 - DNA, 13 bp, Homo sapiens
gaaaggtttcaag

SEQ ID NO: 5611789 - DNA, 18 bp, Homo sapiens
gaaaggtttggaaaacta

SEQ ID NO: 5611790 - DNA, 21 bp, Homo sapiens
gaaaggtttggaaaactaact

SEQ ID NO: 5611791 - DNA, 17 bp, Homo sapiens
gaaagtaaaaaaataat

SEQ ID NO: 5611792 - DNA, 16 bp, Homo sapiens
gaaagtaatttcaaga

SEQ ID NO: 5611793 - DNA, 15 bp, Homo sapiens
gaaagtaatttcttc

SEQ ID NO: 5611794 - DNA, 18 bp, Homo sapiens
gaaagtacactctgctgt

SEQ ID NO: 5611795 - DNA, 22 bp, Homo sapiens
gaaagtacactctgctgtttga

SEQ ID NO: 5611796 - DNA, 13 bp, Homo sapiens
gaaagtacatttt

SEQ ID NO: 5611797 - DNA, 14 bp, Homo sapiens
gaaagtacccagca

SEQ ID NO: 5611798 - DNA, 23 bp, Homo sapiens
gaaagtacccagcaaatgggcat

SEQ ID NO: 5611799 - DNA, 22 bp, Homo sapiens
gaaagtaccctcttttaccaac

SEQ ID NO: 5611800 - DNA, 14 bp, Homo sapiens
gaaagtagctgcta

SEQ ID NO: 5611801 - DNA, 23 bp, Homo sapiens
gaaagtatcaccaaaaaatctat

SEQ ID NO: 5611802 - DNA, 20 bp, Homo sapiens
gaaagtatctctactttcct

SEQ ID NO: 5611803 - DNA, 18 bp, Homo sapiens
gaaagtatgtgatatctg

SEQ ID NO: 5611804 - DNA, 15 bp, Homo sapiens
gaaagtattcagaaa

SEQ ID NO: 5611805 - DNA, 22 bp, Homo sapiens
gaaagtattgtgtttatgcatt

SEQ ID NO: 5611806 - DNA, 14 bp, Homo sapiens
gaaagtatttttga

SEQ ID NO: 5611807 - DNA, 19 bp, Homo sapiens
gaaagtatttttgaaagaa

SEQ ID NO: 5611808 - DNA, 21 bp, Homo sapiens
gaaagtcaaatttactttaaa

SEQ ID NO: 5611809 - DNA, 16 bp, Homo sapiens
gaaagtcaagaagaat

SEQ ID NO: 5611810 - DNA, 17 bp, Homo sapiens
gaaagtcaccaggactt

SEQ ID NO: 5611811 - DNA, 22 bp, Homo sapiens
gaaagtcacctacaggactggg

SEQ ID NO: 5611812 - DNA, 10 bp, Homo sapiens
gaaagtcaga

SEQ ID NO: 5611813 - DNA, 19 bp, Homo sapiens
gaaagtcagacctgtttct

SEQ ID NO: 5611814 - DNA, 20 bp, Homo sapiens
gaaagtcagatgcccagagg

SEQ ID NO: 5611815 - DNA, 22 bp, Homo sapiens
gaaagtcaggctagctgtgctg

SEQ ID NO: 5611816 - DNA, 14 bp, Homo sapiens
gaaagtcattggct

SEQ ID NO: 5611817 - DNA, 17 bp, Homo sapiens
gaaagtcattggcttta

SEQ ID NO: 5611818 - DNA, 23 bp, Homo sapiens
gaaagtccaagccgtaggaccca

SEQ ID NO: 5611819 - DNA, 20 bp, Homo sapiens
gaaagtctgtcaggtttggt

SEQ ID NO: 5611820 - DNA, 15 bp, Homo sapiens
gaaagtctgtccttg

SEQ ID NO: 5611821 - DNA, 16 bp, Homo sapiens
gaaagtctgtccttga

SEQ ID NO: 5611822 - DNA, 19 bp, Homo sapiens
gaaagtgaagcaaatcaga

SEQ ID NO: 5611823 - DNA, 15 bp, Homo sapiens
gaaagtgaataaact

SEQ ID NO: 5611824 - DNA, 19 bp, Homo sapiens
gaaagtgaatttgaatgaa

SEQ ID NO: 5611825 - DNA, 22 bp, Homo sapiens
gaaagtgactttaaaagaaaat

SEQ ID NO: 5611826 - DNA, 15 bp, Homo sapiens
gaaagtgagcagtgt

SEQ ID NO: 5611827 - DNA, 18 bp, Homo sapiens
gaaagtgcactgcagtga

SEQ ID NO: 5611828 - DNA, 16 bp, Homo sapiens
gaaagtgcagcatgga

SEQ ID NO: 5611829 - DNA, 13 bp, Homo sapiens
gaaagtgcatttt

SEQ ID NO: 5611830 - DNA, 14 bp, Homo sapiens
gaaagtgcattttt

SEQ ID NO: 5611831 - DNA, 12 bp, Homo sapiens
gaaagtgccagc

SEQ ID NO: 5611832 - DNA, 14 bp, Homo sapiens
gaaagtgccagcat

SEQ ID NO: 5611833 - DNA, 15 bp, Homo sapiens
gaaagtgcctttgca

SEQ ID NO: 5611834 - DNA, 18 bp, Homo sapiens
gaaagtggcagagccagg

SEQ ID NO: 5611835 - DNA, 18 bp, Homo sapiens
gaaagtgggcaaaagctt

SEQ ID NO: 5611836 - DNA, 18 bp, Homo sapiens
gaaagtggtgctcagttg

SEQ ID NO: 5611837 - DNA, 16 bp, Homo sapiens
gaaagtgtaaagcatt

SEQ ID NO: 5611838 - DNA, 13 bp, Homo sapiens
gaaagtgtcgtct

SEQ ID NO: 5611839 - DNA, 12 bp, Homo sapiens
gaaagtgtgaag

SEQ ID NO: 5611840 - DNA, 15 bp, Homo sapiens
gaaagtgtgagctct

SEQ ID NO: 5611841 - DNA, 21 bp, Homo sapiens
gaaagtgtgagctcttccctt

SEQ ID NO: 5611842 - DNA, 18 bp, Homo sapiens
gaaagtgttaattttacc

SEQ ID NO: 5611843 - DNA, 16 bp, Homo sapiens
gaaagtgttctgttac

SEQ ID NO: 5611844 - DNA, 20 bp, Homo sapiens
gaaagtgttttactcttttt

SEQ ID NO: 5611845 - DNA, 17 bp, Homo sapiens
gaaagttaacattaatg

SEQ ID NO: 5611846 - DNA, 16 bp, Homo sapiens
gaaagttaatgtcaag

SEQ ID NO: 5611847 - DNA, 17 bp, Homo sapiens
gaaagttacaaattgct

SEQ ID NO: 5611848 - DNA, 19 bp, Homo sapiens
gaaagttagggggttctta

SEQ ID NO: 5611849 - DNA, 20 bp, Homo sapiens
gaaagttagggggttcttat

SEQ ID NO: 5611850 - DNA, 14 bp, Homo sapiens
gaaagttattgtgt

SEQ ID NO: 5611851 - DNA, 14 bp, Homo sapiens
gaaagttcagccag

SEQ ID NO: 5611852 - DNA, 15 bp, Homo sapiens
gaaagttcagccaga

SEQ ID NO: 5611853 - DNA, 18 bp, Homo sapiens
gaaagttccaaatgttta

SEQ ID NO: 5611854 - DNA, 19 bp, Homo sapiens
gaaagttccaaatgtttat

SEQ ID NO: 5611855 - DNA, 19 bp, Homo sapiens
gaaagttccagcagtttca

SEQ ID NO: 5611856 - DNA, 22 bp, Homo sapiens
gaaagttctattatctgggttt

SEQ ID NO: 5611857 - DNA, 17 bp, Homo sapiens
gaaagttgccattattc

SEQ ID NO: 5611858 - DNA, 22 bp, Homo sapiens
gaaagttgtaaaatagaaaaag

SEQ ID NO: 5611859 - DNA, 17 bp, Homo sapiens
gaaagttgtacatgata

SEQ ID NO: 5611860 - DNA, 15 bp, Homo sapiens
gaaagttgtctggct

SEQ ID NO: 5611861 - DNA, 17 bp, Homo sapiens
gaaagttgtgatctgtt

SEQ ID NO: 5611862 - DNA, 21 bp, Homo sapiens
gaaagttgtgtaggcaccacc

SEQ ID NO: 5611863 - DNA, 14 bp, Homo sapiens
gaaagtttacagga

SEQ ID NO: 5611864 - DNA, 16 bp, Homo sapiens
gaaagtttacaggaaa

SEQ ID NO: 5611865 - DNA, 20 bp, Homo sapiens
gaaagtttacccatgaagat

SEQ ID NO: 5611866 - DNA, 20 bp, Homo sapiens
gaaagtttagatctgtccct

SEQ ID NO: 5611867 - DNA, 23 bp, Homo sapiens
gaaagtttccccaccagtgaatg

SEQ ID NO: 5611868 - DNA, 20 bp, Homo sapiens
gaaagtttcgttatattaaa

SEQ ID NO: 5611869 - DNA, 20 bp, Homo sapiens
gaaagtttcttcaactctga

SEQ ID NO: 5611870 - DNA, 23 bp, Homo sapiens
gaaagtttcttggtctcagcttc

SEQ ID NO: 5611871 - DNA, 15 bp, Homo sapiens
gaaagtttgttctgc

SEQ ID NO: 5611872 - DNA, 22 bp, Homo sapiens
gaaagttttcagaacctcttcc

SEQ ID NO: 5611873 - DNA, 14 bp, Homo sapiens
gaaagttttccagt

SEQ ID NO: 5611874 - DNA, 18 bp, Homo sapiens
gaaagttttccagtattg

SEQ ID NO: 5611875 - DNA, 23 bp, Homo sapiens
gaaagttttgagtagatattact

SEQ ID NO: 5611876 - DNA, 22 bp, Homo sapiens
gaaagttttgatacttgtaact

SEQ ID NO: 5611877 - DNA, 15 bp, Homo sapiens
gaaagttttgtaaaa

SEQ ID NO: 5611878 - DNA, 20 bp, Homo sapiens
gaaagttttgtaaaagaaat

SEQ ID NO: 5611879 - DNA, 21 bp, Homo sapiens
gaaagttttgtaaaagaaatc

SEQ ID NO: 5611880 - DNA, 18 bp, Homo sapiens
gaaagtttttttttatta

SEQ ID NO: 5611881 - DNA, 19 bp, Homo sapiens
gaaagtttttttttattat

SEQ ID NO: 5611882 - DNA, 21 bp, Homo sapiens
gaaataaaaaaaaaaggatga

SEQ ID NO: 5611883 - DNA, 16 bp, Homo sapiens
gaaataaaaaagtctc

SEQ ID NO: 5611884 - DNA, 17 bp, Homo sapiens
gaaataaaaaagtctct

SEQ ID NO: 5611885 - DNA, 19 bp, Homo sapiens
gaaataaaaaagtctctat

SEQ ID NO: 5611886 - DNA, 20 bp, Homo sapiens
gaaataaaaaagtctctatt

SEQ ID NO: 5611887 - DNA, 22 bp, Homo sapiens
gaaataaaaaagtctctattta

SEQ ID NO: 5611888 - DNA, 14 bp, Homo sapiens
gaaataaaaagagt

SEQ ID NO: 5611889 - DNA, 15 bp, Homo sapiens
gaaataaaaatggca

SEQ ID NO: 5611890 - DNA, 18 bp, Homo sapiens
gaaataaaacaactctga

SEQ ID NO: 5611891 - DNA, 15 bp, Homo sapiens
gaaataaaacctttc

SEQ ID NO: 5611892 - DNA, 17 bp, Homo sapiens
gaaataaaacctttcaa

SEQ ID NO: 5611893 - DNA, 15 bp, Homo sapiens
gaaataaaagcctct

SEQ ID NO: 5611894 - DNA, 13 bp, Homo sapiens
gaaataaaagctt

SEQ ID NO: 5611895 - DNA, 16 bp, Homo sapiens
gaaataaaaggaagcc

SEQ ID NO: 5611896 - DNA, 17 bp, Homo sapiens
gaaataaaaggaagcca

SEQ ID NO: 5611897 - DNA, 18 bp, Homo sapiens
gaaataaaaggaagccaa

SEQ ID NO: 5611898 - DNA, 19 bp, Homo sapiens
gaaataaaaggaagccaaa

SEQ ID NO: 5611899 - DNA, 21 bp, Homo sapiens
gaaataaaagtgaatgaaaga

SEQ ID NO: 5611900 - DNA, 23 bp, Homo sapiens
gaaataaaagtgaatgaaagatt

SEQ ID NO: 5611901 - DNA, 12 bp, Homo sapiens
gaaataaaattt

SEQ ID NO: 5611902 - DNA, 14 bp, Homo sapiens
gaaataaaatttga

SEQ ID NO: 5611903 - DNA, 16 bp, Homo sapiens
gaaataaaatttgaaa

SEQ ID NO: 5611904 - DNA, 14 bp, Homo sapiens
gaaataaacactgg

SEQ ID NO: 5611905 - DNA, 21 bp, Homo sapiens
gaaataaacactggtgccaac

SEQ ID NO: 5611906 - DNA, 17 bp, Homo sapiens
gaaataaacctgcactg

SEQ ID NO: 5611907 - DNA, 19 bp, Homo sapiens
gaaataaacctggagatga

SEQ ID NO: 5611908 - DNA, 20 bp, Homo sapiens
gaaataaacctggagatgat

SEQ ID NO: 5611909 - DNA, 23 bp, Homo sapiens
gaaataaacctggagatgatgat

SEQ ID NO: 5611910 - DNA, 16 bp, Homo sapiens
gaaataaacgtcttaa

SEQ ID NO: 5611911 - DNA, 23 bp, Homo sapiens
gaaataaactagggttttggcct

SEQ ID NO: 5611912 - DNA, 17 bp, Homo sapiens
gaaataaacttcactga

SEQ ID NO: 5611913 - DNA, 18 bp, Homo sapiens
gaaataaagaaaattctc

SEQ ID NO: 5611914 - DNA, 14 bp, Homo sapiens
gaaataaagcgtcc

SEQ ID NO: 5611915 - DNA, 20 bp, Homo sapiens
gaaataaaggtaaaatcact

SEQ ID NO: 5611916 - DNA, 17 bp, Homo sapiens
gaaataaagttgaatat

SEQ ID NO: 5611917 - DNA, 14 bp, Homo sapiens
gaaataaatagcta

SEQ ID NO: 5611918 - DNA, 18 bp, Homo sapiens
gaaataaatcagagagca

SEQ ID NO: 5611919 - DNA, 23 bp, Homo sapiens
gaaataaatcagagagcaaggca

SEQ ID NO: 5611920 - DNA, 13 bp, Homo sapiens
gaaataaatctaa

SEQ ID NO: 5611921 - DNA, 14 bp, Homo sapiens
gaaataaatctaaa

SEQ ID NO: 5611922 - DNA, 16 bp, Homo sapiens
gaaataaatctaaata

SEQ ID NO: 5611923 - DNA, 13 bp, Homo sapiens
gaaataaatgaaa

SEQ ID NO: 5611924 - DNA, 12 bp, Homo sapiens
gaaataaatgta

SEQ ID NO: 5611925 - DNA, 13 bp, Homo sapiens
gaaataaatgttt

SEQ ID NO: 5611926 - DNA, 14 bp, Homo sapiens
gaaataaatgtttc

SEQ ID NO: 5611927 - DNA, 20 bp, Homo sapiens
gaaataaattggtgataagt

SEQ ID NO: 5611928 - DNA, 21 bp, Homo sapiens
gaaataaattggtgataagtg

SEQ ID NO: 5611929 - DNA, 18 bp, Homo sapiens
gaaataaattttgtttca

SEQ ID NO: 5611930 - DNA, 19 bp, Homo sapiens
gaaataacaaaatggacat

SEQ ID NO: 5611931 - DNA, 16 bp, Homo sapiens
gaaataacaatgttaa

SEQ ID NO: 5611932 - DNA, 20 bp, Homo sapiens
gaaataacagaagaaaatag

SEQ ID NO: 5611933 - DNA, 22 bp, Homo sapiens
gaaataacagtatttccacaat

SEQ ID NO: 5611934 - DNA, 17 bp, Homo sapiens
gaaataacccagactta

SEQ ID NO: 5611935 - DNA, 17 bp, Homo sapiens
gaaatttttcttcttga

SEQ ID NO: 5611936 - DNA, 19 bp, Homo sapiens
gaaatttttgatgcccaga

SEQ ID NO: 5611937 - DNA, 18 bp, Homo sapiens
gaaatttttgcatgttta

SEQ ID NO: 5611938 - DNA, 23 bp, Homo sapiens
gaaatttttgcatgtttaataat

SEQ ID NO: 5611939 - DNA, 15 bp, Homo sapiens
gaaattttttagtat

SEQ ID NO: 5611940 - DNA, 17 bp, Homo sapiens
gaaatttttttcctaag

SEQ ID NO: 5611941 - DNA, 15 bp, Homo sapiens
gaacaaaaagaaatc

SEQ ID NO: 5611942 - DNA, 19 bp, Homo sapiens
gaacaaaaagaaatcttgt

SEQ ID NO: 5611943 - DNA, 19 bp, Homo sapiens
gaacaaaaatgtttccact

SEQ ID NO: 5611944 - DNA, 19 bp, Homo sapiens
gaacaaaaattacaaagaa

SEQ ID NO: 5611945 - DNA, 23 bp, Homo sapiens
gaacaaaacacacgcgcgcacac

SEQ ID NO: 5611946 - DNA, 15 bp, Homo sapiens
gaacaaaactccaga

SEQ ID NO: 5611947 - DNA, 22 bp, Homo sapiens
gaacaaaactgttcttttgcat

SEQ ID NO: 5611948 - DNA, 13 bp, Homo sapiens
gaacaaaacttct

SEQ ID NO: 5611949 - DNA, 14 bp, Homo sapiens
gaacaaaataaatt

SEQ ID NO: 5611950 - DNA, 22 bp, Homo sapiens
gaacaaaataagcaactaaatg

SEQ ID NO: 5611951 - DNA, 14 bp, Homo sapiens
gaacaaactcagat

SEQ ID NO: 5611952 - DNA, 17 bp, Homo sapiens
gaacaaactcagatctc

SEQ ID NO: 5611953 - DNA, 21 bp, Homo sapiens
gaacaaagaaaaaaatatatt

SEQ ID NO: 5611954 - DNA, 21 bp, Homo sapiens
gaacaaagaacggcatgtgaa

SEQ ID NO: 5611955 - DNA, 14 bp, Homo sapiens
gaacaaagacaggc

SEQ ID NO: 5611956 - DNA, 14 bp, Homo sapiens
gaacaaagacattt

SEQ ID NO: 5611957 - DNA, 15 bp, Homo sapiens
gaacaaagagtgaaa

SEQ ID NO: 5611958 - DNA, 17 bp, Homo sapiens
gaacaaagagtgaaata

SEQ ID NO: 5611959 - DNA, 13 bp, Homo sapiens
gaacaaagctgtt

SEQ ID NO: 5611960 - DNA, 14 bp, Homo sapiens
gaacaaagctgtta

SEQ ID NO: 5611961 - DNA, 15 bp, Homo sapiens
gaacaaagctgttaa

SEQ ID NO: 5611962 - DNA, 21 bp, Homo sapiens
gaacaaagctgttaaactgtt

SEQ ID NO: 5611963 - DNA, 21 bp, Homo sapiens
gaacaaagggccaaatagagt

SEQ ID NO: 5611964 - DNA, 23 bp, Homo sapiens
gaacaaagtaaaagtagtgttgt

SEQ ID NO: 5611965 - DNA, 24 bp, Homo sapiens
gaacaaatatgattctcctctccc

SEQ ID NO: 5611966 - DNA, 19 bp, Homo sapiens
gaacaaatattcagaatat

SEQ ID NO: 5611967 - DNA, 13 bp, Homo sapiens
gaacaaatcttcc

SEQ ID NO: 5611968 - DNA, 18 bp, Homo sapiens
gaacaaatcttgggtggg

SEQ ID NO: 5611969 - DNA, 22 bp, Homo sapiens
gaacaaatgcttttccaaccca

SEQ ID NO: 5611970 - DNA, 15 bp, Homo sapiens
gaacaaatggccttt

SEQ ID NO: 5611971 - DNA, 15 bp, Homo sapiens
gaacaaatgtgtttt

SEQ ID NO: 5611972 - DNA, 23 bp, Homo sapiens
gaacaaatgtttattaagcatca

SEQ ID NO: 5611973 - DNA, 14 bp, Homo sapiens
gaacaaattatttt

SEQ ID NO: 5611974 - DNA, 16 bp, Homo sapiens
gaacaaattctttagt

SEQ ID NO: 5611975 - DNA, 20 bp, Homo sapiens
gaacaaattctttagtactc

SEQ ID NO: 5611976 - DNA, 17 bp, Homo sapiens
gaacaaatttacagaga

SEQ ID NO: 5611977 - DNA, 15 bp, Homo sapiens
gaacaaattttcaca

SEQ ID NO: 5611978 - DNA, 22 bp, Homo sapiens
gaacaacaacaaagcatgctca

SEQ ID NO: 5611979 - DNA, 13 bp, Homo sapiens
gaacaacaacaac

SEQ ID NO: 5611980 - DNA, 15 bp, Homo sapiens
gaacaacaacaacaa

SEQ ID NO: 5611981 - DNA, 19 bp, Homo sapiens
gaacaacaacaacaataac

SEQ ID NO: 5611982 - DNA, 20 bp, Homo sapiens
gaacaacaacaacaataaca

SEQ ID NO: 5611983 - DNA, 21 bp, Homo sapiens
gaacaacaaggacaactttat

SEQ ID NO: 5611984 - DNA, 16 bp, Homo sapiens
gaacaacaggcagggg

SEQ ID NO: 5611985 - DNA, 17 bp, Homo sapiens
gaacaacaggcaggggc

SEQ ID NO: 5611986 - DNA, 15 bp, Homo sapiens
gaacaacataaaatt

SEQ ID NO: 5611987 - DNA, 15 bp, Homo sapiens
gaacaacatatacaa

SEQ ID NO: 5611988 - DNA, 20 bp, Homo sapiens
gaacaaccctgaagcagagg

SEQ ID NO: 5611989 - DNA, 16 bp, Homo sapiens
gaacaacctcggctcc

SEQ ID NO: 5611990 - DNA, 21 bp, Homo sapiens
gaacaacctcggctcctggac

SEQ ID NO: 5611991 - DNA, 15 bp, Homo sapiens
gaacaactactgtga

SEQ ID NO: 5611992 - DNA, 19 bp, Homo sapiens
gaacaactggaaataaagt

SEQ ID NO: 5611993 - DNA, 20 bp, Homo sapiens
gaacaactggaaataaagta

SEQ ID NO: 5611994 - DNA, 23 bp, Homo sapiens
gaacaacttggaagatctacctg

SEQ ID NO: 5611995 - DNA, 14 bp, Homo sapiens
gaacaacttgtagc

SEQ ID NO: 5611996 - DNA, 15 bp, Homo sapiens
gaacaacttgtagca

SEQ ID NO: 5611997 - DNA, 14 bp, Homo sapiens
gaacaagaaagagt

SEQ ID NO: 5611998 - DNA, 17 bp, Homo sapiens
gaacaagaaatctttct

SEQ ID NO: 5611999 - DNA, 16 bp, Homo sapiens
gaacaagacccccagg

SEQ ID NO: 5612000 - DNA, 20 bp, Homo sapiens
gaacaagacccccaggaagg

SEQ ID NO: 5612001 - DNA, 18 bp, Homo sapiens
gaacaagaccctgtctca

SEQ ID NO: 5612002 - DNA, 16 bp, Homo sapiens
gaacaagatggttcta

SEQ ID NO: 5612003 - DNA, 15 bp, Homo sapiens
gaacaagatttccct

SEQ ID NO: 5612004 - DNA, 21 bp, Homo sapiens
gaacaagcaaacccagacggc

SEQ ID NO: 5612005 - DNA, 23 bp, Homo sapiens
gaacaagcatgatcttgttactg

SEQ ID NO: 5612006 - DNA, 16 bp, Homo sapiens
gaacaagcattctcct

SEQ ID NO: 5612007 - DNA, 18 bp, Homo sapiens
gaacaagctcatctattt

SEQ ID NO: 5612008 - DNA, 15 bp, Homo sapiens
gaacaagtaatgtat

SEQ ID NO: 5612009 - DNA, 16 bp, Homo sapiens
gaacaagtaatgtatt

SEQ ID NO: 5612010 - DNA, 21 bp, Homo sapiens
gaacaagtgcctcctggactg

SEQ ID NO: 5612011 - DNA, 20 bp, Homo sapiens
gaacaagttgagctatgact

SEQ ID NO: 5612012 - DNA, 21 bp, Homo sapiens
gaacaagttgagctatgactt

SEQ ID NO: 5612013 - DNA, 21 bp, Homo sapiens
gaacaagttgtttcattgact

SEQ ID NO: 5612014 - DNA, 18 bp, Homo sapiens
gaacaatagaataatcta

SEQ ID NO: 5612015 - DNA, 18 bp, Homo sapiens
gaacaatatcaatatggt

SEQ ID NO: 5612016 - DNA, 19 bp, Homo sapiens
gaacaatattgactttgtc

SEQ ID NO: 5612017 - DNA, 20 bp, Homo sapiens
gaacaatattgactttgtct

SEQ ID NO: 5612018 - DNA, 14 bp, Homo sapiens
gaacaatcaaagca

SEQ ID NO: 5612019 - DNA, 23 bp, Homo sapiens
gaacaatcacaaaagctgtgtct

SEQ ID NO: 5612020 - DNA, 18 bp, Homo sapiens
gaacaatcactattctta

SEQ ID NO: 5612021 - DNA, 15 bp, Homo sapiens
gaacaatgccagggc

SEQ ID NO: 5612022 - DNA, 23 bp, Homo sapiens
gaacaatggaagaagaaaggact

SEQ ID NO: 5612023 - DNA, 22 bp, Homo sapiens
gaacaatgtgggcgtttgtaaa

SEQ ID NO: 5612024 - DNA, 16 bp, Homo sapiens
gaacaattacatgtaa

SEQ ID NO: 5612025 - DNA, 17 bp, Homo sapiens
gaacaattgaagtaaac

SEQ ID NO: 5612026 - DNA, 20 bp, Homo sapiens
gaacaattgaagtaaacttt

SEQ ID NO: 5612027 - DNA, 17 bp, Homo sapiens
gaacaatttctctgggt

SEQ ID NO: 5612028 - DNA, 13 bp, Homo sapiens
gaacaattttctt

SEQ ID NO: 5612029 - DNA, 21 bp, Homo sapiens
gaacaattttttttctgtaaa

SEQ ID NO: 5612030 - DNA, 14 bp, Homo sapiens
gaacacaaaacatt

SEQ ID NO: 5612031 - DNA, 17 bp, Homo sapiens
gaacacaaactgtaaat

SEQ ID NO: 5612032 - DNA, 19 bp, Homo sapiens
gaacacaaactgtaaataa

SEQ ID NO: 5612033 - DNA, 14 bp, Homo sapiens
gaacacaaatttat

SEQ ID NO: 5612034 - DNA, 15 bp, Homo sapiens
gaacacaagaaaaag

SEQ ID NO: 5612035 - DNA, 19 bp, Homo sapiens
gaacacaataatgtgtcct

SEQ ID NO: 5612036 - DNA, 23 bp, Homo sapiens
gaacacaatacatgttttcactt

SEQ ID NO: 5612037 - DNA, 23 bp, Homo sapiens
gaacacaatcacgttatagtcca

SEQ ID NO: 5612038 - DNA, 23 bp, Homo sapiens
gaacacacacacacgcagacaca

SEQ ID NO: 5612039 - DNA, 19 bp, Homo sapiens
gaacacacacgccagctcc

SEQ ID NO: 5612040 - DNA, 13 bp, Homo sapiens
gaacacacagggc

SEQ ID NO: 5612041 - DNA, 10 bp, Homo sapiens
gaacacacat

SEQ ID NO: 5612042 - DNA, 14 bp, Homo sapiens
gaacacacatccca

SEQ ID NO: 5612043 - DNA, 17 bp, Homo sapiens
gaacacacatcccagga

SEQ ID NO: 5612044 - DNA, 14 bp, Homo sapiens
gaacacactcagca

SEQ ID NO: 5612045 - DNA, 19 bp, Homo sapiens
gaacacagagtgtgttttt

SEQ ID NO: 5612046 - DNA, 16 bp, Homo sapiens
gaacacagcagaccta

SEQ ID NO: 5612047 - DNA, 17 bp, Homo sapiens
gaacacagcatgtgcca

SEQ ID NO: 5612048 - DNA, 22 bp, Homo sapiens
gaacacagcctgggaccagggc

SEQ ID NO: 5612049 - DNA, 17 bp, Homo sapiens
gaacacaggcaaaatcc

SEQ ID NO: 5612050 - DNA, 14 bp, Homo sapiens
gaacacaggcaaag

SEQ ID NO: 5612051 - DNA, 23 bp, Homo sapiens
gaacacaggcttatttttaaaat

SEQ ID NO: 5612052 - DNA, 15 bp, Homo sapiens
gaacacagtgtctgt

SEQ ID NO: 5612053 - DNA, 16 bp, Homo sapiens
gaacacagtgtctgtt

SEQ ID NO: 5612054 - DNA, 15 bp, Homo sapiens
gaacacatgcacaca

SEQ ID NO: 5612055 - DNA, 18 bp, Homo sapiens
gaacacatgcacacacac

SEQ ID NO: 5612056 - DNA, 15 bp, Homo sapiens
gaacacatgttttta

SEQ ID NO: 5612057 - DNA, 16 bp, Homo sapiens
gaacaccaacttttat

SEQ ID NO: 5612058 - DNA, 22 bp, Homo sapiens
gaacaccaacttttatttggaa

SEQ ID NO: 5612059 - DNA, 22 bp, Homo sapiens
gaacaccacgcttgacaggaca

SEQ ID NO: 5612060 - DNA, 20 bp, Homo sapiens
gaacaccactttgtctctga

SEQ ID NO: 5612061 - DNA, 18 bp, Homo sapiens
gaacaccaggactttaat

SEQ ID NO: 5612062 - DNA, 20 bp, Homo sapiens
gaacaccaggactttaatct

SEQ ID NO: 5612063 - DNA, 19 bp, Homo sapiens
gaacaccattgaaggctta

SEQ ID NO: 5612064 - DNA, 13 bp, Homo sapiens
gaacacccactgg

SEQ ID NO: 5612065 - DNA, 16 bp, Homo sapiens
gaacacccactggcca

SEQ ID NO: 5612066 - DNA, 13 bp, Homo sapiens
gaacacccagccc

SEQ ID NO: 5612067 - DNA, 17 bp, Homo sapiens
gaacacccagccccagc

SEQ ID NO: 5612068 - DNA, 21 bp, Homo sapiens
gaacacccgactcctcaaaag

SEQ ID NO: 5612069 - DNA, 17 bp, Homo sapiens
gaacacccggaaagact

SEQ ID NO: 5612070 - DNA, 18 bp, Homo sapiens
gaacacctatgcaaagat

SEQ ID NO: 5612071 - DNA, 19 bp, Homo sapiens
gaacacctgacaacttctg

SEQ ID NO: 5612072 - DNA, 22 bp, Homo sapiens
gaacacctgccttctaccctct

SEQ ID NO: 5612073 - DNA, 15 bp, Homo sapiens
gaacacgtgggtgag

SEQ ID NO: 5612074 - DNA, 16 bp, Homo sapiens
gaacactaacctgacc

SEQ ID NO: 5612075 - DNA, 19 bp, Homo sapiens
gaacactaactcaccagcc

SEQ ID NO: 5612076 - DNA, 15 bp, Homo sapiens
gaacactaattcata

SEQ ID NO: 5612077 - DNA, 18 bp, Homo sapiens
gaacactaattcataatc

SEQ ID NO: 5612078 - DNA, 19 bp, Homo sapiens
gaacactattttcagaatc

SEQ ID NO: 5612079 - DNA, 21 bp, Homo sapiens
gaacactattttcagaatctg

SEQ ID NO: 5612080 - DNA, 23 bp, Homo sapiens
gaacactcatgcggcccagccat

SEQ ID NO: 5612081 - DNA, 20 bp, Homo sapiens
gaacactccaattaaggatt

SEQ ID NO: 5612082 - DNA, 15 bp, Homo sapiens
gaacactccttcaca

SEQ ID NO: 5612083 - DNA, 14 bp, Homo sapiens
gaacactctgagac

SEQ ID NO: 5612084 - DNA, 14 bp, Homo sapiens
gaacactgagaaag

SEQ ID NO: 5612085 - DNA, 17 bp, Homo sapiens
gaacactgcaccctcca

SEQ ID NO: 5612086 - DNA, 22 bp, Homo sapiens
gaacactgcaccctccacagga

SEQ ID NO: 5612087 - DNA, 23 bp, Homo sapiens
gaacactgcactcttaagcttcc

SEQ ID NO: 5612088 - DNA, 17 bp, Homo sapiens
gaacactgccctcgcac

SEQ ID NO: 5612089 - DNA, 22 bp, Homo sapiens
gaacactgcctctgagttttga

SEQ ID NO: 5612090 - DNA, 20 bp, Homo sapiens
gaacactgggggaggggaca

SEQ ID NO: 5612091 - DNA, 18 bp, Homo sapiens
gaacactgtgaccaggct

SEQ ID NO: 5612092 - DNA, 23 bp, Homo sapiens
gaacactgtgaccaggcttttgt

SEQ ID NO: 5612093 - DNA, 16 bp, Homo sapiens
gaacacttcagacaca

SEQ ID NO: 5612094 - DNA, 18 bp, Homo sapiens
gaacacttctaggactgg

SEQ ID NO: 5612095 - DNA, 21 bp, Homo sapiens
gaacactttcctcttctatga

SEQ ID NO: 5612096 - DNA, 19 bp, Homo sapiens
gaacactttgctaggagat

SEQ ID NO: 5612097 - DNA, 12 bp, Homo sapiens
gaacagaaaaca

SEQ ID NO: 5612098 - DNA, 13 bp, Homo sapiens
gaacagaaaacaa

SEQ ID NO: 5612099 - DNA, 21 bp, Homo sapiens
gaacagaaaacaaaagagaga

SEQ ID NO: 5612100 - DNA, 14 bp, Homo sapiens
gaacagaaaacaac

SEQ ID NO: 5612101 - DNA, 17 bp, Homo sapiens
gaacagaaaacaacaaa

SEQ ID NO: 5612102 - DNA, 19 bp, Homo sapiens
gaacagaaaacaacaaaaa

SEQ ID NO: 5612103 - DNA, 20 bp, Homo sapiens
gaacagaaaacaacaaaaaa

SEQ ID NO: 5612104 - DNA, 23 bp, Homo sapiens
gaacagaaaacaacaaaaaataa

SEQ ID NO: 5612105 - DNA, 23 bp, Homo sapiens
gaacagaaatatataaaaatata

SEQ ID NO: 5612106 - DNA, 12 bp, Homo sapiens
gaacagaaattg

SEQ ID NO: 5612107 - DNA, 14 bp, Homo sapiens
gaacagaagaaaat

SEQ ID NO: 5612108 - DNA, 12 bp, Homo sapiens
gaacagaaggat

SEQ ID NO: 5612109 - DNA, 19 bp, Homo sapiens
gaacagaaggatgaatgag

SEQ ID NO: 5612110 - DNA, 15 bp, Homo sapiens
gaacagaatgtttta

SEQ ID NO: 5612111 - DNA, 13 bp, Homo sapiens
gaacgtggtttgc

SEQ ID NO: 5612112 - DNA, 17 bp, Homo sapiens
gaacgtgtgtccaggct

SEQ ID NO: 5612113 - DNA, 17 bp, Homo sapiens
gaacgtttcactgcaaa

SEQ ID NO: 5612114 - DNA, 13 bp, Homo sapiens
gaacgtttctgaa

SEQ ID NO: 5612115 - DNA, 13 bp, Homo sapiens
gaacgtttctggc

SEQ ID NO: 5612116 - DNA, 21 bp, Homo sapiens
gaacgtttctggcctgggttt

SEQ ID NO: 5612117 - DNA, 21 bp, Homo sapiens
gaacgtttggttcaaatgtgt

SEQ ID NO: 5612118 - DNA, 14 bp, Homo sapiens
gaacgttttaaagc

SEQ ID NO: 5612119 - DNA, 14 bp, Homo sapiens
gaacgttttctaat

SEQ ID NO: 5612120 - DNA, 16 bp, Homo sapiens
gaacgttttctaattg

SEQ ID NO: 5612121 - DNA, 13 bp, Homo sapiens
gaacgttttcttc

SEQ ID NO: 5612122 - DNA, 15 bp, Homo sapiens
gaacgtttttcctgt

SEQ ID NO: 5612123 - DNA, 13 bp, Homo sapiens
gaactaaactagt

SEQ ID NO: 5612124 - DNA, 22 bp, Homo sapiens
gaactaaactagtttttcctat

SEQ ID NO: 5612125 - DNA, 12 bp, Homo sapiens
gaactaaacttt

SEQ ID NO: 5612126 - DNA, 21 bp, Homo sapiens
gaactaaagtgctgcactcaa

SEQ ID NO: 5612127 - DNA, 19 bp, Homo sapiens
gaactaaatataaattttc

SEQ ID NO: 5612128 - DNA, 22 bp, Homo sapiens
gaactaaatataaattttcaga

SEQ ID NO: 5612129 - DNA, 16 bp, Homo sapiens
gaactaaatgttctat

SEQ ID NO: 5612130 - DNA, 13 bp, Homo sapiens
gaactaacacgtg

SEQ ID NO: 5612131 - DNA, 14 bp, Homo sapiens
gaactaacataatc

SEQ ID NO: 5612132 - DNA, 16 bp, Homo sapiens
gaactaactgccatgt

SEQ ID NO: 5612133 - DNA, 19 bp, Homo sapiens
gaactaacttactgtccac

SEQ ID NO: 5612134 - DNA, 14 bp, Homo sapiens
gaactaactttggt

SEQ ID NO: 5612135 - DNA, 22 bp, Homo sapiens
gaactaagaaacttttgtaaag

SEQ ID NO: 5612136 - DNA, 23 bp, Homo sapiens
gaactaagcatttttggcaacca

SEQ ID NO: 5612137 - DNA, 20 bp, Homo sapiens
gaactaaggactccaatgtc

SEQ ID NO: 5612138 - DNA, 18 bp, Homo sapiens
gaactaagtaagaaacac

SEQ ID NO: 5612139 - DNA, 17 bp, Homo sapiens
gaactaagttattgctg

SEQ ID NO: 5612140 - DNA, 20 bp, Homo sapiens
gaactaagttattgctgcat

SEQ ID NO: 5612141 - DNA, 22 bp, Homo sapiens
gaactaagttattgctgcataa

SEQ ID NO: 5612142 - DNA, 23 bp, Homo sapiens
gaactaatgataatcccaccacc

SEQ ID NO: 5612143 - DNA, 17 bp, Homo sapiens
gaactaattcatttatt

SEQ ID NO: 5612144 - DNA, 14 bp, Homo sapiens
gaactaatttctgt

SEQ ID NO: 5612145 - DNA, 17 bp, Homo sapiens
gaactaccatgctttgt

SEQ ID NO: 5612146 - DNA, 22 bp, Homo sapiens
gaactaccccacaacacgccta

SEQ ID NO: 5612147 - DNA, 16 bp, Homo sapiens
gaactacccccttttc

SEQ ID NO: 5612148 - DNA, 22 bp, Homo sapiens
gaactacctatccttacatttc

SEQ ID NO: 5612149 - DNA, 19 bp, Homo sapiens
gaactaccttggttccccc

SEQ ID NO: 5612150 - DNA, 22 bp, Homo sapiens
gaactacgcttgctcatttttt

SEQ ID NO: 5612151 - DNA, 12 bp, Homo sapiens
gaactactgcta

SEQ ID NO: 5612152 - DNA, 15 bp, Homo sapiens
gaactactgctattt

SEQ ID NO: 5612153 - DNA, 12 bp, Homo sapiens
gaactactgtac

SEQ ID NO: 5612154 - DNA, 21 bp, Homo sapiens
gaactactttgaaaacaattc

SEQ ID NO: 5612155 - DNA, 13 bp, Homo sapiens
gaactagaaaccc

SEQ ID NO: 5612156 - DNA, 19 bp, Homo sapiens
gaactagaatttgattatt

SEQ ID NO: 5612157 - DNA, 19 bp, Homo sapiens
gaactagactgcctgggtt

SEQ ID NO: 5612158 - DNA, 17 bp, Homo sapiens
gaactagagatgtgcaa

SEQ ID NO: 5612159 - DNA, 21 bp, Homo sapiens
gaactagagcttgcagtgaag

SEQ ID NO: 5612160 - DNA, 22 bp, Homo sapiens
gaactagaggttttatgatatt

SEQ ID NO: 5612161 - DNA, 22 bp, Homo sapiens
gaactagcatataattctatat

SEQ ID NO: 5612162 - DNA, 18 bp, Homo sapiens
gaactagcatatagccat

SEQ ID NO: 5612163 - DNA, 22 bp, Homo sapiens
gaactagccaccaactcttgca

SEQ ID NO: 5612164 - DNA, 19 bp, Homo sapiens
gaactagccttatttctca

SEQ ID NO: 5612165 - DNA, 19 bp, Homo sapiens
gaactagctggaatttttt

SEQ ID NO: 5612166 - DNA, 20 bp, Homo sapiens
gaactaggatagatgtgatt

SEQ ID NO: 5612167 - DNA, 15 bp, Homo sapiens
gaactaggctgagca

SEQ ID NO: 5612168 - DNA, 17 bp, Homo sapiens
gaactaggctgagcaat

SEQ ID NO: 5612169 - DNA, 22 bp, Homo sapiens
gaactaggtagattgttttgtt

SEQ ID NO: 5612170 - DNA, 14 bp, Homo sapiens
gaactaggtgctgg

SEQ ID NO: 5612171 - DNA, 15 bp, Homo sapiens
gaactaggtgctggc

SEQ ID NO: 5612172 - DNA, 17 bp, Homo sapiens
gaactaggtgctggcat

SEQ ID NO: 5612173 - DNA, 23 bp, Homo sapiens
gaactaggtttaaaacagcctgg

SEQ ID NO: 5612174 - DNA, 15 bp, Homo sapiens
gaactagtaaacata

SEQ ID NO: 5612175 - DNA, 21 bp, Homo sapiens
gaactagttttgggaaatgta

SEQ ID NO: 5612176 - DNA, 19 bp, Homo sapiens
gaactataacacctgccac

SEQ ID NO: 5612177 - DNA, 20 bp, Homo sapiens
gaactataacattcaatttg

SEQ ID NO: 5612178 - DNA, 23 bp, Homo sapiens
gaactataacattcaatttgcta

SEQ ID NO: 5612179 - DNA, 22 bp, Homo sapiens
gaactatatcagtagtgtacat

SEQ ID NO: 5612180 - DNA, 15 bp, Homo sapiens
gaactatattttccc

SEQ ID NO: 5612181 - DNA, 13 bp, Homo sapiens
gaactatcttcat

SEQ ID NO: 5612182 - DNA, 14 bp, Homo sapiens
gaactatcttcatc

SEQ ID NO: 5612183 - DNA, 15 bp, Homo sapiens
gaactatgaactaca

SEQ ID NO: 5612184 - DNA, 21 bp, Homo sapiens
gaactattccatcaataggca

SEQ ID NO: 5612185 - DNA, 20 bp, Homo sapiens
gaactattccccagcagggt

SEQ ID NO: 5612186 - DNA, 15 bp, Homo sapiens
gaactattggagggt

SEQ ID NO: 5612187 - DNA, 20 bp, Homo sapiens
gaactattgtgctcagagac

SEQ ID NO: 5612188 - DNA, 16 bp, Homo sapiens
gaactatttattaaaa

SEQ ID NO: 5612189 - DNA, 23 bp, Homo sapiens
gaactatttgaaacacacagtga

SEQ ID NO: 5612190 - DNA, 19 bp, Homo sapiens
gaactcaaaggactgacct

SEQ ID NO: 5612191 - DNA, 15 bp, Homo sapiens
gaactcaactttgac

SEQ ID NO: 5612192 - DNA, 16 bp, Homo sapiens
gaactcaactttgaca

SEQ ID NO: 5612193 - DNA, 13 bp, Homo sapiens
gaactcaagctgc

SEQ ID NO: 5612194 - DNA, 19 bp, Homo sapiens
gaactcaagggttttccag

SEQ ID NO: 5612195 - DNA, 22 bp, Homo sapiens
gaactcaagggttttccaggtg

SEQ ID NO: 5612196 - DNA, 19 bp, Homo sapiens
gaactcaaggtggctggag

SEQ ID NO: 5612197 - DNA, 20 bp, Homo sapiens
gaactcaaggtggctggaga

SEQ ID NO: 5612198 - DNA, 13 bp, Homo sapiens
gaactcaatgcat

SEQ ID NO: 5612199 - DNA, 23 bp, Homo sapiens
gaactcaatgtgcaagttgtact

SEQ ID NO: 5612200 - DNA, 23 bp, Homo sapiens
gaactcacagtacctatgacttt

SEQ ID NO: 5612201 - DNA, 17 bp, Homo sapiens
gaactcaccctgggagc

SEQ ID NO: 5612202 - DNA, 22 bp, Homo sapiens
gaactcacctggggctgctggc

SEQ ID NO: 5612203 - DNA, 16 bp, Homo sapiens
gaactcacgagccttg

SEQ ID NO: 5612204 - DNA, 13 bp, Homo sapiens
gaactcactctgg

SEQ ID NO: 5612205 - DNA, 14 bp, Homo sapiens
gaactcactctggg

SEQ ID NO: 5612206 - DNA, 14 bp, Homo sapiens
gaactcactggggc

SEQ ID NO: 5612207 - DNA, 14 bp, Homo sapiens
gaactcagatccag

SEQ ID NO: 5612208 - DNA, 18 bp, Homo sapiens
gaactcagccaagcacag

SEQ ID NO: 5612209 - DNA, 19 bp, Homo sapiens
gaactcagccaagcacagt

SEQ ID NO: 5612210 - DNA, 16 bp, Homo sapiens
gaactcagctgtctgt

SEQ ID NO: 5612211 - DNA, 22 bp, Homo sapiens
gaactcaggatgggaagaaaaa

SEQ ID NO: 5612212 - DNA, 22 bp, Homo sapiens
gaactcatccctaatgctgcag

SEQ ID NO: 5612213 - DNA, 20 bp, Homo sapiens
gaactcatcccttgtttata

SEQ ID NO: 5612214 - DNA, 11 bp, Homo sapiens
gaactcatcct

SEQ ID NO: 5612215 - DNA, 21 bp, Homo sapiens
gaactcatctaggtaaattac

SEQ ID NO: 5612216 - DNA, 20 bp, Homo sapiens
gaactcattctatccccaat

SEQ ID NO: 5612217 - DNA, 14 bp, Homo sapiens
gaactcatttattc

SEQ ID NO: 5612218 - DNA, 22 bp, Homo sapiens
gaactccaccgaccaactgccc

SEQ ID NO: 5612219 - DNA, 11 bp, Homo sapiens
gaactccaggc

SEQ ID NO: 5612220 - DNA, 23 bp, Homo sapiens
gaactccaggccctcctctccca

SEQ ID NO: 5612221 - DNA, 13 bp, Homo sapiens
gaactccaggctg

SEQ ID NO: 5612222 - DNA, 22 bp, Homo sapiens
gaactccaggctgggctgagcc

SEQ ID NO: 5612223 - DNA, 14 bp, Homo sapiens
gaactccatacagc

SEQ ID NO: 5612224 - DNA, 17 bp, Homo sapiens
gaactcccagcaacaca

SEQ ID NO: 5612225 - DNA, 17 bp, Homo sapiens
gaactcccccagaggtg

SEQ ID NO: 5612226 - DNA, 19 bp, Homo sapiens
gaactcccccagaggtgga

SEQ ID NO: 5612227 - DNA, 16 bp, Homo sapiens
gaactcctaaatcaag

SEQ ID NO: 5612228 - DNA, 18 bp, Homo sapiens
gaactcctacctgaaggc

SEQ ID NO: 5612229 - DNA, 15 bp, Homo sapiens
gaactcctcaagggc

SEQ ID NO: 5612230 - DNA, 17 bp, Homo sapiens
gaactcctcaagggcag

SEQ ID NO: 5612231 - DNA, 12 bp, Homo sapiens
gaactcctccca

SEQ ID NO: 5612232 - DNA, 15 bp, Homo sapiens
gaactcctgacctca

SEQ ID NO: 5612233 - DNA, 13 bp, Homo sapiens
gaactcctgagct

SEQ ID NO: 5612234 - DNA, 13 bp, Homo sapiens
gaactcctgccac

SEQ ID NO: 5612235 - DNA, 19 bp, Homo sapiens
gaactcctgccacaacaga

SEQ ID NO: 5612236 - DNA, 17 bp, Homo sapiens
gaactcctgccatagtc

SEQ ID NO: 5612237 - DNA, 20 bp, Homo sapiens
gaactcctggaaatatcagt

SEQ ID NO: 5612238 - DNA, 14 bp, Homo sapiens
gaactcctgggctc

SEQ ID NO: 5612239 - DNA, 15 bp, Homo sapiens
gaactcctgggctca

SEQ ID NO: 5612240 - DNA, 17 bp, Homo sapiens
gaactccttattttgta

SEQ ID NO: 5612241 - DNA, 20 bp, Homo sapiens
gaactccttattttgtatta

SEQ ID NO: 5612242 - DNA, 14 bp, Homo sapiens
gaactccttggcct

SEQ ID NO: 5612243 - DNA, 17 bp, Homo sapiens
gaactcgaagcccttcc

SEQ ID NO: 5612244 - DNA, 18 bp, Homo sapiens
gaactcgcacctgtgctg

SEQ ID NO: 5612245 - DNA, 23 bp, Homo sapiens
gaactcgcagggaatgcagcagg

SEQ ID NO: 5612246 - DNA, 15 bp, Homo sapiens
gaactcgcctcagcc

SEQ ID NO: 5612247 - DNA, 20 bp, Homo sapiens
gaactcgcttctctgtgact

SEQ ID NO: 5612248 - DNA, 17 bp, Homo sapiens
gaactcggcccctcctc

SEQ ID NO: 5612249 - DNA, 17 bp, Homo sapiens
gaactcggtgtccccac

SEQ ID NO: 5612250 - DNA, 20 bp, Homo sapiens
gaactctaccctggtaggaa

SEQ ID NO: 5612251 - DNA, 17 bp, Homo sapiens
gaactctactcaaccca

SEQ ID NO: 5612252 - DNA, 23 bp, Homo sapiens
gaactctagggatagtcaccttt

SEQ ID NO: 5612253 - DNA, 19 bp, Homo sapiens
gaactctatctgggcctgg

SEQ ID NO: 5612254 - DNA, 20 bp, Homo sapiens
gaactctatctgggcctggg

SEQ ID NO: 5612255 - DNA, 14 bp, Homo sapiens
gaactctcagaaat

SEQ ID NO: 5612256 - DNA, 21 bp, Homo sapiens
gaactctcagaaataaatcac

SEQ ID NO: 5612257 - DNA, 12 bp, Homo sapiens
gaactctcagac

SEQ ID NO: 5612258 - DNA, 16 bp, Homo sapiens
gaactctccaaatatt

SEQ ID NO: 5612259 - DNA, 13 bp, Homo sapiens
gaactctccaggg

SEQ ID NO: 5612260 - DNA, 18 bp, Homo sapiens
gaactctcccctccccat

SEQ ID NO: 5612261 - DNA, 20 bp, Homo sapiens
gaactctcccctccccatct

SEQ ID NO: 5612262 - DNA, 22 bp, Homo sapiens
gaactctcctctttttttaaaa

SEQ ID NO: 5612263 - DNA, 20 bp, Homo sapiens
gaactctctagttccctcag

SEQ ID NO: 5612264 - DNA, 14 bp, Homo sapiens
gaactctctccctg

SEQ ID NO: 5612265 - DNA, 16 bp, Homo sapiens
gaactctctgtcttct

SEQ ID NO: 5612266 - DNA, 17 bp, Homo sapiens
gaactctgaactttgga

SEQ ID NO: 5612267 - DNA, 14 bp, Homo sapiens
gaactctgacaagg

SEQ ID NO: 5612268 - DNA, 16 bp, Homo sapiens
gaactctgcacagcaa

SEQ ID NO: 5612269 - DNA, 14 bp, Homo sapiens
gaactctggtggca

SEQ ID NO: 5612270 - DNA, 19 bp, Homo sapiens
gaactctggtggcacagga

SEQ ID NO: 5612271 - DNA, 20 bp, Homo sapiens
gaactcttaatcaaatagca

SEQ ID NO: 5612272 - DNA, 18 bp, Homo sapiens
gaactcttagaaatgaag

SEQ ID NO: 5612273 - DNA, 12 bp, Homo sapiens
gaactcttcctc

SEQ ID NO: 5612274 - DNA, 15 bp, Homo sapiens
gaactcttcctcctc

SEQ ID NO: 5612275 - DNA, 23 bp, Homo sapiens
gaactcttcctggaatgcattca

SEQ ID NO: 5612276 - DNA, 18 bp, Homo sapiens
gaactctttctggcctgc

SEQ ID NO: 5612277 - DNA, 13 bp, Homo sapiens
gaactgaaaacat

SEQ ID NO: 5612278 - DNA, 16 bp, Homo sapiens
gaactgaaaacataaa

SEQ ID NO: 5612279 - DNA, 21 bp, Homo sapiens
gaactgaaaagagagcagaga

SEQ ID NO: 5612280 - DNA, 16 bp, Homo sapiens
gaactgaaataaaaaa

SEQ ID NO: 5612281 - DNA, 11 bp, Homo sapiens
gaactgaaatc

SEQ ID NO: 5612282 - DNA, 14 bp, Homo sapiens
gaactgaaatcata

SEQ ID NO: 5612283 - DNA, 15 bp, Homo sapiens
gaactgaagcagagt

SEQ ID NO: 5612284 - DNA, 17 bp, Homo sapiens
gaactgaagcagagtca

SEQ ID NO: 5612285 - DNA, 21 bp, Homo sapiens
gaactgaagccacttggccca

SEQ ID NO: 5612286 - DNA, 22 bp, Homo sapiens
gaactgaagccacttggcccag

SEQ ID NO: 5612287 - DNA, 23 bp, Homo sapiens
gaactgaagccacttggcccaga

SEQ ID NO: 5612288 - DNA, 22 bp, Homo sapiens
gaagaatattgttcctaagttc

SEQ ID NO: 5612289 - DNA, 12 bp, Homo sapiens
gaagaatattta

SEQ ID NO: 5612290 - DNA, 18 bp, Homo sapiens
gaagaatcaagagggcag

SEQ ID NO: 5612291 - DNA, 15 bp, Homo sapiens
gaagaatcacgattt

SEQ ID NO: 5612292 - DNA, 20 bp, Homo sapiens
gaagaatccacaaggacctc

SEQ ID NO: 5612293 - DNA, 14 bp, Homo sapiens
gaagaatctttctt

SEQ ID NO: 5612294 - DNA, 15 bp, Homo sapiens
gaagaatgaacccaa

SEQ ID NO: 5612295 - DNA, 14 bp, Homo sapiens
gaagaatgaagccc

SEQ ID NO: 5612296 - DNA, 23 bp, Homo sapiens
gaagaatgcacaagaatggatca

SEQ ID NO: 5612297 - DNA, 16 bp, Homo sapiens
gaagaatggagaggaa

SEQ ID NO: 5612298 - DNA, 15 bp, Homo sapiens
gaagaatggctttca

SEQ ID NO: 5612299 - DNA, 20 bp, Homo sapiens
gaagaatgggctgcagaaga

SEQ ID NO: 5612300 - DNA, 17 bp, Homo sapiens
gaagaatgtctcctgcc

SEQ ID NO: 5612301 - DNA, 14 bp, Homo sapiens
gaagaatgtctgta

SEQ ID NO: 5612302 - DNA, 15 bp, Homo sapiens
gaagaattaatgaca

SEQ ID NO: 5612303 - DNA, 22 bp, Homo sapiens
gaagaattacaatttctttaaa

SEQ ID NO: 5612304 - DNA, 23 bp, Homo sapiens
gaagaattatgtaatatattgta

SEQ ID NO: 5612305 - DNA, 23 bp, Homo sapiens
gaagaattattcagtgaatttgt

SEQ ID NO: 5612306 - DNA, 22 bp, Homo sapiens
gaagaattgaaaagtttttgtt

SEQ ID NO: 5612307 - DNA, 19 bp, Homo sapiens
gaagaattgaacccaggag

SEQ ID NO: 5612308 - DNA, 17 bp, Homo sapiens
gaagaattgtcttgcaa

SEQ ID NO: 5612309 - DNA, 13 bp, Homo sapiens
gaagaatttaaag

SEQ ID NO: 5612310 - DNA, 20 bp, Homo sapiens
gaagaatttaagttctattc

SEQ ID NO: 5612311 - DNA, 18 bp, Homo sapiens
gaagaatttaatggactg

SEQ ID NO: 5612312 - DNA, 19 bp, Homo sapiens
gaagaatttaatggactgt

SEQ ID NO: 5612313 - DNA, 22 bp, Homo sapiens
gaagaatttaatggactgtgaa

SEQ ID NO: 5612314 - DNA, 14 bp, Homo sapiens
gaagaatttgaaga

SEQ ID NO: 5612315 - DNA, 22 bp, Homo sapiens
gaagaattttatttttctgtgg

SEQ ID NO: 5612316 - DNA, 15 bp, Homo sapiens
gaagaattttcagac

SEQ ID NO: 5612317 - DNA, 20 bp, Homo sapiens
gaagaattttcagaccccag

SEQ ID NO: 5612318 - DNA, 20 bp, Homo sapiens
gaagacaaaaagacaaacat

SEQ ID NO: 5612319 - DNA, 20 bp, Homo sapiens
gaagacaaaaatactctaat

SEQ ID NO: 5612320 - DNA, 18 bp, Homo sapiens
gaagacaaaccactgtac

SEQ ID NO: 5612321 - DNA, 21 bp, Homo sapiens
gaagacaaaccactgtacata

SEQ ID NO: 5612322 - DNA, 23 bp, Homo sapiens
gaagacaaaccactgtacatata

SEQ ID NO: 5612323 - DNA, 19 bp, Homo sapiens
gaagacaaagtctaaggaa

SEQ ID NO: 5612324 - DNA, 23 bp, Homo sapiens
gaagacaaatacacatacatata

SEQ ID NO: 5612325 - DNA, 20 bp, Homo sapiens
gaagacaacagaaagaggga

SEQ ID NO: 5612326 - DNA, 17 bp, Homo sapiens
gaagacaagtctgtggc

SEQ ID NO: 5612327 - DNA, 23 bp, Homo sapiens
gaagacaatgtgaaaagaaaaat

SEQ ID NO: 5612328 - DNA, 20 bp, Homo sapiens
gaagacaatttgatacataa

SEQ ID NO: 5612329 - DNA, 12 bp, Homo sapiens
gaagacacagaa

SEQ ID NO: 5612330 - DNA, 14 bp, Homo sapiens
gaagacacagcctc

SEQ ID NO: 5612331 - DNA, 15 bp, Homo sapiens
gaagacaccagagca

SEQ ID NO: 5612332 - DNA, 17 bp, Homo sapiens
gaagacaccagagcaga

SEQ ID NO: 5612333 - DNA, 21 bp, Homo sapiens
gaagacaccagagcagatgca

SEQ ID NO: 5612334 - DNA, 12 bp, Homo sapiens
gaagacactaat

SEQ ID NO: 5612335 - DNA, 22 bp, Homo sapiens
gaagacactaattccttaaatg

SEQ ID NO: 5612336 - DNA, 21 bp, Homo sapiens
gaagacactgaaatatacaca

SEQ ID NO: 5612337 - DNA, 21 bp, Homo sapiens
gaagacactgatgggcaaccc

SEQ ID NO: 5612338 - DNA, 23 bp, Homo sapiens
gaagacactgcagtgaccactta

SEQ ID NO: 5612339 - DNA, 23 bp, Homo sapiens
gaagacactgtgcaggcccaggc

SEQ ID NO: 5612340 - DNA, 14 bp, Homo sapiens
gaagacacttcaga

SEQ ID NO: 5612341 - DNA, 18 bp, Homo sapiens
gaagacacttgctgagtg

SEQ ID NO: 5612342 - DNA, 13 bp, Homo sapiens
gaagacagagatg

SEQ ID NO: 5612343 - DNA, 13 bp, Homo sapiens
gaagacagagcaa

SEQ ID NO: 5612344 - DNA, 16 bp, Homo sapiens
gaagacagagcaggct

SEQ ID NO: 5612345 - DNA, 13 bp, Homo sapiens
gaagacagcaaaa

SEQ ID NO: 5612346 - DNA, 15 bp, Homo sapiens
gaagacagcttccca

SEQ ID NO: 5612347 - DNA, 12 bp, Homo sapiens
gaagacaggaaa

SEQ ID NO: 5612348 - DNA, 13 bp, Homo sapiens
gaagacaggaaag

SEQ ID NO: 5612349 - DNA, 15 bp, Homo sapiens
gaagacaggacagtg

SEQ ID NO: 5612350 - DNA, 15 bp, Homo sapiens
gaagacaggcacaaa

SEQ ID NO: 5612351 - DNA, 21 bp, Homo sapiens
gaagacaggcacaaaatgtga

SEQ ID NO: 5612352 - DNA, 14 bp, Homo sapiens
gaagacataaaact

SEQ ID NO: 5612353 - DNA, 19 bp, Homo sapiens
gaagacataaaactttaaa

SEQ ID NO: 5612354 - DNA, 16 bp, Homo sapiens
gaagacatatcatgtg

SEQ ID NO: 5612355 - DNA, 23 bp, Homo sapiens
gaagacatgaacgttttctcttc

SEQ ID NO: 5612356 - DNA, 19 bp, Homo sapiens
gaagacattaagcagcctt

SEQ ID NO: 5612357 - DNA, 19 bp, Homo sapiens
gaagacattcaaaacgtga

SEQ ID NO: 5612358 - DNA, 23 bp, Homo sapiens
gaagacatttctgctctcagctc

SEQ ID NO: 5612359 - DNA, 16 bp, Homo sapiens
gaagacattttgttac

SEQ ID NO: 5612360 - DNA, 18 bp, Homo sapiens
gaagacattttgttacat

SEQ ID NO: 5612361 - DNA, 15 bp, Homo sapiens
gaagacattttttgc

SEQ ID NO: 5612362 - DNA, 23 bp, Homo sapiens
gaagaccaaaattactaataaat

SEQ ID NO: 5612363 - DNA, 13 bp, Homo sapiens
gaagaccaaagtt

SEQ ID NO: 5612364 - DNA, 20 bp, Homo sapiens
gaagaccacatccacacacg

SEQ ID NO: 5612365 - DNA, 21 bp, Homo sapiens
gaagaccacatgcgctcctgg

SEQ ID NO: 5612366 - DNA, 16 bp, Homo sapiens
gaagaccagtcacagc

SEQ ID NO: 5612367 - DNA, 23 bp, Homo sapiens
gaagaccagtcacagccatttca

SEQ ID NO: 5612368 - DNA, 22 bp, Homo sapiens
gaagaccatgtggagacttcat

SEQ ID NO: 5612369 - DNA, 15 bp, Homo sapiens
gaagacccaaaacag

SEQ ID NO: 5612370 - DNA, 20 bp, Homo sapiens
gaagacccaaaacagctttg

SEQ ID NO: 5612371 - DNA, 15 bp, Homo sapiens
gaagacccacgtgct

SEQ ID NO: 5612372 - DNA, 18 bp, Homo sapiens
gaagacccagcaggaagc

SEQ ID NO: 5612373 - DNA, 20 bp, Homo sapiens
gaagacccaggagagacaga

SEQ ID NO: 5612374 - DNA, 18 bp, Homo sapiens
gaagacccagtgtaaaga

SEQ ID NO: 5612375 - DNA, 22 bp, Homo sapiens
gaagacccattccttcccagag

SEQ ID NO: 5612376 - DNA, 19 bp, Homo sapiens
gaagacccctgactcatca

SEQ ID NO: 5612377 - DNA, 20 bp, Homo sapiens
gaagaccctatctcccacaa

SEQ ID NO: 5612378 - DNA, 15 bp, Homo sapiens
gaagaccctcagtta

SEQ ID NO: 5612379 - DNA, 17 bp, Homo sapiens
gaagaccctcttgccca

SEQ ID NO: 5612380 - DNA, 16 bp, Homo sapiens
gaagaccgaattttat

SEQ ID NO: 5612381 - DNA, 22 bp, Homo sapiens
gaagaccgtttacctagaagaa

SEQ ID NO: 5612382 - DNA, 19 bp, Homo sapiens
gaagacctcacctagaaat

SEQ ID NO: 5612383 - DNA, 17 bp, Homo sapiens
gaagacctgagaatgta

SEQ ID NO: 5612384 - DNA, 21 bp, Homo sapiens
gaagacctttattcacccctg

SEQ ID NO: 5612385 - DNA, 23 bp, Homo sapiens
gaagacgagcatccccctcctct

SEQ ID NO: 5612386 - DNA, 22 bp, Homo sapiens
gaagacgaggccctcgggccca

SEQ ID NO: 5612387 - DNA, 16 bp, Homo sapiens
gaagacgatgtgttga

SEQ ID NO: 5612388 - DNA, 19 bp, Homo sapiens
gaagacgcagagcaaatga

SEQ ID NO: 5612389 - DNA, 20 bp, Homo sapiens
gaagacgggaggggaggcat

SEQ ID NO: 5612390 - DNA, 16 bp, Homo sapiens
gaagacgtcaggggca

SEQ ID NO: 5612391 - DNA, 19 bp, Homo sapiens
gaagacgtcaggggcaagg

SEQ ID NO: 5612392 - DNA, 22 bp, Homo sapiens
gaagactagttatatattcctt

SEQ ID NO: 5612393 - DNA, 22 bp, Homo sapiens
gaagactcaggagtctgccact

SEQ ID NO: 5612394 - DNA, 18 bp, Homo sapiens
gaagactcattcttctgt

SEQ ID NO: 5612395 - DNA, 19 bp, Homo sapiens
gaagactcattcttctgta

SEQ ID NO: 5612396 - DNA, 21 bp, Homo sapiens
gaagactcattcttctgtacg

SEQ ID NO: 5612397 - DNA, 14 bp, Homo sapiens
gaagactccagaaa

SEQ ID NO: 5612398 - DNA, 19 bp, Homo sapiens
gaagactctccactgacct

SEQ ID NO: 5612399 - DNA, 18 bp, Homo sapiens
gaagactctggagccaag

SEQ ID NO: 5612400 - DNA, 19 bp, Homo sapiens
gaagactctggagccaagg

SEQ ID NO: 5612401 - DNA, 23 bp, Homo sapiens
gaagactctggagccaaggcaga

SEQ ID NO: 5612402 - DNA, 16 bp, Homo sapiens
gaagactgagaacttt

SEQ ID NO: 5612403 - DNA, 15 bp, Homo sapiens
gaagactgagccaga

SEQ ID NO: 5612404 - DNA, 13 bp, Homo sapiens
gaagactgcacag

SEQ ID NO: 5612405 - DNA, 19 bp, Homo sapiens
gaagactgcattatattta

SEQ ID NO: 5612406 - DNA, 12 bp, Homo sapiens
gaagactggaag

SEQ ID NO: 5612407 - DNA, 15 bp, Homo sapiens
gaagactggaagcta

SEQ ID NO: 5612408 - DNA, 18 bp, Homo sapiens
gaagactggagaaatgct

SEQ ID NO: 5612409 - DNA, 21 bp, Homo sapiens
gaagactgtattttcaggaag

SEQ ID NO: 5612410 - DNA, 12 bp, Homo sapiens
gaagactgtggc

SEQ ID NO: 5612411 - DNA, 22 bp, Homo sapiens
gaagacttaactggcccagaag

SEQ ID NO: 5612412 - DNA, 15 bp, Homo sapiens
gaagacttaattctg

SEQ ID NO: 5612413 - DNA, 15 bp, Homo sapiens
gaagacttcatccct

SEQ ID NO: 5612414 - DNA, 16 bp, Homo sapiens
gaagacttcatccctc

SEQ ID NO: 5612415 - DNA, 19 bp, Homo sapiens
gaagacttcatccctctgg

SEQ ID NO: 5612416 - DNA, 16 bp, Homo sapiens
gaagacttcctctcta

SEQ ID NO: 5612417 - DNA, 22 bp, Homo sapiens
gaagactttgtgactgtcactt

SEQ ID NO: 5612418 - DNA, 21 bp, Homo sapiens
gaagagaaaaaaaggaaaaga

SEQ ID NO: 5612419 - DNA, 23 bp, Homo sapiens
gaagagaaaaaggctgaaaagaa

SEQ ID NO: 5612420 - DNA, 12 bp, Homo sapiens
gaagagaaacag

SEQ ID NO: 5612421 - DNA, 13 bp, Homo sapiens
gaagagaaacagg

SEQ ID NO: 5612422 - DNA, 10 bp, Homo sapiens
gaagagaaag

SEQ ID NO: 5612423 - DNA, 12 bp, Homo sapiens
gaagagaaagac

SEQ ID NO: 5612424 - DNA, 15 bp, Homo sapiens
gaagagaaccagcca

SEQ ID NO: 5612425 - DNA, 14 bp, Homo sapiens
gaagagaagagaaa

SEQ ID NO: 5612426 - DNA, 13 bp, Homo sapiens
gaagagaagctga

SEQ ID NO: 5612427 - DNA, 16 bp, Homo sapiens
gaagagaagctgagaa

SEQ ID NO: 5612428 - DNA, 14 bp, Homo sapiens
gaagagaaggggag

SEQ ID NO: 5612429 - DNA, 16 bp, Homo sapiens
gaagagaaggggagaa

SEQ ID NO: 5612430 - DNA, 16 bp, Homo sapiens
gaagagaatcaaggcc

SEQ ID NO: 5612431 - DNA, 17 bp, Homo sapiens
gaagagaatcaaggccg

SEQ ID NO: 5612432 - DNA, 15 bp, Homo sapiens
gaagagacaggcacc

SEQ ID NO: 5612433 - DNA, 11 bp, Homo sapiens
gaagagagaga

SEQ ID NO: 5612434 - DNA, 15 bp, Homo sapiens
gaagagagagaccct

SEQ ID NO: 5612435 - DNA, 13 bp, Homo sapiens
gaagagagagaga

SEQ ID NO: 5612436 - DNA, 12 bp, Homo sapiens
gaagagagagcc

SEQ ID NO: 5612437 - DNA, 14 bp, Homo sapiens
gaagagagagccat

SEQ ID NO: 5612438 - DNA, 18 bp, Homo sapiens
gaagagagatatatctga

SEQ ID NO: 5612439 - DNA, 19 bp, Homo sapiens
gaagagagatatatctgaa

SEQ ID NO: 5612440 - DNA, 14 bp, Homo sapiens
gaagagaggagagg

SEQ ID NO: 5612441 - DNA, 18 bp, Homo sapiens
gaagagaggagttcaatg

SEQ ID NO: 5612442 - DNA, 21 bp, Homo sapiens
gaagagaggagttcaatgatc

SEQ ID NO: 5612443 - DNA, 13 bp, Homo sapiens
gaagagaggcacc

SEQ ID NO: 5612444 - DNA, 22 bp, Homo sapiens
gaagagaggggaagaatttaat

SEQ ID NO: 5612445 - DNA, 21 bp, Homo sapiens
gaagagaggtgccggggaggg

SEQ ID NO: 5612446 - DNA, 19 bp, Homo sapiens
gaagagagtatggtgctgg

SEQ ID NO: 5612447 - DNA, 21 bp, Homo sapiens
gaagagagtccatatttcaat

SEQ ID NO: 5612448 - DNA, 14 bp, Homo sapiens
gaagagagttctgg

SEQ ID NO: 5612449 - DNA, 16 bp, Homo sapiens
gaagagatcaggaaga

SEQ ID NO: 5612450 - DNA, 16 bp, Homo sapiens
gaagagatccaaagac

SEQ ID NO: 5612451 - DNA, 17 bp, Homo sapiens
gaagagatccaaagact

SEQ ID NO: 5612452 - DNA, 21 bp, Homo sapiens
gaagagatccttccattccat

SEQ ID NO: 5612453 - DNA, 17 bp, Homo sapiens
gaagagatgacaaacca

SEQ ID NO: 5612454 - DNA, 22 bp, Homo sapiens
gaagagatgacaaaccataact

SEQ ID NO: 5612455 - DNA, 15 bp, Homo sapiens
gaagagatgtttaca

SEQ ID NO: 5612456 - DNA, 14 bp, Homo sapiens
gaagagattgctga

SEQ ID NO: 5612457 - DNA, 15 bp, Homo sapiens
gaagagatttttcat

SEQ ID NO: 5612458 - DNA, 16 bp, Homo sapiens
gaagagcaaaaatatc

SEQ ID NO: 5612459 - DNA, 22 bp, Homo sapiens
gaagagcaaaaatatcccttcc

SEQ ID NO: 5612460 - DNA, 18 bp, Homo sapiens
gaagagcacagagccctg

SEQ ID NO: 5612461 - DNA, 14 bp, Homo sapiens
gaagagcacagccc

SEQ ID NO: 5612462 - DNA, 23 bp, Homo sapiens
gaagagcacggtcccccaggagg

SEQ ID NO: 5612463 - DNA, 12 bp, Homo sapiens
gaagagcagcct

SEQ ID NO: 5612464 - DNA, 18 bp, Homo sapiens
gaagagcaggactccagg

SEQ ID NO: 5612465 - DNA, 15 bp, Homo sapiens
gaagccaacttggct

SEQ ID NO: 5612466 - DNA, 18 bp, Homo sapiens
gaagccaacttggctttc

SEQ ID NO: 5612467 - DNA, 14 bp, Homo sapiens
gaagccaagacagt

SEQ ID NO: 5612468 - DNA, 15 bp, Homo sapiens
gaagccaagcctgga

SEQ ID NO: 5612469 - DNA, 18 bp, Homo sapiens
gaagccaagctccctgga

SEQ ID NO: 5612470 - DNA, 20 bp, Homo sapiens
gaagccaagctccctggagc

SEQ ID NO: 5612471 - DNA, 23 bp, Homo sapiens
gaagccaagctccctggagccct

SEQ ID NO: 5612472 - DNA, 14 bp, Homo sapiens
gaagccaagggaaa

SEQ ID NO: 5612473 - DNA, 20 bp, Homo sapiens
gaagccaagtaaagtgctta

SEQ ID NO: 5612474 - DNA, 13 bp, Homo sapiens
gaagccaagtggg

SEQ ID NO: 5612475 - DNA, 21 bp, Homo sapiens
gaagccaagtggggtgctggg

SEQ ID NO: 5612476 - DNA, 23 bp, Homo sapiens
gaagccaagtggggtgctgggag

SEQ ID NO: 5612477 - DNA, 22 bp, Homo sapiens
gaagccacacagcccagaaggc

SEQ ID NO: 5612478 - DNA, 12 bp, Homo sapiens
gaagccacagaa

SEQ ID NO: 5612479 - DNA, 19 bp, Homo sapiens
gaagccacagcccaggcct

SEQ ID NO: 5612480 - DNA, 14 bp, Homo sapiens
gaagccacaggcct

SEQ ID NO: 5612481 - DNA, 16 bp, Homo sapiens
gaagccacaggcctgg

SEQ ID NO: 5612482 - DNA, 19 bp, Homo sapiens
gaagccacaggcctggcct

SEQ ID NO: 5612483 - DNA, 12 bp, Homo sapiens
gaagccacatcg

SEQ ID NO: 5612484 - DNA, 21 bp, Homo sapiens
gaagccaccatgtatgtggaa

SEQ ID NO: 5612485 - DNA, 14 bp, Homo sapiens
gaagccaccctggg

SEQ ID NO: 5612486 - DNA, 16 bp, Homo sapiens
gaagccacccttccct

SEQ ID NO: 5612487 - DNA, 20 bp, Homo sapiens
gaagccacccttccctgcct

SEQ ID NO: 5612488 - DNA, 21 bp, Homo sapiens
gaagccacccttccctgcctc

SEQ ID NO: 5612489 - DNA, 22 bp, Homo sapiens
gaagccacccttccctgcctcc

SEQ ID NO: 5612490 - DNA, 20 bp, Homo sapiens
gaagccacgggtgccagaag

SEQ ID NO: 5612491 - DNA, 17 bp, Homo sapiens
gaagccacgtgctggag

SEQ ID NO: 5612492 - DNA, 18 bp, Homo sapiens
gaagccacgtgctggaga

SEQ ID NO: 5612493 - DNA, 21 bp, Homo sapiens
gaagccacgtgctggagagta

SEQ ID NO: 5612494 - DNA, 13 bp, Homo sapiens
gaagccactggac

SEQ ID NO: 5612495 - DNA, 17 bp, Homo sapiens
gaagccacttggcccag

SEQ ID NO: 5612496 - DNA, 22 bp, Homo sapiens
gaagccactttctacaggccag

SEQ ID NO: 5612497 - DNA, 21 bp, Homo sapiens
gaagccagaaggtgcaggggc

SEQ ID NO: 5612498 - DNA, 13 bp, Homo sapiens
gaagccagagccc

SEQ ID NO: 5612499 - DNA, 14 bp, Homo sapiens
gaagccagccacag

SEQ ID NO: 5612500 - DNA, 18 bp, Homo sapiens
gaagccagccacagaccc

SEQ ID NO: 5612501 - DNA, 12 bp, Homo sapiens
gaagccagcctt

SEQ ID NO: 5612502 - DNA, 20 bp, Homo sapiens
gaagccagccttcttccatc

SEQ ID NO: 5612503 - DNA, 13 bp, Homo sapiens
gaagccagctgcc

SEQ ID NO: 5612504 - DNA, 12 bp, Homo sapiens
gaagccagctgg

SEQ ID NO: 5612505 - DNA, 13 bp, Homo sapiens
gaagccagcttgt

SEQ ID NO: 5612506 - DNA, 18 bp, Homo sapiens
gaagccagcttgtttaca

SEQ ID NO: 5612507 - DNA, 24 bp, Homo sapiens
gaagccaggaatttcccaggaccc

SEQ ID NO: 5612508 - DNA, 20 bp, Homo sapiens
gaagccaggaggcctgcacc

SEQ ID NO: 5612509 - DNA, 14 bp, Homo sapiens
gaagccaggtacag

SEQ ID NO: 5612510 - DNA, 19 bp, Homo sapiens
gaagccaggtacaggagag

SEQ ID NO: 5612511 - DNA, 17 bp, Homo sapiens
gaagccagtggagctgg

SEQ ID NO: 5612512 - DNA, 20 bp, Homo sapiens
gaagccagtggagctggtct

SEQ ID NO: 5612513 - DNA, 13 bp, Homo sapiens
gaagccagtgtct

SEQ ID NO: 5612514 - DNA, 18 bp, Homo sapiens
gaagccagtgtctaggca

SEQ ID NO: 5612515 - DNA, 21 bp, Homo sapiens
gaagccatagatgctggctgg

SEQ ID NO: 5612516 - DNA, 21 bp, Homo sapiens
gaagccatagggggctgcacg

SEQ ID NO: 5612517 - DNA, 20 bp, Homo sapiens
gaagccatattcacacctca

SEQ ID NO: 5612518 - DNA, 20 bp, Homo sapiens
gaagccatcacctcagatgg

SEQ ID NO: 5612519 - DNA, 22 bp, Homo sapiens
gaagccatcacctcagatggca

SEQ ID NO: 5612520 - DNA, 18 bp, Homo sapiens
gaagccatcacttctccc

SEQ ID NO: 5612521 - DNA, 19 bp, Homo sapiens
gaagccatcacttctcccc

SEQ ID NO: 5612522 - DNA, 14 bp, Homo sapiens
gaagccatgtgggg

SEQ ID NO: 5612523 - DNA, 22 bp, Homo sapiens
gaagccatgtggggttgctgaa

SEQ ID NO: 5612524 - DNA, 19 bp, Homo sapiens
gaagccatttagagggtga

SEQ ID NO: 5612525 - DNA, 15 bp, Homo sapiens
gaagcccaagtgaaa

SEQ ID NO: 5612526 - DNA, 18 bp, Homo sapiens
gaagcccaattgctggag

SEQ ID NO: 5612527 - DNA, 21 bp, Homo sapiens
gaagcccacactatgcacaga

SEQ ID NO: 5612528 - DNA, 11 bp, Homo sapiens
gaagcccaccc

SEQ ID NO: 5612529 - DNA, 15 bp, Homo sapiens
gaagcccacccgccc

SEQ ID NO: 5612530 - DNA, 15 bp, Homo sapiens
gaagcccactgcctc

SEQ ID NO: 5612531 - DNA, 18 bp, Homo sapiens
gaagcccactgcctcctc

SEQ ID NO: 5612532 - DNA, 22 bp, Homo sapiens
gaagcccactgcctcctccctg

SEQ ID NO: 5612533 - DNA, 23 bp, Homo sapiens
gaagcccactgcctcctccctgg

SEQ ID NO: 5612534 - DNA, 17 bp, Homo sapiens
gaagcccagcccaagca

SEQ ID NO: 5612535 - DNA, 18 bp, Homo sapiens
gaagcccagcccaagcac

SEQ ID NO: 5612536 - DNA, 23 bp, Homo sapiens
gaagcccagcccctactgctgtg

SEQ ID NO: 5612537 - DNA, 13 bp, Homo sapiens
gaagcccagctcc

SEQ ID NO: 5612538 - DNA, 13 bp, Homo sapiens
gaagcccaggaaa

SEQ ID NO: 5612539 - DNA, 23 bp, Homo sapiens
gaagcccaggaaaggctccagga

SEQ ID NO: 5612540 - DNA, 14 bp, Homo sapiens
gaagcccaggagcc

SEQ ID NO: 5612541 - DNA, 20 bp, Homo sapiens
gaagcccaggaggacctggg

SEQ ID NO: 5612542 - DNA, 17 bp, Homo sapiens
gaagcccaggctgaaga

SEQ ID NO: 5612543 - DNA, 16 bp, Homo sapiens
gaagcccatcctgacc

SEQ ID NO: 5612544 - DNA, 21 bp, Homo sapiens
gaagcccatcctgaccagctg

SEQ ID NO: 5612545 - DNA, 16 bp, Homo sapiens
gaagcccatgtcttct

SEQ ID NO: 5612546 - DNA, 18 bp, Homo sapiens
gaagcccattcattagaa

SEQ ID NO: 5612547 - DNA, 21 bp, Homo sapiens
gaagcccattcctctgccagg

SEQ ID NO: 5612548 - DNA, 17 bp, Homo sapiens
gaagccccaacgggaaa

SEQ ID NO: 5612549 - DNA, 22 bp, Homo sapiens
gaagccccaacgggaaaggaaa

SEQ ID NO: 5612550 - DNA, 14 bp, Homo sapiens
gaagccccacacca

SEQ ID NO: 5612551 - DNA, 19 bp, Homo sapiens
gaagccccatttgcacagg

SEQ ID NO: 5612552 - DNA, 20 bp, Homo sapiens
gaagcccccaccgtgggcag

SEQ ID NO: 5612553 - DNA, 17 bp, Homo sapiens
gaagcccccagctaaga

SEQ ID NO: 5612554 - DNA, 22 bp, Homo sapiens
gaagcccccagctaagaacctg

SEQ ID NO: 5612555 - DNA, 22 bp, Homo sapiens
gaagcccctgtcgcccacccag

SEQ ID NO: 5612556 - DNA, 15 bp, Homo sapiens
gaagccccttggaga

SEQ ID NO: 5612557 - DNA, 19 bp, Homo sapiens
gaagccccttggagagaga

SEQ ID NO: 5612558 - DNA, 15 bp, Homo sapiens
gaagcccggctcctg

SEQ ID NO: 5612559 - DNA, 17 bp, Homo sapiens
gaagcccggctcctggt

SEQ ID NO: 5612560 - DNA, 20 bp, Homo sapiens
gaagccctagtagctggcgc

SEQ ID NO: 5612561 - DNA, 11 bp, Homo sapiens
gaagccctcct

SEQ ID NO: 5612562 - DNA, 16 bp, Homo sapiens
gaagccctccttccac

SEQ ID NO: 5612563 - DNA, 17 bp, Homo sapiens
gaagccctccttgccac

SEQ ID NO: 5612564 - DNA, 23 bp, Homo sapiens
gaagccctcggcctccagactgc

SEQ ID NO: 5612565 - DNA, 18 bp, Homo sapiens
gaagccctggatttcaga

SEQ ID NO: 5612566 - DNA, 19 bp, Homo sapiens
gaagccctggatttcagaa

SEQ ID NO: 5612567 - DNA, 11 bp, Homo sapiens
gaagccctgtt

SEQ ID NO: 5612568 - DNA, 24 bp, Homo sapiens
gaagcccttagggagagcacctgt

SEQ ID NO: 5612569 - DNA, 14 bp, Homo sapiens
gaagcccttccagt

SEQ ID NO: 5612570 - DNA, 15 bp, Homo sapiens
gaagcccttccagtg

SEQ ID NO: 5612571 - DNA, 16 bp, Homo sapiens
gaagcccttccagtgg

SEQ ID NO: 5612572 - DNA, 21 bp, Homo sapiens
gaagccgactctggccctggc

SEQ ID NO: 5612573 - DNA, 16 bp, Homo sapiens
gaagccgccaggaccg

SEQ ID NO: 5612574 - DNA, 23 bp, Homo sapiens
gaagccgccaggaccgccaaaga

SEQ ID NO: 5612575 - DNA, 20 bp, Homo sapiens
gaagccgcctagtgcagaga

SEQ ID NO: 5612576 - DNA, 16 bp, Homo sapiens
gaagccgggaacagac

SEQ ID NO: 5612577 - DNA, 21 bp, Homo sapiens
gaagccggggaagagatccaa

SEQ ID NO: 5612578 - DNA, 15 bp, Homo sapiens
gaagccggtgtccct

SEQ ID NO: 5612579 - DNA, 16 bp, Homo sapiens
gaagccggtgtccctg

SEQ ID NO: 5612580 - DNA, 19 bp, Homo sapiens
gaagccgtctgactccaga

SEQ ID NO: 5612581 - DNA, 22 bp, Homo sapiens
gaagccgtctgactccagagtc

SEQ ID NO: 5612582 - DNA, 24 bp, Homo sapiens
gaagccgtctgactccagagtctg

SEQ ID NO: 5612583 - DNA, 16 bp, Homo sapiens
gaagccgtgccctgcc

SEQ ID NO: 5612584 - DNA, 20 bp, Homo sapiens
gaagccgtgctcgccccagc

SEQ ID NO: 5612585 - DNA, 15 bp, Homo sapiens
gaagcctaaataaaa

SEQ ID NO: 5612586 - DNA, 18 bp, Homo sapiens
gaagcctaaataaaaagt

SEQ ID NO: 5612587 - DNA, 19 bp, Homo sapiens
gaagcctcagattccttcc

SEQ ID NO: 5612588 - DNA, 17 bp, Homo sapiens
gaagcctcagctaccca

SEQ ID NO: 5612589 - DNA, 22 bp, Homo sapiens
gaagcctccacaccagctgctg

SEQ ID NO: 5612590 - DNA, 13 bp, Homo sapiens
gaagcctccacct

SEQ ID NO: 5612591 - DNA, 17 bp, Homo sapiens
gaagcctccacctgcag

SEQ ID NO: 5612592 - DNA, 20 bp, Homo sapiens
gaagcctccacctgcagccc

SEQ ID NO: 5612593 - DNA, 18 bp, Homo sapiens
gaagcctccgtcaggaga

SEQ ID NO: 5612594 - DNA, 19 bp, Homo sapiens
gaagcctccgtcaggagag

SEQ ID NO: 5612595 - DNA, 15 bp, Homo sapiens
gaagcctcctgctga

SEQ ID NO: 5612596 - DNA, 15 bp, Homo sapiens
gaagcctccttacat

SEQ ID NO: 5612597 - DNA, 17 bp, Homo sapiens
gaagcctccttacatta

SEQ ID NO: 5612598 - DNA, 19 bp, Homo sapiens
gaagcctccttacattaaa

SEQ ID NO: 5612599 - DNA, 21 bp, Homo sapiens
gaagcctccttacattaaaaa

SEQ ID NO: 5612600 - DNA, 19 bp, Homo sapiens
gaagcctccttagaaaaaa

SEQ ID NO: 5612601 - DNA, 21 bp, Homo sapiens
gaagcctctgccctgcctccc

SEQ ID NO: 5612602 - DNA, 19 bp, Homo sapiens
gaagcctctgcctccctag

SEQ ID NO: 5612603 - DNA, 13 bp, Homo sapiens
gaagcctctggct

SEQ ID NO: 5612604 - DNA, 12 bp, Homo sapiens
gaagcctgagca

SEQ ID NO: 5612605 - DNA, 12 bp, Homo sapiens
gaagcctgaggc

SEQ ID NO: 5612606 - DNA, 13 bp, Homo sapiens
gaagcctgaggct

SEQ ID NO: 5612607 - DNA, 19 bp, Homo sapiens
gaagcctgcctggaagagc

SEQ ID NO: 5612608 - DNA, 13 bp, Homo sapiens
gaagcctggaaca

SEQ ID NO: 5612609 - DNA, 12 bp, Homo sapiens
gaagcctggacg

SEQ ID NO: 5612610 - DNA, 17 bp, Homo sapiens
gaagcctggacgcagcc

SEQ ID NO: 5612611 - DNA, 20 bp, Homo sapiens
gaagcctggacgcagccaca

SEQ ID NO: 5612612 - DNA, 14 bp, Homo sapiens
gaagcctggattcc

SEQ ID NO: 5612613 - DNA, 20 bp, Homo sapiens
gaagcctggattccagcagt

SEQ ID NO: 5612614 - DNA, 16 bp, Homo sapiens
gaagcctgggggcctg

SEQ ID NO: 5612615 - DNA, 19 bp, Homo sapiens
gaagcctgggggcctggct

SEQ ID NO: 5612616 - DNA, 22 bp, Homo sapiens
gaagcctgggggcctggctggc

SEQ ID NO: 5612617 - DNA, 10 bp, Homo sapiens
gaagcctgtc

SEQ ID NO: 5612618 - DNA, 16 bp, Homo sapiens
gaagcctgtcctcacc

SEQ ID NO: 5612619 - DNA, 18 bp, Homo sapiens
gaagcctgtgccacctgc

SEQ ID NO: 5612620 - DNA, 15 bp, Homo sapiens
gaagccttaagccat

SEQ ID NO: 5612621 - DNA, 23 bp, Homo sapiens
gaagccttaagccataggcccag

SEQ ID NO: 5612622 - DNA, 19 bp, Homo sapiens
gaagccttaatttgcacag

SEQ ID NO: 5612623 - DNA, 20 bp, Homo sapiens
gaagccttaatttgcacagt

SEQ ID NO: 5612624 - DNA, 17 bp, Homo sapiens
gaagccttaccacgcag

SEQ ID NO: 5612625 - DNA, 18 bp, Homo sapiens
gaagccttaccacgcagt

SEQ ID NO: 5612626 - DNA, 14 bp, Homo sapiens
gaagccttagccag

SEQ ID NO: 5612627 - DNA, 18 bp, Homo sapiens
gaagccttcaagctctga

SEQ ID NO: 5612628 - DNA, 22 bp, Homo sapiens
gaagccttcaagctctgaggga

SEQ ID NO: 5612629 - DNA, 20 bp, Homo sapiens
gaagccttcccccagcaagg

SEQ ID NO: 5612630 - DNA, 17 bp, Homo sapiens
gaagccttctgcagcag

SEQ ID NO: 5612631 - DNA, 23 bp, Homo sapiens
gaagccttcttctgccacttctg

SEQ ID NO: 5612632 - DNA, 16 bp, Homo sapiens
gaagccttggaaccag

SEQ ID NO: 5612633 - DNA, 21 bp, Homo sapiens
gaagccttggggctgatgcag

SEQ ID NO: 5612634 - DNA, 14 bp, Homo sapiens
gaagcctttatcta

SEQ ID NO: 5612635 - DNA, 18 bp, Homo sapiens
gaagcctttgggaagggg

SEQ ID NO: 5612636 - DNA, 19 bp, Homo sapiens
gaagcctttggtgaattcc

SEQ ID NO: 5612637 - DNA, 18 bp, Homo sapiens
gaagccttttccataaag

SEQ ID NO: 5612638 - DNA, 22 bp, Homo sapiens
gaagccttttccataaagtgta

SEQ ID NO: 5612639 - DNA, 15 bp, Homo sapiens
gaagccttttcctga

SEQ ID NO: 5612640 - DNA, 23 bp, Homo sapiens
gaagccttttcctgaggtcatct

SEQ ID NO: 5612641 - DNA, 23 bp, Homo sapiens
gaaggggggccgccgctgaccct

SEQ ID NO: 5612642 - DNA, 23 bp, Homo sapiens
gaaggggggttgcagtggagagg

SEQ ID NO: 5612643 - DNA, 20 bp, Homo sapiens
gaagggggtcaaagcaagga

SEQ ID NO: 5612644 - DNA, 18 bp, Homo sapiens
gaagggggtccacccagc

SEQ ID NO: 5612645 - DNA, 19 bp, Homo sapiens
gaagggggtggtgtctcca

SEQ ID NO: 5612646 - DNA, 16 bp, Homo sapiens
gaagggggtgtgcgtg

SEQ ID NO: 5612647 - DNA, 17 bp, Homo sapiens
gaaggggtagggatttg

SEQ ID NO: 5612648 - DNA, 14 bp, Homo sapiens
gaaggggtcctgca

SEQ ID NO: 5612649 - DNA, 15 bp, Homo sapiens
gaaggggtcctgcag

SEQ ID NO: 5612650 - DNA, 18 bp, Homo sapiens
gaaggggtcctgcagggg

SEQ ID NO: 5612651 - DNA, 18 bp, Homo sapiens
gaaggggtgcaggtgggg

SEQ ID NO: 5612652 - DNA, 17 bp, Homo sapiens
gaaggggtgctgtgagg

SEQ ID NO: 5612653 - DNA, 21 bp, Homo sapiens
gaaggggtgctgtgaggcttg

SEQ ID NO: 5612654 - DNA, 14 bp, Homo sapiens
gaaggggttttctt

SEQ ID NO: 5612655 - DNA, 13 bp, Homo sapiens
gaagggtaaagaa

SEQ ID NO: 5612656 - DNA, 23 bp, Homo sapiens
gaagggtatgtcacaaagagctg

SEQ ID NO: 5612657 - DNA, 15 bp, Homo sapiens
gaagggtcatttctc

SEQ ID NO: 5612658 - DNA, 14 bp, Homo sapiens
gaagggtccggctt

SEQ ID NO: 5612659 - DNA, 16 bp, Homo sapiens
gaagggtcctgccggt

SEQ ID NO: 5612660 - DNA, 21 bp, Homo sapiens
gaagggtctctctccaggtca

SEQ ID NO: 5612661 - DNA, 17 bp, Homo sapiens
gaagggtgcctggctgg

SEQ ID NO: 5612662 - DNA, 21 bp, Homo sapiens
gaagggtggatgacagggcag

SEQ ID NO: 5612663 - DNA, 14 bp, Homo sapiens
gaagggtggctttg

SEQ ID NO: 5612664 - DNA, 14 bp, Homo sapiens
gaagggtgggccct

SEQ ID NO: 5612665 - DNA, 20 bp, Homo sapiens
gaagggttagacaagcctgg

SEQ ID NO: 5612666 - DNA, 18 bp, Homo sapiens
gaagggttctgccctgcc

SEQ ID NO: 5612667 - DNA, 23 bp, Homo sapiens
gaagggttctgccctgcctgagg

SEQ ID NO: 5612668 - DNA, 19 bp, Homo sapiens
gaagggttggtgggctggc

SEQ ID NO: 5612669 - DNA, 21 bp, Homo sapiens
gaagggttggtgggctggccc

SEQ ID NO: 5612670 - DNA, 23 bp, Homo sapiens
gaagggttggtgggctggcccag

SEQ ID NO: 5612671 - DNA, 13 bp, Homo sapiens
gaagggtttctct

SEQ ID NO: 5612672 - DNA, 15 bp, Homo sapiens
gaagggttttctttt

SEQ ID NO: 5612673 - DNA, 13 bp, Homo sapiens
gaaggtaattaaa

SEQ ID NO: 5612674 - DNA, 16 bp, Homo sapiens
gaaggtagaatgtttt

SEQ ID NO: 5612675 - DNA, 20 bp, Homo sapiens
gaaggtagaatgttttcaaa

SEQ ID NO: 5612676 - DNA, 19 bp, Homo sapiens
gaaggtagcattctttgga

SEQ ID NO: 5612677 - DNA, 17 bp, Homo sapiens
gaaggtattggcctgtt

SEQ ID NO: 5612678 - DNA, 23 bp, Homo sapiens
gaaggtcacgctgaatgagaagt

SEQ ID NO: 5612679 - DNA, 21 bp, Homo sapiens
gaaggtcactcttcctgcaag

SEQ ID NO: 5612680 - DNA, 20 bp, Homo sapiens
gaaggtcagcgagaaggagt

SEQ ID NO: 5612681 - DNA, 21 bp, Homo sapiens
gaaggtcccacagccctgaga

SEQ ID NO: 5612682 - DNA, 21 bp, Homo sapiens
gaaggtcccatggcctgctgg

SEQ ID NO: 5612683 - DNA, 16 bp, Homo sapiens
gaaggtcccctggcag

SEQ ID NO: 5612684 - DNA, 20 bp, Homo sapiens
gaaggtcccctggcagtgct

SEQ ID NO: 5612685 - DNA, 17 bp, Homo sapiens
gaaggtcctaagggagt

SEQ ID NO: 5612686 - DNA, 23 bp, Homo sapiens
gaaggtccttgcctgaactccag

SEQ ID NO: 5612687 - DNA, 17 bp, Homo sapiens
gaaggtctcatgcctga

SEQ ID NO: 5612688 - DNA, 20 bp, Homo sapiens
gaaggtctcatgcctgagaa

SEQ ID NO: 5612689 - DNA, 15 bp, Homo sapiens
gaaggtctcattctt

SEQ ID NO: 5612690 - DNA, 21 bp, Homo sapiens
gaaggtctccaagggagggtg

SEQ ID NO: 5612691 - DNA, 16 bp, Homo sapiens
gaaggtctctctggct

SEQ ID NO: 5612692 - DNA, 21 bp, Homo sapiens
gaaggtctgatttgcaggatt

SEQ ID NO: 5612693 - DNA, 15 bp, Homo sapiens
gaaggtctttgttat

SEQ ID NO: 5612694 - DNA, 19 bp, Homo sapiens
gaaggtcttttgagggcta

SEQ ID NO: 5612695 - DNA, 12 bp, Homo sapiens
gaaggtgaatag

SEQ ID NO: 5612696 - DNA, 11 bp, Homo sapiens
gaaggtgacac

SEQ ID NO: 5612697 - DNA, 14 bp, Homo sapiens
gaaggtgacagcag

SEQ ID NO: 5612698 - DNA, 15 bp, Homo sapiens
gaaggtgacagcagt

SEQ ID NO: 5612699 - DNA, 12 bp, Homo sapiens
gaaggtgagagg

SEQ ID NO: 5612700 - DNA, 21 bp, Homo sapiens
gaaggtgaggagcttgaaacc

SEQ ID NO: 5612701 - DNA, 14 bp, Homo sapiens
gaaggtgatggggg

SEQ ID NO: 5612702 - DNA, 21 bp, Homo sapiens
gaaggtgatttaagggcccag

SEQ ID NO: 5612703 - DNA, 13 bp, Homo sapiens
gaaggtgattttt

SEQ ID NO: 5612704 - DNA, 20 bp, Homo sapiens
gaaggtgccagaaggaaggt

SEQ ID NO: 5612705 - DNA, 15 bp, Homo sapiens
gaaggtgcctcagac

SEQ ID NO: 5612706 - DNA, 13 bp, Homo sapiens
gaaggtgcctgcc

SEQ ID NO: 5612707 - DNA, 18 bp, Homo sapiens
gaaggtgcctgccatagc

SEQ ID NO: 5612708 - DNA, 22 bp, Homo sapiens
gaaggtgcctgccatagccagg

SEQ ID NO: 5612709 - DNA, 14 bp, Homo sapiens
gaaggtgcctggcc

SEQ ID NO: 5612710 - DNA, 21 bp, Homo sapiens
gaaggtgctgacggccaggga

SEQ ID NO: 5612711 - DNA, 14 bp, Homo sapiens
gaaggtgctgagct

SEQ ID NO: 5612712 - DNA, 22 bp, Homo sapiens
gaaggtgctgagcttagccttg

SEQ ID NO: 5612713 - DNA, 12 bp, Homo sapiens
gaaggtgctgga

SEQ ID NO: 5612714 - DNA, 20 bp, Homo sapiens
gaaggtgctggaggtgggag

SEQ ID NO: 5612715 - DNA, 21 bp, Homo sapiens
gaaggtgctggaggtgggagc

SEQ ID NO: 5612716 - DNA, 18 bp, Homo sapiens
gaaggtggaagttgcagt

SEQ ID NO: 5612717 - DNA, 20 bp, Homo sapiens
gaaggtggaggttgcggtga

SEQ ID NO: 5612718 - DNA, 22 bp, Homo sapiens
gaaggtggatggccccagcaca

SEQ ID NO: 5612719 - DNA, 14 bp, Homo sapiens
gaaggtggccacag

SEQ ID NO: 5612720 - DNA, 23 bp, Homo sapiens
gaaggtggccacagcaagtacag

SEQ ID NO: 5612721 - DNA, 14 bp, Homo sapiens
gaaggtgggaggat

SEQ ID NO: 5612722 - DNA, 23 bp, Homo sapiens
gaaggtgggggttggctgggtac

SEQ ID NO: 5612723 - DNA, 16 bp, Homo sapiens
gaaggtgggtgaggct

SEQ ID NO: 5612724 - DNA, 13 bp, Homo sapiens
gaaggtggtggca

SEQ ID NO: 5612725 - DNA, 21 bp, Homo sapiens
gaaggtggtggggctgccgga

SEQ ID NO: 5612726 - DNA, 22 bp, Homo sapiens
gaaggtgtctggacattcagaa

SEQ ID NO: 5612727 - DNA, 14 bp, Homo sapiens
gaaggtgtgctaca

SEQ ID NO: 5612728 - DNA, 23 bp, Homo sapiens
gaaggtgtgtcctcaagaagaaa

SEQ ID NO: 5612729 - DNA, 19 bp, Homo sapiens
gaaggtgttggacagggga

SEQ ID NO: 5612730 - DNA, 18 bp, Homo sapiens
gaaggttaaaggaaaagc

SEQ ID NO: 5612731 - DNA, 21 bp, Homo sapiens
gaaggttaggtttgtcaacac

SEQ ID NO: 5612732 - DNA, 16 bp, Homo sapiens
gaaggttcttcatgat

SEQ ID NO: 5612733 - DNA, 23 bp, Homo sapiens
gaaggttggtggggggtccagtc

SEQ ID NO: 5612734 - DNA, 18 bp, Homo sapiens
gaaggttgtatgtaaatc

SEQ ID NO: 5612735 - DNA, 19 bp, Homo sapiens
gaaggttgtatgtaaatct

SEQ ID NO: 5612736 - DNA, 20 bp, Homo sapiens
gaaggtttactctgtggcca

SEQ ID NO: 5612737 - DNA, 14 bp, Homo sapiens
gaaggtttattgtt

SEQ ID NO: 5612738 - DNA, 17 bp, Homo sapiens
gaaggtttcagatgagg

SEQ ID NO: 5612739 - DNA, 18 bp, Homo sapiens
gaaggtttgatgccaaag

SEQ ID NO: 5612740 - DNA, 16 bp, Homo sapiens
gaaggtttgtatattg

SEQ ID NO: 5612741 - DNA, 22 bp, Homo sapiens
gaaggtttgtgttttctctgga

SEQ ID NO: 5612742 - DNA, 13 bp, Homo sapiens
gaaggttttaagt

SEQ ID NO: 5612743 - DNA, 21 bp, Homo sapiens
gaaggtttttatgtgcctttt

SEQ ID NO: 5612744 - DNA, 20 bp, Homo sapiens
gaaggttttttttttaagtg

SEQ ID NO: 5612745 - DNA, 23 bp, Homo sapiens
gaaggttttttttttaagtgcaa

SEQ ID NO: 5612746 - DNA, 14 bp, Homo sapiens
gaagtaaaacagtc

SEQ ID NO: 5612747 - DNA, 19 bp, Homo sapiens
gaagtaaaagcaaaaaaga

SEQ ID NO: 5612748 - DNA, 13 bp, Homo sapiens
gaagtaaacagct

SEQ ID NO: 5612749 - DNA, 17 bp, Homo sapiens
gaagtaaactgatgtac

SEQ ID NO: 5612750 - DNA, 14 bp, Homo sapiens
gaagtaaactgcag

SEQ ID NO: 5612751 - DNA, 20 bp, Homo sapiens
gaagtaaactttttgttctg

SEQ ID NO: 5612752 - DNA, 15 bp, Homo sapiens
gaagtaaagaactgc

SEQ ID NO: 5612753 - DNA, 15 bp, Homo sapiens
gaagtaaagccatta

SEQ ID NO: 5612754 - DNA, 20 bp, Homo sapiens
gaagtaaagtttatttcatg

SEQ ID NO: 5612755 - DNA, 19 bp, Homo sapiens
gaagtaaccatttgcactg

SEQ ID NO: 5612756 - DNA, 17 bp, Homo sapiens
gaagtaacccctcctgg

SEQ ID NO: 5612757 - DNA, 19 bp, Homo sapiens
gaagtaactggtgatatat

SEQ ID NO: 5612758 - DNA, 13 bp, Homo sapiens
gaagtaacttatt

SEQ ID NO: 5612759 - DNA, 14 bp, Homo sapiens
gaagtaagaagagg

SEQ ID NO: 5612760 - DNA, 19 bp, Homo sapiens
gaagtaagaagaggagcct

SEQ ID NO: 5612761 - DNA, 23 bp, Homo sapiens
gaagtaagaagaggagcctcaga

SEQ ID NO: 5612762 - DNA, 21 bp, Homo sapiens
gaagtaagagctaagttctaa

SEQ ID NO: 5612763 - DNA, 22 bp, Homo sapiens
gaagtaagcagagttctttgca

SEQ ID NO: 5612764 - DNA, 16 bp, Homo sapiens
gaagtaagcctcatca

SEQ ID NO: 5612765 - DNA, 21 bp, Homo sapiens
gaagtaagggagtcattgcct

SEQ ID NO: 5612766 - DNA, 17 bp, Homo sapiens
gaagtaagtggggttgc

SEQ ID NO: 5612767 - DNA, 22 bp, Homo sapiens
gaagtaagttctgaaaactgtt

SEQ ID NO: 5612768 - DNA, 12 bp, Homo sapiens
gaagtaataact

SEQ ID NO: 5612769 - DNA, 19 bp, Homo sapiens
gaagtaatatgcacacatt

SEQ ID NO: 5612770 - DNA, 19 bp, Homo sapiens
gaagtaattaaggtacatc

SEQ ID NO: 5612771 - DNA, 22 bp, Homo sapiens
gaagtaattatcagttggtttg

SEQ ID NO: 5612772 - DNA, 17 bp, Homo sapiens
gaagtacacctgtgtgg

SEQ ID NO: 5612773 - DNA, 22 bp, Homo sapiens
gaagtacgagccccacagagca

SEQ ID NO: 5612774 - DNA, 15 bp, Homo sapiens
gaagtacgtttttgc

SEQ ID NO: 5612775 - DNA, 19 bp, Homo sapiens
gaagtactaagacccacaa

SEQ ID NO: 5612776 - DNA, 18 bp, Homo sapiens
gaagtactataatttacc

SEQ ID NO: 5612777 - DNA, 15 bp, Homo sapiens
gaagtactggagaaa

SEQ ID NO: 5612778 - DNA, 15 bp, Homo sapiens
gaagtactttgtgct

SEQ ID NO: 5612779 - DNA, 13 bp, Homo sapiens
gaagtacttttaa

SEQ ID NO: 5612780 - DNA, 14 bp, Homo sapiens
gaagtacttttaac

SEQ ID NO: 5612781 - DNA, 20 bp, Homo sapiens
gaagtagaaacaaaatacaa

SEQ ID NO: 5612782 - DNA, 13 bp, Homo sapiens
gaagtagaaaggg

SEQ ID NO: 5612783 - DNA, 17 bp, Homo sapiens
gaagtagacctcttttt

SEQ ID NO: 5612784 - DNA, 16 bp, Homo sapiens
gaagtagagaacccag

SEQ ID NO: 5612785 - DNA, 12 bp, Homo sapiens
gaagtagcacag

SEQ ID NO: 5612786 - DNA, 19 bp, Homo sapiens
gaagtagcttgctccctgt

SEQ ID NO: 5612787 - DNA, 14 bp, Homo sapiens
gaagtagctttgca

SEQ ID NO: 5612788 - DNA, 13 bp, Homo sapiens
gaagtaggaagta

SEQ ID NO: 5612789 - DNA, 16 bp, Homo sapiens
gaagtaggggaagaat

SEQ ID NO: 5612790 - DNA, 21 bp, Homo sapiens
gaagtaggggaagaataattt

SEQ ID NO: 5612791 - DNA, 14 bp, Homo sapiens
gaagtaggtggctt

SEQ ID NO: 5612792 - DNA, 15 bp, Homo sapiens
gaagtagtgtgagtg

SEQ ID NO: 5612793 - DNA, 13 bp, Homo sapiens
gaagtagttatca

SEQ ID NO: 5612794 - DNA, 16 bp, Homo sapiens
gaagtagttatcatgt

SEQ ID NO: 5612795 - DNA, 21 bp, Homo sapiens
gaagtagttatcatgttagta

SEQ ID NO: 5612796 - DNA, 19 bp, Homo sapiens
gaagtataaacccattttg

SEQ ID NO: 5612797 - DNA, 21 bp, Homo sapiens
gaagtatacctggctttttaa

SEQ ID NO: 5612798 - DNA, 15 bp, Homo sapiens
gaagtatacttttcc

SEQ ID NO: 5612799 - DNA, 18 bp, Homo sapiens
gaagtatacttttcccct

SEQ ID NO: 5612800 - DNA, 22 bp, Homo sapiens
gaagtatccaattatgtgacaa

SEQ ID NO: 5612801 - DNA, 23 bp, Homo sapiens
gaagtatccaattatgtgacaac

SEQ ID NO: 5612802 - DNA, 15 bp, Homo sapiens
gaagtatgagtgctg

SEQ ID NO: 5612803 - DNA, 22 bp, Homo sapiens
gaagtatgatttgttcctttct

SEQ ID NO: 5612804 - DNA, 13 bp, Homo sapiens
gaagtatgcacta

SEQ ID NO: 5612805 - DNA, 21 bp, Homo sapiens
gaagtatgtatattaaaaaag

SEQ ID NO: 5612806 - DNA, 16 bp, Homo sapiens
gaagtatgtcagttat

SEQ ID NO: 5612807 - DNA, 17 bp, Homo sapiens
gaagtatgtcttcaaaa

SEQ ID NO: 5612808 - DNA, 13 bp, Homo sapiens
gaagtatgtgtgg

SEQ ID NO: 5612809 - DNA, 15 bp, Homo sapiens
gaagtattataaatt

SEQ ID NO: 5612810 - DNA, 16 bp, Homo sapiens
gaagtattataaatta

SEQ ID NO: 5612811 - DNA, 20 bp, Homo sapiens
gaagtattataaattatgtt

SEQ ID NO: 5612812 - DNA, 18 bp, Homo sapiens
gaagtattatctgtaaaa

SEQ ID NO: 5612813 - DNA, 13 bp, Homo sapiens
gaagtattgctga

SEQ ID NO: 5612814 - DNA, 19 bp, Homo sapiens
gaagtatttatcaggagaa

SEQ ID NO: 5612815 - DNA, 19 bp, Homo sapiens
gaagtattttgctggaata

SEQ ID NO: 5612816 - DNA, 21 bp, Homo sapiens
gaagtattttttcagtattat

SEQ ID NO: 5612817 - DNA, 12 bp, Homo sapiens
gaagtcaaacta

SEQ ID NO: 5612818 - DNA, 15 bp, Homo sapiens
gaatatataaccagt

SEQ ID NO: 5612819 - DNA, 15 bp, Homo sapiens
gaatatatagaattc

SEQ ID NO: 5612820 - DNA, 21 bp, Homo sapiens
gaatatatagtgtatagaagc

SEQ ID NO: 5612821 - DNA, 20 bp, Homo sapiens
gaatatatctctatttgaga

SEQ ID NO: 5612822 - DNA, 19 bp, Homo sapiens
gaatatatgatttgcatgt

SEQ ID NO: 5612823 - DNA, 22 bp, Homo sapiens
gaatatatggcagagttgtaaa

SEQ ID NO: 5612824 - DNA, 19 bp, Homo sapiens
gaatatatggcatttgcag

SEQ ID NO: 5612825 - DNA, 18 bp, Homo sapiens
gaatatattactgattta

SEQ ID NO: 5612826 - DNA, 11 bp, Homo sapiens
gaatatattat

SEQ ID NO: 5612827 - DNA, 12 bp, Homo sapiens
gaatatattata

SEQ ID NO: 5612828 - DNA, 17 bp, Homo sapiens
gaatatatttatttaaa

SEQ ID NO: 5612829 - DNA, 15 bp, Homo sapiens
gaatatcaatataat

SEQ ID NO: 5612830 - DNA, 13 bp, Homo sapiens
gaatatcatcttt

SEQ ID NO: 5612831 - DNA, 22 bp, Homo sapiens
gaatatccagtggatggattca

SEQ ID NO: 5612832 - DNA, 19 bp, Homo sapiens
gaatatccatgtacttgtt

SEQ ID NO: 5612833 - DNA, 19 bp, Homo sapiens
gaatatcctttaaaattta

SEQ ID NO: 5612834 - DNA, 20 bp, Homo sapiens
gaatatctgagaattgcaaa

SEQ ID NO: 5612835 - DNA, 14 bp, Homo sapiens
gaatatctttcgat

SEQ ID NO: 5612836 - DNA, 20 bp, Homo sapiens
gaatatgaaagtcttattaa

SEQ ID NO: 5612837 - DNA, 22 bp, Homo sapiens
gaatatgaacggtgagcattgt

SEQ ID NO: 5612838 - DNA, 23 bp, Homo sapiens
gaatatgacaatctaccaactgt

SEQ ID NO: 5612839 - DNA, 14 bp, Homo sapiens
gaatatgacagctg

SEQ ID NO: 5612840 - DNA, 20 bp, Homo sapiens
gaatatgacctaaatccatt

SEQ ID NO: 5612841 - DNA, 15 bp, Homo sapiens
gaatatgacggaaga

SEQ ID NO: 5612842 - DNA, 19 bp, Homo sapiens
gaatatgacggaagaacat

SEQ ID NO: 5612843 - DNA, 20 bp, Homo sapiens
gaatatgatccctaatgtgt

SEQ ID NO: 5612844 - DNA, 19 bp, Homo sapiens
gaatatgattagtaaagaa

SEQ ID NO: 5612845 - DNA, 15 bp, Homo sapiens
gaatatgcattgtct

SEQ ID NO: 5612846 - DNA, 13 bp, Homo sapiens
gaatatgcctgta

SEQ ID NO: 5612847 - DNA, 16 bp, Homo sapiens
gaatatgcctgtaatt

SEQ ID NO: 5612848 - DNA, 20 bp, Homo sapiens
gaatatgcctgtaattcagt

SEQ ID NO: 5612849 - DNA, 11 bp, Homo sapiens
gaatatgcctt

SEQ ID NO: 5612850 - DNA, 17 bp, Homo sapiens
gaatatgccttaattta

SEQ ID NO: 5612851 - DNA, 20 bp, Homo sapiens
gaatatgccttaatttagaa

SEQ ID NO: 5612852 - DNA, 23 bp, Homo sapiens
gaatatggacttaaatgttaatg

SEQ ID NO: 5612853 - DNA, 23 bp, Homo sapiens
gaatatggccaaggctctctctg

SEQ ID NO: 5612854 - DNA, 17 bp, Homo sapiens
gaatatgggagaaatag

SEQ ID NO: 5612855 - DNA, 17 bp, Homo sapiens
gaatatgtaagtcagga

SEQ ID NO: 5612856 - DNA, 18 bp, Homo sapiens
gaatatgtagctcatcct

SEQ ID NO: 5612857 - DNA, 12 bp, Homo sapiens
gaatatgtctgc

SEQ ID NO: 5612858 - DNA, 16 bp, Homo sapiens
gaatatgttgattttt

SEQ ID NO: 5612859 - DNA, 16 bp, Homo sapiens
gaatattaaatattat

SEQ ID NO: 5612860 - DNA, 23 bp, Homo sapiens
gaatattagatgctctgagaaat

SEQ ID NO: 5612861 - DNA, 21 bp, Homo sapiens
gaatattagctttactgtttg

SEQ ID NO: 5612862 - DNA, 19 bp, Homo sapiens
gaatattatatttggatgc

SEQ ID NO: 5612863 - DNA, 19 bp, Homo sapiens
gaatattcaaaattccaaa

SEQ ID NO: 5612864 - DNA, 22 bp, Homo sapiens
gaatattcattttactcagaat

SEQ ID NO: 5612865 - DNA, 24 bp, Homo sapiens
gaatattcctggacttacaaaatg

SEQ ID NO: 5612866 - DNA, 21 bp, Homo sapiens
gaatattgacaagtgtctttt

SEQ ID NO: 5612867 - DNA, 14 bp, Homo sapiens
gaatattgcaaaat

SEQ ID NO: 5612868 - DNA, 18 bp, Homo sapiens
gaatattgcaaaatacat

SEQ ID NO: 5612869 - DNA, 19 bp, Homo sapiens
gaatattgccattatgctt

SEQ ID NO: 5612870 - DNA, 11 bp, Homo sapiens
gaatattgctg

SEQ ID NO: 5612871 - DNA, 12 bp, Homo sapiens
gaatattgctga

SEQ ID NO: 5612872 - DNA, 14 bp, Homo sapiens
gaatattgctgatg

SEQ ID NO: 5612873 - DNA, 21 bp, Homo sapiens
gaatattggtaattaaaagac

SEQ ID NO: 5612874 - DNA, 18 bp, Homo sapiens
gaatattgtggctccctg

SEQ ID NO: 5612875 - DNA, 19 bp, Homo sapiens
gaatattgtggctccctgg

SEQ ID NO: 5612876 - DNA, 23 bp, Homo sapiens
gaatattgtgttcctttttatga

SEQ ID NO: 5612877 - DNA, 18 bp, Homo sapiens
gaatatttaagaaaagca

SEQ ID NO: 5612878 - DNA, 15 bp, Homo sapiens
gaatatttagaaaaa

SEQ ID NO: 5612879 - DNA, 13 bp, Homo sapiens
gaatatttataac

SEQ ID NO: 5612880 - DNA, 18 bp, Homo sapiens
gaatatttataacagcat

SEQ ID NO: 5612881 - DNA, 20 bp, Homo sapiens
gaatatttatatttcactat

SEQ ID NO: 5612882 - DNA, 23 bp, Homo sapiens
gaatatttcaagctctgcaacag

SEQ ID NO: 5612883 - DNA, 19 bp, Homo sapiens
gaatatttccatatggatt

SEQ ID NO: 5612884 - DNA, 19 bp, Homo sapiens
gaatatttggttttcctgt

SEQ ID NO: 5612885 - DNA, 14 bp, Homo sapiens
gaatatttgtttta

SEQ ID NO: 5612886 - DNA, 12 bp, Homo sapiens
gaatattttatt

SEQ ID NO: 5612887 - DNA, 21 bp, Homo sapiens
gaatattttcattaaaagcta

SEQ ID NO: 5612888 - DNA, 19 bp, Homo sapiens
gaatatttttatatttcct

SEQ ID NO: 5612889 - DNA, 20 bp, Homo sapiens
gaatatttttatatttcctt

SEQ ID NO: 5612890 - DNA, 20 bp, Homo sapiens
gaatatttttggcattcctc

SEQ ID NO: 5612891 - DNA, 21 bp, Homo sapiens
gaatattttttgaaggtttca

SEQ ID NO: 5612892 - DNA, 15 bp, Homo sapiens
gaatcaaaaattgaa

SEQ ID NO: 5612893 - DNA, 21 bp, Homo sapiens
gaatcaaaaattgaagagaga

SEQ ID NO: 5612894 - DNA, 21 bp, Homo sapiens
gaatcaaaacaaacgagcagg

SEQ ID NO: 5612895 - DNA, 14 bp, Homo sapiens
gaatcaaaactctc

SEQ ID NO: 5612896 - DNA, 23 bp, Homo sapiens
gaatcaaaagtgcctcaagagga

SEQ ID NO: 5612897 - DNA, 12 bp, Homo sapiens
gaatcaaagaca

SEQ ID NO: 5612898 - DNA, 16 bp, Homo sapiens
gaatcaaagacatgga

SEQ ID NO: 5612899 - DNA, 17 bp, Homo sapiens
gaatcaaagacatggaa

SEQ ID NO: 5612900 - DNA, 18 bp, Homo sapiens
gaatcaaagacatttcat

SEQ ID NO: 5612901 - DNA, 17 bp, Homo sapiens
gaatcaaatctgagcct

SEQ ID NO: 5612902 - DNA, 23 bp, Homo sapiens
gaatcaacaccaccgagctctgt

SEQ ID NO: 5612903 - DNA, 14 bp, Homo sapiens
gaatcaacagatga

SEQ ID NO: 5612904 - DNA, 14 bp, Homo sapiens
gaatcaacagggca

SEQ ID NO: 5612905 - DNA, 17 bp, Homo sapiens
gaatcaacatttctcaa

SEQ ID NO: 5612906 - DNA, 17 bp, Homo sapiens
gaatcaagagctgccct

SEQ ID NO: 5612907 - DNA, 18 bp, Homo sapiens
gaatcaagagctgccctc

SEQ ID NO: 5612908 - DNA, 20 bp, Homo sapiens
gaatcaagatgtcagactgg

SEQ ID NO: 5612909 - DNA, 22 bp, Homo sapiens
gaatcaaggaatcctgagtctg

SEQ ID NO: 5612910 - DNA, 16 bp, Homo sapiens
gaatcaagggtcaggc

SEQ ID NO: 5612911 - DNA, 19 bp, Homo sapiens
gaatcaagggtcaggcctt

SEQ ID NO: 5612912 - DNA, 14 bp, Homo sapiens
gaatcaataaaaat

SEQ ID NO: 5612913 - DNA, 17 bp, Homo sapiens
gaatcaatctggcttct

SEQ ID NO: 5612914 - DNA, 20 bp, Homo sapiens
gaatcaatctggcttctgca

SEQ ID NO: 5612915 - DNA, 23 bp, Homo sapiens
gaatcaatctggcttctgcatta

SEQ ID NO: 5612916 - DNA, 13 bp, Homo sapiens
gaatcaatgaaaa

SEQ ID NO: 5612917 - DNA, 17 bp, Homo sapiens
gaatcaatttcccagaa

SEQ ID NO: 5612918 - DNA, 18 bp, Homo sapiens
gaatcaatttcccagaag

SEQ ID NO: 5612919 - DNA, 16 bp, Homo sapiens
gaatcacacaagtttg

SEQ ID NO: 5612920 - DNA, 12 bp, Homo sapiens
gaatcacagcca

SEQ ID NO: 5612921 - DNA, 14 bp, Homo sapiens
gaatcacaggctgg

SEQ ID NO: 5612922 - DNA, 20 bp, Homo sapiens
gaatcacagtactttccagc

SEQ ID NO: 5612923 - DNA, 18 bp, Homo sapiens
gaatcaccaattaaaaac

SEQ ID NO: 5612924 - DNA, 20 bp, Homo sapiens
gaatcaccaattaaaaacct

SEQ ID NO: 5612925 - DNA, 15 bp, Homo sapiens
gaatcacccctctgc

SEQ ID NO: 5612926 - DNA, 17 bp, Homo sapiens
gaatcacccctctgccc

SEQ ID NO: 5612927 - DNA, 19 bp, Homo sapiens
gaatcacccctctgcccct

SEQ ID NO: 5612928 - DNA, 20 bp, Homo sapiens
gaatcacccctctgcccctg

SEQ ID NO: 5612929 - DNA, 22 bp, Homo sapiens
gaatcacccctctgcccctgca

SEQ ID NO: 5612930 - DNA, 23 bp, Homo sapiens
gaatcacccctctgcccctgcag

SEQ ID NO: 5612931 - DNA, 19 bp, Homo sapiens
gaatcacctaattaatttc

SEQ ID NO: 5612932 - DNA, 20 bp, Homo sapiens
gaatcacctaattaatttca

SEQ ID NO: 5612933 - DNA, 19 bp, Homo sapiens
gaatcacctcctgtgttgt

SEQ ID NO: 5612934 - DNA, 19 bp, Homo sapiens
gaatcacctgaaccccaga

SEQ ID NO: 5612935 - DNA, 19 bp, Homo sapiens
gaatcacctggagggcttg

SEQ ID NO: 5612936 - DNA, 21 bp, Homo sapiens
gaatcactcatttatttccat

SEQ ID NO: 5612937 - DNA, 19 bp, Homo sapiens
gaatcactcttgtggatgt

SEQ ID NO: 5612938 - DNA, 14 bp, Homo sapiens
gaatcactgcagcc

SEQ ID NO: 5612939 - DNA, 17 bp, Homo sapiens
gaatcactgcagcccag

SEQ ID NO: 5612940 - DNA, 18 bp, Homo sapiens
gaatcactgcagcccagg

SEQ ID NO: 5612941 - DNA, 17 bp, Homo sapiens
gaatcactgctccaggc

SEQ ID NO: 5612942 - DNA, 11 bp, Homo sapiens
gaatcactgtt

SEQ ID NO: 5612943 - DNA, 19 bp, Homo sapiens
gaatcactgttgctttgaa

SEQ ID NO: 5612944 - DNA, 14 bp, Homo sapiens
gaatcagaaaagct

SEQ ID NO: 5612945 - DNA, 15 bp, Homo sapiens
gaatcagaaaagcta

SEQ ID NO: 5612946 - DNA, 12 bp, Homo sapiens
gaatcagaataa

SEQ ID NO: 5612947 - DNA, 17 bp, Homo sapiens
gaatcagaataaagttg

SEQ ID NO: 5612948 - DNA, 21 bp, Homo sapiens
gaatcagaataaagttgtatt

SEQ ID NO: 5612949 - DNA, 16 bp, Homo sapiens
gaatcagaatcatgga

SEQ ID NO: 5612950 - DNA, 19 bp, Homo sapiens
gaatcagaatcatggagaa

SEQ ID NO: 5612951 - DNA, 18 bp, Homo sapiens
gaatcagaccctacccca

SEQ ID NO: 5612952 - DNA, 13 bp, Homo sapiens
gaatcagagaaaa

SEQ ID NO: 5612953 - DNA, 14 bp, Homo sapiens
gaatcagagaaaac

SEQ ID NO: 5612954 - DNA, 15 bp, Homo sapiens
gaatcagaggcagag

SEQ ID NO: 5612955 - DNA, 16 bp, Homo sapiens
gaatcagagtagaaat

SEQ ID NO: 5612956 - DNA, 16 bp, Homo sapiens
gaatcagcagaacctg

SEQ ID NO: 5612957 - DNA, 18 bp, Homo sapiens
gaatcagcctacaggcct

SEQ ID NO: 5612958 - DNA, 18 bp, Homo sapiens
gaatcagctggacatact

SEQ ID NO: 5612959 - DNA, 21 bp, Homo sapiens
gaatcaggaatattttccaaa

SEQ ID NO: 5612960 - DNA, 23 bp, Homo sapiens
gaatcaggaatattttccaaaga

SEQ ID NO: 5612961 - DNA, 13 bp, Homo sapiens
gaatcaggagagg

SEQ ID NO: 5612962 - DNA, 23 bp, Homo sapiens
gaatcaggattccttcttcccca

SEQ ID NO: 5612963 - DNA, 23 bp, Homo sapiens
gaatcagggaccagctttactgg

SEQ ID NO: 5612964 - DNA, 15 bp, Homo sapiens
gaatcagggtggaga

SEQ ID NO: 5612965 - DNA, 20 bp, Homo sapiens
gaatcagtaatcacttttca

SEQ ID NO: 5612966 - DNA, 16 bp, Homo sapiens
gaatcagtaggaccag

SEQ ID NO: 5612967 - DNA, 18 bp, Homo sapiens
gaatcagtaggaccaggc

SEQ ID NO: 5612968 - DNA, 16 bp, Homo sapiens
gaatcagtgttaaatt

SEQ ID NO: 5612969 - DNA, 17 bp, Homo sapiens
gaatcagtttaaaagca

SEQ ID NO: 5612970 - DNA, 15 bp, Homo sapiens
gaatcataattttca

SEQ ID NO: 5612971 - DNA, 19 bp, Homo sapiens
gaatcatacttagcaaagt

SEQ ID NO: 5612972 - DNA, 16 bp, Homo sapiens
gaatcatgagcctgct

SEQ ID NO: 5612973 - DNA, 15 bp, Homo sapiens
gaatcatgctgttct

SEQ ID NO: 5612974 - DNA, 18 bp, Homo sapiens
gaatcatgctgttctctt

SEQ ID NO: 5612975 - DNA, 22 bp, Homo sapiens
gaatcatgctgttctctttgct

SEQ ID NO: 5612976 - DNA, 13 bp, Homo sapiens
gaatcatggagaa

SEQ ID NO: 5612977 - DNA, 16 bp, Homo sapiens
gaatcatggatttatt

SEQ ID NO: 5612978 - DNA, 11 bp, Homo sapiens
gaatcatgtag

SEQ ID NO: 5612979 - DNA, 21 bp, Homo sapiens
gaatcatgtcaggcctgtgtg

SEQ ID NO: 5612980 - DNA, 21 bp, Homo sapiens
gaatcatgtccatcccttttc

SEQ ID NO: 5612981 - DNA, 22 bp, Homo sapiens
gaatcatgtctgtatccccagt

SEQ ID NO: 5612982 - DNA, 19 bp, Homo sapiens
gaatcatgtgaacccggga

SEQ ID NO: 5612983 - DNA, 21 bp, Homo sapiens
gaatcatgtgcgtcagtccaa

SEQ ID NO: 5612984 - DNA, 22 bp, Homo sapiens
gaatcatgttggatagtcagct

SEQ ID NO: 5612985 - DNA, 15 bp, Homo sapiens
gaatcatgtttcttt

SEQ ID NO: 5612986 - DNA, 23 bp, Homo sapiens
gaatcattaatttcaaaatttaa

SEQ ID NO: 5612987 - DNA, 17 bp, Homo sapiens
gaatcattatttattaa

SEQ ID NO: 5612988 - DNA, 21 bp, Homo sapiens
gaatcattatttattaaattt

SEQ ID NO: 5612989 - DNA, 23 bp, Homo sapiens
gaatcattccactatacaattca

SEQ ID NO: 5612990 - DNA, 14 bp, Homo sapiens
gaatcattgcttat

SEQ ID NO: 5612991 - DNA, 19 bp, Homo sapiens
gaatcattgtccagagctg

SEQ ID NO: 5612992 - DNA, 21 bp, Homo sapiens
gaatcattgtccagagctgct

SEQ ID NO: 5612993 - DNA, 20 bp, Homo sapiens
gaatcattgtgcttaataat

SEQ ID NO: 5612994 - DNA, 13 bp, Homo sapiens
gaatgctgggccc

SEQ ID NO: 5612995 - DNA, 20 bp, Homo sapiens
gaatgctgggcccctgctca

SEQ ID NO: 5612996 - DNA, 19 bp, Homo sapiens
gaatgctgggtttatagat

SEQ ID NO: 5612997 - DNA, 18 bp, Homo sapiens
gaatgctggttttcctaa

SEQ ID NO: 5612998 - DNA, 20 bp, Homo sapiens
gaatgctgtacatctatttt

SEQ ID NO: 5612999 - DNA, 14 bp, Homo sapiens
gaatgctgtgttaa

SEQ ID NO: 5613000 - DNA, 14 bp, Homo sapiens
gaatgcttctaagt

SEQ ID NO: 5613001 - DNA, 23 bp, Homo sapiens
gaatgcttctaagtaaatacaat

SEQ ID NO: 5613002 - DNA, 18 bp, Homo sapiens
gaatgcttctgacttcat

SEQ ID NO: 5613003 - DNA, 14 bp, Homo sapiens
gaatgcttctgatt

SEQ ID NO: 5613004 - DNA, 15 bp, Homo sapiens
gaatgcttcttctca

SEQ ID NO: 5613005 - DNA, 16 bp, Homo sapiens
gaatgcttgaaaaatg

SEQ ID NO: 5613006 - DNA, 20 bp, Homo sapiens
gaatgcttgaaaaatgtgca

SEQ ID NO: 5613007 - DNA, 13 bp, Homo sapiens
gaatgcttggaat

SEQ ID NO: 5613008 - DNA, 19 bp, Homo sapiens
gaatgcttggaatatctgc

SEQ ID NO: 5613009 - DNA, 13 bp, Homo sapiens
gaatgctttgaaa

SEQ ID NO: 5613010 - DNA, 13 bp, Homo sapiens
gaatggaaaaatc

SEQ ID NO: 5613011 - DNA, 19 bp, Homo sapiens
gaatggaactactgtactt

SEQ ID NO: 5613012 - DNA, 22 bp, Homo sapiens
gaatggaagagaaaagacaggg

SEQ ID NO: 5613013 - DNA, 13 bp, Homo sapiens
gaatggaagcaaa

SEQ ID NO: 5613014 - DNA, 20 bp, Homo sapiens
gaatggaagcaaagtgctgg

SEQ ID NO: 5613015 - DNA, 21 bp, Homo sapiens
gaatggaagcctccacctgca

SEQ ID NO: 5613016 - DNA, 22 bp, Homo sapiens
gaatggaagggttctggctgcc

SEQ ID NO: 5613017 - DNA, 11 bp, Homo sapiens
gaatggaataa

SEQ ID NO: 5613018 - DNA, 13 bp, Homo sapiens
gaatggagaaagt

SEQ ID NO: 5613019 - DNA, 14 bp, Homo sapiens
gaatggagaaagta

SEQ ID NO: 5613020 - DNA, 16 bp, Homo sapiens
gaatggagaatggtgt

SEQ ID NO: 5613021 - DNA, 18 bp, Homo sapiens
gaatggagatatgcattc

SEQ ID NO: 5613022 - DNA, 14 bp, Homo sapiens
gaatggagcctgct

SEQ ID NO: 5613023 - DNA, 15 bp, Homo sapiens
gaatggaggagccag

SEQ ID NO: 5613024 - DNA, 14 bp, Homo sapiens
gaatggaggcaggg

SEQ ID NO: 5613025 - DNA, 22 bp, Homo sapiens
gaatggagggcaacattccaca

SEQ ID NO: 5613026 - DNA, 15 bp, Homo sapiens
gaatggaggggcaga

SEQ ID NO: 5613027 - DNA, 20 bp, Homo sapiens
gaatggaggggcagagccag

SEQ ID NO: 5613028 - DNA, 19 bp, Homo sapiens
gaatggagtccagacctgg

SEQ ID NO: 5613029 - DNA, 17 bp, Homo sapiens
gaatggattttcctgaa

SEQ ID NO: 5613030 - DNA, 14 bp, Homo sapiens
gaatggatttttcc

SEQ ID NO: 5613031 - DNA, 23 bp, Homo sapiens
gaatggattttttttttcaggtt

SEQ ID NO: 5613032 - DNA, 21 bp, Homo sapiens
gaatggcaaacgattttacta

SEQ ID NO: 5613033 - DNA, 22 bp, Homo sapiens
gaatggcaatagggtagaatga

SEQ ID NO: 5613034 - DNA, 13 bp, Homo sapiens
gaatggcaatggt

SEQ ID NO: 5613035 - DNA, 11 bp, Homo sapiens
gaatggcagca

SEQ ID NO: 5613036 - DNA, 14 bp, Homo sapiens
gaatggcagctgga

SEQ ID NO: 5613037 - DNA, 15 bp, Homo sapiens
gaatggcaggggaag

SEQ ID NO: 5613038 - DNA, 16 bp, Homo sapiens
gaatggcagtcctgga

SEQ ID NO: 5613039 - DNA, 17 bp, Homo sapiens
gaatggcagtcctggag

SEQ ID NO: 5613040 - DNA, 16 bp, Homo sapiens
gaatggccacaaacct

SEQ ID NO: 5613041 - DNA, 17 bp, Homo sapiens
gaatggcctgccttgaa

SEQ ID NO: 5613042 - DNA, 12 bp, Homo sapiens
gaatggcctgga

SEQ ID NO: 5613043 - DNA, 14 bp, Homo sapiens
gaatggcctggagc

SEQ ID NO: 5613044 - DNA, 17 bp, Homo sapiens
gaatggcctggagcagg

SEQ ID NO: 5613045 - DNA, 19 bp, Homo sapiens
gaatggcctggagcaggcc

SEQ ID NO: 5613046 - DNA, 20 bp, Homo sapiens
gaatggcctggagcaggccc

SEQ ID NO: 5613047 - DNA, 19 bp, Homo sapiens
gaatggcggtttttatcca

SEQ ID NO: 5613048 - DNA, 17 bp, Homo sapiens
gaatggctatgttttta

SEQ ID NO: 5613049 - DNA, 15 bp, Homo sapiens
gaatggctgggtcag

SEQ ID NO: 5613050 - DNA, 13 bp, Homo sapiens
gaatggctgtgcc

SEQ ID NO: 5613051 - DNA, 17 bp, Homo sapiens
gaatggctttgtataga

SEQ ID NO: 5613052 - DNA, 12 bp, Homo sapiens
gaatgggaaagt

SEQ ID NO: 5613053 - DNA, 14 bp, Homo sapiens
gaatgggacagggt

SEQ ID NO: 5613054 - DNA, 14 bp, Homo sapiens
gaatgggagacctg

SEQ ID NO: 5613055 - DNA, 20 bp, Homo sapiens
gaatgggagaggcaataaat

SEQ ID NO: 5613056 - DNA, 23 bp, Homo sapiens
gaatgggaggttgatcagatctg

SEQ ID NO: 5613057 - DNA, 18 bp, Homo sapiens
gaatgggagtctgaaatg

SEQ ID NO: 5613058 - DNA, 16 bp, Homo sapiens
gaatgggatattttga

SEQ ID NO: 5613059 - DNA, 21 bp, Homo sapiens
gaatgggatgtgtgatgcaaa

SEQ ID NO: 5613060 - DNA, 12 bp, Homo sapiens
gaatgggcaggt

SEQ ID NO: 5613061 - DNA, 15 bp, Homo sapiens
gaatgggcagttaca

SEQ ID NO: 5613062 - DNA, 15 bp, Homo sapiens
gaatgggcatttcta

SEQ ID NO: 5613063 - DNA, 18 bp, Homo sapiens
gaatgggctgcagaagat

SEQ ID NO: 5613064 - DNA, 11 bp, Homo sapiens
gaatggggctt

SEQ ID NO: 5613065 - DNA, 16 bp, Homo sapiens
gaatgggggaggccca

SEQ ID NO: 5613066 - DNA, 21 bp, Homo sapiens
gaatgggggccaggctgagcc

SEQ ID NO: 5613067 - DNA, 14 bp, Homo sapiens
gaatgggggtcaga

SEQ ID NO: 5613068 - DNA, 15 bp, Homo sapiens
gaatggggttcctgc

SEQ ID NO: 5613069 - DNA, 19 bp, Homo sapiens
gaatggggttcctgctgtg

SEQ ID NO: 5613070 - DNA, 20 bp, Homo sapiens
gaatggtaaccgagccagca

SEQ ID NO: 5613071 - DNA, 20 bp, Homo sapiens
gaatggtacatgtcttccat

SEQ ID NO: 5613072 - DNA, 20 bp, Homo sapiens
gaatggtccgtgctaaggac

SEQ ID NO: 5613073 - DNA, 22 bp, Homo sapiens
gaatggtccgtgctaaggactt

SEQ ID NO: 5613074 - DNA, 16 bp, Homo sapiens
gaatggtctcagtgtt

SEQ ID NO: 5613075 - DNA, 17 bp, Homo sapiens
gaatggtgcattgtata

SEQ ID NO: 5613076 - DNA, 19 bp, Homo sapiens
gaatggtgggctccagagt

SEQ ID NO: 5613077 - DNA, 22 bp, Homo sapiens
gaatggtgggctccagagtagg

SEQ ID NO: 5613078 - DNA, 19 bp, Homo sapiens
gaatggtgtgaacccggga

SEQ ID NO: 5613079 - DNA, 20 bp, Homo sapiens
gaatggtgttttgtcagact

SEQ ID NO: 5613080 - DNA, 18 bp, Homo sapiens
gaatggttaataaaactg

SEQ ID NO: 5613081 - DNA, 13 bp, Homo sapiens
gaatggttataaa

SEQ ID NO: 5613082 - DNA, 16 bp, Homo sapiens
gaatggttataaaagt

SEQ ID NO: 5613083 - DNA, 17 bp, Homo sapiens
gaatggttataaaagtg

SEQ ID NO: 5613084 - DNA, 12 bp, Homo sapiens
gaatggtttgta

SEQ ID NO: 5613085 - DNA, 23 bp, Homo sapiens
gaatgtaaaacagagccattccc

SEQ ID NO: 5613086 - DNA, 13 bp, Homo sapiens
gaatgtaaagcaa

SEQ ID NO: 5613087 - DNA, 16 bp, Homo sapiens
gaatgtaaatgtctca

SEQ ID NO: 5613088 - DNA, 13 bp, Homo sapiens
gaatgtaaccaat

SEQ ID NO: 5613089 - DNA, 19 bp, Homo sapiens
gaatgtaaccaatcctact

SEQ ID NO: 5613090 - DNA, 18 bp, Homo sapiens
gaatgtaactccagatag

SEQ ID NO: 5613091 - DNA, 17 bp, Homo sapiens
gaatgtaagaaaacaaa

SEQ ID NO: 5613092 - DNA, 18 bp, Homo sapiens
gaatgtaagaaaacaaaa

SEQ ID NO: 5613093 - DNA, 18 bp, Homo sapiens
gaatgtaagaactacaaa

SEQ ID NO: 5613094 - DNA, 22 bp, Homo sapiens
gaatgtaatatactgagctgct

SEQ ID NO: 5613095 - DNA, 11 bp, Homo sapiens
gaatgtaatca

SEQ ID NO: 5613096 - DNA, 14 bp, Homo sapiens
gaatgtaattggaa

SEQ ID NO: 5613097 - DNA, 13 bp, Homo sapiens
gaatgtaatttgt

SEQ ID NO: 5613098 - DNA, 14 bp, Homo sapiens
gaatgtaatttgtg

SEQ ID NO: 5613099 - DNA, 20 bp, Homo sapiens
gaatgtaattttgaactgtt

SEQ ID NO: 5613100 - DNA, 15 bp, Homo sapiens
gaatgtacaaagata

SEQ ID NO: 5613101 - DNA, 20 bp, Homo sapiens
gaatgtacagttgagctcag

SEQ ID NO: 5613102 - DNA, 14 bp, Homo sapiens
gaatgtaccttatt

SEQ ID NO: 5613103 - DNA, 22 bp, Homo sapiens
gaatgtaccttatttaaaagat

SEQ ID NO: 5613104 - DNA, 21 bp, Homo sapiens
gaatgtacgttgagaatcact

SEQ ID NO: 5613105 - DNA, 21 bp, Homo sapiens
gaatgtagcagccccgggagg

SEQ ID NO: 5613106 - DNA, 23 bp, Homo sapiens
gaatgtagcagccccgggagggc

SEQ ID NO: 5613107 - DNA, 18 bp, Homo sapiens
gaatgtagccctctccaa

SEQ ID NO: 5613108 - DNA, 19 bp, Homo sapiens
gaatgtagcgtgtaagctt

SEQ ID NO: 5613109 - DNA, 21 bp, Homo sapiens
gaatgtagcgtgtaagcttgt

SEQ ID NO: 5613110 - DNA, 19 bp, Homo sapiens
gaatgtagcttccacctca

SEQ ID NO: 5613111 - DNA, 13 bp, Homo sapiens
gaatgtagggcct

SEQ ID NO: 5613112 - DNA, 21 bp, Homo sapiens
gaatgtagtattcaatgattt

SEQ ID NO: 5613113 - DNA, 21 bp, Homo sapiens
gaatgtatcagccagccttcc

SEQ ID NO: 5613114 - DNA, 17 bp, Homo sapiens
gaatgtatcaggaaata

SEQ ID NO: 5613115 - DNA, 18 bp, Homo sapiens
gaatgtatgcttcataca

SEQ ID NO: 5613116 - DNA, 21 bp, Homo sapiens
gaatgtatgcttcatacaggg

SEQ ID NO: 5613117 - DNA, 14 bp, Homo sapiens
gaatgtatgtaatg

SEQ ID NO: 5613118 - DNA, 14 bp, Homo sapiens
gaatgtattctgta

SEQ ID NO: 5613119 - DNA, 22 bp, Homo sapiens
gaatgtattctgtatccgtgaa

SEQ ID NO: 5613120 - DNA, 17 bp, Homo sapiens
gaatgtattcttttata

SEQ ID NO: 5613121 - DNA, 20 bp, Homo sapiens
gaatgtattcttttatataa

SEQ ID NO: 5613122 - DNA, 23 bp, Homo sapiens
gaatgtattgtaccttttaacac

SEQ ID NO: 5613123 - DNA, 12 bp, Homo sapiens
gaatgtatttat

SEQ ID NO: 5613124 - DNA, 15 bp, Homo sapiens
gaatgtcaataaatt

SEQ ID NO: 5613125 - DNA, 19 bp, Homo sapiens
gaatgtcacatttgaattc

SEQ ID NO: 5613126 - DNA, 22 bp, Homo sapiens
gaatgtcacatttgaattcttg

SEQ ID NO: 5613127 - DNA, 15 bp, Homo sapiens
gaatgtcactgtagt

SEQ ID NO: 5613128 - DNA, 16 bp, Homo sapiens
gaatgtcagatttctg

SEQ ID NO: 5613129 - DNA, 18 bp, Homo sapiens
gaatgtcagatttctggt

SEQ ID NO: 5613130 - DNA, 19 bp, Homo sapiens
gaatgtcagatttctggtt

SEQ ID NO: 5613131 - DNA, 15 bp, Homo sapiens
gaatgtcagggccag

SEQ ID NO: 5613132 - DNA, 13 bp, Homo sapiens
gaatgtcagtgtg

SEQ ID NO: 5613133 - DNA, 21 bp, Homo sapiens
gaatgtcagtgtgactgatct

SEQ ID NO: 5613134 - DNA, 20 bp, Homo sapiens
gaatgtcagttgttatttat

SEQ ID NO: 5613135 - DNA, 17 bp, Homo sapiens
gaatgtcatttgctaat

SEQ ID NO: 5613136 - DNA, 15 bp, Homo sapiens
gaatgtccaaaattt

SEQ ID NO: 5613137 - DNA, 20 bp, Homo sapiens
gaatgtccccattctataaa

SEQ ID NO: 5613138 - DNA, 17 bp, Homo sapiens
gaatgtcccttttccta

SEQ ID NO: 5613139 - DNA, 12 bp, Homo sapiens
gaatgtctgaga

SEQ ID NO: 5613140 - DNA, 16 bp, Homo sapiens
gaatgtgaaaaaggaa

SEQ ID NO: 5613141 - DNA, 13 bp, Homo sapiens
gaatgtgaagcct

SEQ ID NO: 5613142 - DNA, 16 bp, Homo sapiens
gaatgtgaatagtgtt

SEQ ID NO: 5613143 - DNA, 13 bp, Homo sapiens
gaatgtgagcaca

SEQ ID NO: 5613144 - DNA, 18 bp, Homo sapiens
gaatgtgataaggaaatc

SEQ ID NO: 5613145 - DNA, 21 bp, Homo sapiens
gaatgtgatcatctttgctga

SEQ ID NO: 5613146 - DNA, 13 bp, Homo sapiens
gaatgtgattttt

SEQ ID NO: 5613147 - DNA, 21 bp, Homo sapiens
gaatgtgcaggtttgttacat

SEQ ID NO: 5613148 - DNA, 19 bp, Homo sapiens
gaatgtgcagtgtcttgta

SEQ ID NO: 5613149 - DNA, 13 bp, Homo sapiens
gaatgtgccacag

SEQ ID NO: 5613150 - DNA, 21 bp, Homo sapiens
gaatgtgccacagaggcccca

SEQ ID NO: 5613151 - DNA, 22 bp, Homo sapiens
gaatgtgccacagaggccccac

SEQ ID NO: 5613152 - DNA, 14 bp, Homo sapiens
gaatgtgccacctg

SEQ ID NO: 5613153 - DNA, 13 bp, Homo sapiens
gaatgtgcccctg

SEQ ID NO: 5613154 - DNA, 18 bp, Homo sapiens
gaatgtgcccctggccca

SEQ ID NO: 5613155 - DNA, 13 bp, Homo sapiens
gaatgtgctgcct

SEQ ID NO: 5613156 - DNA, 14 bp, Homo sapiens
gaatgtgctgcctt

SEQ ID NO: 5613157 - DNA, 23 bp, Homo sapiens
gaatgtggaaaacatcctgactt

SEQ ID NO: 5613158 - DNA, 20 bp, Homo sapiens
gaatgtggataaaactgtgt

SEQ ID NO: 5613159 - DNA, 20 bp, Homo sapiens
gaatgtggccacttatttca

SEQ ID NO: 5613160 - DNA, 15 bp, Homo sapiens
gaatgtgggcactgg

SEQ ID NO: 5613161 - DNA, 21 bp, Homo sapiens
gaatgtgggtagtcattctta

SEQ ID NO: 5613162 - DNA, 13 bp, Homo sapiens
gaatgtggtctca

SEQ ID NO: 5613163 - DNA, 22 bp, Homo sapiens
gaatgtggttagttaactgaat

SEQ ID NO: 5613164 - DNA, 15 bp, Homo sapiens
gaatgtgtcccatgc

SEQ ID NO: 5613165 - DNA, 15 bp, Homo sapiens
gaatgtgtcctcctg

SEQ ID NO: 5613166 - DNA, 17 bp, Homo sapiens
gaatgtgtcctcctgct

SEQ ID NO: 5613167 - DNA, 14 bp, Homo sapiens
gaatgtgtgtatgt

SEQ ID NO: 5613168 - DNA, 15 bp, Homo sapiens
gaatgtgtgtgcaga

SEQ ID NO: 5613169 - DNA, 17 bp, Homo sapiens
gaatgtgtgtgtgtggc

SEQ ID NO: 5613170 - DNA, 14 bp, Homo sapiens
gaatgtgtttcaaa

SEQ ID NO: 5613171 - DNA, 22 bp, Homo sapiens
gaatgtgtttcaaaaccatgcc

SEQ ID NO: 5613172 - DNA, 16 bp, Homo sapiens
gaatgttaaagtcagt

SEQ ID NO: 5613173 - DNA, 20 bp, Homo sapiens
gacaaatcacatattttaaa

SEQ ID NO: 5613174 - DNA, 20 bp, Homo sapiens
gacaaatcctttctgccccc

SEQ ID NO: 5613175 - DNA, 12 bp, Homo sapiens
gacaaatctaag

SEQ ID NO: 5613176 - DNA, 14 bp, Homo sapiens
gacaaatctgtctg

SEQ ID NO: 5613177 - DNA, 12 bp, Homo sapiens
gacaaatctgtg

SEQ ID NO: 5613178 - DNA, 16 bp, Homo sapiens
gacaaatctttaagaa

SEQ ID NO: 5613179 - DNA, 23 bp, Homo sapiens
gacaaatgaaagagaaaatatat

SEQ ID NO: 5613180 - DNA, 22 bp, Homo sapiens
gacaaatgctgcgcccttcccc

SEQ ID NO: 5613181 - DNA, 13 bp, Homo sapiens
gacaaatgggact

SEQ ID NO: 5613182 - DNA, 13 bp, Homo sapiens
gacaaatgtgaag

SEQ ID NO: 5613183 - DNA, 19 bp, Homo sapiens
gacaaattacaaaaggctc

SEQ ID NO: 5613184 - DNA, 18 bp, Homo sapiens
gacaaattagcatgcaag

SEQ ID NO: 5613185 - DNA, 14 bp, Homo sapiens
gacaaattctgttt

SEQ ID NO: 5613186 - DNA, 19 bp, Homo sapiens
gacaaattgagacagtgca

SEQ ID NO: 5613187 - DNA, 17 bp, Homo sapiens
gacaaatttaaaacaaa

SEQ ID NO: 5613188 - DNA, 17 bp, Homo sapiens
gacaaatttagccaata

SEQ ID NO: 5613189 - DNA, 17 bp, Homo sapiens
gacaacaaagaggacac

SEQ ID NO: 5613190 - DNA, 14 bp, Homo sapiens
gacaacaaattttg

SEQ ID NO: 5613191 - DNA, 18 bp, Homo sapiens
gacaacaccttcctcctg

SEQ ID NO: 5613192 - DNA, 17 bp, Homo sapiens
gacaacactgattcctg

SEQ ID NO: 5613193 - DNA, 13 bp, Homo sapiens
gacaacagaaaaa

SEQ ID NO: 5613194 - DNA, 14 bp, Homo sapiens
gacaacagaaaaac

SEQ ID NO: 5613195 - DNA, 18 bp, Homo sapiens
gacaacagaaagagggac

SEQ ID NO: 5613196 - DNA, 22 bp, Homo sapiens
gacaacagaagtcatgaagccc

SEQ ID NO: 5613197 - DNA, 20 bp, Homo sapiens
gacaacagcacacaggcagc

SEQ ID NO: 5613198 - DNA, 15 bp, Homo sapiens
gacaacagcccaggc

SEQ ID NO: 5613199 - DNA, 13 bp, Homo sapiens
gacaacagcctga

SEQ ID NO: 5613200 - DNA, 16 bp, Homo sapiens
gacaacagcctgagaa

SEQ ID NO: 5613201 - DNA, 17 bp, Homo sapiens
gacaacagcctgagaaa

SEQ ID NO: 5613202 - DNA, 12 bp, Homo sapiens
gacaacagctct

SEQ ID NO: 5613203 - DNA, 13 bp, Homo sapiens
gacaacagctctc

SEQ ID NO: 5613204 - DNA, 15 bp, Homo sapiens
gacaacagctctcgt

SEQ ID NO: 5613205 - DNA, 20 bp, Homo sapiens
gacaacaggtaaaacagggc

SEQ ID NO: 5613206 - DNA, 15 bp, Homo sapiens
gacaacagtgctttg

SEQ ID NO: 5613207 - DNA, 17 bp, Homo sapiens
gacaacatcccacagtg

SEQ ID NO: 5613208 - DNA, 11 bp, Homo sapiens
gacaacatctg

SEQ ID NO: 5613209 - DNA, 14 bp, Homo sapiens
gacaacatgtttaa

SEQ ID NO: 5613210 - DNA, 13 bp, Homo sapiens
gacaacattatga

SEQ ID NO: 5613211 - DNA, 15 bp, Homo sapiens
gacaacattatgatc

SEQ ID NO: 5613212 - DNA, 14 bp, Homo sapiens
gacaacattgtaag

SEQ ID NO: 5613213 - DNA, 13 bp, Homo sapiens
gacaacatttctg

SEQ ID NO: 5613214 - DNA, 14 bp, Homo sapiens
gacaacattttatt

SEQ ID NO: 5613215 - DNA, 12 bp, Homo sapiens
gacaacattttt

SEQ ID NO: 5613216 - DNA, 22 bp, Homo sapiens
gacaacatttttggtgtatttg

SEQ ID NO: 5613217 - DNA, 20 bp, Homo sapiens
gacaaccacgtaccaagcca

SEQ ID NO: 5613218 - DNA, 17 bp, Homo sapiens
gacaaccactggtctgt

SEQ ID NO: 5613219 - DNA, 15 bp, Homo sapiens
gacaaccagaaggcc

SEQ ID NO: 5613220 - DNA, 18 bp, Homo sapiens
gacaaccagaaggccctt

SEQ ID NO: 5613221 - DNA, 20 bp, Homo sapiens
gacaaccagaaggcccttaa

SEQ ID NO: 5613222 - DNA, 15 bp, Homo sapiens
gacaaccattaaagt

SEQ ID NO: 5613223 - DNA, 21 bp, Homo sapiens
gacaaccctgaggtatctgtg

SEQ ID NO: 5613224 - DNA, 13 bp, Homo sapiens
gacaaccctgcaa

SEQ ID NO: 5613225 - DNA, 14 bp, Homo sapiens
gacaaccctggcct

SEQ ID NO: 5613226 - DNA, 18 bp, Homo sapiens
gacaaccgatgctccagc

SEQ ID NO: 5613227 - DNA, 19 bp, Homo sapiens
gacaaccgatgctccagcc

SEQ ID NO: 5613228 - DNA, 14 bp, Homo sapiens
gacaacctgcccct

SEQ ID NO: 5613229 - DNA, 23 bp, Homo sapiens
gacaacctgtgcagtcccgtgga

SEQ ID NO: 5613230 - DNA, 23 bp, Homo sapiens
gacaacctgtgtgagagaattta

SEQ ID NO: 5613231 - DNA, 15 bp, Homo sapiens
gacaactacagaaaa

SEQ ID NO: 5613232 - DNA, 16 bp, Homo sapiens
gacaactagatttgtc

SEQ ID NO: 5613233 - DNA, 21 bp, Homo sapiens
gacaactatcaattcttgaga

SEQ ID NO: 5613234 - DNA, 17 bp, Homo sapiens
gacaactgaaagaaaaa

SEQ ID NO: 5613235 - DNA, 14 bp, Homo sapiens
gacaactgaagaga

SEQ ID NO: 5613236 - DNA, 19 bp, Homo sapiens
gacaactgctcccacctcc

SEQ ID NO: 5613237 - DNA, 12 bp, Homo sapiens
gacaactggcag

SEQ ID NO: 5613238 - DNA, 13 bp, Homo sapiens
gacaactggcagg

SEQ ID NO: 5613239 - DNA, 16 bp, Homo sapiens
gacaactggcaggcag

SEQ ID NO: 5613240 - DNA, 18 bp, Homo sapiens
gacaactggcaggcaggc

SEQ ID NO: 5613241 - DNA, 23 bp, Homo sapiens
gacaactgttttaataaaagatt

SEQ ID NO: 5613242 - DNA, 22 bp, Homo sapiens
gacaacttatttaaaaatattt

SEQ ID NO: 5613243 - DNA, 22 bp, Homo sapiens
gacaacttgctcctttccatca

SEQ ID NO: 5613244 - DNA, 20 bp, Homo sapiens
gacaagaaaagaggaaaaaa

SEQ ID NO: 5613245 - DNA, 15 bp, Homo sapiens
gacaagaaaatcagg

SEQ ID NO: 5613246 - DNA, 18 bp, Homo sapiens
gacaagaaaggcagacac

SEQ ID NO: 5613247 - DNA, 23 bp, Homo sapiens
gacaagaaaggcagacacaccgc

SEQ ID NO: 5613248 - DNA, 16 bp, Homo sapiens
gacaagaaatccctgt

SEQ ID NO: 5613249 - DNA, 13 bp, Homo sapiens
gacaagaagcaaa

SEQ ID NO: 5613250 - DNA, 19 bp, Homo sapiens
gacaagaagcaaatttttt

SEQ ID NO: 5613251 - DNA, 15 bp, Homo sapiens
gacaagaagctgcta

SEQ ID NO: 5613252 - DNA, 21 bp, Homo sapiens
gacaagacaaaccaagtcgga

SEQ ID NO: 5613253 - DNA, 16 bp, Homo sapiens
gacaagacagagggga

SEQ ID NO: 5613254 - DNA, 14 bp, Homo sapiens
gacaagacaggcag

SEQ ID NO: 5613255 - DNA, 13 bp, Homo sapiens
gacaagaccctct

SEQ ID NO: 5613256 - DNA, 19 bp, Homo sapiens
gacaagaccctctcaggct

SEQ ID NO: 5613257 - DNA, 19 bp, Homo sapiens
gacaagacttcagtatgtt

SEQ ID NO: 5613258 - DNA, 14 bp, Homo sapiens
gacaagagatctac

SEQ ID NO: 5613259 - DNA, 19 bp, Homo sapiens
gacaagagatctacacatg

SEQ ID NO: 5613260 - DNA, 14 bp, Homo sapiens
gacaagagatggga

SEQ ID NO: 5613261 - DNA, 23 bp, Homo sapiens
gacaagagcctgatctcttcctg

SEQ ID NO: 5613262 - DNA, 17 bp, Homo sapiens
gacaagagctgctgtcc

SEQ ID NO: 5613263 - DNA, 14 bp, Homo sapiens
gacaagagctgtta

SEQ ID NO: 5613264 - DNA, 14 bp, Homo sapiens
gacaagagtgagac

SEQ ID NO: 5613265 - DNA, 19 bp, Homo sapiens
gacaagataaaggaagtca

SEQ ID NO: 5613266 - DNA, 22 bp, Homo sapiens
gacaagcacaccacaattctcc

SEQ ID NO: 5613267 - DNA, 22 bp, Homo sapiens
gacaagcactattttatattta

SEQ ID NO: 5613268 - DNA, 18 bp, Homo sapiens
gacaagcaggcaggcagc

SEQ ID NO: 5613269 - DNA, 14 bp, Homo sapiens
gacaagcagtccct

SEQ ID NO: 5613270 - DNA, 14 bp, Homo sapiens
gacaagcccaggac

SEQ ID NO: 5613271 - DNA, 20 bp, Homo sapiens
gacaagcccaggacactgcc

SEQ ID NO: 5613272 - DNA, 22 bp, Homo sapiens
gacaagcccaggacactgcctt

SEQ ID NO: 5613273 - DNA, 20 bp, Homo sapiens
gacaagccctggagaaatgg

SEQ ID NO: 5613274 - DNA, 13 bp, Homo sapiens
gacaagccctggc

SEQ ID NO: 5613275 - DNA, 15 bp, Homo sapiens
gacaagcctggagga

SEQ ID NO: 5613276 - DNA, 20 bp, Homo sapiens
gacaagctgacttggcactt

SEQ ID NO: 5613277 - DNA, 22 bp, Homo sapiens
gacaagctgacttggcacttaa

SEQ ID NO: 5613278 - DNA, 14 bp, Homo sapiens
gacaagctggctta

SEQ ID NO: 5613279 - DNA, 20 bp, Homo sapiens
gacaagctggcttacactgg

SEQ ID NO: 5613280 - DNA, 22 bp, Homo sapiens
gacaagctgttgaccaggcacc

SEQ ID NO: 5613281 - DNA, 16 bp, Homo sapiens
gacaagcttaggtcat

SEQ ID NO: 5613282 - DNA, 12 bp, Homo sapiens
gacaaggaaaat

SEQ ID NO: 5613283 - DNA, 14 bp, Homo sapiens
gacaaggaaaatct

SEQ ID NO: 5613284 - DNA, 20 bp, Homo sapiens
gacaaggaaaatctatattt

SEQ ID NO: 5613285 - DNA, 17 bp, Homo sapiens
gacaaggaaaggcaaat

SEQ ID NO: 5613286 - DNA, 19 bp, Homo sapiens
gacaaggaaaggcaaatgc

SEQ ID NO: 5613287 - DNA, 16 bp, Homo sapiens
gacaaggaagtggggg

SEQ ID NO: 5613288 - DNA, 21 bp, Homo sapiens
gacaaggaagtgggggccgct

SEQ ID NO: 5613289 - DNA, 14 bp, Homo sapiens
gacaaggagagcgg

SEQ ID NO: 5613290 - DNA, 21 bp, Homo sapiens
gacaaggattgctactgtcct

SEQ ID NO: 5613291 - DNA, 15 bp, Homo sapiens
gacaaggcaggcctg

SEQ ID NO: 5613292 - DNA, 15 bp, Homo sapiens
gacaaggcctgcttg

SEQ ID NO: 5613293 - DNA, 19 bp, Homo sapiens
gacaaggccttgctcactc

SEQ ID NO: 5613294 - DNA, 21 bp, Homo sapiens
gacaaggctgtgccaggctgg

SEQ ID NO: 5613295 - DNA, 22 bp, Homo sapiens
gacaaggctgtgccaggctggg

SEQ ID NO: 5613296 - DNA, 13 bp, Homo sapiens
gacaagggctgac

SEQ ID NO: 5613297 - DNA, 15 bp, Homo sapiens
gacaagggctgacct

SEQ ID NO: 5613298 - DNA, 11 bp, Homo sapiens
gacaaggggcg

SEQ ID NO: 5613299 - DNA, 15 bp, Homo sapiens
gacaaggggtggaag

SEQ ID NO: 5613300 - DNA, 22 bp, Homo sapiens
gacaaggggtggaagggcagga

SEQ ID NO: 5613301 - DNA, 16 bp, Homo sapiens
gacaaggtagacatgg

SEQ ID NO: 5613302 - DNA, 14 bp, Homo sapiens
gacaaggtagccct

SEQ ID NO: 5613303 - DNA, 23 bp, Homo sapiens
gacaaggtagccctggccagagg

SEQ ID NO: 5613304 - DNA, 16 bp, Homo sapiens
gacaaggtgcaggcag

SEQ ID NO: 5613305 - DNA, 13 bp, Homo sapiens
gacaaggtgctaa

SEQ ID NO: 5613306 - DNA, 16 bp, Homo sapiens
gacaaggttgctgttg

SEQ ID NO: 5613307 - DNA, 14 bp, Homo sapiens
gacaagtaatcact

SEQ ID NO: 5613308 - DNA, 23 bp, Homo sapiens
gacaagtaatcactaacccgttt

SEQ ID NO: 5613309 - DNA, 16 bp, Homo sapiens
gacaagtacataaagg

SEQ ID NO: 5613310 - DNA, 19 bp, Homo sapiens
gacaagtacatcacccagt

SEQ ID NO: 5613311 - DNA, 20 bp, Homo sapiens
gacaagtctttctcctcttt

SEQ ID NO: 5613312 - DNA, 22 bp, Homo sapiens
gacaagtctttctcctctttga

SEQ ID NO: 5613313 - DNA, 23 bp, Homo sapiens
gacaagtctttctcctctttgag

SEQ ID NO: 5613314 - DNA, 16 bp, Homo sapiens
gacaagtgaagaacac

SEQ ID NO: 5613315 - DNA, 19 bp, Homo sapiens
gacaagtgactgtatctgt

SEQ ID NO: 5613316 - DNA, 20 bp, Homo sapiens
gacaagtgactgtatctgtg

SEQ ID NO: 5613317 - DNA, 19 bp, Homo sapiens
gacaagtgattttcattgt

SEQ ID NO: 5613318 - DNA, 14 bp, Homo sapiens
gacaagtggagggg

SEQ ID NO: 5613319 - DNA, 22 bp, Homo sapiens
gacaagttggaaaaacaacagc

SEQ ID NO: 5613320 - DNA, 18 bp, Homo sapiens
gacaagttgtttatgtat

SEQ ID NO: 5613321 - DNA, 13 bp, Homo sapiens
gacaataaaacat

SEQ ID NO: 5613322 - DNA, 12 bp, Homo sapiens
gacaataaacag

SEQ ID NO: 5613323 - DNA, 22 bp, Homo sapiens
gacaataaaccctcagagcctc

SEQ ID NO: 5613324 - DNA, 21 bp, Homo sapiens
gacaataaacctccgccaatg

SEQ ID NO: 5613325 - DNA, 21 bp, Homo sapiens
gacaataaagatatttccaag

SEQ ID NO: 5613326 - DNA, 22 bp, Homo sapiens
gacaataaagatatttccaaga

SEQ ID NO: 5613327 - DNA, 12 bp, Homo sapiens
gacaataaataa

SEQ ID NO: 5613328 - DNA, 13 bp, Homo sapiens
gacaataagaaac

SEQ ID NO: 5613329 - DNA, 21 bp, Homo sapiens
gacaataatattgttgtataa

SEQ ID NO: 5613330 - DNA, 13 bp, Homo sapiens
gacaataatttca

SEQ ID NO: 5613331 - DNA, 22 bp, Homo sapiens
gacaatactccctttaaagaga

SEQ ID NO: 5613332 - DNA, 19 bp, Homo sapiens
gacaatactgtatgtcgtc

SEQ ID NO: 5613333 - DNA, 21 bp, Homo sapiens
gacaatagggctaaatgttta

SEQ ID NO: 5613334 - DNA, 16 bp, Homo sapiens
gacaatagtatttctc

SEQ ID NO: 5613335 - DNA, 16 bp, Homo sapiens
gacaatcaaagaaaag

SEQ ID NO: 5613336 - DNA, 17 bp, Homo sapiens
gacaatcaactctaata

SEQ ID NO: 5613337 - DNA, 18 bp, Homo sapiens
gacaatcacgggcggtcc

SEQ ID NO: 5613338 - DNA, 12 bp, Homo sapiens
gacaatcactgc

SEQ ID NO: 5613339 - DNA, 13 bp, Homo sapiens
gacaatcactgcc

SEQ ID NO: 5613340 - DNA, 16 bp, Homo sapiens
gacaatcagtcccctc

SEQ ID NO: 5613341 - DNA, 21 bp, Homo sapiens
gacaatcatgaaatatgcatc

SEQ ID NO: 5613342 - DNA, 17 bp, Homo sapiens
gacaatcattgttttga

SEQ ID NO: 5613343 - DNA, 13 bp, Homo sapiens
gacaatctatttt

SEQ ID NO: 5613344 - DNA, 23 bp, Homo sapiens
gacaatctgcaaaatggagagaa

SEQ ID NO: 5613345 - DNA, 14 bp, Homo sapiens
gacaatgaaaaatc

SEQ ID NO: 5613346 - DNA, 19 bp, Homo sapiens
gacaatgaaatactccagc

SEQ ID NO: 5613347 - DNA, 15 bp, Homo sapiens
gacaatgaagggaaa

SEQ ID NO: 5613348 - DNA, 19 bp, Homo sapiens
gacaatgatgtgagtaccc

SEQ ID NO: 5613349 - DNA, 18 bp, Homo sapiens
gacaatgatttggccagg

SEQ ID NO: 5613350 - DNA, 12 bp, Homo sapiens
gacaatgcaaac

SEQ ID NO: 5613351 - DNA, 19 bp, Homo sapiens
gacaatgcagatgccagag

SEQ ID NO: 5613352 - DNA, 20 bp, Homo sapiens
gacagataaatccttaacat

SEQ ID NO: 5613353 - DNA, 19 bp, Homo sapiens
gacagatacatagatggac

SEQ ID NO: 5613354 - DNA, 22 bp, Homo sapiens
gacagatacatagatggaccag

SEQ ID NO: 5613355 - DNA, 21 bp, Homo sapiens
gacagatacctccaaccctgc

SEQ ID NO: 5613356 - DNA, 15 bp, Homo sapiens
gacagatattttatc

SEQ ID NO: 5613357 - DNA, 14 bp, Homo sapiens
gacagatcaagctg

SEQ ID NO: 5613358 - DNA, 23 bp, Homo sapiens
gacagatcaagctgtgagacagt

SEQ ID NO: 5613359 - DNA, 17 bp, Homo sapiens
gacagatcactcctgga

SEQ ID NO: 5613360 - DNA, 20 bp, Homo sapiens
gacagatcatagatttctga

SEQ ID NO: 5613361 - DNA, 17 bp, Homo sapiens
gacagatctcaatttta

SEQ ID NO: 5613362 - DNA, 19 bp, Homo sapiens
gacagatctctgctttgga

SEQ ID NO: 5613363 - DNA, 16 bp, Homo sapiens
gacagatgaagaagga

SEQ ID NO: 5613364 - DNA, 17 bp, Homo sapiens
gacagatgagcaggagc

SEQ ID NO: 5613365 - DNA, 19 bp, Homo sapiens
gacagatgagcaggagctt

SEQ ID NO: 5613366 - DNA, 16 bp, Homo sapiens
gacagatgaggctttc

SEQ ID NO: 5613367 - DNA, 20 bp, Homo sapiens
gacagatggacactgccaag

SEQ ID NO: 5613368 - DNA, 14 bp, Homo sapiens
gacagatggaccaa

SEQ ID NO: 5613369 - DNA, 20 bp, Homo sapiens
gacagatggacgcaggccct

SEQ ID NO: 5613370 - DNA, 22 bp, Homo sapiens
gacagatggacgcaggccctgt

SEQ ID NO: 5613371 - DNA, 16 bp, Homo sapiens
gacagatggcccaagg

SEQ ID NO: 5613372 - DNA, 18 bp, Homo sapiens
gacagatggcccaaggga

SEQ ID NO: 5613373 - DNA, 21 bp, Homo sapiens
gacagatggcccaagggatgg

SEQ ID NO: 5613374 - DNA, 16 bp, Homo sapiens
gacagatgggtgtccc

SEQ ID NO: 5613375 - DNA, 22 bp, Homo sapiens
gacagatgggtgtcccctggtg

SEQ ID NO: 5613376 - DNA, 19 bp, Homo sapiens
gacagatgtcagcttccca

SEQ ID NO: 5613377 - DNA, 14 bp, Homo sapiens
gacagatgtggaca

SEQ ID NO: 5613378 - DNA, 18 bp, Homo sapiens
gacagatgtggacatgca

SEQ ID NO: 5613379 - DNA, 19 bp, Homo sapiens
gacagatgtggacatgcac

SEQ ID NO: 5613380 - DNA, 20 bp, Homo sapiens
gacagatgtggacatgcacc

SEQ ID NO: 5613381 - DNA, 12 bp, Homo sapiens
gacagatgttat

SEQ ID NO: 5613382 - DNA, 23 bp, Homo sapiens
gacagatgttccatcctgtacaa

SEQ ID NO: 5613383 - DNA, 22 bp, Homo sapiens
gacagatttgaggactgaagct

SEQ ID NO: 5613384 - DNA, 15 bp, Homo sapiens
gacagcaaaaactat

SEQ ID NO: 5613385 - DNA, 22 bp, Homo sapiens
gacagcaacaaaatcatggctt

SEQ ID NO: 5613386 - DNA, 22 bp, Homo sapiens
gacagcaacggggaggccaagt

SEQ ID NO: 5613387 - DNA, 19 bp, Homo sapiens
gacagcaaggtgtggaggc

SEQ ID NO: 5613388 - DNA, 20 bp, Homo sapiens
gacagcaaggtgtggaggct

SEQ ID NO: 5613389 - DNA, 23 bp, Homo sapiens
gacagcaaggtgtggaggctcct

SEQ ID NO: 5613390 - DNA, 19 bp, Homo sapiens
gacagcaattcatggttca

SEQ ID NO: 5613391 - DNA, 22 bp, Homo sapiens
gacagcaattcatggttcaagt

SEQ ID NO: 5613392 - DNA, 15 bp, Homo sapiens
gacagcacacacagt

SEQ ID NO: 5613393 - DNA, 16 bp, Homo sapiens
gacagcacagatgtga

SEQ ID NO: 5613394 - DNA, 18 bp, Homo sapiens
gacagcacagatgtgaag

SEQ ID NO: 5613395 - DNA, 15 bp, Homo sapiens
gacagcacaggcagc

SEQ ID NO: 5613396 - DNA, 12 bp, Homo sapiens
gacagcacaggg

SEQ ID NO: 5613397 - DNA, 22 bp, Homo sapiens
gacagcacagggcaggggtggt

SEQ ID NO: 5613398 - DNA, 14 bp, Homo sapiens
gacagcaccactgc

SEQ ID NO: 5613399 - DNA, 24 bp, Homo sapiens
gacagcagacaagagggcaagcct

SEQ ID NO: 5613400 - DNA, 16 bp, Homo sapiens
gacagcagcagcctgc

SEQ ID NO: 5613401 - DNA, 19 bp, Homo sapiens
gacagcagcagcctgcacc

SEQ ID NO: 5613402 - DNA, 12 bp, Homo sapiens
gacagcagcctg

SEQ ID NO: 5613403 - DNA, 13 bp, Homo sapiens
gacagcagctcag

SEQ ID NO: 5613404 - DNA, 20 bp, Homo sapiens
gacagcagctcaggcacact

SEQ ID NO: 5613405 - DNA, 22 bp, Homo sapiens
gacagcagctggactgggtggg

SEQ ID NO: 5613406 - DNA, 13 bp, Homo sapiens
gacagcagctggt

SEQ ID NO: 5613407 - DNA, 22 bp, Homo sapiens
gacagcagctggtgccccacct

SEQ ID NO: 5613408 - DNA, 14 bp, Homo sapiens
gacagcaggcagcg

SEQ ID NO: 5613409 - DNA, 12 bp, Homo sapiens
gacagcaggtgg

SEQ ID NO: 5613410 - DNA, 16 bp, Homo sapiens
gacagcaggtgggaaa

SEQ ID NO: 5613411 - DNA, 15 bp, Homo sapiens
gacagcagtgtgagg

SEQ ID NO: 5613412 - DNA, 12 bp, Homo sapiens
gacagcatatag

SEQ ID NO: 5613413 - DNA, 20 bp, Homo sapiens
gacagcatcccttcccacat

SEQ ID NO: 5613414 - DNA, 21 bp, Homo sapiens
gacagcatcccttcccacatg

SEQ ID NO: 5613415 - DNA, 20 bp, Homo sapiens
gacagcatgactggacagcg

SEQ ID NO: 5613416 - DNA, 12 bp, Homo sapiens
gacagcatgaga

SEQ ID NO: 5613417 - DNA, 15 bp, Homo sapiens
gacagcatgcccctt

SEQ ID NO: 5613418 - DNA, 13 bp, Homo sapiens
gacagcatggtgc

SEQ ID NO: 5613419 - DNA, 18 bp, Homo sapiens
gacagcatgtgccctcct

SEQ ID NO: 5613420 - DNA, 19 bp, Homo sapiens
gacagcatgtgccctcctg

SEQ ID NO: 5613421 - DNA, 23 bp, Homo sapiens
gacagcattttcctctgctttga

SEQ ID NO: 5613422 - DNA, 16 bp, Homo sapiens
gacagccaaaagtaag

SEQ ID NO: 5613423 - DNA, 18 bp, Homo sapiens
gacagccaaaggctggcg

SEQ ID NO: 5613424 - DNA, 18 bp, Homo sapiens
gacagccaagcacctcca

SEQ ID NO: 5613425 - DNA, 13 bp, Homo sapiens
gacagccacggcc

SEQ ID NO: 5613426 - DNA, 14 bp, Homo sapiens
gacagccacggcca

SEQ ID NO: 5613427 - DNA, 18 bp, Homo sapiens
gacagccacggccaggcc

SEQ ID NO: 5613428 - DNA, 19 bp, Homo sapiens
gacagccacggccaggcca

SEQ ID NO: 5613429 - DNA, 21 bp, Homo sapiens
gacagccacggccaggccaga

SEQ ID NO: 5613430 - DNA, 13 bp, Homo sapiens
gacagccagaact

SEQ ID NO: 5613431 - DNA, 14 bp, Homo sapiens
gacagccagagcct

SEQ ID NO: 5613432 - DNA, 11 bp, Homo sapiens
gacagccaggg

SEQ ID NO: 5613433 - DNA, 12 bp, Homo sapiens
gacagccagggc

SEQ ID NO: 5613434 - DNA, 18 bp, Homo sapiens
gacagccagggcagggct

SEQ ID NO: 5613435 - DNA, 17 bp, Homo sapiens
gacagccaggtggcacc

SEQ ID NO: 5613436 - DNA, 15 bp, Homo sapiens
gacagccatacttcc

SEQ ID NO: 5613437 - DNA, 14 bp, Homo sapiens
gacagcccacggtc

SEQ ID NO: 5613438 - DNA, 11 bp, Homo sapiens
gacagcccaga

SEQ ID NO: 5613439 - DNA, 17 bp, Homo sapiens
gacagcccagagcctgg

SEQ ID NO: 5613440 - DNA, 13 bp, Homo sapiens
gacagcccagcct

SEQ ID NO: 5613441 - DNA, 19 bp, Homo sapiens
gacagcccagcgccatcct

SEQ ID NO: 5613442 - DNA, 16 bp, Homo sapiens
gacagccccagagcag

SEQ ID NO: 5613443 - DNA, 19 bp, Homo sapiens
gacagccccagagcagggt

SEQ ID NO: 5613444 - DNA, 13 bp, Homo sapiens
gacagccccaggg

SEQ ID NO: 5613445 - DNA, 15 bp, Homo sapiens
gacagccccctgccc

SEQ ID NO: 5613446 - DNA, 17 bp, Homo sapiens
gacagccccctgccccg

SEQ ID NO: 5613447 - DNA, 21 bp, Homo sapiens
gacagccccctgccccgcagg

SEQ ID NO: 5613448 - DNA, 17 bp, Homo sapiens
gacagcccctccctcct

SEQ ID NO: 5613449 - DNA, 14 bp, Homo sapiens
gacagcccgggctc

SEQ ID NO: 5613450 - DNA, 19 bp, Homo sapiens
gacagcccgggctctgcct

SEQ ID NO: 5613451 - DNA, 13 bp, Homo sapiens
gacagccctccat

SEQ ID NO: 5613452 - DNA, 15 bp, Homo sapiens
gacagccctgcctat

SEQ ID NO: 5613453 - DNA, 15 bp, Homo sapiens
gacagccctggggga

SEQ ID NO: 5613454 - DNA, 18 bp, Homo sapiens
gacagccggatcttggag

SEQ ID NO: 5613455 - DNA, 16 bp, Homo sapiens
gacagccgggaggagc

SEQ ID NO: 5613456 - DNA, 15 bp, Homo sapiens
gacagcctccacctt

SEQ ID NO: 5613457 - DNA, 20 bp, Homo sapiens
gacagcctccccctgtcccc

SEQ ID NO: 5613458 - DNA, 16 bp, Homo sapiens
gacagcctccgccaag

SEQ ID NO: 5613459 - DNA, 22 bp, Homo sapiens
gacagcctcctaggctccctga

SEQ ID NO: 5613460 - DNA, 19 bp, Homo sapiens
gacagcctctgactcacca

SEQ ID NO: 5613461 - DNA, 23 bp, Homo sapiens
gacagcctcttcagccccttctc

SEQ ID NO: 5613462 - DNA, 20 bp, Homo sapiens
gacagcctgcctctgccaca

SEQ ID NO: 5613463 - DNA, 19 bp, Homo sapiens
gacagcctgtttctatcct

SEQ ID NO: 5613464 - DNA, 20 bp, Homo sapiens
gacagcctgtttctatcctg

SEQ ID NO: 5613465 - DNA, 23 bp, Homo sapiens
gacagccttccccagctccagca

SEQ ID NO: 5613466 - DNA, 18 bp, Homo sapiens
gacagccttgggcctttc

SEQ ID NO: 5613467 - DNA, 19 bp, Homo sapiens
gacagccttgggcctttca

SEQ ID NO: 5613468 - DNA, 15 bp, Homo sapiens
gacagcgatggcagg

SEQ ID NO: 5613469 - DNA, 24 bp, Homo sapiens
gacagcgatggcaggcctgaccca

SEQ ID NO: 5613470 - DNA, 16 bp, Homo sapiens
gacagcggccccgcgg

SEQ ID NO: 5613471 - DNA, 13 bp, Homo sapiens
gacagcggcccgg

SEQ ID NO: 5613472 - DNA, 18 bp, Homo sapiens
gacagcggcccggcccac

SEQ ID NO: 5613473 - DNA, 18 bp, Homo sapiens
gacagcgggtaaaaagag

SEQ ID NO: 5613474 - DNA, 14 bp, Homo sapiens
gacagcggttgtaa

SEQ ID NO: 5613475 - DNA, 18 bp, Homo sapiens
gacagctacacagagctt

SEQ ID NO: 5613476 - DNA, 23 bp, Homo sapiens
gacagctaccggaaggaggggaa

SEQ ID NO: 5613477 - DNA, 17 bp, Homo sapiens
gacagctacttctggga

SEQ ID NO: 5613478 - DNA, 12 bp, Homo sapiens
gacagctccacc

SEQ ID NO: 5613479 - DNA, 14 bp, Homo sapiens
gacagctccttctg

SEQ ID NO: 5613480 - DNA, 17 bp, Homo sapiens
gacagctccttctgtcc

SEQ ID NO: 5613481 - DNA, 19 bp, Homo sapiens
gacagctccttctgtccta

SEQ ID NO: 5613482 - DNA, 18 bp, Homo sapiens
gacagctcttcttgaaaa

SEQ ID NO: 5613483 - DNA, 13 bp, Homo sapiens
gacagctgacaga

SEQ ID NO: 5613484 - DNA, 16 bp, Homo sapiens
gacagctgacagatac

SEQ ID NO: 5613485 - DNA, 19 bp, Homo sapiens
gacagctgactgaatgcag

SEQ ID NO: 5613486 - DNA, 18 bp, Homo sapiens
gacagctgataaatttaa

SEQ ID NO: 5613487 - DNA, 18 bp, Homo sapiens
gacagctgcaggtgccca

SEQ ID NO: 5613488 - DNA, 16 bp, Homo sapiens
gacagctgcattccag

SEQ ID NO: 5613489 - DNA, 18 bp, Homo sapiens
gacagctgcccagacaca

SEQ ID NO: 5613490 - DNA, 19 bp, Homo sapiens
gacagctgcccagacacat

SEQ ID NO: 5613491 - DNA, 13 bp, Homo sapiens
gacagctgcctgg

SEQ ID NO: 5613492 - DNA, 15 bp, Homo sapiens
gacagctgcctggga

SEQ ID NO: 5613493 - DNA, 16 bp, Homo sapiens
gacagctgctcagagc

SEQ ID NO: 5613494 - DNA, 20 bp, Homo sapiens
gacagctgctcctagaggga

SEQ ID NO: 5613495 - DNA, 13 bp, Homo sapiens
gacagctgctggg

SEQ ID NO: 5613496 - DNA, 19 bp, Homo sapiens
gacagctgctgggacccac

SEQ ID NO: 5613497 - DNA, 22 bp, Homo sapiens
gacagctgctgggacccacctc

SEQ ID NO: 5613498 - DNA, 18 bp, Homo sapiens
gacagctgcttctgtgca

SEQ ID NO: 5613499 - DNA, 18 bp, Homo sapiens
gacagctggcggaggctg

SEQ ID NO: 5613500 - DNA, 14 bp, Homo sapiens
gacagctggctgct

SEQ ID NO: 5613501 - DNA, 14 bp, Homo sapiens
gacagctggctggg

SEQ ID NO: 5613502 - DNA, 22 bp, Homo sapiens
gacagctggctgggccttcacc

SEQ ID NO: 5613503 - DNA, 15 bp, Homo sapiens
gacagctgtagtcat

SEQ ID NO: 5613504 - DNA, 17 bp, Homo sapiens
gacagctgtccctgtca

SEQ ID NO: 5613505 - DNA, 19 bp, Homo sapiens
gacagctgtcctgagctaa

SEQ ID NO: 5613506 - DNA, 13 bp, Homo sapiens
gacagctgtgccg

SEQ ID NO: 5613507 - DNA, 19 bp, Homo sapiens
gacagctgtgcctcgctcc

SEQ ID NO: 5613508 - DNA, 13 bp, Homo sapiens
gacagctgttcca

SEQ ID NO: 5613509 - DNA, 18 bp, Homo sapiens
gacagctgttccacaggg

SEQ ID NO: 5613510 - DNA, 23 bp, Homo sapiens
gacagcttacaggagccagcctg

SEQ ID NO: 5613511 - DNA, 18 bp, Homo sapiens
gacagcttactgcagcac

SEQ ID NO: 5613512 - DNA, 20 bp, Homo sapiens
gacagcttactgcagcactg

SEQ ID NO: 5613513 - DNA, 14 bp, Homo sapiens
gacagcttcctcac

SEQ ID NO: 5613514 - DNA, 15 bp, Homo sapiens
gacagcttctctgca

SEQ ID NO: 5613515 - DNA, 18 bp, Homo sapiens
gacagcttctctgcagta

SEQ ID NO: 5613516 - DNA, 23 bp, Homo sapiens
gacagcttgacttgtggggcagg

SEQ ID NO: 5613517 - DNA, 15 bp, Homo sapiens
gacagcttgagaagg

SEQ ID NO: 5613518 - DNA, 22 bp, Homo sapiens
gacagcttgagccgggcccctg

SEQ ID NO: 5613519 - DNA, 14 bp, Homo sapiens
gacagcttgtatgt

SEQ ID NO: 5613520 - DNA, 20 bp, Homo sapiens
gacagctttactttaaaatt

SEQ ID NO: 5613521 - DNA, 20 bp, Homo sapiens
gacagctttctaactcacag

SEQ ID NO: 5613522 - DNA, 17 bp, Homo sapiens
gacagctttctgggatg

SEQ ID NO: 5613523 - DNA, 23 bp, Homo sapiens
gacagctttctgggatgtcacag

SEQ ID NO: 5613524 - DNA, 12 bp, Homo sapiens
gacagctttgct

SEQ ID NO: 5613525 - DNA, 15 bp, Homo sapiens
gacaggaaaaaccaa

SEQ ID NO: 5613526 - DNA, 18 bp, Homo sapiens
gacaggaaaatcctctgg

SEQ ID NO: 5613527 - DNA, 19 bp, Homo sapiens
gacaggaaaatcctctggc

SEQ ID NO: 5613528 - DNA, 13 bp, Homo sapiens
gacaggaaagaat

SEQ ID NO: 5613529 - DNA, 14 bp, Homo sapiens
gacaggaaagccag

SEQ ID NO: 5613530 - DNA, 14 bp, Homo sapiens
gacattctaatgca

SEQ ID NO: 5613531 - DNA, 18 bp, Homo sapiens
gacattctcaaagcctct

SEQ ID NO: 5613532 - DNA, 13 bp, Homo sapiens
gacattctcacat

SEQ ID NO: 5613533 - DNA, 19 bp, Homo sapiens
gacattctctttgataaca

SEQ ID NO: 5613534 - DNA, 12 bp, Homo sapiens
gacattctgaat

SEQ ID NO: 5613535 - DNA, 14 bp, Homo sapiens
gacattctgaatgc

SEQ ID NO: 5613536 - DNA, 15 bp, Homo sapiens
gacattctgaatgct

SEQ ID NO: 5613537 - DNA, 22 bp, Homo sapiens
gacattctgaatgcttctaagt

SEQ ID NO: 5613538 - DNA, 22 bp, Homo sapiens
gacattctgattcgaatgacac

SEQ ID NO: 5613539 - DNA, 23 bp, Homo sapiens
gacattctgattcgaatgacact

SEQ ID NO: 5613540 - DNA, 21 bp, Homo sapiens
gacattcttgtaaggctttga

SEQ ID NO: 5613541 - DNA, 14 bp, Homo sapiens
gacattgaaagctc

SEQ ID NO: 5613542 - DNA, 20 bp, Homo sapiens
gacattgaagtgtttaaaag

SEQ ID NO: 5613543 - DNA, 16 bp, Homo sapiens
gacattgacagcaatt

SEQ ID NO: 5613544 - DNA, 16 bp, Homo sapiens
gacattgatgtgttcg

SEQ ID NO: 5613545 - DNA, 13 bp, Homo sapiens
gacattgcagagt

SEQ ID NO: 5613546 - DNA, 20 bp, Homo sapiens
gacattgcctccacctctcc

SEQ ID NO: 5613547 - DNA, 15 bp, Homo sapiens
gacattgcggacagc

SEQ ID NO: 5613548 - DNA, 23 bp, Homo sapiens
gacattggcacctaatccaggca

SEQ ID NO: 5613549 - DNA, 21 bp, Homo sapiens
gacattgggtctattccagct

SEQ ID NO: 5613550 - DNA, 12 bp, Homo sapiens
gacattgtaaat

SEQ ID NO: 5613551 - DNA, 13 bp, Homo sapiens
gacattgtaaata

SEQ ID NO: 5613552 - DNA, 16 bp, Homo sapiens
gacattgtaaataaat

SEQ ID NO: 5613553 - DNA, 20 bp, Homo sapiens
gacattgtatgcagggagca

SEQ ID NO: 5613554 - DNA, 23 bp, Homo sapiens
gacattgtatgcagggagcactg

SEQ ID NO: 5613555 - DNA, 12 bp, Homo sapiens
gacattgtcaat

SEQ ID NO: 5613556 - DNA, 17 bp, Homo sapiens
gacattgtcagaatgtt

SEQ ID NO: 5613557 - DNA, 21 bp, Homo sapiens
gacattgtctcctatatattt

SEQ ID NO: 5613558 - DNA, 19 bp, Homo sapiens
gacattgttacaaggacat

SEQ ID NO: 5613559 - DNA, 17 bp, Homo sapiens
gacattgttggcagcat

SEQ ID NO: 5613560 - DNA, 20 bp, Homo sapiens
gacattgtttggatttcctt

SEQ ID NO: 5613561 - DNA, 14 bp, Homo sapiens
gacattgttttgcc

SEQ ID NO: 5613562 - DNA, 20 bp, Homo sapiens
gacattgttttgccaacatt

SEQ ID NO: 5613563 - DNA, 22 bp, Homo sapiens
gacattgttttgccaacattgc

SEQ ID NO: 5613564 - DNA, 13 bp, Homo sapiens
gacatttaaaata

SEQ ID NO: 5613565 - DNA, 18 bp, Homo sapiens
gacatttaaaatagtttt

SEQ ID NO: 5613566 - DNA, 16 bp, Homo sapiens
gacatttaacttttct

SEQ ID NO: 5613567 - DNA, 14 bp, Homo sapiens
gacatttaatttag

SEQ ID NO: 5613568 - DNA, 21 bp, Homo sapiens
gacatttacaccacactttca

SEQ ID NO: 5613569 - DNA, 15 bp, Homo sapiens
gacatttagaacttt

SEQ ID NO: 5613570 - DNA, 14 bp, Homo sapiens
gacatttatatatt

SEQ ID NO: 5613571 - DNA, 14 bp, Homo sapiens
gacatttatattaa

SEQ ID NO: 5613572 - DNA, 18 bp, Homo sapiens
gacatttatattaaataa

SEQ ID NO: 5613573 - DNA, 11 bp, Homo sapiens
gacatttatgt

SEQ ID NO: 5613574 - DNA, 16 bp, Homo sapiens
gacatttatgtacaaa

SEQ ID NO: 5613575 - DNA, 20 bp, Homo sapiens
gacatttatgtacaaaatga

SEQ ID NO: 5613576 - DNA, 20 bp, Homo sapiens
gacatttatgtctcatgtaa

SEQ ID NO: 5613577 - DNA, 21 bp, Homo sapiens
gacatttcaatcactgaaaat

SEQ ID NO: 5613578 - DNA, 14 bp, Homo sapiens
gacatttcatctgg

SEQ ID NO: 5613579 - DNA, 18 bp, Homo sapiens
gacatttctaacatatgt

SEQ ID NO: 5613580 - DNA, 19 bp, Homo sapiens
gacatttctaacatatgta

SEQ ID NO: 5613581 - DNA, 21 bp, Homo sapiens
gacatttctaacatatgtatt

SEQ ID NO: 5613582 - DNA, 17 bp, Homo sapiens
gacatttctaattcctg

SEQ ID NO: 5613583 - DNA, 22 bp, Homo sapiens
gacatttctatcttgaatttca

SEQ ID NO: 5613584 - DNA, 13 bp, Homo sapiens
gacatttctcaaa

SEQ ID NO: 5613585 - DNA, 22 bp, Homo sapiens
gacatttctctaactcctgcca

SEQ ID NO: 5613586 - DNA, 16 bp, Homo sapiens
gacatttctctaagag

SEQ ID NO: 5613587 - DNA, 15 bp, Homo sapiens
gacatttctgctctc

SEQ ID NO: 5613588 - DNA, 17 bp, Homo sapiens
gacatttcttttctttt

SEQ ID NO: 5613589 - DNA, 19 bp, Homo sapiens
gacatttcttttcttttta

SEQ ID NO: 5613590 - DNA, 21 bp, Homo sapiens
gacatttcttttctttttaca

SEQ ID NO: 5613591 - DNA, 12 bp, Homo sapiens
gacatttgaatt

SEQ ID NO: 5613592 - DNA, 18 bp, Homo sapiens
gacatttgacagtgtggg

SEQ ID NO: 5613593 - DNA, 15 bp, Homo sapiens
gacatttgccttgct

SEQ ID NO: 5613594 - DNA, 22 bp, Homo sapiens
gacatttgggagacatgtgaca

SEQ ID NO: 5613595 - DNA, 17 bp, Homo sapiens
gacatttgtcattttca

SEQ ID NO: 5613596 - DNA, 23 bp, Homo sapiens
gacatttgtcctgcagagctggg

SEQ ID NO: 5613597 - DNA, 14 bp, Homo sapiens
gacattttaacaag

SEQ ID NO: 5613598 - DNA, 22 bp, Homo sapiens
gacattttaacaagaagatgaa

SEQ ID NO: 5613599 - DNA, 14 bp, Homo sapiens
gacattttacatta

SEQ ID NO: 5613600 - DNA, 21 bp, Homo sapiens
gacattttatgtctttcttgt

SEQ ID NO: 5613601 - DNA, 11 bp, Homo sapiens
gacattttcat

SEQ ID NO: 5613602 - DNA, 16 bp, Homo sapiens
gacattttcctcacac

SEQ ID NO: 5613603 - DNA, 17 bp, Homo sapiens
gacattttctcttagag

SEQ ID NO: 5613604 - DNA, 15 bp, Homo sapiens
gacattttcttcaga

SEQ ID NO: 5613605 - DNA, 18 bp, Homo sapiens
gacattttcttttattat

SEQ ID NO: 5613606 - DNA, 23 bp, Homo sapiens
gacattttcttttattatcagtt

SEQ ID NO: 5613607 - DNA, 17 bp, Homo sapiens
gacattttgaaataaaa

SEQ ID NO: 5613608 - DNA, 15 bp, Homo sapiens
gacattttgccaaaa

SEQ ID NO: 5613609 - DNA, 13 bp, Homo sapiens
gacattttgtagc

SEQ ID NO: 5613610 - DNA, 14 bp, Homo sapiens
gacattttgttttt

SEQ ID NO: 5613611 - DNA, 15 bp, Homo sapiens
gacattttttcagtc

SEQ ID NO: 5613612 - DNA, 17 bp, Homo sapiens
gacatttttttcccttg

SEQ ID NO: 5613613 - DNA, 22 bp, Homo sapiens
gacatttttttctgatttgtcc

SEQ ID NO: 5613614 - DNA, 18 bp, Homo sapiens
gacatttttttgttccaa

SEQ ID NO: 5613615 - DNA, 17 bp, Homo sapiens
gaccaaaaaaataaggt

SEQ ID NO: 5613616 - DNA, 19 bp, Homo sapiens
gaccaaaaaccagtattgt

SEQ ID NO: 5613617 - DNA, 15 bp, Homo sapiens
gaccaaaaccagagg

SEQ ID NO: 5613618 - DNA, 16 bp, Homo sapiens
gaccaaaaccagaggg

SEQ ID NO: 5613619 - DNA, 18 bp, Homo sapiens
gaccaaaagatgggtggt

SEQ ID NO: 5613620 - DNA, 19 bp, Homo sapiens
gaccaaaagtgagatggga

SEQ ID NO: 5613621 - DNA, 21 bp, Homo sapiens
gaccaaaagtgagatgggaag

SEQ ID NO: 5613622 - DNA, 14 bp, Homo sapiens
gaccaaaagttaca

SEQ ID NO: 5613623 - DNA, 13 bp, Homo sapiens
gaccaaaatcccc

SEQ ID NO: 5613624 - DNA, 19 bp, Homo sapiens
gaccaaaatccccttctca

SEQ ID NO: 5613625 - DNA, 18 bp, Homo sapiens
gaccaaaatgtgtttcat

SEQ ID NO: 5613626 - DNA, 22 bp, Homo sapiens
gaccaaaattactaataaattg

SEQ ID NO: 5613627 - DNA, 16 bp, Homo sapiens
gaccaaaccagccttc

SEQ ID NO: 5613628 - DNA, 19 bp, Homo sapiens
gaccaaacccttagcagcc

SEQ ID NO: 5613629 - DNA, 22 bp, Homo sapiens
gaccaaacccttagcagcccag

SEQ ID NO: 5613630 - DNA, 23 bp, Homo sapiens
gaccaaacccttagcagcccagc

SEQ ID NO: 5613631 - DNA, 19 bp, Homo sapiens
gaccaaactacttcatttt

SEQ ID NO: 5613632 - DNA, 18 bp, Homo sapiens
gaccaaactcagttcaaa

SEQ ID NO: 5613633 - DNA, 18 bp, Homo sapiens
gaccaaacttcactctgg

SEQ ID NO: 5613634 - DNA, 20 bp, Homo sapiens
gaccaaagcaaagaaaataa

SEQ ID NO: 5613635 - DNA, 21 bp, Homo sapiens
gaccaaagggagtctgccagg

SEQ ID NO: 5613636 - DNA, 19 bp, Homo sapiens
gaccaaagtcccttcctgc

SEQ ID NO: 5613637 - DNA, 19 bp, Homo sapiens
gaccaaatcattgtatcaa

SEQ ID NO: 5613638 - DNA, 18 bp, Homo sapiens
gaccaaatcgagtgatag

SEQ ID NO: 5613639 - DNA, 18 bp, Homo sapiens
gaccaaatctcagttgtt

SEQ ID NO: 5613640 - DNA, 19 bp, Homo sapiens
gaccaaatgtagttttgta

SEQ ID NO: 5613641 - DNA, 20 bp, Homo sapiens
gaccaaattctatcctgtga

SEQ ID NO: 5613642 - DNA, 17 bp, Homo sapiens
gaccaaattgcttctag

SEQ ID NO: 5613643 - DNA, 17 bp, Homo sapiens
gaccaaattgctttaca

SEQ ID NO: 5613644 - DNA, 15 bp, Homo sapiens
gaccaaattgggaga

SEQ ID NO: 5613645 - DNA, 21 bp, Homo sapiens
gaccaacaaagtcacagtcgt

SEQ ID NO: 5613646 - DNA, 17 bp, Homo sapiens
gaccaacagaaaccttt

SEQ ID NO: 5613647 - DNA, 20 bp, Homo sapiens
gaccaacagaacttcacagt

SEQ ID NO: 5613648 - DNA, 15 bp, Homo sapiens
gaccaacatccagtc

SEQ ID NO: 5613649 - DNA, 22 bp, Homo sapiens
gaccaacatggagaaaccctgt

SEQ ID NO: 5613650 - DNA, 22 bp, Homo sapiens
gaccaacattcaaaagcacaaa

SEQ ID NO: 5613651 - DNA, 16 bp, Homo sapiens
gaccaaccctgggacc

SEQ ID NO: 5613652 - DNA, 14 bp, Homo sapiens
gaccaacctgctct

SEQ ID NO: 5613653 - DNA, 17 bp, Homo sapiens
gaccaactagacattct

SEQ ID NO: 5613654 - DNA, 18 bp, Homo sapiens
gaccaactagacattctg

SEQ ID NO: 5613655 - DNA, 17 bp, Homo sapiens
gaccaactatattgcga

SEQ ID NO: 5613656 - DNA, 13 bp, Homo sapiens
gaccaactccaga

SEQ ID NO: 5613657 - DNA, 17 bp, Homo sapiens
gaccaactctctcctgt

SEQ ID NO: 5613658 - DNA, 13 bp, Homo sapiens
gaccaactggctt

SEQ ID NO: 5613659 - DNA, 18 bp, Homo sapiens
gaccaactggcttctgtg

SEQ ID NO: 5613660 - DNA, 13 bp, Homo sapiens
gaccaactgggcc

SEQ ID NO: 5613661 - DNA, 15 bp, Homo sapiens
gaccaactgtgttgt

SEQ ID NO: 5613662 - DNA, 21 bp, Homo sapiens
gaccaactgtgttgtattaac

SEQ ID NO: 5613663 - DNA, 22 bp, Homo sapiens
gaccaactgtgttgtattaaca

SEQ ID NO: 5613664 - DNA, 15 bp, Homo sapiens
gaccaactttttcat

SEQ ID NO: 5613665 - DNA, 21 bp, Homo sapiens
gaccaactttttcattccctg

SEQ ID NO: 5613666 - DNA, 14 bp, Homo sapiens
gaccaagaaaaaga

SEQ ID NO: 5613667 - DNA, 20 bp, Homo sapiens
gaccaagaaaaagaaaaaaa

SEQ ID NO: 5613668 - DNA, 15 bp, Homo sapiens
gaccaagaactgcat

SEQ ID NO: 5613669 - DNA, 14 bp, Homo sapiens
gaccaagagagaaa

SEQ ID NO: 5613670 - DNA, 18 bp, Homo sapiens
gaccaagagagaaagaag

SEQ ID NO: 5613671 - DNA, 21 bp, Homo sapiens
gaccaagatgatcacatggaa

SEQ ID NO: 5613672 - DNA, 19 bp, Homo sapiens
gaccaagatgggcacatga

SEQ ID NO: 5613673 - DNA, 20 bp, Homo sapiens
gaccaagatgtcaagctggc

SEQ ID NO: 5613674 - DNA, 21 bp, Homo sapiens
gaccaagatgtcaagctggcc

SEQ ID NO: 5613675 - DNA, 15 bp, Homo sapiens
gaccaagatttacca

SEQ ID NO: 5613676 - DNA, 14 bp, Homo sapiens
gaccaagcaggaag

SEQ ID NO: 5613677 - DNA, 17 bp, Homo sapiens
gaccaagcaggaagctc

SEQ ID NO: 5613678 - DNA, 17 bp, Homo sapiens
gaccaagccggtgccca

SEQ ID NO: 5613679 - DNA, 21 bp, Homo sapiens
gaccaagcttgtttccctgct

SEQ ID NO: 5613680 - DNA, 19 bp, Homo sapiens
gaccaaggacccctcacct

SEQ ID NO: 5613681 - DNA, 14 bp, Homo sapiens
gaccaaggagcatc

SEQ ID NO: 5613682 - DNA, 21 bp, Homo sapiens
gaccaaggcagggcccagcat

SEQ ID NO: 5613683 - DNA, 18 bp, Homo sapiens
gaccaagggctgacttct

SEQ ID NO: 5613684 - DNA, 18 bp, Homo sapiens
gaccaaggggtgggccac

SEQ ID NO: 5613685 - DNA, 18 bp, Homo sapiens
gaccaaggtaccgatttc

SEQ ID NO: 5613686 - DNA, 18 bp, Homo sapiens
gaccaaggtgaagcaaat

SEQ ID NO: 5613687 - DNA, 21 bp, Homo sapiens
gaccaaggtgcggaccggagc

SEQ ID NO: 5613688 - DNA, 21 bp, Homo sapiens
gaccaataaaatttctaagag

SEQ ID NO: 5613689 - DNA, 14 bp, Homo sapiens
gaccaatacatttg

SEQ ID NO: 5613690 - DNA, 19 bp, Homo sapiens
gaccaatattaccatctta

SEQ ID NO: 5613691 - DNA, 18 bp, Homo sapiens
gaccaatattcaaatgcg

SEQ ID NO: 5613692 - DNA, 21 bp, Homo sapiens
gaccaatattgtacagttttt

SEQ ID NO: 5613693 - DNA, 15 bp, Homo sapiens
gaccaatccccagcc

SEQ ID NO: 5613694 - DNA, 16 bp, Homo sapiens
gaccaatccccagcct

SEQ ID NO: 5613695 - DNA, 19 bp, Homo sapiens
gaccaatcgggagtagcaa

SEQ ID NO: 5613696 - DNA, 13 bp, Homo sapiens
gaccaatctctgt

SEQ ID NO: 5613697 - DNA, 21 bp, Homo sapiens
gaccaatgccttaattaaaga

SEQ ID NO: 5613698 - DNA, 23 bp, Homo sapiens
gaccaatgccttaattaaagaat

SEQ ID NO: 5613699 - DNA, 14 bp, Homo sapiens
gaccaatgtgaaga

SEQ ID NO: 5613700 - DNA, 15 bp, Homo sapiens
gaccaattgccctgc

SEQ ID NO: 5613701 - DNA, 19 bp, Homo sapiens
gaccaattgccctgccagg

SEQ ID NO: 5613702 - DNA, 17 bp, Homo sapiens
gaccaattgtgctgcca

SEQ ID NO: 5613703 - DNA, 18 bp, Homo sapiens
gaccaatttatgggagaa

SEQ ID NO: 5613704 - DNA, 19 bp, Homo sapiens
gaccaatttgcaccagttt

SEQ ID NO: 5613705 - DNA, 18 bp, Homo sapiens
gaccacaaaacttttcta

SEQ ID NO: 5613706 - DNA, 20 bp, Homo sapiens
gaccacaaggctgaaaagtg

SEQ ID NO: 5613707 - DNA, 22 bp, Homo sapiens
gacccacttctcatcacacaca

SEQ ID NO: 5613708 - DNA, 16 bp, Homo sapiens
gacccagacccagtgg

SEQ ID NO: 5613709 - DNA, 21 bp, Homo sapiens
gacccagacgtggtgcttctc

SEQ ID NO: 5613710 - DNA, 13 bp, Homo sapiens
gacccagactccg

SEQ ID NO: 5613711 - DNA, 18 bp, Homo sapiens
gacccagaggtccaggtc

SEQ ID NO: 5613712 - DNA, 16 bp, Homo sapiens
gacccagagtcccagg

SEQ ID NO: 5613713 - DNA, 13 bp, Homo sapiens
gacccagagtgga

SEQ ID NO: 5613714 - DNA, 18 bp, Homo sapiens
gacccagagtggagtctg

SEQ ID NO: 5613715 - DNA, 15 bp, Homo sapiens
gacccagatcctcac

SEQ ID NO: 5613716 - DNA, 16 bp, Homo sapiens
gacccagatcctcaca

SEQ ID NO: 5613717 - DNA, 15 bp, Homo sapiens
gacccagatctcatg

SEQ ID NO: 5613718 - DNA, 17 bp, Homo sapiens
gacccagatctcatgga

SEQ ID NO: 5613719 - DNA, 13 bp, Homo sapiens
gacccagcactgc

SEQ ID NO: 5613720 - DNA, 12 bp, Homo sapiens
gacccagcagga

SEQ ID NO: 5613721 - DNA, 12 bp, Homo sapiens
gacccagcatct

SEQ ID NO: 5613722 - DNA, 15 bp, Homo sapiens
gacccagcatctccc

SEQ ID NO: 5613723 - DNA, 17 bp, Homo sapiens
gacccagcatctcccag

SEQ ID NO: 5613724 - DNA, 18 bp, Homo sapiens
gacccagcatctcccagc

SEQ ID NO: 5613725 - DNA, 12 bp, Homo sapiens
gacccagccagc

SEQ ID NO: 5613726 - DNA, 16 bp, Homo sapiens
gacccagccagctgca

SEQ ID NO: 5613727 - DNA, 19 bp, Homo sapiens
gacccagccagctgcaggg

SEQ ID NO: 5613728 - DNA, 20 bp, Homo sapiens
gacccagccagctgcagggc

SEQ ID NO: 5613729 - DNA, 17 bp, Homo sapiens
gacccagccaggcccag

SEQ ID NO: 5613730 - DNA, 19 bp, Homo sapiens
gacccagccaggcccagcc

SEQ ID NO: 5613731 - DNA, 10 bp, Homo sapiens
gacccagccc

SEQ ID NO: 5613732 - DNA, 15 bp, Homo sapiens
gacccagccccttcc

SEQ ID NO: 5613733 - DNA, 16 bp, Homo sapiens
gacccagccccttccc

SEQ ID NO: 5613734 - DNA, 16 bp, Homo sapiens
gacccagctactctgt

SEQ ID NO: 5613735 - DNA, 11 bp, Homo sapiens
gacccagctcc

SEQ ID NO: 5613736 - DNA, 12 bp, Homo sapiens
gacccagctcct

SEQ ID NO: 5613737 - DNA, 18 bp, Homo sapiens
gacccagctcctctgagc

SEQ ID NO: 5613738 - DNA, 19 bp, Homo sapiens
gacccagctcctctgagcc

SEQ ID NO: 5613739 - DNA, 20 bp, Homo sapiens
gacccagctcctctgagcca

SEQ ID NO: 5613740 - DNA, 19 bp, Homo sapiens
gacccagctctactccagg

SEQ ID NO: 5613741 - DNA, 19 bp, Homo sapiens
gacccagctgcagaccatg

SEQ ID NO: 5613742 - DNA, 22 bp, Homo sapiens
gacccaggaatagtggacatgg

SEQ ID NO: 5613743 - DNA, 12 bp, Homo sapiens
gacccaggacag

SEQ ID NO: 5613744 - DNA, 13 bp, Homo sapiens
gacccaggacagg

SEQ ID NO: 5613745 - DNA, 18 bp, Homo sapiens
gacccaggacccccgagg

SEQ ID NO: 5613746 - DNA, 14 bp, Homo sapiens
gacccaggagagac

SEQ ID NO: 5613747 - DNA, 16 bp, Homo sapiens
gacccaggagtccaga

SEQ ID NO: 5613748 - DNA, 21 bp, Homo sapiens
gacccaggagtccagcccctc

SEQ ID NO: 5613749 - DNA, 13 bp, Homo sapiens
gacccaggccctc

SEQ ID NO: 5613750 - DNA, 17 bp, Homo sapiens
gacccaggccgcagctc

SEQ ID NO: 5613751 - DNA, 17 bp, Homo sapiens
gacccaggccgcctgcc

SEQ ID NO: 5613752 - DNA, 16 bp, Homo sapiens
gacccaggctcccagc

SEQ ID NO: 5613753 - DNA, 17 bp, Homo sapiens
gacccaggctccgccct

SEQ ID NO: 5613754 - DNA, 14 bp, Homo sapiens
gacccaggctgggc

SEQ ID NO: 5613755 - DNA, 15 bp, Homo sapiens
gacccaggctgggca

SEQ ID NO: 5613756 - DNA, 20 bp, Homo sapiens
gacccagggaacagccactc

SEQ ID NO: 5613757 - DNA, 15 bp, Homo sapiens
gacccagggaatgcc

SEQ ID NO: 5613758 - DNA, 12 bp, Homo sapiens
gacccagggaga

SEQ ID NO: 5613759 - DNA, 14 bp, Homo sapiens
gacccagggcctga

SEQ ID NO: 5613760 - DNA, 16 bp, Homo sapiens
gacccagggcctgact

SEQ ID NO: 5613761 - DNA, 16 bp, Homo sapiens
gacccaggggtccagg

SEQ ID NO: 5613762 - DNA, 17 bp, Homo sapiens
gacccaggggtccaggc

SEQ ID NO: 5613763 - DNA, 23 bp, Homo sapiens
gacccaggggtccaggcccccaa

SEQ ID NO: 5613764 - DNA, 17 bp, Homo sapiens
gacccagggtcccctcc

SEQ ID NO: 5613765 - DNA, 18 bp, Homo sapiens
gacccagggtggtcttca

SEQ ID NO: 5613766 - DNA, 22 bp, Homo sapiens
gacccagggtggtcttcaagcc

SEQ ID NO: 5613767 - DNA, 22 bp, Homo sapiens
gacccaggtcttccagacctgc

SEQ ID NO: 5613768 - DNA, 17 bp, Homo sapiens
gacccaggtgtgcctgt

SEQ ID NO: 5613769 - DNA, 21 bp, Homo sapiens
gacccaggtgtgcctgtgctc

SEQ ID NO: 5613770 - DNA, 22 bp, Homo sapiens
gacccaggtgtgcctgtgctcc

SEQ ID NO: 5613771 - DNA, 16 bp, Homo sapiens
gacccagtcccacact

SEQ ID NO: 5613772 - DNA, 14 bp, Homo sapiens
gacccagtccctgg

SEQ ID NO: 5613773 - DNA, 12 bp, Homo sapiens
gacccagtgaga

SEQ ID NO: 5613774 - DNA, 14 bp, Homo sapiens
gacccagtgcagaa

SEQ ID NO: 5613775 - DNA, 22 bp, Homo sapiens
gacccagtggcagggcacaggg

SEQ ID NO: 5613776 - DNA, 23 bp, Homo sapiens
gacccagtggcagggcacagggc

SEQ ID NO: 5613777 - DNA, 14 bp, Homo sapiens
gacccagtggtcag

SEQ ID NO: 5613778 - DNA, 19 bp, Homo sapiens
gacccagtgtgtgctcagc

SEQ ID NO: 5613779 - DNA, 19 bp, Homo sapiens
gacccatacctttccaggg

SEQ ID NO: 5613780 - DNA, 18 bp, Homo sapiens
gacccatagatcttctga

SEQ ID NO: 5613781 - DNA, 15 bp, Homo sapiens
gacccatctctccct

SEQ ID NO: 5613782 - DNA, 21 bp, Homo sapiens
gacccatctctcccttaccca

SEQ ID NO: 5613783 - DNA, 16 bp, Homo sapiens
gacccatctggaggct

SEQ ID NO: 5613784 - DNA, 20 bp, Homo sapiens
gacccatctggaggctccca

SEQ ID NO: 5613785 - DNA, 15 bp, Homo sapiens
gacccatctttctca

SEQ ID NO: 5613786 - DNA, 23 bp, Homo sapiens
gacccatgagttggggtctggca

SEQ ID NO: 5613787 - DNA, 10 bp, Homo sapiens
gacccatgct

SEQ ID NO: 5613788 - DNA, 13 bp, Homo sapiens
gacccatgctgcc

SEQ ID NO: 5613789 - DNA, 14 bp, Homo sapiens
gacccatgctgccc

SEQ ID NO: 5613790 - DNA, 16 bp, Homo sapiens
gacccatgctggtcag

SEQ ID NO: 5613791 - DNA, 19 bp, Homo sapiens
gacccatgctggtcagaga

SEQ ID NO: 5613792 - DNA, 20 bp, Homo sapiens
gacccatgctggtcagagac

SEQ ID NO: 5613793 - DNA, 16 bp, Homo sapiens
gacccatgggcaggag

SEQ ID NO: 5613794 - DNA, 17 bp, Homo sapiens
gacccatgggcaggaga

SEQ ID NO: 5613795 - DNA, 15 bp, Homo sapiens
gacccatgggggctg

SEQ ID NO: 5613796 - DNA, 22 bp, Homo sapiens
gacccatgggggctgtctttgc

SEQ ID NO: 5613797 - DNA, 12 bp, Homo sapiens
gacccatgttca

SEQ ID NO: 5613798 - DNA, 16 bp, Homo sapiens
gacccatttcaggagg

SEQ ID NO: 5613799 - DNA, 17 bp, Homo sapiens
gacccatttcaggaggt

SEQ ID NO: 5613800 - DNA, 17 bp, Homo sapiens
gaccccaaagactctgg

SEQ ID NO: 5613801 - DNA, 17 bp, Homo sapiens
gaccccaaaggaacact

SEQ ID NO: 5613802 - DNA, 22 bp, Homo sapiens
gaccccaacctcagaggcagct

SEQ ID NO: 5613803 - DNA, 18 bp, Homo sapiens
gaccccaagggggctgct

SEQ ID NO: 5613804 - DNA, 21 bp, Homo sapiens
gaccccaagggggctgctgct

SEQ ID NO: 5613805 - DNA, 21 bp, Homo sapiens
gaccccaatgcgacaagtagt

SEQ ID NO: 5613806 - DNA, 10 bp, Homo sapiens
gaccccacac

SEQ ID NO: 5613807 - DNA, 16 bp, Homo sapiens
gaccccacatccttct

SEQ ID NO: 5613808 - DNA, 18 bp, Homo sapiens
gaccccacatccttctca

SEQ ID NO: 5613809 - DNA, 15 bp, Homo sapiens
gaccccaccagcctc

SEQ ID NO: 5613810 - DNA, 20 bp, Homo sapiens
gaccccacccaagcttggca

SEQ ID NO: 5613811 - DNA, 14 bp, Homo sapiens
gaccccacccctca

SEQ ID NO: 5613812 - DNA, 19 bp, Homo sapiens
gaccccaccctgtctgcag

SEQ ID NO: 5613813 - DNA, 16 bp, Homo sapiens
gaccccacctgaggca

SEQ ID NO: 5613814 - DNA, 14 bp, Homo sapiens
gaccccactgcagc

SEQ ID NO: 5613815 - DNA, 20 bp, Homo sapiens
gaccccactgcagcagaaaa

SEQ ID NO: 5613816 - DNA, 14 bp, Homo sapiens
gaccccactggact

SEQ ID NO: 5613817 - DNA, 18 bp, Homo sapiens
gaccccacttatgctgct

SEQ ID NO: 5613818 - DNA, 11 bp, Homo sapiens
gaccccagaat

SEQ ID NO: 5613819 - DNA, 18 bp, Homo sapiens
gaccccagactgtagaga

SEQ ID NO: 5613820 - DNA, 22 bp, Homo sapiens
gaccccagagggaccagctggg

SEQ ID NO: 5613821 - DNA, 15 bp, Homo sapiens
gaccccagagtaggg

SEQ ID NO: 5613822 - DNA, 11 bp, Homo sapiens
gaccccagcat

SEQ ID NO: 5613823 - DNA, 14 bp, Homo sapiens
gaccccagcccaga

SEQ ID NO: 5613824 - DNA, 19 bp, Homo sapiens
gaccccagcccagacagca

SEQ ID NO: 5613825 - DNA, 12 bp, Homo sapiens
gaccccagcctc

SEQ ID NO: 5613826 - DNA, 14 bp, Homo sapiens
gaccccagcctcaa

SEQ ID NO: 5613827 - DNA, 14 bp, Homo sapiens
gaccccagccttgg

SEQ ID NO: 5613828 - DNA, 16 bp, Homo sapiens
gaccccagctagggct

SEQ ID NO: 5613829 - DNA, 11 bp, Homo sapiens
gaccccagctg

SEQ ID NO: 5613830 - DNA, 15 bp, Homo sapiens
gaccccagctgctct

SEQ ID NO: 5613831 - DNA, 12 bp, Homo sapiens
gaccccagctgg

SEQ ID NO: 5613832 - DNA, 15 bp, Homo sapiens
gaccccagctgggag

SEQ ID NO: 5613833 - DNA, 18 bp, Homo sapiens
gaccccagctgtgagcct

SEQ ID NO: 5613834 - DNA, 21 bp, Homo sapiens
gaccccagctgtgagccttgg

SEQ ID NO: 5613835 - DNA, 20 bp, Homo sapiens
gaccccagcttttcttgcca

SEQ ID NO: 5613836 - DNA, 23 bp, Homo sapiens
gaccccagcttttcttgccagct

SEQ ID NO: 5613837 - DNA, 21 bp, Homo sapiens
gaccccaggatcccagagctt

SEQ ID NO: 5613838 - DNA, 13 bp, Homo sapiens
gaccccaggccca

SEQ ID NO: 5613839 - DNA, 17 bp, Homo sapiens
gaccccaggcccactca

SEQ ID NO: 5613840 - DNA, 18 bp, Homo sapiens
gaccccaggcccactcag

SEQ ID NO: 5613841 - DNA, 14 bp, Homo sapiens
gaccccagggcaca

SEQ ID NO: 5613842 - DNA, 16 bp, Homo sapiens
gaccccagggcacagg

SEQ ID NO: 5613843 - DNA, 21 bp, Homo sapiens
gaccccagggcacaggagcta

SEQ ID NO: 5613844 - DNA, 13 bp, Homo sapiens
gaccccagggcct

SEQ ID NO: 5613845 - DNA, 15 bp, Homo sapiens
gaccccagggcctgt

SEQ ID NO: 5613846 - DNA, 13 bp, Homo sapiens
gaccccagggtgg

SEQ ID NO: 5613847 - DNA, 15 bp, Homo sapiens
gaccccaggtcagcc

SEQ ID NO: 5613848 - DNA, 18 bp, Homo sapiens
gaccccaggtcaggggct

SEQ ID NO: 5613849 - DNA, 22 bp, Homo sapiens
gaccccagtcgtgatgtggagg

SEQ ID NO: 5613850 - DNA, 22 bp, Homo sapiens
gaccccatccacctatccacca

SEQ ID NO: 5613851 - DNA, 16 bp, Homo sapiens
gaccccatccagccag

SEQ ID NO: 5613852 - DNA, 17 bp, Homo sapiens
gaccccatccagccagg

SEQ ID NO: 5613853 - DNA, 21 bp, Homo sapiens
gaccccatccagccaggggtg

SEQ ID NO: 5613854 - DNA, 23 bp, Homo sapiens
gaccccatctctgctgcttctgg

SEQ ID NO: 5613855 - DNA, 16 bp, Homo sapiens
gaccccatctgcccag

SEQ ID NO: 5613856 - DNA, 17 bp, Homo sapiens
gaccccatctgcccagg

SEQ ID NO: 5613857 - DNA, 16 bp, Homo sapiens
gaccccatctgtgaat

SEQ ID NO: 5613858 - DNA, 18 bp, Homo sapiens
gaccccatcttccagcca

SEQ ID NO: 5613859 - DNA, 22 bp, Homo sapiens
gaccccattcctgatcccatgg

SEQ ID NO: 5613860 - DNA, 16 bp, Homo sapiens
gacccccaccccttcc

SEQ ID NO: 5613861 - DNA, 19 bp, Homo sapiens
gacccccaccccttcccca

SEQ ID NO: 5613862 - DNA, 18 bp, Homo sapiens
gacccccacgattggcca

SEQ ID NO: 5613863 - DNA, 23 bp, Homo sapiens
gacccccactctcattccccagg

SEQ ID NO: 5613864 - DNA, 20 bp, Homo sapiens
gacccccagcaaccctccta

SEQ ID NO: 5613865 - DNA, 23 bp, Homo sapiens
gacccccagctccggcctgtcct

SEQ ID NO: 5613866 - DNA, 17 bp, Homo sapiens
gacccccaggcagaggg

SEQ ID NO: 5613867 - DNA, 14 bp, Homo sapiens
gacccccaggcctg

SEQ ID NO: 5613868 - DNA, 17 bp, Homo sapiens
gacccccatccagcctc

SEQ ID NO: 5613869 - DNA, 18 bp, Homo sapiens
gacccccatccagcctcc

SEQ ID NO: 5613870 - DNA, 21 bp, Homo sapiens
gacccccatccagcctccagg

SEQ ID NO: 5613871 - DNA, 23 bp, Homo sapiens
gacccccatccagcctccagggc

SEQ ID NO: 5613872 - DNA, 17 bp, Homo sapiens
gacccccatctgagctg

SEQ ID NO: 5613873 - DNA, 19 bp, Homo sapiens
gacccccatctgagctggg

SEQ ID NO: 5613874 - DNA, 15 bp, Homo sapiens
gacccccccagcttc

SEQ ID NO: 5613875 - DNA, 13 bp, Homo sapiens
gacccccccagtc

SEQ ID NO: 5613876 - DNA, 18 bp, Homo sapiens
gacccccccagtccgccc

SEQ ID NO: 5613877 - DNA, 23 bp, Homo sapiens
gaccccccccattagaatgtgat

SEQ ID NO: 5613878 - DNA, 22 bp, Homo sapiens
gaccccccccccccccgcccac

SEQ ID NO: 5613879 - DNA, 13 bp, Homo sapiens
gaccccccttgcc

SEQ ID NO: 5613880 - DNA, 20 bp, Homo sapiens
gacccccctttcacaggcag

SEQ ID NO: 5613881 - DNA, 21 bp, Homo sapiens
gacccccgaggcccccctctg

SEQ ID NO: 5613882 - DNA, 22 bp, Homo sapiens
gacccccgaggcccccctctgc

SEQ ID NO: 5613883 - DNA, 17 bp, Homo sapiens
gacccccgcagaggcag

SEQ ID NO: 5613884 - DNA, 18 bp, Homo sapiens
gacccccgccccctgccc

SEQ ID NO: 5613885 - DNA, 10 bp, Homo sapiens
gaccccctca

SEQ ID NO: 5613886 - DNA, 22 bp, Homo sapiens
gacctaatatcattttattcac

SEQ ID NO: 5613887 - DNA, 21 bp, Homo sapiens
gacctaattgttaaatttaaa

SEQ ID NO: 5613888 - DNA, 18 bp, Homo sapiens
gacctacaagattcctgg

SEQ ID NO: 5613889 - DNA, 19 bp, Homo sapiens
gacctacagacctggctct

SEQ ID NO: 5613890 - DNA, 16 bp, Homo sapiens
gacctacagactaaga

SEQ ID NO: 5613891 - DNA, 20 bp, Homo sapiens
gacctacagggggtctggct

SEQ ID NO: 5613892 - DNA, 22 bp, Homo sapiens
gacctacagggggtctggctgg

SEQ ID NO: 5613893 - DNA, 14 bp, Homo sapiens
gacctacagtgctg

SEQ ID NO: 5613894 - DNA, 22 bp, Homo sapiens
gacctacatctgaaatctacaa

SEQ ID NO: 5613895 - DNA, 16 bp, Homo sapiens
gacctaccaggacaga

SEQ ID NO: 5613896 - DNA, 13 bp, Homo sapiens
gacctaccccagc

SEQ ID NO: 5613897 - DNA, 16 bp, Homo sapiens
gacctaccccagccag

SEQ ID NO: 5613898 - DNA, 16 bp, Homo sapiens
gacctacctcaggttg

SEQ ID NO: 5613899 - DNA, 19 bp, Homo sapiens
gacctacctcaggttgctg

SEQ ID NO: 5613900 - DNA, 16 bp, Homo sapiens
gacctacctccctccc

SEQ ID NO: 5613901 - DNA, 18 bp, Homo sapiens
gacctacctccctccctc

SEQ ID NO: 5613902 - DNA, 21 bp, Homo sapiens
gacctacgttcctggccccct

SEQ ID NO: 5613903 - DNA, 13 bp, Homo sapiens
gacctactctcat

SEQ ID NO: 5613904 - DNA, 19 bp, Homo sapiens
gacctactgaacccagagt

SEQ ID NO: 5613905 - DNA, 15 bp, Homo sapiens
gacctactgttctaa

SEQ ID NO: 5613906 - DNA, 20 bp, Homo sapiens
gacctagaaatgtagcagca

SEQ ID NO: 5613907 - DNA, 22 bp, Homo sapiens
gacctagaagcttaacactatt

SEQ ID NO: 5613908 - DNA, 17 bp, Homo sapiens
gacctagacctgggcca

SEQ ID NO: 5613909 - DNA, 15 bp, Homo sapiens
gacctagcaggctgt

SEQ ID NO: 5613910 - DNA, 13 bp, Homo sapiens
gacctagcaggga

SEQ ID NO: 5613911 - DNA, 19 bp, Homo sapiens
gacctagcctggatggccc

SEQ ID NO: 5613912 - DNA, 22 bp, Homo sapiens
gacctagggatgttctggccct

SEQ ID NO: 5613913 - DNA, 13 bp, Homo sapiens
gacctagggcctc

SEQ ID NO: 5613914 - DNA, 19 bp, Homo sapiens
gacctagggggacggggct

SEQ ID NO: 5613915 - DNA, 18 bp, Homo sapiens
gacctaggggtttctgtt

SEQ ID NO: 5613916 - DNA, 18 bp, Homo sapiens
gacctagtcccctttcct

SEQ ID NO: 5613917 - DNA, 22 bp, Homo sapiens
gacctataaaacaaagtctggg

SEQ ID NO: 5613918 - DNA, 23 bp, Homo sapiens
gacctataaatcattaagacaac

SEQ ID NO: 5613919 - DNA, 23 bp, Homo sapiens
gacctatacagaacagagggcca

SEQ ID NO: 5613920 - DNA, 20 bp, Homo sapiens
gacctatacctgtgtttctt

SEQ ID NO: 5613921 - DNA, 15 bp, Homo sapiens
gacctatagtaagtg

SEQ ID NO: 5613922 - DNA, 16 bp, Homo sapiens
gacctatctgtaagag

SEQ ID NO: 5613923 - DNA, 15 bp, Homo sapiens
gacctatgcagggag

SEQ ID NO: 5613924 - DNA, 16 bp, Homo sapiens
gacctatgcagggagg

SEQ ID NO: 5613925 - DNA, 21 bp, Homo sapiens
gacctatgtcctaaggacaca

SEQ ID NO: 5613926 - DNA, 19 bp, Homo sapiens
gacctattcaccctccact

SEQ ID NO: 5613927 - DNA, 23 bp, Homo sapiens
gacctattgccaggaatgtttca

SEQ ID NO: 5613928 - DNA, 14 bp, Homo sapiens
gacctcaaaagaaa

SEQ ID NO: 5613929 - DNA, 16 bp, Homo sapiens
gacctcaaaagaaaat

SEQ ID NO: 5613930 - DNA, 21 bp, Homo sapiens
gacctcaaaataagccatgct

SEQ ID NO: 5613931 - DNA, 22 bp, Homo sapiens
gacctcaaaataagccatgctg

SEQ ID NO: 5613932 - DNA, 15 bp, Homo sapiens
gacctcaacaaagaa

SEQ ID NO: 5613933 - DNA, 14 bp, Homo sapiens
gacctcaagcaacc

SEQ ID NO: 5613934 - DNA, 13 bp, Homo sapiens
gacctcaagccat

SEQ ID NO: 5613935 - DNA, 14 bp, Homo sapiens
gacctcaagccatc

SEQ ID NO: 5613936 - DNA, 18 bp, Homo sapiens
gacctcaagccctgaggg

SEQ ID NO: 5613937 - DNA, 18 bp, Homo sapiens
gacctcaaggaagctacg

SEQ ID NO: 5613938 - DNA, 24 bp, Homo sapiens
gacctcaagggacagggaatgctg

SEQ ID NO: 5613939 - DNA, 18 bp, Homo sapiens
gacctcaatgaagcagaa

SEQ ID NO: 5613940 - DNA, 20 bp, Homo sapiens
gacctcacacacctctgccc

SEQ ID NO: 5613941 - DNA, 16 bp, Homo sapiens
gacctcacagagtatg

SEQ ID NO: 5613942 - DNA, 23 bp, Homo sapiens
gacctcaccggcatgctggcctg

SEQ ID NO: 5613943 - DNA, 16 bp, Homo sapiens
gacctcacctaggaag

SEQ ID NO: 5613944 - DNA, 16 bp, Homo sapiens
gacctcacctggtcct

SEQ ID NO: 5613945 - DNA, 15 bp, Homo sapiens
gacctcactgtcagg

SEQ ID NO: 5613946 - DNA, 16 bp, Homo sapiens
gacctcactgtgacct

SEQ ID NO: 5613947 - DNA, 16 bp, Homo sapiens
gacctcagcaaatcct

SEQ ID NO: 5613948 - DNA, 17 bp, Homo sapiens
gacctcagcaagctgcc

SEQ ID NO: 5613949 - DNA, 18 bp, Homo sapiens
gacctcagcaagctgccc

SEQ ID NO: 5613950 - DNA, 22 bp, Homo sapiens
gacctcagcaagctgcccagcc

SEQ ID NO: 5613951 - DNA, 23 bp, Homo sapiens
gacctcagcaagctgcccagccc

SEQ ID NO: 5613952 - DNA, 16 bp, Homo sapiens
gacctcagcagggcat

SEQ ID NO: 5613953 - DNA, 12 bp, Homo sapiens
gacctcagcctg

SEQ ID NO: 5613954 - DNA, 13 bp, Homo sapiens
gacctcagcctgc

SEQ ID NO: 5613955 - DNA, 14 bp, Homo sapiens
gacctcagcctgtg

SEQ ID NO: 5613956 - DNA, 14 bp, Homo sapiens
gacctcagccttcc

SEQ ID NO: 5613957 - DNA, 15 bp, Homo sapiens
gacctcagctgcaca

SEQ ID NO: 5613958 - DNA, 16 bp, Homo sapiens
gacctcagctgcacat

SEQ ID NO: 5613959 - DNA, 14 bp, Homo sapiens
gacctcagctgctt

SEQ ID NO: 5613960 - DNA, 16 bp, Homo sapiens
gacctcaggagggcag

SEQ ID NO: 5613961 - DNA, 14 bp, Homo sapiens
gacctcaggcctgg

SEQ ID NO: 5613962 - DNA, 13 bp, Homo sapiens
gacctcagggcac

SEQ ID NO: 5613963 - DNA, 21 bp, Homo sapiens
gacctcagggctatgtggatt

SEQ ID NO: 5613964 - DNA, 11 bp, Homo sapiens
gacctcagggg

SEQ ID NO: 5613965 - DNA, 14 bp, Homo sapiens
gacctcaggggcac

SEQ ID NO: 5613966 - DNA, 19 bp, Homo sapiens
gacctcaggggcacctccg

SEQ ID NO: 5613967 - DNA, 22 bp, Homo sapiens
gacctcaggtaatcgacctgcc

SEQ ID NO: 5613968 - DNA, 19 bp, Homo sapiens
gacctcaggtgagaagcag

SEQ ID NO: 5613969 - DNA, 19 bp, Homo sapiens
gacctcatatcttcctcat

SEQ ID NO: 5613970 - DNA, 13 bp, Homo sapiens
gacctcatcagga

SEQ ID NO: 5613971 - DNA, 23 bp, Homo sapiens
gacctcatcaggatgaacccagg

SEQ ID NO: 5613972 - DNA, 23 bp, Homo sapiens
gacctcatcattaataagtgaag

SEQ ID NO: 5613973 - DNA, 17 bp, Homo sapiens
gacctcatcctgctctt

SEQ ID NO: 5613974 - DNA, 21 bp, Homo sapiens
gacctcatcctgctcttttgt

SEQ ID NO: 5613975 - DNA, 15 bp, Homo sapiens
gacctcatctccaag

SEQ ID NO: 5613976 - DNA, 15 bp, Homo sapiens
gacctcatctgtgga

SEQ ID NO: 5613977 - DNA, 14 bp, Homo sapiens
gacctcatgcccag

SEQ ID NO: 5613978 - DNA, 23 bp, Homo sapiens
gacctcatgcccagctctctgac

SEQ ID NO: 5613979 - DNA, 16 bp, Homo sapiens
gacctccacctgggag

SEQ ID NO: 5613980 - DNA, 15 bp, Homo sapiens
gacctccagaagtcc

SEQ ID NO: 5613981 - DNA, 21 bp, Homo sapiens
gacctccagaagtcccttcaa

SEQ ID NO: 5613982 - DNA, 18 bp, Homo sapiens
gacctccagacagagtcc

SEQ ID NO: 5613983 - DNA, 17 bp, Homo sapiens
gacctccagctctcagt

SEQ ID NO: 5613984 - DNA, 16 bp, Homo sapiens
gacctccagctttcct

SEQ ID NO: 5613985 - DNA, 14 bp, Homo sapiens
gacctccaggggct

SEQ ID NO: 5613986 - DNA, 19 bp, Homo sapiens
gacctccaggggctcctgg

SEQ ID NO: 5613987 - DNA, 16 bp, Homo sapiens
gacctccagtcctgct

SEQ ID NO: 5613988 - DNA, 19 bp, Homo sapiens
gacctccagtcctgctggc

SEQ ID NO: 5613989 - DNA, 21 bp, Homo sapiens
gacctccagtcctgctggcct

SEQ ID NO: 5613990 - DNA, 12 bp, Homo sapiens
gacctccatccc

SEQ ID NO: 5613991 - DNA, 11 bp, Homo sapiens
gacctccatgc

SEQ ID NO: 5613992 - DNA, 14 bp, Homo sapiens
gacctccatgcccc

SEQ ID NO: 5613993 - DNA, 14 bp, Homo sapiens
gacctccccacccc

SEQ ID NO: 5613994 - DNA, 15 bp, Homo sapiens
gacctccccacccgc

SEQ ID NO: 5613995 - DNA, 16 bp, Homo sapiens
gacctccccctcactt

SEQ ID NO: 5613996 - DNA, 23 bp, Homo sapiens
gacctccccctgtgtggccctgg

SEQ ID NO: 5613997 - DNA, 20 bp, Homo sapiens
gacctccctccctccccagt

SEQ ID NO: 5613998 - DNA, 16 bp, Homo sapiens
gacctccctgtgagag

SEQ ID NO: 5613999 - DNA, 14 bp, Homo sapiens
gacctcccttccga

SEQ ID NO: 5614000 - DNA, 23 bp, Homo sapiens
gacctcccttccgaccctctggg

SEQ ID NO: 5614001 - DNA, 15 bp, Homo sapiens
gacctccgcccctgc

SEQ ID NO: 5614002 - DNA, 16 bp, Homo sapiens
gacctccgcccctgcc

SEQ ID NO: 5614003 - DNA, 21 bp, Homo sapiens
gacctccgcccctgcccccgc

SEQ ID NO: 5614004 - DNA, 19 bp, Homo sapiens
gacctccgtcctctcccca

SEQ ID NO: 5614005 - DNA, 21 bp, Homo sapiens
gacctcctccctcattcatct

SEQ ID NO: 5614006 - DNA, 19 bp, Homo sapiens
gacctcctccctgttattt

SEQ ID NO: 5614007 - DNA, 17 bp, Homo sapiens
gacctcctgatgtcttg

SEQ ID NO: 5614008 - DNA, 14 bp, Homo sapiens
gacctcctgcctcc

SEQ ID NO: 5614009 - DNA, 20 bp, Homo sapiens
gacctcctggactgtaggac

SEQ ID NO: 5614010 - DNA, 13 bp, Homo sapiens
gacctcctgtcac

SEQ ID NO: 5614011 - DNA, 22 bp, Homo sapiens
gacctcctgtcactcactgagg

SEQ ID NO: 5614012 - DNA, 17 bp, Homo sapiens
gacctccttagaaaaga

SEQ ID NO: 5614013 - DNA, 17 bp, Homo sapiens
gacctccttctgcaaag

SEQ ID NO: 5614014 - DNA, 21 bp, Homo sapiens
gacctcgagcagatgatgcca

SEQ ID NO: 5614015 - DNA, 19 bp, Homo sapiens
gacctcgatgtccagctgc

SEQ ID NO: 5614016 - DNA, 22 bp, Homo sapiens
gacctcggctgtgtggggaggg

SEQ ID NO: 5614017 - DNA, 18 bp, Homo sapiens
gacctcggtgatgccttc

SEQ ID NO: 5614018 - DNA, 18 bp, Homo sapiens
gacctcgtactcaggagc

SEQ ID NO: 5614019 - DNA, 16 bp, Homo sapiens
gacctcgtcctccccc

SEQ ID NO: 5614020 - DNA, 16 bp, Homo sapiens
gacctcgtggagaatt

SEQ ID NO: 5614021 - DNA, 20 bp, Homo sapiens
gacctctacggacctcacat

SEQ ID NO: 5614022 - DNA, 17 bp, Homo sapiens
gacctctacttgctgaa

SEQ ID NO: 5614023 - DNA, 18 bp, Homo sapiens
gacctctactttccaggc

SEQ ID NO: 5614024 - DNA, 16 bp, Homo sapiens
gacctctagagctgga

SEQ ID NO: 5614025 - DNA, 20 bp, Homo sapiens
gacctctcagcatagcctgc

SEQ ID NO: 5614026 - DNA, 12 bp, Homo sapiens
gacctctcaggg

SEQ ID NO: 5614027 - DNA, 18 bp, Homo sapiens
gacctctcagggcctggc

SEQ ID NO: 5614028 - DNA, 21 bp, Homo sapiens
gacctctccagcatcccagcc

SEQ ID NO: 5614029 - DNA, 22 bp, Homo sapiens
gacctctccagcatcccagcct

SEQ ID NO: 5614030 - DNA, 22 bp, Homo sapiens
gacctctccggcctggcctttt

SEQ ID NO: 5614031 - DNA, 14 bp, Homo sapiens
gacctctctcagcc

SEQ ID NO: 5614032 - DNA, 13 bp, Homo sapiens
gacctctcttgtg

SEQ ID NO: 5614033 - DNA, 13 bp, Homo sapiens
gacctctgaagag

SEQ ID NO: 5614034 - DNA, 18 bp, Homo sapiens
gacctctgaatgtcccag

SEQ ID NO: 5614035 - DNA, 20 bp, Homo sapiens
gacctctgaatgtcccagag

SEQ ID NO: 5614036 - DNA, 15 bp, Homo sapiens
gacctctgacaactg

SEQ ID NO: 5614037 - DNA, 15 bp, Homo sapiens
gacctctgacagcag

SEQ ID NO: 5614038 - DNA, 16 bp, Homo sapiens
gacctctgacagcagc

SEQ ID NO: 5614039 - DNA, 15 bp, Homo sapiens
gacctctgactgatg

SEQ ID NO: 5614040 - DNA, 18 bp, Homo sapiens
gacctctgcaagaggggg

SEQ ID NO: 5614041 - DNA, 16 bp, Homo sapiens
gacctctgcagcaata

SEQ ID NO: 5614042 - DNA, 18 bp, Homo sapiens
gacctctgcagcaataaa

SEQ ID NO: 5614043 - DNA, 22 bp, Homo sapiens
gacctctgcagcaataaagcag

SEQ ID NO: 5614044 - DNA, 16 bp, Homo sapiens
gacctctgctctgagg

SEQ ID NO: 5614045 - DNA, 14 bp, Homo sapiens
gacctctgctgagt

SEQ ID NO: 5614046 - DNA, 17 bp, Homo sapiens
gacctctgctgagtgct

SEQ ID NO: 5614047 - DNA, 19 bp, Homo sapiens
gacctctgctgagtgctgg

SEQ ID NO: 5614048 - DNA, 21 bp, Homo sapiens
gacctctgctgagtgctgggc

SEQ ID NO: 5614049 - DNA, 23 bp, Homo sapiens
gacctctgctgagtgctgggcac

SEQ ID NO: 5614050 - DNA, 15 bp, Homo sapiens
gacctctgggttggg

SEQ ID NO: 5614051 - DNA, 17 bp, Homo sapiens
gacctcttcagctgctg

SEQ ID NO: 5614052 - DNA, 15 bp, Homo sapiens
gacctcttccctctg

SEQ ID NO: 5614053 - DNA, 16 bp, Homo sapiens
gacctcttccctctgg

SEQ ID NO: 5614054 - DNA, 19 bp, Homo sapiens
gacctcttccctctgggcc

SEQ ID NO: 5614055 - DNA, 16 bp, Homo sapiens
gacctcttctggagat

SEQ ID NO: 5614056 - DNA, 16 bp, Homo sapiens
gacctcttgctgccag

SEQ ID NO: 5614057 - DNA, 17 bp, Homo sapiens
gacctcttgctgtctct

SEQ ID NO: 5614058 - DNA, 22 bp, Homo sapiens
gacctcttgctgtctctgctcg

SEQ ID NO: 5614059 - DNA, 17 bp, Homo sapiens
gacctgaaattccaaag

SEQ ID NO: 5614060 - DNA, 17 bp, Homo sapiens
gacctgaaggacctccc

SEQ ID NO: 5614061 - DNA, 21 bp, Homo sapiens
gacctgaagggtgacatccca

SEQ ID NO: 5614062 - DNA, 23 bp, Homo sapiens
gacctgaagggtgacatcccagg

SEQ ID NO: 5614063 - DNA, 13 bp, Homo sapiens
gactaattaaaat

SEQ ID NO: 5614064 - DNA, 16 bp, Homo sapiens
gactaattcacaaaaa

SEQ ID NO: 5614065 - DNA, 13 bp, Homo sapiens
gactaattgtata

SEQ ID NO: 5614066 - DNA, 22 bp, Homo sapiens
gactaattgtataacaggttat

SEQ ID NO: 5614067 - DNA, 18 bp, Homo sapiens
gactaattttacatgttt

SEQ ID NO: 5614068 - DNA, 21 bp, Homo sapiens
gactaattttttaaatatttg

SEQ ID NO: 5614069 - DNA, 11 bp, Homo sapiens
gactacagaag

SEQ ID NO: 5614070 - DNA, 17 bp, Homo sapiens
gactacagaagtggaag

SEQ ID NO: 5614071 - DNA, 17 bp, Homo sapiens
gactacagccagaagcc

SEQ ID NO: 5614072 - DNA, 22 bp, Homo sapiens
gactacagctggggtgcaggga

SEQ ID NO: 5614073 - DNA, 18 bp, Homo sapiens
gactacaggcacccacca

SEQ ID NO: 5614074 - DNA, 12 bp, Homo sapiens
gactacagggcc

SEQ ID NO: 5614075 - DNA, 13 bp, Homo sapiens
gactacagggctt

SEQ ID NO: 5614076 - DNA, 18 bp, Homo sapiens
gactacaggtgtgagtca

SEQ ID NO: 5614077 - DNA, 17 bp, Homo sapiens
gactacaggtgtgcacc

SEQ ID NO: 5614078 - DNA, 14 bp, Homo sapiens
gactacatttagag

SEQ ID NO: 5614079 - DNA, 18 bp, Homo sapiens
gactaccacttatttcta

SEQ ID NO: 5614080 - DNA, 22 bp, Homo sapiens
gactacccacgttctcacaccc

SEQ ID NO: 5614081 - DNA, 16 bp, Homo sapiens
gactaccctagttcaa

SEQ ID NO: 5614082 - DNA, 23 bp, Homo sapiens
gactaccctctcactagtgccaa

SEQ ID NO: 5614083 - DNA, 17 bp, Homo sapiens
gactaccgcaggcccgg

SEQ ID NO: 5614084 - DNA, 17 bp, Homo sapiens
gactaccgtgccagcag

SEQ ID NO: 5614085 - DNA, 18 bp, Homo sapiens
gactaccgtgccagcagc

SEQ ID NO: 5614086 - DNA, 19 bp, Homo sapiens
gactacctataaatggact

SEQ ID NO: 5614087 - DNA, 14 bp, Homo sapiens
gactacctgggacc

SEQ ID NO: 5614088 - DNA, 15 bp, Homo sapiens
gactactacacactg

SEQ ID NO: 5614089 - DNA, 17 bp, Homo sapiens
gactactactctgccaa

SEQ ID NO: 5614090 - DNA, 16 bp, Homo sapiens
gactactatttgaagc

SEQ ID NO: 5614091 - DNA, 14 bp, Homo sapiens
gactactattttct

SEQ ID NO: 5614092 - DNA, 14 bp, Homo sapiens
gactactgctcctg

SEQ ID NO: 5614093 - DNA, 19 bp, Homo sapiens
gactactgctcctgtggca

SEQ ID NO: 5614094 - DNA, 20 bp, Homo sapiens
gactactgctcctgtggcag

SEQ ID NO: 5614095 - DNA, 21 bp, Homo sapiens
gactacttagcatcctaagaa

SEQ ID NO: 5614096 - DNA, 16 bp, Homo sapiens
gactacttgatataat

SEQ ID NO: 5614097 - DNA, 20 bp, Homo sapiens
gactagaaaatttaaaacat

SEQ ID NO: 5614098 - DNA, 19 bp, Homo sapiens
gactagaagattagaaact

SEQ ID NO: 5614099 - DNA, 19 bp, Homo sapiens
gactagaattctagtgctg

SEQ ID NO: 5614100 - DNA, 21 bp, Homo sapiens
gactagaattctagtgctgct

SEQ ID NO: 5614101 - DNA, 14 bp, Homo sapiens
gactagacacacaa

SEQ ID NO: 5614102 - DNA, 16 bp, Homo sapiens
gactagacacacaaag

SEQ ID NO: 5614103 - DNA, 18 bp, Homo sapiens
gactagacaccttctgtg

SEQ ID NO: 5614104 - DNA, 22 bp, Homo sapiens
gactagagaaaccgtcctcttt

SEQ ID NO: 5614105 - DNA, 20 bp, Homo sapiens
gactagagcacaacataatt

SEQ ID NO: 5614106 - DNA, 16 bp, Homo sapiens
gactagaggcagggag

SEQ ID NO: 5614107 - DNA, 17 bp, Homo sapiens
gactagaggcagggagg

SEQ ID NO: 5614108 - DNA, 20 bp, Homo sapiens
gactagaggcagggagggga

SEQ ID NO: 5614109 - DNA, 18 bp, Homo sapiens
gactagaggccagggcag

SEQ ID NO: 5614110 - DNA, 14 bp, Homo sapiens
gactagatgatgga

SEQ ID NO: 5614111 - DNA, 16 bp, Homo sapiens
gactagatgatggatg

SEQ ID NO: 5614112 - DNA, 17 bp, Homo sapiens
gactagattctcacctg

SEQ ID NO: 5614113 - DNA, 17 bp, Homo sapiens
gactagcaatctcttca

SEQ ID NO: 5614114 - DNA, 23 bp, Homo sapiens
gactagcactagacatgtcatgg

SEQ ID NO: 5614115 - DNA, 16 bp, Homo sapiens
gactagcaggctactg

SEQ ID NO: 5614116 - DNA, 19 bp, Homo sapiens
gactagcaggctactggga

SEQ ID NO: 5614117 - DNA, 14 bp, Homo sapiens
gactagccagccag

SEQ ID NO: 5614118 - DNA, 23 bp, Homo sapiens
gactagcccctgtggagactggg

SEQ ID NO: 5614119 - DNA, 15 bp, Homo sapiens
gactagctgccttcg

SEQ ID NO: 5614120 - DNA, 16 bp, Homo sapiens
gactaggcatgtcaga

SEQ ID NO: 5614121 - DNA, 19 bp, Homo sapiens
gactaggcatgtcagagga

SEQ ID NO: 5614122 - DNA, 16 bp, Homo sapiens
gactagggagccatgt

SEQ ID NO: 5614123 - DNA, 17 bp, Homo sapiens
gactagggattcaggct

SEQ ID NO: 5614124 - DNA, 20 bp, Homo sapiens
gactagggattcaggctgct

SEQ ID NO: 5614125 - DNA, 17 bp, Homo sapiens
gactagggtcctcaggc

SEQ ID NO: 5614126 - DNA, 18 bp, Homo sapiens
gactagtgaggaaagatt

SEQ ID NO: 5614127 - DNA, 19 bp, Homo sapiens
gactagtgagtcagcacct

SEQ ID NO: 5614128 - DNA, 16 bp, Homo sapiens
gactagtgctgaagct

SEQ ID NO: 5614129 - DNA, 19 bp, Homo sapiens
gactagtgctgaagcttat

SEQ ID NO: 5614130 - DNA, 19 bp, Homo sapiens
gactagttctcttgtcctg

SEQ ID NO: 5614131 - DNA, 15 bp, Homo sapiens
gactataaataaaaa

SEQ ID NO: 5614132 - DNA, 23 bp, Homo sapiens
gactatagcccctggtgtgtaaa

SEQ ID NO: 5614133 - DNA, 21 bp, Homo sapiens
gactatataaagtactactgt

SEQ ID NO: 5614134 - DNA, 23 bp, Homo sapiens
gactatatacatgtgtgtatata

SEQ ID NO: 5614135 - DNA, 19 bp, Homo sapiens
gactatatagagatgtttt

SEQ ID NO: 5614136 - DNA, 22 bp, Homo sapiens
gactatatttgggcctgctcca

SEQ ID NO: 5614137 - DNA, 18 bp, Homo sapiens
gactatcaaactgaagcc

SEQ ID NO: 5614138 - DNA, 15 bp, Homo sapiens
gactatcacatacaa

SEQ ID NO: 5614139 - DNA, 21 bp, Homo sapiens
gactatcaggagtccactgcc

SEQ ID NO: 5614140 - DNA, 20 bp, Homo sapiens
gactatccattttacacttg

SEQ ID NO: 5614141 - DNA, 22 bp, Homo sapiens
gactatccattttacacttgct

SEQ ID NO: 5614142 - DNA, 21 bp, Homo sapiens
gactatcccaacagtcatgtt

SEQ ID NO: 5614143 - DNA, 22 bp, Homo sapiens
gactatcccaacagtcatgttt

SEQ ID NO: 5614144 - DNA, 15 bp, Homo sapiens
gactatctacaaaaa

SEQ ID NO: 5614145 - DNA, 18 bp, Homo sapiens
gactatctgtctggtggc

SEQ ID NO: 5614146 - DNA, 19 bp, Homo sapiens
gactatcttactatttcac

SEQ ID NO: 5614147 - DNA, 13 bp, Homo sapiens
gactatctttgct

SEQ ID NO: 5614148 - DNA, 19 bp, Homo sapiens
gactatgaaaatgctggct

SEQ ID NO: 5614149 - DNA, 13 bp, Homo sapiens
gactatgacataa

SEQ ID NO: 5614150 - DNA, 19 bp, Homo sapiens
gactatgcagctcatcacc

SEQ ID NO: 5614151 - DNA, 19 bp, Homo sapiens
gactatgcgtttttataaa

SEQ ID NO: 5614152 - DNA, 19 bp, Homo sapiens
gactatggaatgtcagtgt

SEQ ID NO: 5614153 - DNA, 20 bp, Homo sapiens
gactatggaatgtcagtgtt

SEQ ID NO: 5614154 - DNA, 15 bp, Homo sapiens
gactatggagctgag

SEQ ID NO: 5614155 - DNA, 13 bp, Homo sapiens
gactatggcctcg

SEQ ID NO: 5614156 - DNA, 18 bp, Homo sapiens
gactatgtatttttctat

SEQ ID NO: 5614157 - DNA, 14 bp, Homo sapiens
gactatgtccagat

SEQ ID NO: 5614158 - DNA, 14 bp, Homo sapiens
gactattaaatgtt

SEQ ID NO: 5614159 - DNA, 17 bp, Homo sapiens
gactattcatcaagaat

SEQ ID NO: 5614160 - DNA, 22 bp, Homo sapiens
gactattcttgatgtaaaatct

SEQ ID NO: 5614161 - DNA, 16 bp, Homo sapiens
gactatttaacttgag

SEQ ID NO: 5614162 - DNA, 22 bp, Homo sapiens
gactatttataactaatatggt

SEQ ID NO: 5614163 - DNA, 13 bp, Homo sapiens
gactatttctttt

SEQ ID NO: 5614164 - DNA, 21 bp, Homo sapiens
gactatttgacccccacaaca

SEQ ID NO: 5614165 - DNA, 13 bp, Homo sapiens
gactatttgctaa

SEQ ID NO: 5614166 - DNA, 19 bp, Homo sapiens
gactatttgctaatgtata

SEQ ID NO: 5614167 - DNA, 21 bp, Homo sapiens
gactatttttgtttttattaa

SEQ ID NO: 5614168 - DNA, 22 bp, Homo sapiens
gactcaaaacccatctgggctc

SEQ ID NO: 5614169 - DNA, 23 bp, Homo sapiens
gactcaaaacccatctgggctcc

SEQ ID NO: 5614170 - DNA, 12 bp, Homo sapiens
gactcaaagaga

SEQ ID NO: 5614171 - DNA, 13 bp, Homo sapiens
gactcaaagatga

SEQ ID NO: 5614172 - DNA, 15 bp, Homo sapiens
gactcaaatgttcta

SEQ ID NO: 5614173 - DNA, 16 bp, Homo sapiens
gactcaaatgttctaa

SEQ ID NO: 5614174 - DNA, 19 bp, Homo sapiens
gactcaaatgttctaagtt

SEQ ID NO: 5614175 - DNA, 20 bp, Homo sapiens
gactcaagaagtgaagaatg

SEQ ID NO: 5614176 - DNA, 23 bp, Homo sapiens
gactcaagacttatggaacaggg

SEQ ID NO: 5614177 - DNA, 14 bp, Homo sapiens
gactcaagagaatt

SEQ ID NO: 5614178 - DNA, 22 bp, Homo sapiens
gactcaagaggaatctgtttct

SEQ ID NO: 5614179 - DNA, 16 bp, Homo sapiens
gactcaagattcccag

SEQ ID NO: 5614180 - DNA, 21 bp, Homo sapiens
gactcaaggtggacgtgcgtt

SEQ ID NO: 5614181 - DNA, 22 bp, Homo sapiens
gactcaagtgatcctcctgtct

SEQ ID NO: 5614182 - DNA, 15 bp, Homo sapiens
gactcaatccctagg

SEQ ID NO: 5614183 - DNA, 18 bp, Homo sapiens
gactcaattatttgcata

SEQ ID NO: 5614184 - DNA, 18 bp, Homo sapiens
gactcacaacctgaacct

SEQ ID NO: 5614185 - DNA, 21 bp, Homo sapiens
gactcacaagaagaccagact

SEQ ID NO: 5614186 - DNA, 22 bp, Homo sapiens
gactcacaagaagaccagactg

SEQ ID NO: 5614187 - DNA, 23 bp, Homo sapiens
gactcacacctgaactgaacacc

SEQ ID NO: 5614188 - DNA, 18 bp, Homo sapiens
gactcacactctctgcag

SEQ ID NO: 5614189 - DNA, 15 bp, Homo sapiens
gactcacacttgtaa

SEQ ID NO: 5614190 - DNA, 19 bp, Homo sapiens
gactcacaggccctggaga

SEQ ID NO: 5614191 - DNA, 19 bp, Homo sapiens
gactcacaggttggaagag

SEQ ID NO: 5614192 - DNA, 12 bp, Homo sapiens
gactcacccaag

SEQ ID NO: 5614193 - DNA, 18 bp, Homo sapiens
gactcaccctccacaaag

SEQ ID NO: 5614194 - DNA, 17 bp, Homo sapiens
gactcacctctgcctca

SEQ ID NO: 5614195 - DNA, 22 bp, Homo sapiens
gactcacctgcgcaagtgcctg

SEQ ID NO: 5614196 - DNA, 23 bp, Homo sapiens
gactcacctgcgcaagtgcctgg

SEQ ID NO: 5614197 - DNA, 17 bp, Homo sapiens
gactcacctgttacttg

SEQ ID NO: 5614198 - DNA, 13 bp, Homo sapiens
gactcaccttgtg

SEQ ID NO: 5614199 - DNA, 22 bp, Homo sapiens
gactcacggctgcacctgcagg

SEQ ID NO: 5614200 - DNA, 23 bp, Homo sapiens
gactcacggctgcacctgcaggg

SEQ ID NO: 5614201 - DNA, 23 bp, Homo sapiens
gactcacttgatgtttcctggaa

SEQ ID NO: 5614202 - DNA, 13 bp, Homo sapiens
gactcacttgcca

SEQ ID NO: 5614203 - DNA, 21 bp, Homo sapiens
gactcacttgccattgccagg

SEQ ID NO: 5614204 - DNA, 15 bp, Homo sapiens
gactcagaaactcca

SEQ ID NO: 5614205 - DNA, 15 bp, Homo sapiens
gactcagaagcctct

SEQ ID NO: 5614206 - DNA, 17 bp, Homo sapiens
gactcagacaggaaagg

SEQ ID NO: 5614207 - DNA, 18 bp, Homo sapiens
gactcagacattggcacc

SEQ ID NO: 5614208 - DNA, 16 bp, Homo sapiens
gactcagactccattt

SEQ ID NO: 5614209 - DNA, 11 bp, Homo sapiens
gactcagagct

SEQ ID NO: 5614210 - DNA, 18 bp, Homo sapiens
gactcagaggctgggagc

SEQ ID NO: 5614211 - DNA, 17 bp, Homo sapiens
gactcagaggtccaggc

SEQ ID NO: 5614212 - DNA, 18 bp, Homo sapiens
gactcagaggtccaggcc

SEQ ID NO: 5614213 - DNA, 15 bp, Homo sapiens
gactcagcagaggca

SEQ ID NO: 5614214 - DNA, 13 bp, Homo sapiens
gactcagcagagt

SEQ ID NO: 5614215 - DNA, 13 bp, Homo sapiens
gactcagcagcct

SEQ ID NO: 5614216 - DNA, 16 bp, Homo sapiens
gactcagcccacctgc

SEQ ID NO: 5614217 - DNA, 18 bp, Homo sapiens
gactcagcccacctgcac

SEQ ID NO: 5614218 - DNA, 20 bp, Homo sapiens
gactcagcccacctgcaccc

SEQ ID NO: 5614219 - DNA, 16 bp, Homo sapiens
gactcagccctgaggt

SEQ ID NO: 5614220 - DNA, 14 bp, Homo sapiens
gactcagcctctgc

SEQ ID NO: 5614221 - DNA, 15 bp, Homo sapiens
gactcagcctctgct

SEQ ID NO: 5614222 - DNA, 19 bp, Homo sapiens
gactcagccttcagacaga

SEQ ID NO: 5614223 - DNA, 18 bp, Homo sapiens
gactcagccttcctcctc

SEQ ID NO: 5614224 - DNA, 14 bp, Homo sapiens
gactcagccttgca

SEQ ID NO: 5614225 - DNA, 23 bp, Homo sapiens
gactcagccttgcaaatagccag

SEQ ID NO: 5614226 - DNA, 20 bp, Homo sapiens
gactcagcgctcctcctgtg

SEQ ID NO: 5614227 - DNA, 15 bp, Homo sapiens
gactcagctccagaa

SEQ ID NO: 5614228 - DNA, 20 bp, Homo sapiens
gactcagctccccagagtcc

SEQ ID NO: 5614229 - DNA, 12 bp, Homo sapiens
gactcagctctg

SEQ ID NO: 5614230 - DNA, 16 bp, Homo sapiens
gactcagctctgtctg

SEQ ID NO: 5614231 - DNA, 14 bp, Homo sapiens
gactcagctggaag

SEQ ID NO: 5614232 - DNA, 21 bp, Homo sapiens
gactcagctggaagtctacct

SEQ ID NO: 5614233 - DNA, 23 bp, Homo sapiens
gactcaggaccagatgtccgtct

SEQ ID NO: 5614234 - DNA, 12 bp, Homo sapiens
gactcaggagcc

SEQ ID NO: 5614235 - DNA, 15 bp, Homo sapiens
gactcaggagcctcc

SEQ ID NO: 5614236 - DNA, 15 bp, Homo sapiens
gactcaggatgccca

SEQ ID NO: 5614237 - DNA, 13 bp, Homo sapiens
gactcaggcccac

SEQ ID NO: 5614238 - DNA, 23 bp, Homo sapiens
gactcaggcccccacctggctca

SEQ ID NO: 5614239 - DNA, 21 bp, Homo sapiens
gactcaggcctgccaatgcca

SEQ ID NO: 5614240 - DNA, 21 bp, Homo sapiens
gactggacagccagggcaggg

SEQ ID NO: 5614241 - DNA, 22 bp, Homo sapiens
gactggacagccagggcagggc

SEQ ID NO: 5614242 - DNA, 13 bp, Homo sapiens
gactggacagcgg

SEQ ID NO: 5614243 - DNA, 21 bp, Homo sapiens
gactggacagcggttgtaaat

SEQ ID NO: 5614244 - DNA, 14 bp, Homo sapiens
gactggacagcttg

SEQ ID NO: 5614245 - DNA, 15 bp, Homo sapiens
gactggacagcttgt

SEQ ID NO: 5614246 - DNA, 21 bp, Homo sapiens
gactggacagcttgtggcaag

SEQ ID NO: 5614247 - DNA, 17 bp, Homo sapiens
gactggaccgctgactg

SEQ ID NO: 5614248 - DNA, 17 bp, Homo sapiens
gactggacctggtggct

SEQ ID NO: 5614249 - DNA, 15 bp, Homo sapiens
gactggactgcttgg

SEQ ID NO: 5614250 - DNA, 21 bp, Homo sapiens
gactggagaaaacccctccca

SEQ ID NO: 5614251 - DNA, 21 bp, Homo sapiens
gactggagaccgcttcacccc

SEQ ID NO: 5614252 - DNA, 14 bp, Homo sapiens
gactggagcatctg

SEQ ID NO: 5614253 - DNA, 13 bp, Homo sapiens
gactggaggaggc

SEQ ID NO: 5614254 - DNA, 14 bp, Homo sapiens
gactggaggaggcc

SEQ ID NO: 5614255 - DNA, 15 bp, Homo sapiens
gactggaggaggcct

SEQ ID NO: 5614256 - DNA, 16 bp, Homo sapiens
gactggaggaggcctg

SEQ ID NO: 5614257 - DNA, 20 bp, Homo sapiens
gactggaggtcgaagcaatc

SEQ ID NO: 5614258 - DNA, 16 bp, Homo sapiens
gactggagtcagatga

SEQ ID NO: 5614259 - DNA, 17 bp, Homo sapiens
gactggagtcagatgag

SEQ ID NO: 5614260 - DNA, 23 bp, Homo sapiens
gactggagtgaggcttccaggct

SEQ ID NO: 5614261 - DNA, 15 bp, Homo sapiens
gactggatactgccc

SEQ ID NO: 5614262 - DNA, 16 bp, Homo sapiens
gactggatagtccgtc

SEQ ID NO: 5614263 - DNA, 17 bp, Homo sapiens
gactggatagtccgtct

SEQ ID NO: 5614264 - DNA, 15 bp, Homo sapiens
gactggatctgcagg

SEQ ID NO: 5614265 - DNA, 17 bp, Homo sapiens
gactggatcttctatca

SEQ ID NO: 5614266 - DNA, 12 bp, Homo sapiens
gactggatgctc

SEQ ID NO: 5614267 - DNA, 20 bp, Homo sapiens
gactggatgctcgccatcaa

SEQ ID NO: 5614268 - DNA, 17 bp, Homo sapiens
gactggatgtaccacca

SEQ ID NO: 5614269 - DNA, 20 bp, Homo sapiens
gactggatgtccagagctgg

SEQ ID NO: 5614270 - DNA, 16 bp, Homo sapiens
gactggcaagaaaaga

SEQ ID NO: 5614271 - DNA, 14 bp, Homo sapiens
gactggcaataaac

SEQ ID NO: 5614272 - DNA, 16 bp, Homo sapiens
gactggcacttagccc

SEQ ID NO: 5614273 - DNA, 17 bp, Homo sapiens
gactggcagccagggag

SEQ ID NO: 5614274 - DNA, 12 bp, Homo sapiens
gactggcaggcg

SEQ ID NO: 5614275 - DNA, 14 bp, Homo sapiens
gactggccactgaa

SEQ ID NO: 5614276 - DNA, 16 bp, Homo sapiens
gactggccagaggcag

SEQ ID NO: 5614277 - DNA, 15 bp, Homo sapiens
gactggccagggcca

SEQ ID NO: 5614278 - DNA, 16 bp, Homo sapiens
gactggccatgcaagt

SEQ ID NO: 5614279 - DNA, 16 bp, Homo sapiens
gactggcccacccctc

SEQ ID NO: 5614280 - DNA, 17 bp, Homo sapiens
gactggcccagtgccag

SEQ ID NO: 5614281 - DNA, 18 bp, Homo sapiens
gactggcccagtgccagc

SEQ ID NO: 5614282 - DNA, 14 bp, Homo sapiens
gactggcccctggg

SEQ ID NO: 5614283 - DNA, 14 bp, Homo sapiens
gactggcccttgcc

SEQ ID NO: 5614284 - DNA, 17 bp, Homo sapiens
gactggccgggcaggcg

SEQ ID NO: 5614285 - DNA, 22 bp, Homo sapiens
gactggccgggcaggcgtgact

SEQ ID NO: 5614286 - DNA, 23 bp, Homo sapiens
gactggccgggcaggcgtgactc

SEQ ID NO: 5614287 - DNA, 13 bp, Homo sapiens
gactggcctggga

SEQ ID NO: 5614288 - DNA, 17 bp, Homo sapiens
gactggctagagtcctc

SEQ ID NO: 5614289 - DNA, 14 bp, Homo sapiens
gactggctcacccc

SEQ ID NO: 5614290 - DNA, 13 bp, Homo sapiens
gactggctcctga

SEQ ID NO: 5614291 - DNA, 14 bp, Homo sapiens
gactggctggctgc

SEQ ID NO: 5614292 - DNA, 16 bp, Homo sapiens
gactggctggctgcag

SEQ ID NO: 5614293 - DNA, 23 bp, Homo sapiens
gactggctgtgagacgaggcagg

SEQ ID NO: 5614294 - DNA, 15 bp, Homo sapiens
gactggctttcctct

SEQ ID NO: 5614295 - DNA, 22 bp, Homo sapiens
gactggcttttattaatgcact

SEQ ID NO: 5614296 - DNA, 14 bp, Homo sapiens
gactgggaacccat

SEQ ID NO: 5614297 - DNA, 19 bp, Homo sapiens
gactgggaacccctcctgg

SEQ ID NO: 5614298 - DNA, 15 bp, Homo sapiens
gactgggaagggggc

SEQ ID NO: 5614299 - DNA, 19 bp, Homo sapiens
gactgggaagggggcaggc

SEQ ID NO: 5614300 - DNA, 20 bp, Homo sapiens
gactgggaagggggcaggcc

SEQ ID NO: 5614301 - DNA, 18 bp, Homo sapiens
gactgggagcccccagcc

SEQ ID NO: 5614302 - DNA, 19 bp, Homo sapiens
gactgggagcccccagcct

SEQ ID NO: 5614303 - DNA, 20 bp, Homo sapiens
gactgggagcccccagcctg

SEQ ID NO: 5614304 - DNA, 21 bp, Homo sapiens
gactgggaggagggggagggt

SEQ ID NO: 5614305 - DNA, 19 bp, Homo sapiens
gactgggagtcagagccct

SEQ ID NO: 5614306 - DNA, 20 bp, Homo sapiens
gactgggatgggaacactgg

SEQ ID NO: 5614307 - DNA, 18 bp, Homo sapiens
gactgggcaacactgcag

SEQ ID NO: 5614308 - DNA, 16 bp, Homo sapiens
gactgggcacccctgc

SEQ ID NO: 5614309 - DNA, 18 bp, Homo sapiens
gactgggcacccctgcct

SEQ ID NO: 5614310 - DNA, 15 bp, Homo sapiens
gactgggcccaggca

SEQ ID NO: 5614311 - DNA, 16 bp, Homo sapiens
gactgggcccaggcag

SEQ ID NO: 5614312 - DNA, 21 bp, Homo sapiens
gactgggcccaggcaggtctg

SEQ ID NO: 5614313 - DNA, 15 bp, Homo sapiens
gactgggccccacat

SEQ ID NO: 5614314 - DNA, 17 bp, Homo sapiens
gactgggccgggcccag

SEQ ID NO: 5614315 - DNA, 23 bp, Homo sapiens
gactgggccgggcccagggcctc

SEQ ID NO: 5614316 - DNA, 21 bp, Homo sapiens
gactgggcctcccttgggctg

SEQ ID NO: 5614317 - DNA, 22 bp, Homo sapiens
gactgggcctcccttgggctgg

SEQ ID NO: 5614318 - DNA, 14 bp, Homo sapiens
gactgggctgctgg

SEQ ID NO: 5614319 - DNA, 17 bp, Homo sapiens
gactgggctgctggggc

SEQ ID NO: 5614320 - DNA, 19 bp, Homo sapiens
gactgggctgctggggcag

SEQ ID NO: 5614321 - DNA, 14 bp, Homo sapiens
gactgggctggctg

SEQ ID NO: 5614322 - DNA, 18 bp, Homo sapiens
gactgggctggctgcctt

SEQ ID NO: 5614323 - DNA, 16 bp, Homo sapiens
gactgggctgggtttg

SEQ ID NO: 5614324 - DNA, 19 bp, Homo sapiens
gactgggctgggtttgctg

SEQ ID NO: 5614325 - DNA, 16 bp, Homo sapiens
gactggggagggctgc

SEQ ID NO: 5614326 - DNA, 16 bp, Homo sapiens
gactggggatgtggga

SEQ ID NO: 5614327 - DNA, 11 bp, Homo sapiens
gactggggcag

SEQ ID NO: 5614328 - DNA, 22 bp, Homo sapiens
gactgggggcacctgaccagaa

SEQ ID NO: 5614329 - DNA, 16 bp, Homo sapiens
gactgggggcagacat

SEQ ID NO: 5614330 - DNA, 14 bp, Homo sapiens
gactgggggccaga

SEQ ID NO: 5614331 - DNA, 15 bp, Homo sapiens
gactgggggcctctg

SEQ ID NO: 5614332 - DNA, 20 bp, Homo sapiens
gactgggggcctctgcctcc

SEQ ID NO: 5614333 - DNA, 22 bp, Homo sapiens
gactgggggcctctgcctccag

SEQ ID NO: 5614334 - DNA, 18 bp, Homo sapiens
gactggggggccatttcc

SEQ ID NO: 5614335 - DNA, 22 bp, Homo sapiens
gactgggggtgccaaccacctc

SEQ ID NO: 5614336 - DNA, 17 bp, Homo sapiens
gactgggtaggaaagag

SEQ ID NO: 5614337 - DNA, 23 bp, Homo sapiens
gactgggtctcgctttgttgccc

SEQ ID NO: 5614338 - DNA, 15 bp, Homo sapiens
gactgggtctgacct

SEQ ID NO: 5614339 - DNA, 17 bp, Homo sapiens
gactgggtctgacctgg

SEQ ID NO: 5614340 - DNA, 18 bp, Homo sapiens
gactgggttagaggagtc

SEQ ID NO: 5614341 - DNA, 16 bp, Homo sapiens
gactggtaagtaactg

SEQ ID NO: 5614342 - DNA, 21 bp, Homo sapiens
gactggtaggaggaggcatgg

SEQ ID NO: 5614343 - DNA, 15 bp, Homo sapiens
gactggtccagctct

SEQ ID NO: 5614344 - DNA, 17 bp, Homo sapiens
gactggtccagctctga

SEQ ID NO: 5614345 - DNA, 23 bp, Homo sapiens
gactggtcccccatgggctgctg

SEQ ID NO: 5614346 - DNA, 18 bp, Homo sapiens
gactggtgctaatgtcaa

SEQ ID NO: 5614347 - DNA, 19 bp, Homo sapiens
gactggtggcaggggcttc

SEQ ID NO: 5614348 - DNA, 19 bp, Homo sapiens
gactggtgggggttctggc

SEQ ID NO: 5614349 - DNA, 20 bp, Homo sapiens
gactggtgggggttctggca

SEQ ID NO: 5614350 - DNA, 22 bp, Homo sapiens
gactggtgttatcaccgtgggc

SEQ ID NO: 5614351 - DNA, 15 bp, Homo sapiens
gactggttagtgatg

SEQ ID NO: 5614352 - DNA, 17 bp, Homo sapiens
gactggttagtgatgca

SEQ ID NO: 5614353 - DNA, 18 bp, Homo sapiens
gactggttctgaggccag

SEQ ID NO: 5614354 - DNA, 19 bp, Homo sapiens
gactggttctgaggccaga

SEQ ID NO: 5614355 - DNA, 23 bp, Homo sapiens
gactggttctgaggccagaaagg

SEQ ID NO: 5614356 - DNA, 13 bp, Homo sapiens
gactggttgtcag

SEQ ID NO: 5614357 - DNA, 15 bp, Homo sapiens
gactggttgtctctc

SEQ ID NO: 5614358 - DNA, 18 bp, Homo sapiens
gactggtttctcctggta

SEQ ID NO: 5614359 - DNA, 15 bp, Homo sapiens
gactggttttctgcc

SEQ ID NO: 5614360 - DNA, 17 bp, Homo sapiens
gactgtaaacacagaca

SEQ ID NO: 5614361 - DNA, 18 bp, Homo sapiens
gactgtaaacacagacag

SEQ ID NO: 5614362 - DNA, 15 bp, Homo sapiens
gactgtaagatgttg

SEQ ID NO: 5614363 - DNA, 17 bp, Homo sapiens
gactgtaagatgttgtt

SEQ ID NO: 5614364 - DNA, 17 bp, Homo sapiens
gactgtaagttgggctt

SEQ ID NO: 5614365 - DNA, 21 bp, Homo sapiens
gactgtaagttgggcttgcta

SEQ ID NO: 5614366 - DNA, 16 bp, Homo sapiens
gactgtaatgtgtact

SEQ ID NO: 5614367 - DNA, 22 bp, Homo sapiens
gactgtacaaagtagaagtctt

SEQ ID NO: 5614368 - DNA, 13 bp, Homo sapiens
gactgtacagaga

SEQ ID NO: 5614369 - DNA, 14 bp, Homo sapiens
gactgtacagagac

SEQ ID NO: 5614370 - DNA, 22 bp, Homo sapiens
gactgtacagagactctatttt

SEQ ID NO: 5614371 - DNA, 17 bp, Homo sapiens
gactgtacattatgaag

SEQ ID NO: 5614372 - DNA, 18 bp, Homo sapiens
gactgtacattatgaaga

SEQ ID NO: 5614373 - DNA, 20 bp, Homo sapiens
gactgtacctgtaggaaaca

SEQ ID NO: 5614374 - DNA, 16 bp, Homo sapiens
gactgtactcctccca

SEQ ID NO: 5614375 - DNA, 16 bp, Homo sapiens
gactgtagccacagct

SEQ ID NO: 5614376 - DNA, 13 bp, Homo sapiens
gactgtagggagg

SEQ ID NO: 5614377 - DNA, 22 bp, Homo sapiens
gactgtagggagggcggcaggg

SEQ ID NO: 5614378 - DNA, 14 bp, Homo sapiens
gactgtataaacaa

SEQ ID NO: 5614379 - DNA, 18 bp, Homo sapiens
gactgtatctaggcattt

SEQ ID NO: 5614380 - DNA, 22 bp, Homo sapiens
gactgtatctaggcatttcatt

SEQ ID NO: 5614381 - DNA, 16 bp, Homo sapiens
gactgtatctgtgtag

SEQ ID NO: 5614382 - DNA, 14 bp, Homo sapiens
gactgtatttgtga

SEQ ID NO: 5614383 - DNA, 15 bp, Homo sapiens
gactgtatttgtgac

SEQ ID NO: 5614384 - DNA, 19 bp, Homo sapiens
gactgtatttgtgactaat

SEQ ID NO: 5614385 - DNA, 20 bp, Homo sapiens
gactgtatttgtgactaatt

SEQ ID NO: 5614386 - DNA, 22 bp, Homo sapiens
gactgtatttgtgactaattgt

SEQ ID NO: 5614387 - DNA, 23 bp, Homo sapiens
gactgtatttgtgactaattgta

SEQ ID NO: 5614388 - DNA, 14 bp, Homo sapiens
gactgtattttgtt

SEQ ID NO: 5614389 - DNA, 17 bp, Homo sapiens
gactgtcaaatgaactt

SEQ ID NO: 5614390 - DNA, 18 bp, Homo sapiens
gactgtcacactggtgct

SEQ ID NO: 5614391 - DNA, 22 bp, Homo sapiens
gactgtcacgcggcagcttcag

SEQ ID NO: 5614392 - DNA, 22 bp, Homo sapiens
gactgtcacggggttccctcct

SEQ ID NO: 5614393 - DNA, 23 bp, Homo sapiens
gactgtcacggggttccctccta

SEQ ID NO: 5614394 - DNA, 22 bp, Homo sapiens
gactgtcagataatcggtgcag

SEQ ID NO: 5614395 - DNA, 18 bp, Homo sapiens
gactgtcaggaagtaaaa

SEQ ID NO: 5614396 - DNA, 13 bp, Homo sapiens
gactgtcagttct

SEQ ID NO: 5614397 - DNA, 12 bp, Homo sapiens
gactgtccacct

SEQ ID NO: 5614398 - DNA, 16 bp, Homo sapiens
gactgtccaggagcta

SEQ ID NO: 5614399 - DNA, 19 bp, Homo sapiens
gactgtccccatgcccacg

SEQ ID NO: 5614400 - DNA, 13 bp, Homo sapiens
gactgtccctgcc

SEQ ID NO: 5614401 - DNA, 20 bp, Homo sapiens
gactgtcctcccacagacct

SEQ ID NO: 5614402 - DNA, 16 bp, Homo sapiens
gactgtcctctcccct

SEQ ID NO: 5614403 - DNA, 22 bp, Homo sapiens
gactgtcctctcccctccagcc

SEQ ID NO: 5614404 - DNA, 18 bp, Homo sapiens
gactgtcgccacacgcct

SEQ ID NO: 5614405 - DNA, 16 bp, Homo sapiens
gactgtcgtgtttaca

SEQ ID NO: 5614406 - DNA, 18 bp, Homo sapiens
gactgtcgtgtttacaaa

SEQ ID NO: 5614407 - DNA, 19 bp, Homo sapiens
gactgtcgtgtttacaaaa

SEQ ID NO: 5614408 - DNA, 22 bp, Homo sapiens
gactgtctagccactccctccc

SEQ ID NO: 5614409 - DNA, 14 bp, Homo sapiens
gactgtctcaaaaa

SEQ ID NO: 5614410 - DNA, 18 bp, Homo sapiens
gactgtctccatggccct

SEQ ID NO: 5614411 - DNA, 19 bp, Homo sapiens
gactgtctggcccccctgg

SEQ ID NO: 5614412 - DNA, 18 bp, Homo sapiens
gactgtcttcaaccctgc

SEQ ID NO: 5614413 - DNA, 20 bp, Homo sapiens
gactgtcttcaaccctgccc

SEQ ID NO: 5614414 - DNA, 13 bp, Homo sapiens
gactgtcttgact

SEQ ID NO: 5614415 - DNA, 11 bp, Homo sapiens
gactgtgaaag

SEQ ID NO: 5614416 - DNA, 20 bp, Homo sapiens
gactgtgaaagtatgtgata

SEQ ID NO: 5614417 - DNA, 23 bp, Homo sapiens
gactttagggatctggggaagga

SEQ ID NO: 5614418 - DNA, 15 bp, Homo sapiens
gactttagtgaaagc

SEQ ID NO: 5614419 - DNA, 20 bp, Homo sapiens
gactttagtgccctgccccc

SEQ ID NO: 5614420 - DNA, 20 bp, Homo sapiens
gactttagttaccgagacat

SEQ ID NO: 5614421 - DNA, 13 bp, Homo sapiens
gactttataagcc

SEQ ID NO: 5614422 - DNA, 19 bp, Homo sapiens
gactttatagatcagccag

SEQ ID NO: 5614423 - DNA, 13 bp, Homo sapiens
gactttatattta

SEQ ID NO: 5614424 - DNA, 19 bp, Homo sapiens
gactttatcctgagtccct

SEQ ID NO: 5614425 - DNA, 14 bp, Homo sapiens
gactttattattta

SEQ ID NO: 5614426 - DNA, 16 bp, Homo sapiens
gactttatttaatttc

SEQ ID NO: 5614427 - DNA, 17 bp, Homo sapiens
gactttatttaatttca

SEQ ID NO: 5614428 - DNA, 23 bp, Homo sapiens
gactttatttaatttcataaatt

SEQ ID NO: 5614429 - DNA, 13 bp, Homo sapiens
gactttatttatt

SEQ ID NO: 5614430 - DNA, 21 bp, Homo sapiens
gactttcaaaattaaatctgt

SEQ ID NO: 5614431 - DNA, 20 bp, Homo sapiens
gactttcagccgactcagca

SEQ ID NO: 5614432 - DNA, 13 bp, Homo sapiens
gactttccacccc

SEQ ID NO: 5614433 - DNA, 14 bp, Homo sapiens
gactttccagaatg

SEQ ID NO: 5614434 - DNA, 14 bp, Homo sapiens
gactttccattaca

SEQ ID NO: 5614435 - DNA, 22 bp, Homo sapiens
gactttccccaacaatgtgatt

SEQ ID NO: 5614436 - DNA, 14 bp, Homo sapiens
gactttcccctctc

SEQ ID NO: 5614437 - DNA, 18 bp, Homo sapiens
gactttccttccctctcc

SEQ ID NO: 5614438 - DNA, 19 bp, Homo sapiens
gactttctacacctgttgc

SEQ ID NO: 5614439 - DNA, 15 bp, Homo sapiens
gactttctgaaaaca

SEQ ID NO: 5614440 - DNA, 12 bp, Homo sapiens
gactttctgctg

SEQ ID NO: 5614441 - DNA, 22 bp, Homo sapiens
gactttctgtgacgcagacaga

SEQ ID NO: 5614442 - DNA, 19 bp, Homo sapiens
gactttcttctaaatgagc

SEQ ID NO: 5614443 - DNA, 18 bp, Homo sapiens
gactttctttttctacat

SEQ ID NO: 5614444 - DNA, 21 bp, Homo sapiens
gactttctttttctacatgtg

SEQ ID NO: 5614445 - DNA, 23 bp, Homo sapiens
gactttctttttgtagctggggc

SEQ ID NO: 5614446 - DNA, 18 bp, Homo sapiens
gactttcttttttgatat

SEQ ID NO: 5614447 - DNA, 22 bp, Homo sapiens
gactttcttttttgatatagaa

SEQ ID NO: 5614448 - DNA, 17 bp, Homo sapiens
gactttgaatttatata

SEQ ID NO: 5614449 - DNA, 21 bp, Homo sapiens
gactttgaatttatataaagt

SEQ ID NO: 5614450 - DNA, 11 bp, Homo sapiens
gactttgacaa

SEQ ID NO: 5614451 - DNA, 18 bp, Homo sapiens
gactttgacaattactca

SEQ ID NO: 5614452 - DNA, 18 bp, Homo sapiens
gactttgagactattcat

SEQ ID NO: 5614453 - DNA, 14 bp, Homo sapiens
gactttgagctgag

SEQ ID NO: 5614454 - DNA, 23 bp, Homo sapiens
gactttgatccttggaaaccgtg

SEQ ID NO: 5614455 - DNA, 18 bp, Homo sapiens
gactttgatgcatttcca

SEQ ID NO: 5614456 - DNA, 18 bp, Homo sapiens
gactttgatgtcagcagt

SEQ ID NO: 5614457 - DNA, 22 bp, Homo sapiens
gactttgatgtcagcagttgct

SEQ ID NO: 5614458 - DNA, 23 bp, Homo sapiens
gactttgatttccttaatagccc

SEQ ID NO: 5614459 - DNA, 21 bp, Homo sapiens
gactttgcagccggcacaggg

SEQ ID NO: 5614460 - DNA, 17 bp, Homo sapiens
gactttgcccccttgcc

SEQ ID NO: 5614461 - DNA, 15 bp, Homo sapiens
gactttgctgcattt

SEQ ID NO: 5614462 - DNA, 20 bp, Homo sapiens
gactttgctgcattttacac

SEQ ID NO: 5614463 - DNA, 19 bp, Homo sapiens
gactttgctggtgtagtct

SEQ ID NO: 5614464 - DNA, 21 bp, Homo sapiens
gactttgcttcccctccagga

SEQ ID NO: 5614465 - DNA, 15 bp, Homo sapiens
gactttggaagcagg

SEQ ID NO: 5614466 - DNA, 16 bp, Homo sapiens
gactttggacagtggc

SEQ ID NO: 5614467 - DNA, 18 bp, Homo sapiens
gactttggcaagtgatat

SEQ ID NO: 5614468 - DNA, 19 bp, Homo sapiens
gactttggctgcatgcgag

SEQ ID NO: 5614469 - DNA, 22 bp, Homo sapiens
gactttggttattttacttttt

SEQ ID NO: 5614470 - DNA, 18 bp, Homo sapiens
gactttgtatactttaaa

SEQ ID NO: 5614471 - DNA, 13 bp, Homo sapiens
gactttgtgatcc

SEQ ID NO: 5614472 - DNA, 19 bp, Homo sapiens
gactttgtgttcatttcat

SEQ ID NO: 5614473 - DNA, 12 bp, Homo sapiens
gactttgttcac

SEQ ID NO: 5614474 - DNA, 22 bp, Homo sapiens
gactttgttgccttatcttgaa

SEQ ID NO: 5614475 - DNA, 13 bp, Homo sapiens
gacttttaaaatt

SEQ ID NO: 5614476 - DNA, 14 bp, Homo sapiens
gacttttaaacaaa

SEQ ID NO: 5614477 - DNA, 21 bp, Homo sapiens
gacttttaaatggcagtattt

SEQ ID NO: 5614478 - DNA, 21 bp, Homo sapiens
gacttttataacattttgaga

SEQ ID NO: 5614479 - DNA, 15 bp, Homo sapiens
gacttttatgtgaga

SEQ ID NO: 5614480 - DNA, 17 bp, Homo sapiens
gacttttatgtgagatt

SEQ ID NO: 5614481 - DNA, 16 bp, Homo sapiens
gacttttattgagctc

SEQ ID NO: 5614482 - DNA, 17 bp, Homo sapiens
gacttttcctgctgcct

SEQ ID NO: 5614483 - DNA, 19 bp, Homo sapiens
gacttttctggaagacatg

SEQ ID NO: 5614484 - DNA, 13 bp, Homo sapiens
gacttttctttct

SEQ ID NO: 5614485 - DNA, 21 bp, Homo sapiens
gacttttctttgtggcttcct

SEQ ID NO: 5614486 - DNA, 14 bp, Homo sapiens
gacttttcttttta

SEQ ID NO: 5614487 - DNA, 14 bp, Homo sapiens
gacttttgaagaac

SEQ ID NO: 5614488 - DNA, 19 bp, Homo sapiens
gacttttggtttttatatt

SEQ ID NO: 5614489 - DNA, 14 bp, Homo sapiens
gacttttgtaaaat

SEQ ID NO: 5614490 - DNA, 19 bp, Homo sapiens
gacttttgtacatctggct

SEQ ID NO: 5614491 - DNA, 20 bp, Homo sapiens
gacttttgtctgatcaagtg

SEQ ID NO: 5614492 - DNA, 16 bp, Homo sapiens
gacttttgttaaattc

SEQ ID NO: 5614493 - DNA, 22 bp, Homo sapiens
gacttttgttaaattcagtaat

SEQ ID NO: 5614494 - DNA, 17 bp, Homo sapiens
gacttttgttctcttct

SEQ ID NO: 5614495 - DNA, 18 bp, Homo sapiens
gacttttgttctcttctg

SEQ ID NO: 5614496 - DNA, 22 bp, Homo sapiens
gactttttaaaattctgagtga

SEQ ID NO: 5614497 - DNA, 17 bp, Homo sapiens
gactttttagccagtga

SEQ ID NO: 5614498 - DNA, 23 bp, Homo sapiens
gactttttggtggatgtaaataa

SEQ ID NO: 5614499 - DNA, 15 bp, Homo sapiens
gacttttttctaaac

SEQ ID NO: 5614500 - DNA, 20 bp, Homo sapiens
gacttttttttttcttttct

SEQ ID NO: 5614501 - DNA, 21 bp, Homo sapiens
gagaaaaaaaaagtgaaaaaa

SEQ ID NO: 5614502 - DNA, 22 bp, Homo sapiens
gagaaaaaaatataaaatttct

SEQ ID NO: 5614503 - DNA, 17 bp, Homo sapiens
gagaaaaaaatatataa

SEQ ID NO: 5614504 - DNA, 20 bp, Homo sapiens
gagaaaaaaatcaaccctgc

SEQ ID NO: 5614505 - DNA, 10 bp, Homo sapiens
gagaaaaaga

SEQ ID NO: 5614506 - DNA, 19 bp, Homo sapiens
gagaaaaagaaagaactgt

SEQ ID NO: 5614507 - DNA, 15 bp, Homo sapiens
gagaaaaagaaatgc

SEQ ID NO: 5614508 - DNA, 16 bp, Homo sapiens
gagaaaaagaaatgca

SEQ ID NO: 5614509 - DNA, 16 bp, Homo sapiens
gagaaaaagaagaaaa

SEQ ID NO: 5614510 - DNA, 18 bp, Homo sapiens
gagaaaaagaagaaaaga

SEQ ID NO: 5614511 - DNA, 21 bp, Homo sapiens
gagaaaaatattcaagtaaca

SEQ ID NO: 5614512 - DNA, 23 bp, Homo sapiens
gagaaaaatattcaagtaacact

SEQ ID NO: 5614513 - DNA, 21 bp, Homo sapiens
gagaaaacacacgctcctctg

SEQ ID NO: 5614514 - DNA, 12 bp, Homo sapiens
gagaaaacactt

SEQ ID NO: 5614515 - DNA, 20 bp, Homo sapiens
gagaaaacatctcatcatgt

SEQ ID NO: 5614516 - DNA, 19 bp, Homo sapiens
gagaaaaccttaaaagtaa

SEQ ID NO: 5614517 - DNA, 23 bp, Homo sapiens
gagaaaaccttaaaagtaataaa

SEQ ID NO: 5614518 - DNA, 21 bp, Homo sapiens
gagaaaacgtcttgcttggga

SEQ ID NO: 5614519 - DNA, 12 bp, Homo sapiens
gagaaaactgtt

SEQ ID NO: 5614520 - DNA, 23 bp, Homo sapiens
gagaaaacttcgtaagaacatgt

SEQ ID NO: 5614521 - DNA, 12 bp, Homo sapiens
gagaaaagaaaa

SEQ ID NO: 5614522 - DNA, 14 bp, Homo sapiens
gagaaaagaaaaat

SEQ ID NO: 5614523 - DNA, 17 bp, Homo sapiens
gagaaaagacaaatgtg

SEQ ID NO: 5614524 - DNA, 21 bp, Homo sapiens
gagaaaagacagggtgggagg

SEQ ID NO: 5614525 - DNA, 20 bp, Homo sapiens
gagaaaagagccagaagttg

SEQ ID NO: 5614526 - DNA, 14 bp, Homo sapiens
gagaaaagattaaa

SEQ ID NO: 5614527 - DNA, 21 bp, Homo sapiens
gagaaaagctggaccttttcc

SEQ ID NO: 5614528 - DNA, 16 bp, Homo sapiens
gagaaaaggaaaagaa

SEQ ID NO: 5614529 - DNA, 13 bp, Homo sapiens
gagaaaataaaaa

SEQ ID NO: 5614530 - DNA, 19 bp, Homo sapiens
gagaaaataaaaagttaaa

SEQ ID NO: 5614531 - DNA, 13 bp, Homo sapiens
gagaaaatatata

SEQ ID NO: 5614532 - DNA, 17 bp, Homo sapiens
gagaaaatatatgtatt

SEQ ID NO: 5614533 - DNA, 18 bp, Homo sapiens
gagaaaatattacttatt

SEQ ID NO: 5614534 - DNA, 23 bp, Homo sapiens
gagaaaatcatcaagaagggctg

SEQ ID NO: 5614535 - DNA, 18 bp, Homo sapiens
gagaaaatccccattgaa

SEQ ID NO: 5614536 - DNA, 15 bp, Homo sapiens
gagaaaatgcaggag

SEQ ID NO: 5614537 - DNA, 15 bp, Homo sapiens
gagaaaatgcctcaa

SEQ ID NO: 5614538 - DNA, 19 bp, Homo sapiens
gagaaaatgcgagactctg

SEQ ID NO: 5614539 - DNA, 18 bp, Homo sapiens
gagaaaattgcactaaat

SEQ ID NO: 5614540 - DNA, 19 bp, Homo sapiens
gagaaaatttatcacctaa

SEQ ID NO: 5614541 - DNA, 16 bp, Homo sapiens
gagaaacaaaatcctc

SEQ ID NO: 5614542 - DNA, 21 bp, Homo sapiens
gagaaacaagacaagctcctc

SEQ ID NO: 5614543 - DNA, 19 bp, Homo sapiens
gagaaacactatttgtgac

SEQ ID NO: 5614544 - DNA, 13 bp, Homo sapiens
gagaaacacttga

SEQ ID NO: 5614545 - DNA, 14 bp, Homo sapiens
gagaaacacttgaa

SEQ ID NO: 5614546 - DNA, 19 bp, Homo sapiens
gagaaacagagacaggccc

SEQ ID NO: 5614547 - DNA, 16 bp, Homo sapiens
gagaaacagctcagcc

SEQ ID NO: 5614548 - DNA, 13 bp, Homo sapiens
gagaaacaggccc

SEQ ID NO: 5614549 - DNA, 22 bp, Homo sapiens
gagaaacagttggtaacttttg

SEQ ID NO: 5614550 - DNA, 18 bp, Homo sapiens
gagaaacatgaattattt

SEQ ID NO: 5614551 - DNA, 18 bp, Homo sapiens
gagaaacattctttccta

SEQ ID NO: 5614552 - DNA, 23 bp, Homo sapiens
gagaaaccagcttccttcagaga

SEQ ID NO: 5614553 - DNA, 18 bp, Homo sapiens
gagaaacccaccagccta

SEQ ID NO: 5614554 - DNA, 22 bp, Homo sapiens
gagaaacccacgacctgtcctg

SEQ ID NO: 5614555 - DNA, 14 bp, Homo sapiens
gagaaacccagaga

SEQ ID NO: 5614556 - DNA, 17 bp, Homo sapiens
gagaaaccctaaaaaga

SEQ ID NO: 5614557 - DNA, 13 bp, Homo sapiens
gagaaacctccgg

SEQ ID NO: 5614558 - DNA, 13 bp, Homo sapiens
gagaaacctgcca

SEQ ID NO: 5614559 - DNA, 17 bp, Homo sapiens
gagaaacctgtatcttt

SEQ ID NO: 5614560 - DNA, 21 bp, Homo sapiens
gagaaaccttattgtacctct

SEQ ID NO: 5614561 - DNA, 17 bp, Homo sapiens
gagaaacgtccatctct

SEQ ID NO: 5614562 - DNA, 13 bp, Homo sapiens
gagaaactccaaa

SEQ ID NO: 5614563 - DNA, 21 bp, Homo sapiens
gagaaactcgggcactcccta

SEQ ID NO: 5614564 - DNA, 17 bp, Homo sapiens
gagaaactgaaagtgtt

SEQ ID NO: 5614565 - DNA, 15 bp, Homo sapiens
gagaaactgctgcag

SEQ ID NO: 5614566 - DNA, 19 bp, Homo sapiens
gagaaactggcaaagcaga

SEQ ID NO: 5614567 - DNA, 14 bp, Homo sapiens
gagaaactgtgtat

SEQ ID NO: 5614568 - DNA, 17 bp, Homo sapiens
gagaaacttaaagaaca

SEQ ID NO: 5614569 - DNA, 18 bp, Homo sapiens
gagaaacttaagcaaagg

SEQ ID NO: 5614570 - DNA, 23 bp, Homo sapiens
gagaaacttgtaatggtctctga

SEQ ID NO: 5614571 - DNA, 22 bp, Homo sapiens
gagaaactttgagtacagatac

SEQ ID NO: 5614572 - DNA, 15 bp, Homo sapiens
gagaaagaaagggaa

SEQ ID NO: 5614573 - DNA, 18 bp, Homo sapiens
gagaaagaagtaggcatg

SEQ ID NO: 5614574 - DNA, 16 bp, Homo sapiens
gagaaagaatgagaaa

SEQ ID NO: 5614575 - DNA, 17 bp, Homo sapiens
gagaaagacagtatttg

SEQ ID NO: 5614576 - DNA, 22 bp, Homo sapiens
gagaaagaccatgcatttaaag

SEQ ID NO: 5614577 - DNA, 13 bp, Homo sapiens
gagaaagactatt

SEQ ID NO: 5614578 - DNA, 13 bp, Homo sapiens
gagaaagagagaa

SEQ ID NO: 5614579 - DNA, 14 bp, Homo sapiens
gagaaagagagaga

SEQ ID NO: 5614580 - DNA, 16 bp, Homo sapiens
gagaaagatgcagtcc

SEQ ID NO: 5614581 - DNA, 18 bp, Homo sapiens
gagaaagcacaatttaaa

SEQ ID NO: 5614582 - DNA, 22 bp, Homo sapiens
gagaaagcacaatttaaaacaa

SEQ ID NO: 5614583 - DNA, 16 bp, Homo sapiens
gagaaagcatattgac

SEQ ID NO: 5614584 - DNA, 20 bp, Homo sapiens
gagaaagcatattgactttt

SEQ ID NO: 5614585 - DNA, 20 bp, Homo sapiens
gagaaagccaggcaggtagc

SEQ ID NO: 5614586 - DNA, 21 bp, Homo sapiens
gagaaagcccacctgggctgg

SEQ ID NO: 5614587 - DNA, 19 bp, Homo sapiens
gagaaagccgggggagggg

SEQ ID NO: 5614588 - DNA, 20 bp, Homo sapiens
gagaaagctgacttggctgg

SEQ ID NO: 5614589 - DNA, 16 bp, Homo sapiens
gagaaaggaactttta

SEQ ID NO: 5614590 - DNA, 14 bp, Homo sapiens
gagaaaggagccgg

SEQ ID NO: 5614591 - DNA, 15 bp, Homo sapiens
gagaaaggagccgga

SEQ ID NO: 5614592 - DNA, 15 bp, Homo sapiens
gagaaaggattaaga

SEQ ID NO: 5614593 - DNA, 16 bp, Homo sapiens
gagaaagggagagaaa

SEQ ID NO: 5614594 - DNA, 21 bp, Homo sapiens
gagaccacagcaattggctcc

SEQ ID NO: 5614595 - DNA, 12 bp, Homo sapiens
gagaccaccagg

SEQ ID NO: 5614596 - DNA, 18 bp, Homo sapiens
gagaccacccatatcatg

SEQ ID NO: 5614597 - DNA, 23 bp, Homo sapiens
gagaccaccgcgcccctctgcgc

SEQ ID NO: 5614598 - DNA, 16 bp, Homo sapiens
gagaccacttccttaa

SEQ ID NO: 5614599 - DNA, 23 bp, Homo sapiens
gagaccagaaaccttccagagaa

SEQ ID NO: 5614600 - DNA, 14 bp, Homo sapiens
gagaccagaagaaa

SEQ ID NO: 5614601 - DNA, 16 bp, Homo sapiens
gagaccagaagaaaag

SEQ ID NO: 5614602 - DNA, 16 bp, Homo sapiens
gagaccagcctttctt

SEQ ID NO: 5614603 - DNA, 18 bp, Homo sapiens
gagaccagcctttcttcc

SEQ ID NO: 5614604 - DNA, 16 bp, Homo sapiens
gagaccagctcagagg

SEQ ID NO: 5614605 - DNA, 21 bp, Homo sapiens
gagaccagctcagaggcccag

SEQ ID NO: 5614606 - DNA, 12 bp, Homo sapiens
gagaccaggagg

SEQ ID NO: 5614607 - DNA, 18 bp, Homo sapiens
gagaccaggagggagagc

SEQ ID NO: 5614608 - DNA, 14 bp, Homo sapiens
gagaccaggccctg

SEQ ID NO: 5614609 - DNA, 17 bp, Homo sapiens
gagaccaggctgtgtcc

SEQ ID NO: 5614610 - DNA, 13 bp, Homo sapiens
gagaccagggctc

SEQ ID NO: 5614611 - DNA, 16 bp, Homo sapiens
gagaccagggtggcca

SEQ ID NO: 5614612 - DNA, 21 bp, Homo sapiens
gagaccagggtggccacacag

SEQ ID NO: 5614613 - DNA, 23 bp, Homo sapiens
gagaccagggtggccacacaggc

SEQ ID NO: 5614614 - DNA, 13 bp, Homo sapiens
gagaccagtgtat

SEQ ID NO: 5614615 - DNA, 20 bp, Homo sapiens
gagaccagtgtatcaggtca

SEQ ID NO: 5614616 - DNA, 20 bp, Homo sapiens
gagaccagttgggagcactg

SEQ ID NO: 5614617 - DNA, 21 bp, Homo sapiens
gagaccagttgggagcactgg

SEQ ID NO: 5614618 - DNA, 22 bp, Homo sapiens
gagaccagttgggagcactgga

SEQ ID NO: 5614619 - DNA, 15 bp, Homo sapiens
gagaccataagagaa

SEQ ID NO: 5614620 - DNA, 12 bp, Homo sapiens
gagaccatccct

SEQ ID NO: 5614621 - DNA, 12 bp, Homo sapiens
gagaccatcctg

SEQ ID NO: 5614622 - DNA, 15 bp, Homo sapiens
gagaccatcctggct

SEQ ID NO: 5614623 - DNA, 15 bp, Homo sapiens
gagacccaaaccccc

SEQ ID NO: 5614624 - DNA, 19 bp, Homo sapiens
gagacccaacagcagtgat

SEQ ID NO: 5614625 - DNA, 22 bp, Homo sapiens
gagacccaaggctcactgcagc

SEQ ID NO: 5614626 - DNA, 14 bp, Homo sapiens
gagacccacagccc

SEQ ID NO: 5614627 - DNA, 19 bp, Homo sapiens
gagacccacagccctgaaa

SEQ ID NO: 5614628 - DNA, 13 bp, Homo sapiens
gagacccaccatc

SEQ ID NO: 5614629 - DNA, 20 bp, Homo sapiens
gagacccagggggctgaaac

SEQ ID NO: 5614630 - DNA, 18 bp, Homo sapiens
gagaccccaaagactctg

SEQ ID NO: 5614631 - DNA, 17 bp, Homo sapiens
gagaccccagagtaggg

SEQ ID NO: 5614632 - DNA, 13 bp, Homo sapiens
gagacccccacac

SEQ ID NO: 5614633 - DNA, 23 bp, Homo sapiens
gagacccccacacctcagttccc

SEQ ID NO: 5614634 - DNA, 18 bp, Homo sapiens
gagacccccatccagcct

SEQ ID NO: 5614635 - DNA, 17 bp, Homo sapiens
gagaccccgcactgcag

SEQ ID NO: 5614636 - DNA, 18 bp, Homo sapiens
gagaccccgcactgcaga

SEQ ID NO: 5614637 - DNA, 15 bp, Homo sapiens
gagacccctggcctc

SEQ ID NO: 5614638 - DNA, 14 bp, Homo sapiens
gagacccctgtctc

SEQ ID NO: 5614639 - DNA, 15 bp, Homo sapiens
gagaccccttccttt

SEQ ID NO: 5614640 - DNA, 20 bp, Homo sapiens
gagaccccttcctttcctct

SEQ ID NO: 5614641 - DNA, 19 bp, Homo sapiens
gagacccctttgccttccc

SEQ ID NO: 5614642 - DNA, 14 bp, Homo sapiens
gagacccgggaagg

SEQ ID NO: 5614643 - DNA, 16 bp, Homo sapiens
gagaccctcccctgcc

SEQ ID NO: 5614644 - DNA, 18 bp, Homo sapiens
gagaccctcccctgcctc

SEQ ID NO: 5614645 - DNA, 22 bp, Homo sapiens
gagaccctcgccacggggaggg

SEQ ID NO: 5614646 - DNA, 15 bp, Homo sapiens
gagaccctctgccac

SEQ ID NO: 5614647 - DNA, 21 bp, Homo sapiens
gagaccctcttctctgggccc

SEQ ID NO: 5614648 - DNA, 14 bp, Homo sapiens
gagaccctgcaaga

SEQ ID NO: 5614649 - DNA, 21 bp, Homo sapiens
gagaccctgccacagccagag

SEQ ID NO: 5614650 - DNA, 21 bp, Homo sapiens
gagaccctgcgcccctgccca

SEQ ID NO: 5614651 - DNA, 22 bp, Homo sapiens
gagaccctgcgcccctgcccag

SEQ ID NO: 5614652 - DNA, 22 bp, Homo sapiens
gagaccctggaattcagcaccc

SEQ ID NO: 5614653 - DNA, 17 bp, Homo sapiens
gagacccttgcattaga

SEQ ID NO: 5614654 - DNA, 16 bp, Homo sapiens
gagaccgagcctctgt

SEQ ID NO: 5614655 - DNA, 14 bp, Homo sapiens
gagaccgagtgaac

SEQ ID NO: 5614656 - DNA, 21 bp, Homo sapiens
gagaccgagtgtggagctgct

SEQ ID NO: 5614657 - DNA, 13 bp, Homo sapiens
gagaccgcagagg

SEQ ID NO: 5614658 - DNA, 15 bp, Homo sapiens
gagaccggcctgcca

SEQ ID NO: 5614659 - DNA, 18 bp, Homo sapiens
gagaccggcctgccagga

SEQ ID NO: 5614660 - DNA, 20 bp, Homo sapiens
gagaccggcctgccaggagg

SEQ ID NO: 5614661 - DNA, 18 bp, Homo sapiens
gagaccgggccctgggtt

SEQ ID NO: 5614662 - DNA, 14 bp, Homo sapiens
gagaccgtcctcac

SEQ ID NO: 5614663 - DNA, 16 bp, Homo sapiens
gagaccgtcctcaccc

SEQ ID NO: 5614664 - DNA, 20 bp, Homo sapiens
gagaccgtcgggggctgagg

SEQ ID NO: 5614665 - DNA, 17 bp, Homo sapiens
gagacctacaggctgac

SEQ ID NO: 5614666 - DNA, 19 bp, Homo sapiens
gagacctcaagccctgagg

SEQ ID NO: 5614667 - DNA, 24 bp, Homo sapiens
gagacctcaagccctgaggggcag

SEQ ID NO: 5614668 - DNA, 18 bp, Homo sapiens
gagacctcagatgtgttg

SEQ ID NO: 5614669 - DNA, 11 bp, Homo sapiens
gagacctcagc

SEQ ID NO: 5614670 - DNA, 15 bp, Homo sapiens
gagacctcagccatg

SEQ ID NO: 5614671 - DNA, 20 bp, Homo sapiens
gagacctcatcagccttggg

SEQ ID NO: 5614672 - DNA, 16 bp, Homo sapiens
gagacctccctgttca

SEQ ID NO: 5614673 - DNA, 13 bp, Homo sapiens
gagacctcctgcc

SEQ ID NO: 5614674 - DNA, 16 bp, Homo sapiens
gagacctcctgcctcc

SEQ ID NO: 5614675 - DNA, 20 bp, Homo sapiens
gagacctctcaacagatctg

SEQ ID NO: 5614676 - DNA, 16 bp, Homo sapiens
gagacctgaggcagat

SEQ ID NO: 5614677 - DNA, 13 bp, Homo sapiens
gagacctgcccct

SEQ ID NO: 5614678 - DNA, 15 bp, Homo sapiens
gagacctgccctctc

SEQ ID NO: 5614679 - DNA, 20 bp, Homo sapiens
gagacctggacacaggcctg

SEQ ID NO: 5614680 - DNA, 20 bp, Homo sapiens
gagacctgtatcaaactgct

SEQ ID NO: 5614681 - DNA, 12 bp, Homo sapiens
gagacctgtgct

SEQ ID NO: 5614682 - DNA, 17 bp, Homo sapiens
gagacctgttggcctgt

SEQ ID NO: 5614683 - DNA, 21 bp, Homo sapiens
gagacctgttggcctgtgggc

SEQ ID NO: 5614684 - DNA, 22 bp, Homo sapiens
gagacctgttggcctgtgggcc

SEQ ID NO: 5614685 - DNA, 23 bp, Homo sapiens
gagacctgttttaaaaaggaact

SEQ ID NO: 5614686 - DNA, 16 bp, Homo sapiens
gagaccttaatttata

SEQ ID NO: 5614687 - DNA, 13 bp, Homo sapiens
gagaccttacccc

SEQ ID NO: 5614688 - DNA, 14 bp, Homo sapiens
gagaccttcaaatg

SEQ ID NO: 5614689 - DNA, 19 bp, Homo sapiens
gagaccttcaaatgcgaac

SEQ ID NO: 5614690 - DNA, 21 bp, Homo sapiens
gagaccttttctctcccatac

SEQ ID NO: 5614691 - DNA, 11 bp, Homo sapiens
gagacgaggtc

SEQ ID NO: 5614692 - DNA, 23 bp, Homo sapiens
gagacgcagccctgggggccagc

SEQ ID NO: 5614693 - DNA, 16 bp, Homo sapiens
gagacgccactccctg

SEQ ID NO: 5614694 - DNA, 21 bp, Homo sapiens
gagacgccactccctgggaca

SEQ ID NO: 5614695 - DNA, 14 bp, Homo sapiens
gagacgcccagccc

SEQ ID NO: 5614696 - DNA, 15 bp, Homo sapiens
gagacgcccagcccc

SEQ ID NO: 5614697 - DNA, 14 bp, Homo sapiens
gagacggcagagac

SEQ ID NO: 5614698 - DNA, 22 bp, Homo sapiens
gagacggcagagaccccaggat

SEQ ID NO: 5614699 - DNA, 13 bp, Homo sapiens
gagacggcagccc

SEQ ID NO: 5614700 - DNA, 15 bp, Homo sapiens
gagacggccctgctg

SEQ ID NO: 5614701 - DNA, 17 bp, Homo sapiens
gagacggccctgctggg

SEQ ID NO: 5614702 - DNA, 21 bp, Homo sapiens
gagacggcgattttcgggctg

SEQ ID NO: 5614703 - DNA, 13 bp, Homo sapiens
gagacgggcatcg

SEQ ID NO: 5614704 - DNA, 18 bp, Homo sapiens
gagacggggtctccctgt

SEQ ID NO: 5614705 - DNA, 16 bp, Homo sapiens
gagacggtcatgcaag

SEQ ID NO: 5614706 - DNA, 15 bp, Homo sapiens
gagacgtccaccctg

SEQ ID NO: 5614707 - DNA, 20 bp, Homo sapiens
gagacgtccaccctgcagcc

SEQ ID NO: 5614708 - DNA, 20 bp, Homo sapiens
gagacgtggaacctctgtct

SEQ ID NO: 5614709 - DNA, 22 bp, Homo sapiens
gagacgtggaacctctgtctca

SEQ ID NO: 5614710 - DNA, 16 bp, Homo sapiens
gagacgtgtacatagt

SEQ ID NO: 5614711 - DNA, 20 bp, Homo sapiens
gagacgtttataaacagaaa

SEQ ID NO: 5614712 - DNA, 19 bp, Homo sapiens
gagactaacttattttgat

SEQ ID NO: 5614713 - DNA, 21 bp, Homo sapiens
gagactaaggggcagctcctg

SEQ ID NO: 5614714 - DNA, 20 bp, Homo sapiens
gagactaatagagacacaga

SEQ ID NO: 5614715 - DNA, 19 bp, Homo sapiens
gagactagattctcacctg

SEQ ID NO: 5614716 - DNA, 16 bp, Homo sapiens
gagactagggaaggga

SEQ ID NO: 5614717 - DNA, 21 bp, Homo sapiens
gagactatggagcctggcaca

SEQ ID NO: 5614718 - DNA, 19 bp, Homo sapiens
gagactatgtaaaaataac

SEQ ID NO: 5614719 - DNA, 18 bp, Homo sapiens
gagactcaaaaaaacaaa

SEQ ID NO: 5614720 - DNA, 15 bp, Homo sapiens
gagactcacaggaag

SEQ ID NO: 5614721 - DNA, 20 bp, Homo sapiens
gagactcactggttttactt

SEQ ID NO: 5614722 - DNA, 12 bp, Homo sapiens
gagactcagcct

SEQ ID NO: 5614723 - DNA, 17 bp, Homo sapiens
gagactcagcctctgct

SEQ ID NO: 5614724 - DNA, 23 bp, Homo sapiens
gagactcagcctctgctggagaa

SEQ ID NO: 5614725 - DNA, 14 bp, Homo sapiens
gagactcagcctgc

SEQ ID NO: 5614726 - DNA, 15 bp, Homo sapiens
gagactcagcctgca

SEQ ID NO: 5614727 - DNA, 17 bp, Homo sapiens
gagactcagcctgcagt

SEQ ID NO: 5614728 - DNA, 20 bp, Homo sapiens
gagactcagccttcctcctc

SEQ ID NO: 5614729 - DNA, 23 bp, Homo sapiens
gagactcagcgctcctcctgtgt

SEQ ID NO: 5614730 - DNA, 13 bp, Homo sapiens
gagactcaggccc

SEQ ID NO: 5614731 - DNA, 14 bp, Homo sapiens
gagactcaggccca

SEQ ID NO: 5614732 - DNA, 21 bp, Homo sapiens
gagactcagggccccagcact

SEQ ID NO: 5614733 - DNA, 15 bp, Homo sapiens
gagactccacctcaa

SEQ ID NO: 5614734 - DNA, 19 bp, Homo sapiens
gagactccagaatctgctg

SEQ ID NO: 5614735 - DNA, 23 bp, Homo sapiens
gagactccagaatctgctgttgc

SEQ ID NO: 5614736 - DNA, 14 bp, Homo sapiens
gagactccatctct

SEQ ID NO: 5614737 - DNA, 16 bp, Homo sapiens
gagactcccatgaagc

SEQ ID NO: 5614738 - DNA, 18 bp, Homo sapiens
gagactcccatgaagcct

SEQ ID NO: 5614739 - DNA, 19 bp, Homo sapiens
gagactcccatgaagcctt

SEQ ID NO: 5614740 - DNA, 13 bp, Homo sapiens
gagactccccaat

SEQ ID NO: 5614741 - DNA, 16 bp, Homo sapiens
gagactcctaggcagg

SEQ ID NO: 5614742 - DNA, 16 bp, Homo sapiens
gagactcctcagcacc

SEQ ID NO: 5614743 - DNA, 17 bp, Homo sapiens
gagactcctcagcaccc

SEQ ID NO: 5614744 - DNA, 15 bp, Homo sapiens
gagactcctgcaggc

SEQ ID NO: 5614745 - DNA, 18 bp, Homo sapiens
gagactcctgcaggcagc

SEQ ID NO: 5614746 - DNA, 19 bp, Homo sapiens
gagactcctgcaggcagcc

SEQ ID NO: 5614747 - DNA, 21 bp, Homo sapiens
gagactcctgggcagccgttt

SEQ ID NO: 5614748 - DNA, 23 bp, Homo sapiens
gagactcctggtctgtgaagagc

SEQ ID NO: 5614749 - DNA, 16 bp, Homo sapiens
gagactcgagaacttt

SEQ ID NO: 5614750 - DNA, 20 bp, Homo sapiens
gagactcgagaactttcatt

SEQ ID NO: 5614751 - DNA, 16 bp, Homo sapiens
gagactcggccgcagc

SEQ ID NO: 5614752 - DNA, 16 bp, Homo sapiens
gagactctagggtcca

SEQ ID NO: 5614753 - DNA, 19 bp, Homo sapiens
gagactctagggtccagtg

SEQ ID NO: 5614754 - DNA, 20 bp, Homo sapiens
gagactctagggtccagtgg

SEQ ID NO: 5614755 - DNA, 17 bp, Homo sapiens
gagactctattttaatg

SEQ ID NO: 5614756 - DNA, 16 bp, Homo sapiens
gagactctcctgcctc

SEQ ID NO: 5614757 - DNA, 19 bp, Homo sapiens
gagactctcctgcctcagc

SEQ ID NO: 5614758 - DNA, 23 bp, Homo sapiens
gagactctgatggaatgtgccac

SEQ ID NO: 5614759 - DNA, 23 bp, Homo sapiens
gagactctggaagccccccacct

SEQ ID NO: 5614760 - DNA, 18 bp, Homo sapiens
gagactctgtttgcttgt

SEQ ID NO: 5614761 - DNA, 17 bp, Homo sapiens
gagactgaaagcagcag

SEQ ID NO: 5614762 - DNA, 18 bp, Homo sapiens
gagactgaaagcagcagc

SEQ ID NO: 5614763 - DNA, 19 bp, Homo sapiens
gagactgaaagcagcagct

SEQ ID NO: 5614764 - DNA, 20 bp, Homo sapiens
gagactgaaagcagcagcta

SEQ ID NO: 5614765 - DNA, 20 bp, Homo sapiens
gagactgacccattcacatt

SEQ ID NO: 5614766 - DNA, 22 bp, Homo sapiens
gagactgacccattcacatttt

SEQ ID NO: 5614767 - DNA, 17 bp, Homo sapiens
gagactgagcagccgcc

SEQ ID NO: 5614768 - DNA, 15 bp, Homo sapiens
gagactgagggagag

SEQ ID NO: 5614769 - DNA, 23 bp, Homo sapiens
gagactgatcatccaggcctcag

SEQ ID NO: 5614770 - DNA, 22 bp, Homo sapiens
gagactgatccctggccactga

SEQ ID NO: 5614771 - DNA, 17 bp, Homo sapiens
gagagttcgtgaagagg

SEQ ID NO: 5614772 - DNA, 18 bp, Homo sapiens
gagagttctttgctgccc

SEQ ID NO: 5614773 - DNA, 16 bp, Homo sapiens
gagagttggctcaggc

SEQ ID NO: 5614774 - DNA, 16 bp, Homo sapiens
gagagttgggggccag

SEQ ID NO: 5614775 - DNA, 14 bp, Homo sapiens
gagagttgtctctg

SEQ ID NO: 5614776 - DNA, 23 bp, Homo sapiens
gagagtttatcattgggagaagc

SEQ ID NO: 5614777 - DNA, 12 bp, Homo sapiens
gagagtttcaaa

SEQ ID NO: 5614778 - DNA, 15 bp, Homo sapiens
gagagttttgtcttg

SEQ ID NO: 5614779 - DNA, 13 bp, Homo sapiens
gagataaaaatca

SEQ ID NO: 5614780 - DNA, 21 bp, Homo sapiens
gagataaaacagaatcttctg

SEQ ID NO: 5614781 - DNA, 22 bp, Homo sapiens
gagataaaacagaatcttctgg

SEQ ID NO: 5614782 - DNA, 23 bp, Homo sapiens
gagataaacaccaacccaggaat

SEQ ID NO: 5614783 - DNA, 20 bp, Homo sapiens
gagataaaccaataaatcca

SEQ ID NO: 5614784 - DNA, 18 bp, Homo sapiens
gagataaatagaaatttt

SEQ ID NO: 5614785 - DNA, 12 bp, Homo sapiens
gagataaatatt

SEQ ID NO: 5614786 - DNA, 13 bp, Homo sapiens
gagataaatattt

SEQ ID NO: 5614787 - DNA, 15 bp, Homo sapiens
gagataaatctagta

SEQ ID NO: 5614788 - DNA, 12 bp, Homo sapiens
gagataaatgtt

SEQ ID NO: 5614789 - DNA, 24 bp, Homo sapiens
gagataaccacaaccaggaagaac

SEQ ID NO: 5614790 - DNA, 16 bp, Homo sapiens
gagataagaaaagcct

SEQ ID NO: 5614791 - DNA, 12 bp, Homo sapiens
gagataagaaag

SEQ ID NO: 5614792 - DNA, 17 bp, Homo sapiens
gagataaggtggcttct

SEQ ID NO: 5614793 - DNA, 18 bp, Homo sapiens
gagataaggtggcttctc

SEQ ID NO: 5614794 - DNA, 14 bp, Homo sapiens
gagataaggtttta

SEQ ID NO: 5614795 - DNA, 19 bp, Homo sapiens
gagataagtaggctggttt

SEQ ID NO: 5614796 - DNA, 12 bp, Homo sapiens
gagataatacat

SEQ ID NO: 5614797 - DNA, 16 bp, Homo sapiens
gagataatacattccg

SEQ ID NO: 5614798 - DNA, 18 bp, Homo sapiens
gagataatatctgtgagg

SEQ ID NO: 5614799 - DNA, 18 bp, Homo sapiens
gagataatctaaatataa

SEQ ID NO: 5614800 - DNA, 17 bp, Homo sapiens
gagataatttaaccctg

SEQ ID NO: 5614801 - DNA, 23 bp, Homo sapiens
gagataatttaaccctgcctctc

SEQ ID NO: 5614802 - DNA, 17 bp, Homo sapiens
gagatacagaattttat

SEQ ID NO: 5614803 - DNA, 16 bp, Homo sapiens
gagatacatacagaat

SEQ ID NO: 5614804 - DNA, 14 bp, Homo sapiens
gagatacccagaga

SEQ ID NO: 5614805 - DNA, 18 bp, Homo sapiens
gagatacccagagagaaa

SEQ ID NO: 5614806 - DNA, 19 bp, Homo sapiens
gagatacccagagagaaaa

SEQ ID NO: 5614807 - DNA, 13 bp, Homo sapiens
gagatactctggg

SEQ ID NO: 5614808 - DNA, 12 bp, Homo sapiens
gagatactgtgt

SEQ ID NO: 5614809 - DNA, 15 bp, Homo sapiens
gagatacttcccaaa

SEQ ID NO: 5614810 - DNA, 16 bp, Homo sapiens
gagatacttgatgcca

SEQ ID NO: 5614811 - DNA, 21 bp, Homo sapiens
gagatacttggtcacagccag

SEQ ID NO: 5614812 - DNA, 23 bp, Homo sapiens
gagatagacgggttgaaagacat

SEQ ID NO: 5614813 - DNA, 19 bp, Homo sapiens
gagatagccaaggccaaag

SEQ ID NO: 5614814 - DNA, 20 bp, Homo sapiens
gagatagccaaggccaaagg

SEQ ID NO: 5614815 - DNA, 18 bp, Homo sapiens
gagatagcccatcttcct

SEQ ID NO: 5614816 - DNA, 19 bp, Homo sapiens
gagatagccgggctccagg

SEQ ID NO: 5614817 - DNA, 20 bp, Homo sapiens
gagatagccgggctccaggg

SEQ ID NO: 5614818 - DNA, 16 bp, Homo sapiens
gagatagcctgtggcc

SEQ ID NO: 5614819 - DNA, 21 bp, Homo sapiens
gagatagcctgtggccctgtc

SEQ ID NO: 5614820 - DNA, 13 bp, Homo sapiens
gagatagctgggg

SEQ ID NO: 5614821 - DNA, 15 bp, Homo sapiens
gagatagctggggct

SEQ ID NO: 5614822 - DNA, 17 bp, Homo sapiens
gagatagcttagtgtct

SEQ ID NO: 5614823 - DNA, 15 bp, Homo sapiens
gagatagcttcccca

SEQ ID NO: 5614824 - DNA, 21 bp, Homo sapiens
gagataggaaggtcatttcca

SEQ ID NO: 5614825 - DNA, 22 bp, Homo sapiens
gagataggaaggtcatttccat

SEQ ID NO: 5614826 - DNA, 21 bp, Homo sapiens
gagatagtgccaggtggctca

SEQ ID NO: 5614827 - DNA, 17 bp, Homo sapiens
gagatagttttcatcca

SEQ ID NO: 5614828 - DNA, 15 bp, Homo sapiens
gagatagttttttct

SEQ ID NO: 5614829 - DNA, 22 bp, Homo sapiens
gagatatacaaatatatttaat

SEQ ID NO: 5614830 - DNA, 12 bp, Homo sapiens
gagatatatttt

SEQ ID NO: 5614831 - DNA, 22 bp, Homo sapiens
gagatatctgagggaggaggcc

SEQ ID NO: 5614832 - DNA, 13 bp, Homo sapiens
gagatatgcaata

SEQ ID NO: 5614833 - DNA, 13 bp, Homo sapiens
gagatatgcattc

SEQ ID NO: 5614834 - DNA, 13 bp, Homo sapiens
gagatattatttt

SEQ ID NO: 5614835 - DNA, 16 bp, Homo sapiens
gagatattattttaaa

SEQ ID NO: 5614836 - DNA, 14 bp, Homo sapiens
gagatattcttatt

SEQ ID NO: 5614837 - DNA, 19 bp, Homo sapiens
gagatattgggacacacat

SEQ ID NO: 5614838 - DNA, 20 bp, Homo sapiens
gagatatttaggaaaatgct

SEQ ID NO: 5614839 - DNA, 21 bp, Homo sapiens
gagatatttaggaaaatgctt

SEQ ID NO: 5614840 - DNA, 17 bp, Homo sapiens
gagatattttaaaatga

SEQ ID NO: 5614841 - DNA, 17 bp, Homo sapiens
gagatattttgtaaaat

SEQ ID NO: 5614842 - DNA, 20 bp, Homo sapiens
gagatattttgtaaaatgta

SEQ ID NO: 5614843 - DNA, 13 bp, Homo sapiens
gagatatttttat

SEQ ID NO: 5614844 - DNA, 20 bp, Homo sapiens
gagatcaaagatgaaaagta

SEQ ID NO: 5614845 - DNA, 18 bp, Homo sapiens
gagatcaaatggaaagga

SEQ ID NO: 5614846 - DNA, 15 bp, Homo sapiens
gagatcacagcctcc

SEQ ID NO: 5614847 - DNA, 19 bp, Homo sapiens
gagatcacagcctccaggg

SEQ ID NO: 5614848 - DNA, 21 bp, Homo sapiens
gagatcaccagtgtgtggctt

SEQ ID NO: 5614849 - DNA, 22 bp, Homo sapiens
gagatcacgccattgtactcca

SEQ ID NO: 5614850 - DNA, 13 bp, Homo sapiens
gagatcagaattg

SEQ ID NO: 5614851 - DNA, 12 bp, Homo sapiens
gagatcagagtc

SEQ ID NO: 5614852 - DNA, 17 bp, Homo sapiens
gagatcagcatgcctgt

SEQ ID NO: 5614853 - DNA, 13 bp, Homo sapiens
gagatcagcctgg

SEQ ID NO: 5614854 - DNA, 13 bp, Homo sapiens
gagatcaggaaga

SEQ ID NO: 5614855 - DNA, 20 bp, Homo sapiens
gagatcaggagtgacagatc

SEQ ID NO: 5614856 - DNA, 17 bp, Homo sapiens
gagatcaggatcagctt

SEQ ID NO: 5614857 - DNA, 21 bp, Homo sapiens
gagatcataaagagcacgttt

SEQ ID NO: 5614858 - DNA, 22 bp, Homo sapiens
gagatccaaaagaagcccccag

SEQ ID NO: 5614859 - DNA, 13 bp, Homo sapiens
gagatccagcaca

SEQ ID NO: 5614860 - DNA, 14 bp, Homo sapiens
gagatccagcacaa

SEQ ID NO: 5614861 - DNA, 11 bp, Homo sapiens
gagatccagtg

SEQ ID NO: 5614862 - DNA, 19 bp, Homo sapiens
gagatcccaacactgccag

SEQ ID NO: 5614863 - DNA, 15 bp, Homo sapiens
gagatcccaggaggt

SEQ ID NO: 5614864 - DNA, 14 bp, Homo sapiens
gagatccccagggc

SEQ ID NO: 5614865 - DNA, 17 bp, Homo sapiens
gagatccccagggcagc

SEQ ID NO: 5614866 - DNA, 17 bp, Homo sapiens
gagatcccgcctcttct

SEQ ID NO: 5614867 - DNA, 17 bp, Homo sapiens
gagatcccttaagaagt

SEQ ID NO: 5614868 - DNA, 15 bp, Homo sapiens
gagatccgccctggg

SEQ ID NO: 5614869 - DNA, 22 bp, Homo sapiens
gagatcctcaaaaatcatcaaa

SEQ ID NO: 5614870 - DNA, 13 bp, Homo sapiens
gagatcctcctgc

SEQ ID NO: 5614871 - DNA, 17 bp, Homo sapiens
gagatcctcctgcagac

SEQ ID NO: 5614872 - DNA, 20 bp, Homo sapiens
gagatcctctttactctggg

SEQ ID NO: 5614873 - DNA, 13 bp, Homo sapiens
gagatcctggact

SEQ ID NO: 5614874 - DNA, 22 bp, Homo sapiens
gagatcgacaccatcctggcta

SEQ ID NO: 5614875 - DNA, 16 bp, Homo sapiens
gagatcgacagacagc

SEQ ID NO: 5614876 - DNA, 20 bp, Homo sapiens
gagatcgacagacagccagg

SEQ ID NO: 5614877 - DNA, 21 bp, Homo sapiens
gagatcgagaccatcctggct

SEQ ID NO: 5614878 - DNA, 21 bp, Homo sapiens
gagatcgcgccattgcactcc

SEQ ID NO: 5614879 - DNA, 14 bp, Homo sapiens
gagatcgcttttct

SEQ ID NO: 5614880 - DNA, 17 bp, Homo sapiens
gagatcgggaagcagaa

SEQ ID NO: 5614881 - DNA, 16 bp, Homo sapiens
gagatcggggccagag

SEQ ID NO: 5614882 - DNA, 21 bp, Homo sapiens
gagatcggggtggcagaaatc

SEQ ID NO: 5614883 - DNA, 21 bp, Homo sapiens
gagatcgtacctattgcactc

SEQ ID NO: 5614884 - DNA, 17 bp, Homo sapiens
gagatcgtgccactgca

SEQ ID NO: 5614885 - DNA, 20 bp, Homo sapiens
gagatcgtgccactgcactc

SEQ ID NO: 5614886 - DNA, 18 bp, Homo sapiens
gagatcgtgccattgcac

SEQ ID NO: 5614887 - DNA, 22 bp, Homo sapiens
gagatcgtgccgttactctcca

SEQ ID NO: 5614888 - DNA, 21 bp, Homo sapiens
gagatcgtgctactgcactcc

SEQ ID NO: 5614889 - DNA, 15 bp, Homo sapiens
gagatctaaaaataa

SEQ ID NO: 5614890 - DNA, 19 bp, Homo sapiens
gagatctaagcctttccat

SEQ ID NO: 5614891 - DNA, 23 bp, Homo sapiens
gagatctaaggatgtcacagggc

SEQ ID NO: 5614892 - DNA, 13 bp, Homo sapiens
gagatctacacat

SEQ ID NO: 5614893 - DNA, 15 bp, Homo sapiens
gagatctcaggagcc

SEQ ID NO: 5614894 - DNA, 13 bp, Homo sapiens
gagatctgaaggg

SEQ ID NO: 5614895 - DNA, 19 bp, Homo sapiens
gagatctgcacagtcagaa

SEQ ID NO: 5614896 - DNA, 17 bp, Homo sapiens
gagatctggggaggcag

SEQ ID NO: 5614897 - DNA, 21 bp, Homo sapiens
gagatctgtgtggctcctggg

SEQ ID NO: 5614898 - DNA, 19 bp, Homo sapiens
gagatcttcccataataaa

SEQ ID NO: 5614899 - DNA, 23 bp, Homo sapiens
gagatcttcccataataaagcaa

SEQ ID NO: 5614900 - DNA, 13 bp, Homo sapiens
gagatcttccttc

SEQ ID NO: 5614901 - DNA, 21 bp, Homo sapiens
gagatgaaatcttacagctgg

SEQ ID NO: 5614902 - DNA, 15 bp, Homo sapiens
gagatgaacatctgg

SEQ ID NO: 5614903 - DNA, 15 bp, Homo sapiens
gagatgaagcaaaca

SEQ ID NO: 5614904 - DNA, 12 bp, Homo sapiens
gagatgaagtta

SEQ ID NO: 5614905 - DNA, 16 bp, Homo sapiens
gagatgaatagaagaa

SEQ ID NO: 5614906 - DNA, 17 bp, Homo sapiens
gagatgaatagaagaaa

SEQ ID NO: 5614907 - DNA, 21 bp, Homo sapiens
gagatgaatagaagaaagaaa

SEQ ID NO: 5614908 - DNA, 20 bp, Homo sapiens
gagatgacaacaaattttgg

SEQ ID NO: 5614909 - DNA, 18 bp, Homo sapiens
gagatgaccagggatgct

SEQ ID NO: 5614910 - DNA, 13 bp, Homo sapiens
gagatgaccccta

SEQ ID NO: 5614911 - DNA, 22 bp, Homo sapiens
gagatgacccctaccccctcat

SEQ ID NO: 5614912 - DNA, 13 bp, Homo sapiens
gagatgactgagt

SEQ ID NO: 5614913 - DNA, 17 bp, Homo sapiens
gagatgagaaacaacag

SEQ ID NO: 5614914 - DNA, 12 bp, Homo sapiens
gagatgagaaag

SEQ ID NO: 5614915 - DNA, 18 bp, Homo sapiens
gagatgagaaatgatgaa

SEQ ID NO: 5614916 - DNA, 19 bp, Homo sapiens
gagatgaggagtaaaattc

SEQ ID NO: 5614917 - DNA, 13 bp, Homo sapiens
gagatgaggccag

SEQ ID NO: 5614918 - DNA, 14 bp, Homo sapiens
gagatgaggccaga

SEQ ID NO: 5614919 - DNA, 16 bp, Homo sapiens
gagatgagtgtctgga

SEQ ID NO: 5614920 - DNA, 16 bp, Homo sapiens
gagatgagttgcagtt

SEQ ID NO: 5614921 - DNA, 17 bp, Homo sapiens
gagatgagttgcagttt

SEQ ID NO: 5614922 - DNA, 16 bp, Homo sapiens
gagatgagtttctggg

SEQ ID NO: 5614923 - DNA, 20 bp, Homo sapiens
gagatgatgaaaatatttaa

SEQ ID NO: 5614924 - DNA, 17 bp, Homo sapiens
gagatgatgatgatgat

SEQ ID NO: 5614925 - DNA, 18 bp, Homo sapiens
gagatgattcagaagggg

SEQ ID NO: 5614926 - DNA, 12 bp, Homo sapiens
gagatgatttcc

SEQ ID NO: 5614927 - DNA, 16 bp, Homo sapiens
gagatgatttgtactt

SEQ ID NO: 5614928 - DNA, 23 bp, Homo sapiens
gagatgcactatatgtttacaca

SEQ ID NO: 5614929 - DNA, 21 bp, Homo sapiens
gagatgcatctgtggcctggg

SEQ ID NO: 5614930 - DNA, 23 bp, Homo sapiens
gagatgcatctgtggcctggggc

SEQ ID NO: 5614931 - DNA, 12 bp, Homo sapiens
gagatgcatgat

SEQ ID NO: 5614932 - DNA, 16 bp, Homo sapiens
gagatgcatggcctct

SEQ ID NO: 5614933 - DNA, 14 bp, Homo sapiens
gagatgcctccacc

SEQ ID NO: 5614934 - DNA, 19 bp, Homo sapiens
gagatgcctccaccgctgc

SEQ ID NO: 5614935 - DNA, 12 bp, Homo sapiens
gagatgcctccc

SEQ ID NO: 5614936 - DNA, 15 bp, Homo sapiens
gagatgcctccctga

SEQ ID NO: 5614937 - DNA, 14 bp, Homo sapiens
gagatgctaattta

SEQ ID NO: 5614938 - DNA, 19 bp, Homo sapiens
gagatgctactgtcagtgt

SEQ ID NO: 5614939 - DNA, 16 bp, Homo sapiens
gagatgctgagggtgt

SEQ ID NO: 5614940 - DNA, 17 bp, Homo sapiens
gagatgctgctcccgcc

SEQ ID NO: 5614941 - DNA, 18 bp, Homo sapiens
gagatgctggagaagaga

SEQ ID NO: 5614942 - DNA, 20 bp, Homo sapiens
gagatgctggagaagagagg

SEQ ID NO: 5614943 - DNA, 12 bp, Homo sapiens
gagatgctgggc

SEQ ID NO: 5614944 - DNA, 13 bp, Homo sapiens
gagatgctgggct

SEQ ID NO: 5614945 - DNA, 17 bp, Homo sapiens
gagatggaaacaatgtg

SEQ ID NO: 5614946 - DNA, 13 bp, Homo sapiens
gagatggaagctt

SEQ ID NO: 5614947 - DNA, 22 bp, Homo sapiens
gagatggaattgtaataaacca

SEQ ID NO: 5614948 - DNA, 15 bp, Homo sapiens
gagatggagggcttg

SEQ ID NO: 5614949 - DNA, 16 bp, Homo sapiens
gagatggagggcttgg

SEQ ID NO: 5614950 - DNA, 17 bp, Homo sapiens
gagcatccccctcctct

SEQ ID NO: 5614951 - DNA, 13 bp, Homo sapiens
gagcatcccggag

SEQ ID NO: 5614952 - DNA, 21 bp, Homo sapiens
gagcatccggcatgagggctg

SEQ ID NO: 5614953 - DNA, 19 bp, Homo sapiens
gagcatccggccaaatgca

SEQ ID NO: 5614954 - DNA, 15 bp, Homo sapiens
gagcatcctgagccc

SEQ ID NO: 5614955 - DNA, 18 bp, Homo sapiens
gagcatcctgagccccgc

SEQ ID NO: 5614956 - DNA, 12 bp, Homo sapiens
gagcatcctgat

SEQ ID NO: 5614957 - DNA, 19 bp, Homo sapiens
gagcatccttcccagcaga

SEQ ID NO: 5614958 - DNA, 22 bp, Homo sapiens
gagcatccttggcagtgggaat

SEQ ID NO: 5614959 - DNA, 19 bp, Homo sapiens
gagcatcggagggagtccc

SEQ ID NO: 5614960 - DNA, 21 bp, Homo sapiens
gagcatcgtgacccttcaggg

SEQ ID NO: 5614961 - DNA, 17 bp, Homo sapiens
gagcatctcaaatgttt

SEQ ID NO: 5614962 - DNA, 20 bp, Homo sapiens
gagcatctcaaatgttttct

SEQ ID NO: 5614963 - DNA, 21 bp, Homo sapiens
gagcatctcaaatgttttctg

SEQ ID NO: 5614964 - DNA, 23 bp, Homo sapiens
gagcatctcaaatgttttctgca

SEQ ID NO: 5614965 - DNA, 20 bp, Homo sapiens
gagcatctcaggaggggcag

SEQ ID NO: 5614966 - DNA, 14 bp, Homo sapiens
gagcatctctgcct

SEQ ID NO: 5614967 - DNA, 22 bp, Homo sapiens
gagcatctctgtgtacccactc

SEQ ID NO: 5614968 - DNA, 19 bp, Homo sapiens
gagcatctcttgaggccag

SEQ ID NO: 5614969 - DNA, 13 bp, Homo sapiens
gagcatctgcccc

SEQ ID NO: 5614970 - DNA, 15 bp, Homo sapiens
gagcatctgccccag

SEQ ID NO: 5614971 - DNA, 14 bp, Homo sapiens
gagcatctgctctg

SEQ ID NO: 5614972 - DNA, 16 bp, Homo sapiens
gagcatctgctctgag

SEQ ID NO: 5614973 - DNA, 16 bp, Homo sapiens
gagcatctggctgttt

SEQ ID NO: 5614974 - DNA, 20 bp, Homo sapiens
gagcatctgtttacctggca

SEQ ID NO: 5614975 - DNA, 16 bp, Homo sapiens
gagcatcttgccagcc

SEQ ID NO: 5614976 - DNA, 21 bp, Homo sapiens
gagcatgaaactatgcaccta

SEQ ID NO: 5614977 - DNA, 15 bp, Homo sapiens
gagcatgaagataaa

SEQ ID NO: 5614978 - DNA, 14 bp, Homo sapiens
gagcatgagaggag

SEQ ID NO: 5614979 - DNA, 23 bp, Homo sapiens
gagcatgagaggaggcagcagga

SEQ ID NO: 5614980 - DNA, 15 bp, Homo sapiens
gagcatgagccagct

SEQ ID NO: 5614981 - DNA, 17 bp, Homo sapiens
gagcatgagccagctct

SEQ ID NO: 5614982 - DNA, 13 bp, Homo sapiens
gagcatgatttga

SEQ ID NO: 5614983 - DNA, 15 bp, Homo sapiens
gagcatgcacactga

SEQ ID NO: 5614984 - DNA, 19 bp, Homo sapiens
gagcatgcacagctgcttg

SEQ ID NO: 5614985 - DNA, 20 bp, Homo sapiens
gagcatgcacagctgcttgt

SEQ ID NO: 5614986 - DNA, 16 bp, Homo sapiens
gagcatgcacatgctg

SEQ ID NO: 5614987 - DNA, 19 bp, Homo sapiens
gagcatgcattttcttgta

SEQ ID NO: 5614988 - DNA, 22 bp, Homo sapiens
gagcatgcattttcttgtatga

SEQ ID NO: 5614989 - DNA, 21 bp, Homo sapiens
gagcatgcccaaatataacat

SEQ ID NO: 5614990 - DNA, 22 bp, Homo sapiens
gagcatgccctgagctctctga

SEQ ID NO: 5614991 - DNA, 17 bp, Homo sapiens
gagcatgcggagccagc

SEQ ID NO: 5614992 - DNA, 18 bp, Homo sapiens
gagcatgcggagccagca

SEQ ID NO: 5614993 - DNA, 20 bp, Homo sapiens
gagcatgcggagccagcagg

SEQ ID NO: 5614994 - DNA, 21 bp, Homo sapiens
gagcatgcggagccagcaggc

SEQ ID NO: 5614995 - DNA, 23 bp, Homo sapiens
gagcatgcttccctgcagctgac

SEQ ID NO: 5614996 - DNA, 19 bp, Homo sapiens
gagcatggaacacttcgag

SEQ ID NO: 5614997 - DNA, 15 bp, Homo sapiens
gagcatggagacagc

SEQ ID NO: 5614998 - DNA, 19 bp, Homo sapiens
gagcatggccagactattc

SEQ ID NO: 5614999 - DNA, 19 bp, Homo sapiens
gagcatggctgtgaggatg

SEQ ID NO: 5615000 - DNA, 17 bp, Homo sapiens
gagcatggggcgctccc

SEQ ID NO: 5615001 - DNA, 22 bp, Homo sapiens
gagcatggtacttggcctttgg

SEQ ID NO: 5615002 - DNA, 15 bp, Homo sapiens
gagcatgtaagtgtt

SEQ ID NO: 5615003 - DNA, 22 bp, Homo sapiens
gagcatgtactgagccttgtaa

SEQ ID NO: 5615004 - DNA, 18 bp, Homo sapiens
gagcatgtatgtctgcag

SEQ ID NO: 5615005 - DNA, 15 bp, Homo sapiens
gagcatgtcgtggac

SEQ ID NO: 5615006 - DNA, 18 bp, Homo sapiens
gagcatgtgggggaaggc

SEQ ID NO: 5615007 - DNA, 19 bp, Homo sapiens
gagcatgtgggggaaggcc

SEQ ID NO: 5615008 - DNA, 20 bp, Homo sapiens
gagcatgttttgtatacaaa

SEQ ID NO: 5615009 - DNA, 16 bp, Homo sapiens
gagcattaaaataact

SEQ ID NO: 5615010 - DNA, 21 bp, Homo sapiens
gagcattataatcaccagggc

SEQ ID NO: 5615011 - DNA, 20 bp, Homo sapiens
gagcattcaggcagcactga

SEQ ID NO: 5615012 - DNA, 19 bp, Homo sapiens
gagcattctgcctgcctgg

SEQ ID NO: 5615013 - DNA, 16 bp, Homo sapiens
gagcattctggggtgg

SEQ ID NO: 5615014 - DNA, 19 bp, Homo sapiens
gagcattgcagtcactttg

SEQ ID NO: 5615015 - DNA, 15 bp, Homo sapiens
gagcattggctgaga

SEQ ID NO: 5615016 - DNA, 16 bp, Homo sapiens
gagcatttatgtagac

SEQ ID NO: 5615017 - DNA, 22 bp, Homo sapiens
gagcatttatgtagacattgta

SEQ ID NO: 5615018 - DNA, 23 bp, Homo sapiens
gagcatttccaacaccacagaca

SEQ ID NO: 5615019 - DNA, 16 bp, Homo sapiens
gagcatttccctcccg

SEQ ID NO: 5615020 - DNA, 24 bp, Homo sapiens
gagcatttccctcccgggagagga

SEQ ID NO: 5615021 - DNA, 20 bp, Homo sapiens
gagcatttctcatcagtagt

SEQ ID NO: 5615022 - DNA, 18 bp, Homo sapiens
gagcatttgcacctctgt

SEQ ID NO: 5615023 - DNA, 16 bp, Homo sapiens
gagccaaaagaggggg

SEQ ID NO: 5615024 - DNA, 18 bp, Homo sapiens
gagccaaacacactgtaa

SEQ ID NO: 5615025 - DNA, 14 bp, Homo sapiens
gagccaaagccaga

SEQ ID NO: 5615026 - DNA, 20 bp, Homo sapiens
gagccaaattcatcctctta

SEQ ID NO: 5615027 - DNA, 20 bp, Homo sapiens
gagccaacagaagcttccat

SEQ ID NO: 5615028 - DNA, 16 bp, Homo sapiens
gagccaacctcggctt

SEQ ID NO: 5615029 - DNA, 23 bp, Homo sapiens
gagccaacctcggcttgtgggct

SEQ ID NO: 5615030 - DNA, 13 bp, Homo sapiens
gagccaacctgga

SEQ ID NO: 5615031 - DNA, 14 bp, Homo sapiens
gagccaacctggac

SEQ ID NO: 5615032 - DNA, 18 bp, Homo sapiens
gagccaacctggacttcc

SEQ ID NO: 5615033 - DNA, 19 bp, Homo sapiens
gagccaacctggacttcct

SEQ ID NO: 5615034 - DNA, 22 bp, Homo sapiens
gagccaacctggacttcctgtc

SEQ ID NO: 5615035 - DNA, 21 bp, Homo sapiens
gagccaactcactcttatgaa

SEQ ID NO: 5615036 - DNA, 23 bp, Homo sapiens
gagccaactcactcttatgaaat

SEQ ID NO: 5615037 - DNA, 15 bp, Homo sapiens
gagccaactctaaca

SEQ ID NO: 5615038 - DNA, 15 bp, Homo sapiens
gagccaagaaacact

SEQ ID NO: 5615039 - DNA, 15 bp, Homo sapiens
gagccaagacggagg

SEQ ID NO: 5615040 - DNA, 15 bp, Homo sapiens
gagccaagcactgct

SEQ ID NO: 5615041 - DNA, 14 bp, Homo sapiens
gagccaaggacagg

SEQ ID NO: 5615042 - DNA, 17 bp, Homo sapiens
gagccaaggaggcctgg

SEQ ID NO: 5615043 - DNA, 14 bp, Homo sapiens
gagccaaggcagag

SEQ ID NO: 5615044 - DNA, 13 bp, Homo sapiens
gagccaaggccac

SEQ ID NO: 5615045 - DNA, 13 bp, Homo sapiens
gagccaaggccta

SEQ ID NO: 5615046 - DNA, 13 bp, Homo sapiens
gagccaagggagg

SEQ ID NO: 5615047 - DNA, 18 bp, Homo sapiens
gagccaagggagggaagg

SEQ ID NO: 5615048 - DNA, 16 bp, Homo sapiens
gagccaagggatggac

SEQ ID NO: 5615049 - DNA, 19 bp, Homo sapiens
gagccaagggggcagaggg

SEQ ID NO: 5615050 - DNA, 17 bp, Homo sapiens
gagccaaggggtctgct

SEQ ID NO: 5615051 - DNA, 17 bp, Homo sapiens
gagccaagttcaaagaa

SEQ ID NO: 5615052 - DNA, 20 bp, Homo sapiens
gagccaatccactccttcct

SEQ ID NO: 5615053 - DNA, 14 bp, Homo sapiens
gagccaatggtgag

SEQ ID NO: 5615054 - DNA, 19 bp, Homo sapiens
gagccaatggtgagggctg

SEQ ID NO: 5615055 - DNA, 15 bp, Homo sapiens
gagccaattagactt

SEQ ID NO: 5615056 - DNA, 16 bp, Homo sapiens
gagccaattagacttg

SEQ ID NO: 5615057 - DNA, 19 bp, Homo sapiens
gagccaattagacttgaaa

SEQ ID NO: 5615058 - DNA, 17 bp, Homo sapiens
gagccacaagctgcact

SEQ ID NO: 5615059 - DNA, 18 bp, Homo sapiens
gagccacagaccacctgc

SEQ ID NO: 5615060 - DNA, 18 bp, Homo sapiens
gagccacagcactcggcc

SEQ ID NO: 5615061 - DNA, 14 bp, Homo sapiens
gagccacagcagca

SEQ ID NO: 5615062 - DNA, 17 bp, Homo sapiens
gagccacagcagcattt

SEQ ID NO: 5615063 - DNA, 20 bp, Homo sapiens
gagccacaggaacggccctg

SEQ ID NO: 5615064 - DNA, 14 bp, Homo sapiens
gagccacagggacg

SEQ ID NO: 5615065 - DNA, 12 bp, Homo sapiens
gagccacagggt

SEQ ID NO: 5615066 - DNA, 16 bp, Homo sapiens
gagccacatttacata

SEQ ID NO: 5615067 - DNA, 15 bp, Homo sapiens
gagccaccacaccca

SEQ ID NO: 5615068 - DNA, 19 bp, Homo sapiens
gagccaccacacctggcta

SEQ ID NO: 5615069 - DNA, 19 bp, Homo sapiens
gagccaccacgccctgcct

SEQ ID NO: 5615070 - DNA, 22 bp, Homo sapiens
gagccaccagggcactgtctgc

SEQ ID NO: 5615071 - DNA, 14 bp, Homo sapiens
gagccaccagttct

SEQ ID NO: 5615072 - DNA, 18 bp, Homo sapiens
gagccaccgcgcccagcc

SEQ ID NO: 5615073 - DNA, 19 bp, Homo sapiens
gagccaccgcgcctggccc

SEQ ID NO: 5615074 - DNA, 20 bp, Homo sapiens
gagccaccgtgcctggccac

SEQ ID NO: 5615075 - DNA, 12 bp, Homo sapiens
gagccacctcac

SEQ ID NO: 5615076 - DNA, 14 bp, Homo sapiens
gagccacctgcaag

SEQ ID NO: 5615077 - DNA, 19 bp, Homo sapiens
gagccacctgcaagatgga

SEQ ID NO: 5615078 - DNA, 14 bp, Homo sapiens
gagccacctggatc

SEQ ID NO: 5615079 - DNA, 17 bp, Homo sapiens
gagccacctggcagggc

SEQ ID NO: 5615080 - DNA, 24 bp, Homo sapiens
gagccacctggcagggctcacact

SEQ ID NO: 5615081 - DNA, 15 bp, Homo sapiens
gagccacctgggctg

SEQ ID NO: 5615082 - DNA, 15 bp, Homo sapiens
gagccacgctggcct

SEQ ID NO: 5615083 - DNA, 16 bp, Homo sapiens
gagccacgctggcctt

SEQ ID NO: 5615084 - DNA, 23 bp, Homo sapiens
gagccactacctttgtccaggcc

SEQ ID NO: 5615085 - DNA, 15 bp, Homo sapiens
gagccactcctgtcc

SEQ ID NO: 5615086 - DNA, 21 bp, Homo sapiens
gagccactcgcagtcgcagga

SEQ ID NO: 5615087 - DNA, 18 bp, Homo sapiens
gagccactctcttccctt

SEQ ID NO: 5615088 - DNA, 18 bp, Homo sapiens
gagccactcttcaagtag

SEQ ID NO: 5615089 - DNA, 21 bp, Homo sapiens
gagccactgcacctgcccagc

SEQ ID NO: 5615090 - DNA, 16 bp, Homo sapiens
gagccactgcactcca

SEQ ID NO: 5615091 - DNA, 12 bp, Homo sapiens
gagccactgcca

SEQ ID NO: 5615092 - DNA, 17 bp, Homo sapiens
gagccactgccactcca

SEQ ID NO: 5615093 - DNA, 14 bp, Homo sapiens
gagccactgcgccc

SEQ ID NO: 5615094 - DNA, 20 bp, Homo sapiens
gagccactgcgcccagcctg

SEQ ID NO: 5615095 - DNA, 14 bp, Homo sapiens
gagccactgggatt

SEQ ID NO: 5615096 - DNA, 12 bp, Homo sapiens
gagccactgggc

SEQ ID NO: 5615097 - DNA, 19 bp, Homo sapiens
gagccacttctccccagaa

SEQ ID NO: 5615098 - DNA, 18 bp, Homo sapiens
gagccagaaatgggcagt

SEQ ID NO: 5615099 - DNA, 19 bp, Homo sapiens
gagccagaaatgggcagtt

SEQ ID NO: 5615100 - DNA, 14 bp, Homo sapiens
gagccagacagacc

SEQ ID NO: 5615101 - DNA, 12 bp, Homo sapiens
gagccagagaag

SEQ ID NO: 5615102 - DNA, 18 bp, Homo sapiens
gagccagagaagtgacag

SEQ ID NO: 5615103 - DNA, 15 bp, Homo sapiens
gagccagagcctctg

SEQ ID NO: 5615104 - DNA, 11 bp, Homo sapiens
gagccagaggc

SEQ ID NO: 5615105 - DNA, 12 bp, Homo sapiens
gagccagaggca

SEQ ID NO: 5615106 - DNA, 12 bp, Homo sapiens
gagccagaggcc

SEQ ID NO: 5615107 - DNA, 17 bp, Homo sapiens
gagccagaggccaggat

SEQ ID NO: 5615108 - DNA, 21 bp, Homo sapiens
gagccagatgcaggacaggag

SEQ ID NO: 5615109 - DNA, 23 bp, Homo sapiens
gagccagatgcaggacaggaggc

SEQ ID NO: 5615110 - DNA, 19 bp, Homo sapiens
gagccagatgcctccccaa

SEQ ID NO: 5615111 - DNA, 18 bp, Homo sapiens
gagccagattaggcctgg

SEQ ID NO: 5615112 - DNA, 21 bp, Homo sapiens
gagccagattaggcctggagt

SEQ ID NO: 5615113 - DNA, 13 bp, Homo sapiens
gagccagatttca

SEQ ID NO: 5615114 - DNA, 15 bp, Homo sapiens
gagccagatttcact

SEQ ID NO: 5615115 - DNA, 19 bp, Homo sapiens
gagccagatttcactctcc

SEQ ID NO: 5615116 - DNA, 23 bp, Homo sapiens
gagccagatttcactctccttgg

SEQ ID NO: 5615117 - DNA, 18 bp, Homo sapiens
gagccagcaagaggaagg

SEQ ID NO: 5615118 - DNA, 15 bp, Homo sapiens
gagccagcagacatt

SEQ ID NO: 5615119 - DNA, 13 bp, Homo sapiens
gagccagcagctg

SEQ ID NO: 5615120 - DNA, 19 bp, Homo sapiens
gagccagcagctgaagtct

SEQ ID NO: 5615121 - DNA, 23 bp, Homo sapiens
gagccagcagggcgggccaggag

SEQ ID NO: 5615122 - DNA, 14 bp, Homo sapiens
gagccagcagggct

SEQ ID NO: 5615123 - DNA, 12 bp, Homo sapiens
gagccagcagtg

SEQ ID NO: 5615124 - DNA, 12 bp, Homo sapiens
gagccagccctc

SEQ ID NO: 5615125 - DNA, 13 bp, Homo sapiens
gagccagccctcc

SEQ ID NO: 5615126 - DNA, 20 bp, Homo sapiens
gagccagccgagcaggaggc

SEQ ID NO: 5615127 - DNA, 21 bp, Homo sapiens
gagccagccgagcaggaggcc

SEQ ID NO: 5615128 - DNA, 18 bp, Homo sapiens
gagccggtaactgtcctg

SEQ ID NO: 5615129 - DNA, 19 bp, Homo sapiens
gagccggtaactgtcctgt

SEQ ID NO: 5615130 - DNA, 16 bp, Homo sapiens
gagccggtggtgcccg

SEQ ID NO: 5615131 - DNA, 20 bp, Homo sapiens
gagccggtttgggagagacc

SEQ ID NO: 5615132 - DNA, 15 bp, Homo sapiens
gagccgtcagcctgt

SEQ ID NO: 5615133 - DNA, 17 bp, Homo sapiens
gagccgtgaactgtgca

SEQ ID NO: 5615134 - DNA, 18 bp, Homo sapiens
gagccgtgaactgtgcat

SEQ ID NO: 5615135 - DNA, 15 bp, Homo sapiens
gagccgtgcagctgg

SEQ ID NO: 5615136 - DNA, 15 bp, Homo sapiens
gagccgtggccgagg

SEQ ID NO: 5615137 - DNA, 20 bp, Homo sapiens
gagccgtggtccctgaggat

SEQ ID NO: 5615138 - DNA, 23 bp, Homo sapiens
gagccgttcctgggactgtcaga

SEQ ID NO: 5615139 - DNA, 19 bp, Homo sapiens
gagcctaaaaataaagcac

SEQ ID NO: 5615140 - DNA, 19 bp, Homo sapiens
gagcctacagaagggcagt

SEQ ID NO: 5615141 - DNA, 17 bp, Homo sapiens
gagcctacctctgtctg

SEQ ID NO: 5615142 - DNA, 15 bp, Homo sapiens
gagcctactgtctcc

SEQ ID NO: 5615143 - DNA, 20 bp, Homo sapiens
gagcctactgtctccttccc

SEQ ID NO: 5615144 - DNA, 21 bp, Homo sapiens
gagcctactgtctccttccca

SEQ ID NO: 5615145 - DNA, 14 bp, Homo sapiens
gagcctagccacct

SEQ ID NO: 5615146 - DNA, 15 bp, Homo sapiens
gagcctagccacctc

SEQ ID NO: 5615147 - DNA, 17 bp, Homo sapiens
gagcctagccacctccc

SEQ ID NO: 5615148 - DNA, 18 bp, Homo sapiens
gagcctagccacctccca

SEQ ID NO: 5615149 - DNA, 19 bp, Homo sapiens
gagcctagcggagcccagc

SEQ ID NO: 5615150 - DNA, 22 bp, Homo sapiens
gagcctaggaccactcagcccc

SEQ ID NO: 5615151 - DNA, 21 bp, Homo sapiens
gagcctagtttttaatagcta

SEQ ID NO: 5615152 - DNA, 11 bp, Homo sapiens
gagcctatgat

SEQ ID NO: 5615153 - DNA, 23 bp, Homo sapiens
gagcctatggaaagggtgtggct

SEQ ID NO: 5615154 - DNA, 16 bp, Homo sapiens
gagcctcaaccttctg

SEQ ID NO: 5615155 - DNA, 16 bp, Homo sapiens
gagcctcaatttcctc

SEQ ID NO: 5615156 - DNA, 13 bp, Homo sapiens
gagcctcacagca

SEQ ID NO: 5615157 - DNA, 14 bp, Homo sapiens
gagcctcacagcag

SEQ ID NO: 5615158 - DNA, 22 bp, Homo sapiens
gagcctcagaccccaggtcagc

SEQ ID NO: 5615159 - DNA, 19 bp, Homo sapiens
gagcctcagcatcctggca

SEQ ID NO: 5615160 - DNA, 18 bp, Homo sapiens
gagcctcagtctccctcc

SEQ ID NO: 5615161 - DNA, 19 bp, Homo sapiens
gagcctcatccagcctcag

SEQ ID NO: 5615162 - DNA, 20 bp, Homo sapiens
gagcctcatccagcctcaga

SEQ ID NO: 5615163 - DNA, 14 bp, Homo sapiens
gagcctccacttag

SEQ ID NO: 5615164 - DNA, 17 bp, Homo sapiens
gagcctccaggttcctc

SEQ ID NO: 5615165 - DNA, 15 bp, Homo sapiens
gagcctccatttctg

SEQ ID NO: 5615166 - DNA, 20 bp, Homo sapiens
gagcctcccaaggagaacaa

SEQ ID NO: 5615167 - DNA, 18 bp, Homo sapiens
gagcctcccaccagagcc

SEQ ID NO: 5615168 - DNA, 19 bp, Homo sapiens
gagcctcccaccagagccg

SEQ ID NO: 5615169 - DNA, 20 bp, Homo sapiens
gagcctccccatctgtccag

SEQ ID NO: 5615170 - DNA, 12 bp, Homo sapiens
gagcctccccct

SEQ ID NO: 5615171 - DNA, 15 bp, Homo sapiens
gagcctccccctcag

SEQ ID NO: 5615172 - DNA, 20 bp, Homo sapiens
gagcctccctcaattccccc

SEQ ID NO: 5615173 - DNA, 13 bp, Homo sapiens
gagcctccctcag

SEQ ID NO: 5615174 - DNA, 17 bp, Homo sapiens
gagcctccctgcagcca

SEQ ID NO: 5615175 - DNA, 16 bp, Homo sapiens
gagcctcctcaggggg

SEQ ID NO: 5615176 - DNA, 22 bp, Homo sapiens
gagcctcctctctcaaactggg

SEQ ID NO: 5615177 - DNA, 17 bp, Homo sapiens
gagcctcctgaccctgt

SEQ ID NO: 5615178 - DNA, 19 bp, Homo sapiens
gagcctcctgcccagtccc

SEQ ID NO: 5615179 - DNA, 22 bp, Homo sapiens
gagcctcctgcccttacctgcc

SEQ ID NO: 5615180 - DNA, 12 bp, Homo sapiens
gagcctcctggg

SEQ ID NO: 5615181 - DNA, 19 bp, Homo sapiens
gagcctcctgtgcctggcc

SEQ ID NO: 5615182 - DNA, 23 bp, Homo sapiens
gagcctcctgtgcctggccccag

SEQ ID NO: 5615183 - DNA, 23 bp, Homo sapiens
gagcctcgcaacccgtgccaagt

SEQ ID NO: 5615184 - DNA, 16 bp, Homo sapiens
gagcctcgctttttca

SEQ ID NO: 5615185 - DNA, 21 bp, Homo sapiens
gagcctcgctttttcatcctt

SEQ ID NO: 5615186 - DNA, 17 bp, Homo sapiens
gagcctcggtggccatg

SEQ ID NO: 5615187 - DNA, 19 bp, Homo sapiens
gagcctcgtccaaggcagt

SEQ ID NO: 5615188 - DNA, 23 bp, Homo sapiens
gagcctcgtccaaggcagttctg

SEQ ID NO: 5615189 - DNA, 16 bp, Homo sapiens
gagcctcgtccctccc

SEQ ID NO: 5615190 - DNA, 20 bp, Homo sapiens
gagcctcgtgtccagactca

SEQ ID NO: 5615191 - DNA, 15 bp, Homo sapiens
gagcctctgatcaaa

SEQ ID NO: 5615192 - DNA, 14 bp, Homo sapiens
gagcctctgcagac

SEQ ID NO: 5615193 - DNA, 13 bp, Homo sapiens
gagcctctgcgcc

SEQ ID NO: 5615194 - DNA, 23 bp, Homo sapiens
gagcctctgctggaaggggcagc

SEQ ID NO: 5615195 - DNA, 13 bp, Homo sapiens
gagcctctggaag

SEQ ID NO: 5615196 - DNA, 13 bp, Homo sapiens
gagcctctggccc

SEQ ID NO: 5615197 - DNA, 12 bp, Homo sapiens
gagcctctggct

SEQ ID NO: 5615198 - DNA, 15 bp, Homo sapiens
gagcctctggcttcc

SEQ ID NO: 5615199 - DNA, 12 bp, Homo sapiens
gagcctctgggg

SEQ ID NO: 5615200 - DNA, 18 bp, Homo sapiens
gagcctctgtcactgcag

SEQ ID NO: 5615201 - DNA, 21 bp, Homo sapiens
gagcctctgtcactgcaggca

SEQ ID NO: 5615202 - DNA, 13 bp, Homo sapiens
gagcctcttgggg

SEQ ID NO: 5615203 - DNA, 19 bp, Homo sapiens
gagcctgaactgagcccca

SEQ ID NO: 5615204 - DNA, 18 bp, Homo sapiens
gagcctgaagctggcctg

SEQ ID NO: 5615205 - DNA, 19 bp, Homo sapiens
gagcctgaattttgttgct

SEQ ID NO: 5615206 - DNA, 19 bp, Homo sapiens
gagcctgacagccagaact

SEQ ID NO: 5615207 - DNA, 17 bp, Homo sapiens
gagcctgactgccagga

SEQ ID NO: 5615208 - DNA, 20 bp, Homo sapiens
gagcctgactgtgttcagtg

SEQ ID NO: 5615209 - DNA, 10 bp, Homo sapiens
gagcctgagg

SEQ ID NO: 5615210 - DNA, 12 bp, Homo sapiens
gagcctgaggga

SEQ ID NO: 5615211 - DNA, 15 bp, Homo sapiens
gagcctgagtcaggg

SEQ ID NO: 5615212 - DNA, 17 bp, Homo sapiens
gagcctgagtcagggcc

SEQ ID NO: 5615213 - DNA, 21 bp, Homo sapiens
gagcctgagtcagggcccaga

SEQ ID NO: 5615214 - DNA, 22 bp, Homo sapiens
gagcctgagtcagggcccagag

SEQ ID NO: 5615215 - DNA, 15 bp, Homo sapiens
gagcctgatctcttc

SEQ ID NO: 5615216 - DNA, 16 bp, Homo sapiens
gagcctgattttttga

SEQ ID NO: 5615217 - DNA, 22 bp, Homo sapiens
gagcctgcacggtgaatggctt

SEQ ID NO: 5615218 - DNA, 13 bp, Homo sapiens
gagcctgcaggca

SEQ ID NO: 5615219 - DNA, 13 bp, Homo sapiens
gagcctgcaggga

SEQ ID NO: 5615220 - DNA, 15 bp, Homo sapiens
gagcctgcagggtgg

SEQ ID NO: 5615221 - DNA, 22 bp, Homo sapiens
gagcctgcagggtggtgctggg

SEQ ID NO: 5615222 - DNA, 23 bp, Homo sapiens
gagcctgcagggtggtgctggga

SEQ ID NO: 5615223 - DNA, 12 bp, Homo sapiens
gagcctgcagtt

SEQ ID NO: 5615224 - DNA, 15 bp, Homo sapiens
gagcctgcagttatt

SEQ ID NO: 5615225 - DNA, 19 bp, Homo sapiens
gagcctgccaaagtgcctg

SEQ ID NO: 5615226 - DNA, 16 bp, Homo sapiens
gagcctgccccagctg

SEQ ID NO: 5615227 - DNA, 16 bp, Homo sapiens
gagcctgccctcactc

SEQ ID NO: 5615228 - DNA, 14 bp, Homo sapiens
gagcctgccgagca

SEQ ID NO: 5615229 - DNA, 22 bp, Homo sapiens
gagcctgccgagcaaccgtggc

SEQ ID NO: 5615230 - DNA, 18 bp, Homo sapiens
gagcctgccgcccccgcc

SEQ ID NO: 5615231 - DNA, 12 bp, Homo sapiens
gagcctgcctaa

SEQ ID NO: 5615232 - DNA, 20 bp, Homo sapiens
gagcctgcctaaccaggccc

SEQ ID NO: 5615233 - DNA, 17 bp, Homo sapiens
gagcctgcctcagctgc

SEQ ID NO: 5615234 - DNA, 14 bp, Homo sapiens
gagcctgcctggag

SEQ ID NO: 5615235 - DNA, 15 bp, Homo sapiens
gagcctgcctggagc

SEQ ID NO: 5615236 - DNA, 16 bp, Homo sapiens
gagcctgcgtggcctg

SEQ ID NO: 5615237 - DNA, 13 bp, Homo sapiens
gagcctgctaagg

SEQ ID NO: 5615238 - DNA, 14 bp, Homo sapiens
gagcctgctaagga

SEQ ID NO: 5615239 - DNA, 19 bp, Homo sapiens
gagcctgctcccccacccc

SEQ ID NO: 5615240 - DNA, 19 bp, Homo sapiens
gagcctggagcccctgtgt

SEQ ID NO: 5615241 - DNA, 21 bp, Homo sapiens
gagcctggcaggtcccctgcc

SEQ ID NO: 5615242 - DNA, 18 bp, Homo sapiens
gagcctggccaacatggt

SEQ ID NO: 5615243 - DNA, 15 bp, Homo sapiens
gagcctggccagcct

SEQ ID NO: 5615244 - DNA, 16 bp, Homo sapiens
gagcctggccaggcag

SEQ ID NO: 5615245 - DNA, 17 bp, Homo sapiens
gagcctggccaggcagg

SEQ ID NO: 5615246 - DNA, 19 bp, Homo sapiens
gagcctggccaggcaggga

SEQ ID NO: 5615247 - DNA, 20 bp, Homo sapiens
gagcctggccaggcagggag

SEQ ID NO: 5615248 - DNA, 18 bp, Homo sapiens
gagcctggccatgtcctc

SEQ ID NO: 5615249 - DNA, 18 bp, Homo sapiens
gagcctggcccatagaaa

SEQ ID NO: 5615250 - DNA, 12 bp, Homo sapiens
gagcctggcccc

SEQ ID NO: 5615251 - DNA, 15 bp, Homo sapiens
gagcctggcgtctgg

SEQ ID NO: 5615252 - DNA, 22 bp, Homo sapiens
gagcctggcgtctggacgccga

SEQ ID NO: 5615253 - DNA, 23 bp, Homo sapiens
gagcctggctccgtccaggagcc

SEQ ID NO: 5615254 - DNA, 23 bp, Homo sapiens
gagcctggctcttgtgctggatg

SEQ ID NO: 5615255 - DNA, 13 bp, Homo sapiens
gagcctgggaggt

SEQ ID NO: 5615256 - DNA, 21 bp, Homo sapiens
gagcctgggaggtcaaggctg

SEQ ID NO: 5615257 - DNA, 21 bp, Homo sapiens
gagcctgggatttctatgcag

SEQ ID NO: 5615258 - DNA, 11 bp, Homo sapiens
gagcctggggg

SEQ ID NO: 5615259 - DNA, 17 bp, Homo sapiens
gagcctgggggctcctc

SEQ ID NO: 5615260 - DNA, 15 bp, Homo sapiens
gagcctgtcaccaga

SEQ ID NO: 5615261 - DNA, 19 bp, Homo sapiens
gagcctgtcaccagagctt

SEQ ID NO: 5615262 - DNA, 24 bp, Homo sapiens
gagcctgtcaccagagcttctctg

SEQ ID NO: 5615263 - DNA, 18 bp, Homo sapiens
gagcctgtcacgtggtca

SEQ ID NO: 5615264 - DNA, 16 bp, Homo sapiens
gagcctgtccccgcct

SEQ ID NO: 5615265 - DNA, 11 bp, Homo sapiens
gagcctgtcct

SEQ ID NO: 5615266 - DNA, 15 bp, Homo sapiens
gagcctgtcctgcct

SEQ ID NO: 5615267 - DNA, 19 bp, Homo sapiens
gagcctgtcctgcctgtgg

SEQ ID NO: 5615268 - DNA, 19 bp, Homo sapiens
gagcctgtctttcagcatt

SEQ ID NO: 5615269 - DNA, 17 bp, Homo sapiens
gagcctgtgaacccagg

SEQ ID NO: 5615270 - DNA, 19 bp, Homo sapiens
gagcctgtgaacccaggac

SEQ ID NO: 5615271 - DNA, 17 bp, Homo sapiens
gagcctgtgaccttggg

SEQ ID NO: 5615272 - DNA, 18 bp, Homo sapiens
gagcctgtgaccttggga

SEQ ID NO: 5615273 - DNA, 15 bp, Homo sapiens
gagcctgtgcagcct

SEQ ID NO: 5615274 - DNA, 19 bp, Homo sapiens
gagcctgtgcctcctcacc

SEQ ID NO: 5615275 - DNA, 13 bp, Homo sapiens
gagcctgtgcctt

SEQ ID NO: 5615276 - DNA, 18 bp, Homo sapiens
gagcctgtgccttcctcc

SEQ ID NO: 5615277 - DNA, 16 bp, Homo sapiens
gagcctgtggccagca

SEQ ID NO: 5615278 - DNA, 23 bp, Homo sapiens
gagcctgtggccagcagccccca

SEQ ID NO: 5615279 - DNA, 17 bp, Homo sapiens
gagcctgtgtaacagct

SEQ ID NO: 5615280 - DNA, 21 bp, Homo sapiens
gagcctgtgtaacagctcctt

SEQ ID NO: 5615281 - DNA, 20 bp, Homo sapiens
gagcctgtgttagtgtctgt

SEQ ID NO: 5615282 - DNA, 15 bp, Homo sapiens
gagcctgtttttgtg

SEQ ID NO: 5615283 - DNA, 14 bp, Homo sapiens
gagccttaaaacat

SEQ ID NO: 5615284 - DNA, 22 bp, Homo sapiens
gagccttaccaagactcctgca

SEQ ID NO: 5615285 - DNA, 21 bp, Homo sapiens
gagccttacttcaaagtgcct

SEQ ID NO: 5615286 - DNA, 19 bp, Homo sapiens
gagccttagccgcccatgc

SEQ ID NO: 5615287 - DNA, 16 bp, Homo sapiens
gagccttagctcccag

SEQ ID NO: 5615288 - DNA, 19 bp, Homo sapiens
gagccttagtttcagctga

SEQ ID NO: 5615289 - DNA, 14 bp, Homo sapiens
gagccttcaagtgc

SEQ ID NO: 5615290 - DNA, 12 bp, Homo sapiens
gagccttcagca

SEQ ID NO: 5615291 - DNA, 13 bp, Homo sapiens
gagccttcagcct

SEQ ID NO: 5615292 - DNA, 18 bp, Homo sapiens
gagccttcaggccagctg

SEQ ID NO: 5615293 - DNA, 12 bp, Homo sapiens
gagccttccacc

SEQ ID NO: 5615294 - DNA, 15 bp, Homo sapiens
gagccttccacccag

SEQ ID NO: 5615295 - DNA, 18 bp, Homo sapiens
gagccttccaccggcact

SEQ ID NO: 5615296 - DNA, 15 bp, Homo sapiens
gagccttccaggggt

SEQ ID NO: 5615297 - DNA, 20 bp, Homo sapiens
gagccttccaggggtgggac

SEQ ID NO: 5615298 - DNA, 16 bp, Homo sapiens
gagccttcctttctcc

SEQ ID NO: 5615299 - DNA, 23 bp, Homo sapiens
gagccttcctttctcctgcccca

SEQ ID NO: 5615300 - DNA, 13 bp, Homo sapiens
gagccttctcaga

SEQ ID NO: 5615301 - DNA, 18 bp, Homo sapiens
gagccttctcctgcctac

SEQ ID NO: 5615302 - DNA, 22 bp, Homo sapiens
gagccttctgaggacattccaa

SEQ ID NO: 5615303 - DNA, 21 bp, Homo sapiens
gagccttgataatacttgacc

SEQ ID NO: 5615304 - DNA, 14 bp, Homo sapiens
gagccttgcatgta

SEQ ID NO: 5615305 - DNA, 19 bp, Homo sapiens
gagccttgcatgtacttga

SEQ ID NO: 5615306 - DNA, 19 bp, Homo sapiens
gagctgccactgggcacct

SEQ ID NO: 5615307 - DNA, 22 bp, Homo sapiens
gagctgccactgggcacctgcg

SEQ ID NO: 5615308 - DNA, 12 bp, Homo sapiens
gagctgccagcc

SEQ ID NO: 5615309 - DNA, 11 bp, Homo sapiens
gagctgccagt

SEQ ID NO: 5615310 - DNA, 20 bp, Homo sapiens
gagctgccatccagggatgc

SEQ ID NO: 5615311 - DNA, 17 bp, Homo sapiens
gagctgcccacagcagg

SEQ ID NO: 5615312 - DNA, 18 bp, Homo sapiens
gagctgcccctctctggg

SEQ ID NO: 5615313 - DNA, 19 bp, Homo sapiens
gagctgcccggcgcctgcc

SEQ ID NO: 5615314 - DNA, 20 bp, Homo sapiens
gagctgcccggcgcctgccc

SEQ ID NO: 5615315 - DNA, 15 bp, Homo sapiens
gagctgccctccttg

SEQ ID NO: 5615316 - DNA, 16 bp, Homo sapiens
gagctgccctctcctg

SEQ ID NO: 5615317 - DNA, 19 bp, Homo sapiens
gagctgccctctcctgggc

SEQ ID NO: 5615318 - DNA, 18 bp, Homo sapiens
gagctgccgcaaggccct

SEQ ID NO: 5615319 - DNA, 19 bp, Homo sapiens
gagctgcctaagaggcaat

SEQ ID NO: 5615320 - DNA, 23 bp, Homo sapiens
gagctgcctatgcccagcctcca

SEQ ID NO: 5615321 - DNA, 19 bp, Homo sapiens
gagctgcctccagcctggt

SEQ ID NO: 5615322 - DNA, 20 bp, Homo sapiens
gagctgcctccccaatccat

SEQ ID NO: 5615323 - DNA, 13 bp, Homo sapiens
gagctgcctgcag

SEQ ID NO: 5615324 - DNA, 22 bp, Homo sapiens
gagctgcctgcttggcccggcc

SEQ ID NO: 5615325 - DNA, 15 bp, Homo sapiens
gagctgcctggaccc

SEQ ID NO: 5615326 - DNA, 16 bp, Homo sapiens
gagctgcctggacccg

SEQ ID NO: 5615327 - DNA, 23 bp, Homo sapiens
gagctgcctggatgagaaacagc

SEQ ID NO: 5615328 - DNA, 19 bp, Homo sapiens
gagctgcctgttcagctcc

SEQ ID NO: 5615329 - DNA, 21 bp, Homo sapiens
gagctgcctgttcagctccag

SEQ ID NO: 5615330 - DNA, 23 bp, Homo sapiens
gagctgccttccctagctttaga

SEQ ID NO: 5615331 - DNA, 15 bp, Homo sapiens
gagctgccttggctc

SEQ ID NO: 5615332 - DNA, 15 bp, Homo sapiens
gagctgcgccggaca

SEQ ID NO: 5615333 - DNA, 13 bp, Homo sapiens
gagctgcgggctg

SEQ ID NO: 5615334 - DNA, 15 bp, Homo sapiens
gagctgctaaaataa

SEQ ID NO: 5615335 - DNA, 23 bp, Homo sapiens
gagctgctaaaataaacctgttt

SEQ ID NO: 5615336 - DNA, 20 bp, Homo sapiens
gagctgctaagctaaagaaa

SEQ ID NO: 5615337 - DNA, 18 bp, Homo sapiens
gagctgctatagcctggg

SEQ ID NO: 5615338 - DNA, 20 bp, Homo sapiens
gagctgctatagcctggggt

SEQ ID NO: 5615339 - DNA, 21 bp, Homo sapiens
gagctgctatagcctggggtg

SEQ ID NO: 5615340 - DNA, 18 bp, Homo sapiens
gagctgctcaccggagtc

SEQ ID NO: 5615341 - DNA, 12 bp, Homo sapiens
gagctgctcaga

SEQ ID NO: 5615342 - DNA, 24 bp, Homo sapiens
gagctgctctgaattagtccttgc

SEQ ID NO: 5615343 - DNA, 14 bp, Homo sapiens
gagctgctctgcta

SEQ ID NO: 5615344 - DNA, 22 bp, Homo sapiens
gagctgctgagtgacagctttc

SEQ ID NO: 5615345 - DNA, 15 bp, Homo sapiens
gagctgctgcatgag

SEQ ID NO: 5615346 - DNA, 15 bp, Homo sapiens
gagctgctggccatg

SEQ ID NO: 5615347 - DNA, 15 bp, Homo sapiens
gagctgctgtatttg

SEQ ID NO: 5615348 - DNA, 12 bp, Homo sapiens
gagctgctgtgc

SEQ ID NO: 5615349 - DNA, 18 bp, Homo sapiens
gagctgcttcactaggga

SEQ ID NO: 5615350 - DNA, 16 bp, Homo sapiens
gagctgctttgtgggc

SEQ ID NO: 5615351 - DNA, 16 bp, Homo sapiens
gagctgctttttttga

SEQ ID NO: 5615352 - DNA, 22 bp, Homo sapiens
gagctggaaaggatgcttctgc

SEQ ID NO: 5615353 - DNA, 12 bp, Homo sapiens
gagctggaaata

SEQ ID NO: 5615354 - DNA, 14 bp, Homo sapiens
gagctggaaggcag

SEQ ID NO: 5615355 - DNA, 18 bp, Homo sapiens
gagctggaaggcagggca

SEQ ID NO: 5615356 - DNA, 21 bp, Homo sapiens
gagctggaaggcagggcagag

SEQ ID NO: 5615357 - DNA, 13 bp, Homo sapiens
gagctggaagggg

SEQ ID NO: 5615358 - DNA, 16 bp, Homo sapiens
gagctggactccctca

SEQ ID NO: 5615359 - DNA, 18 bp, Homo sapiens
gagctggagcccccagca

SEQ ID NO: 5615360 - DNA, 20 bp, Homo sapiens
gagctggagcctggtgccct

SEQ ID NO: 5615361 - DNA, 11 bp, Homo sapiens
gagctggagct

SEQ ID NO: 5615362 - DNA, 18 bp, Homo sapiens
gagctggagctaaggcca

SEQ ID NO: 5615363 - DNA, 12 bp, Homo sapiens
gagctggaggaa

SEQ ID NO: 5615364 - DNA, 15 bp, Homo sapiens
gagctggaggggtgg

SEQ ID NO: 5615365 - DNA, 17 bp, Homo sapiens
gagctggaggggtgggg

SEQ ID NO: 5615366 - DNA, 19 bp, Homo sapiens
gagctggaggggtggggag

SEQ ID NO: 5615367 - DNA, 19 bp, Homo sapiens
gagctggagtctgggctcc

SEQ ID NO: 5615368 - DNA, 18 bp, Homo sapiens
gagctggatagacttggg

SEQ ID NO: 5615369 - DNA, 15 bp, Homo sapiens
gagctggcaaccagc

SEQ ID NO: 5615370 - DNA, 18 bp, Homo sapiens
gagctggcaccattcaga

SEQ ID NO: 5615371 - DNA, 20 bp, Homo sapiens
gagctggccaaagagccttt

SEQ ID NO: 5615372 - DNA, 21 bp, Homo sapiens
gagctggccaggccctgagag

SEQ ID NO: 5615373 - DNA, 15 bp, Homo sapiens
gagctggcccagggg

SEQ ID NO: 5615374 - DNA, 21 bp, Homo sapiens
gagctggcccagggggcctgg

SEQ ID NO: 5615375 - DNA, 17 bp, Homo sapiens
gagctggccccgccgcc

SEQ ID NO: 5615376 - DNA, 23 bp, Homo sapiens
gagctggccgcgccaaataatgt

SEQ ID NO: 5615377 - DNA, 17 bp, Homo sapiens
gagctggccgtgggcct

SEQ ID NO: 5615378 - DNA, 20 bp, Homo sapiens
gagctggcctaggtgggagc

SEQ ID NO: 5615379 - DNA, 14 bp, Homo sapiens
gagctggcctgtgg

SEQ ID NO: 5615380 - DNA, 16 bp, Homo sapiens
gagctggcctgtggca

SEQ ID NO: 5615381 - DNA, 23 bp, Homo sapiens
gagctggctctataaggcagcct

SEQ ID NO: 5615382 - DNA, 14 bp, Homo sapiens
gagctggctggcag

SEQ ID NO: 5615383 - DNA, 17 bp, Homo sapiens
gagctggctggcaggtg

SEQ ID NO: 5615384 - DNA, 18 bp, Homo sapiens
gagctggctgtgcctgct

SEQ ID NO: 5615385 - DNA, 19 bp, Homo sapiens
gagctggctgtgcctgctt

SEQ ID NO: 5615386 - DNA, 14 bp, Homo sapiens
gagctgggaaacag

SEQ ID NO: 5615387 - DNA, 13 bp, Homo sapiens
gagctgggagaca

SEQ ID NO: 5615388 - DNA, 14 bp, Homo sapiens
gagctgggagaccc

SEQ ID NO: 5615389 - DNA, 14 bp, Homo sapiens
gagctgggagccag

SEQ ID NO: 5615390 - DNA, 16 bp, Homo sapiens
gagctgggagccgggc

SEQ ID NO: 5615391 - DNA, 21 bp, Homo sapiens
gagctgggaggagaggtccac

SEQ ID NO: 5615392 - DNA, 21 bp, Homo sapiens
gagctgggaggtagaagggga

SEQ ID NO: 5615393 - DNA, 15 bp, Homo sapiens
gagctgggaggtctc

SEQ ID NO: 5615394 - DNA, 21 bp, Homo sapiens
gagctgggatcccacagccct

SEQ ID NO: 5615395 - DNA, 16 bp, Homo sapiens
gagctgggcagacagg

SEQ ID NO: 5615396 - DNA, 22 bp, Homo sapiens
gagctgggcagacaggtgggag

SEQ ID NO: 5615397 - DNA, 12 bp, Homo sapiens
gagctgggccca

SEQ ID NO: 5615398 - DNA, 13 bp, Homo sapiens
gagctgggcccag

SEQ ID NO: 5615399 - DNA, 16 bp, Homo sapiens
gagctgggcccagccc

SEQ ID NO: 5615400 - DNA, 15 bp, Homo sapiens
gagctgggcccctgc

SEQ ID NO: 5615401 - DNA, 22 bp, Homo sapiens
gagctgggcccctgcacaggca

SEQ ID NO: 5615402 - DNA, 23 bp, Homo sapiens
gagctgggcccgacatggctccg

SEQ ID NO: 5615403 - DNA, 19 bp, Homo sapiens
gagctgggccctgcctgca

SEQ ID NO: 5615404 - DNA, 20 bp, Homo sapiens
gagctggggagaatggggct

SEQ ID NO: 5615405 - DNA, 12 bp, Homo sapiens
gagctggggagg

SEQ ID NO: 5615406 - DNA, 13 bp, Homo sapiens
gagctggggaggt

SEQ ID NO: 5615407 - DNA, 18 bp, Homo sapiens
gagctggggaggtgggag

SEQ ID NO: 5615408 - DNA, 21 bp, Homo sapiens
gagctggggaggtgggaggcc

SEQ ID NO: 5615409 - DNA, 23 bp, Homo sapiens
gagctggggcctggagaggggcc

SEQ ID NO: 5615410 - DNA, 19 bp, Homo sapiens
gagctggggctgccagcct

SEQ ID NO: 5615411 - DNA, 17 bp, Homo sapiens
gagctggggcttctttc

SEQ ID NO: 5615412 - DNA, 20 bp, Homo sapiens
gagctgggggaaggcaggag

SEQ ID NO: 5615413 - DNA, 18 bp, Homo sapiens
gagctgggggccatgagc

SEQ ID NO: 5615414 - DNA, 15 bp, Homo sapiens
gagctggggtacagg

SEQ ID NO: 5615415 - DNA, 16 bp, Homo sapiens
gagctggggtctgggc

SEQ ID NO: 5615416 - DNA, 18 bp, Homo sapiens
gagctggggtctgggcag

SEQ ID NO: 5615417 - DNA, 21 bp, Homo sapiens
gagctggggtctgggcagtgc

SEQ ID NO: 5615418 - DNA, 23 bp, Homo sapiens
gagctggggtctgggcagtgcca

SEQ ID NO: 5615419 - DNA, 16 bp, Homo sapiens
gagctgggtaccaggc

SEQ ID NO: 5615420 - DNA, 18 bp, Homo sapiens
gagctgggtaccaggcca

SEQ ID NO: 5615421 - DNA, 22 bp, Homo sapiens
gagctgggtactgactgagata

SEQ ID NO: 5615422 - DNA, 18 bp, Homo sapiens
gagctggtgacagccttg

SEQ ID NO: 5615423 - DNA, 19 bp, Homo sapiens
gagctggtgccagatgtgg

SEQ ID NO: 5615424 - DNA, 15 bp, Homo sapiens
gagctggtggtttga

SEQ ID NO: 5615425 - DNA, 11 bp, Homo sapiens
gagctggtttc

SEQ ID NO: 5615426 - DNA, 21 bp, Homo sapiens
gagctgtataactgtgcagag

SEQ ID NO: 5615427 - DNA, 21 bp, Homo sapiens
gagctgtatcttgatgtttag

SEQ ID NO: 5615428 - DNA, 19 bp, Homo sapiens
gagctgtcacctctcagct

SEQ ID NO: 5615429 - DNA, 14 bp, Homo sapiens
gagctgtcaggcag

SEQ ID NO: 5615430 - DNA, 18 bp, Homo sapiens
gagctgtccggctggtgg

SEQ ID NO: 5615431 - DNA, 16 bp, Homo sapiens
gagctgtcctcctggc

SEQ ID NO: 5615432 - DNA, 18 bp, Homo sapiens
gagctgtcctcctggcac

SEQ ID NO: 5615433 - DNA, 20 bp, Homo sapiens
gagctgtcctcctggcacct

SEQ ID NO: 5615434 - DNA, 18 bp, Homo sapiens
gagctgtcggagggctgg

SEQ ID NO: 5615435 - DNA, 19 bp, Homo sapiens
gagctgtcggagggctgga

SEQ ID NO: 5615436 - DNA, 19 bp, Homo sapiens
gagctgtctatgcagcctg

SEQ ID NO: 5615437 - DNA, 20 bp, Homo sapiens
gagctgtctatgcagcctgc

SEQ ID NO: 5615438 - DNA, 14 bp, Homo sapiens
gagctgtctgactg

SEQ ID NO: 5615439 - DNA, 22 bp, Homo sapiens
gagctgtctgcggagccagcgc

SEQ ID NO: 5615440 - DNA, 14 bp, Homo sapiens
gagctgtctgtctc

SEQ ID NO: 5615441 - DNA, 15 bp, Homo sapiens
gagctgtctgtctct

SEQ ID NO: 5615442 - DNA, 15 bp, Homo sapiens
gagctgtcttcccct

SEQ ID NO: 5615443 - DNA, 17 bp, Homo sapiens
gagctgtcttcccctga

SEQ ID NO: 5615444 - DNA, 13 bp, Homo sapiens
gagctgtgccagc

SEQ ID NO: 5615445 - DNA, 15 bp, Homo sapiens
gagctgtgccagcag

SEQ ID NO: 5615446 - DNA, 18 bp, Homo sapiens
gagctgtgccagcagggg

SEQ ID NO: 5615447 - DNA, 16 bp, Homo sapiens
gagctgtgccagctgc

SEQ ID NO: 5615448 - DNA, 23 bp, Homo sapiens
gagctgtgccagctgcttctgcc

SEQ ID NO: 5615449 - DNA, 19 bp, Homo sapiens
gagctgtgcgctgctctgc

SEQ ID NO: 5615450 - DNA, 22 bp, Homo sapiens
gagctgtgctcgggtgctgcca

SEQ ID NO: 5615451 - DNA, 23 bp, Homo sapiens
gagctgtgctcgggtgctgccag

SEQ ID NO: 5615452 - DNA, 20 bp, Homo sapiens
gagctgtggactttgttcac

SEQ ID NO: 5615453 - DNA, 19 bp, Homo sapiens
gagctgtggaggattgcta

SEQ ID NO: 5615454 - DNA, 13 bp, Homo sapiens
gagctgtggctgg

SEQ ID NO: 5615455 - DNA, 22 bp, Homo sapiens
gagctgtgggcaaaagagtgta

SEQ ID NO: 5615456 - DNA, 19 bp, Homo sapiens
gagctgtgttcacagacct

SEQ ID NO: 5615457 - DNA, 21 bp, Homo sapiens
gagctgttatgctgtttccta

SEQ ID NO: 5615458 - DNA, 22 bp, Homo sapiens
gagctgttcaacatcactgaaa

SEQ ID NO: 5615459 - DNA, 17 bp, Homo sapiens
gagctgttcacagccag

SEQ ID NO: 5615460 - DNA, 14 bp, Homo sapiens
gagctgttcgctcc

SEQ ID NO: 5615461 - DNA, 16 bp, Homo sapiens
gagctgttcgctcctc

SEQ ID NO: 5615462 - DNA, 18 bp, Homo sapiens
gagctgttggcctcgcct

SEQ ID NO: 5615463 - DNA, 17 bp, Homo sapiens
gagctgttggcctgggt

SEQ ID NO: 5615464 - DNA, 16 bp, Homo sapiens
gagctgtttatggcct

SEQ ID NO: 5615465 - DNA, 16 bp, Homo sapiens
gagctgtttatgtttt

SEQ ID NO: 5615466 - DNA, 14 bp, Homo sapiens
gagctgtttcctca

SEQ ID NO: 5615467 - DNA, 21 bp, Homo sapiens
gagctgtttggatacagctgc

SEQ ID NO: 5615468 - DNA, 16 bp, Homo sapiens
gagcttaaaatacaag

SEQ ID NO: 5615469 - DNA, 15 bp, Homo sapiens
gagcttaaattgtca

SEQ ID NO: 5615470 - DNA, 14 bp, Homo sapiens
gagcttaatgtctt

SEQ ID NO: 5615471 - DNA, 22 bp, Homo sapiens
gagcttacattgaaaacagata

SEQ ID NO: 5615472 - DNA, 12 bp, Homo sapiens
gagcttagaaac

SEQ ID NO: 5615473 - DNA, 16 bp, Homo sapiens
gagcttagcatatctg

SEQ ID NO: 5615474 - DNA, 19 bp, Homo sapiens
gagcttagccttgtgccct

SEQ ID NO: 5615475 - DNA, 20 bp, Homo sapiens
gagcttagccttgtgccctg

SEQ ID NO: 5615476 - DNA, 22 bp, Homo sapiens
gagcttattcaatatttactga

SEQ ID NO: 5615477 - DNA, 18 bp, Homo sapiens
gagcttattggccactgg

SEQ ID NO: 5615478 - DNA, 18 bp, Homo sapiens
gagcttcagccaggtctg

SEQ ID NO: 5615479 - DNA, 13 bp, Homo sapiens
gagcttcagggct

SEQ ID NO: 5615480 - DNA, 19 bp, Homo sapiens
gagcttcatggcagaaggc

SEQ ID NO: 5615481 - DNA, 15 bp, Homo sapiens
gagcttcattgggag

SEQ ID NO: 5615482 - DNA, 14 bp, Homo sapiens
gagcttccaaatgt

SEQ ID NO: 5615483 - DNA, 15 bp, Homo sapiens
gaggagtggccctga

SEQ ID NO: 5615484 - DNA, 14 bp, Homo sapiens
gaggagtgggacag

SEQ ID NO: 5615485 - DNA, 15 bp, Homo sapiens
gaggagtgggacaga

SEQ ID NO: 5615486 - DNA, 19 bp, Homo sapiens
gaggagtgggacagacagc

SEQ ID NO: 5615487 - DNA, 14 bp, Homo sapiens
gaggagttcaatga

SEQ ID NO: 5615488 - DNA, 15 bp, Homo sapiens
gaggagttcaatgat

SEQ ID NO: 5615489 - DNA, 20 bp, Homo sapiens
gaggagtttcctaaaagttc

SEQ ID NO: 5615490 - DNA, 20 bp, Homo sapiens
gaggagtttcgaggtagagt

SEQ ID NO: 5615491 - DNA, 23 bp, Homo sapiens
gaggagtttggggtatgggagag

SEQ ID NO: 5615492 - DNA, 21 bp, Homo sapiens
gaggataaaaaggaaggagag

SEQ ID NO: 5615493 - DNA, 23 bp, Homo sapiens
gaggataacttccttgcccctgc

SEQ ID NO: 5615494 - DNA, 13 bp, Homo sapiens
gaggataactttt

SEQ ID NO: 5615495 - DNA, 13 bp, Homo sapiens
gaggatacaaatt

SEQ ID NO: 5615496 - DNA, 13 bp, Homo sapiens
gaggatacagagg

SEQ ID NO: 5615497 - DNA, 16 bp, Homo sapiens
gaggataccccaaagt

SEQ ID NO: 5615498 - DNA, 21 bp, Homo sapiens
gaggataccttccatctcaac

SEQ ID NO: 5615499 - DNA, 15 bp, Homo sapiens
gaggatagaaaaagg

SEQ ID NO: 5615500 - DNA, 15 bp, Homo sapiens
gaggataggacagag

SEQ ID NO: 5615501 - DNA, 18 bp, Homo sapiens
gaggatatattttcactt

SEQ ID NO: 5615502 - DNA, 16 bp, Homo sapiens
gaggatcagaaagtaa

SEQ ID NO: 5615503 - DNA, 14 bp, Homo sapiens
gaggatcagttttt

SEQ ID NO: 5615504 - DNA, 13 bp, Homo sapiens
gaggatccagggc

SEQ ID NO: 5615505 - DNA, 17 bp, Homo sapiens
gaggatccagggcagca

SEQ ID NO: 5615506 - DNA, 16 bp, Homo sapiens
gaggatcccctgaggt

SEQ ID NO: 5615507 - DNA, 18 bp, Homo sapiens
gaggatcccctgtcccct

SEQ ID NO: 5615508 - DNA, 21 bp, Homo sapiens
gaggatcccctgtcccctggg

SEQ ID NO: 5615509 - DNA, 21 bp, Homo sapiens
gaggatccctccatccggctc

SEQ ID NO: 5615510 - DNA, 16 bp, Homo sapiens
gaggatcctcacagga

SEQ ID NO: 5615511 - DNA, 20 bp, Homo sapiens
gaggatcctcacaggagcag

SEQ ID NO: 5615512 - DNA, 20 bp, Homo sapiens
gaggatcctggagaagtggg

SEQ ID NO: 5615513 - DNA, 22 bp, Homo sapiens
gaggatcctggtattgtaatat

SEQ ID NO: 5615514 - DNA, 20 bp, Homo sapiens
gaggatctattactgaccgt

SEQ ID NO: 5615515 - DNA, 19 bp, Homo sapiens
gaggatctcttgagcctgg

SEQ ID NO: 5615516 - DNA, 13 bp, Homo sapiens
gaggatctggaga

SEQ ID NO: 5615517 - DNA, 17 bp, Homo sapiens
gaggatgaacatctttt

SEQ ID NO: 5615518 - DNA, 16 bp, Homo sapiens
gaggatgaaggaaggg

SEQ ID NO: 5615519 - DNA, 22 bp, Homo sapiens
gaggatgaatagatgtgatcac

SEQ ID NO: 5615520 - DNA, 14 bp, Homo sapiens
gaggatgagaccca

SEQ ID NO: 5615521 - DNA, 15 bp, Homo sapiens
gaggatgagcagagg

SEQ ID NO: 5615522 - DNA, 22 bp, Homo sapiens
gaggatgatttcagaaggagaa

SEQ ID NO: 5615523 - DNA, 16 bp, Homo sapiens
gaggatgcactggcct

SEQ ID NO: 5615524 - DNA, 17 bp, Homo sapiens
gaggatgccacagcccc

SEQ ID NO: 5615525 - DNA, 22 bp, Homo sapiens
gaggatgccacagccccacagc

SEQ ID NO: 5615526 - DNA, 16 bp, Homo sapiens
gaggatgccttttctg

SEQ ID NO: 5615527 - DNA, 19 bp, Homo sapiens
gaggatgccttttctgtga

SEQ ID NO: 5615528 - DNA, 17 bp, Homo sapiens
gaggatgctaaaaatgt

SEQ ID NO: 5615529 - DNA, 20 bp, Homo sapiens
gaggatgctctttcccagga

SEQ ID NO: 5615530 - DNA, 19 bp, Homo sapiens
gaggatgctgacatcattt

SEQ ID NO: 5615531 - DNA, 17 bp, Homo sapiens
gaggatggacgagtgag

SEQ ID NO: 5615532 - DNA, 14 bp, Homo sapiens
gaggatggccagtg

SEQ ID NO: 5615533 - DNA, 16 bp, Homo sapiens
gaggatggccagtgtc

SEQ ID NO: 5615534 - DNA, 20 bp, Homo sapiens
gaggatggcctctgctaagc

SEQ ID NO: 5615535 - DNA, 21 bp, Homo sapiens
gaggatggcttgagcccagga

SEQ ID NO: 5615536 - DNA, 19 bp, Homo sapiens
gaggatgggaaggagggag

SEQ ID NO: 5615537 - DNA, 22 bp, Homo sapiens
gaggatgggatgtatttttctt

SEQ ID NO: 5615538 - DNA, 13 bp, Homo sapiens
gaggatgggctcg

SEQ ID NO: 5615539 - DNA, 20 bp, Homo sapiens
gaggatggtgtcctgaggcc

SEQ ID NO: 5615540 - DNA, 21 bp, Homo sapiens
gaggatggtgtcctgaggcct

SEQ ID NO: 5615541 - DNA, 15 bp, Homo sapiens
gaggatgtaaggcct

SEQ ID NO: 5615542 - DNA, 21 bp, Homo sapiens
gaggatgtaaggccttagcca

SEQ ID NO: 5615543 - DNA, 22 bp, Homo sapiens
gaggatgtataaaatggtcatg

SEQ ID NO: 5615544 - DNA, 13 bp, Homo sapiens
gaggatgtatgtg

SEQ ID NO: 5615545 - DNA, 20 bp, Homo sapiens
gaggatgtcactcagatgga

SEQ ID NO: 5615546 - DNA, 20 bp, Homo sapiens
gaggatgtccctgggccagg

SEQ ID NO: 5615547 - DNA, 19 bp, Homo sapiens
gaggatgtggaaagcactt

SEQ ID NO: 5615548 - DNA, 14 bp, Homo sapiens
gaggatgtggcagg

SEQ ID NO: 5615549 - DNA, 15 bp, Homo sapiens
gaggatgtggcaggg

SEQ ID NO: 5615550 - DNA, 16 bp, Homo sapiens
gaggatgttagacttg

SEQ ID NO: 5615551 - DNA, 17 bp, Homo sapiens
gaggatgttagacttgc

SEQ ID NO: 5615552 - DNA, 14 bp, Homo sapiens
gaggattagtttag

SEQ ID NO: 5615553 - DNA, 19 bp, Homo sapiens
gaggattatgggtcctgca

SEQ ID NO: 5615554 - DNA, 14 bp, Homo sapiens
gaggattattgata

SEQ ID NO: 5615555 - DNA, 17 bp, Homo sapiens
gaggattcaggggctgg

SEQ ID NO: 5615556 - DNA, 19 bp, Homo sapiens
gaggattcaggggctgggg

SEQ ID NO: 5615557 - DNA, 14 bp, Homo sapiens
gaggattctgtctt

SEQ ID NO: 5615558 - DNA, 15 bp, Homo sapiens
gaggattgctgccag

SEQ ID NO: 5615559 - DNA, 20 bp, Homo sapiens
gaggattgcttgagctcagg

SEQ ID NO: 5615560 - DNA, 22 bp, Homo sapiens
gaggatttaagggatggaaaag

SEQ ID NO: 5615561 - DNA, 17 bp, Homo sapiens
gaggatttcaagcctgc

SEQ ID NO: 5615562 - DNA, 19 bp, Homo sapiens
gaggatttccctgaagcta

SEQ ID NO: 5615563 - DNA, 15 bp, Homo sapiens
gaggatttcctggag

SEQ ID NO: 5615564 - DNA, 16 bp, Homo sapiens
gaggatttctgggacc

SEQ ID NO: 5615565 - DNA, 13 bp, Homo sapiens
gaggattttgagt

SEQ ID NO: 5615566 - DNA, 14 bp, Homo sapiens
gaggcaaaaatgtc

SEQ ID NO: 5615567 - DNA, 23 bp, Homo sapiens
gaggcaaaaatgtccagccaccc

SEQ ID NO: 5615568 - DNA, 13 bp, Homo sapiens
gaggcaaaagaag

SEQ ID NO: 5615569 - DNA, 20 bp, Homo sapiens
gaggcaaagctggctcacct

SEQ ID NO: 5615570 - DNA, 14 bp, Homo sapiens
gaggcaaaggcctg

SEQ ID NO: 5615571 - DNA, 15 bp, Homo sapiens
gaggcaaaggcctgg

SEQ ID NO: 5615572 - DNA, 16 bp, Homo sapiens
gaggcaaatggcactg

SEQ ID NO: 5615573 - DNA, 22 bp, Homo sapiens
gaggcaacagtgttctgagccc

SEQ ID NO: 5615574 - DNA, 14 bp, Homo sapiens
gaggcaagagaaat

SEQ ID NO: 5615575 - DNA, 22 bp, Homo sapiens
gaggcaagagggaggggacaga

SEQ ID NO: 5615576 - DNA, 22 bp, Homo sapiens
gaggcaagcgaccgaggccctc

SEQ ID NO: 5615577 - DNA, 16 bp, Homo sapiens
gaggcaagcgtgttct

SEQ ID NO: 5615578 - DNA, 14 bp, Homo sapiens
gaggcaaggcccag

SEQ ID NO: 5615579 - DNA, 17 bp, Homo sapiens
gaggcaaggcccagacc

SEQ ID NO: 5615580 - DNA, 18 bp, Homo sapiens
gaggcaaggttatatgca

SEQ ID NO: 5615581 - DNA, 22 bp, Homo sapiens
gaggcaatgggagctgaggcca

SEQ ID NO: 5615582 - DNA, 19 bp, Homo sapiens
gaggcaatgtcaggaacag

SEQ ID NO: 5615583 - DNA, 17 bp, Homo sapiens
gaggcacaaagggcagg

SEQ ID NO: 5615584 - DNA, 21 bp, Homo sapiens
gaggcacaaagggcaggcctg

SEQ ID NO: 5615585 - DNA, 13 bp, Homo sapiens
gaggcacactttc

SEQ ID NO: 5615586 - DNA, 13 bp, Homo sapiens
gaggcacatgaca

SEQ ID NO: 5615587 - DNA, 19 bp, Homo sapiens
gaggcaccagctctgtggc

SEQ ID NO: 5615588 - DNA, 21 bp, Homo sapiens
gaggcaccagctctgtggcct

SEQ ID NO: 5615589 - DNA, 22 bp, Homo sapiens
gaggcaccagctctgtggcctg

SEQ ID NO: 5615590 - DNA, 13 bp, Homo sapiens
gaggcaccaggaa

SEQ ID NO: 5615591 - DNA, 17 bp, Homo sapiens
gaggcaccaggaagccg

SEQ ID NO: 5615592 - DNA, 15 bp, Homo sapiens
gaggcaccggcgctg

SEQ ID NO: 5615593 - DNA, 17 bp, Homo sapiens
gaggcaccggcgctgca

SEQ ID NO: 5615594 - DNA, 18 bp, Homo sapiens
gaggcaccggcgctgcag

SEQ ID NO: 5615595 - DNA, 19 bp, Homo sapiens
gaggcaccggcgctgcagg

SEQ ID NO: 5615596 - DNA, 20 bp, Homo sapiens
gaggcaccggcgctgcaggt

SEQ ID NO: 5615597 - DNA, 15 bp, Homo sapiens
gaggcacctccaggc

SEQ ID NO: 5615598 - DNA, 18 bp, Homo sapiens
gaggcacgcaccactgct

SEQ ID NO: 5615599 - DNA, 22 bp, Homo sapiens
gaggcacgcaccactgcttccc

SEQ ID NO: 5615600 - DNA, 21 bp, Homo sapiens
gaggcactcagtgagcctcct

SEQ ID NO: 5615601 - DNA, 15 bp, Homo sapiens
gaggcacttccacct

SEQ ID NO: 5615602 - DNA, 21 bp, Homo sapiens
gaggcacttcctcccctcgcc

SEQ ID NO: 5615603 - DNA, 23 bp, Homo sapiens
gaggcagaaacctatctcaggga

SEQ ID NO: 5615604 - DNA, 20 bp, Homo sapiens
gaggcagaaagcagaggctg

SEQ ID NO: 5615605 - DNA, 23 bp, Homo sapiens
gaggcagaaagcagaggctggcc

SEQ ID NO: 5615606 - DNA, 14 bp, Homo sapiens
gaggcagaacctgg

SEQ ID NO: 5615607 - DNA, 22 bp, Homo sapiens
gaggcagaacctggtggctgga

SEQ ID NO: 5615608 - DNA, 16 bp, Homo sapiens
gaggcagacagcagct

SEQ ID NO: 5615609 - DNA, 22 bp, Homo sapiens
gaggcagacagcagctcaggca

SEQ ID NO: 5615610 - DNA, 15 bp, Homo sapiens
gaggcagactcgagg

SEQ ID NO: 5615611 - DNA, 22 bp, Homo sapiens
gaggcagacttccctgaatgta

SEQ ID NO: 5615612 - DNA, 16 bp, Homo sapiens
gaggcagagaaagaag

SEQ ID NO: 5615613 - DNA, 21 bp, Homo sapiens
gaggcagagaaagaagagaca

SEQ ID NO: 5615614 - DNA, 11 bp, Homo sapiens
gaggcagagag

SEQ ID NO: 5615615 - DNA, 13 bp, Homo sapiens
gaggcagagagcg

SEQ ID NO: 5615616 - DNA, 17 bp, Homo sapiens
gaggcagagcgggaggg

SEQ ID NO: 5615617 - DNA, 14 bp, Homo sapiens
gaggcagaggacag

SEQ ID NO: 5615618 - DNA, 20 bp, Homo sapiens
gaggcagatgtggggctgag

SEQ ID NO: 5615619 - DNA, 21 bp, Homo sapiens
gaggcagcaacaggaccagga

SEQ ID NO: 5615620 - DNA, 23 bp, Homo sapiens
gaggcagcaacaggaccaggagc

SEQ ID NO: 5615621 - DNA, 22 bp, Homo sapiens
gaggcagcagtgggttcaggcc

SEQ ID NO: 5615622 - DNA, 20 bp, Homo sapiens
gaggcagcagtgtgaggcca

SEQ ID NO: 5615623 - DNA, 22 bp, Homo sapiens
gaggcagcagtgtgaggccagg

SEQ ID NO: 5615624 - DNA, 22 bp, Homo sapiens
gaggcagccacagggaagctca

SEQ ID NO: 5615625 - DNA, 17 bp, Homo sapiens
gaggcagccagacccag

SEQ ID NO: 5615626 - DNA, 12 bp, Homo sapiens
gaggcagccagg

SEQ ID NO: 5615627 - DNA, 13 bp, Homo sapiens
gaggcagcccagg

SEQ ID NO: 5615628 - DNA, 18 bp, Homo sapiens
gaggcagccccattctgc

SEQ ID NO: 5615629 - DNA, 19 bp, Homo sapiens
gaggcagccccattctgcc

SEQ ID NO: 5615630 - DNA, 20 bp, Homo sapiens
gaggcagccccattctgcct

SEQ ID NO: 5615631 - DNA, 21 bp, Homo sapiens
gaggcagccccattctgcctg

SEQ ID NO: 5615632 - DNA, 23 bp, Homo sapiens
gaggcagccccattctgcctgcc

SEQ ID NO: 5615633 - DNA, 12 bp, Homo sapiens
gaggcagcccgc

SEQ ID NO: 5615634 - DNA, 21 bp, Homo sapiens
gaggcagcctagcctatgtct

SEQ ID NO: 5615635 - DNA, 14 bp, Homo sapiens
gaggcagccttggg

SEQ ID NO: 5615636 - DNA, 20 bp, Homo sapiens
gaggcagcgtgggctctgcc

SEQ ID NO: 5615637 - DNA, 13 bp, Homo sapiens
gaggcagctcagg

SEQ ID NO: 5615638 - DNA, 16 bp, Homo sapiens
gaggcagctcaggata

SEQ ID NO: 5615639 - DNA, 20 bp, Homo sapiens
gaggcagcttcaagtgcctt

SEQ ID NO: 5615640 - DNA, 16 bp, Homo sapiens
gaggcaggaaggattg

SEQ ID NO: 5615641 - DNA, 18 bp, Homo sapiens
gaggcaggaatgggggtc

SEQ ID NO: 5615642 - DNA, 21 bp, Homo sapiens
gaggcaggaatgggggtcaga

SEQ ID NO: 5615643 - DNA, 19 bp, Homo sapiens
gaggcaggaccagaaggca

SEQ ID NO: 5615644 - DNA, 20 bp, Homo sapiens
gaggcaggaccagaaggcaa

SEQ ID NO: 5615645 - DNA, 13 bp, Homo sapiens
gaggcaggagaat

SEQ ID NO: 5615646 - DNA, 15 bp, Homo sapiens
gaggcaggaggagca

SEQ ID NO: 5615647 - DNA, 23 bp, Homo sapiens
gaggcaggaggattgcttgagcc

SEQ ID NO: 5615648 - DNA, 21 bp, Homo sapiens
gaggcaggatatccccaggga

SEQ ID NO: 5615649 - DNA, 20 bp, Homo sapiens
gaggcaggcatggccctggg

SEQ ID NO: 5615650 - DNA, 21 bp, Homo sapiens
gaggcaggctccccctgcctt

SEQ ID NO: 5615651 - DNA, 23 bp, Homo sapiens
gaggcagggaacatggggaggag

SEQ ID NO: 5615652 - DNA, 14 bp, Homo sapiens
gaggcagggaagga

SEQ ID NO: 5615653 - DNA, 14 bp, Homo sapiens
gaggcagggaagtc

SEQ ID NO: 5615654 - DNA, 13 bp, Homo sapiens
gaggcagggacaa

SEQ ID NO: 5615655 - DNA, 22 bp, Homo sapiens
gaggcagggacctaaagggact

SEQ ID NO: 5615656 - DNA, 16 bp, Homo sapiens
gaggcagggaggggac

SEQ ID NO: 5615657 - DNA, 12 bp, Homo sapiens
gaggcagggccc

SEQ ID NO: 5615658 - DNA, 13 bp, Homo sapiens
gaggcagggccct

SEQ ID NO: 5615659 - DNA, 16 bp, Homo sapiens
gaggcgtgggatccag

SEQ ID NO: 5615660 - DNA, 20 bp, Homo sapiens
gaggcgtgggatccagagag

SEQ ID NO: 5615661 - DNA, 20 bp, Homo sapiens
gaggcgttagtgggcaggtg

SEQ ID NO: 5615662 - DNA, 17 bp, Homo sapiens
gaggcgttctcctgctt

SEQ ID NO: 5615663 - DNA, 21 bp, Homo sapiens
gaggcgttgtgaatgtgtccc

SEQ ID NO: 5615664 - DNA, 18 bp, Homo sapiens
gaggctaaaacaaatctc

SEQ ID NO: 5615665 - DNA, 14 bp, Homo sapiens
gaggctaaaatgtt

SEQ ID NO: 5615666 - DNA, 16 bp, Homo sapiens
gaggctaaaatgtttt

SEQ ID NO: 5615667 - DNA, 12 bp, Homo sapiens
gaggctaaataa

SEQ ID NO: 5615668 - DNA, 16 bp, Homo sapiens
gaggctaaataaagtc

SEQ ID NO: 5615669 - DNA, 14 bp, Homo sapiens
gaggctaagcctgg

SEQ ID NO: 5615670 - DNA, 17 bp, Homo sapiens
gaggctaagcctggaca

SEQ ID NO: 5615671 - DNA, 21 bp, Homo sapiens
gaggctaattcagtgtcacat

SEQ ID NO: 5615672 - DNA, 15 bp, Homo sapiens
gaggctacagctcca

SEQ ID NO: 5615673 - DNA, 20 bp, Homo sapiens
gaggctacagctccacacgc

SEQ ID NO: 5615674 - DNA, 16 bp, Homo sapiens
gaggctacctcacctg

SEQ ID NO: 5615675 - DNA, 18 bp, Homo sapiens
gaggctacctcacctggg

SEQ ID NO: 5615676 - DNA, 14 bp, Homo sapiens
gaggctagcaaagc

SEQ ID NO: 5615677 - DNA, 14 bp, Homo sapiens
gaggctagccccag

SEQ ID NO: 5615678 - DNA, 22 bp, Homo sapiens
gaggctaggtgggttgaaagcc

SEQ ID NO: 5615679 - DNA, 23 bp, Homo sapiens
gaggctagtctcttctcagagca

SEQ ID NO: 5615680 - DNA, 16 bp, Homo sapiens
gaggctcaaattttga

SEQ ID NO: 5615681 - DNA, 18 bp, Homo sapiens
gaggctcaagaggcccag

SEQ ID NO: 5615682 - DNA, 19 bp, Homo sapiens
gaggctcaagaggcccagg

SEQ ID NO: 5615683 - DNA, 20 bp, Homo sapiens
gaggctcaagaggcccaggg

SEQ ID NO: 5615684 - DNA, 13 bp, Homo sapiens
gaggctcagagag

SEQ ID NO: 5615685 - DNA, 14 bp, Homo sapiens
gaggctcagattgt

SEQ ID NO: 5615686 - DNA, 12 bp, Homo sapiens
gaggctcagccc

SEQ ID NO: 5615687 - DNA, 13 bp, Homo sapiens
gaggctcagccct

SEQ ID NO: 5615688 - DNA, 10 bp, Homo sapiens
gaggctcagg

SEQ ID NO: 5615689 - DNA, 16 bp, Homo sapiens
gaggctcatggccctg

SEQ ID NO: 5615690 - DNA, 12 bp, Homo sapiens
gaggctccactt

SEQ ID NO: 5615691 - DNA, 17 bp, Homo sapiens
gaggctccacttggtct

SEQ ID NO: 5615692 - DNA, 14 bp, Homo sapiens
gaggctccagaggg

SEQ ID NO: 5615693 - DNA, 18 bp, Homo sapiens
gaggctccaggactccac

SEQ ID NO: 5615694 - DNA, 14 bp, Homo sapiens
gaggctccaggcag

SEQ ID NO: 5615695 - DNA, 16 bp, Homo sapiens
gaggctcccagaccca

SEQ ID NO: 5615696 - DNA, 20 bp, Homo sapiens
gaggctcccagacccagggc

SEQ ID NO: 5615697 - DNA, 21 bp, Homo sapiens
gaggctcccagacccagggca

SEQ ID NO: 5615698 - DNA, 23 bp, Homo sapiens
gaggctcccagacccagggcagt

SEQ ID NO: 5615699 - DNA, 15 bp, Homo sapiens
gaggctccccagggc

SEQ ID NO: 5615700 - DNA, 16 bp, Homo sapiens
gaggctccccagggct

SEQ ID NO: 5615701 - DNA, 13 bp, Homo sapiens
gaggctccccgcc

SEQ ID NO: 5615702 - DNA, 14 bp, Homo sapiens
gaggctccccgcct

SEQ ID NO: 5615703 - DNA, 18 bp, Homo sapiens
gaggctcccggggcctgg

SEQ ID NO: 5615704 - DNA, 17 bp, Homo sapiens
gaggctccgtgagccct

SEQ ID NO: 5615705 - DNA, 12 bp, Homo sapiens
gaggctcctccc

SEQ ID NO: 5615706 - DNA, 22 bp, Homo sapiens
gaggctcctccctctgcctcat

SEQ ID NO: 5615707 - DNA, 14 bp, Homo sapiens
gaggctcctctagg

SEQ ID NO: 5615708 - DNA, 13 bp, Homo sapiens
gaggctcctggag

SEQ ID NO: 5615709 - DNA, 17 bp, Homo sapiens
gaggctcctggagccag

SEQ ID NO: 5615710 - DNA, 19 bp, Homo sapiens
gaggctcctggtggggcag

SEQ ID NO: 5615711 - DNA, 20 bp, Homo sapiens
gaggctcctggtggggcaga

SEQ ID NO: 5615712 - DNA, 21 bp, Homo sapiens
gaggctcctggtggggcagaa

SEQ ID NO: 5615713 - DNA, 22 bp, Homo sapiens
gaggctcctgtggtagtcctcc

SEQ ID NO: 5615714 - DNA, 17 bp, Homo sapiens
gaggctcgtgcatgtaa

SEQ ID NO: 5615715 - DNA, 14 bp, Homo sapiens
gaggctctattgag

SEQ ID NO: 5615716 - DNA, 17 bp, Homo sapiens
gaggctctattgagcca

SEQ ID NO: 5615717 - DNA, 21 bp, Homo sapiens
gaggctctggacagcagaagc

SEQ ID NO: 5615718 - DNA, 22 bp, Homo sapiens
gaggctctggacagcagaagcc

SEQ ID NO: 5615719 - DNA, 23 bp, Homo sapiens
gaggctctggacagcagaagcct

SEQ ID NO: 5615720 - DNA, 19 bp, Homo sapiens
gaggctctggagcccactg

SEQ ID NO: 5615721 - DNA, 20 bp, Homo sapiens
gaggctctggagcccactgt

SEQ ID NO: 5615722 - DNA, 18 bp, Homo sapiens
gaggctcttccatcccca

SEQ ID NO: 5615723 - DNA, 19 bp, Homo sapiens
gaggctgacgtgtgaggga

SEQ ID NO: 5615724 - DNA, 16 bp, Homo sapiens
gaggctgactcctggt

SEQ ID NO: 5615725 - DNA, 19 bp, Homo sapiens
gaggctgactcctggtcct

SEQ ID NO: 5615726 - DNA, 20 bp, Homo sapiens
gaggctgagaaatgcagaga

SEQ ID NO: 5615727 - DNA, 16 bp, Homo sapiens
gaggctgagacaggag

SEQ ID NO: 5615728 - DNA, 18 bp, Homo sapiens
gaggctgagacaggagaa

SEQ ID NO: 5615729 - DNA, 21 bp, Homo sapiens
gaggctgagacaggagaatca

SEQ ID NO: 5615730 - DNA, 22 bp, Homo sapiens
gaggctgagcctacagatgaac

SEQ ID NO: 5615731 - DNA, 14 bp, Homo sapiens
gaggctgaggcaca

SEQ ID NO: 5615732 - DNA, 18 bp, Homo sapiens
gaggctgaggcagaagaa

SEQ ID NO: 5615733 - DNA, 12 bp, Homo sapiens
gaggctgaggcg

SEQ ID NO: 5615734 - DNA, 15 bp, Homo sapiens
gaggctgaggctggc

SEQ ID NO: 5615735 - DNA, 16 bp, Homo sapiens
gaggctgaggctggca

SEQ ID NO: 5615736 - DNA, 21 bp, Homo sapiens
gaggctgcacccctgggccag

SEQ ID NO: 5615737 - DNA, 18 bp, Homo sapiens
gaggctgcactggagcca

SEQ ID NO: 5615738 - DNA, 22 bp, Homo sapiens
gaggctgcactggagccacagg

SEQ ID NO: 5615739 - DNA, 23 bp, Homo sapiens
gaggctgcactggagccacaggc

SEQ ID NO: 5615740 - DNA, 13 bp, Homo sapiens
gaggctgcagcag

SEQ ID NO: 5615741 - DNA, 18 bp, Homo sapiens
gaggctgcagcaggtgct

SEQ ID NO: 5615742 - DNA, 16 bp, Homo sapiens
gaggctgcagccaggc

SEQ ID NO: 5615743 - DNA, 20 bp, Homo sapiens
gaggctgcagccaggcctcg

SEQ ID NO: 5615744 - DNA, 19 bp, Homo sapiens
gaggctgcagtcagccctg

SEQ ID NO: 5615745 - DNA, 17 bp, Homo sapiens
gaggctgcatgctctgg

SEQ ID NO: 5615746 - DNA, 9 bp, Homo sapiens
gaggctgcc

SEQ ID NO: 5615747 - DNA, 15 bp, Homo sapiens
gaggctgccccaggc

SEQ ID NO: 5615748 - DNA, 17 bp, Homo sapiens
gaggctgccccaggccg

SEQ ID NO: 5615749 - DNA, 19 bp, Homo sapiens
gaggctgccccaggccgga

SEQ ID NO: 5615750 - DNA, 21 bp, Homo sapiens
gaggctgccccattgagatct

SEQ ID NO: 5615751 - DNA, 13 bp, Homo sapiens
gaggctgccccca

SEQ ID NO: 5615752 - DNA, 17 bp, Homo sapiens
gaggctgcccccatcca

SEQ ID NO: 5615753 - DNA, 17 bp, Homo sapiens
gaggctgcccccggccc

SEQ ID NO: 5615754 - DNA, 20 bp, Homo sapiens
gaggctgcccccggccccct

SEQ ID NO: 5615755 - DNA, 23 bp, Homo sapiens
gaggctgcccccggccccctggt

SEQ ID NO: 5615756 - DNA, 14 bp, Homo sapiens
gaggctgcccctct

SEQ ID NO: 5615757 - DNA, 17 bp, Homo sapiens
gaggctgccccttggat

SEQ ID NO: 5615758 - DNA, 15 bp, Homo sapiens
gaggctgccctcctg

SEQ ID NO: 5615759 - DNA, 15 bp, Homo sapiens
gaggctgcctcccaa

SEQ ID NO: 5615760 - DNA, 15 bp, Homo sapiens
gaggctgcctccgca

SEQ ID NO: 5615761 - DNA, 14 bp, Homo sapiens
gaggctgcctctcc

SEQ ID NO: 5615762 - DNA, 13 bp, Homo sapiens
gaggctgcctctg

SEQ ID NO: 5615763 - DNA, 14 bp, Homo sapiens
gaggctgcctctgg

SEQ ID NO: 5615764 - DNA, 17 bp, Homo sapiens
gaggctgcctctgggtg

SEQ ID NO: 5615765 - DNA, 18 bp, Homo sapiens
gaggctgcctgctgtgct

SEQ ID NO: 5615766 - DNA, 18 bp, Homo sapiens
gaggctgctcggggtgca

SEQ ID NO: 5615767 - DNA, 21 bp, Homo sapiens
gaggctgctcggggtgcacag

SEQ ID NO: 5615768 - DNA, 23 bp, Homo sapiens
gaggctgctcggggtgcacagga

SEQ ID NO: 5615769 - DNA, 24 bp, Homo sapiens
gaggctgctcggggtgcacaggag

SEQ ID NO: 5615770 - DNA, 18 bp, Homo sapiens
gaggctgctgccaggccc

SEQ ID NO: 5615771 - DNA, 14 bp, Homo sapiens
gaggctgctgcccc

SEQ ID NO: 5615772 - DNA, 19 bp, Homo sapiens
gaggctgctgccccctggc

SEQ ID NO: 5615773 - DNA, 20 bp, Homo sapiens
gaggctggactccagatctg

SEQ ID NO: 5615774 - DNA, 20 bp, Homo sapiens
gaggctggataggagaggaa

SEQ ID NO: 5615775 - DNA, 18 bp, Homo sapiens
gaggctggatgacttgct

SEQ ID NO: 5615776 - DNA, 21 bp, Homo sapiens
gaggctggatgacttgctcaa

SEQ ID NO: 5615777 - DNA, 13 bp, Homo sapiens
gaggctggcatcc

SEQ ID NO: 5615778 - DNA, 18 bp, Homo sapiens
gaggctggcatcctggct

SEQ ID NO: 5615779 - DNA, 19 bp, Homo sapiens
gaggctggcatcctggctg

SEQ ID NO: 5615780 - DNA, 15 bp, Homo sapiens
gaggctggcctcaga

SEQ ID NO: 5615781 - DNA, 16 bp, Homo sapiens
gaggctggctggggcc

SEQ ID NO: 5615782 - DNA, 22 bp, Homo sapiens
gaggctgggaatggaggggcag

SEQ ID NO: 5615783 - DNA, 13 bp, Homo sapiens
gaggctgggacac

SEQ ID NO: 5615784 - DNA, 20 bp, Homo sapiens
gaggctgggacgctctgctg

SEQ ID NO: 5615785 - DNA, 15 bp, Homo sapiens
gaggctgggcacaga

SEQ ID NO: 5615786 - DNA, 13 bp, Homo sapiens
gaggctgggcagg

SEQ ID NO: 5615787 - DNA, 15 bp, Homo sapiens
gaggctgggccaagc

SEQ ID NO: 5615788 - DNA, 15 bp, Homo sapiens
gaggctgggccagcc

SEQ ID NO: 5615789 - DNA, 22 bp, Homo sapiens
gaggctgggccagcctcagctc

SEQ ID NO: 5615790 - DNA, 14 bp, Homo sapiens
gaggctgggcccct

SEQ ID NO: 5615791 - DNA, 14 bp, Homo sapiens
gaggctgggctccc

SEQ ID NO: 5615792 - DNA, 16 bp, Homo sapiens
gaggctgggctggcca

SEQ ID NO: 5615793 - DNA, 17 bp, Homo sapiens
gaggctggggacccaga

SEQ ID NO: 5615794 - DNA, 22 bp, Homo sapiens
gaggctggggccccatcttgat

SEQ ID NO: 5615795 - DNA, 13 bp, Homo sapiens
gaggctggggctc

SEQ ID NO: 5615796 - DNA, 21 bp, Homo sapiens
gaggctggggcttttgtgcca

SEQ ID NO: 5615797 - DNA, 12 bp, Homo sapiens
gaggctggggga

SEQ ID NO: 5615798 - DNA, 20 bp, Homo sapiens
gaggctgggggagagccgtg

SEQ ID NO: 5615799 - DNA, 21 bp, Homo sapiens
gaggctgggtggccggccctg

SEQ ID NO: 5615800 - DNA, 12 bp, Homo sapiens
gaggctggtgcc

SEQ ID NO: 5615801 - DNA, 13 bp, Homo sapiens
gaggctggttttg

SEQ ID NO: 5615802 - DNA, 23 bp, Homo sapiens
gaggctggttttgatggctgggt

SEQ ID NO: 5615803 - DNA, 21 bp, Homo sapiens
gaggctgtaactgagagaaag

SEQ ID NO: 5615804 - DNA, 15 bp, Homo sapiens
gaggctgtctggggc

SEQ ID NO: 5615805 - DNA, 17 bp, Homo sapiens
gaggctgtctggggcct

SEQ ID NO: 5615806 - DNA, 20 bp, Homo sapiens
gaggctgtcttctcaggctc

SEQ ID NO: 5615807 - DNA, 22 bp, Homo sapiens
gaggctgtcttctcaggctctg

SEQ ID NO: 5615808 - DNA, 18 bp, Homo sapiens
gaggctgtggctggtgag

SEQ ID NO: 5615809 - DNA, 15 bp, Homo sapiens
gaggctgtggtcaga

SEQ ID NO: 5615810 - DNA, 24 bp, Homo sapiens
gaggctgtggtcagagagggaagc

SEQ ID NO: 5615811 - DNA, 17 bp, Homo sapiens
gaggctgtgtggccaac

SEQ ID NO: 5615812 - DNA, 16 bp, Homo sapiens
gaggcttagagagagg

SEQ ID NO: 5615813 - DNA, 17 bp, Homo sapiens
gaggcttatatttgtgt

SEQ ID NO: 5615814 - DNA, 18 bp, Homo sapiens
gaggcttcacgccgggag

SEQ ID NO: 5615815 - DNA, 22 bp, Homo sapiens
gaggcttccagagagtcctctg

SEQ ID NO: 5615816 - DNA, 23 bp, Homo sapiens
gaggcttccagagagtcctctgg

SEQ ID NO: 5615817 - DNA, 13 bp, Homo sapiens
gaggcttccagct

SEQ ID NO: 5615818 - DNA, 15 bp, Homo sapiens
gaggcttccagctca

SEQ ID NO: 5615819 - DNA, 16 bp, Homo sapiens
gaggcttccagctcag

SEQ ID NO: 5615820 - DNA, 14 bp, Homo sapiens
gaggcttccaggct

SEQ ID NO: 5615821 - DNA, 15 bp, Homo sapiens
gaggcttccaggctc

SEQ ID NO: 5615822 - DNA, 16 bp, Homo sapiens
gaggcttccaggctct

SEQ ID NO: 5615823 - DNA, 19 bp, Homo sapiens
gaggcttccaggctcttcc

SEQ ID NO: 5615824 - DNA, 13 bp, Homo sapiens
gaggcttccctac

SEQ ID NO: 5615825 - DNA, 20 bp, Homo sapiens
gaggcttctccgccagcctc

SEQ ID NO: 5615826 - DNA, 16 bp, Homo sapiens
gaggcttcttcagatc

SEQ ID NO: 5615827 - DNA, 16 bp, Homo sapiens
gaggcttcttcctgga

SEQ ID NO: 5615828 - DNA, 17 bp, Homo sapiens
gaggcttgcccaggagc

SEQ ID NO: 5615829 - DNA, 19 bp, Homo sapiens
gaggcttgctgaacatgga

SEQ ID NO: 5615830 - DNA, 15 bp, Homo sapiens
gaggcttgctgagag

SEQ ID NO: 5615831 - DNA, 18 bp, Homo sapiens
gaggcttgggcccagtag

SEQ ID NO: 5615832 - DNA, 17 bp, Homo sapiens
gaggcttgtcagagctg

SEQ ID NO: 5615833 - DNA, 19 bp, Homo sapiens
gaggcttgtttacctttct

SEQ ID NO: 5615834 - DNA, 23 bp, Homo sapiens
gaggcttgtttacctttctctct

SEQ ID NO: 5615835 - DNA, 16 bp, Homo sapiens
gaggctttaaaaagaa

SEQ ID NO: 5615836 - DNA, 20 bp, Homo sapiens
gaggctttaagcgaggcaga

SEQ ID NO: 5615837 - DNA, 15 bp, Homo sapiens
gagggtcagccaggg

SEQ ID NO: 5615838 - DNA, 21 bp, Homo sapiens
gagggtcatgtacttctttat

SEQ ID NO: 5615839 - DNA, 24 bp, Homo sapiens
gagggtcattttcctttctgtatt

SEQ ID NO: 5615840 - DNA, 16 bp, Homo sapiens
gagggtccacctggag

SEQ ID NO: 5615841 - DNA, 23 bp, Homo sapiens
gagggtcccaagctgggccccag

SEQ ID NO: 5615842 - DNA, 15 bp, Homo sapiens
gagggtcccagggct

SEQ ID NO: 5615843 - DNA, 18 bp, Homo sapiens
gagggtcccagggctgca

SEQ ID NO: 5615844 - DNA, 19 bp, Homo sapiens
gagggtccctaattctctt

SEQ ID NO: 5615845 - DNA, 13 bp, Homo sapiens
gagggtcctgcag

SEQ ID NO: 5615846 - DNA, 17 bp, Homo sapiens
gagggtcctgcagcctg

SEQ ID NO: 5615847 - DNA, 15 bp, Homo sapiens
gagggtcctggctcc

SEQ ID NO: 5615848 - DNA, 18 bp, Homo sapiens
gagggtcgtgggaaaggg

SEQ ID NO: 5615849 - DNA, 17 bp, Homo sapiens
gagggtctccctgggca

SEQ ID NO: 5615850 - DNA, 23 bp, Homo sapiens
gagggtctccctgggcaccctgc

SEQ ID NO: 5615851 - DNA, 18 bp, Homo sapiens
gagggtctcgctgtcact

SEQ ID NO: 5615852 - DNA, 19 bp, Homo sapiens
gagggtctcgctgtcactg

SEQ ID NO: 5615853 - DNA, 18 bp, Homo sapiens
gagggtctctttgttcaa

SEQ ID NO: 5615854 - DNA, 14 bp, Homo sapiens
gagggtctgaggaa

SEQ ID NO: 5615855 - DNA, 15 bp, Homo sapiens
gagggtctgggggca

SEQ ID NO: 5615856 - DNA, 19 bp, Homo sapiens
gagggtctgggggcagctg

SEQ ID NO: 5615857 - DNA, 19 bp, Homo sapiens
gagggtcttgaggggaagc

SEQ ID NO: 5615858 - DNA, 21 bp, Homo sapiens
gagggtcttgaggggaagctg

SEQ ID NO: 5615859 - DNA, 17 bp, Homo sapiens
gagggtgaaaggcaggg

SEQ ID NO: 5615860 - DNA, 13 bp, Homo sapiens
gagggtgaagcct

SEQ ID NO: 5615861 - DNA, 20 bp, Homo sapiens
gagggtgacccacagctctg

SEQ ID NO: 5615862 - DNA, 15 bp, Homo sapiens
gagggtgacgcccag

SEQ ID NO: 5615863 - DNA, 17 bp, Homo sapiens
gagggtgacgcccagct

SEQ ID NO: 5615864 - DNA, 15 bp, Homo sapiens
gagggtgagaggaag

SEQ ID NO: 5615865 - DNA, 13 bp, Homo sapiens
gagggtgagctgg

SEQ ID NO: 5615866 - DNA, 15 bp, Homo sapiens
gagggtgagggcctt

SEQ ID NO: 5615867 - DNA, 19 bp, Homo sapiens
gagggtgagtcctccagaa

SEQ ID NO: 5615868 - DNA, 15 bp, Homo sapiens
gagggtgagtgcaag

SEQ ID NO: 5615869 - DNA, 18 bp, Homo sapiens
gagggtgatggggctgag

SEQ ID NO: 5615870 - DNA, 19 bp, Homo sapiens
gagggtgcccgagtgcggc

SEQ ID NO: 5615871 - DNA, 22 bp, Homo sapiens
gagggtgccggaaagagagctg

SEQ ID NO: 5615872 - DNA, 12 bp, Homo sapiens
gagggtggaata

SEQ ID NO: 5615873 - DNA, 20 bp, Homo sapiens
gagggtggatcacacctcag

SEQ ID NO: 5615874 - DNA, 22 bp, Homo sapiens
gagggtggcacttcgtggatga

SEQ ID NO: 5615875 - DNA, 14 bp, Homo sapiens
gagggtggcagaga

SEQ ID NO: 5615876 - DNA, 19 bp, Homo sapiens
gagggtggcagagacagtg

SEQ ID NO: 5615877 - DNA, 20 bp, Homo sapiens
gagggtggcagagacagtgg

SEQ ID NO: 5615878 - DNA, 13 bp, Homo sapiens
gagggtggcaggt

SEQ ID NO: 5615879 - DNA, 13 bp, Homo sapiens
gagggtgggaagg

SEQ ID NO: 5615880 - DNA, 18 bp, Homo sapiens
gagggtgggagagcccag

SEQ ID NO: 5615881 - DNA, 15 bp, Homo sapiens
gagggtgggagtggg

SEQ ID NO: 5615882 - DNA, 17 bp, Homo sapiens
gagggtggggccgggtg

SEQ ID NO: 5615883 - DNA, 17 bp, Homo sapiens
gagggtggggtgcccca

SEQ ID NO: 5615884 - DNA, 19 bp, Homo sapiens
gagggtgggttggggaggg

SEQ ID NO: 5615885 - DNA, 20 bp, Homo sapiens
gagggtggtttacctgcacc

SEQ ID NO: 5615886 - DNA, 18 bp, Homo sapiens
gagggtgtatctagctct

SEQ ID NO: 5615887 - DNA, 24 bp, Homo sapiens
gagggtgtgagaagtgccttctcc

SEQ ID NO: 5615888 - DNA, 19 bp, Homo sapiens
gagggtgttcagaggcagc

SEQ ID NO: 5615889 - DNA, 17 bp, Homo sapiens
gagggtgtttcctctaa

SEQ ID NO: 5615890 - DNA, 19 bp, Homo sapiens
gagggttagcctgcaccgc

SEQ ID NO: 5615891 - DNA, 21 bp, Homo sapiens
gagggttcctcttaggtcaga

SEQ ID NO: 5615892 - DNA, 15 bp, Homo sapiens
gagggttctaagtgg

SEQ ID NO: 5615893 - DNA, 13 bp, Homo sapiens
gagggttgctggt

SEQ ID NO: 5615894 - DNA, 23 bp, Homo sapiens
gagggttgggcgtgctacctgca

SEQ ID NO: 5615895 - DNA, 20 bp, Homo sapiens
gagggttgggttcatctgag

SEQ ID NO: 5615896 - DNA, 20 bp, Homo sapiens
gagggttgtgcccacttcat

SEQ ID NO: 5615897 - DNA, 13 bp, Homo sapiens
gagggttgtgcta

SEQ ID NO: 5615898 - DNA, 17 bp, Homo sapiens
gagggttgttctcctag

SEQ ID NO: 5615899 - DNA, 18 bp, Homo sapiens
gagggttgttctcctaga

SEQ ID NO: 5615900 - DNA, 22 bp, Homo sapiens
gagggtttcattgtctgtgaag

SEQ ID NO: 5615901 - DNA, 16 bp, Homo sapiens
gagggtttctctccca

SEQ ID NO: 5615902 - DNA, 18 bp, Homo sapiens
gagggtttctgatctgta

SEQ ID NO: 5615903 - DNA, 21 bp, Homo sapiens
gagggtttctgatctgtactt

SEQ ID NO: 5615904 - DNA, 14 bp, Homo sapiens
gagggtttgggcag

SEQ ID NO: 5615905 - DNA, 17 bp, Homo sapiens
gagggtttgggcagagc

SEQ ID NO: 5615906 - DNA, 21 bp, Homo sapiens
gagggttttaggtagaaaaac

SEQ ID NO: 5615907 - DNA, 15 bp, Homo sapiens
gaggtaaaaaaaaga

SEQ ID NO: 5615908 - DNA, 16 bp, Homo sapiens
gaggtaaaggatgagg

SEQ ID NO: 5615909 - DNA, 15 bp, Homo sapiens
gaggtaacagaacag

SEQ ID NO: 5615910 - DNA, 16 bp, Homo sapiens
gaggtaacagaacagc

SEQ ID NO: 5615911 - DNA, 18 bp, Homo sapiens
gaggtaactatcaatatt

SEQ ID NO: 5615912 - DNA, 24 bp, Homo sapiens
gaggtaaggaatacctgtccccct

SEQ ID NO: 5615913 - DNA, 19 bp, Homo sapiens
gaggtaccacaggaagccg

SEQ ID NO: 5615914 - DNA, 21 bp, Homo sapiens
gaggtacctttccacccagac

SEQ ID NO: 5615915 - DNA, 13 bp, Homo sapiens
gaggtactgagac

SEQ ID NO: 5615916 - DNA, 15 bp, Homo sapiens
gaggtagaatgactc

SEQ ID NO: 5615917 - DNA, 20 bp, Homo sapiens
gaggtagaccaggatttcta

SEQ ID NO: 5615918 - DNA, 21 bp, Homo sapiens
gaggtagaccaggatttctaa

SEQ ID NO: 5615919 - DNA, 13 bp, Homo sapiens
gaggtagaggaaa

SEQ ID NO: 5615920 - DNA, 17 bp, Homo sapiens
gaggtagaggaaaatca

SEQ ID NO: 5615921 - DNA, 17 bp, Homo sapiens
gaggtagcactctcaga

SEQ ID NO: 5615922 - DNA, 23 bp, Homo sapiens
gaggtagctatagttgcagccca

SEQ ID NO: 5615923 - DNA, 21 bp, Homo sapiens
gaggtagctttgaggtggaag

SEQ ID NO: 5615924 - DNA, 13 bp, Homo sapiens
gaggtaggctgtg

SEQ ID NO: 5615925 - DNA, 15 bp, Homo sapiens
gaggtaggctgtggg

SEQ ID NO: 5615926 - DNA, 23 bp, Homo sapiens
gaggtagggctggctggaggaag

SEQ ID NO: 5615927 - DNA, 14 bp, Homo sapiens
gaggtataaagaca

SEQ ID NO: 5615928 - DNA, 17 bp, Homo sapiens
gaggtataaagacaagt

SEQ ID NO: 5615929 - DNA, 15 bp, Homo sapiens
gaggtataggggtcc

SEQ ID NO: 5615930 - DNA, 17 bp, Homo sapiens
gaggtatggccatgccc

SEQ ID NO: 5615931 - DNA, 20 bp, Homo sapiens
gaggtatggccatgccctag

SEQ ID NO: 5615932 - DNA, 15 bp, Homo sapiens
gaggtatgggctggg

SEQ ID NO: 5615933 - DNA, 20 bp, Homo sapiens
gaggtatgtgcccctcctgg

SEQ ID NO: 5615934 - DNA, 22 bp, Homo sapiens
gaggtatgtgcccctcctgggt

SEQ ID NO: 5615935 - DNA, 22 bp, Homo sapiens
gaggtattcaatatcctttgcc

SEQ ID NO: 5615936 - DNA, 14 bp, Homo sapiens
gaggtatttaactg

SEQ ID NO: 5615937 - DNA, 20 bp, Homo sapiens
gaggtcaaagctgcagtcag

SEQ ID NO: 5615938 - DNA, 15 bp, Homo sapiens
gaggtcaacagagaa

SEQ ID NO: 5615939 - DNA, 22 bp, Homo sapiens
gaggtcaacagagaaggcagga

SEQ ID NO: 5615940 - DNA, 18 bp, Homo sapiens
gaggtcaagaccagcctg

SEQ ID NO: 5615941 - DNA, 20 bp, Homo sapiens
gaggtcaagcctgcagcgag

SEQ ID NO: 5615942 - DNA, 16 bp, Homo sapiens
gaggtcaataaagcag

SEQ ID NO: 5615943 - DNA, 17 bp, Homo sapiens
gaggtcacacagcctgt

SEQ ID NO: 5615944 - DNA, 20 bp, Homo sapiens
gaggtcacagctggatctgc

SEQ ID NO: 5615945 - DNA, 22 bp, Homo sapiens
gaggtcacattcaggaagatga

SEQ ID NO: 5615946 - DNA, 12 bp, Homo sapiens
gaggtcactgct

SEQ ID NO: 5615947 - DNA, 13 bp, Homo sapiens
gaggtcactgcta

SEQ ID NO: 5615948 - DNA, 15 bp, Homo sapiens
gaggtcactggaaag

SEQ ID NO: 5615949 - DNA, 17 bp, Homo sapiens
gaggtcactggaaaggg

SEQ ID NO: 5615950 - DNA, 18 bp, Homo sapiens
gaggtcactggaaagggg

SEQ ID NO: 5615951 - DNA, 20 bp, Homo sapiens
gaggtcactggaaaggggag

SEQ ID NO: 5615952 - DNA, 21 bp, Homo sapiens
gaggtcactggaaaggggaga

SEQ ID NO: 5615953 - DNA, 17 bp, Homo sapiens
gaggtcactggctgacc

SEQ ID NO: 5615954 - DNA, 22 bp, Homo sapiens
gaggtcaggaaacttttaactg

SEQ ID NO: 5615955 - DNA, 22 bp, Homo sapiens
gaggtcaggaagcaggggtggg

SEQ ID NO: 5615956 - DNA, 21 bp, Homo sapiens
gaggtcaggacggctcctcag

SEQ ID NO: 5615957 - DNA, 23 bp, Homo sapiens
gaggtcaggagttcgaggcgagc

SEQ ID NO: 5615958 - DNA, 14 bp, Homo sapiens
gaggtcaggccctg

SEQ ID NO: 5615959 - DNA, 14 bp, Homo sapiens
gaggtcagggagtg

SEQ ID NO: 5615960 - DNA, 22 bp, Homo sapiens
gaggtcatcccggggccatgga

SEQ ID NO: 5615961 - DNA, 12 bp, Homo sapiens
gaggtcatccct

SEQ ID NO: 5615962 - DNA, 18 bp, Homo sapiens
gaggtcatctgtaaaata

SEQ ID NO: 5615963 - DNA, 19 bp, Homo sapiens
gaggtccaagattctggag

SEQ ID NO: 5615964 - DNA, 19 bp, Homo sapiens
gaggtccaccggcccctgg

SEQ ID NO: 5615965 - DNA, 13 bp, Homo sapiens
gaggtccagccca

SEQ ID NO: 5615966 - DNA, 17 bp, Homo sapiens
gaggtccagccctggct

SEQ ID NO: 5615967 - DNA, 17 bp, Homo sapiens
gaggtccagctgggcct

SEQ ID NO: 5615968 - DNA, 21 bp, Homo sapiens
gaggtccagctgggcctcctg

SEQ ID NO: 5615969 - DNA, 17 bp, Homo sapiens
gaggtccaggcaggagg

SEQ ID NO: 5615970 - DNA, 23 bp, Homo sapiens
gaggtccattaatacttccttat

SEQ ID NO: 5615971 - DNA, 12 bp, Homo sapiens
gaggtcccagac

SEQ ID NO: 5615972 - DNA, 16 bp, Homo sapiens
gaggtcccagccccag

SEQ ID NO: 5615973 - DNA, 23 bp, Homo sapiens
gaggtcccagccccaggcctggc

SEQ ID NO: 5615974 - DNA, 18 bp, Homo sapiens
gaggtcccagccctgggg

SEQ ID NO: 5615975 - DNA, 15 bp, Homo sapiens
gaggtcccaggaagt

SEQ ID NO: 5615976 - DNA, 12 bp, Homo sapiens
gaggtcccaggc

SEQ ID NO: 5615977 - DNA, 18 bp, Homo sapiens
gaggtccctgctgccagc

SEQ ID NO: 5615978 - DNA, 21 bp, Homo sapiens
gaggtcccttcaaggcctccc

SEQ ID NO: 5615979 - DNA, 19 bp, Homo sapiens
gaggtcctcaggtcagctg

SEQ ID NO: 5615980 - DNA, 23 bp, Homo sapiens
gaggtcctccgtagggtctttct

SEQ ID NO: 5615981 - DNA, 20 bp, Homo sapiens
gaggtcctcctggcctgagc

SEQ ID NO: 5615982 - DNA, 12 bp, Homo sapiens
gaggtcctgagc

SEQ ID NO: 5615983 - DNA, 14 bp, Homo sapiens
gaggtcctgagcac

SEQ ID NO: 5615984 - DNA, 18 bp, Homo sapiens
gaggtcctgagcactgcc

SEQ ID NO: 5615985 - DNA, 22 bp, Homo sapiens
gaggtccttggagtgctgcagc

SEQ ID NO: 5615986 - DNA, 22 bp, Homo sapiens
gaggtcgaccccaaagcccctt

SEQ ID NO: 5615987 - DNA, 22 bp, Homo sapiens
gaggtcgcagctaccctcagcc

SEQ ID NO: 5615988 - DNA, 22 bp, Homo sapiens
gaggtcgggagttcaagaccag

SEQ ID NO: 5615989 - DNA, 20 bp, Homo sapiens
gaggtcgggagtttgagacc

SEQ ID NO: 5615990 - DNA, 21 bp, Homo sapiens
gaggtcggtaggttcagccaa

SEQ ID NO: 5615991 - DNA, 23 bp, Homo sapiens
gaggtcggtaggttcagccaagg

SEQ ID NO: 5615992 - DNA, 18 bp, Homo sapiens
gaggtctcatctcccagg

SEQ ID NO: 5615993 - DNA, 17 bp, Homo sapiens
gaggtctccaggggcct

SEQ ID NO: 5615994 - DNA, 17 bp, Homo sapiens
gaggtctcgaccctgtc

SEQ ID NO: 5615995 - DNA, 20 bp, Homo sapiens
gaggtctcgctgatgctggg

SEQ ID NO: 5615996 - DNA, 14 bp, Homo sapiens
gaggtctctgggag

SEQ ID NO: 5615997 - DNA, 14 bp, Homo sapiens
gaggtctcttgagg

SEQ ID NO: 5615998 - DNA, 18 bp, Homo sapiens
gaggtctcttttctctac

SEQ ID NO: 5615999 - DNA, 22 bp, Homo sapiens
gaggtctgaaaagaggagccag

SEQ ID NO: 5616000 - DNA, 13 bp, Homo sapiens
gaggtctgagccc

SEQ ID NO: 5616001 - DNA, 23 bp, Homo sapiens
gaggtctgagtggtggtctttgg

SEQ ID NO: 5616002 - DNA, 19 bp, Homo sapiens
gaggtctgctcggccgtct

SEQ ID NO: 5616003 - DNA, 23 bp, Homo sapiens
gaggtcttggccgactcagggac

SEQ ID NO: 5616004 - DNA, 18 bp, Homo sapiens
gaggtctttctcctcagg

SEQ ID NO: 5616005 - DNA, 22 bp, Homo sapiens
gaggtcttttgacatgtggaaa

SEQ ID NO: 5616006 - DNA, 17 bp, Homo sapiens
gaggtgaaaaggccaag

SEQ ID NO: 5616007 - DNA, 21 bp, Homo sapiens
gaggtgaaagaaagggaccca

SEQ ID NO: 5616008 - DNA, 23 bp, Homo sapiens
gaggtgaacaagcaaacccagac

SEQ ID NO: 5616009 - DNA, 18 bp, Homo sapiens
gaggtgaacattaaaata

SEQ ID NO: 5616010 - DNA, 17 bp, Homo sapiens
gaggtgaactccaggca

SEQ ID NO: 5616011 - DNA, 19 bp, Homo sapiens
gaggtgaactccaggcatg

SEQ ID NO: 5616012 - DNA, 16 bp, Homo sapiens
gagtctccctctgatt

SEQ ID NO: 5616013 - DNA, 18 bp, Homo sapiens
gagtctcctcactgccac

SEQ ID NO: 5616014 - DNA, 15 bp, Homo sapiens
gagtctccttctctt

SEQ ID NO: 5616015 - DNA, 17 bp, Homo sapiens
gagtctccttctcttct

SEQ ID NO: 5616016 - DNA, 14 bp, Homo sapiens
gagtctcgctctgc

SEQ ID NO: 5616017 - DNA, 21 bp, Homo sapiens
gagtctcgctctgctgcccag

SEQ ID NO: 5616018 - DNA, 22 bp, Homo sapiens
gagtctcggcatagtccccaga

SEQ ID NO: 5616019 - DNA, 20 bp, Homo sapiens
gagtctctcactgtcgccca

SEQ ID NO: 5616020 - DNA, 12 bp, Homo sapiens
gagtctctccag

SEQ ID NO: 5616021 - DNA, 13 bp, Homo sapiens
gagtctctctggg

SEQ ID NO: 5616022 - DNA, 18 bp, Homo sapiens
gagtctctgatacacagt

SEQ ID NO: 5616023 - DNA, 16 bp, Homo sapiens
gagtctctgccaccca

SEQ ID NO: 5616024 - DNA, 15 bp, Homo sapiens
gagtctcttctccac

SEQ ID NO: 5616025 - DNA, 23 bp, Homo sapiens
gagtctgaagcagatgcaaagag

SEQ ID NO: 5616026 - DNA, 15 bp, Homo sapiens
gagtctgaagcctgc

SEQ ID NO: 5616027 - DNA, 15 bp, Homo sapiens
gagtctgaaggagag

SEQ ID NO: 5616028 - DNA, 20 bp, Homo sapiens
gagtctgaaggagaggagtg

SEQ ID NO: 5616029 - DNA, 14 bp, Homo sapiens
gagtctgacaggaa

SEQ ID NO: 5616030 - DNA, 15 bp, Homo sapiens
gagtctgacaggaag

SEQ ID NO: 5616031 - DNA, 20 bp, Homo sapiens
gagtctgacaggaagactgg

SEQ ID NO: 5616032 - DNA, 22 bp, Homo sapiens
gagtctgaggactgtcctccca

SEQ ID NO: 5616033 - DNA, 23 bp, Homo sapiens
gagtctgaggccgttgctgactt

SEQ ID NO: 5616034 - DNA, 13 bp, Homo sapiens
gagtctgaggtcc

SEQ ID NO: 5616035 - DNA, 15 bp, Homo sapiens
gagtctgaggtcctg

SEQ ID NO: 5616036 - DNA, 16 bp, Homo sapiens
gagtctgaggtcctga

SEQ ID NO: 5616037 - DNA, 17 bp, Homo sapiens
gagtctgaggtcctgag

SEQ ID NO: 5616038 - DNA, 14 bp, Homo sapiens
gagtctgagtcctg

SEQ ID NO: 5616039 - DNA, 12 bp, Homo sapiens
gagtctgatgat

SEQ ID NO: 5616040 - DNA, 20 bp, Homo sapiens
gagtctgccagggcccctct

SEQ ID NO: 5616041 - DNA, 21 bp, Homo sapiens
gagtctgccagggcccctctc

SEQ ID NO: 5616042 - DNA, 21 bp, Homo sapiens
gagtctgctatattttcatga

SEQ ID NO: 5616043 - DNA, 14 bp, Homo sapiens
gagtctggaatgct

SEQ ID NO: 5616044 - DNA, 16 bp, Homo sapiens
gagtctggacctccat

SEQ ID NO: 5616045 - DNA, 12 bp, Homo sapiens
gagtctggagac

SEQ ID NO: 5616046 - DNA, 19 bp, Homo sapiens
gagtctggagaccaggact

SEQ ID NO: 5616047 - DNA, 17 bp, Homo sapiens
gagtctggagtgggcag

SEQ ID NO: 5616048 - DNA, 22 bp, Homo sapiens
gagtctggcaaacatgtgcaac

SEQ ID NO: 5616049 - DNA, 17 bp, Homo sapiens
gagtctggccctagact

SEQ ID NO: 5616050 - DNA, 14 bp, Homo sapiens
gagtctggcctgcc

SEQ ID NO: 5616051 - DNA, 20 bp, Homo sapiens
gagtctggctctgtcgccca

SEQ ID NO: 5616052 - DNA, 11 bp, Homo sapiens
gagtctgggac

SEQ ID NO: 5616053 - DNA, 23 bp, Homo sapiens
gagtctgggcaatgaaaccaaag

SEQ ID NO: 5616054 - DNA, 15 bp, Homo sapiens
gagtctggggacctg

SEQ ID NO: 5616055 - DNA, 21 bp, Homo sapiens
gagtctggggacctggcactg

SEQ ID NO: 5616056 - DNA, 15 bp, Homo sapiens
gagtctgtcataata

SEQ ID NO: 5616057 - DNA, 20 bp, Homo sapiens
gagtctgtccagataagtta

SEQ ID NO: 5616058 - DNA, 13 bp, Homo sapiens
gagtctgtctctt

SEQ ID NO: 5616059 - DNA, 21 bp, Homo sapiens
gagtctgtgaataaagccaca

SEQ ID NO: 5616060 - DNA, 14 bp, Homo sapiens
gagtctgtgctctt

SEQ ID NO: 5616061 - DNA, 11 bp, Homo sapiens
gagtctgtgtg

SEQ ID NO: 5616062 - DNA, 12 bp, Homo sapiens
gagtctgtgtgt

SEQ ID NO: 5616063 - DNA, 19 bp, Homo sapiens
gagtctgtgtgtagccagg

SEQ ID NO: 5616064 - DNA, 20 bp, Homo sapiens
gagtctgtttcccaagctag

SEQ ID NO: 5616065 - DNA, 17 bp, Homo sapiens
gagtctgttttgtaaag

SEQ ID NO: 5616066 - DNA, 22 bp, Homo sapiens
gagtcttaagggtcactggcct

SEQ ID NO: 5616067 - DNA, 14 bp, Homo sapiens
gagtcttaataaaa

SEQ ID NO: 5616068 - DNA, 21 bp, Homo sapiens
gagtcttatatcccaggtgag

SEQ ID NO: 5616069 - DNA, 19 bp, Homo sapiens
gagtcttcacatttagaat

SEQ ID NO: 5616070 - DNA, 14 bp, Homo sapiens
gagtcttcagaccc

SEQ ID NO: 5616071 - DNA, 11 bp, Homo sapiens
gagtcttcatg

SEQ ID NO: 5616072 - DNA, 18 bp, Homo sapiens
gagtcttccaaggccaga

SEQ ID NO: 5616073 - DNA, 17 bp, Homo sapiens
gagtcttccaggtgcct

SEQ ID NO: 5616074 - DNA, 20 bp, Homo sapiens
gagtcttgctctgtctccca

SEQ ID NO: 5616075 - DNA, 16 bp, Homo sapiens
gagtcttggcctgcct

SEQ ID NO: 5616076 - DNA, 21 bp, Homo sapiens
gagtcttggcggcagcagcca

SEQ ID NO: 5616077 - DNA, 16 bp, Homo sapiens
gagtcttgggcctggc

SEQ ID NO: 5616078 - DNA, 13 bp, Homo sapiens
gagtcttggttct

SEQ ID NO: 5616079 - DNA, 17 bp, Homo sapiens
gagtcttggttctaaag

SEQ ID NO: 5616080 - DNA, 19 bp, Homo sapiens
gagtcttggtttctctcta

SEQ ID NO: 5616081 - DNA, 22 bp, Homo sapiens
gagtcttggtttctctctacag

SEQ ID NO: 5616082 - DNA, 15 bp, Homo sapiens
gagtcttgtgaaagt

SEQ ID NO: 5616083 - DNA, 19 bp, Homo sapiens
gagtctttcattcggtgtg

SEQ ID NO: 5616084 - DNA, 23 bp, Homo sapiens
gagtctttcattcggtgtgaact

SEQ ID NO: 5616085 - DNA, 15 bp, Homo sapiens
gagtctttctcactg

SEQ ID NO: 5616086 - DNA, 14 bp, Homo sapiens
gagtctttggttct

SEQ ID NO: 5616087 - DNA, 16 bp, Homo sapiens
gagtctttggttctaa

SEQ ID NO: 5616088 - DNA, 18 bp, Homo sapiens
gagtctttggttctaagg

SEQ ID NO: 5616089 - DNA, 14 bp, Homo sapiens
gagtctttgtgtgt

SEQ ID NO: 5616090 - DNA, 15 bp, Homo sapiens
gagtctttttagtgt

SEQ ID NO: 5616091 - DNA, 23 bp, Homo sapiens
gagtgaaaaatcttaagtaccaa

SEQ ID NO: 5616092 - DNA, 13 bp, Homo sapiens
gagtgaaacagag

SEQ ID NO: 5616093 - DNA, 19 bp, Homo sapiens
gagtgaaacagagaaagaa

SEQ ID NO: 5616094 - DNA, 22 bp, Homo sapiens
gagtgaaaccatgactgtgacc

SEQ ID NO: 5616095 - DNA, 22 bp, Homo sapiens
gagtgaaacctttagggcagct

SEQ ID NO: 5616096 - DNA, 18 bp, Homo sapiens
gagtgaaagggctatggc

SEQ ID NO: 5616097 - DNA, 22 bp, Homo sapiens
gagtgaaagggctatggcaagg

SEQ ID NO: 5616098 - DNA, 12 bp, Homo sapiens
gagtgaaatact

SEQ ID NO: 5616099 - DNA, 15 bp, Homo sapiens
gagtgaaatattgta

SEQ ID NO: 5616100 - DNA, 17 bp, Homo sapiens
gagtgaaatattgtaaa

SEQ ID NO: 5616101 - DNA, 16 bp, Homo sapiens
gagtgaacctaccttc

SEQ ID NO: 5616102 - DNA, 21 bp, Homo sapiens
gagtgaactggtcttcctttt

SEQ ID NO: 5616103 - DNA, 14 bp, Homo sapiens
gagtgaagaggggc

SEQ ID NO: 5616104 - DNA, 21 bp, Homo sapiens
gagtgaagaggggcagccctt

SEQ ID NO: 5616105 - DNA, 16 bp, Homo sapiens
gagtgaagagtgaaga

SEQ ID NO: 5616106 - DNA, 17 bp, Homo sapiens
gagtgaagctgggagaa

SEQ ID NO: 5616107 - DNA, 22 bp, Homo sapiens
gagtgaagtattgctgaaaagt

SEQ ID NO: 5616108 - DNA, 22 bp, Homo sapiens
gagtgaagtccagtgaccctgg

SEQ ID NO: 5616109 - DNA, 14 bp, Homo sapiens
gagtgaataaatgt

SEQ ID NO: 5616110 - DNA, 17 bp, Homo sapiens
gagtgaatcaggcaaag

SEQ ID NO: 5616111 - DNA, 17 bp, Homo sapiens
gagtgaatgccagtgtg

SEQ ID NO: 5616112 - DNA, 23 bp, Homo sapiens
gagtgaatgccatttagaatcta

SEQ ID NO: 5616113 - DNA, 17 bp, Homo sapiens
gagtgaatgtggcagtt

SEQ ID NO: 5616114 - DNA, 23 bp, Homo sapiens
gagtgaattgtacctatttctga

SEQ ID NO: 5616115 - DNA, 14 bp, Homo sapiens
gagtgaatttcagt

SEQ ID NO: 5616116 - DNA, 21 bp, Homo sapiens
gagtgacagagcgagactcca

SEQ ID NO: 5616117 - DNA, 15 bp, Homo sapiens
gagtgacagaggcag

SEQ ID NO: 5616118 - DNA, 18 bp, Homo sapiens
gagtgacagaggcagccc

SEQ ID NO: 5616119 - DNA, 14 bp, Homo sapiens
gagtgacagagtaa

SEQ ID NO: 5616120 - DNA, 16 bp, Homo sapiens
gagtgacagctttctg

SEQ ID NO: 5616121 - DNA, 17 bp, Homo sapiens
gagtgacagctttctgg

SEQ ID NO: 5616122 - DNA, 19 bp, Homo sapiens
gagtgacagctttctggga

SEQ ID NO: 5616123 - DNA, 16 bp, Homo sapiens
gagtgacaggcaccag

SEQ ID NO: 5616124 - DNA, 13 bp, Homo sapiens
gagtgacatgaag

SEQ ID NO: 5616125 - DNA, 15 bp, Homo sapiens
gagtgacatgaagca

SEQ ID NO: 5616126 - DNA, 11 bp, Homo sapiens
gagtgacatgg

SEQ ID NO: 5616127 - DNA, 13 bp, Homo sapiens
gagtgaccctcag

SEQ ID NO: 5616128 - DNA, 22 bp, Homo sapiens
gagtgaccgggcactggcactg

SEQ ID NO: 5616129 - DNA, 22 bp, Homo sapiens
gagtgaccgggggctgctgggc

SEQ ID NO: 5616130 - DNA, 16 bp, Homo sapiens
gagtgacctaaagcat

SEQ ID NO: 5616131 - DNA, 21 bp, Homo sapiens
gagtgacctcggacagagccc

SEQ ID NO: 5616132 - DNA, 15 bp, Homo sapiens
gagtgacggctggca

SEQ ID NO: 5616133 - DNA, 18 bp, Homo sapiens
gagtgacggctggcatgg

SEQ ID NO: 5616134 - DNA, 18 bp, Homo sapiens
gagtgacgggagcctcct

SEQ ID NO: 5616135 - DNA, 17 bp, Homo sapiens
gagtgactccaagaaca

SEQ ID NO: 5616136 - DNA, 23 bp, Homo sapiens
gagtgactcggtgtaaaaccatg

SEQ ID NO: 5616137 - DNA, 13 bp, Homo sapiens
gagtgactctcca

SEQ ID NO: 5616138 - DNA, 18 bp, Homo sapiens
gagtgactctggctgcca

SEQ ID NO: 5616139 - DNA, 19 bp, Homo sapiens
gagtgactctggctgccaa

SEQ ID NO: 5616140 - DNA, 18 bp, Homo sapiens
gagtgacttattttgtct

SEQ ID NO: 5616141 - DNA, 14 bp, Homo sapiens
gagtgagaacagca

SEQ ID NO: 5616142 - DNA, 18 bp, Homo sapiens
gagtgagactctgtctca

SEQ ID NO: 5616143 - DNA, 13 bp, Homo sapiens
gagtgagactgac

SEQ ID NO: 5616144 - DNA, 13 bp, Homo sapiens
gagtgagagagag

SEQ ID NO: 5616145 - DNA, 14 bp, Homo sapiens
gagtgagagccttt

SEQ ID NO: 5616146 - DNA, 19 bp, Homo sapiens
gagtgagaggggaggccaa

SEQ ID NO: 5616147 - DNA, 24 bp, Homo sapiens
gagtgagcactaaggtgtgctctg

SEQ ID NO: 5616148 - DNA, 23 bp, Homo sapiens
gagtgagcagtagaagcctgcag

SEQ ID NO: 5616149 - DNA, 13 bp, Homo sapiens
gagtgagcctggc

SEQ ID NO: 5616150 - DNA, 15 bp, Homo sapiens
gagtgagctacagag

SEQ ID NO: 5616151 - DNA, 22 bp, Homo sapiens
gagtgagctacagagccgagca

SEQ ID NO: 5616152 - DNA, 19 bp, Homo sapiens
gagtgagctaccaggaaga

SEQ ID NO: 5616153 - DNA, 19 bp, Homo sapiens
gagtgaggaatggcagtga

SEQ ID NO: 5616154 - DNA, 17 bp, Homo sapiens
gagtgaggcaggtgaca

SEQ ID NO: 5616155 - DNA, 20 bp, Homo sapiens
gagtgagggagacaggaacg

SEQ ID NO: 5616156 - DNA, 11 bp, Homo sapiens
gagtgaggggt

SEQ ID NO: 5616157 - DNA, 21 bp, Homo sapiens
gagtgaggggtaaaagctgat

SEQ ID NO: 5616158 - DNA, 22 bp, Homo sapiens
gagtgagggtttctgagctgct

SEQ ID NO: 5616159 - DNA, 16 bp, Homo sapiens
gagtgaggtcatcccg

SEQ ID NO: 5616160 - DNA, 20 bp, Homo sapiens
gagtgaggtcatcccggggc

SEQ ID NO: 5616161 - DNA, 15 bp, Homo sapiens
gagtgagtcacctgc

SEQ ID NO: 5616162 - DNA, 13 bp, Homo sapiens
gagtgagtgtatg

SEQ ID NO: 5616163 - DNA, 19 bp, Homo sapiens
gagtgagtgtggctcccct

SEQ ID NO: 5616164 - DNA, 21 bp, Homo sapiens
gagtgagttgggtgtattgtg

SEQ ID NO: 5616165 - DNA, 22 bp, Homo sapiens
gagtgataatattgtttccctc

SEQ ID NO: 5616166 - DNA, 22 bp, Homo sapiens
gagtgatacaacttcaagtgca

SEQ ID NO: 5616167 - DNA, 22 bp, Homo sapiens
gagtgatcctcccgccccagcc

SEQ ID NO: 5616168 - DNA, 23 bp, Homo sapiens
gagtgatctcaaatccactgaca

SEQ ID NO: 5616169 - DNA, 23 bp, Homo sapiens
gagtgatctcagctcactgcaac

SEQ ID NO: 5616170 - DNA, 10 bp, Homo sapiens
gagtgatctt

SEQ ID NO: 5616171 - DNA, 19 bp, Homo sapiens
gagtgatgatttgggggag

SEQ ID NO: 5616172 - DNA, 22 bp, Homo sapiens
gagtgatgggcaaggggccagg

SEQ ID NO: 5616173 - DNA, 20 bp, Homo sapiens
gagtgatgtagcgtaacaaa

SEQ ID NO: 5616174 - DNA, 15 bp, Homo sapiens
gagtgattagagctg

SEQ ID NO: 5616175 - DNA, 15 bp, Homo sapiens
gagtgattcaggggc

SEQ ID NO: 5616176 - DNA, 24 bp, Homo sapiens
gagtgattgaaccagctcatctcc

SEQ ID NO: 5616177 - DNA, 20 bp, Homo sapiens
gagtgatttgtaaaacagtg

SEQ ID NO: 5616178 - DNA, 21 bp, Homo sapiens
gagtgcaaatccatagcacaa

SEQ ID NO: 5616179 - DNA, 14 bp, Homo sapiens
gagtgcaaattgta

SEQ ID NO: 5616180 - DNA, 15 bp, Homo sapiens
gagtgcaagagcctg

SEQ ID NO: 5616181 - DNA, 22 bp, Homo sapiens
gagtgcaagagcctgagactgg

SEQ ID NO: 5616182 - DNA, 16 bp, Homo sapiens
gagtgcaagcaaagca

SEQ ID NO: 5616183 - DNA, 17 bp, Homo sapiens
gagtgcaagcaaagcag

SEQ ID NO: 5616184 - DNA, 14 bp, Homo sapiens
gagtgcacagctgt

SEQ ID NO: 5616185 - DNA, 16 bp, Homo sapiens
gagtgcacagctgtcc

SEQ ID NO: 5616186 - DNA, 14 bp, Homo sapiens
gagtgcacctgcct

SEQ ID NO: 5616187 - DNA, 17 bp, Homo sapiens
gagtgcactcctggtga

SEQ ID NO: 5616188 - DNA, 19 bp, Homo sapiens
gagtgcagaggctgagcag

SEQ ID NO: 5616189 - DNA, 23 bp, Homo sapiens
gagttggacttcagtcttgccta

SEQ ID NO: 5616190 - DNA, 20 bp, Homo sapiens
gagttggagacccgcctggc

SEQ ID NO: 5616191 - DNA, 22 bp, Homo sapiens
gagttggagtactatatttaca

SEQ ID NO: 5616192 - DNA, 16 bp, Homo sapiens
gagttggcattgcatt

SEQ ID NO: 5616193 - DNA, 18 bp, Homo sapiens
gagttggctcaggcagac

SEQ ID NO: 5616194 - DNA, 12 bp, Homo sapiens
gagttggctgtg

SEQ ID NO: 5616195 - DNA, 13 bp, Homo sapiens
gagttggctgtgt

SEQ ID NO: 5616196 - DNA, 17 bp, Homo sapiens
gagttgggcaaaaccca

SEQ ID NO: 5616197 - DNA, 21 bp, Homo sapiens
gagttgggcaaaacccaggac

SEQ ID NO: 5616198 - DNA, 14 bp, Homo sapiens
gagttgggctggtt

SEQ ID NO: 5616199 - DNA, 23 bp, Homo sapiens
gagttggggagaaactgaagccg

SEQ ID NO: 5616200 - DNA, 14 bp, Homo sapiens
gagttgggggcagg

SEQ ID NO: 5616201 - DNA, 20 bp, Homo sapiens
gagttgggggcaggtcagga

SEQ ID NO: 5616202 - DNA, 14 bp, Homo sapiens
gagttgggggccag

SEQ ID NO: 5616203 - DNA, 16 bp, Homo sapiens
gagttgggggccagca

SEQ ID NO: 5616204 - DNA, 11 bp, Homo sapiens
gagttgggggt

SEQ ID NO: 5616205 - DNA, 19 bp, Homo sapiens
gagttgggggtattttcta

SEQ ID NO: 5616206 - DNA, 14 bp, Homo sapiens
gagttgtaaatata

SEQ ID NO: 5616207 - DNA, 15 bp, Homo sapiens
gagttgtaaatatat

SEQ ID NO: 5616208 - DNA, 22 bp, Homo sapiens
gagttgtacctccattggcttc

SEQ ID NO: 5616209 - DNA, 19 bp, Homo sapiens
gagttgtcctgatgttttt

SEQ ID NO: 5616210 - DNA, 21 bp, Homo sapiens
gagttgtcgtttttagctttg

SEQ ID NO: 5616211 - DNA, 16 bp, Homo sapiens
gagttgtctctgttgg

SEQ ID NO: 5616212 - DNA, 23 bp, Homo sapiens
gagttgtgagcactctactgcaa

SEQ ID NO: 5616213 - DNA, 15 bp, Homo sapiens
gagttgtgatggagg

SEQ ID NO: 5616214 - DNA, 12 bp, Homo sapiens
gagttgtgcctc

SEQ ID NO: 5616215 - DNA, 23 bp, Homo sapiens
gagttgtgtgaataccccaagac

SEQ ID NO: 5616216 - DNA, 16 bp, Homo sapiens
gagttgtgttgttctt

SEQ ID NO: 5616217 - DNA, 22 bp, Homo sapiens
gagttgttacatttttaagtgc

SEQ ID NO: 5616218 - DNA, 14 bp, Homo sapiens
gagttgttatgcca

SEQ ID NO: 5616219 - DNA, 23 bp, Homo sapiens
gagttgttcctagaggagacagc

SEQ ID NO: 5616220 - DNA, 16 bp, Homo sapiens
gagttgttctcagggg

SEQ ID NO: 5616221 - DNA, 20 bp, Homo sapiens
gagttgttttggtgcctgcc

SEQ ID NO: 5616222 - DNA, 14 bp, Homo sapiens
gagtttaaaaatca

SEQ ID NO: 5616223 - DNA, 13 bp, Homo sapiens
gagtttaaaagca

SEQ ID NO: 5616224 - DNA, 20 bp, Homo sapiens
gagtttaaaatcatcagaaa

SEQ ID NO: 5616225 - DNA, 18 bp, Homo sapiens
gagtttaaagagaaaagg

SEQ ID NO: 5616226 - DNA, 20 bp, Homo sapiens
gagtttaactttgggcccag

SEQ ID NO: 5616227 - DNA, 17 bp, Homo sapiens
gagtttaagaccagcct

SEQ ID NO: 5616228 - DNA, 15 bp, Homo sapiens
gagtttaatcttttc

SEQ ID NO: 5616229 - DNA, 14 bp, Homo sapiens
gagtttacaaagat

SEQ ID NO: 5616230 - DNA, 11 bp, Homo sapiens
gagtttacagt

SEQ ID NO: 5616231 - DNA, 23 bp, Homo sapiens
gagtttacagtttgtgttttaaa

SEQ ID NO: 5616232 - DNA, 20 bp, Homo sapiens
gagtttaccatttgtaataa

SEQ ID NO: 5616233 - DNA, 21 bp, Homo sapiens
gagtttagtgatctgaacaga

SEQ ID NO: 5616234 - DNA, 18 bp, Homo sapiens
gagtttatacagtgtaca

SEQ ID NO: 5616235 - DNA, 21 bp, Homo sapiens
gagtttatacagtgtacatgt

SEQ ID NO: 5616236 - DNA, 18 bp, Homo sapiens
gagtttatgttccattaa

SEQ ID NO: 5616237 - DNA, 13 bp, Homo sapiens
gagtttattacaa

SEQ ID NO: 5616238 - DNA, 23 bp, Homo sapiens
gagtttattacaatgtatcttta

SEQ ID NO: 5616239 - DNA, 22 bp, Homo sapiens
gagtttatttttttgatggcta

SEQ ID NO: 5616240 - DNA, 21 bp, Homo sapiens
gagtttcactgtactgcatgt

SEQ ID NO: 5616241 - DNA, 17 bp, Homo sapiens
gagtttcagctggaaac

SEQ ID NO: 5616242 - DNA, 18 bp, Homo sapiens
gagtttcagctttcttca

SEQ ID NO: 5616243 - DNA, 11 bp, Homo sapiens
gagtttcatgt

SEQ ID NO: 5616244 - DNA, 12 bp, Homo sapiens
gagtttcccttc

SEQ ID NO: 5616245 - DNA, 12 bp, Homo sapiens
gagtttctaagg

SEQ ID NO: 5616246 - DNA, 13 bp, Homo sapiens
gagtttctaaggt

SEQ ID NO: 5616247 - DNA, 14 bp, Homo sapiens
gagtttctctaaag

SEQ ID NO: 5616248 - DNA, 12 bp, Homo sapiens
gagtttctctct

SEQ ID NO: 5616249 - DNA, 18 bp, Homo sapiens
gagtttctggctgaaaat

SEQ ID NO: 5616250 - DNA, 14 bp, Homo sapiens
gagtttctgtttga

SEQ ID NO: 5616251 - DNA, 20 bp, Homo sapiens
gagtttgaaaaactaattga

SEQ ID NO: 5616252 - DNA, 22 bp, Homo sapiens
gagtttgaaggaggtgagggat

SEQ ID NO: 5616253 - DNA, 22 bp, Homo sapiens
gagtttgagacaagccctggca

SEQ ID NO: 5616254 - DNA, 17 bp, Homo sapiens
gagtttgagaccagcct

SEQ ID NO: 5616255 - DNA, 19 bp, Homo sapiens
gagtttgatcatagaattg

SEQ ID NO: 5616256 - DNA, 20 bp, Homo sapiens
gagtttgcctccctgcactt

SEQ ID NO: 5616257 - DNA, 21 bp, Homo sapiens
gagtttgctaaattgagaggg

SEQ ID NO: 5616258 - DNA, 22 bp, Homo sapiens
gagtttgctgtatacaaacagg

SEQ ID NO: 5616259 - DNA, 20 bp, Homo sapiens
gagtttgctgttgaggtggc

SEQ ID NO: 5616260 - DNA, 18 bp, Homo sapiens
gagtttggaaggtgtcca

SEQ ID NO: 5616261 - DNA, 19 bp, Homo sapiens
gagtttggagagagcagac

SEQ ID NO: 5616262 - DNA, 22 bp, Homo sapiens
gagtttggagagagcagactgg

SEQ ID NO: 5616263 - DNA, 16 bp, Homo sapiens
gagtttggtctggact

SEQ ID NO: 5616264 - DNA, 17 bp, Homo sapiens
gagtttggtctggactg

SEQ ID NO: 5616265 - DNA, 21 bp, Homo sapiens
gagtttggttaatcagtgttg

SEQ ID NO: 5616266 - DNA, 21 bp, Homo sapiens
gagtttgtaaaattgttcctg

SEQ ID NO: 5616267 - DNA, 18 bp, Homo sapiens
gagtttgtcgctcatgtg

SEQ ID NO: 5616268 - DNA, 12 bp, Homo sapiens
gagtttgtttct

SEQ ID NO: 5616269 - DNA, 16 bp, Homo sapiens
gagttttaacaatcca

SEQ ID NO: 5616270 - DNA, 12 bp, Homo sapiens
gagttttaacac

SEQ ID NO: 5616271 - DNA, 18 bp, Homo sapiens
gagttttattcctttcct

SEQ ID NO: 5616272 - DNA, 21 bp, Homo sapiens
gagttttctctttgtggggct

SEQ ID NO: 5616273 - DNA, 12 bp, Homo sapiens
gagttttcttat

SEQ ID NO: 5616274 - DNA, 14 bp, Homo sapiens
gagttttcttcctt

SEQ ID NO: 5616275 - DNA, 14 bp, Homo sapiens
gagttttctttagt

SEQ ID NO: 5616276 - DNA, 16 bp, Homo sapiens
gagttttggatgcagt

SEQ ID NO: 5616277 - DNA, 13 bp, Homo sapiens
gagttttgtagca

SEQ ID NO: 5616278 - DNA, 13 bp, Homo sapiens
gagttttgtgttt

SEQ ID NO: 5616279 - DNA, 18 bp, Homo sapiens
gagttttgtttcactttg

SEQ ID NO: 5616280 - DNA, 20 bp, Homo sapiens
gagttttgttttttgtttct

SEQ ID NO: 5616281 - DNA, 16 bp, Homo sapiens
gagtttttaatagaac

SEQ ID NO: 5616282 - DNA, 16 bp, Homo sapiens
gagtttttatgccttt

SEQ ID NO: 5616283 - DNA, 20 bp, Homo sapiens
gagtttttatgcctttctct

SEQ ID NO: 5616284 - DNA, 19 bp, Homo sapiens
gagtttttatggggctgaa

SEQ ID NO: 5616285 - DNA, 20 bp, Homo sapiens
gagtttttcctcccagtgag

SEQ ID NO: 5616286 - DNA, 17 bp, Homo sapiens
gataaaaaagaaaacat

SEQ ID NO: 5616287 - DNA, 19 bp, Homo sapiens
gataaaaaattttgtaatt

SEQ ID NO: 5616288 - DNA, 20 bp, Homo sapiens
gataaaaacccaaaatacag

SEQ ID NO: 5616289 - DNA, 22 bp, Homo sapiens
gataaaaacccaaaatacagct

SEQ ID NO: 5616290 - DNA, 17 bp, Homo sapiens
gataaaaaggaaggaga

SEQ ID NO: 5616291 - DNA, 14 bp, Homo sapiens
gataaaaataaagc

SEQ ID NO: 5616292 - DNA, 13 bp, Homo sapiens
gataaaaataata

SEQ ID NO: 5616293 - DNA, 20 bp, Homo sapiens
gataaaaataataataaagt

SEQ ID NO: 5616294 - DNA, 19 bp, Homo sapiens
gataaaacacgccacagcc

SEQ ID NO: 5616295 - DNA, 21 bp, Homo sapiens
gataaaacatctttgaaatta

SEQ ID NO: 5616296 - DNA, 17 bp, Homo sapiens
gataaaacattagaaga

SEQ ID NO: 5616297 - DNA, 22 bp, Homo sapiens
gataaaactgggcctgtagctc

SEQ ID NO: 5616298 - DNA, 13 bp, Homo sapiens
gataaaactgtgt

SEQ ID NO: 5616299 - DNA, 17 bp, Homo sapiens
gataaaactgtgtaaac

SEQ ID NO: 5616300 - DNA, 21 bp, Homo sapiens
gataaaactgtgtaaaccaca

SEQ ID NO: 5616301 - DNA, 23 bp, Homo sapiens
gataaaagaatggccaaaccctc

SEQ ID NO: 5616302 - DNA, 16 bp, Homo sapiens
gataaaagatacattt

SEQ ID NO: 5616303 - DNA, 16 bp, Homo sapiens
gataaaagatggccat

SEQ ID NO: 5616304 - DNA, 22 bp, Homo sapiens
gataaaagcaattctgactgtc

SEQ ID NO: 5616305 - DNA, 19 bp, Homo sapiens
gataaaagggcaaatctgc

SEQ ID NO: 5616306 - DNA, 12 bp, Homo sapiens
gataaaataagt

SEQ ID NO: 5616307 - DNA, 21 bp, Homo sapiens
gataaaataagtaacatataa

SEQ ID NO: 5616308 - DNA, 19 bp, Homo sapiens
gataaaatcataagtattt

SEQ ID NO: 5616309 - DNA, 16 bp, Homo sapiens
gataaaatcttcaact

SEQ ID NO: 5616310 - DNA, 12 bp, Homo sapiens
gataaaatgatg

SEQ ID NO: 5616311 - DNA, 16 bp, Homo sapiens
gataaaatgttccttt

SEQ ID NO: 5616312 - DNA, 18 bp, Homo sapiens
gataaaattgtgatgttt

SEQ ID NO: 5616313 - DNA, 22 bp, Homo sapiens
gataaacacaaaatccattcca

SEQ ID NO: 5616314 - DNA, 14 bp, Homo sapiens
gataaacacaagat

SEQ ID NO: 5616315 - DNA, 23 bp, Homo sapiens
gataaacacagaggttttaaaca

SEQ ID NO: 5616316 - DNA, 18 bp, Homo sapiens
gataaacacaggcaggta

SEQ ID NO: 5616317 - DNA, 18 bp, Homo sapiens
gataaacatcacatgaga

SEQ ID NO: 5616318 - DNA, 13 bp, Homo sapiens
gataaacattcat

SEQ ID NO: 5616319 - DNA, 17 bp, Homo sapiens
gataaaccaaaaacatt

SEQ ID NO: 5616320 - DNA, 18 bp, Homo sapiens
gataaacctagataaaga

SEQ ID NO: 5616321 - DNA, 22 bp, Homo sapiens
gataaacctgctccaaggcagt

SEQ ID NO: 5616322 - DNA, 18 bp, Homo sapiens
gataaactgatgtttgaa

SEQ ID NO: 5616323 - DNA, 14 bp, Homo sapiens
gataaagaaaagaa

SEQ ID NO: 5616324 - DNA, 18 bp, Homo sapiens
gataaagaaaagacattt

SEQ ID NO: 5616325 - DNA, 13 bp, Homo sapiens
gataaagacagct

SEQ ID NO: 5616326 - DNA, 18 bp, Homo sapiens
gataaagacagctgacag

SEQ ID NO: 5616327 - DNA, 22 bp, Homo sapiens
gataaagagatacgaatttcta

SEQ ID NO: 5616328 - DNA, 15 bp, Homo sapiens
gataaagatatcaat

SEQ ID NO: 5616329 - DNA, 22 bp, Homo sapiens
gataaagatgcaaggaccagga

SEQ ID NO: 5616330 - DNA, 13 bp, Homo sapiens
gataaagattgtg

SEQ ID NO: 5616331 - DNA, 19 bp, Homo sapiens
gataaagattttttaataa

SEQ ID NO: 5616332 - DNA, 17 bp, Homo sapiens
gataaagcctcaaggtt

SEQ ID NO: 5616333 - DNA, 15 bp, Homo sapiens
gataaaggaaacata

SEQ ID NO: 5616334 - DNA, 14 bp, Homo sapiens
gataaaggcttagg

SEQ ID NO: 5616335 - DNA, 22 bp, Homo sapiens
gataaagtaacagtatgtcaga

SEQ ID NO: 5616336 - DNA, 15 bp, Homo sapiens
gataaagtaataatg

SEQ ID NO: 5616337 - DNA, 15 bp, Homo sapiens
gataaagtagtaaaa

SEQ ID NO: 5616338 - DNA, 14 bp, Homo sapiens
gataaagtgaccag

SEQ ID NO: 5616339 - DNA, 13 bp, Homo sapiens
gataaagtggaat

SEQ ID NO: 5616340 - DNA, 15 bp, Homo sapiens
gataaagttccttaa

SEQ ID NO: 5616341 - DNA, 14 bp, Homo sapiens
gataaagtttctca

SEQ ID NO: 5616342 - DNA, 21 bp, Homo sapiens
gataaataacttttttttaag

SEQ ID NO: 5616343 - DNA, 23 bp, Homo sapiens
gataaataataaaggttctatga

SEQ ID NO: 5616344 - DNA, 19 bp, Homo sapiens
gataaatacatttatattt

SEQ ID NO: 5616345 - DNA, 22 bp, Homo sapiens
gataaatagtttatgattccac

SEQ ID NO: 5616346 - DNA, 13 bp, Homo sapiens
gataaatatatat

SEQ ID NO: 5616347 - DNA, 17 bp, Homo sapiens
gataaatatcattatag

SEQ ID NO: 5616348 - DNA, 22 bp, Homo sapiens
gataaatatcattatagcatgt

SEQ ID NO: 5616349 - DNA, 21 bp, Homo sapiens
gataaatattgagcagatcta

SEQ ID NO: 5616350 - DNA, 13 bp, Homo sapiens
gataaatatttat

SEQ ID NO: 5616351 - DNA, 21 bp, Homo sapiens
gataaatccttaacatttctc

SEQ ID NO: 5616352 - DNA, 22 bp, Homo sapiens
gataaatccttaacatttctct

SEQ ID NO: 5616353 - DNA, 14 bp, Homo sapiens
gataaatgaaataa

SEQ ID NO: 5616354 - DNA, 15 bp, Homo sapiens
gataaatgatagaca

SEQ ID NO: 5616355 - DNA, 11 bp, Homo sapiens
gataaatgcca

SEQ ID NO: 5616356 - DNA, 14 bp, Homo sapiens
gataaatgctttaa

SEQ ID NO: 5616357 - DNA, 15 bp, Homo sapiens
gataaattacattaa

SEQ ID NO: 5616358 - DNA, 18 bp, Homo sapiens
gataaattactataaaga

SEQ ID NO: 5616359 - DNA, 13 bp, Homo sapiens
gataaattataag

SEQ ID NO: 5616360 - DNA, 17 bp, Homo sapiens
gataaattgccataata

SEQ ID NO: 5616361 - DNA, 18 bp, Homo sapiens
gataaattgccataatat

SEQ ID NO: 5616362 - DNA, 15 bp, Homo sapiens
gataaatttaaaaca

SEQ ID NO: 5616363 - DNA, 20 bp, Homo sapiens
gataaatttaaaacacagta

SEQ ID NO: 5616364 - DNA, 15 bp, Homo sapiens
gataacaaaaaataa

SEQ ID NO: 5616365 - DNA, 16 bp, Homo sapiens
gataacaaaaaataaa

SEQ ID NO: 5616366 - DNA, 17 bp, Homo sapiens
gataacaaaaaataaat

SEQ ID NO: 5616367 - DNA, 17 bp, Homo sapiens
gatagccgggctccagg

SEQ ID NO: 5616368 - DNA, 15 bp, Homo sapiens
gatagcctagggtga

SEQ ID NO: 5616369 - DNA, 14 bp, Homo sapiens
gatagcctgtggcc

SEQ ID NO: 5616370 - DNA, 17 bp, Homo sapiens
gatagccttgaaaacaa

SEQ ID NO: 5616371 - DNA, 19 bp, Homo sapiens
gatagccttgaaaacaaac

SEQ ID NO: 5616372 - DNA, 22 bp, Homo sapiens
gatagcgaatgcactcagggtc

SEQ ID NO: 5616373 - DNA, 14 bp, Homo sapiens
gatagcgttggaat

SEQ ID NO: 5616374 - DNA, 14 bp, Homo sapiens
gatagctaaataac

SEQ ID NO: 5616375 - DNA, 18 bp, Homo sapiens
gatagctaacattttaaa

SEQ ID NO: 5616376 - DNA, 22 bp, Homo sapiens
gatagctaacattttaaataaa

SEQ ID NO: 5616377 - DNA, 16 bp, Homo sapiens
gatagctaactgtaaa

SEQ ID NO: 5616378 - DNA, 20 bp, Homo sapiens
gatagctaactgtaaatcat

SEQ ID NO: 5616379 - DNA, 18 bp, Homo sapiens
gatagctactaaatatat

SEQ ID NO: 5616380 - DNA, 14 bp, Homo sapiens
gatagctccttcat

SEQ ID NO: 5616381 - DNA, 23 bp, Homo sapiens
gatagctgactcattcttttgga

SEQ ID NO: 5616382 - DNA, 13 bp, Homo sapiens
gatagctggggct

SEQ ID NO: 5616383 - DNA, 14 bp, Homo sapiens
gatagctggggctt

SEQ ID NO: 5616384 - DNA, 15 bp, Homo sapiens
gatagcttacactga

SEQ ID NO: 5616385 - DNA, 17 bp, Homo sapiens
gatagcttacactgagg

SEQ ID NO: 5616386 - DNA, 23 bp, Homo sapiens
gatagcttcaccccaatcccagc

SEQ ID NO: 5616387 - DNA, 23 bp, Homo sapiens
gatagcttccccaccagctttat

SEQ ID NO: 5616388 - DNA, 15 bp, Homo sapiens
gatagcttctcttct

SEQ ID NO: 5616389 - DNA, 16 bp, Homo sapiens
gatagcttgggattta

SEQ ID NO: 5616390 - DNA, 20 bp, Homo sapiens
gatagctttattttttaagt

SEQ ID NO: 5616391 - DNA, 19 bp, Homo sapiens
gataggaaaaatgagtaat

SEQ ID NO: 5616392 - DNA, 14 bp, Homo sapiens
gataggaaaagaag

SEQ ID NO: 5616393 - DNA, 15 bp, Homo sapiens
gataggaaactgaag

SEQ ID NO: 5616394 - DNA, 19 bp, Homo sapiens
gataggaagaaagaagaca

SEQ ID NO: 5616395 - DNA, 18 bp, Homo sapiens
gataggaaggtcatttcc

SEQ ID NO: 5616396 - DNA, 22 bp, Homo sapiens
gataggactccatttctttctt

SEQ ID NO: 5616397 - DNA, 17 bp, Homo sapiens
gataggagacttgtaca

SEQ ID NO: 5616398 - DNA, 13 bp, Homo sapiens
gataggagaggaa

SEQ ID NO: 5616399 - DNA, 14 bp, Homo sapiens
gataggagaggaaa

SEQ ID NO: 5616400 - DNA, 17 bp, Homo sapiens
gataggagcttccagat

SEQ ID NO: 5616401 - DNA, 15 bp, Homo sapiens
gataggcaaggatga

SEQ ID NO: 5616402 - DNA, 15 bp, Homo sapiens
gataggcagcactga

SEQ ID NO: 5616403 - DNA, 13 bp, Homo sapiens
gataggccagccg

SEQ ID NO: 5616404 - DNA, 15 bp, Homo sapiens
gataggcccaaggtc

SEQ ID NO: 5616405 - DNA, 14 bp, Homo sapiens
gataggcccctggg

SEQ ID NO: 5616406 - DNA, 23 bp, Homo sapiens
gataggcctgtgggccagattgc

SEQ ID NO: 5616407 - DNA, 14 bp, Homo sapiens
gataggctctgcac

SEQ ID NO: 5616408 - DNA, 20 bp, Homo sapiens
gataggctctgcacagatgg

SEQ ID NO: 5616409 - DNA, 22 bp, Homo sapiens
gatagggctgggcaaggaaaaa

SEQ ID NO: 5616410 - DNA, 14 bp, Homo sapiens
gatagggtggcaca

SEQ ID NO: 5616411 - DNA, 19 bp, Homo sapiens
gatagggtggcacatctgt

SEQ ID NO: 5616412 - DNA, 13 bp, Homo sapiens
gataggtaaattt

SEQ ID NO: 5616413 - DNA, 19 bp, Homo sapiens
gatagtagtaaaattagaa

SEQ ID NO: 5616414 - DNA, 15 bp, Homo sapiens
gatagtatcttttaa

SEQ ID NO: 5616415 - DNA, 15 bp, Homo sapiens
gatagtatttataat

SEQ ID NO: 5616416 - DNA, 13 bp, Homo sapiens
gatagtcacctgc

SEQ ID NO: 5616417 - DNA, 18 bp, Homo sapiens
gatagtccttcctggcat

SEQ ID NO: 5616418 - DNA, 16 bp, Homo sapiens
gatagtctgggtcaga

SEQ ID NO: 5616419 - DNA, 16 bp, Homo sapiens
gatagtcttcagtttc

SEQ ID NO: 5616420 - DNA, 23 bp, Homo sapiens
gatagtcttttgcttttggcaaa

SEQ ID NO: 5616421 - DNA, 13 bp, Homo sapiens
gatagtgagattt

SEQ ID NO: 5616422 - DNA, 15 bp, Homo sapiens
gatagtgcctctgca

SEQ ID NO: 5616423 - DNA, 20 bp, Homo sapiens
gatagtgtcccacggtgcct

SEQ ID NO: 5616424 - DNA, 16 bp, Homo sapiens
gatagtgttctgctcc

SEQ ID NO: 5616425 - DNA, 22 bp, Homo sapiens
gatagtgtttcgttaagcagta

SEQ ID NO: 5616426 - DNA, 12 bp, Homo sapiens
gatagttactgt

SEQ ID NO: 5616427 - DNA, 20 bp, Homo sapiens
gatagttactgttgtgacct

SEQ ID NO: 5616428 - DNA, 21 bp, Homo sapiens
gatagttgaatgttgcaatgt

SEQ ID NO: 5616429 - DNA, 15 bp, Homo sapiens
gatagttgatgcatg

SEQ ID NO: 5616430 - DNA, 20 bp, Homo sapiens
gatagttgccttttcttccc

SEQ ID NO: 5616431 - DNA, 15 bp, Homo sapiens
gatagttgctatttt

SEQ ID NO: 5616432 - DNA, 13 bp, Homo sapiens
gatagtttattat

SEQ ID NO: 5616433 - DNA, 15 bp, Homo sapiens
gatagttttcatttt

SEQ ID NO: 5616434 - DNA, 16 bp, Homo sapiens
gatataaaaacagatt

SEQ ID NO: 5616435 - DNA, 18 bp, Homo sapiens
gatataaaaacagattct

SEQ ID NO: 5616436 - DNA, 20 bp, Homo sapiens
gatataaaactctgggtctt

SEQ ID NO: 5616437 - DNA, 18 bp, Homo sapiens
gatataaaagactgacca

SEQ ID NO: 5616438 - DNA, 23 bp, Homo sapiens
gatataaaaggatgttacaagtt

SEQ ID NO: 5616439 - DNA, 14 bp, Homo sapiens
gatataaaatgtgc

SEQ ID NO: 5616440 - DNA, 18 bp, Homo sapiens
gatataaagaatgaaagt

SEQ ID NO: 5616441 - DNA, 19 bp, Homo sapiens
gatataaagaatgaaagta

SEQ ID NO: 5616442 - DNA, 22 bp, Homo sapiens
gatataaaggaccctgtttctg

SEQ ID NO: 5616443 - DNA, 11 bp, Homo sapiens
gatataaatac

SEQ ID NO: 5616444 - DNA, 15 bp, Homo sapiens
gatataaatatatat

SEQ ID NO: 5616445 - DNA, 16 bp, Homo sapiens
gatataaatatatata

SEQ ID NO: 5616446 - DNA, 17 bp, Homo sapiens
gatataaatatatataa

SEQ ID NO: 5616447 - DNA, 22 bp, Homo sapiens
gatataaatatatataaatata

SEQ ID NO: 5616448 - DNA, 12 bp, Homo sapiens
gatataaatgaa

SEQ ID NO: 5616449 - DNA, 15 bp, Homo sapiens
gatataaatggctgg

SEQ ID NO: 5616450 - DNA, 16 bp, Homo sapiens
gatataaattaattgt

SEQ ID NO: 5616451 - DNA, 21 bp, Homo sapiens
gatataaattgggataaacat

SEQ ID NO: 5616452 - DNA, 18 bp, Homo sapiens
gatataaatttttaagag

SEQ ID NO: 5616453 - DNA, 22 bp, Homo sapiens
gatataacacaaagagatattt

SEQ ID NO: 5616454 - DNA, 17 bp, Homo sapiens
gatataacactttccag

SEQ ID NO: 5616455 - DNA, 19 bp, Homo sapiens
gatataactattgcccagg

SEQ ID NO: 5616456 - DNA, 20 bp, Homo sapiens
gatataactgtcttgtttca

SEQ ID NO: 5616457 - DNA, 20 bp, Homo sapiens
gatataagagaagtctcatt

SEQ ID NO: 5616458 - DNA, 22 bp, Homo sapiens
gatataagatttgtacatatta

SEQ ID NO: 5616459 - DNA, 21 bp, Homo sapiens
gatataagccatagccccagg

SEQ ID NO: 5616460 - DNA, 16 bp, Homo sapiens
gatataagtgctgtat

SEQ ID NO: 5616461 - DNA, 21 bp, Homo sapiens
gatataagtgctgtataaaat

SEQ ID NO: 5616462 - DNA, 21 bp, Homo sapiens
gatataagtgtgtgtttttca

SEQ ID NO: 5616463 - DNA, 17 bp, Homo sapiens
gatataataattactta

SEQ ID NO: 5616464 - DNA, 14 bp, Homo sapiens
gatataatctttca

SEQ ID NO: 5616465 - DNA, 16 bp, Homo sapiens
gatataatctttcaaa

SEQ ID NO: 5616466 - DNA, 17 bp, Homo sapiens
gatataattacttaatg

SEQ ID NO: 5616467 - DNA, 18 bp, Homo sapiens
gatataattacttaatgt

SEQ ID NO: 5616468 - DNA, 20 bp, Homo sapiens
gatataattgtactgtgttt

SEQ ID NO: 5616469 - DNA, 23 bp, Homo sapiens
gatataattgtactgtgttttta

SEQ ID NO: 5616470 - DNA, 13 bp, Homo sapiens
gatataatttaaa

SEQ ID NO: 5616471 - DNA, 12 bp, Homo sapiens
gatatacacagt

SEQ ID NO: 5616472 - DNA, 20 bp, Homo sapiens
gatatacagacctccagatt

SEQ ID NO: 5616473 - DNA, 14 bp, Homo sapiens
gatatacagatgaa

SEQ ID NO: 5616474 - DNA, 17 bp, Homo sapiens
gatatacatgaaaattt

SEQ ID NO: 5616475 - DNA, 13 bp, Homo sapiens
gatatacattgtg

SEQ ID NO: 5616476 - DNA, 15 bp, Homo sapiens
gatatactgcagctt

SEQ ID NO: 5616477 - DNA, 15 bp, Homo sapiens
gatatactgtgtgct

SEQ ID NO: 5616478 - DNA, 13 bp, Homo sapiens
gatatacttgttt

SEQ ID NO: 5616479 - DNA, 15 bp, Homo sapiens
gatatacttgttttt

SEQ ID NO: 5616480 - DNA, 18 bp, Homo sapiens
gatatacttttttcttat

SEQ ID NO: 5616481 - DNA, 12 bp, Homo sapiens
gatatagaaaat

SEQ ID NO: 5616482 - DNA, 21 bp, Homo sapiens
gatatagagtcattgtaatgt

SEQ ID NO: 5616483 - DNA, 18 bp, Homo sapiens
gatatagatcacataaca

SEQ ID NO: 5616484 - DNA, 21 bp, Homo sapiens
gatatagcagaggtttaaatg

SEQ ID NO: 5616485 - DNA, 22 bp, Homo sapiens
gatatagcagaggtttaaatgt

SEQ ID NO: 5616486 - DNA, 16 bp, Homo sapiens
gatatagccagaaaaa

SEQ ID NO: 5616487 - DNA, 16 bp, Homo sapiens
gatataggaaaataca

SEQ ID NO: 5616488 - DNA, 17 bp, Homo sapiens
gatataggataaaataa

SEQ ID NO: 5616489 - DNA, 14 bp, Homo sapiens
gatataggcatttg

SEQ ID NO: 5616490 - DNA, 20 bp, Homo sapiens
gatataggcatttggtctca

SEQ ID NO: 5616491 - DNA, 23 bp, Homo sapiens
gatataggtcagtgaggcccagg

SEQ ID NO: 5616492 - DNA, 21 bp, Homo sapiens
gatataggtttttctcatgta

SEQ ID NO: 5616493 - DNA, 19 bp, Homo sapiens
gatatagttttacttttaa

SEQ ID NO: 5616494 - DNA, 13 bp, Homo sapiens
gatatataaataa

SEQ ID NO: 5616495 - DNA, 21 bp, Homo sapiens
gatatataatggtaatagaat

SEQ ID NO: 5616496 - DNA, 18 bp, Homo sapiens
gatatataatttcctcac

SEQ ID NO: 5616497 - DNA, 22 bp, Homo sapiens
gatatatatttactaaaagaat

SEQ ID NO: 5616498 - DNA, 14 bp, Homo sapiens
gatatatatttcca

SEQ ID NO: 5616499 - DNA, 18 bp, Homo sapiens
gatatatatttccaaata

SEQ ID NO: 5616500 - DNA, 21 bp, Homo sapiens
gatatatcatgagtgaataaa

SEQ ID NO: 5616501 - DNA, 12 bp, Homo sapiens
gatatatctgaa

SEQ ID NO: 5616502 - DNA, 23 bp, Homo sapiens
gatatatgctctgcatgttacat

SEQ ID NO: 5616503 - DNA, 16 bp, Homo sapiens
gatatatggataatgc

SEQ ID NO: 5616504 - DNA, 16 bp, Homo sapiens
gatatatgtaaatata

SEQ ID NO: 5616505 - DNA, 23 bp, Homo sapiens
gatatatgtatttattgtcatta

SEQ ID NO: 5616506 - DNA, 20 bp, Homo sapiens
gatatattaaaaatataaaa

SEQ ID NO: 5616507 - DNA, 22 bp, Homo sapiens
gatatattaaaaatataaaact

SEQ ID NO: 5616508 - DNA, 15 bp, Homo sapiens
gatatatttaaaaat

SEQ ID NO: 5616509 - DNA, 15 bp, Homo sapiens
gatatatttaagcct

SEQ ID NO: 5616510 - DNA, 16 bp, Homo sapiens
gatatatttataaata

SEQ ID NO: 5616511 - DNA, 22 bp, Homo sapiens
gatatatttcacttttgttctg

SEQ ID NO: 5616512 - DNA, 23 bp, Homo sapiens
gatatatttcacttttgttctgc

SEQ ID NO: 5616513 - DNA, 13 bp, Homo sapiens
gatatatttgaaa

SEQ ID NO: 5616514 - DNA, 20 bp, Homo sapiens
gatatattttatttttagaa

SEQ ID NO: 5616515 - DNA, 12 bp, Homo sapiens
gatatattttga

SEQ ID NO: 5616516 - DNA, 16 bp, Homo sapiens
gatatatttttaagat

SEQ ID NO: 5616517 - DNA, 17 bp, Homo sapiens
gatatatttttaagata

SEQ ID NO: 5616518 - DNA, 14 bp, Homo sapiens
gatatcaaaattct

SEQ ID NO: 5616519 - DNA, 18 bp, Homo sapiens
gatatcaccatgatttaa

SEQ ID NO: 5616520 - DNA, 18 bp, Homo sapiens
gatatcacctctcttcag

SEQ ID NO: 5616521 - DNA, 13 bp, Homo sapiens
gatatcacctgaa

SEQ ID NO: 5616522 - DNA, 18 bp, Homo sapiens
gatatcacctgaattatt

SEQ ID NO: 5616523 - DNA, 17 bp, Homo sapiens
gatatcagaatttgtgt

SEQ ID NO: 5616524 - DNA, 16 bp, Homo sapiens
gatatcagcactggat

SEQ ID NO: 5616525 - DNA, 16 bp, Homo sapiens
gatatcatgcaaattt

SEQ ID NO: 5616526 - DNA, 18 bp, Homo sapiens
gatatccacataaatgct

SEQ ID NO: 5616527 - DNA, 20 bp, Homo sapiens
gatatccacataaatgctcc

SEQ ID NO: 5616528 - DNA, 14 bp, Homo sapiens
gatatccatctttt

SEQ ID NO: 5616529 - DNA, 15 bp, Homo sapiens
gatatccatcttttt

SEQ ID NO: 5616530 - DNA, 16 bp, Homo sapiens
gatatccattctttct

SEQ ID NO: 5616531 - DNA, 22 bp, Homo sapiens
gatatccctatgctgcctaggc

SEQ ID NO: 5616532 - DNA, 23 bp, Homo sapiens
gatatccctatgctgcctaggct

SEQ ID NO: 5616533 - DNA, 23 bp, Homo sapiens
gatatcgacttgtttttgcacat

SEQ ID NO: 5616534 - DNA, 16 bp, Homo sapiens
gatatcgtgaaatcct

SEQ ID NO: 5616535 - DNA, 21 bp, Homo sapiens
gatatctagctagtaatatat

SEQ ID NO: 5616536 - DNA, 15 bp, Homo sapiens
gatatctataaaata

SEQ ID NO: 5616537 - DNA, 19 bp, Homo sapiens
gatatctatatatgtatct

SEQ ID NO: 5616538 - DNA, 18 bp, Homo sapiens
gatatctatattctaaag

SEQ ID NO: 5616539 - DNA, 15 bp, Homo sapiens
gatatctatgactgt

SEQ ID NO: 5616540 - DNA, 13 bp, Homo sapiens
gatatctcatctc

SEQ ID NO: 5616541 - DNA, 14 bp, Homo sapiens
gatatctcatctct

SEQ ID NO: 5616542 - DNA, 23 bp, Homo sapiens
gatatctgaacacatactagaaa

SEQ ID NO: 5616543 - DNA, 14 bp, Homo sapiens
gatatctgaatgtt

SEQ ID NO: 5616544 - DNA, 16 bp, Homo sapiens
gatatctgagggagga

SEQ ID NO: 5616545 - DNA, 12 bp, Homo sapiens
gatcatgatgat

SEQ ID NO: 5616546 - DNA, 15 bp, Homo sapiens
gatcatgcattgttg

SEQ ID NO: 5616547 - DNA, 13 bp, Homo sapiens
gatcatggcagga

SEQ ID NO: 5616548 - DNA, 16 bp, Homo sapiens
gatcatggctcactgc

SEQ ID NO: 5616549 - DNA, 22 bp, Homo sapiens
gatcatggtcagctcacaccct

SEQ ID NO: 5616550 - DNA, 18 bp, Homo sapiens
gatcatggtttttgctct

SEQ ID NO: 5616551 - DNA, 13 bp, Homo sapiens
gatcatgtacttt

SEQ ID NO: 5616552 - DNA, 15 bp, Homo sapiens
gatcatgttgttaaa

SEQ ID NO: 5616553 - DNA, 21 bp, Homo sapiens
gatcatgttgttaaaattatg

SEQ ID NO: 5616554 - DNA, 19 bp, Homo sapiens
gatcattacatggctgtgg

SEQ ID NO: 5616555 - DNA, 22 bp, Homo sapiens
gatcattacatggctgtggttc

SEQ ID NO: 5616556 - DNA, 14 bp, Homo sapiens
gatcattatcagcc

SEQ ID NO: 5616557 - DNA, 18 bp, Homo sapiens
gatcattatcttcatgtt

SEQ ID NO: 5616558 - DNA, 12 bp, Homo sapiens
gatcattatttc

SEQ ID NO: 5616559 - DNA, 18 bp, Homo sapiens
gatcattggagtttagga

SEQ ID NO: 5616560 - DNA, 16 bp, Homo sapiens
gatcattgtgcccact

SEQ ID NO: 5616561 - DNA, 15 bp, Homo sapiens
gatcatttaaaaagc

SEQ ID NO: 5616562 - DNA, 20 bp, Homo sapiens
gatcatttataatactgttt

SEQ ID NO: 5616563 - DNA, 17 bp, Homo sapiens
gatcatttatttcatga

SEQ ID NO: 5616564 - DNA, 18 bp, Homo sapiens
gatcatttgcagctgctg

SEQ ID NO: 5616565 - DNA, 18 bp, Homo sapiens
gatcattttccccccact

SEQ ID NO: 5616566 - DNA, 13 bp, Homo sapiens
gatcattttctta

SEQ ID NO: 5616567 - DNA, 16 bp, Homo sapiens
gatccaaaagaagccc

SEQ ID NO: 5616568 - DNA, 19 bp, Homo sapiens
gatccaaaagaagccccca

SEQ ID NO: 5616569 - DNA, 14 bp, Homo sapiens
gatccaaacagaaa

SEQ ID NO: 5616570 - DNA, 20 bp, Homo sapiens
gatccaaattgtgcttctcc

SEQ ID NO: 5616571 - DNA, 22 bp, Homo sapiens
gatccaaggcagggaaaggaaa

SEQ ID NO: 5616572 - DNA, 21 bp, Homo sapiens
gatccaataattttcctgtga

SEQ ID NO: 5616573 - DNA, 23 bp, Homo sapiens
gatccaataattttcctgtgaca

SEQ ID NO: 5616574 - DNA, 22 bp, Homo sapiens
gatccaatgttagagacttttt

SEQ ID NO: 5616575 - DNA, 14 bp, Homo sapiens
gatccacacacaga

SEQ ID NO: 5616576 - DNA, 13 bp, Homo sapiens
gatccacatcctc

SEQ ID NO: 5616577 - DNA, 17 bp, Homo sapiens
gatccacccacctcagc

SEQ ID NO: 5616578 - DNA, 20 bp, Homo sapiens
gatccacccaccttggcctc

SEQ ID NO: 5616579 - DNA, 12 bp, Homo sapiens
gatccaccccct

SEQ ID NO: 5616580 - DNA, 21 bp, Homo sapiens
gatccaccctcaaatgtcaga

SEQ ID NO: 5616581 - DNA, 20 bp, Homo sapiens
gatccaccggcctcggcctc

SEQ ID NO: 5616582 - DNA, 14 bp, Homo sapiens
gatccacctgcaca

SEQ ID NO: 5616583 - DNA, 17 bp, Homo sapiens
gatccacgctgggccta

SEQ ID NO: 5616584 - DNA, 15 bp, Homo sapiens
gatccactcccagga

SEQ ID NO: 5616585 - DNA, 22 bp, Homo sapiens
gatccacttcttaatgctttcc

SEQ ID NO: 5616586 - DNA, 14 bp, Homo sapiens
gatccagagacctg

SEQ ID NO: 5616587 - DNA, 17 bp, Homo sapiens
gatccagagacctgctc

SEQ ID NO: 5616588 - DNA, 16 bp, Homo sapiens
gatccagagagaagca

SEQ ID NO: 5616589 - DNA, 23 bp, Homo sapiens
gatccagagagaagcaccccacc

SEQ ID NO: 5616590 - DNA, 14 bp, Homo sapiens
gatccagagagcag

SEQ ID NO: 5616591 - DNA, 16 bp, Homo sapiens
gatccagagagcagct

SEQ ID NO: 5616592 - DNA, 20 bp, Homo sapiens
gatccagattcccaggccag

SEQ ID NO: 5616593 - DNA, 13 bp, Homo sapiens
gatccagcactgg

SEQ ID NO: 5616594 - DNA, 20 bp, Homo sapiens
gatccagcccaaacctggga

SEQ ID NO: 5616595 - DNA, 12 bp, Homo sapiens
gatccagccctg

SEQ ID NO: 5616596 - DNA, 17 bp, Homo sapiens
gatccagcctctcccct

SEQ ID NO: 5616597 - DNA, 12 bp, Homo sapiens
gatccagcctgg

SEQ ID NO: 5616598 - DNA, 15 bp, Homo sapiens
gatccagcggggctt

SEQ ID NO: 5616599 - DNA, 21 bp, Homo sapiens
gatccagcggggcttctgggc

SEQ ID NO: 5616600 - DNA, 14 bp, Homo sapiens
gatccagctcaagg

SEQ ID NO: 5616601 - DNA, 15 bp, Homo sapiens
gatccagctctggga

SEQ ID NO: 5616602 - DNA, 19 bp, Homo sapiens
gatccagctgtgtgttttc

SEQ ID NO: 5616603 - DNA, 16 bp, Homo sapiens
gatccaggaaagatgt

SEQ ID NO: 5616604 - DNA, 17 bp, Homo sapiens
gatccaggaaagatgtc

SEQ ID NO: 5616605 - DNA, 21 bp, Homo sapiens
gatccaggaaagatgtcccac

SEQ ID NO: 5616606 - DNA, 16 bp, Homo sapiens
gatccaggaacacatg

SEQ ID NO: 5616607 - DNA, 17 bp, Homo sapiens
gatccaggaacacatgc

SEQ ID NO: 5616608 - DNA, 18 bp, Homo sapiens
gatccaggaacacatgca

SEQ ID NO: 5616609 - DNA, 19 bp, Homo sapiens
gatccaggaacacatgcac

SEQ ID NO: 5616610 - DNA, 22 bp, Homo sapiens
gatccaggaacacatgcacaca

SEQ ID NO: 5616611 - DNA, 12 bp, Homo sapiens
gatccaggacta

SEQ ID NO: 5616612 - DNA, 16 bp, Homo sapiens
gatccaggcaggagca

SEQ ID NO: 5616613 - DNA, 22 bp, Homo sapiens
gatccagggacagaggccccag

SEQ ID NO: 5616614 - DNA, 19 bp, Homo sapiens
gatccagggaggctggtcc

SEQ ID NO: 5616615 - DNA, 13 bp, Homo sapiens
gatccagggatgg

SEQ ID NO: 5616616 - DNA, 22 bp, Homo sapiens
gatccagtgcagttgtgatttc

SEQ ID NO: 5616617 - DNA, 11 bp, Homo sapiens
gatccagtttt

SEQ ID NO: 5616618 - DNA, 23 bp, Homo sapiens
gatccataaagacaatcactgcc

SEQ ID NO: 5616619 - DNA, 22 bp, Homo sapiens
gatccatactgaaaaaatgctg

SEQ ID NO: 5616620 - DNA, 19 bp, Homo sapiens
gatccatccgtccagccaa

SEQ ID NO: 5616621 - DNA, 21 bp, Homo sapiens
gatccatcctgctagcacctc

SEQ ID NO: 5616622 - DNA, 22 bp, Homo sapiens
gatccatcctgctagcacctcc

SEQ ID NO: 5616623 - DNA, 20 bp, Homo sapiens
gatccatcctgtttttcctt

SEQ ID NO: 5616624 - DNA, 22 bp, Homo sapiens
gatccatcctgtttttcctttt

SEQ ID NO: 5616625 - DNA, 17 bp, Homo sapiens
gatccatggggggagaa

SEQ ID NO: 5616626 - DNA, 16 bp, Homo sapiens
gatccatttaaaacaa

SEQ ID NO: 5616627 - DNA, 19 bp, Homo sapiens
gatccatttggacaaaatg

SEQ ID NO: 5616628 - DNA, 20 bp, Homo sapiens
gatccatttggacaaaatgg

SEQ ID NO: 5616629 - DNA, 16 bp, Homo sapiens
gatccattttttatat

SEQ ID NO: 5616630 - DNA, 18 bp, Homo sapiens
gatccattttttatattt

SEQ ID NO: 5616631 - DNA, 12 bp, Homo sapiens
gatcccaacact

SEQ ID NO: 5616632 - DNA, 17 bp, Homo sapiens
gatcccaacatggtcct

SEQ ID NO: 5616633 - DNA, 20 bp, Homo sapiens
gatcccaagatggagaggaa

SEQ ID NO: 5616634 - DNA, 21 bp, Homo sapiens
gatcccaagtagaatctcagt

SEQ ID NO: 5616635 - DNA, 22 bp, Homo sapiens
gatcccaagtcaaacagtgtgg

SEQ ID NO: 5616636 - DNA, 15 bp, Homo sapiens
gatcccacagcccta

SEQ ID NO: 5616637 - DNA, 17 bp, Homo sapiens
gatcccacagccctagt

SEQ ID NO: 5616638 - DNA, 20 bp, Homo sapiens
gatcccaccccctcctcccc

SEQ ID NO: 5616639 - DNA, 12 bp, Homo sapiens
gatcccaccctg

SEQ ID NO: 5616640 - DNA, 13 bp, Homo sapiens
gatcccacgggag

SEQ ID NO: 5616641 - DNA, 18 bp, Homo sapiens
gatcccacttcactgtga

SEQ ID NO: 5616642 - DNA, 20 bp, Homo sapiens
gatcccagagcttcccagga

SEQ ID NO: 5616643 - DNA, 17 bp, Homo sapiens
gatcccagagttatttc

SEQ ID NO: 5616644 - DNA, 13 bp, Homo sapiens
gatcccagcccac

SEQ ID NO: 5616645 - DNA, 15 bp, Homo sapiens
gatcccagcccaccc

SEQ ID NO: 5616646 - DNA, 17 bp, Homo sapiens
gatcccagcccaccctg

SEQ ID NO: 5616647 - DNA, 22 bp, Homo sapiens
gatcccagctcactgcagcctc

SEQ ID NO: 5616648 - DNA, 23 bp, Homo sapiens
gatcccaggggcccaaggcggcc

SEQ ID NO: 5616649 - DNA, 20 bp, Homo sapiens
gatcccaggtgcgtgtgtct

SEQ ID NO: 5616650 - DNA, 15 bp, Homo sapiens
gatcccagtagaaaa

SEQ ID NO: 5616651 - DNA, 15 bp, Homo sapiens
gatcccagtcactcc

SEQ ID NO: 5616652 - DNA, 17 bp, Homo sapiens
gatcccagtcactcctc

SEQ ID NO: 5616653 - DNA, 14 bp, Homo sapiens
gatcccatggccag

SEQ ID NO: 5616654 - DNA, 21 bp, Homo sapiens
gatcccatgtcacctcagctg

SEQ ID NO: 5616655 - DNA, 22 bp, Homo sapiens
gatccccaagacatgtggaggg

SEQ ID NO: 5616656 - DNA, 16 bp, Homo sapiens
gatccccacgccacag

SEQ ID NO: 5616657 - DNA, 17 bp, Homo sapiens
gatccccacgccacagc

SEQ ID NO: 5616658 - DNA, 19 bp, Homo sapiens
gatccccacgccacagccc

SEQ ID NO: 5616659 - DNA, 21 bp, Homo sapiens
gatccccagcccctcctccct

SEQ ID NO: 5616660 - DNA, 14 bp, Homo sapiens
gatccccagctgtt

SEQ ID NO: 5616661 - DNA, 14 bp, Homo sapiens
gatccccagggcag

SEQ ID NO: 5616662 - DNA, 15 bp, Homo sapiens
gatccccagggcagc

SEQ ID NO: 5616663 - DNA, 17 bp, Homo sapiens
gatccccagggcagcct

SEQ ID NO: 5616664 - DNA, 22 bp, Homo sapiens
gatccccatggaacagccctgc

SEQ ID NO: 5616665 - DNA, 21 bp, Homo sapiens
gatcccccaaacagcatgtgc

SEQ ID NO: 5616666 - DNA, 22 bp, Homo sapiens
gatcccccaagtgtcctggacc

SEQ ID NO: 5616667 - DNA, 14 bp, Homo sapiens
gatcccccaggttc

SEQ ID NO: 5616668 - DNA, 17 bp, Homo sapiens
gatcccccgccccatcc

SEQ ID NO: 5616669 - DNA, 19 bp, Homo sapiens
gatccccctctttgcacag

SEQ ID NO: 5616670 - DNA, 13 bp, Homo sapiens
gatccccgcctgg

SEQ ID NO: 5616671 - DNA, 14 bp, Homo sapiens
gatccccgcctggc

SEQ ID NO: 5616672 - DNA, 16 bp, Homo sapiens
gatccccgcctggcca

SEQ ID NO: 5616673 - DNA, 20 bp, Homo sapiens
gatccccgcctggccaggag

SEQ ID NO: 5616674 - DNA, 17 bp, Homo sapiens
gatcccctcaggactgc

SEQ ID NO: 5616675 - DNA, 13 bp, Homo sapiens
gatcccctccccc

SEQ ID NO: 5616676 - DNA, 21 bp, Homo sapiens
gatcccctctctgtggctcca

SEQ ID NO: 5616677 - DNA, 22 bp, Homo sapiens
gatcccctctctgtggctccaa

SEQ ID NO: 5616678 - DNA, 21 bp, Homo sapiens
gatcccctctgtctacaaata

SEQ ID NO: 5616679 - DNA, 17 bp, Homo sapiens
gatcccctgtcccctgg

SEQ ID NO: 5616680 - DNA, 21 bp, Homo sapiens
gatcccctgtcccctggggct

SEQ ID NO: 5616681 - DNA, 22 bp, Homo sapiens
gatcccctgtcccctggggctg

SEQ ID NO: 5616682 - DNA, 20 bp, Homo sapiens
gatcccgaggtatggcagag

SEQ ID NO: 5616683 - DNA, 21 bp, Homo sapiens
gatcccgcctcttcttcttca

SEQ ID NO: 5616684 - DNA, 21 bp, Homo sapiens
gatcccggccggccctggctt

SEQ ID NO: 5616685 - DNA, 16 bp, Homo sapiens
gatcccgttttcccca

SEQ ID NO: 5616686 - DNA, 20 bp, Homo sapiens
gatccctaatgtgtttcttt

SEQ ID NO: 5616687 - DNA, 12 bp, Homo sapiens
gatccctcatct

SEQ ID NO: 5616688 - DNA, 12 bp, Homo sapiens
gatccctccacc

SEQ ID NO: 5616689 - DNA, 17 bp, Homo sapiens
gatccctccacccccat

SEQ ID NO: 5616690 - DNA, 20 bp, Homo sapiens
gatccctccatccggctcct

SEQ ID NO: 5616691 - DNA, 17 bp, Homo sapiens
gatccctcccctcagcc

SEQ ID NO: 5616692 - DNA, 13 bp, Homo sapiens
gatccctcctgag

SEQ ID NO: 5616693 - DNA, 15 bp, Homo sapiens
gatccctcctgagct

SEQ ID NO: 5616694 - DNA, 16 bp, Homo sapiens
gatccctcctgagctc

SEQ ID NO: 5616695 - DNA, 19 bp, Homo sapiens
gatccctcctgagctcggg

SEQ ID NO: 5616696 - DNA, 14 bp, Homo sapiens
gatccctctctgga

SEQ ID NO: 5616697 - DNA, 21 bp, Homo sapiens
gatccctgaacccctggccag

SEQ ID NO: 5616698 - DNA, 14 bp, Homo sapiens
gatccctgctctct

SEQ ID NO: 5616699 - DNA, 21 bp, Homo sapiens
gatccctgtgttgtctctaga

SEQ ID NO: 5616700 - DNA, 24 bp, Homo sapiens
gatccctgtgttgtctctagagca

SEQ ID NO: 5616701 - DNA, 18 bp, Homo sapiens
gatccctgttacccagag

SEQ ID NO: 5616702 - DNA, 22 bp, Homo sapiens
gatcccttccccctgctgatca

SEQ ID NO: 5616703 - DNA, 14 bp, Homo sapiens
gatccgactgcttt

SEQ ID NO: 5616704 - DNA, 18 bp, Homo sapiens
gatccgactgctttggac

SEQ ID NO: 5616705 - DNA, 20 bp, Homo sapiens
gatccgactgctttggacct

SEQ ID NO: 5616706 - DNA, 17 bp, Homo sapiens
gatccgcaacccatgcc

SEQ ID NO: 5616707 - DNA, 15 bp, Homo sapiens
gatccgcatgtgtct

SEQ ID NO: 5616708 - DNA, 17 bp, Homo sapiens
gatccgcatgtgtctgt

SEQ ID NO: 5616709 - DNA, 18 bp, Homo sapiens
gatccgcatgtgtctgta

SEQ ID NO: 5616710 - DNA, 20 bp, Homo sapiens
gatccgcatgtgtctgtatt

SEQ ID NO: 5616711 - DNA, 20 bp, Homo sapiens
gatccgcccacctcagcctc

SEQ ID NO: 5616712 - DNA, 21 bp, Homo sapiens
gatccgcccgcctctgcctcc

SEQ ID NO: 5616713 - DNA, 17 bp, Homo sapiens
gatccgccctgggctct

SEQ ID NO: 5616714 - DNA, 21 bp, Homo sapiens
gatccgcctacctcagcctcc

SEQ ID NO: 5616715 - DNA, 18 bp, Homo sapiens
gatccgcctgcctctgcc

SEQ ID NO: 5616716 - DNA, 18 bp, Homo sapiens
gatccgcggggaccctgc

SEQ ID NO: 5616717 - DNA, 16 bp, Homo sapiens
gatccgctgccaccac

SEQ ID NO: 5616718 - DNA, 13 bp, Homo sapiens
gatccggctgctc

SEQ ID NO: 5616719 - DNA, 21 bp, Homo sapiens
gatccgtttgaccaatttgca

SEQ ID NO: 5616720 - DNA, 12 bp, Homo sapiens
gatcctaaactc

SEQ ID NO: 5616721 - DNA, 17 bp, Homo sapiens
gatcctaaccctgggct

SEQ ID NO: 5616722 - DNA, 20 bp, Homo sapiens
gattcttgtgcctcggcctc

SEQ ID NO: 5616723 - DNA, 21 bp, Homo sapiens
gattcttgtgcctcggcctcc

SEQ ID NO: 5616724 - DNA, 21 bp, Homo sapiens
gattcttgttttgcttcccct

SEQ ID NO: 5616725 - DNA, 14 bp, Homo sapiens
gattctttaaatat

SEQ ID NO: 5616726 - DNA, 15 bp, Homo sapiens
gattctttaaggaga

SEQ ID NO: 5616727 - DNA, 16 bp, Homo sapiens
gattctttaaggagat

SEQ ID NO: 5616728 - DNA, 19 bp, Homo sapiens
gattctttaaggagataga

SEQ ID NO: 5616729 - DNA, 19 bp, Homo sapiens
gattctttccattatgatt

SEQ ID NO: 5616730 - DNA, 22 bp, Homo sapiens
gattctttccatttgcatttgt

SEQ ID NO: 5616731 - DNA, 15 bp, Homo sapiens
gattctttccccaga

SEQ ID NO: 5616732 - DNA, 12 bp, Homo sapiens
gattctttcctg

SEQ ID NO: 5616733 - DNA, 20 bp, Homo sapiens
gattctttcctgaggctggg

SEQ ID NO: 5616734 - DNA, 16 bp, Homo sapiens
gattctttgatatgtt

SEQ ID NO: 5616735 - DNA, 20 bp, Homo sapiens
gattcttttaaattagaaaa

SEQ ID NO: 5616736 - DNA, 14 bp, Homo sapiens
gattctttttctga

SEQ ID NO: 5616737 - DNA, 16 bp, Homo sapiens
gattcttttttcaatg

SEQ ID NO: 5616738 - DNA, 17 bp, Homo sapiens
gattcttttttcaatgt

SEQ ID NO: 5616739 - DNA, 19 bp, Homo sapiens
gattcttttttcaatgtac

SEQ ID NO: 5616740 - DNA, 15 bp, Homo sapiens
gattcttttttcagt

SEQ ID NO: 5616741 - DNA, 21 bp, Homo sapiens
gattctttttttctgtcagta

SEQ ID NO: 5616742 - DNA, 23 bp, Homo sapiens
gattctttttttctgtcagtaaa

SEQ ID NO: 5616743 - DNA, 15 bp, Homo sapiens
gattgaaaaaagaga

SEQ ID NO: 5616744 - DNA, 17 bp, Homo sapiens
gattgaaaaaagagaaa

SEQ ID NO: 5616745 - DNA, 15 bp, Homo sapiens
gattgaaaacttttc

SEQ ID NO: 5616746 - DNA, 19 bp, Homo sapiens
gattgaaaacttttctcag

SEQ ID NO: 5616747 - DNA, 21 bp, Homo sapiens
gattgaaaacttttctcagat

SEQ ID NO: 5616748 - DNA, 17 bp, Homo sapiens
gattgaaaataatgctg

SEQ ID NO: 5616749 - DNA, 22 bp, Homo sapiens
gattgaaaccattccagtagga

SEQ ID NO: 5616750 - DNA, 16 bp, Homo sapiens
gattgaaagaaaaaaa

SEQ ID NO: 5616751 - DNA, 23 bp, Homo sapiens
gattgaaaggacctcttctgaag

SEQ ID NO: 5616752 - DNA, 13 bp, Homo sapiens
gattgaaagtatg

SEQ ID NO: 5616753 - DNA, 15 bp, Homo sapiens
gattgaacacaggca

SEQ ID NO: 5616754 - DNA, 19 bp, Homo sapiens
gattgaactggaataatat

SEQ ID NO: 5616755 - DNA, 18 bp, Homo sapiens
gattgaagaatctgcccc

SEQ ID NO: 5616756 - DNA, 20 bp, Homo sapiens
gattgaagtttattattttc

SEQ ID NO: 5616757 - DNA, 21 bp, Homo sapiens
gattgaagtttattattttca

SEQ ID NO: 5616758 - DNA, 14 bp, Homo sapiens
gattgaatctactt

SEQ ID NO: 5616759 - DNA, 16 bp, Homo sapiens
gattgaattacggaaa

SEQ ID NO: 5616760 - DNA, 19 bp, Homo sapiens
gattgacagctttgctgct

SEQ ID NO: 5616761 - DNA, 19 bp, Homo sapiens
gattgacattctacagttg

SEQ ID NO: 5616762 - DNA, 17 bp, Homo sapiens
gattgacctataaaaca

SEQ ID NO: 5616763 - DNA, 20 bp, Homo sapiens
gattgacctgaggagacatc

SEQ ID NO: 5616764 - DNA, 15 bp, Homo sapiens
gattgacctgctccg

SEQ ID NO: 5616765 - DNA, 23 bp, Homo sapiens
gattgacctgctccgctgctcct

SEQ ID NO: 5616766 - DNA, 23 bp, Homo sapiens
gattgacgggactgttggtattg

SEQ ID NO: 5616767 - DNA, 15 bp, Homo sapiens
gattgactaaataaa

SEQ ID NO: 5616768 - DNA, 23 bp, Homo sapiens
gattgactaactcaaatacacat

SEQ ID NO: 5616769 - DNA, 13 bp, Homo sapiens
gattgagaactga

SEQ ID NO: 5616770 - DNA, 15 bp, Homo sapiens
gattgagaactgaca

SEQ ID NO: 5616771 - DNA, 18 bp, Homo sapiens
gattgagaactgacaaag

SEQ ID NO: 5616772 - DNA, 19 bp, Homo sapiens
gattgagacctacaggctg

SEQ ID NO: 5616773 - DNA, 20 bp, Homo sapiens
gattgagacctacaggctga

SEQ ID NO: 5616774 - DNA, 13 bp, Homo sapiens
gattgaggcctgc

SEQ ID NO: 5616775 - DNA, 17 bp, Homo sapiens
gattgaggggccctggc

SEQ ID NO: 5616776 - DNA, 19 bp, Homo sapiens
gattgagtaatgggatttg

SEQ ID NO: 5616777 - DNA, 20 bp, Homo sapiens
gattgagtcagtgtttgctg

SEQ ID NO: 5616778 - DNA, 14 bp, Homo sapiens
gattgagtgagggc

SEQ ID NO: 5616779 - DNA, 23 bp, Homo sapiens
gattgagttattaactgtatttt

SEQ ID NO: 5616780 - DNA, 14 bp, Homo sapiens
gattgatatcgtga

SEQ ID NO: 5616781 - DNA, 15 bp, Homo sapiens
gattgatcacacagt

SEQ ID NO: 5616782 - DNA, 22 bp, Homo sapiens
gattgatcggagcctcctctct

SEQ ID NO: 5616783 - DNA, 17 bp, Homo sapiens
gattgatttgaagaaca

SEQ ID NO: 5616784 - DNA, 19 bp, Homo sapiens
gattgatttgaagtggaaa

SEQ ID NO: 5616785 - DNA, 11 bp, Homo sapiens
gattgcaaagg

SEQ ID NO: 5616786 - DNA, 16 bp, Homo sapiens
gattgcaacaggctgg

SEQ ID NO: 5616787 - DNA, 20 bp, Homo sapiens
gattgcaacaggctgggctt

SEQ ID NO: 5616788 - DNA, 21 bp, Homo sapiens
gattgcaatatctgaagccct

SEQ ID NO: 5616789 - DNA, 14 bp, Homo sapiens
gattgcacattgtt

SEQ ID NO: 5616790 - DNA, 15 bp, Homo sapiens
gattgcacgtgcctg

SEQ ID NO: 5616791 - DNA, 15 bp, Homo sapiens
gattgcacgtggcct

SEQ ID NO: 5616792 - DNA, 20 bp, Homo sapiens
gattgcacgtggcctcttga

SEQ ID NO: 5616793 - DNA, 12 bp, Homo sapiens
gattgcagcttt

SEQ ID NO: 5616794 - DNA, 19 bp, Homo sapiens
gattgcaggtggaactcag

SEQ ID NO: 5616795 - DNA, 16 bp, Homo sapiens
gattgcatcctgctgg

SEQ ID NO: 5616796 - DNA, 15 bp, Homo sapiens
gattgccccagagcc

SEQ ID NO: 5616797 - DNA, 23 bp, Homo sapiens
gattgcccctggctttgcctctt

SEQ ID NO: 5616798 - DNA, 19 bp, Homo sapiens
gattgcccgcgctcaggag

SEQ ID NO: 5616799 - DNA, 18 bp, Homo sapiens
gattgcctcaataaagct

SEQ ID NO: 5616800 - DNA, 19 bp, Homo sapiens
gattgcctcaataaagctc

SEQ ID NO: 5616801 - DNA, 16 bp, Homo sapiens
gattgcgagaattttc

SEQ ID NO: 5616802 - DNA, 16 bp, Homo sapiens
gattgcgagagatgtg

SEQ ID NO: 5616803 - DNA, 17 bp, Homo sapiens
gattgcgagagatgtgt

SEQ ID NO: 5616804 - DNA, 18 bp, Homo sapiens
gattgcgagagatgtgtg

SEQ ID NO: 5616805 - DNA, 16 bp, Homo sapiens
gattgctaaatgtaac

SEQ ID NO: 5616806 - DNA, 17 bp, Homo sapiens
gattgctaattgctgtt

SEQ ID NO: 5616807 - DNA, 15 bp, Homo sapiens
gattgctatggttta

SEQ ID NO: 5616808 - DNA, 21 bp, Homo sapiens
gattgctcagagaaatatgca

SEQ ID NO: 5616809 - DNA, 14 bp, Homo sapiens
gattgctcccagga

SEQ ID NO: 5616810 - DNA, 18 bp, Homo sapiens
gattgctctggaagcctg

SEQ ID NO: 5616811 - DNA, 22 bp, Homo sapiens
gattgctctggaagcctgctga

SEQ ID NO: 5616812 - DNA, 13 bp, Homo sapiens
gattgctctggag

SEQ ID NO: 5616813 - DNA, 16 bp, Homo sapiens
gattgctctggagcag

SEQ ID NO: 5616814 - DNA, 21 bp, Homo sapiens
gattgctgaatcccatcaggc

SEQ ID NO: 5616815 - DNA, 13 bp, Homo sapiens
gattgctgaggca

SEQ ID NO: 5616816 - DNA, 15 bp, Homo sapiens
gattgctgcaaagat

SEQ ID NO: 5616817 - DNA, 16 bp, Homo sapiens
gattgctgccactttt

SEQ ID NO: 5616818 - DNA, 22 bp, Homo sapiens
gattgctgccactttttaacta

SEQ ID NO: 5616819 - DNA, 15 bp, Homo sapiens
gattgctgccagaga

SEQ ID NO: 5616820 - DNA, 21 bp, Homo sapiens
gattgctgccccatcagtgct

SEQ ID NO: 5616821 - DNA, 13 bp, Homo sapiens
gattgctgggagg

SEQ ID NO: 5616822 - DNA, 20 bp, Homo sapiens
gattgctggggccaggcccc

SEQ ID NO: 5616823 - DNA, 16 bp, Homo sapiens
gattgctgtggcctag

SEQ ID NO: 5616824 - DNA, 18 bp, Homo sapiens
gattgctgtgtccaactc

SEQ ID NO: 5616825 - DNA, 21 bp, Homo sapiens
gattgctgtgtccaactccag

SEQ ID NO: 5616826 - DNA, 23 bp, Homo sapiens
gattgctgtgtgttgcctgggac

SEQ ID NO: 5616827 - DNA, 17 bp, Homo sapiens
gattgcttaaaatagca

SEQ ID NO: 5616828 - DNA, 17 bp, Homo sapiens
gattgcttcaattaaaa

SEQ ID NO: 5616829 - DNA, 14 bp, Homo sapiens
gattgcttctgtag

SEQ ID NO: 5616830 - DNA, 19 bp, Homo sapiens
gattgcttgagcccaggag

SEQ ID NO: 5616831 - DNA, 13 bp, Homo sapiens
gattgcttttaaa

SEQ ID NO: 5616832 - DNA, 14 bp, Homo sapiens
gattgcttttaaaa

SEQ ID NO: 5616833 - DNA, 18 bp, Homo sapiens
gattgcttttaaaatttt

SEQ ID NO: 5616834 - DNA, 12 bp, Homo sapiens
gattggaaaata

SEQ ID NO: 5616835 - DNA, 22 bp, Homo sapiens
gattggaaaataataaaagaat

SEQ ID NO: 5616836 - DNA, 19 bp, Homo sapiens
gattggaaggagacacaga

SEQ ID NO: 5616837 - DNA, 15 bp, Homo sapiens
gattggacaaaatga

SEQ ID NO: 5616838 - DNA, 22 bp, Homo sapiens
gattggacaggagatcagcagc

SEQ ID NO: 5616839 - DNA, 15 bp, Homo sapiens
gattggaccaggcca

SEQ ID NO: 5616840 - DNA, 14 bp, Homo sapiens
gattggacctggcc

SEQ ID NO: 5616841 - DNA, 23 bp, Homo sapiens
gattggacggcctgatgctccct

SEQ ID NO: 5616842 - DNA, 20 bp, Homo sapiens
gattggattattcatttaaa

SEQ ID NO: 5616843 - DNA, 13 bp, Homo sapiens
gattggattattt

SEQ ID NO: 5616844 - DNA, 16 bp, Homo sapiens
gattggatttgctgtg

SEQ ID NO: 5616845 - DNA, 21 bp, Homo sapiens
gattggcacaagctccctggt

SEQ ID NO: 5616846 - DNA, 23 bp, Homo sapiens
gattggcagatgagcttatttca

SEQ ID NO: 5616847 - DNA, 19 bp, Homo sapiens
gattggcagcttcaaaaca

SEQ ID NO: 5616848 - DNA, 14 bp, Homo sapiens
gattggcaggaggc

SEQ ID NO: 5616849 - DNA, 17 bp, Homo sapiens
gattggcaggaggcagg

SEQ ID NO: 5616850 - DNA, 20 bp, Homo sapiens
gattggcaggaggcaggata

SEQ ID NO: 5616851 - DNA, 22 bp, Homo sapiens
gattggccactggatcctgctg

SEQ ID NO: 5616852 - DNA, 16 bp, Homo sapiens
gattggccagtgagaa

SEQ ID NO: 5616853 - DNA, 13 bp, Homo sapiens
gattggccctgcc

SEQ ID NO: 5616854 - DNA, 14 bp, Homo sapiens
gattggccctgccc

SEQ ID NO: 5616855 - DNA, 16 bp, Homo sapiens
gattggccctgcccct

SEQ ID NO: 5616856 - DNA, 14 bp, Homo sapiens
gattggcctccagg

SEQ ID NO: 5616857 - DNA, 20 bp, Homo sapiens
gattggcctgtagagttgct

SEQ ID NO: 5616858 - DNA, 18 bp, Homo sapiens
gattggctcacccaagca

SEQ ID NO: 5616859 - DNA, 22 bp, Homo sapiens
gattggctcacccaagcaaggc

SEQ ID NO: 5616860 - DNA, 11 bp, Homo sapiens
gattggctgca

SEQ ID NO: 5616861 - DNA, 13 bp, Homo sapiens
gattggctgcagg

SEQ ID NO: 5616862 - DNA, 22 bp, Homo sapiens
gattggctgcttaaactggaaa

SEQ ID NO: 5616863 - DNA, 17 bp, Homo sapiens
gattggctggattgcct

SEQ ID NO: 5616864 - DNA, 16 bp, Homo sapiens
gattggcttaaagtga

SEQ ID NO: 5616865 - DNA, 20 bp, Homo sapiens
gattggcttaaagtgaagga

SEQ ID NO: 5616866 - DNA, 21 bp, Homo sapiens
gattggcttaaagtgaaggaa

SEQ ID NO: 5616867 - DNA, 23 bp, Homo sapiens
gattggcttaaagtgaaggaaat

SEQ ID NO: 5616868 - DNA, 16 bp, Homo sapiens
gattggctttaaacac

SEQ ID NO: 5616869 - DNA, 13 bp, Homo sapiens
gattgggagaaag

SEQ ID NO: 5616870 - DNA, 17 bp, Homo sapiens
gattgggagccattttg

SEQ ID NO: 5616871 - DNA, 19 bp, Homo sapiens
gattgggagggacagggct

SEQ ID NO: 5616872 - DNA, 19 bp, Homo sapiens
gattgggggatgtgaagaa

SEQ ID NO: 5616873 - DNA, 22 bp, Homo sapiens
gattgggggatgtgaagaaata

SEQ ID NO: 5616874 - DNA, 13 bp, Homo sapiens
gattgggggccct

SEQ ID NO: 5616875 - DNA, 14 bp, Homo sapiens
gattgggggctggt

SEQ ID NO: 5616876 - DNA, 23 bp, Homo sapiens
gattgggggggccaaaaggaaaa

SEQ ID NO: 5616877 - DNA, 22 bp, Homo sapiens
gattgggggggcttggggtaga

SEQ ID NO: 5616878 - DNA, 16 bp, Homo sapiens
gattgggtcagctggc

SEQ ID NO: 5616879 - DNA, 12 bp, Homo sapiens
gattgggtctag

SEQ ID NO: 5616880 - DNA, 11 bp, Homo sapiens
gattgggtgcc

SEQ ID NO: 5616881 - DNA, 23 bp, Homo sapiens
gattgggtgccatgtggagtgga

SEQ ID NO: 5616882 - DNA, 20 bp, Homo sapiens
gattgggtgggcaggaaaag

SEQ ID NO: 5616883 - DNA, 18 bp, Homo sapiens
gattggtatgatgctgcc

SEQ ID NO: 5616884 - DNA, 23 bp, Homo sapiens
gattggtctgggtggatgtgagc

SEQ ID NO: 5616885 - DNA, 19 bp, Homo sapiens
gattggtgacgatgggtgt

SEQ ID NO: 5616886 - DNA, 20 bp, Homo sapiens
gattggtgtttttttctatg

SEQ ID NO: 5616887 - DNA, 15 bp, Homo sapiens
gattggttaaaatgt

SEQ ID NO: 5616888 - DNA, 16 bp, Homo sapiens
gattggttaaaatgtg

SEQ ID NO: 5616889 - DNA, 19 bp, Homo sapiens
gattggttgtgccttccct

SEQ ID NO: 5616890 - DNA, 16 bp, Homo sapiens
gattggtttctcttct

SEQ ID NO: 5616891 - DNA, 13 bp, Homo sapiens
gattgtaaaaaaa

SEQ ID NO: 5616892 - DNA, 18 bp, Homo sapiens
gattgtaaaaaaaaatgc

SEQ ID NO: 5616893 - DNA, 14 bp, Homo sapiens
gattgtaaaaataa

SEQ ID NO: 5616894 - DNA, 19 bp, Homo sapiens
gattgtaaaaataatcagt

SEQ ID NO: 5616895 - DNA, 12 bp, Homo sapiens
gattgtaaaata

SEQ ID NO: 5616896 - DNA, 20 bp, Homo sapiens
gattgtaaaatagcttgtat

SEQ ID NO: 5616897 - DNA, 15 bp, Homo sapiens
gattgtaacatattt

SEQ ID NO: 5616898 - DNA, 17 bp, Homo sapiens
gattgtaacatggacca

SEQ ID NO: 5616899 - DNA, 13 bp, Homo sapiens
gattttacagaga

SEQ ID NO: 5616900 - DNA, 17 bp, Homo sapiens
gattttacagagcgcac

SEQ ID NO: 5616901 - DNA, 22 bp, Homo sapiens
gattttacatttatctgtacat

SEQ ID NO: 5616902 - DNA, 12 bp, Homo sapiens
gattttaccaaa

SEQ ID NO: 5616903 - DNA, 14 bp, Homo sapiens
gattttaccaaagc

SEQ ID NO: 5616904 - DNA, 16 bp, Homo sapiens
gattttaccaaagcat

SEQ ID NO: 5616905 - DNA, 19 bp, Homo sapiens
gattttaccaaagcatcaa

SEQ ID NO: 5616906 - DNA, 15 bp, Homo sapiens
gattttagagttctt

SEQ ID NO: 5616907 - DNA, 22 bp, Homo sapiens
gattttagatttctttgattgt

SEQ ID NO: 5616908 - DNA, 20 bp, Homo sapiens
gattttagctaggatttgaa

SEQ ID NO: 5616909 - DNA, 21 bp, Homo sapiens
gattttaggagctaaggctct

SEQ ID NO: 5616910 - DNA, 22 bp, Homo sapiens
gattttagttttattttctaaa

SEQ ID NO: 5616911 - DNA, 17 bp, Homo sapiens
gattttatcccccacca

SEQ ID NO: 5616912 - DNA, 13 bp, Homo sapiens
gattttatgcttt

SEQ ID NO: 5616913 - DNA, 17 bp, Homo sapiens
gattttatgtgcttgaa

SEQ ID NO: 5616914 - DNA, 11 bp, Homo sapiens
gattttatgtt

SEQ ID NO: 5616915 - DNA, 14 bp, Homo sapiens
gattttatgttgac

SEQ ID NO: 5616916 - DNA, 16 bp, Homo sapiens
gattttatgttgacat

SEQ ID NO: 5616917 - DNA, 20 bp, Homo sapiens
gattttatgttgacatttgt

SEQ ID NO: 5616918 - DNA, 21 bp, Homo sapiens
gattttatgtttaaaatggca

SEQ ID NO: 5616919 - DNA, 17 bp, Homo sapiens
gattttattacagaaat

SEQ ID NO: 5616920 - DNA, 21 bp, Homo sapiens
gattttattcaatatggttac

SEQ ID NO: 5616921 - DNA, 13 bp, Homo sapiens
gattttattcttg

SEQ ID NO: 5616922 - DNA, 15 bp, Homo sapiens
gattttattcttgat

SEQ ID NO: 5616923 - DNA, 19 bp, Homo sapiens
gattttatttatatcttta

SEQ ID NO: 5616924 - DNA, 23 bp, Homo sapiens
gattttatttatggaattaacca

SEQ ID NO: 5616925 - DNA, 15 bp, Homo sapiens
gattttattttacta

SEQ ID NO: 5616926 - DNA, 22 bp, Homo sapiens
gattttattttcaagcaaatat

SEQ ID NO: 5616927 - DNA, 21 bp, Homo sapiens
gattttattttttgtgagtga

SEQ ID NO: 5616928 - DNA, 18 bp, Homo sapiens
gattttcaaaaaaatgtt

SEQ ID NO: 5616929 - DNA, 12 bp, Homo sapiens
gattttcaaata

SEQ ID NO: 5616930 - DNA, 16 bp, Homo sapiens
gattttcaaatatgta

SEQ ID NO: 5616931 - DNA, 20 bp, Homo sapiens
gattttcaaatatgtaaact

SEQ ID NO: 5616932 - DNA, 19 bp, Homo sapiens
gattttcaagttattcaga

SEQ ID NO: 5616933 - DNA, 22 bp, Homo sapiens
gattttcaagttattcagaaat

SEQ ID NO: 5616934 - DNA, 23 bp, Homo sapiens
gattttcaagttattcagaaata

SEQ ID NO: 5616935 - DNA, 14 bp, Homo sapiens
gattttcagttact

SEQ ID NO: 5616936 - DNA, 18 bp, Homo sapiens
gattttcatcaatttaaa

SEQ ID NO: 5616937 - DNA, 14 bp, Homo sapiens
gattttcatgttct

SEQ ID NO: 5616938 - DNA, 15 bp, Homo sapiens
gattttcatttcatg

SEQ ID NO: 5616939 - DNA, 15 bp, Homo sapiens
gattttcctttgtag

SEQ ID NO: 5616940 - DNA, 20 bp, Homo sapiens
gattttcctttgtagctact

SEQ ID NO: 5616941 - DNA, 19 bp, Homo sapiens
gattttccttttttataca

SEQ ID NO: 5616942 - DNA, 12 bp, Homo sapiens
gattttctagac

SEQ ID NO: 5616943 - DNA, 19 bp, Homo sapiens
gattttctagtttcctgcc

SEQ ID NO: 5616944 - DNA, 23 bp, Homo sapiens
gattttctattatggaaaactgt

SEQ ID NO: 5616945 - DNA, 14 bp, Homo sapiens
gattttctccagct

SEQ ID NO: 5616946 - DNA, 20 bp, Homo sapiens
gattttctgctactttgctg

SEQ ID NO: 5616947 - DNA, 21 bp, Homo sapiens
gattttcttctttgtggtctt

SEQ ID NO: 5616948 - DNA, 16 bp, Homo sapiens
gattttctttaaaaga

SEQ ID NO: 5616949 - DNA, 15 bp, Homo sapiens
gattttctttctatg

SEQ ID NO: 5616950 - DNA, 23 bp, Homo sapiens
gattttcttttgttttcttcatt

SEQ ID NO: 5616951 - DNA, 13 bp, Homo sapiens
gattttgaaaact

SEQ ID NO: 5616952 - DNA, 21 bp, Homo sapiens
gattttgaaatcatgaagata

SEQ ID NO: 5616953 - DNA, 12 bp, Homo sapiens
gattttgaactt

SEQ ID NO: 5616954 - DNA, 13 bp, Homo sapiens
gattttgaaggaa

SEQ ID NO: 5616955 - DNA, 12 bp, Homo sapiens
gattttgaatct

SEQ ID NO: 5616956 - DNA, 14 bp, Homo sapiens
gattttgaccttgt

SEQ ID NO: 5616957 - DNA, 15 bp, Homo sapiens
gattttgaccttgta

SEQ ID NO: 5616958 - DNA, 12 bp, Homo sapiens
gattttgataac

SEQ ID NO: 5616959 - DNA, 12 bp, Homo sapiens
gattttgatctc

SEQ ID NO: 5616960 - DNA, 10 bp, Homo sapiens
gattttgctg

SEQ ID NO: 5616961 - DNA, 16 bp, Homo sapiens
gattttgctgtagaag

SEQ ID NO: 5616962 - DNA, 16 bp, Homo sapiens
gattttgcttttccct

SEQ ID NO: 5616963 - DNA, 16 bp, Homo sapiens
gattttggaaactcaa

SEQ ID NO: 5616964 - DNA, 17 bp, Homo sapiens
gattttggctcactgca

SEQ ID NO: 5616965 - DNA, 22 bp, Homo sapiens
gattttgggagtgactcaagaa

SEQ ID NO: 5616966 - DNA, 19 bp, Homo sapiens
gattttggttttgttcccc

SEQ ID NO: 5616967 - DNA, 21 bp, Homo sapiens
gattttgtaaagttgccttta

SEQ ID NO: 5616968 - DNA, 12 bp, Homo sapiens
gattttgtaaat

SEQ ID NO: 5616969 - DNA, 16 bp, Homo sapiens
gattttgtaacccaga

SEQ ID NO: 5616970 - DNA, 16 bp, Homo sapiens
gattttgtcactgtct

SEQ ID NO: 5616971 - DNA, 15 bp, Homo sapiens
gattttgtgaaattt

SEQ ID NO: 5616972 - DNA, 13 bp, Homo sapiens
gattttgttttgc

SEQ ID NO: 5616973 - DNA, 14 bp, Homo sapiens
gattttgttttgct

SEQ ID NO: 5616974 - DNA, 13 bp, Homo sapiens
gatttttaaaatg

SEQ ID NO: 5616975 - DNA, 14 bp, Homo sapiens
gatttttaaaatga

SEQ ID NO: 5616976 - DNA, 16 bp, Homo sapiens
gatttttaaaatgtac

SEQ ID NO: 5616977 - DNA, 14 bp, Homo sapiens
gatttttaaattat

SEQ ID NO: 5616978 - DNA, 15 bp, Homo sapiens
gatttttaaattgga

SEQ ID NO: 5616979 - DNA, 15 bp, Homo sapiens
gatttttaacaaaaa

SEQ ID NO: 5616980 - DNA, 16 bp, Homo sapiens
gatttttaacttttta

SEQ ID NO: 5616981 - DNA, 17 bp, Homo sapiens
gatttttacaagatcca

SEQ ID NO: 5616982 - DNA, 15 bp, Homo sapiens
gatttttacaataat

SEQ ID NO: 5616983 - DNA, 20 bp, Homo sapiens
gatttttactaatatatatt

SEQ ID NO: 5616984 - DNA, 19 bp, Homo sapiens
gatttttattaactgcttt

SEQ ID NO: 5616985 - DNA, 16 bp, Homo sapiens
gatttttcatgtatct

SEQ ID NO: 5616986 - DNA, 16 bp, Homo sapiens
gatttttccatgtgtg

SEQ ID NO: 5616987 - DNA, 11 bp, Homo sapiens
gatttttcctt

SEQ ID NO: 5616988 - DNA, 13 bp, Homo sapiens
gatttttctcaaa

SEQ ID NO: 5616989 - DNA, 22 bp, Homo sapiens
gatttttcttcaggtaacacta

SEQ ID NO: 5616990 - DNA, 16 bp, Homo sapiens
gatttttcttctttta

SEQ ID NO: 5616991 - DNA, 14 bp, Homo sapiens
gatttttctttaca

SEQ ID NO: 5616992 - DNA, 21 bp, Homo sapiens
gatttttcttttgaggcatgc

SEQ ID NO: 5616993 - DNA, 22 bp, Homo sapiens
gatttttgccctgcgtcccttc

SEQ ID NO: 5616994 - DNA, 14 bp, Homo sapiens
gatttttggtattt

SEQ ID NO: 5616995 - DNA, 16 bp, Homo sapiens
gatttttggtatttat

SEQ ID NO: 5616996 - DNA, 20 bp, Homo sapiens
gatttttggtatttatgtaa

SEQ ID NO: 5616997 - DNA, 17 bp, Homo sapiens
gatttttgtaaaaagct

SEQ ID NO: 5616998 - DNA, 15 bp, Homo sapiens
gatttttgtaagaca

SEQ ID NO: 5616999 - DNA, 18 bp, Homo sapiens
gatttttgtaataaaagg

SEQ ID NO: 5617000 - DNA, 13 bp, Homo sapiens
gatttttgtatca

SEQ ID NO: 5617001 - DNA, 13 bp, Homo sapiens
gatttttgtttga

SEQ ID NO: 5617002 - DNA, 21 bp, Homo sapiens
gatttttgttttccactgtgc

SEQ ID NO: 5617003 - DNA, 21 bp, Homo sapiens
gattttttaaaattttggaat

SEQ ID NO: 5617004 - DNA, 16 bp, Homo sapiens
gattttttaagcagac

SEQ ID NO: 5617005 - DNA, 19 bp, Homo sapiens
gattttttaagtctatgtt

SEQ ID NO: 5617006 - DNA, 20 bp, Homo sapiens
gattttttacagctgcctgc

SEQ ID NO: 5617007 - DNA, 17 bp, Homo sapiens
gattttttatgtacaac

SEQ ID NO: 5617008 - DNA, 12 bp, Homo sapiens
gattttttccaa

SEQ ID NO: 5617009 - DNA, 13 bp, Homo sapiens
gattttttccaaa

SEQ ID NO: 5617010 - DNA, 20 bp, Homo sapiens
gattttttccctttttatgt

SEQ ID NO: 5617011 - DNA, 12 bp, Homo sapiens
gattttttggat

SEQ ID NO: 5617012 - DNA, 16 bp, Homo sapiens
gattttttgttcttgt

SEQ ID NO: 5617013 - DNA, 19 bp, Homo sapiens
gatttttttaatagtgctt

SEQ ID NO: 5617014 - DNA, 14 bp, Homo sapiens
gatttttttattat

SEQ ID NO: 5617015 - DNA, 13 bp, Homo sapiens
gatttttttcctg

SEQ ID NO: 5617016 - DNA, 14 bp, Homo sapiens
gatttttttctgag

SEQ ID NO: 5617017 - DNA, 13 bp, Homo sapiens
gatttttttgtaa

SEQ ID NO: 5617018 - DNA, 16 bp, Homo sapiens
gatttttttgtaaggg

SEQ ID NO: 5617019 - DNA, 20 bp, Homo sapiens
gatttttttgtgtatgtttt

SEQ ID NO: 5617020 - DNA, 12 bp, Homo sapiens
gatttttttgtt

SEQ ID NO: 5617021 - DNA, 18 bp, Homo sapiens
gatttttttgttcttgtt

SEQ ID NO: 5617022 - DNA, 18 bp, Homo sapiens
gatttttttgttgtttgt

SEQ ID NO: 5617023 - DNA, 21 bp, Homo sapiens
gatttttttgttgtttgttta

SEQ ID NO: 5617024 - DNA, 21 bp, Homo sapiens
gattttttttgtaacttcaaa

SEQ ID NO: 5617025 - DNA, 21 bp, Homo sapiens
gatttttttttagaacagaaa

SEQ ID NO: 5617026 - DNA, 21 bp, Homo sapiens
gatttttttttagacagcaaa

SEQ ID NO: 5617027 - DNA, 15 bp, Homo sapiens
gatttttttttcata

SEQ ID NO: 5617028 - DNA, 18 bp, Homo sapiens
gatttttttttccttcag

SEQ ID NO: 5617029 - DNA, 17 bp, Homo sapiens
gattttttttttaactt

SEQ ID NO: 5617030 - DNA, 21 bp, Homo sapiens
gattttttttttaacttgaaa

SEQ ID NO: 5617031 - DNA, 18 bp, Homo sapiens
gattttttttttcaggtt

SEQ ID NO: 5617032 - DNA, 17 bp, Homo sapiens
gatttttttttttcata

SEQ ID NO: 5617033 - DNA, 16 bp, Homo sapiens
gattttttttttttct

SEQ ID NO: 5617034 - DNA, 20 bp, Homo sapiens
gattttttttttttggtcct

SEQ ID NO: 5617035 - DNA, 23 bp, Homo sapiens
gcaaaaaaaaaaattacattatg

SEQ ID NO: 5617036 - DNA, 22 bp, Homo sapiens
gcaaaaaaaaacttaaagcaaa

SEQ ID NO: 5617037 - DNA, 19 bp, Homo sapiens
gcaaaaaaaaatttagcta

SEQ ID NO: 5617038 - DNA, 14 bp, Homo sapiens
gcaaaaaaagcctc

SEQ ID NO: 5617039 - DNA, 19 bp, Homo sapiens
gcaaaaaaagttgtatgat

SEQ ID NO: 5617040 - DNA, 15 bp, Homo sapiens
gcaaaaaaataagaa

SEQ ID NO: 5617041 - DNA, 22 bp, Homo sapiens
gcaaaaaactcttaatctgtgt

SEQ ID NO: 5617042 - DNA, 13 bp, Homo sapiens
gcaaaaaagaaaa

SEQ ID NO: 5617043 - DNA, 15 bp, Homo sapiens
gcaaaaaagaaaacc

SEQ ID NO: 5617044 - DNA, 18 bp, Homo sapiens
gcaaaaaagaaaaccttt

SEQ ID NO: 5617045 - DNA, 12 bp, Homo sapiens
gcaaaaaagaac

SEQ ID NO: 5617046 - DNA, 19 bp, Homo sapiens
gcaaaaaagaacagtgttg

SEQ ID NO: 5617047 - DNA, 17 bp, Homo sapiens
gcaaaaaatgtttttgg

SEQ ID NO: 5617048 - DNA, 18 bp, Homo sapiens
gcaaaaaattctttagag

SEQ ID NO: 5617049 - DNA, 15 bp, Homo sapiens
gcaaaaacatgtatg

SEQ ID NO: 5617050 - DNA, 17 bp, Homo sapiens
gcaaaaacgaaagctgg

SEQ ID NO: 5617051 - DNA, 20 bp, Homo sapiens
gcaaaaactacattttgcaa

SEQ ID NO: 5617052 - DNA, 16 bp, Homo sapiens
gcaaaaagaggatccg

SEQ ID NO: 5617053 - DNA, 20 bp, Homo sapiens
gcaaaaagatttaacaaata

SEQ ID NO: 5617054 - DNA, 18 bp, Homo sapiens
gcaaaaataaaatggaca

SEQ ID NO: 5617055 - DNA, 17 bp, Homo sapiens
gcaaaaataaccaagtc

SEQ ID NO: 5617056 - DNA, 13 bp, Homo sapiens
gcaaaaataatca

SEQ ID NO: 5617057 - DNA, 15 bp, Homo sapiens
gcaaaaataatttat

SEQ ID NO: 5617058 - DNA, 21 bp, Homo sapiens
gcaaaaataatttattttgct

SEQ ID NO: 5617059 - DNA, 23 bp, Homo sapiens
gcaaaaatagtttggatatgtaa

SEQ ID NO: 5617060 - DNA, 10 bp, Homo sapiens
gcaaaaatat

SEQ ID NO: 5617061 - DNA, 11 bp, Homo sapiens
gcaaaaatatt

SEQ ID NO: 5617062 - DNA, 23 bp, Homo sapiens
gcaaaaatatttataaaacttct

SEQ ID NO: 5617063 - DNA, 16 bp, Homo sapiens
gcaaaaatattttatg

SEQ ID NO: 5617064 - DNA, 23 bp, Homo sapiens
gcaaaaatattttatgatccagc

SEQ ID NO: 5617065 - DNA, 13 bp, Homo sapiens
gcaaaaatgaatt

SEQ ID NO: 5617066 - DNA, 13 bp, Homo sapiens
gcaaaaatgctaa

SEQ ID NO: 5617067 - DNA, 22 bp, Homo sapiens
gcaaaaatgtccagccaccccc

SEQ ID NO: 5617068 - DNA, 18 bp, Homo sapiens
gcaaaacaaattcaaata

SEQ ID NO: 5617069 - DNA, 19 bp, Homo sapiens
gcaaaacacaaaacaaatc

SEQ ID NO: 5617070 - DNA, 16 bp, Homo sapiens
gcaaaacagattcaaa

SEQ ID NO: 5617071 - DNA, 21 bp, Homo sapiens
gcaaaaccactagaactctcc

SEQ ID NO: 5617072 - DNA, 21 bp, Homo sapiens
gcaaaaccaggttttgttccg

SEQ ID NO: 5617073 - DNA, 16 bp, Homo sapiens
gcaaaaccattgcttc

SEQ ID NO: 5617074 - DNA, 17 bp, Homo sapiens
gcaaaaccattgcttca

SEQ ID NO: 5617075 - DNA, 16 bp, Homo sapiens
gcaaaacccacagaag

SEQ ID NO: 5617076 - DNA, 17 bp, Homo sapiens
gcaaaaccccatctcta

SEQ ID NO: 5617077 - DNA, 20 bp, Homo sapiens
gcaaaacctgcagttcctga

SEQ ID NO: 5617078 - DNA, 20 bp, Homo sapiens
gcaaaactaaatacttgctc

SEQ ID NO: 5617079 - DNA, 19 bp, Homo sapiens
gcaactgtctatttctgct

SEQ ID NO: 5617080 - DNA, 15 bp, Homo sapiens
gcaactgtgaattca

SEQ ID NO: 5617081 - DNA, 16 bp, Homo sapiens
gcaacttagaatagtt

SEQ ID NO: 5617082 - DNA, 16 bp, Homo sapiens
gcaacttcagtcctgg

SEQ ID NO: 5617083 - DNA, 19 bp, Homo sapiens
gcaacttcatcccagctgc

SEQ ID NO: 5617084 - DNA, 20 bp, Homo sapiens
gcaacttcatcccagctgct

SEQ ID NO: 5617085 - DNA, 23 bp, Homo sapiens
gcaacttcatttgacacaaagct

SEQ ID NO: 5617086 - DNA, 16 bp, Homo sapiens
gcaacttcccaggccg

SEQ ID NO: 5617087 - DNA, 19 bp, Homo sapiens
gcaacttctgtcccttgtt

SEQ ID NO: 5617088 - DNA, 18 bp, Homo sapiens
gcaacttcttctccatcc

SEQ ID NO: 5617089 - DNA, 19 bp, Homo sapiens
gcaacttgaaattatatct

SEQ ID NO: 5617090 - DNA, 12 bp, Homo sapiens
gcaacttgaaga

SEQ ID NO: 5617091 - DNA, 14 bp, Homo sapiens
gcaacttgaagaaa

SEQ ID NO: 5617092 - DNA, 19 bp, Homo sapiens
gcaacttgaagaaacgctt

SEQ ID NO: 5617093 - DNA, 14 bp, Homo sapiens
gcaacttgcttcta

SEQ ID NO: 5617094 - DNA, 21 bp, Homo sapiens
gcaacttgtcctagcacagat

SEQ ID NO: 5617095 - DNA, 19 bp, Homo sapiens
gcaacttgtctttttctgg

SEQ ID NO: 5617096 - DNA, 21 bp, Homo sapiens
gcaacttgtctttttctggac

SEQ ID NO: 5617097 - DNA, 19 bp, Homo sapiens
gcaactttagaaagaaatt

SEQ ID NO: 5617098 - DNA, 23 bp, Homo sapiens
gcaacttttccaacatacaattt

SEQ ID NO: 5617099 - DNA, 17 bp, Homo sapiens
gcaacttttcttggaac

SEQ ID NO: 5617100 - DNA, 20 bp, Homo sapiens
gcaacttttgtgtaatgaaa

SEQ ID NO: 5617101 - DNA, 16 bp, Homo sapiens
gcaacttttttatgtc

SEQ ID NO: 5617102 - DNA, 21 bp, Homo sapiens
gcaagaaaaaagtacagaaca

SEQ ID NO: 5617103 - DNA, 14 bp, Homo sapiens
gcaagaaaaccaca

SEQ ID NO: 5617104 - DNA, 11 bp, Homo sapiens
gcaagaaaagg

SEQ ID NO: 5617105 - DNA, 11 bp, Homo sapiens
gcaagaaacag

SEQ ID NO: 5617106 - DNA, 20 bp, Homo sapiens
gcaagaaagagggtcccagg

SEQ ID NO: 5617107 - DNA, 15 bp, Homo sapiens
gcaagaaagcttcct

SEQ ID NO: 5617108 - DNA, 15 bp, Homo sapiens
gcaagaaatgaactt

SEQ ID NO: 5617109 - DNA, 22 bp, Homo sapiens
gcaagaaatggcgtctgctctg

SEQ ID NO: 5617110 - DNA, 23 bp, Homo sapiens
gcaagaaatggcgtctgctctgg

SEQ ID NO: 5617111 - DNA, 14 bp, Homo sapiens
gcaagaacagaagt

SEQ ID NO: 5617112 - DNA, 18 bp, Homo sapiens
gcaagaacctaaagtagc

SEQ ID NO: 5617113 - DNA, 20 bp, Homo sapiens
gcaagaactcatcactgtgg

SEQ ID NO: 5617114 - DNA, 22 bp, Homo sapiens
gcaagaactcatcactgtggct

SEQ ID NO: 5617115 - DNA, 20 bp, Homo sapiens
gcaagaacttgtttacaaca

SEQ ID NO: 5617116 - DNA, 14 bp, Homo sapiens
gcaagaagactgta

SEQ ID NO: 5617117 - DNA, 17 bp, Homo sapiens
gcaagaagactgtattt

SEQ ID NO: 5617118 - DNA, 19 bp, Homo sapiens
gcaagaagatcacgctccc

SEQ ID NO: 5617119 - DNA, 21 bp, Homo sapiens
gcaagaagatcacgctccccg

SEQ ID NO: 5617120 - DNA, 16 bp, Homo sapiens
gcaagaagattctaaa

SEQ ID NO: 5617121 - DNA, 23 bp, Homo sapiens
gcaagaaggcaaaaatagtttgg

SEQ ID NO: 5617122 - DNA, 22 bp, Homo sapiens
gcaagaaggcaacttgaagaaa

SEQ ID NO: 5617123 - DNA, 13 bp, Homo sapiens
gcaagaagtagca

SEQ ID NO: 5617124 - DNA, 20 bp, Homo sapiens
gcaagaagtctggccatttt

SEQ ID NO: 5617125 - DNA, 12 bp, Homo sapiens
gcaagaattaaa

SEQ ID NO: 5617126 - DNA, 15 bp, Homo sapiens
gcaagaattaaaact

SEQ ID NO: 5617127 - DNA, 21 bp, Homo sapiens
gcaagaattaaaactgagtcc

SEQ ID NO: 5617128 - DNA, 17 bp, Homo sapiens
gcaagaattgaagcagg

SEQ ID NO: 5617129 - DNA, 22 bp, Homo sapiens
gcaagaatttctggaagaaagg

SEQ ID NO: 5617130 - DNA, 22 bp, Homo sapiens
gcaagacacccagtggaaccaa

SEQ ID NO: 5617131 - DNA, 13 bp, Homo sapiens
gcaagacagaaaa

SEQ ID NO: 5617132 - DNA, 15 bp, Homo sapiens
gcaagacagaaaagt

SEQ ID NO: 5617133 - DNA, 19 bp, Homo sapiens
gcaagacagaaaagtgcct

SEQ ID NO: 5617134 - DNA, 19 bp, Homo sapiens
gcaagacagagacgcagga

SEQ ID NO: 5617135 - DNA, 12 bp, Homo sapiens
gcaagaccacgg

SEQ ID NO: 5617136 - DNA, 23 bp, Homo sapiens
gcaagaccacggagggagcgaca

SEQ ID NO: 5617137 - DNA, 17 bp, Homo sapiens
gcaagaccctcccatgg

SEQ ID NO: 5617138 - DNA, 14 bp, Homo sapiens
gcaagaccctgcct

SEQ ID NO: 5617139 - DNA, 18 bp, Homo sapiens
gcaagacctcatctgtgg

SEQ ID NO: 5617140 - DNA, 21 bp, Homo sapiens
gcaagacctcatctgtggagc

SEQ ID NO: 5617141 - DNA, 21 bp, Homo sapiens
gcaagacctcttccctctggg

SEQ ID NO: 5617142 - DNA, 14 bp, Homo sapiens
gcaagacgctgtgc

SEQ ID NO: 5617143 - DNA, 19 bp, Homo sapiens
gcaagacgtcctggaatga

SEQ ID NO: 5617144 - DNA, 17 bp, Homo sapiens
gcaagactccatctcag

SEQ ID NO: 5617145 - DNA, 20 bp, Homo sapiens
gcaagactctgccttaattt

SEQ ID NO: 5617146 - DNA, 17 bp, Homo sapiens
gcaagactctgtctcaa

SEQ ID NO: 5617147 - DNA, 18 bp, Homo sapiens
gcaagacttcactgcagc

SEQ ID NO: 5617148 - DNA, 13 bp, Homo sapiens
gcaagagaacatt

SEQ ID NO: 5617149 - DNA, 15 bp, Homo sapiens
gcaagagaacatttt

SEQ ID NO: 5617150 - DNA, 16 bp, Homo sapiens
gcaagagaacatttta

SEQ ID NO: 5617151 - DNA, 17 bp, Homo sapiens
gcaagagaaggagatgt

SEQ ID NO: 5617152 - DNA, 22 bp, Homo sapiens
gcaagagaaggagatgtaatga

SEQ ID NO: 5617153 - DNA, 19 bp, Homo sapiens
gcaagagaattgcttgaac

SEQ ID NO: 5617154 - DNA, 13 bp, Homo sapiens
gcaagagacagaa

SEQ ID NO: 5617155 - DNA, 19 bp, Homo sapiens
gcaagagacagagccccca

SEQ ID NO: 5617156 - DNA, 21 bp, Homo sapiens
gcaagagactactctgcctga

SEQ ID NO: 5617157 - DNA, 20 bp, Homo sapiens
gcaagagactctggcctcca

SEQ ID NO: 5617158 - DNA, 19 bp, Homo sapiens
gcaagagactgggagccac

SEQ ID NO: 5617159 - DNA, 15 bp, Homo sapiens
gcaagagactttgtc

SEQ ID NO: 5617160 - DNA, 23 bp, Homo sapiens
gcaagagagagctcgctcttggg

SEQ ID NO: 5617161 - DNA, 14 bp, Homo sapiens
gcaagagagatgtt

SEQ ID NO: 5617162 - DNA, 17 bp, Homo sapiens
gcaagagagatgttttg

SEQ ID NO: 5617163 - DNA, 18 bp, Homo sapiens
gcaagagagcagcgccca

SEQ ID NO: 5617164 - DNA, 20 bp, Homo sapiens
gcaagagatggaaaaaaagt

SEQ ID NO: 5617165 - DNA, 17 bp, Homo sapiens
gcaagagatgggacaag

SEQ ID NO: 5617166 - DNA, 12 bp, Homo sapiens
gcaagagcccag

SEQ ID NO: 5617167 - DNA, 17 bp, Homo sapiens
gcaagagcctgagactg

SEQ ID NO: 5617168 - DNA, 21 bp, Homo sapiens
gcaagagcctgagactggaaa

SEQ ID NO: 5617169 - DNA, 22 bp, Homo sapiens
gcaagaggaaggggtgctgtga

SEQ ID NO: 5617170 - DNA, 19 bp, Homo sapiens
gcaagaggcatcccaagac

SEQ ID NO: 5617171 - DNA, 14 bp, Homo sapiens
gcaagaggccattg

SEQ ID NO: 5617172 - DNA, 13 bp, Homo sapiens
gcaagaggcctca

SEQ ID NO: 5617173 - DNA, 14 bp, Homo sapiens
gcaagagggaaggt

SEQ ID NO: 5617174 - DNA, 13 bp, Homo sapiens
gcaagagggacag

SEQ ID NO: 5617175 - DNA, 14 bp, Homo sapiens
gcaagagggacaga

SEQ ID NO: 5617176 - DNA, 23 bp, Homo sapiens
gcaagagggacagagcccgggag

SEQ ID NO: 5617177 - DNA, 19 bp, Homo sapiens
gcaagagggggacctgcca

SEQ ID NO: 5617178 - DNA, 23 bp, Homo sapiens
gcaagagggggtggaggggtgtg

SEQ ID NO: 5617179 - DNA, 17 bp, Homo sapiens
gcaagaggggtggagac

SEQ ID NO: 5617180 - DNA, 15 bp, Homo sapiens
gcaagaggtgcctgg

SEQ ID NO: 5617181 - DNA, 21 bp, Homo sapiens
gcaagaggtgcctgggaggag

SEQ ID NO: 5617182 - DNA, 18 bp, Homo sapiens
gcaagagtatactttgta

SEQ ID NO: 5617183 - DNA, 15 bp, Homo sapiens
gcaagataaacatta

SEQ ID NO: 5617184 - DNA, 13 bp, Homo sapiens
gcaagataatttt

SEQ ID NO: 5617185 - DNA, 19 bp, Homo sapiens
gcaagatagatttggaata

SEQ ID NO: 5617186 - DNA, 15 bp, Homo sapiens
gcaagatatttatat

SEQ ID NO: 5617187 - DNA, 16 bp, Homo sapiens
gcaagatcgctgtgct

SEQ ID NO: 5617188 - DNA, 14 bp, Homo sapiens
gcaagatgaaataa

SEQ ID NO: 5617189 - DNA, 16 bp, Homo sapiens
gcaagatgagctgtgc

SEQ ID NO: 5617190 - DNA, 24 bp, Homo sapiens
gcaagatgatttttaagtacaaaa

SEQ ID NO: 5617191 - DNA, 21 bp, Homo sapiens
gcaagatggacacgagccaca

SEQ ID NO: 5617192 - DNA, 17 bp, Homo sapiens
gcaagatggcacagggc

SEQ ID NO: 5617193 - DNA, 19 bp, Homo sapiens
gcaagatggcacagggcat

SEQ ID NO: 5617194 - DNA, 15 bp, Homo sapiens
gcaagatgttttgta

SEQ ID NO: 5617195 - DNA, 19 bp, Homo sapiens
gcaagatgttttgtataaa

SEQ ID NO: 5617196 - DNA, 15 bp, Homo sapiens
gcaagattctgtggg

SEQ ID NO: 5617197 - DNA, 16 bp, Homo sapiens
gcaagattctgtgggc

SEQ ID NO: 5617198 - DNA, 22 bp, Homo sapiens
gcaagattctgtgggcagctgg

SEQ ID NO: 5617199 - DNA, 15 bp, Homo sapiens
gcaagattgaagtct

SEQ ID NO: 5617200 - DNA, 16 bp, Homo sapiens
gcaagattgatgtttc

SEQ ID NO: 5617201 - DNA, 14 bp, Homo sapiens
gcaagattgcttaa

SEQ ID NO: 5617202 - DNA, 17 bp, Homo sapiens
gcaagattggaaagaca

SEQ ID NO: 5617203 - DNA, 18 bp, Homo sapiens
gcaagattggaaagacag

SEQ ID NO: 5617204 - DNA, 19 bp, Homo sapiens
gcaagattggaaagacagg

SEQ ID NO: 5617205 - DNA, 20 bp, Homo sapiens
gcaagattggaaagacagga

SEQ ID NO: 5617206 - DNA, 23 bp, Homo sapiens
gcaagattggaaagacaggaaga

SEQ ID NO: 5617207 - DNA, 15 bp, Homo sapiens
gcaagattttgtcaa

SEQ ID NO: 5617208 - DNA, 17 bp, Homo sapiens
gcaagattttgtcaaaa

SEQ ID NO: 5617209 - DNA, 17 bp, Homo sapiens
gcaagcaaaattatttt

SEQ ID NO: 5617210 - DNA, 18 bp, Homo sapiens
gcaagcaacaagctattt

SEQ ID NO: 5617211 - DNA, 19 bp, Homo sapiens
gcaagcaacacagaggaat

SEQ ID NO: 5617212 - DNA, 18 bp, Homo sapiens
gcaagcaagaaacactgg

SEQ ID NO: 5617213 - DNA, 23 bp, Homo sapiens
gcaagcaagaggccgtggctgct

SEQ ID NO: 5617214 - DNA, 20 bp, Homo sapiens
gcaagcaatcctaggtaggg

SEQ ID NO: 5617215 - DNA, 18 bp, Homo sapiens
gcaagcacaatggtttca

SEQ ID NO: 5617216 - DNA, 14 bp, Homo sapiens
gcaagcagaggacc

SEQ ID NO: 5617217 - DNA, 11 bp, Homo sapiens
gcaagcagatg

SEQ ID NO: 5617218 - DNA, 11 bp, Homo sapiens
gcaagcagctt

SEQ ID NO: 5617219 - DNA, 12 bp, Homo sapiens
gcaagcagcttt

SEQ ID NO: 5617220 - DNA, 23 bp, Homo sapiens
gcaagcagctttttattccctgc

SEQ ID NO: 5617221 - DNA, 15 bp, Homo sapiens
gcaagcaggacctgg

SEQ ID NO: 5617222 - DNA, 17 bp, Homo sapiens
gcaagcaggacctggca

SEQ ID NO: 5617223 - DNA, 13 bp, Homo sapiens
gcaagcaggagtg

SEQ ID NO: 5617224 - DNA, 15 bp, Homo sapiens
gcaagcaggagtgtg

SEQ ID NO: 5617225 - DNA, 12 bp, Homo sapiens
gcaagcagggaa

SEQ ID NO: 5617226 - DNA, 22 bp, Homo sapiens
gcaagcaggggtcgtaccttgc

SEQ ID NO: 5617227 - DNA, 14 bp, Homo sapiens
gcaagcagtttcaa

SEQ ID NO: 5617228 - DNA, 22 bp, Homo sapiens
gcaagcagtttcaataaagttt

SEQ ID NO: 5617229 - DNA, 16 bp, Homo sapiens
gcaagcatgcttgtga

SEQ ID NO: 5617230 - DNA, 11 bp, Homo sapiens
gcaagccaacc

SEQ ID NO: 5617231 - DNA, 13 bp, Homo sapiens
gcaagccacagaa

SEQ ID NO: 5617232 - DNA, 15 bp, Homo sapiens
gcaagccacagaaat

SEQ ID NO: 5617233 - DNA, 14 bp, Homo sapiens
gcaagccacagcct

SEQ ID NO: 5617234 - DNA, 16 bp, Homo sapiens
gcaagccacagcctgt

SEQ ID NO: 5617235 - DNA, 13 bp, Homo sapiens
gcaagccacagga

SEQ ID NO: 5617236 - DNA, 15 bp, Homo sapiens
gcaagccacaggaag

SEQ ID NO: 5617237 - DNA, 21 bp, Homo sapiens
gcaagccactatgtccagcta

SEQ ID NO: 5617238 - DNA, 10 bp, Homo sapiens
gcaagccaga

SEQ ID NO: 5617239 - DNA, 21 bp, Homo sapiens
gcaagccagggatgaagaaag

SEQ ID NO: 5617240 - DNA, 12 bp, Homo sapiens
gcaagccagggc

SEQ ID NO: 5617241 - DNA, 21 bp, Homo sapiens
gcaagccagggcccagagccc

SEQ ID NO: 5617242 - DNA, 16 bp, Homo sapiens
gcaagccatcatcctc

SEQ ID NO: 5617243 - DNA, 17 bp, Homo sapiens
gcaagccatggagtgag

SEQ ID NO: 5617244 - DNA, 19 bp, Homo sapiens
gcaagccccagggcctggg

SEQ ID NO: 5617245 - DNA, 15 bp, Homo sapiens
gcaagcccctcagcc

SEQ ID NO: 5617246 - DNA, 16 bp, Homo sapiens
gcaagcccctcagccc

SEQ ID NO: 5617247 - DNA, 14 bp, Homo sapiens
gcaagccctgaccc

SEQ ID NO: 5617248 - DNA, 15 bp, Homo sapiens
gcaagccctgcccac

SEQ ID NO: 5617249 - DNA, 12 bp, Homo sapiens
gcaagcctcagc

SEQ ID NO: 5617250 - DNA, 13 bp, Homo sapiens
gcaagcctcagcc

SEQ ID NO: 5617251 - DNA, 20 bp, Homo sapiens
gcaagcctctagtgtaccaa

SEQ ID NO: 5617252 - DNA, 12 bp, Homo sapiens
gcaagcctggcc

SEQ ID NO: 5617253 - DNA, 19 bp, Homo sapiens
gcaagcctgtaatcccagc

SEQ ID NO: 5617254 - DNA, 20 bp, Homo sapiens
gcaagcctgtaatcccagct

SEQ ID NO: 5617255 - DNA, 23 bp, Homo sapiens
gcaagcctgtatcagaatctgaa

SEQ ID NO: 5617256 - DNA, 17 bp, Homo sapiens
gcaagcgaaagagcaaa

SEQ ID NO: 5617257 - DNA, 17 bp, Homo sapiens
gcaatgcgtcttgtgaa

SEQ ID NO: 5617258 - DNA, 19 bp, Homo sapiens
gcaatgcgtcttgtgaaat

SEQ ID NO: 5617259 - DNA, 20 bp, Homo sapiens
gcaatgcgtcttgtgaaatt

SEQ ID NO: 5617260 - DNA, 22 bp, Homo sapiens
gcaatgcgtcttgtgaaattgt

SEQ ID NO: 5617261 - DNA, 15 bp, Homo sapiens
gcaatgctatcactg

SEQ ID NO: 5617262 - DNA, 22 bp, Homo sapiens
gcaatgctatcactgtctttga

SEQ ID NO: 5617263 - DNA, 14 bp, Homo sapiens
gcaatgctggctgt

SEQ ID NO: 5617264 - DNA, 23 bp, Homo sapiens
gcaatgctggctgttggctgggg

SEQ ID NO: 5617265 - DNA, 15 bp, Homo sapiens
gcaatgctgtgaata

SEQ ID NO: 5617266 - DNA, 16 bp, Homo sapiens
gcaatgcttctgtagc

SEQ ID NO: 5617267 - DNA, 21 bp, Homo sapiens
gcaatgcttttaatgaattta

SEQ ID NO: 5617268 - DNA, 12 bp, Homo sapiens
gcaatggcagcc

SEQ ID NO: 5617269 - DNA, 17 bp, Homo sapiens
gcaatggccaggggcca

SEQ ID NO: 5617270 - DNA, 14 bp, Homo sapiens
gcaatgggactgga

SEQ ID NO: 5617271 - DNA, 18 bp, Homo sapiens
gcaatgggagggggctcc

SEQ ID NO: 5617272 - DNA, 21 bp, Homo sapiens
gcaatgggagggggctccatg

SEQ ID NO: 5617273 - DNA, 14 bp, Homo sapiens
gcaatgggcactgg

SEQ ID NO: 5617274 - DNA, 22 bp, Homo sapiens
gcaatgggcagctatccagtga

SEQ ID NO: 5617275 - DNA, 19 bp, Homo sapiens
gcaatgggccgtcccctct

SEQ ID NO: 5617276 - DNA, 12 bp, Homo sapiens
gcaatggggaga

SEQ ID NO: 5617277 - DNA, 15 bp, Homo sapiens
gcaatggggagaggc

SEQ ID NO: 5617278 - DNA, 16 bp, Homo sapiens
gcaatggggagaggca

SEQ ID NO: 5617279 - DNA, 19 bp, Homo sapiens
gcaatgggtaagggaggga

SEQ ID NO: 5617280 - DNA, 22 bp, Homo sapiens
gcaatgggtaagggagggaagg

SEQ ID NO: 5617281 - DNA, 23 bp, Homo sapiens
gcaatgggtcttagctctttctc

SEQ ID NO: 5617282 - DNA, 19 bp, Homo sapiens
gcaatggtagtttctgtgg

SEQ ID NO: 5617283 - DNA, 19 bp, Homo sapiens
gcaatggtgactgatttca

SEQ ID NO: 5617284 - DNA, 21 bp, Homo sapiens
gcaatggtgactgatttcaaa

SEQ ID NO: 5617285 - DNA, 19 bp, Homo sapiens
gcaatggtgcaatcacagc

SEQ ID NO: 5617286 - DNA, 15 bp, Homo sapiens
gcaatgtatcccttc

SEQ ID NO: 5617287 - DNA, 21 bp, Homo sapiens
gcaatgtcacaacctctctga

SEQ ID NO: 5617288 - DNA, 20 bp, Homo sapiens
gcaatgtcaggaacagaagg

SEQ ID NO: 5617289 - DNA, 20 bp, Homo sapiens
gcaatgtcccttgcacagcc

SEQ ID NO: 5617290 - DNA, 14 bp, Homo sapiens
gcaatgtctgtgct

SEQ ID NO: 5617291 - DNA, 15 bp, Homo sapiens
gcaatgtctgtgcta

SEQ ID NO: 5617292 - DNA, 14 bp, Homo sapiens
gcaatgtgataaaa

SEQ ID NO: 5617293 - DNA, 13 bp, Homo sapiens
gcaatgtgatttt

SEQ ID NO: 5617294 - DNA, 15 bp, Homo sapiens
gcaatgtgccttgat

SEQ ID NO: 5617295 - DNA, 22 bp, Homo sapiens
gcaatgttccaggaatgaaata

SEQ ID NO: 5617296 - DNA, 22 bp, Homo sapiens
gcaatgttccgttcatctgagg

SEQ ID NO: 5617297 - DNA, 17 bp, Homo sapiens
gcaatgttttgcttttg

SEQ ID NO: 5617298 - DNA, 17 bp, Homo sapiens
gcaatgtttttctcaaa

SEQ ID NO: 5617299 - DNA, 22 bp, Homo sapiens
gcaatgtttttctcaaaaagct

SEQ ID NO: 5617300 - DNA, 22 bp, Homo sapiens
gcaattaaacttccaaagaaag

SEQ ID NO: 5617301 - DNA, 16 bp, Homo sapiens
gcaattaattccttca

SEQ ID NO: 5617302 - DNA, 18 bp, Homo sapiens
gcaattaggtagcacagc

SEQ ID NO: 5617303 - DNA, 19 bp, Homo sapiens
gcaattaggtagcacagca

SEQ ID NO: 5617304 - DNA, 21 bp, Homo sapiens
gcaattagtctgaaactggct

SEQ ID NO: 5617305 - DNA, 12 bp, Homo sapiens
gcaattatgaaa

SEQ ID NO: 5617306 - DNA, 19 bp, Homo sapiens
gcaattatgaaaataatct

SEQ ID NO: 5617307 - DNA, 20 bp, Homo sapiens
gcaattattctaattttata

SEQ ID NO: 5617308 - DNA, 22 bp, Homo sapiens
gcaattattctaattttatata

SEQ ID NO: 5617309 - DNA, 13 bp, Homo sapiens
gcaattattttgg

SEQ ID NO: 5617310 - DNA, 14 bp, Homo sapiens
gcaattcaatgcaa

SEQ ID NO: 5617311 - DNA, 15 bp, Homo sapiens
gcaattcaatgcaat

SEQ ID NO: 5617312 - DNA, 18 bp, Homo sapiens
gcaattcacgctgtctct

SEQ ID NO: 5617313 - DNA, 18 bp, Homo sapiens
gcaattcagtctgctctc

SEQ ID NO: 5617314 - DNA, 22 bp, Homo sapiens
gcaattcagtctgctctccctt

SEQ ID NO: 5617315 - DNA, 14 bp, Homo sapiens
gcaattcataaaaa

SEQ ID NO: 5617316 - DNA, 14 bp, Homo sapiens
gcaattcatcccag

SEQ ID NO: 5617317 - DNA, 16 bp, Homo sapiens
gcaattcatggttcaa

SEQ ID NO: 5617318 - DNA, 18 bp, Homo sapiens
gcaattccaagaaaatat

SEQ ID NO: 5617319 - DNA, 15 bp, Homo sapiens
gcaattccaggctga

SEQ ID NO: 5617320 - DNA, 18 bp, Homo sapiens
gcaattccaggctgagcc

SEQ ID NO: 5617321 - DNA, 18 bp, Homo sapiens
gcaattctaagtgagatg

SEQ ID NO: 5617322 - DNA, 14 bp, Homo sapiens
gcaattctacagtt

SEQ ID NO: 5617323 - DNA, 16 bp, Homo sapiens
gcaattctcctgcctc

SEQ ID NO: 5617324 - DNA, 20 bp, Homo sapiens
gcaattctcctgcctcagcc

SEQ ID NO: 5617325 - DNA, 19 bp, Homo sapiens
gcaattctcgattctttga

SEQ ID NO: 5617326 - DNA, 22 bp, Homo sapiens
gcaattctcgattctttgaaga

SEQ ID NO: 5617327 - DNA, 22 bp, Homo sapiens
gcaattctttttggaaaagagc

SEQ ID NO: 5617328 - DNA, 13 bp, Homo sapiens
gcaattgccctgt

SEQ ID NO: 5617329 - DNA, 21 bp, Homo sapiens
gcaattgctcatgttggccaa

SEQ ID NO: 5617330 - DNA, 16 bp, Homo sapiens
gcaattggaataatca

SEQ ID NO: 5617331 - DNA, 14 bp, Homo sapiens
gcaattgggatggc

SEQ ID NO: 5617332 - DNA, 16 bp, Homo sapiens
gcaattggggaagaaa

SEQ ID NO: 5617333 - DNA, 16 bp, Homo sapiens
gcaattgtaaacagaa

SEQ ID NO: 5617334 - DNA, 23 bp, Homo sapiens
gcaattgtcttttttttcctttg

SEQ ID NO: 5617335 - DNA, 19 bp, Homo sapiens
gcaattgttacaagtgttc

SEQ ID NO: 5617336 - DNA, 22 bp, Homo sapiens
gcaattgttacaagtgttctta

SEQ ID NO: 5617337 - DNA, 17 bp, Homo sapiens
gcaattgttgaaagctt

SEQ ID NO: 5617338 - DNA, 22 bp, Homo sapiens
gcaattgttgaaagctttgaaa

SEQ ID NO: 5617339 - DNA, 22 bp, Homo sapiens
gcaattgtttaagaatcatgga

SEQ ID NO: 5617340 - DNA, 13 bp, Homo sapiens
gcaatttaaatgt

SEQ ID NO: 5617341 - DNA, 19 bp, Homo sapiens
gcaatttacctggtactaa

SEQ ID NO: 5617342 - DNA, 16 bp, Homo sapiens
gcaatttacttggaat

SEQ ID NO: 5617343 - DNA, 16 bp, Homo sapiens
gcaatttatacaatat

SEQ ID NO: 5617344 - DNA, 19 bp, Homo sapiens
gcaatttatacaatatcat

SEQ ID NO: 5617345 - DNA, 19 bp, Homo sapiens
gcaatttatatctttatgc

SEQ ID NO: 5617346 - DNA, 23 bp, Homo sapiens
gcaatttcaaattactctttctc

SEQ ID NO: 5617347 - DNA, 18 bp, Homo sapiens
gcaatttcaaggttctaa

SEQ ID NO: 5617348 - DNA, 21 bp, Homo sapiens
gcaatttcaggaatttaattt

SEQ ID NO: 5617349 - DNA, 16 bp, Homo sapiens
gcaatttccccctaaa

SEQ ID NO: 5617350 - DNA, 18 bp, Homo sapiens
gcaatttcctggccctcc

SEQ ID NO: 5617351 - DNA, 19 bp, Homo sapiens
gcaatttctaatttttaag

SEQ ID NO: 5617352 - DNA, 22 bp, Homo sapiens
gcaatttctaatttttaagaat

SEQ ID NO: 5617353 - DNA, 22 bp, Homo sapiens
gcaatttctgtacatttgcaat

SEQ ID NO: 5617354 - DNA, 14 bp, Homo sapiens
gcaatttgaattta

SEQ ID NO: 5617355 - DNA, 16 bp, Homo sapiens
gcaatttggcttccct

SEQ ID NO: 5617356 - DNA, 19 bp, Homo sapiens
gcaatttgttattctttta

SEQ ID NO: 5617357 - DNA, 18 bp, Homo sapiens
gcaatttgtttaaagaat

SEQ ID NO: 5617358 - DNA, 20 bp, Homo sapiens
gcaatttgtttaaagaataa

SEQ ID NO: 5617359 - DNA, 16 bp, Homo sapiens
gcaattttaatcccct

SEQ ID NO: 5617360 - DNA, 23 bp, Homo sapiens
gcaattttacctagtttgcacta

SEQ ID NO: 5617361 - DNA, 18 bp, Homo sapiens
gcaattttactgtgaaaa

SEQ ID NO: 5617362 - DNA, 15 bp, Homo sapiens
gcaattttagtgtat

SEQ ID NO: 5617363 - DNA, 19 bp, Homo sapiens
gcaattttagtgtattaat

SEQ ID NO: 5617364 - DNA, 20 bp, Homo sapiens
gcaattttagtgtattaatc

SEQ ID NO: 5617365 - DNA, 17 bp, Homo sapiens
gcaattttccttgaagc

SEQ ID NO: 5617366 - DNA, 20 bp, Homo sapiens
gcaattttccttgaagccga

SEQ ID NO: 5617367 - DNA, 22 bp, Homo sapiens
gcaattttctaagcaatttctt

SEQ ID NO: 5617368 - DNA, 15 bp, Homo sapiens
gcaattttctttgtt

SEQ ID NO: 5617369 - DNA, 20 bp, Homo sapiens
gcaattttgcatagctttcc

SEQ ID NO: 5617370 - DNA, 21 bp, Homo sapiens
gcaattttgtatccatttaaa

SEQ ID NO: 5617371 - DNA, 19 bp, Homo sapiens
gcaatttttacaacctgag

SEQ ID NO: 5617372 - DNA, 16 bp, Homo sapiens
gcaatttttatattaa

SEQ ID NO: 5617373 - DNA, 23 bp, Homo sapiens
gcaatttttccatgaagtttgaa

SEQ ID NO: 5617374 - DNA, 20 bp, Homo sapiens
gcaatttttttttgttccct

SEQ ID NO: 5617375 - DNA, 18 bp, Homo sapiens
gcacaaaaaatttaagag

SEQ ID NO: 5617376 - DNA, 23 bp, Homo sapiens
gcacaaaaagataccttaaaatt

SEQ ID NO: 5617377 - DNA, 16 bp, Homo sapiens
gcacaaaaagcacaag

SEQ ID NO: 5617378 - DNA, 13 bp, Homo sapiens
gcacaaaagacag

SEQ ID NO: 5617379 - DNA, 15 bp, Homo sapiens
gcacaaaatgataat

SEQ ID NO: 5617380 - DNA, 16 bp, Homo sapiens
gcacaaaatgtgacat

SEQ ID NO: 5617381 - DNA, 23 bp, Homo sapiens
gcacaaaattcgacctgatttac

SEQ ID NO: 5617382 - DNA, 20 bp, Homo sapiens
gcacaaaattctagaagcag

SEQ ID NO: 5617383 - DNA, 14 bp, Homo sapiens
gcacaaacacacac

SEQ ID NO: 5617384 - DNA, 15 bp, Homo sapiens
gcacaaacacacaca

SEQ ID NO: 5617385 - DNA, 18 bp, Homo sapiens
gcacaaacacacacacta

SEQ ID NO: 5617386 - DNA, 15 bp, Homo sapiens
gcacaaacagaattt

SEQ ID NO: 5617387 - DNA, 19 bp, Homo sapiens
gcacaaacagaattttcca

SEQ ID NO: 5617388 - DNA, 20 bp, Homo sapiens
gcacaaacagaattttccat

SEQ ID NO: 5617389 - DNA, 15 bp, Homo sapiens
gcacaaacagaggcc

SEQ ID NO: 5617390 - DNA, 15 bp, Homo sapiens
gcacaaacatagaca

SEQ ID NO: 5617391 - DNA, 14 bp, Homo sapiens
gcacaaacattttt

SEQ ID NO: 5617392 - DNA, 16 bp, Homo sapiens
gcacaaaccctgggga

SEQ ID NO: 5617393 - DNA, 23 bp, Homo sapiens
gcacaaaccttcttttcaatgca

SEQ ID NO: 5617394 - DNA, 11 bp, Homo sapiens
gcacaaactgt

SEQ ID NO: 5617395 - DNA, 20 bp, Homo sapiens
gcacaaacttcagaaacccg

SEQ ID NO: 5617396 - DNA, 21 bp, Homo sapiens
gcacaaacttgtgagcatcag

SEQ ID NO: 5617397 - DNA, 22 bp, Homo sapiens
gcacaaactttagggtaaaaat

SEQ ID NO: 5617398 - DNA, 18 bp, Homo sapiens
gcacaaagaccctggctt

SEQ ID NO: 5617399 - DNA, 22 bp, Homo sapiens
gcacaaagataacgcaggagag

SEQ ID NO: 5617400 - DNA, 11 bp, Homo sapiens
gcacaaagatg

SEQ ID NO: 5617401 - DNA, 23 bp, Homo sapiens
gcacaaagatgggtgaaggctgg

SEQ ID NO: 5617402 - DNA, 19 bp, Homo sapiens
gcacaaagcactggccttg

SEQ ID NO: 5617403 - DNA, 21 bp, Homo sapiens
gcacaaagcagtttttccccc

SEQ ID NO: 5617404 - DNA, 16 bp, Homo sapiens
gcacaaagggcaggcc

SEQ ID NO: 5617405 - DNA, 16 bp, Homo sapiens
gcacaaagggcccaga

SEQ ID NO: 5617406 - DNA, 16 bp, Homo sapiens
gcacaaagttctcaga

SEQ ID NO: 5617407 - DNA, 15 bp, Homo sapiens
gcacaaatatttatt

SEQ ID NO: 5617408 - DNA, 20 bp, Homo sapiens
gcacaaatttcatctcctag

SEQ ID NO: 5617409 - DNA, 18 bp, Homo sapiens
gcacaaccatgttcttga

SEQ ID NO: 5617410 - DNA, 17 bp, Homo sapiens
gcacaaccggtcccttc

SEQ ID NO: 5617411 - DNA, 23 bp, Homo sapiens
gcacaaccggtcccttccatgcc

SEQ ID NO: 5617412 - DNA, 14 bp, Homo sapiens
gcacaactctccaa

SEQ ID NO: 5617413 - DNA, 15 bp, Homo sapiens
gcacaagaaggccag

SEQ ID NO: 5617414 - DNA, 19 bp, Homo sapiens
gcacaagaaggccagccca

SEQ ID NO: 5617415 - DNA, 21 bp, Homo sapiens
gcacaagaaggccagcccact

SEQ ID NO: 5617416 - DNA, 15 bp, Homo sapiens
gcacaagaatggatc

SEQ ID NO: 5617417 - DNA, 16 bp, Homo sapiens
gcacaagactggccca

SEQ ID NO: 5617418 - DNA, 21 bp, Homo sapiens
gcacaagaggaagagagagac

SEQ ID NO: 5617419 - DNA, 14 bp, Homo sapiens
gcacaagcagagtg

SEQ ID NO: 5617420 - DNA, 22 bp, Homo sapiens
gcacaagcagagtgcacagctg

SEQ ID NO: 5617421 - DNA, 14 bp, Homo sapiens
gcacaagcattcct

SEQ ID NO: 5617422 - DNA, 21 bp, Homo sapiens
gcacaagctccaagctcccag

SEQ ID NO: 5617423 - DNA, 15 bp, Homo sapiens
gcacaagctccctgg

SEQ ID NO: 5617424 - DNA, 17 bp, Homo sapiens
gcacaagcttgtatata

SEQ ID NO: 5617425 - DNA, 19 bp, Homo sapiens
gcacaagcttgtatataca

SEQ ID NO: 5617426 - DNA, 23 bp, Homo sapiens
gcacaaggaatttccctgtgtgg

SEQ ID NO: 5617427 - DNA, 19 bp, Homo sapiens
gcacaaggctgaccaagag

SEQ ID NO: 5617428 - DNA, 19 bp, Homo sapiens
gcacaagggcacattgccc

SEQ ID NO: 5617429 - DNA, 21 bp, Homo sapiens
gcacaagggcacattgcccat

SEQ ID NO: 5617430 - DNA, 16 bp, Homo sapiens
gcacaaggggccaagg

SEQ ID NO: 5617431 - DNA, 19 bp, Homo sapiens
gcacaaggttggttgctaa

SEQ ID NO: 5617432 - DNA, 15 bp, Homo sapiens
gcaccacccccagtc

SEQ ID NO: 5617433 - DNA, 17 bp, Homo sapiens
gcaccaccctccttccc

SEQ ID NO: 5617434 - DNA, 17 bp, Homo sapiens
gcaccacctacacagga

SEQ ID NO: 5617435 - DNA, 19 bp, Homo sapiens
gcaccacctacacaggagt

SEQ ID NO: 5617436 - DNA, 21 bp, Homo sapiens
gcaccacggcgtttttttaca

SEQ ID NO: 5617437 - DNA, 15 bp, Homo sapiens
gcaccacggggtcgg

SEQ ID NO: 5617438 - DNA, 14 bp, Homo sapiens
gcaccactctcctt

SEQ ID NO: 5617439 - DNA, 17 bp, Homo sapiens
gcaccactctgggcaca

SEQ ID NO: 5617440 - DNA, 20 bp, Homo sapiens
gcaccactgctgaggagtct

SEQ ID NO: 5617441 - DNA, 16 bp, Homo sapiens
gcaccactgcttccca

SEQ ID NO: 5617442 - DNA, 19 bp, Homo sapiens
gcaccactgcttcccactg

SEQ ID NO: 5617443 - DNA, 15 bp, Homo sapiens
gcaccagacacccag

SEQ ID NO: 5617444 - DNA, 17 bp, Homo sapiens
gcaccagacacccagga

SEQ ID NO: 5617445 - DNA, 17 bp, Homo sapiens
gcaccagcatccacctt

SEQ ID NO: 5617446 - DNA, 13 bp, Homo sapiens
gcaccagccagcg

SEQ ID NO: 5617447 - DNA, 15 bp, Homo sapiens
gcaccagccccctgg

SEQ ID NO: 5617448 - DNA, 16 bp, Homo sapiens
gcaccagccccctgga

SEQ ID NO: 5617449 - DNA, 16 bp, Homo sapiens
gcaccagcccttccct

SEQ ID NO: 5617450 - DNA, 18 bp, Homo sapiens
gcaccagcctcagtgcag

SEQ ID NO: 5617451 - DNA, 17 bp, Homo sapiens
gcaccagcctgagccac

SEQ ID NO: 5617452 - DNA, 18 bp, Homo sapiens
gcaccagcgaagggagtg

SEQ ID NO: 5617453 - DNA, 13 bp, Homo sapiens
gcaccagctctgt

SEQ ID NO: 5617454 - DNA, 20 bp, Homo sapiens
gcaccagctctgtggcctgt

SEQ ID NO: 5617455 - DNA, 14 bp, Homo sapiens
gcaccagctgctct

SEQ ID NO: 5617456 - DNA, 15 bp, Homo sapiens
gcaccagctgctctg

SEQ ID NO: 5617457 - DNA, 21 bp, Homo sapiens
gcaccagctgctctgcccctt

SEQ ID NO: 5617458 - DNA, 20 bp, Homo sapiens
gcaccagcttctccaggctc

SEQ ID NO: 5617459 - DNA, 14 bp, Homo sapiens
gcaccaggaagccg

SEQ ID NO: 5617460 - DNA, 18 bp, Homo sapiens
gcaccaggaagccgtcct

SEQ ID NO: 5617461 - DNA, 13 bp, Homo sapiens
gcaccaggagaca

SEQ ID NO: 5617462 - DNA, 21 bp, Homo sapiens
gcaccaggcacgaacccacct

SEQ ID NO: 5617463 - DNA, 18 bp, Homo sapiens
gcaccaggcgctgcccac

SEQ ID NO: 5617464 - DNA, 22 bp, Homo sapiens
gcaccagggactcggcccaggg

SEQ ID NO: 5617465 - DNA, 17 bp, Homo sapiens
gcaccagggagaggcct

SEQ ID NO: 5617466 - DNA, 18 bp, Homo sapiens
gcaccaggggtttctcgc

SEQ ID NO: 5617467 - DNA, 23 bp, Homo sapiens
gcaccagggttgaccccagagga

SEQ ID NO: 5617468 - DNA, 18 bp, Homo sapiens
gcaccaggtcactctgac

SEQ ID NO: 5617469 - DNA, 22 bp, Homo sapiens
gcaccaggtcactctgacctta

SEQ ID NO: 5617470 - DNA, 16 bp, Homo sapiens
gcaccagtgccgcctg

SEQ ID NO: 5617471 - DNA, 21 bp, Homo sapiens
gcaccagtgccgcctgtgccc

SEQ ID NO: 5617472 - DNA, 15 bp, Homo sapiens
gcaccagtgcctcag

SEQ ID NO: 5617473 - DNA, 18 bp, Homo sapiens
gcaccagtgcctcagtgc

SEQ ID NO: 5617474 - DNA, 22 bp, Homo sapiens
gcaccagtgcctcagtgctgca

SEQ ID NO: 5617475 - DNA, 23 bp, Homo sapiens
gcaccagtgcctcagtgctgcaa

SEQ ID NO: 5617476 - DNA, 20 bp, Homo sapiens
gcaccagtgtcctcccctca

SEQ ID NO: 5617477 - DNA, 23 bp, Homo sapiens
gcaccagttttatccataatgat

SEQ ID NO: 5617478 - DNA, 23 bp, Homo sapiens
gcaccatacattatttcttccca

SEQ ID NO: 5617479 - DNA, 23 bp, Homo sapiens
gcaccatagaagaacagcagatg

SEQ ID NO: 5617480 - DNA, 16 bp, Homo sapiens
gcaccatcacacatgc

SEQ ID NO: 5617481 - DNA, 17 bp, Homo sapiens
gcaccatcccctccggc

SEQ ID NO: 5617482 - DNA, 15 bp, Homo sapiens
gcaccatctctcctc

SEQ ID NO: 5617483 - DNA, 20 bp, Homo sapiens
gcaccatctctgattttcaa

SEQ ID NO: 5617484 - DNA, 14 bp, Homo sapiens
gcaccatctgcttg

SEQ ID NO: 5617485 - DNA, 15 bp, Homo sapiens
gcaccatctggacgg

SEQ ID NO: 5617486 - DNA, 14 bp, Homo sapiens
gcaccatgctgggc

SEQ ID NO: 5617487 - DNA, 16 bp, Homo sapiens
gcaccatggacatgtg

SEQ ID NO: 5617488 - DNA, 21 bp, Homo sapiens
gcaccattcagactttcagcc

SEQ ID NO: 5617489 - DNA, 20 bp, Homo sapiens
gcaccattctcctgcctcag

SEQ ID NO: 5617490 - DNA, 15 bp, Homo sapiens
gcaccattctgactc

SEQ ID NO: 5617491 - DNA, 20 bp, Homo sapiens
gcaccattgcttaaaagaaa

SEQ ID NO: 5617492 - DNA, 19 bp, Homo sapiens
gcaccattttaagtccctg

SEQ ID NO: 5617493 - DNA, 18 bp, Homo sapiens
gcacccaaatcacatctc

SEQ ID NO: 5617494 - DNA, 22 bp, Homo sapiens
gcacccacaaataaatgacaag

SEQ ID NO: 5617495 - DNA, 14 bp, Homo sapiens
gcacccacaagccc

SEQ ID NO: 5617496 - DNA, 15 bp, Homo sapiens
gcacccacaagcccg

SEQ ID NO: 5617497 - DNA, 19 bp, Homo sapiens
gcacccacaagtgccactg

SEQ ID NO: 5617498 - DNA, 16 bp, Homo sapiens
gcacccacacagagga

SEQ ID NO: 5617499 - DNA, 19 bp, Homo sapiens
gcacccacacagaggacct

SEQ ID NO: 5617500 - DNA, 16 bp, Homo sapiens
gcacccacagccgcag

SEQ ID NO: 5617501 - DNA, 15 bp, Homo sapiens
gcacccaccactctc

SEQ ID NO: 5617502 - DNA, 22 bp, Homo sapiens
gcacccaccagaaattccagta

SEQ ID NO: 5617503 - DNA, 22 bp, Homo sapiens
gcacccaccatcatgtctggct

SEQ ID NO: 5617504 - DNA, 19 bp, Homo sapiens
gcacccacccagcacccag

SEQ ID NO: 5617505 - DNA, 19 bp, Homo sapiens
gcacccacccatgcacgca

SEQ ID NO: 5617506 - DNA, 24 bp, Homo sapiens
gcacccacctggtactgacccagg

SEQ ID NO: 5617507 - DNA, 20 bp, Homo sapiens
gcacccacctgttttctgaa

SEQ ID NO: 5617508 - DNA, 13 bp, Homo sapiens
gcacccacgtgca

SEQ ID NO: 5617509 - DNA, 14 bp, Homo sapiens
gcacccactcacca

SEQ ID NO: 5617510 - DNA, 19 bp, Homo sapiens
gcacccactcaccagggtc

SEQ ID NO: 5617511 - DNA, 13 bp, Homo sapiens
gcacccactcagc

SEQ ID NO: 5617512 - DNA, 21 bp, Homo sapiens
gcacccagaaattccttccca

SEQ ID NO: 5617513 - DNA, 14 bp, Homo sapiens
gcacccagagaaaa

SEQ ID NO: 5617514 - DNA, 19 bp, Homo sapiens
gcacccagagaaaattaat

SEQ ID NO: 5617515 - DNA, 15 bp, Homo sapiens
gcacccagagcaccc

SEQ ID NO: 5617516 - DNA, 13 bp, Homo sapiens
gcacccagcccaa

SEQ ID NO: 5617517 - DNA, 14 bp, Homo sapiens
gcacccagcccaga

SEQ ID NO: 5617518 - DNA, 21 bp, Homo sapiens
gcacccagccccaaggggtgg

SEQ ID NO: 5617519 - DNA, 12 bp, Homo sapiens
gcacccagccct

SEQ ID NO: 5617520 - DNA, 14 bp, Homo sapiens
gcacccagccctgg

SEQ ID NO: 5617521 - DNA, 18 bp, Homo sapiens
gcacccagctccaggggc

SEQ ID NO: 5617522 - DNA, 18 bp, Homo sapiens
gcacccaggctccatggg

SEQ ID NO: 5617523 - DNA, 17 bp, Homo sapiens
gcacccagtgagcactc

SEQ ID NO: 5617524 - DNA, 21 bp, Homo sapiens
gcacccagtgagcactcccaa

SEQ ID NO: 5617525 - DNA, 24 bp, Homo sapiens
gcacccatatctgtgtgccctagg

SEQ ID NO: 5617526 - DNA, 22 bp, Homo sapiens
gcacccatccaccgtcccctcc

SEQ ID NO: 5617527 - DNA, 18 bp, Homo sapiens
gcacccatgccccactct

SEQ ID NO: 5617528 - DNA, 21 bp, Homo sapiens
gcacccatgccccactctgct

SEQ ID NO: 5617529 - DNA, 13 bp, Homo sapiens
gcaccccaaggct

SEQ ID NO: 5617530 - DNA, 22 bp, Homo sapiens
gcaccccaccacacacaccctt

SEQ ID NO: 5617531 - DNA, 17 bp, Homo sapiens
gcaccccagcgtcaggc

SEQ ID NO: 5617532 - DNA, 20 bp, Homo sapiens
gcaccccagcgtcaggccta

SEQ ID NO: 5617533 - DNA, 22 bp, Homo sapiens
gcaccccaggcagctcctgttt

SEQ ID NO: 5617534 - DNA, 17 bp, Homo sapiens
gcaccccatgagtagtg

SEQ ID NO: 5617535 - DNA, 15 bp, Homo sapiens
gcacccccaaattca

SEQ ID NO: 5617536 - DNA, 21 bp, Homo sapiens
gcacccccacaagctgtccct

SEQ ID NO: 5617537 - DNA, 16 bp, Homo sapiens
gcacccccacccacct

SEQ ID NO: 5617538 - DNA, 13 bp, Homo sapiens
gcacccccaccct

SEQ ID NO: 5617539 - DNA, 15 bp, Homo sapiens
gcacccccacccttt

SEQ ID NO: 5617540 - DNA, 18 bp, Homo sapiens
gcacccccaccctttggg

SEQ ID NO: 5617541 - DNA, 22 bp, Homo sapiens
gcacccccagaatgacctggcc

SEQ ID NO: 5617542 - DNA, 11 bp, Homo sapiens
gcacccccagc

SEQ ID NO: 5617543 - DNA, 22 bp, Homo sapiens
gcacccccagcctcccccaggc

SEQ ID NO: 5617544 - DNA, 15 bp, Homo sapiens
gcacccccagcctgg

SEQ ID NO: 5617545 - DNA, 16 bp, Homo sapiens
gcacccccagcctggg

SEQ ID NO: 5617546 - DNA, 17 bp, Homo sapiens
gcacccccagcctgggc

SEQ ID NO: 5617547 - DNA, 18 bp, Homo sapiens
gcacccccagcctgggcc

SEQ ID NO: 5617548 - DNA, 19 bp, Homo sapiens
gcacccccagcctgggcct

SEQ ID NO: 5617549 - DNA, 13 bp, Homo sapiens
gcacccccaggcc

SEQ ID NO: 5617550 - DNA, 13 bp, Homo sapiens
gcacccccctgtg

SEQ ID NO: 5617551 - DNA, 17 bp, Homo sapiens
gcacccccctgtgcctg

SEQ ID NO: 5617552 - DNA, 21 bp, Homo sapiens
gcacccccctgtgcctgctgg

SEQ ID NO: 5617553 - DNA, 19 bp, Homo sapiens
gcacccccctgttctaagg

SEQ ID NO: 5617554 - DNA, 16 bp, Homo sapiens
gcacccccgccaggcg

SEQ ID NO: 5617555 - DNA, 17 bp, Homo sapiens
gcacccccgccaggcgc

SEQ ID NO: 5617556 - DNA, 16 bp, Homo sapiens
gcacccccgtcaagag

SEQ ID NO: 5617557 - DNA, 12 bp, Homo sapiens
gcaccccctccc

SEQ ID NO: 5617558 - DNA, 15 bp, Homo sapiens
gcaccccctcctgct

SEQ ID NO: 5617559 - DNA, 16 bp, Homo sapiens
gcaccccctcctgctg

SEQ ID NO: 5617560 - DNA, 15 bp, Homo sapiens
gcaccccctggcttg

SEQ ID NO: 5617561 - DNA, 21 bp, Homo sapiens
gcaccccgaagggagcatctg

SEQ ID NO: 5617562 - DNA, 14 bp, Homo sapiens
gcaccccgcccctg

SEQ ID NO: 5617563 - DNA, 16 bp, Homo sapiens
gcaccccgcccctgca

SEQ ID NO: 5617564 - DNA, 16 bp, Homo sapiens
gcaccccgccggagga

SEQ ID NO: 5617565 - DNA, 21 bp, Homo sapiens
gcaccccgccggaggaaggtc

SEQ ID NO: 5617566 - DNA, 22 bp, Homo sapiens
gcaccccgcttttgcagcagag

SEQ ID NO: 5617567 - DNA, 23 bp, Homo sapiens
gcaccccgcttttgcagcagagg

SEQ ID NO: 5617568 - DNA, 17 bp, Homo sapiens
gcaccccggcctcaggg

SEQ ID NO: 5617569 - DNA, 16 bp, Homo sapiens
gcacccctactcacat

SEQ ID NO: 5617570 - DNA, 13 bp, Homo sapiens
gcacccctcccat

SEQ ID NO: 5617571 - DNA, 14 bp, Homo sapiens
gcacccctccctgc

SEQ ID NO: 5617572 - DNA, 15 bp, Homo sapiens
gcacccctccctgct

SEQ ID NO: 5617573 - DNA, 17 bp, Homo sapiens
gcacccctccctgcttg

SEQ ID NO: 5617574 - DNA, 21 bp, Homo sapiens
gcacccctccctgcttgcaca

SEQ ID NO: 5617575 - DNA, 22 bp, Homo sapiens
gcacccctccctgcttgcacac

SEQ ID NO: 5617576 - DNA, 22 bp, Homo sapiens
gcacccctccgtgtggagcacg

SEQ ID NO: 5617577 - DNA, 20 bp, Homo sapiens
gcacccctgagccagcaggg

SEQ ID NO: 5617578 - DNA, 21 bp, Homo sapiens
gcacccctgagttgggcagcc

SEQ ID NO: 5617579 - DNA, 13 bp, Homo sapiens
gcacccctgcctc

SEQ ID NO: 5617580 - DNA, 18 bp, Homo sapiens
gcacccctgggccagcgg

SEQ ID NO: 5617581 - DNA, 22 bp, Homo sapiens
gcacccctggtgtccctgcctg

SEQ ID NO: 5617582 - DNA, 13 bp, Homo sapiens
gcacccctgtctc

SEQ ID NO: 5617583 - DNA, 17 bp, Homo sapiens
gcaccccttcctcccca

SEQ ID NO: 5617584 - DNA, 12 bp, Homo sapiens
gcaccccttctc

SEQ ID NO: 5617585 - DNA, 13 bp, Homo sapiens
gcaccccttctct

SEQ ID NO: 5617586 - DNA, 20 bp, Homo sapiens
gcaccccttctctcctcccc

SEQ ID NO: 5617587 - DNA, 22 bp, Homo sapiens
gcaccccttctctcctccccaa

SEQ ID NO: 5617588 - DNA, 16 bp, Homo sapiens
gcaccccttgtttctg

SEQ ID NO: 5617589 - DNA, 21 bp, Homo sapiens
gcaccccttgtttctgttgtt

SEQ ID NO: 5617590 - DNA, 22 bp, Homo sapiens
gcacccctttcctccccataca

SEQ ID NO: 5617591 - DNA, 15 bp, Homo sapiens
gcacccggcccctgc

SEQ ID NO: 5617592 - DNA, 18 bp, Homo sapiens
gcacccggcccctgctgg

SEQ ID NO: 5617593 - DNA, 19 bp, Homo sapiens
gcacccggcccctgctggt

SEQ ID NO: 5617594 - DNA, 16 bp, Homo sapiens
gcacccgggctcaggg

SEQ ID NO: 5617595 - DNA, 22 bp, Homo sapiens
gcacccggtcccctctgcccca

SEQ ID NO: 5617596 - DNA, 22 bp, Homo sapiens
gcacccgtctgggaatcctgga

SEQ ID NO: 5617597 - DNA, 15 bp, Homo sapiens
gcacccgtgccacgc

SEQ ID NO: 5617598 - DNA, 16 bp, Homo sapiens
gcaccctaggcagcct

SEQ ID NO: 5617599 - DNA, 13 bp, Homo sapiens
gcaccctataaat

SEQ ID NO: 5617600 - DNA, 14 bp, Homo sapiens
gcaccctcaacctc

SEQ ID NO: 5617601 - DNA, 13 bp, Homo sapiens
gcaccctcaggga

SEQ ID NO: 5617602 - DNA, 17 bp, Homo sapiens
gcaccctcatacacaga

SEQ ID NO: 5617603 - DNA, 20 bp, Homo sapiens
gcaccctcatacacagaaac

SEQ ID NO: 5617604 - DNA, 21 bp, Homo sapiens
gcaccctcattccctcgggac

SEQ ID NO: 5617605 - DNA, 17 bp, Homo sapiens
gcaccctccacaggagc

SEQ ID NO: 5617606 - DNA, 15 bp, Homo sapiens
gcaccctccaccctg

SEQ ID NO: 5617607 - DNA, 16 bp, Homo sapiens
gcaccctccaccctgt

SEQ ID NO: 5617608 - DNA, 19 bp, Homo sapiens
gcaccctccaccctgtccc

SEQ ID NO: 5617609 - DNA, 19 bp, Homo sapiens
gcactgagggtctggtgcc

SEQ ID NO: 5617610 - DNA, 16 bp, Homo sapiens
gcactgagtgaaggaa

SEQ ID NO: 5617611 - DNA, 18 bp, Homo sapiens
gcactgatgctgcccctc

SEQ ID NO: 5617612 - DNA, 18 bp, Homo sapiens
gcactgatgtccctcctt

SEQ ID NO: 5617613 - DNA, 22 bp, Homo sapiens
gcactgcacctgcctccagccg

SEQ ID NO: 5617614 - DNA, 21 bp, Homo sapiens
gcactgcagatagccagacac

SEQ ID NO: 5617615 - DNA, 22 bp, Homo sapiens
gcactgcagatagccagacaca

SEQ ID NO: 5617616 - DNA, 23 bp, Homo sapiens
gcactgcagatagccagacacat

SEQ ID NO: 5617617 - DNA, 13 bp, Homo sapiens
gcactgcaggggc

SEQ ID NO: 5617618 - DNA, 19 bp, Homo sapiens
gcactgcaggtggcctccc

SEQ ID NO: 5617619 - DNA, 13 bp, Homo sapiens
gcactgcatgcaa

SEQ ID NO: 5617620 - DNA, 18 bp, Homo sapiens
gcactgcattcctgtgcc

SEQ ID NO: 5617621 - DNA, 19 bp, Homo sapiens
gcactgcattcctgtgccc

SEQ ID NO: 5617622 - DNA, 21 bp, Homo sapiens
gcactgccaccagcaatgccc

SEQ ID NO: 5617623 - DNA, 22 bp, Homo sapiens
gcactgccaccagcaatgccct

SEQ ID NO: 5617624 - DNA, 14 bp, Homo sapiens
gcactgccagccca

SEQ ID NO: 5617625 - DNA, 14 bp, Homo sapiens
gcactgccaggagg

SEQ ID NO: 5617626 - DNA, 15 bp, Homo sapiens
gcactgccaggaggg

SEQ ID NO: 5617627 - DNA, 16 bp, Homo sapiens
gcactgccaggaggga

SEQ ID NO: 5617628 - DNA, 14 bp, Homo sapiens
gcactgccatgcag

SEQ ID NO: 5617629 - DNA, 15 bp, Homo sapiens
gcactgccatgcagg

SEQ ID NO: 5617630 - DNA, 19 bp, Homo sapiens
gcactgcccacatgggacc

SEQ ID NO: 5617631 - DNA, 21 bp, Homo sapiens
gcactgcccagggaagccctc

SEQ ID NO: 5617632 - DNA, 19 bp, Homo sapiens
gcactgcccatcccacccc

SEQ ID NO: 5617633 - DNA, 12 bp, Homo sapiens
gcactgccctgg

SEQ ID NO: 5617634 - DNA, 19 bp, Homo sapiens
gcactgccctggtggccct

SEQ ID NO: 5617635 - DNA, 13 bp, Homo sapiens
gcactgccctgtt

SEQ ID NO: 5617636 - DNA, 22 bp, Homo sapiens
gcactgcctcctgttttctccc

SEQ ID NO: 5617637 - DNA, 23 bp, Homo sapiens
gcactgcctcctgttttctccct

SEQ ID NO: 5617638 - DNA, 18 bp, Homo sapiens
gcactgcctctatgccct

SEQ ID NO: 5617639 - DNA, 21 bp, Homo sapiens
gcactgcctctatgccctgca

SEQ ID NO: 5617640 - DNA, 13 bp, Homo sapiens
gcactgcctctca

SEQ ID NO: 5617641 - DNA, 16 bp, Homo sapiens
gcactgcctctcacag

SEQ ID NO: 5617642 - DNA, 21 bp, Homo sapiens
gcactgcctctcacagctgag

SEQ ID NO: 5617643 - DNA, 18 bp, Homo sapiens
gcactgcctgatggacct

SEQ ID NO: 5617644 - DNA, 20 bp, Homo sapiens
gcactgcctgcatgagctgg

SEQ ID NO: 5617645 - DNA, 22 bp, Homo sapiens
gcactgcctgcatgagctggca

SEQ ID NO: 5617646 - DNA, 13 bp, Homo sapiens
gcactgcctgcca

SEQ ID NO: 5617647 - DNA, 14 bp, Homo sapiens
gcactgcctgccaa

SEQ ID NO: 5617648 - DNA, 22 bp, Homo sapiens
gcactgccttctcctctctggg

SEQ ID NO: 5617649 - DNA, 21 bp, Homo sapiens
gcactgctaggcgagtgccag

SEQ ID NO: 5617650 - DNA, 23 bp, Homo sapiens
gcactgctaggcgagtgccagga

SEQ ID NO: 5617651 - DNA, 18 bp, Homo sapiens
gcactgctccctacccca

SEQ ID NO: 5617652 - DNA, 20 bp, Homo sapiens
gcactgctccctaccccagg

SEQ ID NO: 5617653 - DNA, 17 bp, Homo sapiens
gcactgctgggtggccc

SEQ ID NO: 5617654 - DNA, 15 bp, Homo sapiens
gcactgctgtgctgt

SEQ ID NO: 5617655 - DNA, 13 bp, Homo sapiens
gcactgcttccag

SEQ ID NO: 5617656 - DNA, 14 bp, Homo sapiens
gcactgcttccagt

SEQ ID NO: 5617657 - DNA, 15 bp, Homo sapiens
gcactgcttccagtg

SEQ ID NO: 5617658 - DNA, 16 bp, Homo sapiens
gcactggaaaacatag

SEQ ID NO: 5617659 - DNA, 17 bp, Homo sapiens
gcactggactccggggc

SEQ ID NO: 5617660 - DNA, 13 bp, Homo sapiens
gcactggagccac

SEQ ID NO: 5617661 - DNA, 17 bp, Homo sapiens
gcactggagctgggagg

SEQ ID NO: 5617662 - DNA, 20 bp, Homo sapiens
gcactggaggggcccaccca

SEQ ID NO: 5617663 - DNA, 17 bp, Homo sapiens
gcactggagtccagtct

SEQ ID NO: 5617664 - DNA, 19 bp, Homo sapiens
gcactggatggagctggag

SEQ ID NO: 5617665 - DNA, 18 bp, Homo sapiens
gcactggattgtagaact

SEQ ID NO: 5617666 - DNA, 19 bp, Homo sapiens
gcactggattgtagaactt

SEQ ID NO: 5617667 - DNA, 22 bp, Homo sapiens
gcactggcaaacagggcctctg

SEQ ID NO: 5617668 - DNA, 19 bp, Homo sapiens
gcactggccagagagggcc

SEQ ID NO: 5617669 - DNA, 15 bp, Homo sapiens
gcactggccccaccc

SEQ ID NO: 5617670 - DNA, 15 bp, Homo sapiens
gcactggcctgcacg

SEQ ID NO: 5617671 - DNA, 11 bp, Homo sapiens
gcactggcctt

SEQ ID NO: 5617672 - DNA, 21 bp, Homo sapiens
gcactggccttctgatgaaat

SEQ ID NO: 5617673 - DNA, 15 bp, Homo sapiens
gcactggccttgcct

SEQ ID NO: 5617674 - DNA, 17 bp, Homo sapiens
gcactggcggtcaagtg

SEQ ID NO: 5617675 - DNA, 13 bp, Homo sapiens
gcactggctgctc

SEQ ID NO: 5617676 - DNA, 19 bp, Homo sapiens
gcactgggaagctggagtg

SEQ ID NO: 5617677 - DNA, 22 bp, Homo sapiens
gcactgggaatttatttatgtt

SEQ ID NO: 5617678 - DNA, 15 bp, Homo sapiens
gcactgggaggcagg

SEQ ID NO: 5617679 - DNA, 20 bp, Homo sapiens
gcactgggaggctccccttc

SEQ ID NO: 5617680 - DNA, 23 bp, Homo sapiens
gcactgggatgagccgctgtgag

SEQ ID NO: 5617681 - DNA, 17 bp, Homo sapiens
gcactgggcacaggccg

SEQ ID NO: 5617682 - DNA, 22 bp, Homo sapiens
gcactgggcaggttcctggggc

SEQ ID NO: 5617683 - DNA, 13 bp, Homo sapiens
gcactgggcatga

SEQ ID NO: 5617684 - DNA, 12 bp, Homo sapiens
gcactgggccac

SEQ ID NO: 5617685 - DNA, 22 bp, Homo sapiens
gcactgggcgtctgactccctc

SEQ ID NO: 5617686 - DNA, 21 bp, Homo sapiens
gcactgggctaatttgtatgt

SEQ ID NO: 5617687 - DNA, 14 bp, Homo sapiens
gcactgggctcccg

SEQ ID NO: 5617688 - DNA, 17 bp, Homo sapiens
gcactggggaaacataa

SEQ ID NO: 5617689 - DNA, 23 bp, Homo sapiens
gcactggggcgtttcctactgcg

SEQ ID NO: 5617690 - DNA, 21 bp, Homo sapiens
gcactgggttgcaggggattg

SEQ ID NO: 5617691 - DNA, 23 bp, Homo sapiens
gcactggtaggttgggacaccag

SEQ ID NO: 5617692 - DNA, 20 bp, Homo sapiens
gcactggtcggaccaggcag

SEQ ID NO: 5617693 - DNA, 23 bp, Homo sapiens
gcactggtgaactgagctgggca

SEQ ID NO: 5617694 - DNA, 21 bp, Homo sapiens
gcactggtgccaaaaccaggc

SEQ ID NO: 5617695 - DNA, 14 bp, Homo sapiens
gcactggtggcccg

SEQ ID NO: 5617696 - DNA, 23 bp, Homo sapiens
gcactggtggcccgacagcctgg

SEQ ID NO: 5617697 - DNA, 15 bp, Homo sapiens
gcactggtttgtttc

SEQ ID NO: 5617698 - DNA, 14 bp, Homo sapiens
gcactgtaaaatgt

SEQ ID NO: 5617699 - DNA, 16 bp, Homo sapiens
gcactgtaaaatgtgg

SEQ ID NO: 5617700 - DNA, 22 bp, Homo sapiens
gcactgtaaatatccctcccct

SEQ ID NO: 5617701 - DNA, 17 bp, Homo sapiens
gcactgtagttctaaga

SEQ ID NO: 5617702 - DNA, 18 bp, Homo sapiens
gcactgtagttctaagac

SEQ ID NO: 5617703 - DNA, 19 bp, Homo sapiens
gcactgtagttctaagact

SEQ ID NO: 5617704 - DNA, 20 bp, Homo sapiens
gcactgtatcatttcatgct

SEQ ID NO: 5617705 - DNA, 16 bp, Homo sapiens
gcactgtcactttgct

SEQ ID NO: 5617706 - DNA, 18 bp, Homo sapiens
gcactgtcactttgctct

SEQ ID NO: 5617707 - DNA, 20 bp, Homo sapiens
gcactgtcactttgctctgg

SEQ ID NO: 5617708 - DNA, 17 bp, Homo sapiens
gcactgtcatgcccagc

SEQ ID NO: 5617709 - DNA, 14 bp, Homo sapiens
gcactgtccagggc

SEQ ID NO: 5617710 - DNA, 17 bp, Homo sapiens
gcactgtccagggccca

SEQ ID NO: 5617711 - DNA, 22 bp, Homo sapiens
gcactgtcccagtagccaaggc

SEQ ID NO: 5617712 - DNA, 23 bp, Homo sapiens
gcactgtcccagtagccaaggcc

SEQ ID NO: 5617713 - DNA, 17 bp, Homo sapiens
gcactgtcccttgcctc

SEQ ID NO: 5617714 - DNA, 23 bp, Homo sapiens
gcactgtcccttgcctcaatgcc

SEQ ID NO: 5617715 - DNA, 20 bp, Homo sapiens
gcactgtcctgctccacagt

SEQ ID NO: 5617716 - DNA, 22 bp, Homo sapiens
gcactgtcctgctccacagtgt

SEQ ID NO: 5617717 - DNA, 19 bp, Homo sapiens
gcactgtctcagtttcact

SEQ ID NO: 5617718 - DNA, 15 bp, Homo sapiens
gcactgtctgcgtga

SEQ ID NO: 5617719 - DNA, 21 bp, Homo sapiens
gcactgtctgtacctaaagca

SEQ ID NO: 5617720 - DNA, 22 bp, Homo sapiens
gcactgtgaactattttgaaga

SEQ ID NO: 5617721 - DNA, 19 bp, Homo sapiens
gcactgtgaatcctggcaa

SEQ ID NO: 5617722 - DNA, 16 bp, Homo sapiens
gcactgtgatacagtt

SEQ ID NO: 5617723 - DNA, 17 bp, Homo sapiens
gcactgtgatacagttt

SEQ ID NO: 5617724 - DNA, 13 bp, Homo sapiens
gcactgtgctcag

SEQ ID NO: 5617725 - DNA, 17 bp, Homo sapiens
gcactgtggaactgcca

SEQ ID NO: 5617726 - DNA, 18 bp, Homo sapiens
gcactgtggaactgccac

SEQ ID NO: 5617727 - DNA, 15 bp, Homo sapiens
gcactgtggcactgc

SEQ ID NO: 5617728 - DNA, 19 bp, Homo sapiens
gcactgtggcactgccacc

SEQ ID NO: 5617729 - DNA, 13 bp, Homo sapiens
gcactgtggccct

SEQ ID NO: 5617730 - DNA, 18 bp, Homo sapiens
gcactgtgggggctggtc

SEQ ID NO: 5617731 - DNA, 21 bp, Homo sapiens
gcactgtggtcaggcccagcc

SEQ ID NO: 5617732 - DNA, 13 bp, Homo sapiens
gcactgtggtttc

SEQ ID NO: 5617733 - DNA, 19 bp, Homo sapiens
gcactgtggtttcagatgt

SEQ ID NO: 5617734 - DNA, 16 bp, Homo sapiens
gcactgtgtgctgact

SEQ ID NO: 5617735 - DNA, 20 bp, Homo sapiens
gcactgtgtttatatgtctt

SEQ ID NO: 5617736 - DNA, 22 bp, Homo sapiens
gcactgtgtttatatgtcttgc

SEQ ID NO: 5617737 - DNA, 18 bp, Homo sapiens
gcactgttcaggagtcca

SEQ ID NO: 5617738 - DNA, 21 bp, Homo sapiens
gcactgttccagcctgccctc

SEQ ID NO: 5617739 - DNA, 15 bp, Homo sapiens
gcactgttccccctg

SEQ ID NO: 5617740 - DNA, 20 bp, Homo sapiens
gcactgttccccctgtgcag

SEQ ID NO: 5617741 - DNA, 14 bp, Homo sapiens
gcactgttgagaag

SEQ ID NO: 5617742 - DNA, 15 bp, Homo sapiens
gcactgttgctgact

SEQ ID NO: 5617743 - DNA, 13 bp, Homo sapiens
gcactgtttatgg

SEQ ID NO: 5617744 - DNA, 16 bp, Homo sapiens
gcactgtttgaagatt

SEQ ID NO: 5617745 - DNA, 12 bp, Homo sapiens
gcactgtttgca

SEQ ID NO: 5617746 - DNA, 23 bp, Homo sapiens
gcactgtttgcatgcgcccgagg

SEQ ID NO: 5617747 - DNA, 14 bp, Homo sapiens
gcactgtttttcca

SEQ ID NO: 5617748 - DNA, 12 bp, Homo sapiens
gcacttaaaaat

SEQ ID NO: 5617749 - DNA, 14 bp, Homo sapiens
gcacttaaagaagt

SEQ ID NO: 5617750 - DNA, 18 bp, Homo sapiens
gcacttaaagctttcaga

SEQ ID NO: 5617751 - DNA, 21 bp, Homo sapiens
gcacttaaatatcaatcattt

SEQ ID NO: 5617752 - DNA, 18 bp, Homo sapiens
gcacttaagagaatattt

SEQ ID NO: 5617753 - DNA, 19 bp, Homo sapiens
gcacttaaggcactctgtt

SEQ ID NO: 5617754 - DNA, 22 bp, Homo sapiens
gcacttaatttgtaaacttctg

SEQ ID NO: 5617755 - DNA, 23 bp, Homo sapiens
gcacttaatttgtaaacttctga

SEQ ID NO: 5617756 - DNA, 17 bp, Homo sapiens
gcacttacaccagtttg

SEQ ID NO: 5617757 - DNA, 23 bp, Homo sapiens
gcacttacaccagtttgactgtg

SEQ ID NO: 5617758 - DNA, 22 bp, Homo sapiens
gcacttacacttataaaataac

SEQ ID NO: 5617759 - DNA, 21 bp, Homo sapiens
gcacttactggtccttaccag

SEQ ID NO: 5617760 - DNA, 15 bp, Homo sapiens
gcacttagcaggcac

SEQ ID NO: 5617761 - DNA, 13 bp, Homo sapiens
gcacttagccatg

SEQ ID NO: 5617762 - DNA, 19 bp, Homo sapiens
gcacttagctatcagaaga

SEQ ID NO: 5617763 - DNA, 19 bp, Homo sapiens
gcacttagctgttggaatg

SEQ ID NO: 5617764 - DNA, 21 bp, Homo sapiens
gcacttatctcgaatttgaag

SEQ ID NO: 5617765 - DNA, 14 bp, Homo sapiens
gcacttatggtaat

SEQ ID NO: 5617766 - DNA, 17 bp, Homo sapiens
gcacttattgaatatat

SEQ ID NO: 5617767 - DNA, 20 bp, Homo sapiens
gcacttattgaatatatgat

SEQ ID NO: 5617768 - DNA, 18 bp, Homo sapiens
gcacttattgaccatttt

SEQ ID NO: 5617769 - DNA, 23 bp, Homo sapiens
gcacttattgaccattttttaat

SEQ ID NO: 5617770 - DNA, 16 bp, Homo sapiens
gcacttattgtaaatt

SEQ ID NO: 5617771 - DNA, 18 bp, Homo sapiens
gcacttatttaatgccga

SEQ ID NO: 5617772 - DNA, 20 bp, Homo sapiens
gcacttattttttaatgtga

SEQ ID NO: 5617773 - DNA, 21 bp, Homo sapiens
gcacttattttttaatgtgag

SEQ ID NO: 5617774 - DNA, 18 bp, Homo sapiens
gcacttcaaattcaaata

SEQ ID NO: 5617775 - DNA, 15 bp, Homo sapiens
gcacttcaagcaaag

SEQ ID NO: 5617776 - DNA, 14 bp, Homo sapiens
gcacttcaggaggc

SEQ ID NO: 5617777 - DNA, 13 bp, Homo sapiens
gcacttcatatct

SEQ ID NO: 5617778 - DNA, 22 bp, Homo sapiens
gcacttcatatctagatttcta

SEQ ID NO: 5617779 - DNA, 17 bp, Homo sapiens
gcacttcatcccggagc

SEQ ID NO: 5617780 - DNA, 13 bp, Homo sapiens
gcacttccctgct

SEQ ID NO: 5617781 - DNA, 14 bp, Homo sapiens
gcacttccctgctg

SEQ ID NO: 5617782 - DNA, 15 bp, Homo sapiens
gcacttcctccacag

SEQ ID NO: 5617783 - DNA, 21 bp, Homo sapiens
gcacttccttttacctgccca

SEQ ID NO: 5617784 - DNA, 13 bp, Homo sapiens
gcacttctattta

SEQ ID NO: 5617785 - DNA, 19 bp, Homo sapiens
gcagagaaatgccccagtg

SEQ ID NO: 5617786 - DNA, 17 bp, Homo sapiens
gcagagaactgtctttc

SEQ ID NO: 5617787 - DNA, 20 bp, Homo sapiens
gcagagaagaataagacata

SEQ ID NO: 5617788 - DNA, 15 bp, Homo sapiens
gcagagaagagacca

SEQ ID NO: 5617789 - DNA, 17 bp, Homo sapiens
gcagagaagatgaaatt

SEQ ID NO: 5617790 - DNA, 18 bp, Homo sapiens
gcagagaagatgaaattt

SEQ ID NO: 5617791 - DNA, 20 bp, Homo sapiens
gcagagaagcatcctccaca

SEQ ID NO: 5617792 - DNA, 15 bp, Homo sapiens
gcagagaagccccgg

SEQ ID NO: 5617793 - DNA, 14 bp, Homo sapiens
gcagagaagccttg

SEQ ID NO: 5617794 - DNA, 16 bp, Homo sapiens
gcagagaagccttggt

SEQ ID NO: 5617795 - DNA, 15 bp, Homo sapiens
gcagagaagctggac

SEQ ID NO: 5617796 - DNA, 23 bp, Homo sapiens
gcagagaaggatgtccgttccag

SEQ ID NO: 5617797 - DNA, 12 bp, Homo sapiens
gcagagaaggct

SEQ ID NO: 5617798 - DNA, 17 bp, Homo sapiens
gcagagaaggcttcctc

SEQ ID NO: 5617799 - DNA, 19 bp, Homo sapiens
gcagagaagggcaggagag

SEQ ID NO: 5617800 - DNA, 12 bp, Homo sapiens
gcagagaatata

SEQ ID NO: 5617801 - DNA, 19 bp, Homo sapiens
gcagagaatggctgggtca

SEQ ID NO: 5617802 - DNA, 16 bp, Homo sapiens
gcagagaatgtgaaca

SEQ ID NO: 5617803 - DNA, 21 bp, Homo sapiens
gcagagaattctcttatccaa

SEQ ID NO: 5617804 - DNA, 18 bp, Homo sapiens
gcagagacaataaaacat

SEQ ID NO: 5617805 - DNA, 17 bp, Homo sapiens
gcagagacactttgtct

SEQ ID NO: 5617806 - DNA, 19 bp, Homo sapiens
gcagagaccataagagaaa

SEQ ID NO: 5617807 - DNA, 22 bp, Homo sapiens
gcagagaccataagagaaacct

SEQ ID NO: 5617808 - DNA, 17 bp, Homo sapiens
gcagagaccccaggatc

SEQ ID NO: 5617809 - DNA, 13 bp, Homo sapiens
gcagagacctcca

SEQ ID NO: 5617810 - DNA, 19 bp, Homo sapiens
gcagagacgcaagggagaa

SEQ ID NO: 5617811 - DNA, 14 bp, Homo sapiens
gcagagacggcagc

SEQ ID NO: 5617812 - DNA, 16 bp, Homo sapiens
gcagagacggcagccc

SEQ ID NO: 5617813 - DNA, 14 bp, Homo sapiens
gcagagagaagcct

SEQ ID NO: 5617814 - DNA, 11 bp, Homo sapiens
gcagagagaga

SEQ ID NO: 5617815 - DNA, 22 bp, Homo sapiens
gcagagagagaggacagagggg

SEQ ID NO: 5617816 - DNA, 20 bp, Homo sapiens
gcagagagatgcggccaaga

SEQ ID NO: 5617817 - DNA, 17 bp, Homo sapiens
gcagagagcaaaggaga

SEQ ID NO: 5617818 - DNA, 19 bp, Homo sapiens
gcagagagcgaccagcagg

SEQ ID NO: 5617819 - DNA, 20 bp, Homo sapiens
gcagagagcgaccagcaggc

SEQ ID NO: 5617820 - DNA, 12 bp, Homo sapiens
gcagagaggaag

SEQ ID NO: 5617821 - DNA, 19 bp, Homo sapiens
gcagagaggtaaagggtgg

SEQ ID NO: 5617822 - DNA, 14 bp, Homo sapiens
gcagagaggtggag

SEQ ID NO: 5617823 - DNA, 20 bp, Homo sapiens
gcagagatatttcttcagga

SEQ ID NO: 5617824 - DNA, 19 bp, Homo sapiens
gcagagatcgacagacagc

SEQ ID NO: 5617825 - DNA, 22 bp, Homo sapiens
gcagagatcgacagacagccag

SEQ ID NO: 5617826 - DNA, 16 bp, Homo sapiens
gcagagatgtgccccc

SEQ ID NO: 5617827 - DNA, 22 bp, Homo sapiens
gcagagatgtgcccccaccccc

SEQ ID NO: 5617828 - DNA, 21 bp, Homo sapiens
gcagagattgggggggcttgg

SEQ ID NO: 5617829 - DNA, 22 bp, Homo sapiens
gcagagattgggggggcttggg

SEQ ID NO: 5617830 - DNA, 12 bp, Homo sapiens
gcagagcaataa

SEQ ID NO: 5617831 - DNA, 18 bp, Homo sapiens
gcagagcaataacactat

SEQ ID NO: 5617832 - DNA, 21 bp, Homo sapiens
gcagagcaataacactatatt

SEQ ID NO: 5617833 - DNA, 16 bp, Homo sapiens
gcagagcaattccagg

SEQ ID NO: 5617834 - DNA, 18 bp, Homo sapiens
gcagagcaattccaggct

SEQ ID NO: 5617835 - DNA, 19 bp, Homo sapiens
gcagagcaattccaggctg

SEQ ID NO: 5617836 - DNA, 22 bp, Homo sapiens
gcagagcaattccaggctgagc

SEQ ID NO: 5617837 - DNA, 15 bp, Homo sapiens
gcagagcacagccca

SEQ ID NO: 5617838 - DNA, 17 bp, Homo sapiens
gcagagcacagcccacg

SEQ ID NO: 5617839 - DNA, 18 bp, Homo sapiens
gcagagcacagcccacgg

SEQ ID NO: 5617840 - DNA, 21 bp, Homo sapiens
gcagagcacctttgcacagga

SEQ ID NO: 5617841 - DNA, 12 bp, Homo sapiens
gcagagcagaga

SEQ ID NO: 5617842 - DNA, 14 bp, Homo sapiens
gcagagcagagacc

SEQ ID NO: 5617843 - DNA, 18 bp, Homo sapiens
gcagagcagcagcacctt

SEQ ID NO: 5617844 - DNA, 13 bp, Homo sapiens
gcagagcaggaag

SEQ ID NO: 5617845 - DNA, 15 bp, Homo sapiens
gcagagcaggaagga

SEQ ID NO: 5617846 - DNA, 14 bp, Homo sapiens
gcagagcaggggca

SEQ ID NO: 5617847 - DNA, 21 bp, Homo sapiens
gcagagcattttttatgatat

SEQ ID NO: 5617848 - DNA, 11 bp, Homo sapiens
gcagagccaag

SEQ ID NO: 5617849 - DNA, 14 bp, Homo sapiens
gcagagccaaggcc

SEQ ID NO: 5617850 - DNA, 19 bp, Homo sapiens
gcagagccaccagggcact

SEQ ID NO: 5617851 - DNA, 16 bp, Homo sapiens
gcagagccaggaagat

SEQ ID NO: 5617852 - DNA, 13 bp, Homo sapiens
gcagagccagggc

SEQ ID NO: 5617853 - DNA, 21 bp, Homo sapiens
gcagagccatgggcctgggcc

SEQ ID NO: 5617854 - DNA, 22 bp, Homo sapiens
gcagagccatgggcctgggcct

SEQ ID NO: 5617855 - DNA, 17 bp, Homo sapiens
gcagagcccaccagcca

SEQ ID NO: 5617856 - DNA, 16 bp, Homo sapiens
gcagagccccggagca

SEQ ID NO: 5617857 - DNA, 16 bp, Homo sapiens
gcagagcccggagctc

SEQ ID NO: 5617858 - DNA, 18 bp, Homo sapiens
gcagagcccggccccacc

SEQ ID NO: 5617859 - DNA, 17 bp, Homo sapiens
gcagagccgttcctggg

SEQ ID NO: 5617860 - DNA, 20 bp, Homo sapiens
gcagagcctcccaaggagaa

SEQ ID NO: 5617861 - DNA, 16 bp, Homo sapiens
gcagagcctcctggga

SEQ ID NO: 5617862 - DNA, 17 bp, Homo sapiens
gcagagcctcctgggaa

SEQ ID NO: 5617863 - DNA, 13 bp, Homo sapiens
gcagagcctgggg

SEQ ID NO: 5617864 - DNA, 14 bp, Homo sapiens
gcagagcctgtccc

SEQ ID NO: 5617865 - DNA, 16 bp, Homo sapiens
gcagagccttctcaga

SEQ ID NO: 5617866 - DNA, 19 bp, Homo sapiens
gcagagccttctcagaagc

SEQ ID NO: 5617867 - DNA, 23 bp, Homo sapiens
gcagagccttctcagaagcacag

SEQ ID NO: 5617868 - DNA, 13 bp, Homo sapiens
gcagagcgcagcc

SEQ ID NO: 5617869 - DNA, 16 bp, Homo sapiens
gcagagcgcagccccc

SEQ ID NO: 5617870 - DNA, 23 bp, Homo sapiens
gcagagcgccgtgagttctcagg

SEQ ID NO: 5617871 - DNA, 18 bp, Homo sapiens
gcagagcgcgcccctagc

SEQ ID NO: 5617872 - DNA, 19 bp, Homo sapiens
gcagagcgcgcccctagcc

SEQ ID NO: 5617873 - DNA, 21 bp, Homo sapiens
gcagagcgggactctgtccaa

SEQ ID NO: 5617874 - DNA, 18 bp, Homo sapiens
gcagagctcagaggagtc

SEQ ID NO: 5617875 - DNA, 19 bp, Homo sapiens
gcagagctcagcacagcct

SEQ ID NO: 5617876 - DNA, 19 bp, Homo sapiens
gcagagctctacaggcctg

SEQ ID NO: 5617877 - DNA, 20 bp, Homo sapiens
gcagagctctacaggcctgc

SEQ ID NO: 5617878 - DNA, 23 bp, Homo sapiens
gcagagctctcccctcctgctgg

SEQ ID NO: 5617879 - DNA, 20 bp, Homo sapiens
gcagagctgagggccctgtg

SEQ ID NO: 5617880 - DNA, 20 bp, Homo sapiens
gcagagctgagtcggctggg

SEQ ID NO: 5617881 - DNA, 22 bp, Homo sapiens
gcagagctgagtcggctgggca

SEQ ID NO: 5617882 - DNA, 18 bp, Homo sapiens
gcagagctgatggagaag

SEQ ID NO: 5617883 - DNA, 21 bp, Homo sapiens
gcagagctgatggagaaggaa

SEQ ID NO: 5617884 - DNA, 22 bp, Homo sapiens
gcagagctgcacttggcctcag

SEQ ID NO: 5617885 - DNA, 17 bp, Homo sapiens
gcagagctgcgggctgg

SEQ ID NO: 5617886 - DNA, 13 bp, Homo sapiens
gcagagctggaca

SEQ ID NO: 5617887 - DNA, 13 bp, Homo sapiens
gcagagctggagc

SEQ ID NO: 5617888 - DNA, 22 bp, Homo sapiens
gcagagctggagcccccagcag

SEQ ID NO: 5617889 - DNA, 12 bp, Homo sapiens
gcagagctggct

SEQ ID NO: 5617890 - DNA, 14 bp, Homo sapiens
gcagagctggctct

SEQ ID NO: 5617891 - DNA, 15 bp, Homo sapiens
gcagagctggctctg

SEQ ID NO: 5617892 - DNA, 23 bp, Homo sapiens
gcagagctggctctgagcgcctc

SEQ ID NO: 5617893 - DNA, 20 bp, Homo sapiens
gcagagctggggctgccagc

SEQ ID NO: 5617894 - DNA, 21 bp, Homo sapiens
gcagagctggggctgccagcc

SEQ ID NO: 5617895 - DNA, 13 bp, Homo sapiens
gcagagctggtgc

SEQ ID NO: 5617896 - DNA, 14 bp, Homo sapiens
gcagagctggtgcg

SEQ ID NO: 5617897 - DNA, 17 bp, Homo sapiens
gcagagcttctcctgac

SEQ ID NO: 5617898 - DNA, 20 bp, Homo sapiens
gcagagcttgtggtggggca

SEQ ID NO: 5617899 - DNA, 19 bp, Homo sapiens
gcagaggaaaaagaaaaac

SEQ ID NO: 5617900 - DNA, 13 bp, Homo sapiens
gcagaggaaagca

SEQ ID NO: 5617901 - DNA, 21 bp, Homo sapiens
gcagaggaaagcaaaggagat

SEQ ID NO: 5617902 - DNA, 20 bp, Homo sapiens
gcagaggaacccccaccaga

SEQ ID NO: 5617903 - DNA, 12 bp, Homo sapiens
gcagaggaatgt

SEQ ID NO: 5617904 - DNA, 23 bp, Homo sapiens
gcagaggaattggtgtgccttaa

SEQ ID NO: 5617905 - DNA, 22 bp, Homo sapiens
gcagaggacagtctggagaagg

SEQ ID NO: 5617906 - DNA, 14 bp, Homo sapiens
gcagaggaccacag

SEQ ID NO: 5617907 - DNA, 24 bp, Homo sapiens
gcagaggacgcacgctcgctgcca

SEQ ID NO: 5617908 - DNA, 19 bp, Homo sapiens
gcagaggagaacttgctgc

SEQ ID NO: 5617909 - DNA, 22 bp, Homo sapiens
gcagaggagaacttgctgcctc

SEQ ID NO: 5617910 - DNA, 14 bp, Homo sapiens
gcagaggagcccag

SEQ ID NO: 5617911 - DNA, 19 bp, Homo sapiens
gcagaggagctgagttggc

SEQ ID NO: 5617912 - DNA, 15 bp, Homo sapiens
gcagaggaggagaaa

SEQ ID NO: 5617913 - DNA, 14 bp, Homo sapiens
gcagaggaggggcc

SEQ ID NO: 5617914 - DNA, 15 bp, Homo sapiens
gcagaggaggggccg

SEQ ID NO: 5617915 - DNA, 17 bp, Homo sapiens
gcagaggagtccagggc

SEQ ID NO: 5617916 - DNA, 16 bp, Homo sapiens
gcagaggatgttcata

SEQ ID NO: 5617917 - DNA, 21 bp, Homo sapiens
gcagaggcaagcgaccgaggc

SEQ ID NO: 5617918 - DNA, 19 bp, Homo sapiens
gcagaggcagcaggagcca

SEQ ID NO: 5617919 - DNA, 22 bp, Homo sapiens
gcagaggcaggaccagaaggca

SEQ ID NO: 5617920 - DNA, 15 bp, Homo sapiens
gcagaggcaggctgg

SEQ ID NO: 5617921 - DNA, 13 bp, Homo sapiens
gcagaggcagggc

SEQ ID NO: 5617922 - DNA, 17 bp, Homo sapiens
gcagaggcagggccctg

SEQ ID NO: 5617923 - DNA, 18 bp, Homo sapiens
gcagaggcagggccctgg

SEQ ID NO: 5617924 - DNA, 16 bp, Homo sapiens
gcagaggcagtggcca

SEQ ID NO: 5617925 - DNA, 17 bp, Homo sapiens
gcagaggcagtggccac

SEQ ID NO: 5617926 - DNA, 10 bp, Homo sapiens
gcagaggccc

SEQ ID NO: 5617927 - DNA, 13 bp, Homo sapiens
gcagaggccctgc

SEQ ID NO: 5617928 - DNA, 16 bp, Homo sapiens
gcagaggccctgcccc

SEQ ID NO: 5617929 - DNA, 22 bp, Homo sapiens
gcagaggccctgcccccacccc

SEQ ID NO: 5617930 - DNA, 18 bp, Homo sapiens
gcagaggcctgcagggcc

SEQ ID NO: 5617931 - DNA, 21 bp, Homo sapiens
gcagaggcctgcagggcctct

SEQ ID NO: 5617932 - DNA, 22 bp, Homo sapiens
gcagaggcctgggctgggaaaa

SEQ ID NO: 5617933 - DNA, 13 bp, Homo sapiens
gcagaggcggaaa

SEQ ID NO: 5617934 - DNA, 16 bp, Homo sapiens
gcagaggcggaaacct

SEQ ID NO: 5617935 - DNA, 17 bp, Homo sapiens
gcagaggcggaaacctt

SEQ ID NO: 5617936 - DNA, 23 bp, Homo sapiens
gcagaggcggaaaccttgcagca

SEQ ID NO: 5617937 - DNA, 19 bp, Homo sapiens
gcagaggctggaggcaggg

SEQ ID NO: 5617938 - DNA, 14 bp, Homo sapiens
gcagaggctggcct

SEQ ID NO: 5617939 - DNA, 18 bp, Homo sapiens
gcagaggctggcctcaga

SEQ ID NO: 5617940 - DNA, 18 bp, Homo sapiens
gcagaggctgtggctggt

SEQ ID NO: 5617941 - DNA, 14 bp, Homo sapiens
gcagaggctttggg

SEQ ID NO: 5617942 - DNA, 14 bp, Homo sapiens
gcagagggacaacc

SEQ ID NO: 5617943 - DNA, 19 bp, Homo sapiens
gcagagggacaaccagaag

SEQ ID NO: 5617944 - DNA, 20 bp, Homo sapiens
gcagagggacaaccagaagg

SEQ ID NO: 5617945 - DNA, 22 bp, Homo sapiens
gcagagggacaaccagaaggcc

SEQ ID NO: 5617946 - DNA, 21 bp, Homo sapiens
gcagagggagacggccctgct

SEQ ID NO: 5617947 - DNA, 16 bp, Homo sapiens
gcagagggcagaggct

SEQ ID NO: 5617948 - DNA, 18 bp, Homo sapiens
gcagagggcagaggctgg

SEQ ID NO: 5617949 - DNA, 19 bp, Homo sapiens
gcagagggcagaggctgga

SEQ ID NO: 5617950 - DNA, 12 bp, Homo sapiens
gcagagggctgg

SEQ ID NO: 5617951 - DNA, 13 bp, Homo sapiens
gcagagggctgga

SEQ ID NO: 5617952 - DNA, 18 bp, Homo sapiens
gcagagggctggaggccc

SEQ ID NO: 5617953 - DNA, 19 bp, Homo sapiens
gcagagggctttcagcgcc

SEQ ID NO: 5617954 - DNA, 14 bp, Homo sapiens
gcagaggggagagg

SEQ ID NO: 5617955 - DNA, 18 bp, Homo sapiens
gcagaggggagaggaagc

SEQ ID NO: 5617956 - DNA, 19 bp, Homo sapiens
gcagaggggagaggaagca

SEQ ID NO: 5617957 - DNA, 14 bp, Homo sapiens
gcagaggggcagag

SEQ ID NO: 5617958 - DNA, 13 bp, Homo sapiens
gcagaggggcagc

SEQ ID NO: 5617959 - DNA, 14 bp, Homo sapiens
gcagaggggcagcc

SEQ ID NO: 5617960 - DNA, 15 bp, Homo sapiens
gcagaggggcagccg

SEQ ID NO: 5617961 - DNA, 17 bp, Homo sapiens
gcagaggggcaggccct

SEQ ID NO: 5617962 - DNA, 16 bp, Homo sapiens
gcagaggggccaggcc

SEQ ID NO: 5617963 - DNA, 17 bp, Homo sapiens
gcagccagacccagagc

SEQ ID NO: 5617964 - DNA, 13 bp, Homo sapiens
gcagccagagctg

SEQ ID NO: 5617965 - DNA, 17 bp, Homo sapiens
gcagccagagctgtgcc

SEQ ID NO: 5617966 - DNA, 17 bp, Homo sapiens
gcagccagatccccagg

SEQ ID NO: 5617967 - DNA, 12 bp, Homo sapiens
gcagccagcaga

SEQ ID NO: 5617968 - DNA, 15 bp, Homo sapiens
gcagccagcagaggg

SEQ ID NO: 5617969 - DNA, 15 bp, Homo sapiens
gcagccagcatctgg

SEQ ID NO: 5617970 - DNA, 19 bp, Homo sapiens
gcagccagcatctgggcct

SEQ ID NO: 5617971 - DNA, 17 bp, Homo sapiens
gcagccagccctgcctg

SEQ ID NO: 5617972 - DNA, 22 bp, Homo sapiens
gcagccagccctgcctggagga

SEQ ID NO: 5617973 - DNA, 13 bp, Homo sapiens
gcagccagccgtg

SEQ ID NO: 5617974 - DNA, 14 bp, Homo sapiens
gcagccagccgtgg

SEQ ID NO: 5617975 - DNA, 19 bp, Homo sapiens
gcagccagctccccacacc

SEQ ID NO: 5617976 - DNA, 13 bp, Homo sapiens
gcagccagctctc

SEQ ID NO: 5617977 - DNA, 12 bp, Homo sapiens
gcagccaggacc

SEQ ID NO: 5617978 - DNA, 18 bp, Homo sapiens
gcagccaggacccgcctg

SEQ ID NO: 5617979 - DNA, 21 bp, Homo sapiens
gcagccaggacccgcctgctc

SEQ ID NO: 5617980 - DNA, 16 bp, Homo sapiens
gcagccaggaggagag

SEQ ID NO: 5617981 - DNA, 14 bp, Homo sapiens
gcagccaggaggga

SEQ ID NO: 5617982 - DNA, 16 bp, Homo sapiens
gcagccaggagggacc

SEQ ID NO: 5617983 - DNA, 13 bp, Homo sapiens
gcagccaggccac

SEQ ID NO: 5617984 - DNA, 12 bp, Homo sapiens
gcagccaggcct

SEQ ID NO: 5617985 - DNA, 14 bp, Homo sapiens
gcagccaggcctcg

SEQ ID NO: 5617986 - DNA, 19 bp, Homo sapiens
gcagccaggcctcgcctgc

SEQ ID NO: 5617987 - DNA, 19 bp, Homo sapiens
gcagccaggctgcacagca

SEQ ID NO: 5617988 - DNA, 17 bp, Homo sapiens
gcagccaggctgccaag

SEQ ID NO: 5617989 - DNA, 16 bp, Homo sapiens
gcagccagggaccccc

SEQ ID NO: 5617990 - DNA, 20 bp, Homo sapiens
gcagccagggagagcccagg

SEQ ID NO: 5617991 - DNA, 17 bp, Homo sapiens
gcagccagggagcccgg

SEQ ID NO: 5617992 - DNA, 13 bp, Homo sapiens
gcagccagggctg

SEQ ID NO: 5617993 - DNA, 13 bp, Homo sapiens
gcagccagtcagg

SEQ ID NO: 5617994 - DNA, 18 bp, Homo sapiens
gcagccagtctcagagac

SEQ ID NO: 5617995 - DNA, 13 bp, Homo sapiens
gcagccagtgaga

SEQ ID NO: 5617996 - DNA, 18 bp, Homo sapiens
gcagccatcccaaggctc

SEQ ID NO: 5617997 - DNA, 23 bp, Homo sapiens
gcagccatgaccagttctggcca

SEQ ID NO: 5617998 - DNA, 11 bp, Homo sapiens
gcagccatgcc

SEQ ID NO: 5617999 - DNA, 18 bp, Homo sapiens
gcagccatgcctcatgcc

SEQ ID NO: 5618000 - DNA, 20 bp, Homo sapiens
gcagccatgcctcatgccac

SEQ ID NO: 5618001 - DNA, 22 bp, Homo sapiens
gcagccatttctccatggagtt

SEQ ID NO: 5618002 - DNA, 18 bp, Homo sapiens
gcagcccacagaggacag

SEQ ID NO: 5618003 - DNA, 15 bp, Homo sapiens
gcagcccaccagacg

SEQ ID NO: 5618004 - DNA, 16 bp, Homo sapiens
gcagcccaccaggagc

SEQ ID NO: 5618005 - DNA, 18 bp, Homo sapiens
gcagcccacccctcaaca

SEQ ID NO: 5618006 - DNA, 14 bp, Homo sapiens
gcagcccacctgct

SEQ ID NO: 5618007 - DNA, 16 bp, Homo sapiens
gcagcccactgcaccg

SEQ ID NO: 5618008 - DNA, 22 bp, Homo sapiens
gcagcccactgcaccgcctcag

SEQ ID NO: 5618009 - DNA, 19 bp, Homo sapiens
gcagcccagaacgggcctc

SEQ ID NO: 5618010 - DNA, 20 bp, Homo sapiens
gcagcccagaacgggcctcc

SEQ ID NO: 5618011 - DNA, 22 bp, Homo sapiens
gcagcccagaacgggcctcccc

SEQ ID NO: 5618012 - DNA, 13 bp, Homo sapiens
gcagcccagagag

SEQ ID NO: 5618013 - DNA, 23 bp, Homo sapiens
gcagcccagagagaccctgccaa

SEQ ID NO: 5618014 - DNA, 11 bp, Homo sapiens
gcagcccagcc

SEQ ID NO: 5618015 - DNA, 21 bp, Homo sapiens
gcagcccagcctagtcagggc

SEQ ID NO: 5618016 - DNA, 13 bp, Homo sapiens
gcagcccagcctc

SEQ ID NO: 5618017 - DNA, 20 bp, Homo sapiens
gcagcccagcttcctggtgt

SEQ ID NO: 5618018 - DNA, 14 bp, Homo sapiens
gcagcccaggaagt

SEQ ID NO: 5618019 - DNA, 12 bp, Homo sapiens
gcagcccaggcc

SEQ ID NO: 5618020 - DNA, 19 bp, Homo sapiens
gcagcccagggcctagagg

SEQ ID NO: 5618021 - DNA, 17 bp, Homo sapiens
gcagcccatgcccacct

SEQ ID NO: 5618022 - DNA, 22 bp, Homo sapiens
gcagccccaaattgtcacctgc

SEQ ID NO: 5618023 - DNA, 17 bp, Homo sapiens
gcagccccacagtccca

SEQ ID NO: 5618024 - DNA, 13 bp, Homo sapiens
gcagccccacttc

SEQ ID NO: 5618025 - DNA, 12 bp, Homo sapiens
gcagccccagag

SEQ ID NO: 5618026 - DNA, 15 bp, Homo sapiens
gcagccccagagaga

SEQ ID NO: 5618027 - DNA, 16 bp, Homo sapiens
gcagccccagagagag

SEQ ID NO: 5618028 - DNA, 14 bp, Homo sapiens
gcagccccagcctg

SEQ ID NO: 5618029 - DNA, 15 bp, Homo sapiens
gcagccccagcctgc

SEQ ID NO: 5618030 - DNA, 14 bp, Homo sapiens
gcagccccaggaga

SEQ ID NO: 5618031 - DNA, 15 bp, Homo sapiens
gcagccccaggcctc

SEQ ID NO: 5618032 - DNA, 16 bp, Homo sapiens
gcagccccaggcctcc

SEQ ID NO: 5618033 - DNA, 16 bp, Homo sapiens
gcagccccagggcctg

SEQ ID NO: 5618034 - DNA, 18 bp, Homo sapiens
gcagccccatccttcccg

SEQ ID NO: 5618035 - DNA, 17 bp, Homo sapiens
gcagccccattctgcct

SEQ ID NO: 5618036 - DNA, 19 bp, Homo sapiens
gcagccccattctgcctgc

SEQ ID NO: 5618037 - DNA, 12 bp, Homo sapiens
gcagcccccaaa

SEQ ID NO: 5618038 - DNA, 22 bp, Homo sapiens
gcagcccccaaagagctgtggc

SEQ ID NO: 5618039 - DNA, 11 bp, Homo sapiens
gcagcccccac

SEQ ID NO: 5618040 - DNA, 13 bp, Homo sapiens
gcagcccccacgc

SEQ ID NO: 5618041 - DNA, 17 bp, Homo sapiens
gcagcccccactgacct

SEQ ID NO: 5618042 - DNA, 19 bp, Homo sapiens
gcagcccccactgacctgc

SEQ ID NO: 5618043 - DNA, 14 bp, Homo sapiens
gcagcccccagctc

SEQ ID NO: 5618044 - DNA, 19 bp, Homo sapiens
gcagcccccagctcccacc

SEQ ID NO: 5618045 - DNA, 13 bp, Homo sapiens
gcagccccccacg

SEQ ID NO: 5618046 - DNA, 21 bp, Homo sapiens
gcagccccccacgcttctgga

SEQ ID NO: 5618047 - DNA, 14 bp, Homo sapiens
gcagccccccagca

SEQ ID NO: 5618048 - DNA, 14 bp, Homo sapiens
gcagcccccccctc

SEQ ID NO: 5618049 - DNA, 15 bp, Homo sapiens
gcagcccccccctca

SEQ ID NO: 5618050 - DNA, 13 bp, Homo sapiens
gcagccccctcca

SEQ ID NO: 5618051 - DNA, 19 bp, Homo sapiens
gcagccccctccacaccag

SEQ ID NO: 5618052 - DNA, 20 bp, Homo sapiens
gcagccccctcctgacccca

SEQ ID NO: 5618053 - DNA, 14 bp, Homo sapiens
gcagccccctgtgg

SEQ ID NO: 5618054 - DNA, 21 bp, Homo sapiens
gcagccccgacccctgtccag

SEQ ID NO: 5618055 - DNA, 17 bp, Homo sapiens
gcagccccgcgaccacc

SEQ ID NO: 5618056 - DNA, 20 bp, Homo sapiens
gcagccccgtggggttcctc

SEQ ID NO: 5618057 - DNA, 21 bp, Homo sapiens
gcagccccgttttggggacgt

SEQ ID NO: 5618058 - DNA, 12 bp, Homo sapiens
gcagcccctccc

SEQ ID NO: 5618059 - DNA, 14 bp, Homo sapiens
gcagcccctcccag

SEQ ID NO: 5618060 - DNA, 16 bp, Homo sapiens
gcagcccctcccagat

SEQ ID NO: 5618061 - DNA, 14 bp, Homo sapiens
gcagcccctcccca

SEQ ID NO: 5618062 - DNA, 19 bp, Homo sapiens
gcagcccctccccacacca

SEQ ID NO: 5618063 - DNA, 18 bp, Homo sapiens
gcagcccctcgaggccta

SEQ ID NO: 5618064 - DNA, 23 bp, Homo sapiens
gcagcccctcgaggcctacagag

SEQ ID NO: 5618065 - DNA, 19 bp, Homo sapiens
gcagcccctctcacaggca

SEQ ID NO: 5618066 - DNA, 20 bp, Homo sapiens
gcagcccctgagagcctgtg

SEQ ID NO: 5618067 - DNA, 14 bp, Homo sapiens
gcagcccctgctgg

SEQ ID NO: 5618068 - DNA, 12 bp, Homo sapiens
gcagcccctgga

SEQ ID NO: 5618069 - DNA, 13 bp, Homo sapiens
gcagcccctggga

SEQ ID NO: 5618070 - DNA, 14 bp, Homo sapiens
gcagcccctgggcc

SEQ ID NO: 5618071 - DNA, 15 bp, Homo sapiens
gcagcccctgttttc

SEQ ID NO: 5618072 - DNA, 23 bp, Homo sapiens
gcagcccctgttttctgctgttt

SEQ ID NO: 5618073 - DNA, 21 bp, Homo sapiens
gcagccccttctggccggtgc

SEQ ID NO: 5618074 - DNA, 16 bp, Homo sapiens
gcagcccctttcccca

SEQ ID NO: 5618075 - DNA, 16 bp, Homo sapiens
gcagcccgaagcccag

SEQ ID NO: 5618076 - DNA, 21 bp, Homo sapiens
gcagcccgatgtccctgtccc

SEQ ID NO: 5618077 - DNA, 15 bp, Homo sapiens
gcagcccgcctgccg

SEQ ID NO: 5618078 - DNA, 19 bp, Homo sapiens
gcagcccgcctgccgtgca

SEQ ID NO: 5618079 - DNA, 17 bp, Homo sapiens
gcagcccggctgctgct

SEQ ID NO: 5618080 - DNA, 19 bp, Homo sapiens
gcagcccgtgtccaggagc

SEQ ID NO: 5618081 - DNA, 20 bp, Homo sapiens
gcagcccgtgtggccccttc

SEQ ID NO: 5618082 - DNA, 18 bp, Homo sapiens
gcagccctagagcctgcc

SEQ ID NO: 5618083 - DNA, 17 bp, Homo sapiens
gcagccctagcggctgc

SEQ ID NO: 5618084 - DNA, 22 bp, Homo sapiens
gcagccctagtgggagcccagc

SEQ ID NO: 5618085 - DNA, 23 bp, Homo sapiens
gcagccctagtgggagcccagca

SEQ ID NO: 5618086 - DNA, 18 bp, Homo sapiens
gcagccctcaacaggccc

SEQ ID NO: 5618087 - DNA, 19 bp, Homo sapiens
gcagccctcaacaggccca

SEQ ID NO: 5618088 - DNA, 20 bp, Homo sapiens
gcagccctcaacaggcccag

SEQ ID NO: 5618089 - DNA, 10 bp, Homo sapiens
gcagccctcc

SEQ ID NO: 5618090 - DNA, 12 bp, Homo sapiens
gcagccctccat

SEQ ID NO: 5618091 - DNA, 19 bp, Homo sapiens
gcagccctccatggtcctg

SEQ ID NO: 5618092 - DNA, 15 bp, Homo sapiens
gcagccctcctcacc

SEQ ID NO: 5618093 - DNA, 13 bp, Homo sapiens
gcagccctcctta

SEQ ID NO: 5618094 - DNA, 15 bp, Homo sapiens
gcagccctcgggacc

SEQ ID NO: 5618095 - DNA, 14 bp, Homo sapiens
gcagccctctccac

SEQ ID NO: 5618096 - DNA, 19 bp, Homo sapiens
gcagccctctccacccaga

SEQ ID NO: 5618097 - DNA, 22 bp, Homo sapiens
gcagccctctccacccagaggt

SEQ ID NO: 5618098 - DNA, 11 bp, Homo sapiens
gcagccctgag

SEQ ID NO: 5618099 - DNA, 14 bp, Homo sapiens
gcagccctgagtgg

SEQ ID NO: 5618100 - DNA, 20 bp, Homo sapiens
gcagccctgagtggtcactg

SEQ ID NO: 5618101 - DNA, 17 bp, Homo sapiens
gcagccctgcagagggc

SEQ ID NO: 5618102 - DNA, 16 bp, Homo sapiens
gcagccctgccccaca

SEQ ID NO: 5618103 - DNA, 19 bp, Homo sapiens
gcagccctgccccacacct

SEQ ID NO: 5618104 - DNA, 20 bp, Homo sapiens
gcagccctgctgctgcctgc

SEQ ID NO: 5618105 - DNA, 21 bp, Homo sapiens
gcagccctgctgctgcctgcc

SEQ ID NO: 5618106 - DNA, 13 bp, Homo sapiens
gcagccctgcttt

SEQ ID NO: 5618107 - DNA, 13 bp, Homo sapiens
gcagccctggatg

SEQ ID NO: 5618108 - DNA, 19 bp, Homo sapiens
gcagccctggcagggggca

SEQ ID NO: 5618109 - DNA, 14 bp, Homo sapiens
gcagccctggccca

SEQ ID NO: 5618110 - DNA, 18 bp, Homo sapiens
gcagccctggcccatcat

SEQ ID NO: 5618111 - DNA, 14 bp, Homo sapiens
gcagccctggcccc

SEQ ID NO: 5618112 - DNA, 17 bp, Homo sapiens
gcagccctggcccccat

SEQ ID NO: 5618113 - DNA, 14 bp, Homo sapiens
gcagcccttccaaa

SEQ ID NO: 5618114 - DNA, 21 bp, Homo sapiens
gcagcccttgctttcggagct

SEQ ID NO: 5618115 - DNA, 15 bp, Homo sapiens
gcagcccttggccag

SEQ ID NO: 5618116 - DNA, 12 bp, Homo sapiens
gcagcccttggg

SEQ ID NO: 5618117 - DNA, 20 bp, Homo sapiens
gcagcccttgtgtgtgccct

SEQ ID NO: 5618118 - DNA, 16 bp, Homo sapiens
gcagcccttgtttata

SEQ ID NO: 5618119 - DNA, 23 bp, Homo sapiens
gcagccgaggtccctgctgccag

SEQ ID NO: 5618120 - DNA, 17 bp, Homo sapiens
gcagccgcagagaaatg

SEQ ID NO: 5618121 - DNA, 13 bp, Homo sapiens
gcagccgccagct

SEQ ID NO: 5618122 - DNA, 19 bp, Homo sapiens
gcagccgccgccgcccacg

SEQ ID NO: 5618123 - DNA, 14 bp, Homo sapiens
gcagccgccgggca

SEQ ID NO: 5618124 - DNA, 20 bp, Homo sapiens
gcagccgccttaagctgatc

SEQ ID NO: 5618125 - DNA, 16 bp, Homo sapiens
gcagccgcgctctgcc

SEQ ID NO: 5618126 - DNA, 17 bp, Homo sapiens
gcagccgcgctctgccc

SEQ ID NO: 5618127 - DNA, 18 bp, Homo sapiens
gcagccgcgctctgcccc

SEQ ID NO: 5618128 - DNA, 19 bp, Homo sapiens
gcagccgctaggagagact

SEQ ID NO: 5618129 - DNA, 19 bp, Homo sapiens
gcagccggaatagagcctc

SEQ ID NO: 5618130 - DNA, 20 bp, Homo sapiens
gcagccggaatagagcctcg

SEQ ID NO: 5618131 - DNA, 18 bp, Homo sapiens
gcagccggaggaggagat

SEQ ID NO: 5618132 - DNA, 21 bp, Homo sapiens
gcagccggagggaggcactag

SEQ ID NO: 5618133 - DNA, 19 bp, Homo sapiens
gcagccggagtcactgcct

SEQ ID NO: 5618134 - DNA, 19 bp, Homo sapiens
gcagccggcacagggtctg

SEQ ID NO: 5618135 - DNA, 15 bp, Homo sapiens
gcagccggggagctg

SEQ ID NO: 5618136 - DNA, 19 bp, Homo sapiens
gcagccggggagctgaggg

SEQ ID NO: 5618137 - DNA, 20 bp, Homo sapiens
gcagccggggagctgagggg

SEQ ID NO: 5618138 - DNA, 23 bp, Homo sapiens
gcagccggggagctgaggggcag

SEQ ID NO: 5618139 - DNA, 15 bp, Homo sapiens
gcagccgtgcaggac

SEQ ID NO: 5618140 - DNA, 16 bp, Homo sapiens
gcagccgtgcaggact

SEQ ID NO: 5618141 - DNA, 15 bp, Homo sapiens
gcagccgtgccttca

SEQ ID NO: 5618142 - DNA, 21 bp, Homo sapiens
gcagcctaagaagaaggccag

SEQ ID NO: 5618143 - DNA, 20 bp, Homo sapiens
gcagcttgaatggtttttct

SEQ ID NO: 5618144 - DNA, 13 bp, Homo sapiens
gcagcttgacgcg

SEQ ID NO: 5618145 - DNA, 16 bp, Homo sapiens
gcagcttgctgggctt

SEQ ID NO: 5618146 - DNA, 11 bp, Homo sapiens
gcagcttggct

SEQ ID NO: 5618147 - DNA, 15 bp, Homo sapiens
gcagcttggctgagc

SEQ ID NO: 5618148 - DNA, 17 bp, Homo sapiens
gcagcttggctgagccc

SEQ ID NO: 5618149 - DNA, 21 bp, Homo sapiens
gcagcttgggagagcccctgg

SEQ ID NO: 5618150 - DNA, 14 bp, Homo sapiens
gcagcttgtagcca

SEQ ID NO: 5618151 - DNA, 17 bp, Homo sapiens
gcagcttgtagccagcc

SEQ ID NO: 5618152 - DNA, 18 bp, Homo sapiens
gcagcttgtagccagccg

SEQ ID NO: 5618153 - DNA, 19 bp, Homo sapiens
gcagcttgtagccagccgg

SEQ ID NO: 5618154 - DNA, 20 bp, Homo sapiens
gcagcttgtagccagccggg

SEQ ID NO: 5618155 - DNA, 21 bp, Homo sapiens
gcagcttgtccttgctcctgg

SEQ ID NO: 5618156 - DNA, 21 bp, Homo sapiens
gcagcttgtgtgcaaaagcag

SEQ ID NO: 5618157 - DNA, 21 bp, Homo sapiens
gcagctttaaactcagggaca

SEQ ID NO: 5618158 - DNA, 14 bp, Homo sapiens
gcagctttgctcat

SEQ ID NO: 5618159 - DNA, 19 bp, Homo sapiens
gcagctttgggaaagctgc

SEQ ID NO: 5618160 - DNA, 17 bp, Homo sapiens
gcagctttgggatccca

SEQ ID NO: 5618161 - DNA, 16 bp, Homo sapiens
gcagcttttggtctcc

SEQ ID NO: 5618162 - DNA, 22 bp, Homo sapiens
gcagctttttattccctgccca

SEQ ID NO: 5618163 - DNA, 15 bp, Homo sapiens
gcaggaaaaaaggaa

SEQ ID NO: 5618164 - DNA, 15 bp, Homo sapiens
gcaggaaaccccagc

SEQ ID NO: 5618165 - DNA, 19 bp, Homo sapiens
gcaggaaagagggagcagg

SEQ ID NO: 5618166 - DNA, 18 bp, Homo sapiens
gcaggaaagatcccaagt

SEQ ID NO: 5618167 - DNA, 22 bp, Homo sapiens
gcaggaaagatcccaagtcaaa

SEQ ID NO: 5618168 - DNA, 21 bp, Homo sapiens
gcaggaaagtttacccatgaa

SEQ ID NO: 5618169 - DNA, 11 bp, Homo sapiens
gcaggaaatag

SEQ ID NO: 5618170 - DNA, 18 bp, Homo sapiens
gcaggaaatcagagctgg

SEQ ID NO: 5618171 - DNA, 19 bp, Homo sapiens
gcaggaaatcagagctggc

SEQ ID NO: 5618172 - DNA, 20 bp, Homo sapiens
gcaggaaatcagagctggca

SEQ ID NO: 5618173 - DNA, 22 bp, Homo sapiens
gcaggaaatcagagctggcagc

SEQ ID NO: 5618174 - DNA, 21 bp, Homo sapiens
gcaggaaatgagagatagagg

SEQ ID NO: 5618175 - DNA, 18 bp, Homo sapiens
gcaggaaatggctgtgga

SEQ ID NO: 5618176 - DNA, 16 bp, Homo sapiens
gcaggaacaaacaggg

SEQ ID NO: 5618177 - DNA, 18 bp, Homo sapiens
gcaggaaccatggacctg

SEQ ID NO: 5618178 - DNA, 16 bp, Homo sapiens
gcaggaaccgaggact

SEQ ID NO: 5618179 - DNA, 18 bp, Homo sapiens
gcaggaaccgaggactcc

SEQ ID NO: 5618180 - DNA, 15 bp, Homo sapiens
gcaggaaccggaggg

SEQ ID NO: 5618181 - DNA, 20 bp, Homo sapiens
gcaggaacgagcactggcca

SEQ ID NO: 5618182 - DNA, 22 bp, Homo sapiens
gcaggaacgagcactggccaga

SEQ ID NO: 5618183 - DNA, 23 bp, Homo sapiens
gcaggaacgagcactggccagag

SEQ ID NO: 5618184 - DNA, 14 bp, Homo sapiens
gcaggaagaccaca

SEQ ID NO: 5618185 - DNA, 16 bp, Homo sapiens
gcaggaagacttccag

SEQ ID NO: 5618186 - DNA, 17 bp, Homo sapiens
gcaggaagagatgctct

SEQ ID NO: 5618187 - DNA, 13 bp, Homo sapiens
gcaggaagaggcc

SEQ ID NO: 5618188 - DNA, 18 bp, Homo sapiens
gcaggaagcaaggccagc

SEQ ID NO: 5618189 - DNA, 15 bp, Homo sapiens
gcaggaagccaggct

SEQ ID NO: 5618190 - DNA, 14 bp, Homo sapiens
gcaggaagctcaga

SEQ ID NO: 5618191 - DNA, 21 bp, Homo sapiens
gcaggaaggaactcaaggtgg

SEQ ID NO: 5618192 - DNA, 22 bp, Homo sapiens
gcaggaaggaactcaaggtggc

SEQ ID NO: 5618193 - DNA, 23 bp, Homo sapiens
gcaggaaggactatgaaaagcta

SEQ ID NO: 5618194 - DNA, 13 bp, Homo sapiens
gcaggaaggagag

SEQ ID NO: 5618195 - DNA, 23 bp, Homo sapiens
gcaggaaggagagcctgctgcat

SEQ ID NO: 5618196 - DNA, 15 bp, Homo sapiens
gcaggaaggagcggc

SEQ ID NO: 5618197 - DNA, 18 bp, Homo sapiens
gcaggaaggagcggcgcc

SEQ ID NO: 5618198 - DNA, 14 bp, Homo sapiens
gcaggaaggagctg

SEQ ID NO: 5618199 - DNA, 19 bp, Homo sapiens
gcaggaaggagctgcctgg

SEQ ID NO: 5618200 - DNA, 22 bp, Homo sapiens
gcaggaaggagctgcctggacc

SEQ ID NO: 5618201 - DNA, 17 bp, Homo sapiens
gcaggaaggatggcaag

SEQ ID NO: 5618202 - DNA, 15 bp, Homo sapiens
gcaggaagggtggga

SEQ ID NO: 5618203 - DNA, 13 bp, Homo sapiens
gcaggaagtctct

SEQ ID NO: 5618204 - DNA, 19 bp, Homo sapiens
gcaggaatatatgtgtgcc

SEQ ID NO: 5618205 - DNA, 21 bp, Homo sapiens
gcaggaatatatgtgtgccta

SEQ ID NO: 5618206 - DNA, 19 bp, Homo sapiens
gcaggaatcaaaaattgaa

SEQ ID NO: 5618207 - DNA, 17 bp, Homo sapiens
gcaggaatcaaggagcc

SEQ ID NO: 5618208 - DNA, 14 bp, Homo sapiens
gcaggaatcacccc

SEQ ID NO: 5618209 - DNA, 21 bp, Homo sapiens
gcaggaatcccggctccagag

SEQ ID NO: 5618210 - DNA, 22 bp, Homo sapiens
gcaggaatcccggctccagagc

SEQ ID NO: 5618211 - DNA, 13 bp, Homo sapiens
gcaggaatgaaaa

SEQ ID NO: 5618212 - DNA, 23 bp, Homo sapiens
gcaggaatgcggttgggaggcag

SEQ ID NO: 5618213 - DNA, 15 bp, Homo sapiens
gcaggaatgggggtc

SEQ ID NO: 5618214 - DNA, 19 bp, Homo sapiens
gcaggaatgggggtcagaa

SEQ ID NO: 5618215 - DNA, 16 bp, Homo sapiens
gcaggaatttcttttt

SEQ ID NO: 5618216 - DNA, 14 bp, Homo sapiens
gcaggacacagatc

SEQ ID NO: 5618217 - DNA, 23 bp, Homo sapiens
gcaggacacatcccggcctcttc

SEQ ID NO: 5618218 - DNA, 11 bp, Homo sapiens
gcaggacagag

SEQ ID NO: 5618219 - DNA, 15 bp, Homo sapiens
gcaggacagctcctg

SEQ ID NO: 5618220 - DNA, 12 bp, Homo sapiens
gcaggaccaagg

SEQ ID NO: 5618221 - DNA, 18 bp, Homo sapiens
gcaggaccaagggggcgg

SEQ ID NO: 5618222 - DNA, 20 bp, Homo sapiens
gcaggaccagaaggcaatca

SEQ ID NO: 5618223 - DNA, 13 bp, Homo sapiens
gcaggaccagccc

SEQ ID NO: 5618224 - DNA, 15 bp, Homo sapiens
gcaggaccagcccac

SEQ ID NO: 5618225 - DNA, 22 bp, Homo sapiens
gcaggaccagcccacgctgact

SEQ ID NO: 5618226 - DNA, 14 bp, Homo sapiens
gcaggacccagtgg

SEQ ID NO: 5618227 - DNA, 21 bp, Homo sapiens
gcaggacccagtggtcagcag

SEQ ID NO: 5618228 - DNA, 15 bp, Homo sapiens
gcaggaccctgtcag

SEQ ID NO: 5618229 - DNA, 19 bp, Homo sapiens
gcaggaccctgtcctgcag

SEQ ID NO: 5618230 - DNA, 17 bp, Homo sapiens
gcaggaccgatgccagc

SEQ ID NO: 5618231 - DNA, 20 bp, Homo sapiens
gcaggacctagctgttgtaa

SEQ ID NO: 5618232 - DNA, 15 bp, Homo sapiens
gcaggacctcagagt

SEQ ID NO: 5618233 - DNA, 15 bp, Homo sapiens
gcaggacctcgtgcc

SEQ ID NO: 5618234 - DNA, 12 bp, Homo sapiens
gcaggacctctg

SEQ ID NO: 5618235 - DNA, 14 bp, Homo sapiens
gcaggacctgcctg

SEQ ID NO: 5618236 - DNA, 16 bp, Homo sapiens
gcaggacctgcctgta

SEQ ID NO: 5618237 - DNA, 20 bp, Homo sapiens
gcaggacctgcctgtagccc

SEQ ID NO: 5618238 - DNA, 20 bp, Homo sapiens
gcaggacctgtgctttgaga

SEQ ID NO: 5618239 - DNA, 20 bp, Homo sapiens
gcaggaccttcgggctgtgc

SEQ ID NO: 5618240 - DNA, 13 bp, Homo sapiens
gcaggaccttggg

SEQ ID NO: 5618241 - DNA, 17 bp, Homo sapiens
gcaggacgaaaaagagg

SEQ ID NO: 5618242 - DNA, 13 bp, Homo sapiens
gcaggactccagg

SEQ ID NO: 5618243 - DNA, 14 bp, Homo sapiens
gcaggactccaggc

SEQ ID NO: 5618244 - DNA, 18 bp, Homo sapiens
gcaggactctagctcatg

SEQ ID NO: 5618245 - DNA, 13 bp, Homo sapiens
gcaggactgagga

SEQ ID NO: 5618246 - DNA, 23 bp, Homo sapiens
gcaggactgatgtctcctaagca

SEQ ID NO: 5618247 - DNA, 15 bp, Homo sapiens
gcaggactgcagagc

SEQ ID NO: 5618248 - DNA, 15 bp, Homo sapiens
gcaggactgtcccct

SEQ ID NO: 5618249 - DNA, 19 bp, Homo sapiens
gcaggacttgcacacaggg

SEQ ID NO: 5618250 - DNA, 22 bp, Homo sapiens
gcaggagaagaacaagaaatgg

SEQ ID NO: 5618251 - DNA, 14 bp, Homo sapiens
gcaggagacactgg

SEQ ID NO: 5618252 - DNA, 22 bp, Homo sapiens
gcaggagacactggtctcagag

SEQ ID NO: 5618253 - DNA, 10 bp, Homo sapiens
gcaggagaga

SEQ ID NO: 5618254 - DNA, 16 bp, Homo sapiens
gcaggagagagagaga

SEQ ID NO: 5618255 - DNA, 22 bp, Homo sapiens
gcaggagagagagagagaaaga

SEQ ID NO: 5618256 - DNA, 12 bp, Homo sapiens
gcaggagaggaa

SEQ ID NO: 5618257 - DNA, 13 bp, Homo sapiens
gcaggagaggaga

SEQ ID NO: 5618258 - DNA, 17 bp, Homo sapiens
gcaggagaggagagcca

SEQ ID NO: 5618259 - DNA, 19 bp, Homo sapiens
gcaggagaggagagccaga

SEQ ID NO: 5618260 - DNA, 15 bp, Homo sapiens
gcaggagaggctggg

SEQ ID NO: 5618261 - DNA, 17 bp, Homo sapiens
gcaggagaggctgggct

SEQ ID NO: 5618262 - DNA, 23 bp, Homo sapiens
gcaggagagtgtgtgggcagggt

SEQ ID NO: 5618263 - DNA, 18 bp, Homo sapiens
gcaggagattgagaagga

SEQ ID NO: 5618264 - DNA, 19 bp, Homo sapiens
gcaggagattgagaaggag

SEQ ID NO: 5618265 - DNA, 22 bp, Homo sapiens
gcaggagattgagaaggagaga

SEQ ID NO: 5618266 - DNA, 20 bp, Homo sapiens
gcaggagcacacccagcccc

SEQ ID NO: 5618267 - DNA, 22 bp, Homo sapiens
gcaggagcagctgtgctgcacc

SEQ ID NO: 5618268 - DNA, 22 bp, Homo sapiens
gcaggagcagtatcatgaagcc

SEQ ID NO: 5618269 - DNA, 18 bp, Homo sapiens
gcaggagccccgccacag

SEQ ID NO: 5618270 - DNA, 15 bp, Homo sapiens
gcaggagcccctggg

SEQ ID NO: 5618271 - DNA, 17 bp, Homo sapiens
gcaggagcctacttcta

SEQ ID NO: 5618272 - DNA, 17 bp, Homo sapiens
gcaggagcctagaggag

SEQ ID NO: 5618273 - DNA, 18 bp, Homo sapiens
gcaggagcctccctgcac

SEQ ID NO: 5618274 - DNA, 21 bp, Homo sapiens
gcaggagccttcctttctcct

SEQ ID NO: 5618275 - DNA, 20 bp, Homo sapiens
gcaggagcgtgaaggactta

SEQ ID NO: 5618276 - DNA, 22 bp, Homo sapiens
gcaggagcgtgaaggacttagc

SEQ ID NO: 5618277 - DNA, 16 bp, Homo sapiens
gcaggagctactgaga

SEQ ID NO: 5618278 - DNA, 20 bp, Homo sapiens
gcaggagctagttctcagct

SEQ ID NO: 5618279 - DNA, 13 bp, Homo sapiens
gcaggagctcaca

SEQ ID NO: 5618280 - DNA, 18 bp, Homo sapiens
gcaggagctcacaccgca

SEQ ID NO: 5618281 - DNA, 14 bp, Homo sapiens
gcaggagctcctgg

SEQ ID NO: 5618282 - DNA, 17 bp, Homo sapiens
gcaggagctcctggaag

SEQ ID NO: 5618283 - DNA, 18 bp, Homo sapiens
gcaggagctcctggaagc

SEQ ID NO: 5618284 - DNA, 22 bp, Homo sapiens
gcaggagcttctgggagatttt

SEQ ID NO: 5618285 - DNA, 13 bp, Homo sapiens
gcaggaggacagg

SEQ ID NO: 5618286 - DNA, 14 bp, Homo sapiens
gcaggaggacaggt

SEQ ID NO: 5618287 - DNA, 18 bp, Homo sapiens
gcaggaggacaggtggag

SEQ ID NO: 5618288 - DNA, 15 bp, Homo sapiens
gcaggaggagcccgg

SEQ ID NO: 5618289 - DNA, 13 bp, Homo sapiens
gcaggaggaggtg

SEQ ID NO: 5618290 - DNA, 15 bp, Homo sapiens
gcaggaggaggtgcc

SEQ ID NO: 5618291 - DNA, 21 bp, Homo sapiens
gcaggaggatcacttgaggcc

SEQ ID NO: 5618292 - DNA, 20 bp, Homo sapiens
gcaggaggatcacttgagtc

SEQ ID NO: 5618293 - DNA, 14 bp, Homo sapiens
gcaggaggattgct

SEQ ID NO: 5618294 - DNA, 17 bp, Homo sapiens
gcaggaggcacagcagt

SEQ ID NO: 5618295 - DNA, 13 bp, Homo sapiens
gcaggaggcagga

SEQ ID NO: 5618296 - DNA, 17 bp, Homo sapiens
gcaggaggcagggctct

SEQ ID NO: 5618297 - DNA, 11 bp, Homo sapiens
gcaggaggcca

SEQ ID NO: 5618298 - DNA, 16 bp, Homo sapiens
gcaggaggccaataaa

SEQ ID NO: 5618299 - DNA, 17 bp, Homo sapiens
gcaggaggccaataaaa

SEQ ID NO: 5618300 - DNA, 21 bp, Homo sapiens
gcaggaggccaataaaaagtt

SEQ ID NO: 5618301 - DNA, 16 bp, Homo sapiens
gcaggaggccaggccg

SEQ ID NO: 5618302 - DNA, 14 bp, Homo sapiens
gcaggaggccccag

SEQ ID NO: 5618303 - DNA, 23 bp, Homo sapiens
gcaggaggcctgggagggcaagg

SEQ ID NO: 5618304 - DNA, 17 bp, Homo sapiens
gcaggaggctttctggg

SEQ ID NO: 5618305 - DNA, 11 bp, Homo sapiens
gcaggagggag

SEQ ID NO: 5618306 - DNA, 12 bp, Homo sapiens
gcaggagggagg

SEQ ID NO: 5618307 - DNA, 13 bp, Homo sapiens
gcaggagggaggc

SEQ ID NO: 5618308 - DNA, 23 bp, Homo sapiens
gcaggagggaggcggggaggagg

SEQ ID NO: 5618309 - DNA, 15 bp, Homo sapiens
gcaggagggcactgg

SEQ ID NO: 5618310 - DNA, 23 bp, Homo sapiens
gcaggagggcactggagctggga

SEQ ID NO: 5618311 - DNA, 13 bp, Homo sapiens
gcaggaggggagt

SEQ ID NO: 5618312 - DNA, 14 bp, Homo sapiens
gcaggagggtggca

SEQ ID NO: 5618313 - DNA, 16 bp, Homo sapiens
gcaggagggtggcact

SEQ ID NO: 5618314 - DNA, 15 bp, Homo sapiens
gcaggaggtggagaa

SEQ ID NO: 5618315 - DNA, 20 bp, Homo sapiens
gcaggaggttctgggcctct

SEQ ID NO: 5618316 - DNA, 15 bp, Homo sapiens
gcaggagtagctgag

SEQ ID NO: 5618317 - DNA, 21 bp, Homo sapiens
gcaggagtagctgagctcaca

SEQ ID NO: 5618318 - DNA, 23 bp, Homo sapiens
gcaggagtcaccatgcaagggtg

SEQ ID NO: 5618319 - DNA, 17 bp, Homo sapiens
gcaggagtctctgccag

SEQ ID NO: 5618320 - DNA, 17 bp, Homo sapiens
gcaggagtgccaggacc

SEQ ID NO: 5618321 - DNA, 19 bp, Homo sapiens
gcagtcgcttgccaaagca

SEQ ID NO: 5618322 - DNA, 20 bp, Homo sapiens
gcagtcggcatgccaggacc

SEQ ID NO: 5618323 - DNA, 18 bp, Homo sapiens
gcagtcgggggctggcct

SEQ ID NO: 5618324 - DNA, 16 bp, Homo sapiens
gcagtcgtcccaggct

SEQ ID NO: 5618325 - DNA, 17 bp, Homo sapiens
gcagtcgtcccaggctg

SEQ ID NO: 5618326 - DNA, 18 bp, Homo sapiens
gcagtcgtcgcacagtct

SEQ ID NO: 5618327 - DNA, 17 bp, Homo sapiens
gcagtcgtgcctgtgtc

SEQ ID NO: 5618328 - DNA, 19 bp, Homo sapiens
gcagtcgtgcctgtgtcca

SEQ ID NO: 5618329 - DNA, 19 bp, Homo sapiens
gcagtcgtggctttggcag

SEQ ID NO: 5618330 - DNA, 21 bp, Homo sapiens
gcagtcgtgtaattggcccaa

SEQ ID NO: 5618331 - DNA, 16 bp, Homo sapiens
gcagtctagtcctggg

SEQ ID NO: 5618332 - DNA, 19 bp, Homo sapiens
gcagtctcagaaagccttc

SEQ ID NO: 5618333 - DNA, 16 bp, Homo sapiens
gcagtctccccttcct

SEQ ID NO: 5618334 - DNA, 19 bp, Homo sapiens
gcagtctccccttcctggc

SEQ ID NO: 5618335 - DNA, 13 bp, Homo sapiens
gcagtctccgctc

SEQ ID NO: 5618336 - DNA, 23 bp, Homo sapiens
gcagtctcctctttaaaacaaaa

SEQ ID NO: 5618337 - DNA, 17 bp, Homo sapiens
gcagtctccttcagcac

SEQ ID NO: 5618338 - DNA, 18 bp, Homo sapiens
gcagtctcgggtggctag

SEQ ID NO: 5618339 - DNA, 17 bp, Homo sapiens
gcagtctctataccaat

SEQ ID NO: 5618340 - DNA, 22 bp, Homo sapiens
gcagtctctatattatgtcttc

SEQ ID NO: 5618341 - DNA, 15 bp, Homo sapiens
gcagtctctcttacc

SEQ ID NO: 5618342 - DNA, 22 bp, Homo sapiens
gcagtctctcttacccttctgt

SEQ ID NO: 5618343 - DNA, 14 bp, Homo sapiens
gcagtctgaaccct

SEQ ID NO: 5618344 - DNA, 17 bp, Homo sapiens
gcagtctgataaactga

SEQ ID NO: 5618345 - DNA, 12 bp, Homo sapiens
gcagtctgctct

SEQ ID NO: 5618346 - DNA, 23 bp, Homo sapiens
gcagtctgctctgctgctctgac

SEQ ID NO: 5618347 - DNA, 15 bp, Homo sapiens
gcagtctggaggggc

SEQ ID NO: 5618348 - DNA, 19 bp, Homo sapiens
gcagtctggctgagccctg

SEQ ID NO: 5618349 - DNA, 22 bp, Homo sapiens
gcagtctgtggagcgtccttgt

SEQ ID NO: 5618350 - DNA, 18 bp, Homo sapiens
gcagtcttatgcttccag

SEQ ID NO: 5618351 - DNA, 21 bp, Homo sapiens
gcagtcttctctctggctcag

SEQ ID NO: 5618352 - DNA, 17 bp, Homo sapiens
gcagtcttctgggctgc

SEQ ID NO: 5618353 - DNA, 20 bp, Homo sapiens
gcagtcttgcaacagtgcca

SEQ ID NO: 5618354 - DNA, 22 bp, Homo sapiens
gcagtctttatttttttcccat

SEQ ID NO: 5618355 - DNA, 23 bp, Homo sapiens
gcagtctttatttttttcccatg

SEQ ID NO: 5618356 - DNA, 12 bp, Homo sapiens
gcagtctttccc

SEQ ID NO: 5618357 - DNA, 16 bp, Homo sapiens
gcagtctttcccccag

SEQ ID NO: 5618358 - DNA, 19 bp, Homo sapiens
gcagtctttcccccaggaa

SEQ ID NO: 5618359 - DNA, 12 bp, Homo sapiens
gcagtctttctt

SEQ ID NO: 5618360 - DNA, 18 bp, Homo sapiens
gcagtctttcttgaaatt

SEQ ID NO: 5618361 - DNA, 19 bp, Homo sapiens
gcagtctttcttgaaattg

SEQ ID NO: 5618362 - DNA, 12 bp, Homo sapiens
gcagtcttttgc

SEQ ID NO: 5618363 - DNA, 16 bp, Homo sapiens
gcagtgaactattttt

SEQ ID NO: 5618364 - DNA, 14 bp, Homo sapiens
gcagtgaactgaga

SEQ ID NO: 5618365 - DNA, 14 bp, Homo sapiens
gcagtgaagatgtg

SEQ ID NO: 5618366 - DNA, 16 bp, Homo sapiens
gcagtgaagatgtgta

SEQ ID NO: 5618367 - DNA, 20 bp, Homo sapiens
gcagtgaatgattcagtgtt

SEQ ID NO: 5618368 - DNA, 18 bp, Homo sapiens
gcagtgaatttgaataaa

SEQ ID NO: 5618369 - DNA, 19 bp, Homo sapiens
gcagtgacacaatctcggc

SEQ ID NO: 5618370 - DNA, 18 bp, Homo sapiens
gcagtgacgtgagtgggg

SEQ ID NO: 5618371 - DNA, 18 bp, Homo sapiens
gcagtgacgtgcacctgt

SEQ ID NO: 5618372 - DNA, 17 bp, Homo sapiens
gcagtgactccccagcc

SEQ ID NO: 5618373 - DNA, 18 bp, Homo sapiens
gcagtgactccccagccc

SEQ ID NO: 5618374 - DNA, 14 bp, Homo sapiens
gcagtgactggcag

SEQ ID NO: 5618375 - DNA, 16 bp, Homo sapiens
gcagtgactggcaggt

SEQ ID NO: 5618376 - DNA, 18 bp, Homo sapiens
gcagtgactgtggccatg

SEQ ID NO: 5618377 - DNA, 12 bp, Homo sapiens
gcagtgactttg

SEQ ID NO: 5618378 - DNA, 15 bp, Homo sapiens
gcagtgactttgtat

SEQ ID NO: 5618379 - DNA, 23 bp, Homo sapiens
gcagtgagaaaaagctcctgtcc

SEQ ID NO: 5618380 - DNA, 14 bp, Homo sapiens
gcagtgagagcaga

SEQ ID NO: 5618381 - DNA, 12 bp, Homo sapiens
gcagtgagagtt

SEQ ID NO: 5618382 - DNA, 10 bp, Homo sapiens
gcagtgagcc

SEQ ID NO: 5618383 - DNA, 13 bp, Homo sapiens
gcagtgagccgag

SEQ ID NO: 5618384 - DNA, 21 bp, Homo sapiens
gcagtgagccgcatcttctcc

SEQ ID NO: 5618385 - DNA, 14 bp, Homo sapiens
gcagtgagctgaga

SEQ ID NO: 5618386 - DNA, 15 bp, Homo sapiens
gcagtgagctgagat

SEQ ID NO: 5618387 - DNA, 22 bp, Homo sapiens
gcagtgaggggtatatctgggc

SEQ ID NO: 5618388 - DNA, 18 bp, Homo sapiens
gcagtgagtgagcctggc

SEQ ID NO: 5618389 - DNA, 19 bp, Homo sapiens
gcagtgagtgagcctggct

SEQ ID NO: 5618390 - DNA, 20 bp, Homo sapiens
gcagtgagttacagcgagag

SEQ ID NO: 5618391 - DNA, 16 bp, Homo sapiens
gcagtgatagttgact

SEQ ID NO: 5618392 - DNA, 19 bp, Homo sapiens
gcagtgatatggcagaaga

SEQ ID NO: 5618393 - DNA, 18 bp, Homo sapiens
gcagtgatctcagggcag

SEQ ID NO: 5618394 - DNA, 18 bp, Homo sapiens
gcagtgatgacttgctgt

SEQ ID NO: 5618395 - DNA, 21 bp, Homo sapiens
gcagtgatgctggatgctcct

SEQ ID NO: 5618396 - DNA, 21 bp, Homo sapiens
gcagtgatggcgcgggaggca

SEQ ID NO: 5618397 - DNA, 21 bp, Homo sapiens
gcagtgatggttgccaggacg

SEQ ID NO: 5618398 - DNA, 21 bp, Homo sapiens
gcagtgatgtatacatcttat

SEQ ID NO: 5618399 - DNA, 22 bp, Homo sapiens
gcagtgatgtttgccatttgct

SEQ ID NO: 5618400 - DNA, 23 bp, Homo sapiens
gcagtgatgtttgccatttgctg

SEQ ID NO: 5618401 - DNA, 14 bp, Homo sapiens
gcagtgattaaggt

SEQ ID NO: 5618402 - DNA, 22 bp, Homo sapiens
gcagtgattgttatgccttgct

SEQ ID NO: 5618403 - DNA, 20 bp, Homo sapiens
gcagtgcaagagactctggc

SEQ ID NO: 5618404 - DNA, 21 bp, Homo sapiens
gcagtgcaatggcgcgatctc

SEQ ID NO: 5618405 - DNA, 22 bp, Homo sapiens
gcagtgcagcaaccagagcact

SEQ ID NO: 5618406 - DNA, 15 bp, Homo sapiens
gcagtgcaggcacag

SEQ ID NO: 5618407 - DNA, 22 bp, Homo sapiens
gcagtgcatgtgaagcatgctt

SEQ ID NO: 5618408 - DNA, 15 bp, Homo sapiens
gcagtgccacagcct

SEQ ID NO: 5618409 - DNA, 20 bp, Homo sapiens
gcagtgccacagcctgctgg

SEQ ID NO: 5618410 - DNA, 22 bp, Homo sapiens
gcagtgccacagcctgctggca

SEQ ID NO: 5618411 - DNA, 23 bp, Homo sapiens
gcagtgccacagcctgctggcag

SEQ ID NO: 5618412 - DNA, 12 bp, Homo sapiens
gcagtgccagcc

SEQ ID NO: 5618413 - DNA, 17 bp, Homo sapiens
gcagtgccagctccctc

SEQ ID NO: 5618414 - DNA, 14 bp, Homo sapiens
gcagtgcccaggtg

SEQ ID NO: 5618415 - DNA, 19 bp, Homo sapiens
gcagtgcccatgtgtacat

SEQ ID NO: 5618416 - DNA, 14 bp, Homo sapiens
gcagtgccccaggg

SEQ ID NO: 5618417 - DNA, 16 bp, Homo sapiens
gcagtgccccagggag

SEQ ID NO: 5618418 - DNA, 17 bp, Homo sapiens
gcagtgccctagaaggg

SEQ ID NO: 5618419 - DNA, 17 bp, Homo sapiens
gcagtgcctcctgggac

SEQ ID NO: 5618420 - DNA, 18 bp, Homo sapiens
gcagtgcctcctgggacc

SEQ ID NO: 5618421 - DNA, 18 bp, Homo sapiens
gcagtgcctcgaggcacc

SEQ ID NO: 5618422 - DNA, 21 bp, Homo sapiens
gcagtgcctcgaggcaccggc

SEQ ID NO: 5618423 - DNA, 15 bp, Homo sapiens
gcagtgcctgataag

SEQ ID NO: 5618424 - DNA, 15 bp, Homo sapiens
gcagtgccttccata

SEQ ID NO: 5618425 - DNA, 17 bp, Homo sapiens
gcagtgcctttccccat

SEQ ID NO: 5618426 - DNA, 19 bp, Homo sapiens
gcagtgctagtgagctggg

SEQ ID NO: 5618427 - DNA, 13 bp, Homo sapiens
gcagtgctctttg

SEQ ID NO: 5618428 - DNA, 13 bp, Homo sapiens
gcagtgctgaagg

SEQ ID NO: 5618429 - DNA, 19 bp, Homo sapiens
gcagtgctgaagggggcat

SEQ ID NO: 5618430 - DNA, 22 bp, Homo sapiens
gcagtgctgagggaccgagccc

SEQ ID NO: 5618431 - DNA, 21 bp, Homo sapiens
gcagtgctgatccggctgctc

SEQ ID NO: 5618432 - DNA, 13 bp, Homo sapiens
gcagtgctgggac

SEQ ID NO: 5618433 - DNA, 23 bp, Homo sapiens
gcagtgctgggaccagagccaga

SEQ ID NO: 5618434 - DNA, 14 bp, Homo sapiens
gcagtgctgggccc

SEQ ID NO: 5618435 - DNA, 21 bp, Homo sapiens
gcagtgctgggcccagccggg

SEQ ID NO: 5618436 - DNA, 20 bp, Homo sapiens
gcagtgcttggcccaggagt

SEQ ID NO: 5618437 - DNA, 13 bp, Homo sapiens
gcagtgcttttgg

SEQ ID NO: 5618438 - DNA, 17 bp, Homo sapiens
gcagtggactgtgtccc

SEQ ID NO: 5618439 - DNA, 17 bp, Homo sapiens
gcagtggagaggggact

SEQ ID NO: 5618440 - DNA, 19 bp, Homo sapiens
gcagtggaggctgctgtga

SEQ ID NO: 5618441 - DNA, 14 bp, Homo sapiens
gcagtggagggggc

SEQ ID NO: 5618442 - DNA, 16 bp, Homo sapiens
gcagtggagggggcaa

SEQ ID NO: 5618443 - DNA, 23 bp, Homo sapiens
gcagtggagggggcaagctttgc

SEQ ID NO: 5618444 - DNA, 20 bp, Homo sapiens
gcagtggaggtagaatgact

SEQ ID NO: 5618445 - DNA, 16 bp, Homo sapiens
gcagtggaggtgctgc

SEQ ID NO: 5618446 - DNA, 23 bp, Homo sapiens
gcagtggaggtggggtgtttggg

SEQ ID NO: 5618447 - DNA, 23 bp, Homo sapiens
gcagtggatggccgtgaatgggt

SEQ ID NO: 5618448 - DNA, 14 bp, Homo sapiens
gcagtggcaaaata

SEQ ID NO: 5618449 - DNA, 16 bp, Homo sapiens
gcagtggcaaaatatt

SEQ ID NO: 5618450 - DNA, 12 bp, Homo sapiens
gcagtggcagga

SEQ ID NO: 5618451 - DNA, 14 bp, Homo sapiens
gcagtggccaagcc

SEQ ID NO: 5618452 - DNA, 16 bp, Homo sapiens
gcagtggccaagcctg

SEQ ID NO: 5618453 - DNA, 12 bp, Homo sapiens
gcagtggccagg

SEQ ID NO: 5618454 - DNA, 21 bp, Homo sapiens
gcagtggccccatccagcatg

SEQ ID NO: 5618455 - DNA, 23 bp, Homo sapiens
gcagtggcctggccgttcagcct

SEQ ID NO: 5618456 - DNA, 23 bp, Homo sapiens
gcagtggctcccctgcccagcct

SEQ ID NO: 5618457 - DNA, 14 bp, Homo sapiens
gcagtggctggggg

SEQ ID NO: 5618458 - DNA, 21 bp, Homo sapiens
gcagtggctgggggactgctt

SEQ ID NO: 5618459 - DNA, 22 bp, Homo sapiens
gcagtggctgggggactgcttt

SEQ ID NO: 5618460 - DNA, 18 bp, Homo sapiens
gcagtggctggtccaggg

SEQ ID NO: 5618461 - DNA, 22 bp, Homo sapiens
gcagtggcttggagcagaggtg

SEQ ID NO: 5618462 - DNA, 20 bp, Homo sapiens
gcagtggcttttgccccaga

SEQ ID NO: 5618463 - DNA, 14 bp, Homo sapiens
gcagtgggaaaaat

SEQ ID NO: 5618464 - DNA, 21 bp, Homo sapiens
gcagtgggaatgttctttctg

SEQ ID NO: 5618465 - DNA, 13 bp, Homo sapiens
gcagtgggaccaa

SEQ ID NO: 5618466 - DNA, 11 bp, Homo sapiens
gcagtgggagc

SEQ ID NO: 5618467 - DNA, 17 bp, Homo sapiens
gcagtgggagctgcctg

SEQ ID NO: 5618468 - DNA, 15 bp, Homo sapiens
gcagtgggcaggtgg

SEQ ID NO: 5618469 - DNA, 16 bp, Homo sapiens
gcagtgggccctggct

SEQ ID NO: 5618470 - DNA, 18 bp, Homo sapiens
gcagtgggccctggctct

SEQ ID NO: 5618471 - DNA, 13 bp, Homo sapiens
gcagtgggcctgc

SEQ ID NO: 5618472 - DNA, 14 bp, Homo sapiens
gcagtggggtgaaa

SEQ ID NO: 5618473 - DNA, 14 bp, Homo sapiens
gcagtgggtggagg

SEQ ID NO: 5618474 - DNA, 13 bp, Homo sapiens
gcagtgggtggat

SEQ ID NO: 5618475 - DNA, 18 bp, Homo sapiens
gcagtggtaagctctggc

SEQ ID NO: 5618476 - DNA, 21 bp, Homo sapiens
gcagtggtgatgcctaaagga

SEQ ID NO: 5618477 - DNA, 21 bp, Homo sapiens
gcagtggtgcgatcatggctc

SEQ ID NO: 5618478 - DNA, 20 bp, Homo sapiens
gcagtggtgcgatctgggtt

SEQ ID NO: 5618479 - DNA, 21 bp, Homo sapiens
gcagtggtggttttctgttct

SEQ ID NO: 5618480 - DNA, 24 bp, Homo sapiens
gcagtggttttggcaaacgctaaa

SEQ ID NO: 5618481 - DNA, 20 bp, Homo sapiens
gcagtgtagggagttgtggg

SEQ ID NO: 5618482 - DNA, 18 bp, Homo sapiens
gcagtgtcatcagaagat

SEQ ID NO: 5618483 - DNA, 21 bp, Homo sapiens
gcagtgtccagaagcggcctg

SEQ ID NO: 5618484 - DNA, 16 bp, Homo sapiens
gcagtgtccagagacc

SEQ ID NO: 5618485 - DNA, 17 bp, Homo sapiens
gcagtgtccagagaccc

SEQ ID NO: 5618486 - DNA, 18 bp, Homo sapiens
gcagtgtcccttttgcta

SEQ ID NO: 5618487 - DNA, 19 bp, Homo sapiens
gcagtgtcgccgtccctct

SEQ ID NO: 5618488 - DNA, 21 bp, Homo sapiens
gcagtgtcgccgtccctctgc

SEQ ID NO: 5618489 - DNA, 23 bp, Homo sapiens
gcagtgtctgtaaaagagcctag

SEQ ID NO: 5618490 - DNA, 18 bp, Homo sapiens
gcagtgtcttaaggagac

SEQ ID NO: 5618491 - DNA, 11 bp, Homo sapiens
gcagtgtcttc

SEQ ID NO: 5618492 - DNA, 19 bp, Homo sapiens
gcagtgtgaagtacaataa

SEQ ID NO: 5618493 - DNA, 19 bp, Homo sapiens
gcagtgtgaatgctgggcc

SEQ ID NO: 5618494 - DNA, 14 bp, Homo sapiens
gcagtgtgagggtg

SEQ ID NO: 5618495 - DNA, 14 bp, Homo sapiens
gcagtgtgagtgtg

SEQ ID NO: 5618496 - DNA, 21 bp, Homo sapiens
gcagtgtgcactaaggggccc

SEQ ID NO: 5618497 - DNA, 11 bp, Homo sapiens
gcatcctggat

SEQ ID NO: 5618498 - DNA, 14 bp, Homo sapiens
gcatcctggcaccc

SEQ ID NO: 5618499 - DNA, 17 bp, Homo sapiens
gcatcctggcacccggc

SEQ ID NO: 5618500 - DNA, 21 bp, Homo sapiens
gcatcctggcacccggcccct

SEQ ID NO: 5618501 - DNA, 23 bp, Homo sapiens
gcatcctggcacccggcccctgc

SEQ ID NO: 5618502 - DNA, 16 bp, Homo sapiens
gcatcctggctggctg

SEQ ID NO: 5618503 - DNA, 21 bp, Homo sapiens
gcatcctggctggctgtgtcc

SEQ ID NO: 5618504 - DNA, 14 bp, Homo sapiens
gcatcctgtgaagt

SEQ ID NO: 5618505 - DNA, 16 bp, Homo sapiens
gcatcctgtgccacta

SEQ ID NO: 5618506 - DNA, 21 bp, Homo sapiens
gcatccttcatcacagcatgt

SEQ ID NO: 5618507 - DNA, 14 bp, Homo sapiens
gcatccttcctata

SEQ ID NO: 5618508 - DNA, 15 bp, Homo sapiens
gcatccttcctataa

SEQ ID NO: 5618509 - DNA, 14 bp, Homo sapiens
gcatccttcctggg

SEQ ID NO: 5618510 - DNA, 15 bp, Homo sapiens
gcatccttcctgggg

SEQ ID NO: 5618511 - DNA, 15 bp, Homo sapiens
gcatccttgaggacc

SEQ ID NO: 5618512 - DNA, 22 bp, Homo sapiens
gcatccttgaggacctccacct

SEQ ID NO: 5618513 - DNA, 15 bp, Homo sapiens
gcatccttgcctgtc

SEQ ID NO: 5618514 - DNA, 16 bp, Homo sapiens
gcatccttgcctgtct

SEQ ID NO: 5618515 - DNA, 17 bp, Homo sapiens
gcatccttgcctgtcta

SEQ ID NO: 5618516 - DNA, 20 bp, Homo sapiens
gcatccttgtaatacctgat

SEQ ID NO: 5618517 - DNA, 14 bp, Homo sapiens
gcatccttgtcttt

SEQ ID NO: 5618518 - DNA, 19 bp, Homo sapiens
gcatcgaccacaccagcct

SEQ ID NO: 5618519 - DNA, 22 bp, Homo sapiens
gcatcggacaagacccccagca

SEQ ID NO: 5618520 - DNA, 21 bp, Homo sapiens
gcatcggcagctgaaccctgc

SEQ ID NO: 5618521 - DNA, 20 bp, Homo sapiens
gcatcggcctagggccccca

SEQ ID NO: 5618522 - DNA, 20 bp, Homo sapiens
gcatcgggaaagaagaaact

SEQ ID NO: 5618523 - DNA, 18 bp, Homo sapiens
gcatcgggagcacccaga

SEQ ID NO: 5618524 - DNA, 23 bp, Homo sapiens
gcatcggggccatttggccggct

SEQ ID NO: 5618525 - DNA, 15 bp, Homo sapiens
gcatcgggggcctgc

SEQ ID NO: 5618526 - DNA, 16 bp, Homo sapiens
gcatcgggggcctgca

SEQ ID NO: 5618527 - DNA, 19 bp, Homo sapiens
gcatcgggggcctgcaaat

SEQ ID NO: 5618528 - DNA, 19 bp, Homo sapiens
gcatcggggtggcccactg

SEQ ID NO: 5618529 - DNA, 17 bp, Homo sapiens
gcatcggtcagcggggc

SEQ ID NO: 5618530 - DNA, 15 bp, Homo sapiens
gcatcggtcatgtgt

SEQ ID NO: 5618531 - DNA, 19 bp, Homo sapiens
gcatcgtagaagagatgtg

SEQ ID NO: 5618532 - DNA, 23 bp, Homo sapiens
gcatcgtcatgcacagtatttgt

SEQ ID NO: 5618533 - DNA, 18 bp, Homo sapiens
gcatcgtgacccttcagg

SEQ ID NO: 5618534 - DNA, 18 bp, Homo sapiens
gcatcgtgatcactgagc

SEQ ID NO: 5618535 - DNA, 19 bp, Homo sapiens
gcatcgtgtattccatatg

SEQ ID NO: 5618536 - DNA, 20 bp, Homo sapiens
gcatcgtgtattccatatgt

SEQ ID NO: 5618537 - DNA, 18 bp, Homo sapiens
gcatcgtgtgggtcccta

SEQ ID NO: 5618538 - DNA, 16 bp, Homo sapiens
gcatctaaactttaat

SEQ ID NO: 5618539 - DNA, 22 bp, Homo sapiens
gcatctaagttataagactctc

SEQ ID NO: 5618540 - DNA, 16 bp, Homo sapiens
gcatctaattcttatt

SEQ ID NO: 5618541 - DNA, 15 bp, Homo sapiens
gcatctacacagcct

SEQ ID NO: 5618542 - DNA, 16 bp, Homo sapiens
gcatctacacagcctg

SEQ ID NO: 5618543 - DNA, 20 bp, Homo sapiens
gcatctacacagcctggact

SEQ ID NO: 5618544 - DNA, 23 bp, Homo sapiens
gcatctactctggaccaaggagc

SEQ ID NO: 5618545 - DNA, 21 bp, Homo sapiens
gcatctagaggcttccttcat

SEQ ID NO: 5618546 - DNA, 14 bp, Homo sapiens
gcatctagccagag

SEQ ID NO: 5618547 - DNA, 20 bp, Homo sapiens
gcatctagccagaggctgga

SEQ ID NO: 5618548 - DNA, 14 bp, Homo sapiens
gcatctagctggag

SEQ ID NO: 5618549 - DNA, 16 bp, Homo sapiens
gcatctaggtaatttt

SEQ ID NO: 5618550 - DNA, 15 bp, Homo sapiens
gcatctatctgtgct

SEQ ID NO: 5618551 - DNA, 23 bp, Homo sapiens
gcatctatgggagagtgtcaacc

SEQ ID NO: 5618552 - DNA, 15 bp, Homo sapiens
gcatctcaagatgtt

SEQ ID NO: 5618553 - DNA, 21 bp, Homo sapiens
gcatctcacagctatgcaaaa

SEQ ID NO: 5618554 - DNA, 17 bp, Homo sapiens
gcatctcagcgccagct

SEQ ID NO: 5618555 - DNA, 19 bp, Homo sapiens
gcatctcattgtagagctt

SEQ ID NO: 5618556 - DNA, 12 bp, Homo sapiens
gcatctccagga

SEQ ID NO: 5618557 - DNA, 13 bp, Homo sapiens
gcatctccaggaa

SEQ ID NO: 5618558 - DNA, 16 bp, Homo sapiens
gcatctcccctagctc

SEQ ID NO: 5618559 - DNA, 23 bp, Homo sapiens
gcatctcccctagctcaccaggc

SEQ ID NO: 5618560 - DNA, 20 bp, Homo sapiens
gcatctccctcactgaaacc

SEQ ID NO: 5618561 - DNA, 16 bp, Homo sapiens
gcatctcctctcccca

SEQ ID NO: 5618562 - DNA, 18 bp, Homo sapiens
gcatctcctgtcctgggc

SEQ ID NO: 5618563 - DNA, 15 bp, Homo sapiens
gcatctccttgggct

SEQ ID NO: 5618564 - DNA, 18 bp, Homo sapiens
gcatctctaccttctccc

SEQ ID NO: 5618565 - DNA, 13 bp, Homo sapiens
gcatctctagaga

SEQ ID NO: 5618566 - DNA, 19 bp, Homo sapiens
gcatctctccccatatata

SEQ ID NO: 5618567 - DNA, 13 bp, Homo sapiens
gcatctctctggg

SEQ ID NO: 5618568 - DNA, 12 bp, Homo sapiens
gcatctctgagt

SEQ ID NO: 5618569 - DNA, 20 bp, Homo sapiens
gcatctctgagtgtctctgc

SEQ ID NO: 5618570 - DNA, 13 bp, Homo sapiens
gcatctctggagt

SEQ ID NO: 5618571 - DNA, 23 bp, Homo sapiens
gcatctctgggctggatgagctc

SEQ ID NO: 5618572 - DNA, 22 bp, Homo sapiens
gcatctctgtcccattccctgg

SEQ ID NO: 5618573 - DNA, 17 bp, Homo sapiens
gcatctcttgaggccag

SEQ ID NO: 5618574 - DNA, 18 bp, Homo sapiens
gcatctcttgaggccagg

SEQ ID NO: 5618575 - DNA, 20 bp, Homo sapiens
gcatctcttgaggccaggag

SEQ ID NO: 5618576 - DNA, 12 bp, Homo sapiens
gcatctgaaaac

SEQ ID NO: 5618577 - DNA, 21 bp, Homo sapiens
gcatctgaatgaaaataactg

SEQ ID NO: 5618578 - DNA, 23 bp, Homo sapiens
gcatctgaatgaaaataactgaa

SEQ ID NO: 5618579 - DNA, 14 bp, Homo sapiens
gcatctgacacaaa

SEQ ID NO: 5618580 - DNA, 16 bp, Homo sapiens
gcatctgacacaaaaa

SEQ ID NO: 5618581 - DNA, 17 bp, Homo sapiens
gcatctgaccagcagcg

SEQ ID NO: 5618582 - DNA, 18 bp, Homo sapiens
gcatctgaccatctgtga

SEQ ID NO: 5618583 - DNA, 15 bp, Homo sapiens
gcatctgagggggag

SEQ ID NO: 5618584 - DNA, 17 bp, Homo sapiens
gcatctgagtccagctc

SEQ ID NO: 5618585 - DNA, 19 bp, Homo sapiens
gcatctgagtccagctccc

SEQ ID NO: 5618586 - DNA, 15 bp, Homo sapiens
gcatctgcaaaggaa

SEQ ID NO: 5618587 - DNA, 12 bp, Homo sapiens
gcatctgcaccc

SEQ ID NO: 5618588 - DNA, 14 bp, Homo sapiens
gcatctgcaggcac

SEQ ID NO: 5618589 - DNA, 12 bp, Homo sapiens
gcatctgcccca

SEQ ID NO: 5618590 - DNA, 14 bp, Homo sapiens
gcatctgccccagg

SEQ ID NO: 5618591 - DNA, 19 bp, Homo sapiens
gcatctgcctctattcaat

SEQ ID NO: 5618592 - DNA, 11 bp, Homo sapiens
gcatctgcctg

SEQ ID NO: 5618593 - DNA, 14 bp, Homo sapiens
gcatctgcctggag

SEQ ID NO: 5618594 - DNA, 19 bp, Homo sapiens
gcatctgcctggagcctgg

SEQ ID NO: 5618595 - DNA, 20 bp, Homo sapiens
gcatctgcctggagcctggg

SEQ ID NO: 5618596 - DNA, 21 bp, Homo sapiens
gcatctgcctggagcctgggc

SEQ ID NO: 5618597 - DNA, 14 bp, Homo sapiens
gcatctgctctaga

SEQ ID NO: 5618598 - DNA, 22 bp, Homo sapiens
gcatctgctctagattcataaa

SEQ ID NO: 5618599 - DNA, 12 bp, Homo sapiens
gcatctgctctg

SEQ ID NO: 5618600 - DNA, 15 bp, Homo sapiens
gcatctggagagaac

SEQ ID NO: 5618601 - DNA, 23 bp, Homo sapiens
gcatctggcacgtggccaggagc

SEQ ID NO: 5618602 - DNA, 16 bp, Homo sapiens
gcatctggccctgctg

SEQ ID NO: 5618603 - DNA, 19 bp, Homo sapiens
gcatctggccctgctgccc

SEQ ID NO: 5618604 - DNA, 20 bp, Homo sapiens
gcatctggccctgctgcccc

SEQ ID NO: 5618605 - DNA, 12 bp, Homo sapiens
gcatctggccta

SEQ ID NO: 5618606 - DNA, 16 bp, Homo sapiens
gcatctggcctggcca

SEQ ID NO: 5618607 - DNA, 19 bp, Homo sapiens
gcatctggcctggccagtg

SEQ ID NO: 5618608 - DNA, 16 bp, Homo sapiens
gcatctggcctggggg

SEQ ID NO: 5618609 - DNA, 18 bp, Homo sapiens
gcatctggctgtctagaa

SEQ ID NO: 5618610 - DNA, 16 bp, Homo sapiens
gcatctgggattccca

SEQ ID NO: 5618611 - DNA, 12 bp, Homo sapiens
gcatctgggcct

SEQ ID NO: 5618612 - DNA, 14 bp, Homo sapiens
gcatctgggccttg

SEQ ID NO: 5618613 - DNA, 21 bp, Homo sapiens
gcatctgggccttggcctgga

SEQ ID NO: 5618614 - DNA, 20 bp, Homo sapiens
gcatctggggcccatactgg

SEQ ID NO: 5618615 - DNA, 19 bp, Homo sapiens
gcatctggtgtaggaagtt

SEQ ID NO: 5618616 - DNA, 12 bp, Homo sapiens
gcatctgtacaa

SEQ ID NO: 5618617 - DNA, 15 bp, Homo sapiens
gcatctgtcccactg

SEQ ID NO: 5618618 - DNA, 16 bp, Homo sapiens
gcatctgtcccactgg

SEQ ID NO: 5618619 - DNA, 18 bp, Homo sapiens
gcatctgtctgtctgtgg

SEQ ID NO: 5618620 - DNA, 21 bp, Homo sapiens
gcatctgtctgtctgtgggct

SEQ ID NO: 5618621 - DNA, 12 bp, Homo sapiens
gcatctgtgcgt

SEQ ID NO: 5618622 - DNA, 16 bp, Homo sapiens
gcatctgtggcctggg

SEQ ID NO: 5618623 - DNA, 12 bp, Homo sapiens
gcatctgtgtgt

SEQ ID NO: 5618624 - DNA, 15 bp, Homo sapiens
gcatcttactgaagg

SEQ ID NO: 5618625 - DNA, 13 bp, Homo sapiens
gcatcttccagaa

SEQ ID NO: 5618626 - DNA, 21 bp, Homo sapiens
gcatcttccagaagtgtgatt

SEQ ID NO: 5618627 - DNA, 20 bp, Homo sapiens
gcatcttcgtcttcactctt

SEQ ID NO: 5618628 - DNA, 23 bp, Homo sapiens
gcatcttcgtcttcactcttagg

SEQ ID NO: 5618629 - DNA, 13 bp, Homo sapiens
gcatcttctggag

SEQ ID NO: 5618630 - DNA, 23 bp, Homo sapiens
gcatcttctggagtctccagtgg

SEQ ID NO: 5618631 - DNA, 19 bp, Homo sapiens
gcatcttcttgcatctaat

SEQ ID NO: 5618632 - DNA, 21 bp, Homo sapiens
gcatcttcttgcatctaatga

SEQ ID NO: 5618633 - DNA, 16 bp, Homo sapiens
gcatcttgcctccagg

SEQ ID NO: 5618634 - DNA, 15 bp, Homo sapiens
gcatcttgctctgtg

SEQ ID NO: 5618635 - DNA, 18 bp, Homo sapiens
gcatcttgctctgtggcc

SEQ ID NO: 5618636 - DNA, 21 bp, Homo sapiens
gcatcttgctctgtggccttg

SEQ ID NO: 5618637 - DNA, 13 bp, Homo sapiens
gcatcttggaaat

SEQ ID NO: 5618638 - DNA, 20 bp, Homo sapiens
gcatctttagtgctttcttg

SEQ ID NO: 5618639 - DNA, 17 bp, Homo sapiens
gcatctttgatgtgttg

SEQ ID NO: 5618640 - DNA, 18 bp, Homo sapiens
gcatctttgccttgggct

SEQ ID NO: 5618641 - DNA, 23 bp, Homo sapiens
gcatctttgccttgggctgctcc

SEQ ID NO: 5618642 - DNA, 23 bp, Homo sapiens
gcatctttgggacacctcagaaa

SEQ ID NO: 5618643 - DNA, 23 bp, Homo sapiens
gcatctttggggaggtgttcact

SEQ ID NO: 5618644 - DNA, 20 bp, Homo sapiens
gcatgaaaaaccatttttga

SEQ ID NO: 5618645 - DNA, 23 bp, Homo sapiens
gcatgaaaaatcatgggccagag

SEQ ID NO: 5618646 - DNA, 21 bp, Homo sapiens
gcatgaaaatagctatttttt

SEQ ID NO: 5618647 - DNA, 13 bp, Homo sapiens
gcatgaaactagg

SEQ ID NO: 5618648 - DNA, 22 bp, Homo sapiens
gcatgaaactatgcacctataa

SEQ ID NO: 5618649 - DNA, 12 bp, Homo sapiens
gcatgaaagcat

SEQ ID NO: 5618650 - DNA, 13 bp, Homo sapiens
gcatgaaagcatt

SEQ ID NO: 5618651 - DNA, 14 bp, Homo sapiens
gcatgaaaggcttt

SEQ ID NO: 5618652 - DNA, 18 bp, Homo sapiens
gcatgaaataaaatatat

SEQ ID NO: 5618653 - DNA, 15 bp, Homo sapiens
gcatgaaatgtgaat

SEQ ID NO: 5618654 - DNA, 18 bp, Homo sapiens
gcatgaaattttgcctgc

SEQ ID NO: 5618655 - DNA, 15 bp, Homo sapiens
gcatgaaatttttaa

SEQ ID NO: 5618656 - DNA, 20 bp, Homo sapiens
gcatgaaccccaggctggag

SEQ ID NO: 5618657 - DNA, 18 bp, Homo sapiens
gcatgaacgtggattgta

SEQ ID NO: 5618658 - DNA, 20 bp, Homo sapiens
gcatgaacgtggattgtatt

SEQ ID NO: 5618659 - DNA, 15 bp, Homo sapiens
gcatgaagagcaaaa

SEQ ID NO: 5618660 - DNA, 18 bp, Homo sapiens
gcatgaagagcaaaaata

SEQ ID NO: 5618661 - DNA, 20 bp, Homo sapiens
gcatgaagagcaaaaatatc

SEQ ID NO: 5618662 - DNA, 22 bp, Homo sapiens
gcatgaagtaatatgcacacat

SEQ ID NO: 5618663 - DNA, 18 bp, Homo sapiens
gcatgaataaaacactca

SEQ ID NO: 5618664 - DNA, 22 bp, Homo sapiens
gcatgaataaaacactcatccc

SEQ ID NO: 5618665 - DNA, 20 bp, Homo sapiens
gcatgaatcactgtgctcag

SEQ ID NO: 5618666 - DNA, 18 bp, Homo sapiens
gcatgaatccatcgattt

SEQ ID NO: 5618667 - DNA, 23 bp, Homo sapiens
gcatgaatccatcgatttgtatt

SEQ ID NO: 5618668 - DNA, 23 bp, Homo sapiens
gcatgaatcgggctaaggtccct

SEQ ID NO: 5618669 - DNA, 20 bp, Homo sapiens
gcatgaattcacaaacaaat

SEQ ID NO: 5618670 - DNA, 21 bp, Homo sapiens
gcatgacaaaaataacactgt

SEQ ID NO: 5618671 - DNA, 17 bp, Homo sapiens
gcatgacaaaagtgaca

SEQ ID NO: 5618672 - DNA, 18 bp, Homo sapiens
gcatgacaagccccaggc

SEQ ID NO: 5618673 - DNA, 19 bp, Homo sapiens
gcatgacaagccccaggca

SEQ ID NO: 5618674 - DNA, 16 bp, Homo sapiens
gcatgtgggggaaggc

SEQ ID NO: 5618675 - DNA, 23 bp, Homo sapiens
gcatgtgggggaggagggagaga

SEQ ID NO: 5618676 - DNA, 20 bp, Homo sapiens
gcatgtgggtgtcagtgtca

SEQ ID NO: 5618677 - DNA, 16 bp, Homo sapiens
gcatgtgggttgtgat

SEQ ID NO: 5618678 - DNA, 19 bp, Homo sapiens
gcatgtggtttggttcctc

SEQ ID NO: 5618679 - DNA, 20 bp, Homo sapiens
gcatgtggtttggttcctct

SEQ ID NO: 5618680 - DNA, 12 bp, Homo sapiens
gcatgtgtattt

SEQ ID NO: 5618681 - DNA, 18 bp, Homo sapiens
gcatgtgtcagagtgttg

SEQ ID NO: 5618682 - DNA, 20 bp, Homo sapiens
gcatgtgtcctttcaagggg

SEQ ID NO: 5618683 - DNA, 16 bp, Homo sapiens
gcatgtgtctggccct

SEQ ID NO: 5618684 - DNA, 16 bp, Homo sapiens
gcatgtgtctgtattc

SEQ ID NO: 5618685 - DNA, 19 bp, Homo sapiens
gcatgtgtgcatgtgctgt

SEQ ID NO: 5618686 - DNA, 19 bp, Homo sapiens
gcatgtgtgcgagtgtgtg

SEQ ID NO: 5618687 - DNA, 11 bp, Homo sapiens
gcatgtgtgta

SEQ ID NO: 5618688 - DNA, 12 bp, Homo sapiens
gcatgtgtgtat

SEQ ID NO: 5618689 - DNA, 14 bp, Homo sapiens
gcatgtgtgtgctc

SEQ ID NO: 5618690 - DNA, 14 bp, Homo sapiens
gcatgtgtgtgtct

SEQ ID NO: 5618691 - DNA, 15 bp, Homo sapiens
gcatgtgtgtgtctc

SEQ ID NO: 5618692 - DNA, 18 bp, Homo sapiens
gcatgtgtgtgtctctat

SEQ ID NO: 5618693 - DNA, 18 bp, Homo sapiens
gcatgtgtgtgtctgtct

SEQ ID NO: 5618694 - DNA, 19 bp, Homo sapiens
gcatgtgtgtgtctgtctt

SEQ ID NO: 5618695 - DNA, 13 bp, Homo sapiens
gcatgtgtgtgtg

SEQ ID NO: 5618696 - DNA, 20 bp, Homo sapiens
gcatgtgttgcagctgtcac

SEQ ID NO: 5618697 - DNA, 16 bp, Homo sapiens
gcatgtgttgtacaat

SEQ ID NO: 5618698 - DNA, 21 bp, Homo sapiens
gcatgttaagtgccattacta

SEQ ID NO: 5618699 - DNA, 21 bp, Homo sapiens
gcatgttactacagaggaaag

SEQ ID NO: 5618700 - DNA, 18 bp, Homo sapiens
gcatgttatgtttaataa

SEQ ID NO: 5618701 - DNA, 14 bp, Homo sapiens
gcatgttcctcctt

SEQ ID NO: 5618702 - DNA, 23 bp, Homo sapiens
gcatgttcctccttttcttcacc

SEQ ID NO: 5618703 - DNA, 22 bp, Homo sapiens
gcatgttctctgaggacactaa

SEQ ID NO: 5618704 - DNA, 14 bp, Homo sapiens
gcatgttgaatgta

SEQ ID NO: 5618705 - DNA, 17 bp, Homo sapiens
gcatgttgggataaata

SEQ ID NO: 5618706 - DNA, 22 bp, Homo sapiens
gcatgttggggtttcctttacc

SEQ ID NO: 5618707 - DNA, 23 bp, Homo sapiens
gcatgttgtgatgtacacatttt

SEQ ID NO: 5618708 - DNA, 14 bp, Homo sapiens
gcatgtttaataat

SEQ ID NO: 5618709 - DNA, 19 bp, Homo sapiens
gcatgtttaattgtgatat

SEQ ID NO: 5618710 - DNA, 20 bp, Homo sapiens
gcatgtttaattgtgatatt

SEQ ID NO: 5618711 - DNA, 16 bp, Homo sapiens
gcatgtttagacttta

SEQ ID NO: 5618712 - DNA, 22 bp, Homo sapiens
gcatgtttagactttaacataa

SEQ ID NO: 5618713 - DNA, 14 bp, Homo sapiens
gcatgtttagtcta

SEQ ID NO: 5618714 - DNA, 14 bp, Homo sapiens
gcatgtttgaaatg

SEQ ID NO: 5618715 - DNA, 20 bp, Homo sapiens
gcatgttttatgtgcactca

SEQ ID NO: 5618716 - DNA, 14 bp, Homo sapiens
gcatgttttccagg

SEQ ID NO: 5618717 - DNA, 15 bp, Homo sapiens
gcatgttttgcatgt

SEQ ID NO: 5618718 - DNA, 14 bp, Homo sapiens
gcatgttttgtcat

SEQ ID NO: 5618719 - DNA, 20 bp, Homo sapiens
gcatgttttgtcattgtttt

SEQ ID NO: 5618720 - DNA, 16 bp, Homo sapiens
gcattaaaaataaaag

SEQ ID NO: 5618721 - DNA, 14 bp, Homo sapiens
gcattaaaataact

SEQ ID NO: 5618722 - DNA, 19 bp, Homo sapiens
gcattaaataaccttcatc

SEQ ID NO: 5618723 - DNA, 16 bp, Homo sapiens
gcattaaatataaaat

SEQ ID NO: 5618724 - DNA, 20 bp, Homo sapiens
gcattaaatataaaatacat

SEQ ID NO: 5618725 - DNA, 15 bp, Homo sapiens
gcattaaatgcaaaa

SEQ ID NO: 5618726 - DNA, 14 bp, Homo sapiens
gcattaaattacag

SEQ ID NO: 5618727 - DNA, 18 bp, Homo sapiens
gcattaaattcacaaact

SEQ ID NO: 5618728 - DNA, 21 bp, Homo sapiens
gcattaaccactctacagact

SEQ ID NO: 5618729 - DNA, 16 bp, Homo sapiens
gcattaactaaatgct

SEQ ID NO: 5618730 - DNA, 18 bp, Homo sapiens
gcattaactaaatgctca

SEQ ID NO: 5618731 - DNA, 13 bp, Homo sapiens
gcattaacttaaa

SEQ ID NO: 5618732 - DNA, 14 bp, Homo sapiens
gcattaagcacaca

SEQ ID NO: 5618733 - DNA, 15 bp, Homo sapiens
gcattaagcacacac

SEQ ID NO: 5618734 - DNA, 21 bp, Homo sapiens
gcattaagcacacacatctgg

SEQ ID NO: 5618735 - DNA, 16 bp, Homo sapiens
gcattaagggcctgct

SEQ ID NO: 5618736 - DNA, 13 bp, Homo sapiens
gcattaataaaac

SEQ ID NO: 5618737 - DNA, 16 bp, Homo sapiens
gcattaataaaactgt

SEQ ID NO: 5618738 - DNA, 17 bp, Homo sapiens
gcattaattgttccttg

SEQ ID NO: 5618739 - DNA, 19 bp, Homo sapiens
gcattaattgttccttgct

SEQ ID NO: 5618740 - DNA, 13 bp, Homo sapiens
gcattacaggcaa

SEQ ID NO: 5618741 - DNA, 13 bp, Homo sapiens
gcattacattcct

SEQ ID NO: 5618742 - DNA, 16 bp, Homo sapiens
gcattacatttccaaa

SEQ ID NO: 5618743 - DNA, 21 bp, Homo sapiens
gcattacccccaacctcattt

SEQ ID NO: 5618744 - DNA, 21 bp, Homo sapiens
gcattaccctctgcagaacag

SEQ ID NO: 5618745 - DNA, 18 bp, Homo sapiens
gcattaccgcgttgtaaa

SEQ ID NO: 5618746 - DNA, 20 bp, Homo sapiens
gcattaccgcgttgtaaaat

SEQ ID NO: 5618747 - DNA, 18 bp, Homo sapiens
gcattacctctttggaaa

SEQ ID NO: 5618748 - DNA, 15 bp, Homo sapiens
gcattacgtgagcca

SEQ ID NO: 5618749 - DNA, 18 bp, Homo sapiens
gcattacgtgagccaggt

SEQ ID NO: 5618750 - DNA, 15 bp, Homo sapiens
gcattactcttgtaa

SEQ ID NO: 5618751 - DNA, 16 bp, Homo sapiens
gcattactcttgtaag

SEQ ID NO: 5618752 - DNA, 18 bp, Homo sapiens
gcattactcttgtaagat

SEQ ID NO: 5618753 - DNA, 21 bp, Homo sapiens
gcattactcttgtaagatttt

SEQ ID NO: 5618754 - DNA, 21 bp, Homo sapiens
gcattactgtccccttgatat

SEQ ID NO: 5618755 - DNA, 14 bp, Homo sapiens
gcattactttatag

SEQ ID NO: 5618756 - DNA, 16 bp, Homo sapiens
gcattagaaaccatga

SEQ ID NO: 5618757 - DNA, 16 bp, Homo sapiens
gcattagaaatagaca

SEQ ID NO: 5618758 - DNA, 21 bp, Homo sapiens
gcattagaaatagacagtata

SEQ ID NO: 5618759 - DNA, 18 bp, Homo sapiens
gcattagaattatttaaa

SEQ ID NO: 5618760 - DNA, 19 bp, Homo sapiens
gcattagatagtcatgctg

SEQ ID NO: 5618761 - DNA, 21 bp, Homo sapiens
gcattagattcctttcctgtg

SEQ ID NO: 5618762 - DNA, 19 bp, Homo sapiens
gcattagcaaggcagagcc

SEQ ID NO: 5618763 - DNA, 17 bp, Homo sapiens
gcattagcacagatttt

SEQ ID NO: 5618764 - DNA, 15 bp, Homo sapiens
gcattagctaaaacc

SEQ ID NO: 5618765 - DNA, 17 bp, Homo sapiens
gcattagctttaattaa

SEQ ID NO: 5618766 - DNA, 18 bp, Homo sapiens
gcattagggatgcctcct

SEQ ID NO: 5618767 - DNA, 17 bp, Homo sapiens
gcattagtgggaaaaag

SEQ ID NO: 5618768 - DNA, 16 bp, Homo sapiens
gcattagtgtcccccc

SEQ ID NO: 5618769 - DNA, 21 bp, Homo sapiens
gcattagttggagctagaaaa

SEQ ID NO: 5618770 - DNA, 22 bp, Homo sapiens
gcattagttggagctagaaaat

SEQ ID NO: 5618771 - DNA, 19 bp, Homo sapiens
gcattatataccatttatc

SEQ ID NO: 5618772 - DNA, 18 bp, Homo sapiens
gcattatatttgtaaatt

SEQ ID NO: 5618773 - DNA, 17 bp, Homo sapiens
gcattatctctttctct

SEQ ID NO: 5618774 - DNA, 18 bp, Homo sapiens
gcattatgtatttataat

SEQ ID NO: 5618775 - DNA, 22 bp, Homo sapiens
gcattatgtatttataatttaa

SEQ ID NO: 5618776 - DNA, 22 bp, Homo sapiens
gcattatgtccactgtgtatag

SEQ ID NO: 5618777 - DNA, 23 bp, Homo sapiens
gcattatgtccactgtgtataga

SEQ ID NO: 5618778 - DNA, 14 bp, Homo sapiens
gcattattaaattg

SEQ ID NO: 5618779 - DNA, 18 bp, Homo sapiens
gcattattaaattgtaaa

SEQ ID NO: 5618780 - DNA, 14 bp, Homo sapiens
gcattattcataaa

SEQ ID NO: 5618781 - DNA, 12 bp, Homo sapiens
gcattattcatt

SEQ ID NO: 5618782 - DNA, 22 bp, Homo sapiens
gcattattctcttttatctgtt

SEQ ID NO: 5618783 - DNA, 17 bp, Homo sapiens
gcattattgacgaactg

SEQ ID NO: 5618784 - DNA, 14 bp, Homo sapiens
gcattattgcatta

SEQ ID NO: 5618785 - DNA, 14 bp, Homo sapiens
gcattattgccaaa

SEQ ID NO: 5618786 - DNA, 23 bp, Homo sapiens
gcattattggaatataattgttt

SEQ ID NO: 5618787 - DNA, 16 bp, Homo sapiens
gcattatttaatgttt

SEQ ID NO: 5618788 - DNA, 18 bp, Homo sapiens
gcattatttaatgtttga

SEQ ID NO: 5618789 - DNA, 22 bp, Homo sapiens
gcattattttatatatttttta

SEQ ID NO: 5618790 - DNA, 14 bp, Homo sapiens
gcattcaaaatctt

SEQ ID NO: 5618791 - DNA, 13 bp, Homo sapiens
gcattcaaagtaa

SEQ ID NO: 5618792 - DNA, 23 bp, Homo sapiens
gcattcaaagtaatatatcaaat

SEQ ID NO: 5618793 - DNA, 16 bp, Homo sapiens
gcattcaaccttacca

SEQ ID NO: 5618794 - DNA, 13 bp, Homo sapiens
gcattcacacaca

SEQ ID NO: 5618795 - DNA, 14 bp, Homo sapiens
gcattcacacacag

SEQ ID NO: 5618796 - DNA, 15 bp, Homo sapiens
gcattcacacacagc

SEQ ID NO: 5618797 - DNA, 17 bp, Homo sapiens
gcattcacacacagcct

SEQ ID NO: 5618798 - DNA, 18 bp, Homo sapiens
gcattcagaagaaaaaga

SEQ ID NO: 5618799 - DNA, 13 bp, Homo sapiens
gcattcagagagc

SEQ ID NO: 5618800 - DNA, 15 bp, Homo sapiens
gcattcagcacaccc

SEQ ID NO: 5618801 - DNA, 21 bp, Homo sapiens
gcattcagcacaccccaaggg

SEQ ID NO: 5618802 - DNA, 18 bp, Homo sapiens
gcattcagggttatacac

SEQ ID NO: 5618803 - DNA, 23 bp, Homo sapiens
gcattcagggttatacacagaaa

SEQ ID NO: 5618804 - DNA, 14 bp, Homo sapiens
gcattcataaactt

SEQ ID NO: 5618805 - DNA, 22 bp, Homo sapiens
gcattcataaacttttctctta

SEQ ID NO: 5618806 - DNA, 18 bp, Homo sapiens
gcattcatgcaagagttt

SEQ ID NO: 5618807 - DNA, 11 bp, Homo sapiens
gcattcatgtt

SEQ ID NO: 5618808 - DNA, 23 bp, Homo sapiens
gcattcatgttttaaaagtttgt

SEQ ID NO: 5618809 - DNA, 17 bp, Homo sapiens
gcattcatttgtttttt

SEQ ID NO: 5618810 - DNA, 11 bp, Homo sapiens
gcattcatttt

SEQ ID NO: 5618811 - DNA, 17 bp, Homo sapiens
gcattcatttttatagc

SEQ ID NO: 5618812 - DNA, 19 bp, Homo sapiens
gcattcatttttatagcaa

SEQ ID NO: 5618813 - DNA, 22 bp, Homo sapiens
gcattcatttttatagcaacaa

SEQ ID NO: 5618814 - DNA, 17 bp, Homo sapiens
gcattccacacctaaga

SEQ ID NO: 5618815 - DNA, 11 bp, Homo sapiens
gcattccacag

SEQ ID NO: 5618816 - DNA, 12 bp, Homo sapiens
gcattccagaat

SEQ ID NO: 5618817 - DNA, 16 bp, Homo sapiens
gcattccagaatcttg

SEQ ID NO: 5618818 - DNA, 19 bp, Homo sapiens
gcattccagagttaaaatg

SEQ ID NO: 5618819 - DNA, 12 bp, Homo sapiens
gcattccagccc

SEQ ID NO: 5618820 - DNA, 15 bp, Homo sapiens
gcattccagcccctc

SEQ ID NO: 5618821 - DNA, 16 bp, Homo sapiens
gcattccagcccctct

SEQ ID NO: 5618822 - DNA, 15 bp, Homo sapiens
gcattccagcgtctg

SEQ ID NO: 5618823 - DNA, 18 bp, Homo sapiens
gcattccagcgtctgctg

SEQ ID NO: 5618824 - DNA, 17 bp, Homo sapiens
gcattccagctctgccc

SEQ ID NO: 5618825 - DNA, 22 bp, Homo sapiens
gcattccagctgtcactctgtg

SEQ ID NO: 5618826 - DNA, 14 bp, Homo sapiens
gcattccaggctcc

SEQ ID NO: 5618827 - DNA, 22 bp, Homo sapiens
gcattccaggggctgcagcccc

SEQ ID NO: 5618828 - DNA, 17 bp, Homo sapiens
gcattccagtcaggctc

SEQ ID NO: 5618829 - DNA, 11 bp, Homo sapiens
gcattccatga

SEQ ID NO: 5618830 - DNA, 13 bp, Homo sapiens
gcattccatgatt

SEQ ID NO: 5618831 - DNA, 16 bp, Homo sapiens
gcattccatgatttta

SEQ ID NO: 5618832 - DNA, 13 bp, Homo sapiens
gcattcccagagg

SEQ ID NO: 5618833 - DNA, 16 bp, Homo sapiens
gcattcccagggacct

SEQ ID NO: 5618834 - DNA, 13 bp, Homo sapiens
gcattcccaggta

SEQ ID NO: 5618835 - DNA, 20 bp, Homo sapiens
gcattcccaggtaggccaag

SEQ ID NO: 5618836 - DNA, 13 bp, Homo sapiens
gcattcccagtgg

SEQ ID NO: 5618837 - DNA, 12 bp, Homo sapiens
gcattccccact

SEQ ID NO: 5618838 - DNA, 12 bp, Homo sapiens
gcattccccagg

SEQ ID NO: 5618839 - DNA, 15 bp, Homo sapiens
gcattccccaggagg

SEQ ID NO: 5618840 - DNA, 20 bp, Homo sapiens
gcattccccaggaggccagc

SEQ ID NO: 5618841 - DNA, 17 bp, Homo sapiens
gcattcccggtgcagaa

SEQ ID NO: 5618842 - DNA, 21 bp, Homo sapiens
gcattccctgagtcaccagga

SEQ ID NO: 5618843 - DNA, 20 bp, Homo sapiens
gcattcctcaggaaggacat

SEQ ID NO: 5618844 - DNA, 19 bp, Homo sapiens
gcattcctgatatgattta

SEQ ID NO: 5618845 - DNA, 21 bp, Homo sapiens
gcattcctgtaacttttaatc

SEQ ID NO: 5618846 - DNA, 16 bp, Homo sapiens
gcattccttacttgca

SEQ ID NO: 5618847 - DNA, 19 bp, Homo sapiens
gcattccttacttgcactg

SEQ ID NO: 5618848 - DNA, 14 bp, Homo sapiens
gcattccttctttg

SEQ ID NO: 5618849 - DNA, 19 bp, Homo sapiens
gcattccttctttgataat

SEQ ID NO: 5618850 - DNA, 14 bp, Homo sapiens
gcattcgcagcagc

SEQ ID NO: 5618851 - DNA, 22 bp, Homo sapiens
gcattcgcagcagctccgcctg

SEQ ID NO: 5618852 - DNA, 14 bp, Homo sapiens
gcattcgttgctcc

SEQ ID NO: 5618853 - DNA, 13 bp, Homo sapiens
gccaagccttctg

SEQ ID NO: 5618854 - DNA, 23 bp, Homo sapiens
gccaagcgggggcgtggctggcc

SEQ ID NO: 5618855 - DNA, 22 bp, Homo sapiens
gccaagctccctggagccctgt

SEQ ID NO: 5618856 - DNA, 20 bp, Homo sapiens
gccaagctgaagtgaaggag

SEQ ID NO: 5618857 - DNA, 20 bp, Homo sapiens
gccaagctgaggaggtgctg

SEQ ID NO: 5618858 - DNA, 12 bp, Homo sapiens
gccaagctgtgt

SEQ ID NO: 5618859 - DNA, 21 bp, Homo sapiens
gccaagcttcaaccctcagcc

SEQ ID NO: 5618860 - DNA, 15 bp, Homo sapiens
gccaagcttcctgtg

SEQ ID NO: 5618861 - DNA, 22 bp, Homo sapiens
gccaagcttgttatcagctttc

SEQ ID NO: 5618862 - DNA, 15 bp, Homo sapiens
gccaagctttaaatt

SEQ ID NO: 5618863 - DNA, 16 bp, Homo sapiens
gccaagctttaaatta

SEQ ID NO: 5618864 - DNA, 23 bp, Homo sapiens
gccaaggaagtctgtgtctacca

SEQ ID NO: 5618865 - DNA, 14 bp, Homo sapiens
gccaaggacactga

SEQ ID NO: 5618866 - DNA, 15 bp, Homo sapiens
gccaaggacctgaga

SEQ ID NO: 5618867 - DNA, 16 bp, Homo sapiens
gccaaggactgactga

SEQ ID NO: 5618868 - DNA, 12 bp, Homo sapiens
gccaaggagctg

SEQ ID NO: 5618869 - DNA, 13 bp, Homo sapiens
gccaaggagctgc

SEQ ID NO: 5618870 - DNA, 14 bp, Homo sapiens
gccaaggagctgct

SEQ ID NO: 5618871 - DNA, 15 bp, Homo sapiens
gccaaggagctgcta

SEQ ID NO: 5618872 - DNA, 16 bp, Homo sapiens
gccaaggagctgctat

SEQ ID NO: 5618873 - DNA, 14 bp, Homo sapiens
gccaaggaggcctg

SEQ ID NO: 5618874 - DNA, 18 bp, Homo sapiens
gccaaggaggcctgggga

SEQ ID NO: 5618875 - DNA, 17 bp, Homo sapiens
gccaaggagggaagagt

SEQ ID NO: 5618876 - DNA, 14 bp, Homo sapiens
gccaaggaggtggg

SEQ ID NO: 5618877 - DNA, 21 bp, Homo sapiens
gccaaggagtcactgagacca

SEQ ID NO: 5618878 - DNA, 14 bp, Homo sapiens
gccaaggcagaggc

SEQ ID NO: 5618879 - DNA, 15 bp, Homo sapiens
gccaaggcagaggcc

SEQ ID NO: 5618880 - DNA, 16 bp, Homo sapiens
gccaaggcagaggcct

SEQ ID NO: 5618881 - DNA, 21 bp, Homo sapiens
gccaaggcagaggcctgggct

SEQ ID NO: 5618882 - DNA, 18 bp, Homo sapiens
gccaaggcagcgacccca

SEQ ID NO: 5618883 - DNA, 15 bp, Homo sapiens
gccaaggcaggtaga

SEQ ID NO: 5618884 - DNA, 20 bp, Homo sapiens
gccaaggccaaaggaagcac

SEQ ID NO: 5618885 - DNA, 12 bp, Homo sapiens
gccaaggccacc

SEQ ID NO: 5618886 - DNA, 15 bp, Homo sapiens
gccaaggccagccca

SEQ ID NO: 5618887 - DNA, 19 bp, Homo sapiens
gccaaggccgaagctctgg

SEQ ID NO: 5618888 - DNA, 20 bp, Homo sapiens
gccaaggccgaagctctggc

SEQ ID NO: 5618889 - DNA, 15 bp, Homo sapiens
gccaaggccgccagc

SEQ ID NO: 5618890 - DNA, 16 bp, Homo sapiens
gccaaggccgcccacc

SEQ ID NO: 5618891 - DNA, 17 bp, Homo sapiens
gccaaggccggagaccc

SEQ ID NO: 5618892 - DNA, 19 bp, Homo sapiens
gccaaggcctatgccacct

SEQ ID NO: 5618893 - DNA, 21 bp, Homo sapiens
gccaaggcctatgccacctgc

SEQ ID NO: 5618894 - DNA, 22 bp, Homo sapiens
gccaaggcctatgccacctgca

SEQ ID NO: 5618895 - DNA, 13 bp, Homo sapiens
gccaaggcctcag

SEQ ID NO: 5618896 - DNA, 17 bp, Homo sapiens
gccaaggcctccctcag

SEQ ID NO: 5618897 - DNA, 14 bp, Homo sapiens
gccaaggccttctc

SEQ ID NO: 5618898 - DNA, 18 bp, Homo sapiens
gccaaggctctcccctct

SEQ ID NO: 5618899 - DNA, 19 bp, Homo sapiens
gccaaggctctcccctctc

SEQ ID NO: 5618900 - DNA, 15 bp, Homo sapiens
gccaaggctctctct

SEQ ID NO: 5618901 - DNA, 16 bp, Homo sapiens
gccaaggctctctctg

SEQ ID NO: 5618902 - DNA, 15 bp, Homo sapiens
gccaaggctgagagc

SEQ ID NO: 5618903 - DNA, 18 bp, Homo sapiens
gccaaggctgagagctct

SEQ ID NO: 5618904 - DNA, 19 bp, Homo sapiens
gccaagggaacctgtgtcc

SEQ ID NO: 5618905 - DNA, 20 bp, Homo sapiens
gccaagggaattatagctgc

SEQ ID NO: 5618906 - DNA, 15 bp, Homo sapiens
gccaagggccagaca

SEQ ID NO: 5618907 - DNA, 16 bp, Homo sapiens
gccaagggccagacag

SEQ ID NO: 5618908 - DNA, 17 bp, Homo sapiens
gccaagggccagacaga

SEQ ID NO: 5618909 - DNA, 14 bp, Homo sapiens
gccaagggccccag

SEQ ID NO: 5618910 - DNA, 16 bp, Homo sapiens
gccaagggccccaggg

SEQ ID NO: 5618911 - DNA, 21 bp, Homo sapiens
gccaagggccgactaagagaa

SEQ ID NO: 5618912 - DNA, 15 bp, Homo sapiens
gccaagggctaggct

SEQ ID NO: 5618913 - DNA, 19 bp, Homo sapiens
gccaagggctaggctcttg

SEQ ID NO: 5618914 - DNA, 22 bp, Homo sapiens
gccaaggggagtcaccttccct

SEQ ID NO: 5618915 - DNA, 13 bp, Homo sapiens
gccaaggggctgc

SEQ ID NO: 5618916 - DNA, 20 bp, Homo sapiens
gccaaggggctgcgctagca

SEQ ID NO: 5618917 - DNA, 22 bp, Homo sapiens
gccaagggggacctcgggctgt

SEQ ID NO: 5618918 - DNA, 18 bp, Homo sapiens
gccaagggggtgactgga

SEQ ID NO: 5618919 - DNA, 17 bp, Homo sapiens
gccaaggggtctgctcc

SEQ ID NO: 5618920 - DNA, 21 bp, Homo sapiens
gccaaggggtctgctcctgtg

SEQ ID NO: 5618921 - DNA, 20 bp, Homo sapiens
gccaagggtcctcacccctc

SEQ ID NO: 5618922 - DNA, 20 bp, Homo sapiens
gccaaggtaagaggattgct

SEQ ID NO: 5618923 - DNA, 16 bp, Homo sapiens
gccaaggtacctaggt

SEQ ID NO: 5618924 - DNA, 15 bp, Homo sapiens
gccaaggtctgagcc

SEQ ID NO: 5618925 - DNA, 20 bp, Homo sapiens
gccaaggtgaatagcacagg

SEQ ID NO: 5618926 - DNA, 21 bp, Homo sapiens
gccaaggtgaatagcacaggt

SEQ ID NO: 5618927 - DNA, 22 bp, Homo sapiens
gccaaggtgccaccaccctgcc

SEQ ID NO: 5618928 - DNA, 17 bp, Homo sapiens
gccaaggtggagggaag

SEQ ID NO: 5618929 - DNA, 15 bp, Homo sapiens
gccaaggtgggcgga

SEQ ID NO: 5618930 - DNA, 16 bp, Homo sapiens
gccaaggtgggctgag

SEQ ID NO: 5618931 - DNA, 18 bp, Homo sapiens
gccaaggtgggctgagcc

SEQ ID NO: 5618932 - DNA, 21 bp, Homo sapiens
gccaaggtgggctgagccctg

SEQ ID NO: 5618933 - DNA, 22 bp, Homo sapiens
gccaaggtgtccagggtcctct

SEQ ID NO: 5618934 - DNA, 20 bp, Homo sapiens
gccaaggtgtcctacagaaa

SEQ ID NO: 5618935 - DNA, 20 bp, Homo sapiens
gccaaggtgtggcctgcact

SEQ ID NO: 5618936 - DNA, 18 bp, Homo sapiens
gccaaggttgtcctggag

SEQ ID NO: 5618937 - DNA, 22 bp, Homo sapiens
gccaaggtttcccagtgagcct

SEQ ID NO: 5618938 - DNA, 16 bp, Homo sapiens
gccaagtaaacagggt

SEQ ID NO: 5618939 - DNA, 16 bp, Homo sapiens
gccaagtaagaaagtg

SEQ ID NO: 5618940 - DNA, 16 bp, Homo sapiens
gccaagtataattttt

SEQ ID NO: 5618941 - DNA, 22 bp, Homo sapiens
gccaagtcagctttgccttcca

SEQ ID NO: 5618942 - DNA, 21 bp, Homo sapiens
gccaagtcatggagaatctgc

SEQ ID NO: 5618943 - DNA, 15 bp, Homo sapiens
gccaagtccactgtc

SEQ ID NO: 5618944 - DNA, 13 bp, Homo sapiens
gccaagtccctgg

SEQ ID NO: 5618945 - DNA, 20 bp, Homo sapiens
gccaagtcctagctcctcct

SEQ ID NO: 5618946 - DNA, 16 bp, Homo sapiens
gccaagtcctgccttt

SEQ ID NO: 5618947 - DNA, 18 bp, Homo sapiens
gccaagtctaatgaagag

SEQ ID NO: 5618948 - DNA, 17 bp, Homo sapiens
gccaagtctcagaagag

SEQ ID NO: 5618949 - DNA, 23 bp, Homo sapiens
gccaagtctggcaccatgttggc

SEQ ID NO: 5618950 - DNA, 14 bp, Homo sapiens
gccaagtgcctgct

SEQ ID NO: 5618951 - DNA, 16 bp, Homo sapiens
gccaagtgcctgctta

SEQ ID NO: 5618952 - DNA, 17 bp, Homo sapiens
gccaagtgcctgcttag

SEQ ID NO: 5618953 - DNA, 15 bp, Homo sapiens
gccaagtgctctttg

SEQ ID NO: 5618954 - DNA, 21 bp, Homo sapiens
gccaagtggacttggagctgc

SEQ ID NO: 5618955 - DNA, 17 bp, Homo sapiens
gccaagtggccctcaga

SEQ ID NO: 5618956 - DNA, 19 bp, Homo sapiens
gccaagtgtgaccccactg

SEQ ID NO: 5618957 - DNA, 18 bp, Homo sapiens
gccaagtgttttgtattt

SEQ ID NO: 5618958 - DNA, 11 bp, Homo sapiens
gccaagttcaa

SEQ ID NO: 5618959 - DNA, 15 bp, Homo sapiens
gccaagtttttcaga

SEQ ID NO: 5618960 - DNA, 16 bp, Homo sapiens
gccaagtttttcagaa

SEQ ID NO: 5618961 - DNA, 18 bp, Homo sapiens
gccaataaataatattat

SEQ ID NO: 5618962 - DNA, 23 bp, Homo sapiens
gccaataaatcaactccagctcc

SEQ ID NO: 5618963 - DNA, 17 bp, Homo sapiens
gccaataaattctaaat

SEQ ID NO: 5618964 - DNA, 19 bp, Homo sapiens
gccaataaccaagtttatt

SEQ ID NO: 5618965 - DNA, 20 bp, Homo sapiens
gccaataataatacctccct

SEQ ID NO: 5618966 - DNA, 16 bp, Homo sapiens
gccaatacagacaaag

SEQ ID NO: 5618967 - DNA, 15 bp, Homo sapiens
gccaatactgagtgc

SEQ ID NO: 5618968 - DNA, 16 bp, Homo sapiens
gccaatatcctaataa

SEQ ID NO: 5618969 - DNA, 17 bp, Homo sapiens
gccaatatcctaataaa

SEQ ID NO: 5618970 - DNA, 20 bp, Homo sapiens
gccaatatcctaataaaaag

SEQ ID NO: 5618971 - DNA, 22 bp, Homo sapiens
gccaatatcctaataaaaaggt

SEQ ID NO: 5618972 - DNA, 13 bp, Homo sapiens
gccaatatgtatt

SEQ ID NO: 5618973 - DNA, 18 bp, Homo sapiens
gccaatattaaatctgct

SEQ ID NO: 5618974 - DNA, 22 bp, Homo sapiens
gccaatccaggtgggagagaca

SEQ ID NO: 5618975 - DNA, 21 bp, Homo sapiens
gccaatccctcaccttctgag

SEQ ID NO: 5618976 - DNA, 22 bp, Homo sapiens
gccaatctagaggcaagcctgg

SEQ ID NO: 5618977 - DNA, 16 bp, Homo sapiens
gccaatctattctcaa

SEQ ID NO: 5618978 - DNA, 18 bp, Homo sapiens
gccaatctgcaatttcta

SEQ ID NO: 5618979 - DNA, 15 bp, Homo sapiens
gccaatctggccctt

SEQ ID NO: 5618980 - DNA, 17 bp, Homo sapiens
gccaatcttaaagacaa

SEQ ID NO: 5618981 - DNA, 23 bp, Homo sapiens
gccaatgaaggctgaatcaaaga

SEQ ID NO: 5618982 - DNA, 15 bp, Homo sapiens
gccaatgccacagcc

SEQ ID NO: 5618983 - DNA, 19 bp, Homo sapiens
gccaatgccacagccaagc

SEQ ID NO: 5618984 - DNA, 22 bp, Homo sapiens
gccaatgccatgactgctcagg

SEQ ID NO: 5618985 - DNA, 21 bp, Homo sapiens
gccaatgctacagtaataaat

SEQ ID NO: 5618986 - DNA, 22 bp, Homo sapiens
gccaatgctgtacgtactgcat

SEQ ID NO: 5618987 - DNA, 19 bp, Homo sapiens
gccaatggaacctcctttc

SEQ ID NO: 5618988 - DNA, 18 bp, Homo sapiens
gccaatggtgagggctga

SEQ ID NO: 5618989 - DNA, 21 bp, Homo sapiens
gccaatggtgagggctgagag

SEQ ID NO: 5618990 - DNA, 16 bp, Homo sapiens
gccaatggtgcttccc

SEQ ID NO: 5618991 - DNA, 18 bp, Homo sapiens
gccaatgtcgaaacctac

SEQ ID NO: 5618992 - DNA, 20 bp, Homo sapiens
gccaatgtgggctgcccctc

SEQ ID NO: 5618993 - DNA, 22 bp, Homo sapiens
gccaatgttatgccagctccat

SEQ ID NO: 5618994 - DNA, 17 bp, Homo sapiens
gccaatgttgctgatgg

SEQ ID NO: 5618995 - DNA, 16 bp, Homo sapiens
gccaatgttgtgtgtt

SEQ ID NO: 5618996 - DNA, 20 bp, Homo sapiens
gccaatgttgtgtgttgcac

SEQ ID NO: 5618997 - DNA, 16 bp, Homo sapiens
gccaattaaaatatat

SEQ ID NO: 5618998 - DNA, 17 bp, Homo sapiens
gccaattaaaatatata

SEQ ID NO: 5618999 - DNA, 22 bp, Homo sapiens
gccaattagggggtaaggcccc

SEQ ID NO: 5619000 - DNA, 17 bp, Homo sapiens
gccaattcagacaggca

SEQ ID NO: 5619001 - DNA, 13 bp, Homo sapiens
gccaattcctata

SEQ ID NO: 5619002 - DNA, 19 bp, Homo sapiens
gccaattgttcttaaaacc

SEQ ID NO: 5619003 - DNA, 20 bp, Homo sapiens
gccaatttcaaagaaaacag

SEQ ID NO: 5619004 - DNA, 16 bp, Homo sapiens
gccaatttcaccccat

SEQ ID NO: 5619005 - DNA, 16 bp, Homo sapiens
gccaatttcctctcca

SEQ ID NO: 5619006 - DNA, 22 bp, Homo sapiens
gccaatttcctctccactgctg

SEQ ID NO: 5619007 - DNA, 15 bp, Homo sapiens
gccaatttctctcag

SEQ ID NO: 5619008 - DNA, 13 bp, Homo sapiens
gccaatttgtctc

SEQ ID NO: 5619009 - DNA, 15 bp, Homo sapiens
gccaatttgtctcct

SEQ ID NO: 5619010 - DNA, 22 bp, Homo sapiens
gccaatttgtctcctactctgt

SEQ ID NO: 5619011 - DNA, 13 bp, Homo sapiens
gccaattttggat

SEQ ID NO: 5619012 - DNA, 15 bp, Homo sapiens
gccaattttggatga

SEQ ID NO: 5619013 - DNA, 16 bp, Homo sapiens
gccaattttggatgag

SEQ ID NO: 5619014 - DNA, 22 bp, Homo sapiens
gccaatttttctgcactgagca

SEQ ID NO: 5619015 - DNA, 13 bp, Homo sapiens
gccaatttttgta

SEQ ID NO: 5619016 - DNA, 18 bp, Homo sapiens
gccaatttttgttttccc

SEQ ID NO: 5619017 - DNA, 15 bp, Homo sapiens
gccacaaaaatgttc

SEQ ID NO: 5619018 - DNA, 20 bp, Homo sapiens
gccacaaaccaccaggactg

SEQ ID NO: 5619019 - DNA, 20 bp, Homo sapiens
gccacaaagccccccagctc

SEQ ID NO: 5619020 - DNA, 22 bp, Homo sapiens
gccacaaagccccccagctccc

SEQ ID NO: 5619021 - DNA, 15 bp, Homo sapiens
gccacaaataaaatg

SEQ ID NO: 5619022 - DNA, 23 bp, Homo sapiens
gccacaaatcaaagcaagggctc

SEQ ID NO: 5619023 - DNA, 20 bp, Homo sapiens
gccacaacagaataaagcag

SEQ ID NO: 5619024 - DNA, 23 bp, Homo sapiens
gccacaacagaataaagcagcct

SEQ ID NO: 5619025 - DNA, 22 bp, Homo sapiens
gccacaactgctgtggccccct

SEQ ID NO: 5619026 - DNA, 16 bp, Homo sapiens
gccacaagacccttgt

SEQ ID NO: 5619027 - DNA, 14 bp, Homo sapiens
gccacaagcacaat

SEQ ID NO: 5619028 - DNA, 13 bp, Homo sapiens
gccacaagctgca

SEQ ID NO: 5619029 - DNA, 13 bp, Homo sapiens
gccacccttccct

SEQ ID NO: 5619030 - DNA, 14 bp, Homo sapiens
gccacccttccctg

SEQ ID NO: 5619031 - DNA, 18 bp, Homo sapiens
gccacccttccctgcctc

SEQ ID NO: 5619032 - DNA, 18 bp, Homo sapiens
gccacccttggtctcatg

SEQ ID NO: 5619033 - DNA, 15 bp, Homo sapiens
gccaccgactgccca

SEQ ID NO: 5619034 - DNA, 17 bp, Homo sapiens
gccaccgactgcccagc

SEQ ID NO: 5619035 - DNA, 21 bp, Homo sapiens
gccaccgactgcccagccact

SEQ ID NO: 5619036 - DNA, 13 bp, Homo sapiens
gccaccgcagctg

SEQ ID NO: 5619037 - DNA, 19 bp, Homo sapiens
gccaccgcagctgctgcca

SEQ ID NO: 5619038 - DNA, 20 bp, Homo sapiens
gccaccgcagctgctgccac

SEQ ID NO: 5619039 - DNA, 19 bp, Homo sapiens
gccaccgcaggggactgtc

SEQ ID NO: 5619040 - DNA, 21 bp, Homo sapiens
gccaccgcaggggactgtctc

SEQ ID NO: 5619041 - DNA, 16 bp, Homo sapiens
gccaccgcccagctca

SEQ ID NO: 5619042 - DNA, 13 bp, Homo sapiens
gccaccgccttgc

SEQ ID NO: 5619043 - DNA, 16 bp, Homo sapiens
gccaccgccttgccca

SEQ ID NO: 5619044 - DNA, 20 bp, Homo sapiens
gccaccgccttgcccagcct

SEQ ID NO: 5619045 - DNA, 17 bp, Homo sapiens
gccaccgcgcccagcct

SEQ ID NO: 5619046 - DNA, 21 bp, Homo sapiens
gccaccgcgccctcctgccca

SEQ ID NO: 5619047 - DNA, 18 bp, Homo sapiens
gccaccgctctcctgcct

SEQ ID NO: 5619048 - DNA, 15 bp, Homo sapiens
gccaccgctgccagc

SEQ ID NO: 5619049 - DNA, 16 bp, Homo sapiens
gccaccgctgccagca

SEQ ID NO: 5619050 - DNA, 20 bp, Homo sapiens
gccaccgcttccggctcctg

SEQ ID NO: 5619051 - DNA, 23 bp, Homo sapiens
gccaccgcttccggctcctgtgc

SEQ ID NO: 5619052 - DNA, 23 bp, Homo sapiens
gccaccggcctgtgggtctctga

SEQ ID NO: 5619053 - DNA, 22 bp, Homo sapiens
gccaccgggacagacctggaca

SEQ ID NO: 5619054 - DNA, 21 bp, Homo sapiens
gccaccgggcatgtctgcctg

SEQ ID NO: 5619055 - DNA, 23 bp, Homo sapiens
gccaccggggcaagagggaaggt

SEQ ID NO: 5619056 - DNA, 16 bp, Homo sapiens
gccaccggtgggcagt

SEQ ID NO: 5619057 - DNA, 17 bp, Homo sapiens
gccaccggtgggcagtg

SEQ ID NO: 5619058 - DNA, 15 bp, Homo sapiens
gccaccgtcacacag

SEQ ID NO: 5619059 - DNA, 14 bp, Homo sapiens
gccaccgtgcctgg

SEQ ID NO: 5619060 - DNA, 22 bp, Homo sapiens
gccaccgtgcctggccacgccc

SEQ ID NO: 5619061 - DNA, 18 bp, Homo sapiens
gccaccgtgcctggccag

SEQ ID NO: 5619062 - DNA, 19 bp, Homo sapiens
gccaccgtgcctggccaga

SEQ ID NO: 5619063 - DNA, 18 bp, Homo sapiens
gccaccgtgcctggctga

SEQ ID NO: 5619064 - DNA, 23 bp, Homo sapiens
gccacctagaaaggggcccattc

SEQ ID NO: 5619065 - DNA, 19 bp, Homo sapiens
gccacctagaagtctccct

SEQ ID NO: 5619066 - DNA, 21 bp, Homo sapiens
gccacctatctcgtgggagag

SEQ ID NO: 5619067 - DNA, 22 bp, Homo sapiens
gccacctatctcgtgggagagc

SEQ ID NO: 5619068 - DNA, 15 bp, Homo sapiens
gccacctatgcctgt

SEQ ID NO: 5619069 - DNA, 16 bp, Homo sapiens
gccacctatgcctgtg

SEQ ID NO: 5619070 - DNA, 13 bp, Homo sapiens
gccacctcaccct

SEQ ID NO: 5619071 - DNA, 20 bp, Homo sapiens
gccacctcaccctctccgca

SEQ ID NO: 5619072 - DNA, 18 bp, Homo sapiens
gccacctccacacccacc

SEQ ID NO: 5619073 - DNA, 17 bp, Homo sapiens
gccacctccacccccaa

SEQ ID NO: 5619074 - DNA, 20 bp, Homo sapiens
gccacctccacccccaagaa

SEQ ID NO: 5619075 - DNA, 13 bp, Homo sapiens
gccacctccagaa

SEQ ID NO: 5619076 - DNA, 14 bp, Homo sapiens
gccacctcccaccc

SEQ ID NO: 5619077 - DNA, 15 bp, Homo sapiens
gccacctcccacccc

SEQ ID NO: 5619078 - DNA, 17 bp, Homo sapiens
gccacctcccaccccac

SEQ ID NO: 5619079 - DNA, 19 bp, Homo sapiens
gccacctcccaccccactc

SEQ ID NO: 5619080 - DNA, 22 bp, Homo sapiens
gccacctcccaccccactccag

SEQ ID NO: 5619081 - DNA, 23 bp, Homo sapiens
gccacctcccaccccactccagc

SEQ ID NO: 5619082 - DNA, 11 bp, Homo sapiens
gccacctcccc

SEQ ID NO: 5619083 - DNA, 12 bp, Homo sapiens
gccacctcccca

SEQ ID NO: 5619084 - DNA, 15 bp, Homo sapiens
gccacctccccactc

SEQ ID NO: 5619085 - DNA, 19 bp, Homo sapiens
gccacctccccactccagc

SEQ ID NO: 5619086 - DNA, 22 bp, Homo sapiens
gccacctccccactccagcaga

SEQ ID NO: 5619087 - DNA, 15 bp, Homo sapiens
gccacctccccaggc

SEQ ID NO: 5619088 - DNA, 15 bp, Homo sapiens
gccacctcccctatc

SEQ ID NO: 5619089 - DNA, 20 bp, Homo sapiens
gccacctcccctatccaccc

SEQ ID NO: 5619090 - DNA, 14 bp, Homo sapiens
gccacctccgccag

SEQ ID NO: 5619091 - DNA, 19 bp, Homo sapiens
gccacctccgccagacccc

SEQ ID NO: 5619092 - DNA, 21 bp, Homo sapiens
gccacctcctaaaaggcccag

SEQ ID NO: 5619093 - DNA, 14 bp, Homo sapiens
gccacctcctaccc

SEQ ID NO: 5619094 - DNA, 13 bp, Homo sapiens
gccacctcctcgt

SEQ ID NO: 5619095 - DNA, 17 bp, Homo sapiens
gccacctctaacagcac

SEQ ID NO: 5619096 - DNA, 13 bp, Homo sapiens
gccacctctccaa

SEQ ID NO: 5619097 - DNA, 14 bp, Homo sapiens
gccacctctccaag

SEQ ID NO: 5619098 - DNA, 23 bp, Homo sapiens
gccacctctccaagggcttctgc

SEQ ID NO: 5619099 - DNA, 13 bp, Homo sapiens
gccacctctctgc

SEQ ID NO: 5619100 - DNA, 23 bp, Homo sapiens
gccacctctgcggaccccagctg

SEQ ID NO: 5619101 - DNA, 14 bp, Homo sapiens
gccacctcttcctg

SEQ ID NO: 5619102 - DNA, 15 bp, Homo sapiens
gccacctcttcctgg

SEQ ID NO: 5619103 - DNA, 15 bp, Homo sapiens
gccacctcttgggca

SEQ ID NO: 5619104 - DNA, 16 bp, Homo sapiens
gccacctgaataaaga

SEQ ID NO: 5619105 - DNA, 17 bp, Homo sapiens
gccacctgcaagatgga

SEQ ID NO: 5619106 - DNA, 16 bp, Homo sapiens
gccacctgcaagtgcc

SEQ ID NO: 5619107 - DNA, 16 bp, Homo sapiens
gccacctgcaggtcac

SEQ ID NO: 5619108 - DNA, 19 bp, Homo sapiens
gccacctgccacccccagg

SEQ ID NO: 5619109 - DNA, 21 bp, Homo sapiens
gccacctgccacccccaggtc

SEQ ID NO: 5619110 - DNA, 12 bp, Homo sapiens
gccacctgccag

SEQ ID NO: 5619111 - DNA, 18 bp, Homo sapiens
gccacctgccaggcctcc

SEQ ID NO: 5619112 - DNA, 20 bp, Homo sapiens
gccacctgccaggcctccct

SEQ ID NO: 5619113 - DNA, 22 bp, Homo sapiens
gccacctgccaggcctccctcg

SEQ ID NO: 5619114 - DNA, 14 bp, Homo sapiens
gccacctgccccct

SEQ ID NO: 5619115 - DNA, 16 bp, Homo sapiens
gccacctgcccccttc

SEQ ID NO: 5619116 - DNA, 18 bp, Homo sapiens
gccacctgcccccttctc

SEQ ID NO: 5619117 - DNA, 23 bp, Homo sapiens
gccacctgcctgcgtcttccgcc

SEQ ID NO: 5619118 - DNA, 20 bp, Homo sapiens
gccacctgcggtgctatctc

SEQ ID NO: 5619119 - DNA, 16 bp, Homo sapiens
gccacctggacccctg

SEQ ID NO: 5619120 - DNA, 20 bp, Homo sapiens
gccacctggcagggctcaca

SEQ ID NO: 5619121 - DNA, 22 bp, Homo sapiens
gccacctggcggccctaagcca

SEQ ID NO: 5619122 - DNA, 22 bp, Homo sapiens
gccacctgggaacacagttctg

SEQ ID NO: 5619123 - DNA, 13 bp, Homo sapiens
gccacctgggctg

SEQ ID NO: 5619124 - DNA, 14 bp, Homo sapiens
gccacctgggctgg

SEQ ID NO: 5619125 - DNA, 18 bp, Homo sapiens
gccacctgggctgggaga

SEQ ID NO: 5619126 - DNA, 20 bp, Homo sapiens
gccacctgggctgggagaag

SEQ ID NO: 5619127 - DNA, 14 bp, Homo sapiens
gccacctggggcag

SEQ ID NO: 5619128 - DNA, 17 bp, Homo sapiens
gccacctgtagccatct

SEQ ID NO: 5619129 - DNA, 18 bp, Homo sapiens
gccacctgtcccacctca

SEQ ID NO: 5619130 - DNA, 21 bp, Homo sapiens
gccacctgtccggcccagtgc

SEQ ID NO: 5619131 - DNA, 23 bp, Homo sapiens
gccacctgtccggcccagtgcca

SEQ ID NO: 5619132 - DNA, 13 bp, Homo sapiens
gccacctgtctgt

SEQ ID NO: 5619133 - DNA, 15 bp, Homo sapiens
gccacctgtctgtct

SEQ ID NO: 5619134 - DNA, 18 bp, Homo sapiens
gccacctgtgtgttcttt

SEQ ID NO: 5619135 - DNA, 12 bp, Homo sapiens
gccaccttccca

SEQ ID NO: 5619136 - DNA, 16 bp, Homo sapiens
gccaccttcccacccc

SEQ ID NO: 5619137 - DNA, 20 bp, Homo sapiens
gccaccttcccaccccttca

SEQ ID NO: 5619138 - DNA, 18 bp, Homo sapiens
gccaccttgcttgaggga

SEQ ID NO: 5619139 - DNA, 15 bp, Homo sapiens
gccaccttggaggag

SEQ ID NO: 5619140 - DNA, 16 bp, Homo sapiens
gccaccttggaggagg

SEQ ID NO: 5619141 - DNA, 19 bp, Homo sapiens
gccaccttgtgtgtttaaa

SEQ ID NO: 5619142 - DNA, 14 bp, Homo sapiens
gccaccttgttaca

SEQ ID NO: 5619143 - DNA, 22 bp, Homo sapiens
gccaccttgttacaaatttttt

SEQ ID NO: 5619144 - DNA, 23 bp, Homo sapiens
gccacctttgtgcagcttcgagg

SEQ ID NO: 5619145 - DNA, 21 bp, Homo sapiens
gccacgaggtggtagctctga

SEQ ID NO: 5619146 - DNA, 22 bp, Homo sapiens
gccacgaggttaaagaagctgc

SEQ ID NO: 5619147 - DNA, 15 bp, Homo sapiens
gccacgattgcagga

SEQ ID NO: 5619148 - DNA, 13 bp, Homo sapiens
gccacgattttaa

SEQ ID NO: 5619149 - DNA, 14 bp, Homo sapiens
gccacgcactgggc

SEQ ID NO: 5619150 - DNA, 20 bp, Homo sapiens
gccacgcactgggccacgga

SEQ ID NO: 5619151 - DNA, 15 bp, Homo sapiens
gccacgcagccagga

SEQ ID NO: 5619152 - DNA, 13 bp, Homo sapiens
gccacgcaggcca

SEQ ID NO: 5619153 - DNA, 14 bp, Homo sapiens
gccacgcagggcca

SEQ ID NO: 5619154 - DNA, 23 bp, Homo sapiens
gccacgcagggccatccactgtg

SEQ ID NO: 5619155 - DNA, 19 bp, Homo sapiens
gccacgcagtgcctggagt

SEQ ID NO: 5619156 - DNA, 17 bp, Homo sapiens
gccacgcccagcttcct

SEQ ID NO: 5619157 - DNA, 18 bp, Homo sapiens
gccacgccccagcccgac

SEQ ID NO: 5619158 - DNA, 13 bp, Homo sapiens
gccacgccctccc

SEQ ID NO: 5619159 - DNA, 14 bp, Homo sapiens
gccacgccctccct

SEQ ID NO: 5619160 - DNA, 18 bp, Homo sapiens
gccacgccctccctgcta

SEQ ID NO: 5619161 - DNA, 13 bp, Homo sapiens
gccacgcctctct

SEQ ID NO: 5619162 - DNA, 21 bp, Homo sapiens
gccacgcctctctcagcccag

SEQ ID NO: 5619163 - DNA, 13 bp, Homo sapiens
gccacgcctgcga

SEQ ID NO: 5619164 - DNA, 13 bp, Homo sapiens
gccacgcgctctg

SEQ ID NO: 5619165 - DNA, 18 bp, Homo sapiens
gccacgcgctctgcatgc

SEQ ID NO: 5619166 - DNA, 21 bp, Homo sapiens
gccacgcgctctgcatgctcc

SEQ ID NO: 5619167 - DNA, 21 bp, Homo sapiens
gccacgcggtacaaaggaaaa

SEQ ID NO: 5619168 - DNA, 15 bp, Homo sapiens
gccacgctcagtgcc

SEQ ID NO: 5619169 - DNA, 13 bp, Homo sapiens
gccacgctccagc

SEQ ID NO: 5619170 - DNA, 16 bp, Homo sapiens
gccacgctccagctgc

SEQ ID NO: 5619171 - DNA, 19 bp, Homo sapiens
gccacgctccctctcctgt

SEQ ID NO: 5619172 - DNA, 14 bp, Homo sapiens
gccacgctggcctt

SEQ ID NO: 5619173 - DNA, 15 bp, Homo sapiens
gccacgctgtcctct

SEQ ID NO: 5619174 - DNA, 15 bp, Homo sapiens
gccacggaaacatag

SEQ ID NO: 5619175 - DNA, 22 bp, Homo sapiens
gccacggaccgcatcctccagg

SEQ ID NO: 5619176 - DNA, 21 bp, Homo sapiens
gccacggaggagggatgctgc

SEQ ID NO: 5619177 - DNA, 14 bp, Homo sapiens
gccacggagggagg

SEQ ID NO: 5619178 - DNA, 21 bp, Homo sapiens
gccacggagggaggcaccatg

SEQ ID NO: 5619179 - DNA, 15 bp, Homo sapiens
gccacggcagccacc

SEQ ID NO: 5619180 - DNA, 18 bp, Homo sapiens
gccacggcagccaccctg

SEQ ID NO: 5619181 - DNA, 14 bp, Homo sapiens
gccacggcagccta

SEQ ID NO: 5619182 - DNA, 14 bp, Homo sapiens
gccacggccaccct

SEQ ID NO: 5619183 - DNA, 19 bp, Homo sapiens
gccacggccaggccagagg

SEQ ID NO: 5619184 - DNA, 18 bp, Homo sapiens
gccacggccatgagggct

SEQ ID NO: 5619185 - DNA, 14 bp, Homo sapiens
gccacggcccaggg

SEQ ID NO: 5619186 - DNA, 23 bp, Homo sapiens
gccacggcctggctggtgggaag

SEQ ID NO: 5619187 - DNA, 14 bp, Homo sapiens
gccacggctgagcc

SEQ ID NO: 5619188 - DNA, 15 bp, Homo sapiens
gccacggctgagcct

SEQ ID NO: 5619189 - DNA, 16 bp, Homo sapiens
gccacggctgagcctt

SEQ ID NO: 5619190 - DNA, 18 bp, Homo sapiens
gccacggggactcagccc

SEQ ID NO: 5619191 - DNA, 11 bp, Homo sapiens
gccacggggga

SEQ ID NO: 5619192 - DNA, 22 bp, Homo sapiens
gccacgggtctgtgttcgactc

SEQ ID NO: 5619193 - DNA, 16 bp, Homo sapiens
gccacgggtttccctc

SEQ ID NO: 5619194 - DNA, 20 bp, Homo sapiens
gccacgtatagtcctagctg

SEQ ID NO: 5619195 - DNA, 15 bp, Homo sapiens
gccacgtccaggtcc

SEQ ID NO: 5619196 - DNA, 23 bp, Homo sapiens
gccacgtccatagttctgaggtc

SEQ ID NO: 5619197 - DNA, 16 bp, Homo sapiens
gccacgtcccagcatc

SEQ ID NO: 5619198 - DNA, 17 bp, Homo sapiens
gccacgtcccgctgcct

SEQ ID NO: 5619199 - DNA, 20 bp, Homo sapiens
gccacgtcccgctgcctcct

SEQ ID NO: 5619200 - DNA, 14 bp, Homo sapiens
gccacgtgccaggc

SEQ ID NO: 5619201 - DNA, 17 bp, Homo sapiens
gccacgtgccaggcccg

SEQ ID NO: 5619202 - DNA, 17 bp, Homo sapiens
gccacgtgccttaggaa

SEQ ID NO: 5619203 - DNA, 19 bp, Homo sapiens
gccacgtggccgctgccca

SEQ ID NO: 5619204 - DNA, 20 bp, Homo sapiens
gccacgtgtgctgtggccag

SEQ ID NO: 5619205 - DNA, 21 bp, Homo sapiens
gccacgtgtgctgtggccagg

SEQ ID NO: 5619206 - DNA, 21 bp, Homo sapiens
gccacgtgtttagacctagat

SEQ ID NO: 5619207 - DNA, 18 bp, Homo sapiens
gccagccgctctcctgcc

SEQ ID NO: 5619208 - DNA, 22 bp, Homo sapiens
gccagccgctctcctgccacat

SEQ ID NO: 5619209 - DNA, 15 bp, Homo sapiens
gccagccgctggtgc

SEQ ID NO: 5619210 - DNA, 19 bp, Homo sapiens
gccagccgctggtgcccac

SEQ ID NO: 5619211 - DNA, 16 bp, Homo sapiens
gccagccggtgcctgg

SEQ ID NO: 5619212 - DNA, 17 bp, Homo sapiens
gccagccggtgcctggc

SEQ ID NO: 5619213 - DNA, 18 bp, Homo sapiens
gccagccgtgatgctcag

SEQ ID NO: 5619214 - DNA, 20 bp, Homo sapiens
gccagcctacactgccagcc

SEQ ID NO: 5619215 - DNA, 17 bp, Homo sapiens
gccagcctagcccttgt

SEQ ID NO: 5619216 - DNA, 16 bp, Homo sapiens
gccagcctcagaaggc

SEQ ID NO: 5619217 - DNA, 19 bp, Homo sapiens
gccagcctcagaaggcccc

SEQ ID NO: 5619218 - DNA, 23 bp, Homo sapiens
gccagcctcagaaggccccagag

SEQ ID NO: 5619219 - DNA, 14 bp, Homo sapiens
gccagcctcagtgc

SEQ ID NO: 5619220 - DNA, 19 bp, Homo sapiens
gccagcctcagtgccactt

SEQ ID NO: 5619221 - DNA, 16 bp, Homo sapiens
gccagcctccccacat

SEQ ID NO: 5619222 - DNA, 18 bp, Homo sapiens
gccagcctccgagaggga

SEQ ID NO: 5619223 - DNA, 21 bp, Homo sapiens
gccagcctccgagagggagag

SEQ ID NO: 5619224 - DNA, 14 bp, Homo sapiens
gccagcctcgccca

SEQ ID NO: 5619225 - DNA, 22 bp, Homo sapiens
gccagcctgaccttccttcctg

SEQ ID NO: 5619226 - DNA, 16 bp, Homo sapiens
gccagcctgcttccca

SEQ ID NO: 5619227 - DNA, 14 bp, Homo sapiens
gccagcctggcatc

SEQ ID NO: 5619228 - DNA, 20 bp, Homo sapiens
gccagcctggcatcagttta

SEQ ID NO: 5619229 - DNA, 22 bp, Homo sapiens
gccagcctggctctgccccctc

SEQ ID NO: 5619230 - DNA, 13 bp, Homo sapiens
gccagcctggctg

SEQ ID NO: 5619231 - DNA, 15 bp, Homo sapiens
gccagcctgggactc

SEQ ID NO: 5619232 - DNA, 21 bp, Homo sapiens
gccagcctgggactcccagtg

SEQ ID NO: 5619233 - DNA, 20 bp, Homo sapiens
gccagcctggggcctggcag

SEQ ID NO: 5619234 - DNA, 20 bp, Homo sapiens
gccagcctgtcccatggaca

SEQ ID NO: 5619235 - DNA, 12 bp, Homo sapiens
gccagccttccc

SEQ ID NO: 5619236 - DNA, 22 bp, Homo sapiens
gccagccttcctctgcagctga

SEQ ID NO: 5619237 - DNA, 19 bp, Homo sapiens
gccagccttcttccatccc

SEQ ID NO: 5619238 - DNA, 12 bp, Homo sapiens
gccagccttgac

SEQ ID NO: 5619239 - DNA, 14 bp, Homo sapiens
gccagccttgacca

SEQ ID NO: 5619240 - DNA, 22 bp, Homo sapiens
gccagccttgaccattctccac

SEQ ID NO: 5619241 - DNA, 17 bp, Homo sapiens
gccagccttgagccctg

SEQ ID NO: 5619242 - DNA, 19 bp, Homo sapiens
gccagccttgagccctggc

SEQ ID NO: 5619243 - DNA, 20 bp, Homo sapiens
gccagccttgcactgtgggg

SEQ ID NO: 5619244 - DNA, 14 bp, Homo sapiens
gccagccttggcac

SEQ ID NO: 5619245 - DNA, 12 bp, Homo sapiens
gccagcgaactt

SEQ ID NO: 5619246 - DNA, 21 bp, Homo sapiens
gccagcgaggcgaggctgcct

SEQ ID NO: 5619247 - DNA, 15 bp, Homo sapiens
gccagcgcagcgcca

SEQ ID NO: 5619248 - DNA, 20 bp, Homo sapiens
gccagcgcagcgccagggct

SEQ ID NO: 5619249 - DNA, 13 bp, Homo sapiens
gccagcgcaggcc

SEQ ID NO: 5619250 - DNA, 15 bp, Homo sapiens
gccagcgccagggcc

SEQ ID NO: 5619251 - DNA, 16 bp, Homo sapiens
gccagcgccagggccc

SEQ ID NO: 5619252 - DNA, 20 bp, Homo sapiens
gccagcgcctccctccaccc

SEQ ID NO: 5619253 - DNA, 23 bp, Homo sapiens
gccagcgcctccctccaccccag

SEQ ID NO: 5619254 - DNA, 14 bp, Homo sapiens
gccagcgcctgccc

SEQ ID NO: 5619255 - DNA, 15 bp, Homo sapiens
gccagcgcctgcccg

SEQ ID NO: 5619256 - DNA, 13 bp, Homo sapiens
gccagcgctgtgg

SEQ ID NO: 5619257 - DNA, 17 bp, Homo sapiens
gccagcggcatatactt

SEQ ID NO: 5619258 - DNA, 20 bp, Homo sapiens
gccagcggccctcccaggcg

SEQ ID NO: 5619259 - DNA, 19 bp, Homo sapiens
gccagcgggaatggcagct

SEQ ID NO: 5619260 - DNA, 13 bp, Homo sapiens
gccagcgggcaca

SEQ ID NO: 5619261 - DNA, 14 bp, Homo sapiens
gccagcggtgacca

SEQ ID NO: 5619262 - DNA, 12 bp, Homo sapiens
gccagcgtcctc

SEQ ID NO: 5619263 - DNA, 19 bp, Homo sapiens
gccagcgtcctcctctgtg

SEQ ID NO: 5619264 - DNA, 19 bp, Homo sapiens
gccagcgtcggtctgtgcc

SEQ ID NO: 5619265 - DNA, 22 bp, Homo sapiens
gccagcgtcggtctgtgcccct

SEQ ID NO: 5619266 - DNA, 16 bp, Homo sapiens
gccagcgtctgttgtg

SEQ ID NO: 5619267 - DNA, 15 bp, Homo sapiens
gccagcgtgtggagc

SEQ ID NO: 5619268 - DNA, 17 bp, Homo sapiens
gccagcgtgtggagcag

SEQ ID NO: 5619269 - DNA, 16 bp, Homo sapiens
gccagctaaggggtgg

SEQ ID NO: 5619270 - DNA, 22 bp, Homo sapiens
gccagctaaggggtggggctgc

SEQ ID NO: 5619271 - DNA, 23 bp, Homo sapiens
gccagctaataagaagtgccaag

SEQ ID NO: 5619272 - DNA, 22 bp, Homo sapiens
gccagctaatttttgtattttt

SEQ ID NO: 5619273 - DNA, 18 bp, Homo sapiens
gccagctatctgcctgac

SEQ ID NO: 5619274 - DNA, 19 bp, Homo sapiens
gccagctatctgcctgaca

SEQ ID NO: 5619275 - DNA, 23 bp, Homo sapiens
gccagctatctgcctgacaggct

SEQ ID NO: 5619276 - DNA, 22 bp, Homo sapiens
gccagctcagcagttcacttcc

SEQ ID NO: 5619277 - DNA, 13 bp, Homo sapiens
gccagctcaggaa

SEQ ID NO: 5619278 - DNA, 22 bp, Homo sapiens
gccagctccagtgccgctcctg

SEQ ID NO: 5619279 - DNA, 10 bp, Homo sapiens
gccagctccc

SEQ ID NO: 5619280 - DNA, 13 bp, Homo sapiens
gccagctcccagc

SEQ ID NO: 5619281 - DNA, 14 bp, Homo sapiens
gccagctcctctct

SEQ ID NO: 5619282 - DNA, 21 bp, Homo sapiens
gccagctcctgggcagcttga

SEQ ID NO: 5619283 - DNA, 22 bp, Homo sapiens
gccagctcctttcccttttcca

SEQ ID NO: 5619284 - DNA, 19 bp, Homo sapiens
gccagctctaggcttcagg

SEQ ID NO: 5619285 - DNA, 10 bp, Homo sapiens
gccagctctc

SEQ ID NO: 5619286 - DNA, 17 bp, Homo sapiens
gccagctctctctaccc

SEQ ID NO: 5619287 - DNA, 12 bp, Homo sapiens
gccagctctgag

SEQ ID NO: 5619288 - DNA, 13 bp, Homo sapiens
gccagctctgagg

SEQ ID NO: 5619289 - DNA, 23 bp, Homo sapiens
gccagctctgaggggaggcacct

SEQ ID NO: 5619290 - DNA, 17 bp, Homo sapiens
gccagctctgggggctc

SEQ ID NO: 5619291 - DNA, 14 bp, Homo sapiens
gccagctctgtcac

SEQ ID NO: 5619292 - DNA, 15 bp, Homo sapiens
gccagctctgtcacc

SEQ ID NO: 5619293 - DNA, 20 bp, Homo sapiens
gccagctctgtcaccctggc

SEQ ID NO: 5619294 - DNA, 12 bp, Homo sapiens
gccagctctgtt

SEQ ID NO: 5619295 - DNA, 22 bp, Homo sapiens
gccagctctgttcttcctcagc

SEQ ID NO: 5619296 - DNA, 13 bp, Homo sapiens
gccagctcttcct

SEQ ID NO: 5619297 - DNA, 17 bp, Homo sapiens
gccagctgatgactcaa

SEQ ID NO: 5619298 - DNA, 12 bp, Homo sapiens
gccagctgcagc

SEQ ID NO: 5619299 - DNA, 19 bp, Homo sapiens
gccagctgcagctgggctg

SEQ ID NO: 5619300 - DNA, 20 bp, Homo sapiens
gccagctgcagctgggctgt

SEQ ID NO: 5619301 - DNA, 18 bp, Homo sapiens
gccagctgcatctactca

SEQ ID NO: 5619302 - DNA, 22 bp, Homo sapiens
gccagctgcatctactcaggcc

SEQ ID NO: 5619303 - DNA, 20 bp, Homo sapiens
gccagctgccctatgggcct

SEQ ID NO: 5619304 - DNA, 17 bp, Homo sapiens
gccagctgcccttgcag

SEQ ID NO: 5619305 - DNA, 14 bp, Homo sapiens
gccagctgccgcac

SEQ ID NO: 5619306 - DNA, 17 bp, Homo sapiens
gccagctgccgcaccag

SEQ ID NO: 5619307 - DNA, 18 bp, Homo sapiens
gccagctgccgcaccagc

SEQ ID NO: 5619308 - DNA, 20 bp, Homo sapiens
gccagctgcctgtgcctgcc

SEQ ID NO: 5619309 - DNA, 21 bp, Homo sapiens
gccagctgcctgtgcctgcca

SEQ ID NO: 5619310 - DNA, 22 bp, Homo sapiens
gccagctgcctgtgcctgccat

SEQ ID NO: 5619311 - DNA, 12 bp, Homo sapiens
gccagctgcctt

SEQ ID NO: 5619312 - DNA, 15 bp, Homo sapiens
gccagctgccttcct

SEQ ID NO: 5619313 - DNA, 20 bp, Homo sapiens
gccagctgcggccaggcctg

SEQ ID NO: 5619314 - DNA, 13 bp, Homo sapiens
gccagctgctccc

SEQ ID NO: 5619315 - DNA, 15 bp, Homo sapiens
gccagctgctcccca

SEQ ID NO: 5619316 - DNA, 16 bp, Homo sapiens
gccagctgctccccag

SEQ ID NO: 5619317 - DNA, 22 bp, Homo sapiens
gccagctgctgagccgcagaga

SEQ ID NO: 5619318 - DNA, 11 bp, Homo sapiens
gccagctgctt

SEQ ID NO: 5619319 - DNA, 17 bp, Homo sapiens
gccagctgcttctgccc

SEQ ID NO: 5619320 - DNA, 18 bp, Homo sapiens
gccagctgcttctgccca

SEQ ID NO: 5619321 - DNA, 15 bp, Homo sapiens
gccagctgcttgggc

SEQ ID NO: 5619322 - DNA, 20 bp, Homo sapiens
gccagctgcttgggcttcat

SEQ ID NO: 5619323 - DNA, 14 bp, Homo sapiens
gccagctggaggca

SEQ ID NO: 5619324 - DNA, 17 bp, Homo sapiens
gccagctggatcgctgc

SEQ ID NO: 5619325 - DNA, 21 bp, Homo sapiens
gccagctggcccagtgggtag

SEQ ID NO: 5619326 - DNA, 16 bp, Homo sapiens
gccagctggcctttgt

SEQ ID NO: 5619327 - DNA, 16 bp, Homo sapiens
gccagctgggatctga

SEQ ID NO: 5619328 - DNA, 13 bp, Homo sapiens
gccagctggggag

SEQ ID NO: 5619329 - DNA, 14 bp, Homo sapiens
gccagctggggaga

SEQ ID NO: 5619330 - DNA, 15 bp, Homo sapiens
gccagctgggtgccc

SEQ ID NO: 5619331 - DNA, 18 bp, Homo sapiens
gccagctgggtttagccc

SEQ ID NO: 5619332 - DNA, 14 bp, Homo sapiens
gccagctggtgctg

SEQ ID NO: 5619333 - DNA, 16 bp, Homo sapiens
gccagctggtgctgca

SEQ ID NO: 5619334 - DNA, 17 bp, Homo sapiens
gccagctgtactgagtt

SEQ ID NO: 5619335 - DNA, 14 bp, Homo sapiens
gccagctgtgcact

SEQ ID NO: 5619336 - DNA, 15 bp, Homo sapiens
gccagctgtttccag

SEQ ID NO: 5619337 - DNA, 18 bp, Homo sapiens
gccagcttcccctcactt

SEQ ID NO: 5619338 - DNA, 19 bp, Homo sapiens
gccagcttcctgtgcagaa

SEQ ID NO: 5619339 - DNA, 21 bp, Homo sapiens
gccagcttcgtgctggaggaa

SEQ ID NO: 5619340 - DNA, 16 bp, Homo sapiens
gccagcttctctctcc

SEQ ID NO: 5619341 - DNA, 18 bp, Homo sapiens
gccagcttctctctccag

SEQ ID NO: 5619342 - DNA, 19 bp, Homo sapiens
gccagcttctctctccagg

SEQ ID NO: 5619343 - DNA, 21 bp, Homo sapiens
gccagcttctctctccagggt

SEQ ID NO: 5619344 - DNA, 18 bp, Homo sapiens
gccagcttctttgcagct

SEQ ID NO: 5619345 - DNA, 11 bp, Homo sapiens
gccagcttggc

SEQ ID NO: 5619346 - DNA, 16 bp, Homo sapiens
gccagcttgtttacat

SEQ ID NO: 5619347 - DNA, 14 bp, Homo sapiens
gccagcttttcaaa

SEQ ID NO: 5619348 - DNA, 17 bp, Homo sapiens
gccaggaaaagccctca

SEQ ID NO: 5619349 - DNA, 18 bp, Homo sapiens
gccaggaaacaagggaag

SEQ ID NO: 5619350 - DNA, 22 bp, Homo sapiens
gccaggaaaccctcttcttccc

SEQ ID NO: 5619351 - DNA, 15 bp, Homo sapiens
gccaggaacagggac

SEQ ID NO: 5619352 - DNA, 16 bp, Homo sapiens
gccaggaacagggacc

SEQ ID NO: 5619353 - DNA, 23 bp, Homo sapiens
gccaggaacagggaccagctccc

SEQ ID NO: 5619354 - DNA, 16 bp, Homo sapiens
gccaggaactggctcc

SEQ ID NO: 5619355 - DNA, 18 bp, Homo sapiens
gccaggaactggctcctt

SEQ ID NO: 5619356 - DNA, 13 bp, Homo sapiens
gccaggaagcacg

SEQ ID NO: 5619357 - DNA, 17 bp, Homo sapiens
gccaggaagccagagcc

SEQ ID NO: 5619358 - DNA, 20 bp, Homo sapiens
gccaggaagccagagcccca

SEQ ID NO: 5619359 - DNA, 14 bp, Homo sapiens
gccaggaagccagc

SEQ ID NO: 5619360 - DNA, 15 bp, Homo sapiens
gccaggaaggacaga

SEQ ID NO: 5619361 - DNA, 21 bp, Homo sapiens
gccaggaaggacagactggcc

SEQ ID NO: 5619362 - DNA, 13 bp, Homo sapiens
gccaggaagggga

SEQ ID NO: 5619363 - DNA, 14 bp, Homo sapiens
gccaggaaggggac

SEQ ID NO: 5619364 - DNA, 20 bp, Homo sapiens
gccaggaaggggacaggatt

SEQ ID NO: 5619365 - DNA, 21 bp, Homo sapiens
gccaggaaggggacaggattg

SEQ ID NO: 5619366 - DNA, 18 bp, Homo sapiens
gccaggaagtagcacagg

SEQ ID NO: 5619367 - DNA, 15 bp, Homo sapiens
gccaggaatctgcca

SEQ ID NO: 5619368 - DNA, 23 bp, Homo sapiens
gccaggaatgtttcagctgcagt

SEQ ID NO: 5619369 - DNA, 18 bp, Homo sapiens
gccaggaatttcccagga

SEQ ID NO: 5619370 - DNA, 21 bp, Homo sapiens
gccaggaatttcccaggaccc

SEQ ID NO: 5619371 - DNA, 23 bp, Homo sapiens
gccaggaatttcccaggaccctg

SEQ ID NO: 5619372 - DNA, 11 bp, Homo sapiens
gccaggacacc

SEQ ID NO: 5619373 - DNA, 18 bp, Homo sapiens
gccaggacaccagtccag

SEQ ID NO: 5619374 - DNA, 20 bp, Homo sapiens
gccaggacaccgggcagggc

SEQ ID NO: 5619375 - DNA, 13 bp, Homo sapiens
gccaggacacctg

SEQ ID NO: 5619376 - DNA, 15 bp, Homo sapiens
gccaggacacctgcc

SEQ ID NO: 5619377 - DNA, 16 bp, Homo sapiens
gccaggacacctgccc

SEQ ID NO: 5619378 - DNA, 18 bp, Homo sapiens
gccaggacacctgcccca

SEQ ID NO: 5619379 - DNA, 20 bp, Homo sapiens
gccaggacacctgccccagc

SEQ ID NO: 5619380 - DNA, 14 bp, Homo sapiens
gccaggacagcagc

SEQ ID NO: 5619381 - DNA, 19 bp, Homo sapiens
gccaggacagcagcactcc

SEQ ID NO: 5619382 - DNA, 23 bp, Homo sapiens
gccaggacagcagcactcccgct

SEQ ID NO: 5619383 - DNA, 17 bp, Homo sapiens
gccaggacagctggctg

SEQ ID NO: 5619384 - DNA, 22 bp, Homo sapiens
gccaggacagctggctgctgac

SEQ ID NO: 5619385 - DNA, 23 bp, Homo sapiens
gccatatatgaccagaagccttg

SEQ ID NO: 5619386 - DNA, 18 bp, Homo sapiens
gccatatggacactgtga

SEQ ID NO: 5619387 - DNA, 23 bp, Homo sapiens
gccatatgtaccctaccctgcac

SEQ ID NO: 5619388 - DNA, 14 bp, Homo sapiens
gccatattaaattt

SEQ ID NO: 5619389 - DNA, 14 bp, Homo sapiens
gccatattccagca

SEQ ID NO: 5619390 - DNA, 14 bp, Homo sapiens
gccatattccgcac

SEQ ID NO: 5619391 - DNA, 18 bp, Homo sapiens
gccatattctaaattcac

SEQ ID NO: 5619392 - DNA, 19 bp, Homo sapiens
gccatattctaaattcact

SEQ ID NO: 5619393 - DNA, 20 bp, Homo sapiens
gccatattctggttcttgaa

SEQ ID NO: 5619394 - DNA, 22 bp, Homo sapiens
gccatattgcacatgtcttaat

SEQ ID NO: 5619395 - DNA, 16 bp, Homo sapiens
gccatatttacctcag

SEQ ID NO: 5619396 - DNA, 15 bp, Homo sapiens
gccatatttatagaa

SEQ ID NO: 5619397 - DNA, 20 bp, Homo sapiens
gccatatttgtaaaatgaca

SEQ ID NO: 5619398 - DNA, 17 bp, Homo sapiens
gccatattttcaccatt

SEQ ID NO: 5619399 - DNA, 14 bp, Homo sapiens
gccatcaaaatgct

SEQ ID NO: 5619400 - DNA, 16 bp, Homo sapiens
gccatcaaaatgcttt

SEQ ID NO: 5619401 - DNA, 21 bp, Homo sapiens
gccatcaagcactcctacctt

SEQ ID NO: 5619402 - DNA, 15 bp, Homo sapiens
gccatcaagcacttc

SEQ ID NO: 5619403 - DNA, 18 bp, Homo sapiens
gccatcacaggatgccag

SEQ ID NO: 5619404 - DNA, 22 bp, Homo sapiens
gccatcacaggatgccagcccc

SEQ ID NO: 5619405 - DNA, 16 bp, Homo sapiens
gccatcaccctcaccc

SEQ ID NO: 5619406 - DNA, 17 bp, Homo sapiens
gccatcaccctcaccca

SEQ ID NO: 5619407 - DNA, 15 bp, Homo sapiens
gccatcaccgctggg

SEQ ID NO: 5619408 - DNA, 15 bp, Homo sapiens
gccatcacctcagat

SEQ ID NO: 5619409 - DNA, 23 bp, Homo sapiens
gccatcacctcagatggcagctt

SEQ ID NO: 5619410 - DNA, 14 bp, Homo sapiens
gccatcaccttaga

SEQ ID NO: 5619411 - DNA, 19 bp, Homo sapiens
gccatcactagaagaaaag

SEQ ID NO: 5619412 - DNA, 22 bp, Homo sapiens
gccatcactcagcccctacccc

SEQ ID NO: 5619413 - DNA, 16 bp, Homo sapiens
gccatcactggtccag

SEQ ID NO: 5619414 - DNA, 17 bp, Homo sapiens
gccatcacttctccccg

SEQ ID NO: 5619415 - DNA, 13 bp, Homo sapiens
gccatcagccatg

SEQ ID NO: 5619416 - DNA, 18 bp, Homo sapiens
gccatcagccatggccct

SEQ ID NO: 5619417 - DNA, 14 bp, Homo sapiens
gccatcagcccctg

SEQ ID NO: 5619418 - DNA, 17 bp, Homo sapiens
gccatcaggactttccc

SEQ ID NO: 5619419 - DNA, 13 bp, Homo sapiens
gccatcagggccc

SEQ ID NO: 5619420 - DNA, 15 bp, Homo sapiens
gccatcagggccctg

SEQ ID NO: 5619421 - DNA, 17 bp, Homo sapiens
gccatcagggccctgcc

SEQ ID NO: 5619422 - DNA, 22 bp, Homo sapiens
gccatcagggccctgccccagg

SEQ ID NO: 5619423 - DNA, 22 bp, Homo sapiens
gccatcagggtgggccactctc

SEQ ID NO: 5619424 - DNA, 21 bp, Homo sapiens
gccatcatcagcttaatttaa

SEQ ID NO: 5619425 - DNA, 17 bp, Homo sapiens
gccatcatgccttgata

SEQ ID NO: 5619426 - DNA, 21 bp, Homo sapiens
gccatcattgatgatcactgt

SEQ ID NO: 5619427 - DNA, 18 bp, Homo sapiens
gccatcatttttgatgac

SEQ ID NO: 5619428 - DNA, 22 bp, Homo sapiens
gccatccaaagaaacactaagc

SEQ ID NO: 5619429 - DNA, 12 bp, Homo sapiens
gccatccacacc

SEQ ID NO: 5619430 - DNA, 18 bp, Homo sapiens
gccatccacattttaaca

SEQ ID NO: 5619431 - DNA, 19 bp, Homo sapiens
gccatccacattttaacag

SEQ ID NO: 5619432 - DNA, 16 bp, Homo sapiens
gccatccagggtctgg

SEQ ID NO: 5619433 - DNA, 19 bp, Homo sapiens
gccatccaggttcagcttg

SEQ ID NO: 5619434 - DNA, 14 bp, Homo sapiens
gccatcccagcccc

SEQ ID NO: 5619435 - DNA, 17 bp, Homo sapiens
gccatcccagccccaat

SEQ ID NO: 5619436 - DNA, 15 bp, Homo sapiens
gccatccccctctca

SEQ ID NO: 5619437 - DNA, 18 bp, Homo sapiens
gccatcccgcttagcctg

SEQ ID NO: 5619438 - DNA, 21 bp, Homo sapiens
gccatcccgcttagcctgcct

SEQ ID NO: 5619439 - DNA, 22 bp, Homo sapiens
gccatcccgcttagcctgcctc

SEQ ID NO: 5619440 - DNA, 11 bp, Homo sapiens
gccatccctcc

SEQ ID NO: 5619441 - DNA, 15 bp, Homo sapiens
gccatccctccctcc

SEQ ID NO: 5619442 - DNA, 16 bp, Homo sapiens
gccatccctccctcca

SEQ ID NO: 5619443 - DNA, 23 bp, Homo sapiens
gccatccctccctccacctccct

SEQ ID NO: 5619444 - DNA, 23 bp, Homo sapiens
gccatccctgagagaccagaccg

SEQ ID NO: 5619445 - DNA, 14 bp, Homo sapiens
gccatccctgggcc

SEQ ID NO: 5619446 - DNA, 19 bp, Homo sapiens
gccatccctgggcccctcc

SEQ ID NO: 5619447 - DNA, 21 bp, Homo sapiens
gccatccctgggcccctccac

SEQ ID NO: 5619448 - DNA, 14 bp, Homo sapiens
gccatccctgtgag

SEQ ID NO: 5619449 - DNA, 13 bp, Homo sapiens
gccatcccttggg

SEQ ID NO: 5619450 - DNA, 17 bp, Homo sapiens
gccatcccttggggaag

SEQ ID NO: 5619451 - DNA, 23 bp, Homo sapiens
gccatccctttttttacatttca

SEQ ID NO: 5619452 - DNA, 23 bp, Homo sapiens
gccatccgcagactgcttggcca

SEQ ID NO: 5619453 - DNA, 15 bp, Homo sapiens
gccatccgggacgct

SEQ ID NO: 5619454 - DNA, 16 bp, Homo sapiens
gccatccgggacgctt

SEQ ID NO: 5619455 - DNA, 23 bp, Homo sapiens
gccatccgggacgcttccagacc

SEQ ID NO: 5619456 - DNA, 23 bp, Homo sapiens
gccatccggtcccctgcctggaa

SEQ ID NO: 5619457 - DNA, 15 bp, Homo sapiens
gccatcctacccagc

SEQ ID NO: 5619458 - DNA, 21 bp, Homo sapiens
gccatcctcaaacactgcagg

SEQ ID NO: 5619459 - DNA, 13 bp, Homo sapiens
gccatcctccctg

SEQ ID NO: 5619460 - DNA, 13 bp, Homo sapiens
gccatcctctgcc

SEQ ID NO: 5619461 - DNA, 19 bp, Homo sapiens
gccatcctctttctctttt

SEQ ID NO: 5619462 - DNA, 12 bp, Homo sapiens
gccatcctgtcc

SEQ ID NO: 5619463 - DNA, 12 bp, Homo sapiens
gccatccttcac

SEQ ID NO: 5619464 - DNA, 17 bp, Homo sapiens
gccatcggaagagaggg

SEQ ID NO: 5619465 - DNA, 20 bp, Homo sapiens
gccatcggaagagagggctg

SEQ ID NO: 5619466 - DNA, 21 bp, Homo sapiens
gccatcggaagagagggctga

SEQ ID NO: 5619467 - DNA, 14 bp, Homo sapiens
gccatcggacagga

SEQ ID NO: 5619468 - DNA, 13 bp, Homo sapiens
gccatcgtcctgg

SEQ ID NO: 5619469 - DNA, 15 bp, Homo sapiens
gccatcgtcctggga

SEQ ID NO: 5619470 - DNA, 16 bp, Homo sapiens
gccatcgtcctgggac

SEQ ID NO: 5619471 - DNA, 21 bp, Homo sapiens
gccatctcaattgtgctttgt

SEQ ID NO: 5619472 - DNA, 19 bp, Homo sapiens
gccatctcagattctgtct

SEQ ID NO: 5619473 - DNA, 17 bp, Homo sapiens
gccatctcagcttgctg

SEQ ID NO: 5619474 - DNA, 13 bp, Homo sapiens
gccatctcaggag

SEQ ID NO: 5619475 - DNA, 12 bp, Homo sapiens
gccatctcaggt

SEQ ID NO: 5619476 - DNA, 20 bp, Homo sapiens
gccatctccaccctgagcct

SEQ ID NO: 5619477 - DNA, 13 bp, Homo sapiens
gccatctctgctc

SEQ ID NO: 5619478 - DNA, 16 bp, Homo sapiens
gccatctctggatgcc

SEQ ID NO: 5619479 - DNA, 19 bp, Homo sapiens
gccatctctggatgcctga

SEQ ID NO: 5619480 - DNA, 17 bp, Homo sapiens
gccatctgacagcaggc

SEQ ID NO: 5619481 - DNA, 20 bp, Homo sapiens
gccatctgacagcaggccac

SEQ ID NO: 5619482 - DNA, 23 bp, Homo sapiens
gccatctgactgccaagccagat

SEQ ID NO: 5619483 - DNA, 14 bp, Homo sapiens
gccatctgcccagg

SEQ ID NO: 5619484 - DNA, 15 bp, Homo sapiens
gccatctgcccaggg

SEQ ID NO: 5619485 - DNA, 16 bp, Homo sapiens
gccatctgcgcagggt

SEQ ID NO: 5619486 - DNA, 17 bp, Homo sapiens
gccatctgcgcagggtg

SEQ ID NO: 5619487 - DNA, 21 bp, Homo sapiens
gccatctgcgtgacaataaaa

SEQ ID NO: 5619488 - DNA, 20 bp, Homo sapiens
gccatctggaaatccagctg

SEQ ID NO: 5619489 - DNA, 22 bp, Homo sapiens
gccatctggaaatccagctggt

SEQ ID NO: 5619490 - DNA, 20 bp, Homo sapiens
gccatctggagagcccagag

SEQ ID NO: 5619491 - DNA, 21 bp, Homo sapiens
gccatctgggctcctccaggg

SEQ ID NO: 5619492 - DNA, 13 bp, Homo sapiens
gccatctgtaaat

SEQ ID NO: 5619493 - DNA, 20 bp, Homo sapiens
gccatctgtaaatatcccag

SEQ ID NO: 5619494 - DNA, 22 bp, Homo sapiens
gccatctgtaaatatcccagag

SEQ ID NO: 5619495 - DNA, 23 bp, Homo sapiens
gccatctgtgcacactaagaaat

SEQ ID NO: 5619496 - DNA, 12 bp, Homo sapiens
gccatctgtggg

SEQ ID NO: 5619497 - DNA, 16 bp, Homo sapiens
gccatctgttttcaac

SEQ ID NO: 5619498 - DNA, 13 bp, Homo sapiens
gccatcttccata

SEQ ID NO: 5619499 - DNA, 20 bp, Homo sapiens
gccatcttccatatccgggt

SEQ ID NO: 5619500 - DNA, 23 bp, Homo sapiens
gccatcttccatatccgggtgct

SEQ ID NO: 5619501 - DNA, 19 bp, Homo sapiens
gccatcttctccccgaggc

SEQ ID NO: 5619502 - DNA, 17 bp, Homo sapiens
gccatcttcttccctta

SEQ ID NO: 5619503 - DNA, 15 bp, Homo sapiens
gccatcttctttctt

SEQ ID NO: 5619504 - DNA, 16 bp, Homo sapiens
gccatcttgaagtgat

SEQ ID NO: 5619505 - DNA, 16 bp, Homo sapiens
gccatcttggtaaatt

SEQ ID NO: 5619506 - DNA, 23 bp, Homo sapiens
gccatctttggcaaaggtccctg

SEQ ID NO: 5619507 - DNA, 18 bp, Homo sapiens
gccatctttttatgcaaa

SEQ ID NO: 5619508 - DNA, 16 bp, Homo sapiens
gccatgaaccaaatgg

SEQ ID NO: 5619509 - DNA, 16 bp, Homo sapiens
gccatgaactggaggc

SEQ ID NO: 5619510 - DNA, 12 bp, Homo sapiens
gccatgaactgt

SEQ ID NO: 5619511 - DNA, 20 bp, Homo sapiens
gccatgaatctctgcctctc

SEQ ID NO: 5619512 - DNA, 15 bp, Homo sapiens
gccatgacagaggct

SEQ ID NO: 5619513 - DNA, 16 bp, Homo sapiens
gccatgacagaggctg

SEQ ID NO: 5619514 - DNA, 17 bp, Homo sapiens
gccatgaccctgcctct

SEQ ID NO: 5619515 - DNA, 23 bp, Homo sapiens
gccatgactagggtcctcaggca

SEQ ID NO: 5619516 - DNA, 21 bp, Homo sapiens
gccatgagactgatccctggc

SEQ ID NO: 5619517 - DNA, 15 bp, Homo sapiens
gccatgagctccaga

SEQ ID NO: 5619518 - DNA, 18 bp, Homo sapiens
gccatgagctccagaccc

SEQ ID NO: 5619519 - DNA, 18 bp, Homo sapiens
gccatgaggaacaaggca

SEQ ID NO: 5619520 - DNA, 14 bp, Homo sapiens
gccatgaggaggca

SEQ ID NO: 5619521 - DNA, 19 bp, Homo sapiens
gccatgaggaggcagagag

SEQ ID NO: 5619522 - DNA, 20 bp, Homo sapiens
gccatgaggcctcagtggac

SEQ ID NO: 5619523 - DNA, 14 bp, Homo sapiens
gccatgagggacag

SEQ ID NO: 5619524 - DNA, 19 bp, Homo sapiens
gccatgagggacagggtct

SEQ ID NO: 5619525 - DNA, 14 bp, Homo sapiens
gccatgagggctgg

SEQ ID NO: 5619526 - DNA, 20 bp, Homo sapiens
gccatgagggtccaccttca

SEQ ID NO: 5619527 - DNA, 21 bp, Homo sapiens
gccatgagtattagcttaccc

SEQ ID NO: 5619528 - DNA, 15 bp, Homo sapiens
gccatgatctgcagg

SEQ ID NO: 5619529 - DNA, 13 bp, Homo sapiens
gccatgatgcctc

SEQ ID NO: 5619530 - DNA, 19 bp, Homo sapiens
gccatgatgcctctgtctt

SEQ ID NO: 5619531 - DNA, 15 bp, Homo sapiens
gccatgatggcaaca

SEQ ID NO: 5619532 - DNA, 19 bp, Homo sapiens
gccatgatggcaacagatc

SEQ ID NO: 5619533 - DNA, 23 bp, Homo sapiens
gccatgatggcaacagatctgga

SEQ ID NO: 5619534 - DNA, 22 bp, Homo sapiens
gccatgatggtgctgacctctg

SEQ ID NO: 5619535 - DNA, 17 bp, Homo sapiens
gccatgatgtggagtgg

SEQ ID NO: 5619536 - DNA, 19 bp, Homo sapiens
gccatgatttcccactgca

SEQ ID NO: 5619537 - DNA, 21 bp, Homo sapiens
gccatgatttgtcccagcctg

SEQ ID NO: 5619538 - DNA, 21 bp, Homo sapiens
gccatgattttggccactttg

SEQ ID NO: 5619539 - DNA, 22 bp, Homo sapiens
gccatgatttttggtatttatg

SEQ ID NO: 5619540 - DNA, 18 bp, Homo sapiens
gccatgcaactccatgcc

SEQ ID NO: 5619541 - DNA, 22 bp, Homo sapiens
gccatgcagacctcatgcccag

SEQ ID NO: 5619542 - DNA, 23 bp, Homo sapiens
gccatgcagacctcatgcccagc

SEQ ID NO: 5619543 - DNA, 20 bp, Homo sapiens
gccatgcaggaagaggccca

SEQ ID NO: 5619544 - DNA, 12 bp, Homo sapiens
gccatgcatgat

SEQ ID NO: 5619545 - DNA, 16 bp, Homo sapiens
gccatgcatgatgggt

SEQ ID NO: 5619546 - DNA, 19 bp, Homo sapiens
gccatgccagcttatctca

SEQ ID NO: 5619547 - DNA, 15 bp, Homo sapiens
gccatgccaggaacc

SEQ ID NO: 5619548 - DNA, 15 bp, Homo sapiens
gccatgcccaccatc

SEQ ID NO: 5619549 - DNA, 21 bp, Homo sapiens
gccatgcccaccgcccctgga

SEQ ID NO: 5619550 - DNA, 22 bp, Homo sapiens
gccatgccctagaccctcccca

SEQ ID NO: 5619551 - DNA, 14 bp, Homo sapiens
gccatgcctcagcc

SEQ ID NO: 5619552 - DNA, 13 bp, Homo sapiens
gccatgcctcatg

SEQ ID NO: 5619553 - DNA, 16 bp, Homo sapiens
gccatgcctcatgcca

SEQ ID NO: 5619554 - DNA, 15 bp, Homo sapiens
gccatgcctcctcag

SEQ ID NO: 5619555 - DNA, 14 bp, Homo sapiens
gccatgcctgctcc

SEQ ID NO: 5619556 - DNA, 15 bp, Homo sapiens
gccatgcgaggggcc

SEQ ID NO: 5619557 - DNA, 22 bp, Homo sapiens
gccatgcgaggggccagcagag

SEQ ID NO: 5619558 - DNA, 23 bp, Homo sapiens
gccatgcgaggggccagcagagg

SEQ ID NO: 5619559 - DNA, 20 bp, Homo sapiens
gccatgcgccccctccgccc

SEQ ID NO: 5619560 - DNA, 22 bp, Homo sapiens
gccatgctcaacccccctccca

SEQ ID NO: 5619561 - DNA, 17 bp, Homo sapiens
gcccacaccatctggcc

SEQ ID NO: 5619562 - DNA, 21 bp, Homo sapiens
gcccacaccatctggcccagg

SEQ ID NO: 5619563 - DNA, 21 bp, Homo sapiens
gcccacacccgacaccagccc

SEQ ID NO: 5619564 - DNA, 15 bp, Homo sapiens
gcccacaccctcggg

SEQ ID NO: 5619565 - DNA, 13 bp, Homo sapiens
gcccacacctcct

SEQ ID NO: 5619566 - DNA, 14 bp, Homo sapiens
gcccacacctcctg

SEQ ID NO: 5619567 - DNA, 15 bp, Homo sapiens
gcccacacctcctgg

SEQ ID NO: 5619568 - DNA, 21 bp, Homo sapiens
gcccacacctccttccctctc

SEQ ID NO: 5619569 - DNA, 17 bp, Homo sapiens
gcccacacctgcctctg

SEQ ID NO: 5619570 - DNA, 13 bp, Homo sapiens
gcccacacctggt

SEQ ID NO: 5619571 - DNA, 18 bp, Homo sapiens
gcccacagagatgcatgc

SEQ ID NO: 5619572 - DNA, 13 bp, Homo sapiens
gcccacagagcct

SEQ ID NO: 5619573 - DNA, 15 bp, Homo sapiens
gcccacagaggacag

SEQ ID NO: 5619574 - DNA, 20 bp, Homo sapiens
gcccacagatgatgaagaaa

SEQ ID NO: 5619575 - DNA, 22 bp, Homo sapiens
gcccacagcacagctccctgcc

SEQ ID NO: 5619576 - DNA, 14 bp, Homo sapiens
gcccacagcaggcc

SEQ ID NO: 5619577 - DNA, 19 bp, Homo sapiens
gcccacagcccccacccca

SEQ ID NO: 5619578 - DNA, 14 bp, Homo sapiens
gcccacagcccgca

SEQ ID NO: 5619579 - DNA, 15 bp, Homo sapiens
gcccacagcgagcct

SEQ ID NO: 5619580 - DNA, 17 bp, Homo sapiens
gcccacagcgagcctgt

SEQ ID NO: 5619581 - DNA, 22 bp, Homo sapiens
gcccacagcgagcctgtgcctt

SEQ ID NO: 5619582 - DNA, 13 bp, Homo sapiens
gcccacagctccc

SEQ ID NO: 5619583 - DNA, 18 bp, Homo sapiens
gcccacagctctgctgga

SEQ ID NO: 5619584 - DNA, 16 bp, Homo sapiens
gcccacagctgtatga

SEQ ID NO: 5619585 - DNA, 18 bp, Homo sapiens
gcccacaggaagctcagc

SEQ ID NO: 5619586 - DNA, 20 bp, Homo sapiens
gcccacaggaagctcagcct

SEQ ID NO: 5619587 - DNA, 18 bp, Homo sapiens
gcccacaggatcagtctg

SEQ ID NO: 5619588 - DNA, 19 bp, Homo sapiens
gcccacagggaaccctgct

SEQ ID NO: 5619589 - DNA, 17 bp, Homo sapiens
gcccacaggtgtcccca

SEQ ID NO: 5619590 - DNA, 18 bp, Homo sapiens
gcccacaggtgtccccag

SEQ ID NO: 5619591 - DNA, 15 bp, Homo sapiens
gcccacagtatattt

SEQ ID NO: 5619592 - DNA, 12 bp, Homo sapiens
gcccacagtctg

SEQ ID NO: 5619593 - DNA, 14 bp, Homo sapiens
gcccacagtctttc

SEQ ID NO: 5619594 - DNA, 14 bp, Homo sapiens
gcccacagtgcctg

SEQ ID NO: 5619595 - DNA, 15 bp, Homo sapiens
gcccacagtgctcag

SEQ ID NO: 5619596 - DNA, 16 bp, Homo sapiens
gcccacagtgctcagt

SEQ ID NO: 5619597 - DNA, 14 bp, Homo sapiens
gcccacatattcta

SEQ ID NO: 5619598 - DNA, 16 bp, Homo sapiens
gcccacatattctatt

SEQ ID NO: 5619599 - DNA, 15 bp, Homo sapiens
gcccacatccagtgg

SEQ ID NO: 5619600 - DNA, 17 bp, Homo sapiens
gcccacatccattccag

SEQ ID NO: 5619601 - DNA, 20 bp, Homo sapiens
gcccacatcgggctcacctt

SEQ ID NO: 5619602 - DNA, 22 bp, Homo sapiens
gcccacatgtgtccatcccagc

SEQ ID NO: 5619603 - DNA, 21 bp, Homo sapiens
gcccacattgcccacacctgc

SEQ ID NO: 5619604 - DNA, 17 bp, Homo sapiens
gcccacatttgggctca

SEQ ID NO: 5619605 - DNA, 21 bp, Homo sapiens
gcccacatttgggctcagggt

SEQ ID NO: 5619606 - DNA, 18 bp, Homo sapiens
gcccaccaaaggtcaatg

SEQ ID NO: 5619607 - DNA, 23 bp, Homo sapiens
gcccaccaccaagccctgcaaat

SEQ ID NO: 5619608 - DNA, 13 bp, Homo sapiens
gcccaccagagct

SEQ ID NO: 5619609 - DNA, 14 bp, Homo sapiens
gcccaccagagctg

SEQ ID NO: 5619610 - DNA, 21 bp, Homo sapiens
gcccaccagccacctcatccc

SEQ ID NO: 5619611 - DNA, 23 bp, Homo sapiens
gcccaccagccagccctggccca

SEQ ID NO: 5619612 - DNA, 15 bp, Homo sapiens
gcccaccagccttgc

SEQ ID NO: 5619613 - DNA, 16 bp, Homo sapiens
gcccaccagctggctc

SEQ ID NO: 5619614 - DNA, 22 bp, Homo sapiens
gcccaccagctggctctgcagc

SEQ ID NO: 5619615 - DNA, 24 bp, Homo sapiens
gcccaccagctggctctgcagcac

SEQ ID NO: 5619616 - DNA, 22 bp, Homo sapiens
gcccaccaggagcacctggacc

SEQ ID NO: 5619617 - DNA, 16 bp, Homo sapiens
gcccaccagggactgc

SEQ ID NO: 5619618 - DNA, 12 bp, Homo sapiens
gcccaccaggtg

SEQ ID NO: 5619619 - DNA, 13 bp, Homo sapiens
gcccaccaggtgt

SEQ ID NO: 5619620 - DNA, 14 bp, Homo sapiens
gcccaccaggtgtc

SEQ ID NO: 5619621 - DNA, 14 bp, Homo sapiens
gcccaccagtgact

SEQ ID NO: 5619622 - DNA, 16 bp, Homo sapiens
gcccaccatcaccacc

SEQ ID NO: 5619623 - DNA, 13 bp, Homo sapiens
gcccaccattccc

SEQ ID NO: 5619624 - DNA, 21 bp, Homo sapiens
gcccaccatttggcatccctg

SEQ ID NO: 5619625 - DNA, 12 bp, Homo sapiens
gcccacccacat

SEQ ID NO: 5619626 - DNA, 15 bp, Homo sapiens
gcccacccagcagcg

SEQ ID NO: 5619627 - DNA, 18 bp, Homo sapiens
gcccacccagcagcgccc

SEQ ID NO: 5619628 - DNA, 14 bp, Homo sapiens
gcccacccagctgg

SEQ ID NO: 5619629 - DNA, 16 bp, Homo sapiens
gcccacccagggcccg

SEQ ID NO: 5619630 - DNA, 19 bp, Homo sapiens
gcccacccagggcccggca

SEQ ID NO: 5619631 - DNA, 15 bp, Homo sapiens
gcccacccaggtccc

SEQ ID NO: 5619632 - DNA, 19 bp, Homo sapiens
gcccacccagtccatgctc

SEQ ID NO: 5619633 - DNA, 16 bp, Homo sapiens
gcccaccccacccact

SEQ ID NO: 5619634 - DNA, 21 bp, Homo sapiens
gcccaccccagcctcgcctgt

SEQ ID NO: 5619635 - DNA, 15 bp, Homo sapiens
gcccaccccatccct

SEQ ID NO: 5619636 - DNA, 21 bp, Homo sapiens
gcccaccccatccctggctga

SEQ ID NO: 5619637 - DNA, 21 bp, Homo sapiens
gcccacccccaccatgcagcc

SEQ ID NO: 5619638 - DNA, 17 bp, Homo sapiens
gcccacccccctcccca

SEQ ID NO: 5619639 - DNA, 21 bp, Homo sapiens
gcccacccccgggatcctgcc

SEQ ID NO: 5619640 - DNA, 16 bp, Homo sapiens
gcccaccccctgctgg

SEQ ID NO: 5619641 - DNA, 19 bp, Homo sapiens
gcccaccccctgctggtgc

SEQ ID NO: 5619642 - DNA, 21 bp, Homo sapiens
gcccaccccctttgactctgg

SEQ ID NO: 5619643 - DNA, 16 bp, Homo sapiens
gcccaccccgcctctg

SEQ ID NO: 5619644 - DNA, 18 bp, Homo sapiens
gcccaccccgcctctggg

SEQ ID NO: 5619645 - DNA, 21 bp, Homo sapiens
gcccaccccgcctgccctccc

SEQ ID NO: 5619646 - DNA, 13 bp, Homo sapiens
gcccaccccgctc

SEQ ID NO: 5619647 - DNA, 17 bp, Homo sapiens
gcccaccccgctctgca

SEQ ID NO: 5619648 - DNA, 17 bp, Homo sapiens
gcccaccccgctgcctg

SEQ ID NO: 5619649 - DNA, 21 bp, Homo sapiens
gcccaccccgctgcctggcgg

SEQ ID NO: 5619650 - DNA, 15 bp, Homo sapiens
gcccacccctcaaca

SEQ ID NO: 5619651 - DNA, 15 bp, Homo sapiens
gcccacccctgctgc

SEQ ID NO: 5619652 - DNA, 17 bp, Homo sapiens
gcccacccctgctgccg

SEQ ID NO: 5619653 - DNA, 13 bp, Homo sapiens
gcccacccgcccc

SEQ ID NO: 5619654 - DNA, 15 bp, Homo sapiens
gcccacccgccccag

SEQ ID NO: 5619655 - DNA, 13 bp, Homo sapiens
gcccacccgcccg

SEQ ID NO: 5619656 - DNA, 19 bp, Homo sapiens
gcccacccgtggagatggg

SEQ ID NO: 5619657 - DNA, 23 bp, Homo sapiens
gcccacccgtgttctcctccaaa

SEQ ID NO: 5619658 - DNA, 16 bp, Homo sapiens
gcccaccctaccagct

SEQ ID NO: 5619659 - DNA, 18 bp, Homo sapiens
gcccaccctaccagctcc

SEQ ID NO: 5619660 - DNA, 20 bp, Homo sapiens
gcccaccctcctgtcttccc

SEQ ID NO: 5619661 - DNA, 22 bp, Homo sapiens
gcccaccctcctgtcttcccag

SEQ ID NO: 5619662 - DNA, 20 bp, Homo sapiens
gcccaccctctgcccaggga

SEQ ID NO: 5619663 - DNA, 14 bp, Homo sapiens
gcccaccctctgtg

SEQ ID NO: 5619664 - DNA, 20 bp, Homo sapiens
gcccaccctgctgctggtgc

SEQ ID NO: 5619665 - DNA, 22 bp, Homo sapiens
gcccaccctgggatgggccacc

SEQ ID NO: 5619666 - DNA, 13 bp, Homo sapiens
gcccaccctgggc

SEQ ID NO: 5619667 - DNA, 14 bp, Homo sapiens
gcccaccctgggcc

SEQ ID NO: 5619668 - DNA, 15 bp, Homo sapiens
gcccaccctgggctc

SEQ ID NO: 5619669 - DNA, 18 bp, Homo sapiens
gcccaccctgggctccac

SEQ ID NO: 5619670 - DNA, 19 bp, Homo sapiens
gcccaccctgggctccaca

SEQ ID NO: 5619671 - DNA, 21 bp, Homo sapiens
gcccaccgaggagccccagcc

SEQ ID NO: 5619672 - DNA, 22 bp, Homo sapiens
gcccaccgaggagccccagccc

SEQ ID NO: 5619673 - DNA, 18 bp, Homo sapiens
gcccaccgcatgccccct

SEQ ID NO: 5619674 - DNA, 14 bp, Homo sapiens
gcccaccgccctcc

SEQ ID NO: 5619675 - DNA, 20 bp, Homo sapiens
gcccaccgccctcctccact

SEQ ID NO: 5619676 - DNA, 23 bp, Homo sapiens
gcccaccgtgggcagtgccaccc

SEQ ID NO: 5619677 - DNA, 22 bp, Homo sapiens
gcccacctaaagggaagccctg

SEQ ID NO: 5619678 - DNA, 23 bp, Homo sapiens
gcccacctaaagggaagccctga

SEQ ID NO: 5619679 - DNA, 23 bp, Homo sapiens
gcccacctaagggctaaggcctc

SEQ ID NO: 5619680 - DNA, 13 bp, Homo sapiens
gcccacctcagcc

SEQ ID NO: 5619681 - DNA, 15 bp, Homo sapiens
gcccacctcagcctc

SEQ ID NO: 5619682 - DNA, 18 bp, Homo sapiens
gcccacctccccacgccc

SEQ ID NO: 5619683 - DNA, 16 bp, Homo sapiens
gcccacctcctccagc

SEQ ID NO: 5619684 - DNA, 17 bp, Homo sapiens
gcccacctcctccagcg

SEQ ID NO: 5619685 - DNA, 17 bp, Homo sapiens
gcccacctcgctcccct

SEQ ID NO: 5619686 - DNA, 22 bp, Homo sapiens
gcccacctcgctcccctctgga

SEQ ID NO: 5619687 - DNA, 22 bp, Homo sapiens
gcccacctcggccctccctgcg

SEQ ID NO: 5619688 - DNA, 24 bp, Homo sapiens
gcccacctcggccctccctgcgct

SEQ ID NO: 5619689 - DNA, 13 bp, Homo sapiens
gcccacctcgtcc

SEQ ID NO: 5619690 - DNA, 13 bp, Homo sapiens
gcccacctctgct

SEQ ID NO: 5619691 - DNA, 20 bp, Homo sapiens
gcccacctctgctgcccacg

SEQ ID NO: 5619692 - DNA, 9 bp, Homo sapiens
gcccacctg

SEQ ID NO: 5619693 - DNA, 19 bp, Homo sapiens
gcccacctgaaagcctgtc

SEQ ID NO: 5619694 - DNA, 20 bp, Homo sapiens
gcccacctgaaagcctgtct

SEQ ID NO: 5619695 - DNA, 21 bp, Homo sapiens
gcccacctgaaagcctgtctc

SEQ ID NO: 5619696 - DNA, 13 bp, Homo sapiens
gcccacctgcacc

SEQ ID NO: 5619697 - DNA, 14 bp, Homo sapiens
gcccacctgcaccc

SEQ ID NO: 5619698 - DNA, 22 bp, Homo sapiens
gcccacctgcatcagcctctgg

SEQ ID NO: 5619699 - DNA, 11 bp, Homo sapiens
gcccacctgcc

SEQ ID NO: 5619700 - DNA, 13 bp, Homo sapiens
gcccacctgccag

SEQ ID NO: 5619701 - DNA, 18 bp, Homo sapiens
gcccacctgccaggctgc

SEQ ID NO: 5619702 - DNA, 12 bp, Homo sapiens
gcccacctgccc

SEQ ID NO: 5619703 - DNA, 14 bp, Homo sapiens
gcccacctgcccag

SEQ ID NO: 5619704 - DNA, 15 bp, Homo sapiens
gcccacctgcccagt

SEQ ID NO: 5619705 - DNA, 14 bp, Homo sapiens
gcccacctgcccat

SEQ ID NO: 5619706 - DNA, 15 bp, Homo sapiens
gcccacctgcctggc

SEQ ID NO: 5619707 - DNA, 22 bp, Homo sapiens
gcccacctgcctggccggccag

SEQ ID NO: 5619708 - DNA, 18 bp, Homo sapiens
gcccacctgctcccaggc

SEQ ID NO: 5619709 - DNA, 13 bp, Homo sapiens
gcccacctgctgc

SEQ ID NO: 5619710 - DNA, 14 bp, Homo sapiens
gcccacctgctgcc

SEQ ID NO: 5619711 - DNA, 17 bp, Homo sapiens
gcccacctgctgcccgt

SEQ ID NO: 5619712 - DNA, 13 bp, Homo sapiens
gcccacctggcca

SEQ ID NO: 5619713 - DNA, 19 bp, Homo sapiens
gcccacctggccacctgag

SEQ ID NO: 5619714 - DNA, 17 bp, Homo sapiens
gcccacctggcctctgc

SEQ ID NO: 5619715 - DNA, 20 bp, Homo sapiens
gcccacctggcctctgcact

SEQ ID NO: 5619716 - DNA, 14 bp, Homo sapiens
gcccacctggctgc

SEQ ID NO: 5619717 - DNA, 12 bp, Homo sapiens
gcccacctgggc

SEQ ID NO: 5619718 - DNA, 15 bp, Homo sapiens
gcccacctgggctgg

SEQ ID NO: 5619719 - DNA, 16 bp, Homo sapiens
gcccacctgggctggg

SEQ ID NO: 5619720 - DNA, 22 bp, Homo sapiens
gcccacctgtcaaacaaagcca

SEQ ID NO: 5619721 - DNA, 19 bp, Homo sapiens
gcccacctgtgggccagcc

SEQ ID NO: 5619722 - DNA, 22 bp, Homo sapiens
gcccaccttggaccctggtgac

SEQ ID NO: 5619723 - DNA, 17 bp, Homo sapiens
gcccaccttggctcaag

SEQ ID NO: 5619724 - DNA, 17 bp, Homo sapiens
gcccacgatggaatgta

SEQ ID NO: 5619725 - DNA, 23 bp, Homo sapiens
gcccacgcacgacgtcagcctct

SEQ ID NO: 5619726 - DNA, 13 bp, Homo sapiens
gcccacgcagagc

SEQ ID NO: 5619727 - DNA, 18 bp, Homo sapiens
gcccacgccagctggccc

SEQ ID NO: 5619728 - DNA, 19 bp, Homo sapiens
gcccacgccagctggccca

SEQ ID NO: 5619729 - DNA, 13 bp, Homo sapiens
gcccacgccccca

SEQ ID NO: 5619730 - DNA, 19 bp, Homo sapiens
gcccacgcccctccccagc

SEQ ID NO: 5619731 - DNA, 21 bp, Homo sapiens
gcccacgcccttggagccttc

SEQ ID NO: 5619732 - DNA, 23 bp, Homo sapiens
gcccacgccggcctctgctgccc

SEQ ID NO: 5619733 - DNA, 20 bp, Homo sapiens
gcccacgcggctgctgcttc

SEQ ID NO: 5619734 - DNA, 23 bp, Homo sapiens
gcccacgcggctgctgcttctcc

SEQ ID NO: 5619735 - DNA, 17 bp, Homo sapiens
gcccacgctcaccccct

SEQ ID NO: 5619736 - DNA, 15 bp, Homo sapiens
gcccacgctggagtg

SEQ ID NO: 5619737 - DNA, 23 bp, Homo sapiens
gcccacggaggcctcgagcagag

SEQ ID NO: 5619738 - DNA, 13 bp, Homo sapiens
gcccacggccacc

SEQ ID NO: 5619739 - DNA, 21 bp, Homo sapiens
gcccataaagtctgagaaata

SEQ ID NO: 5619740 - DNA, 20 bp, Homo sapiens
gcccataaggccagaaactc

SEQ ID NO: 5619741 - DNA, 19 bp, Homo sapiens
gcccatacccctgcctggg

SEQ ID NO: 5619742 - DNA, 20 bp, Homo sapiens
gcccatacccgtgacagtgg

SEQ ID NO: 5619743 - DNA, 16 bp, Homo sapiens
gcccataccttctggt

SEQ ID NO: 5619744 - DNA, 16 bp, Homo sapiens
gcccatactcagcctg

SEQ ID NO: 5619745 - DNA, 20 bp, Homo sapiens
gcccatactcagcctgctgc

SEQ ID NO: 5619746 - DNA, 18 bp, Homo sapiens
gcccatagaaacatgaca

SEQ ID NO: 5619747 - DNA, 22 bp, Homo sapiens
gcccatagaaacatgacactga

SEQ ID NO: 5619748 - DNA, 23 bp, Homo sapiens
gcccatagaaacatgacactgac

SEQ ID NO: 5619749 - DNA, 18 bp, Homo sapiens
gcccatagctattttcct

SEQ ID NO: 5619750 - DNA, 15 bp, Homo sapiens
gcccatatccctggt

SEQ ID NO: 5619751 - DNA, 20 bp, Homo sapiens
gcccatattttacttggaaa

SEQ ID NO: 5619752 - DNA, 16 bp, Homo sapiens
gcccatcaagtgcagt

SEQ ID NO: 5619753 - DNA, 17 bp, Homo sapiens
gcccatcaagtgcagtc

SEQ ID NO: 5619754 - DNA, 17 bp, Homo sapiens
gcccatcacagggttgg

SEQ ID NO: 5619755 - DNA, 17 bp, Homo sapiens
gcccatcactcggctgt

SEQ ID NO: 5619756 - DNA, 14 bp, Homo sapiens
gcccatcaggcagt

SEQ ID NO: 5619757 - DNA, 22 bp, Homo sapiens
gcccatcaggggcaggaaccag

SEQ ID NO: 5619758 - DNA, 20 bp, Homo sapiens
gcccatcagtgacagactgg

SEQ ID NO: 5619759 - DNA, 16 bp, Homo sapiens
gcccatcatctctgcc

SEQ ID NO: 5619760 - DNA, 20 bp, Homo sapiens
gcccatcatctctgcctttg

SEQ ID NO: 5619761 - DNA, 20 bp, Homo sapiens
gcccatccaaacactgaggc

SEQ ID NO: 5619762 - DNA, 20 bp, Homo sapiens
gcccatccatagtaactgac

SEQ ID NO: 5619763 - DNA, 14 bp, Homo sapiens
gcccatcccacccc

SEQ ID NO: 5619764 - DNA, 13 bp, Homo sapiens
gcccatcccagtc

SEQ ID NO: 5619765 - DNA, 17 bp, Homo sapiens
gcccatcccagtccctc

SEQ ID NO: 5619766 - DNA, 18 bp, Homo sapiens
gcccatcccagtccctcg

SEQ ID NO: 5619767 - DNA, 21 bp, Homo sapiens
gcccatcccccacctgccagc

SEQ ID NO: 5619768 - DNA, 12 bp, Homo sapiens
gcccatcccccc

SEQ ID NO: 5619769 - DNA, 18 bp, Homo sapiens
gcccatcccccctcacca

SEQ ID NO: 5619770 - DNA, 24 bp, Homo sapiens
gcccatcccctgcctctatccctg

SEQ ID NO: 5619771 - DNA, 14 bp, Homo sapiens
gcccatccctgacc

SEQ ID NO: 5619772 - DNA, 14 bp, Homo sapiens
gcccatccctgcct

SEQ ID NO: 5619773 - DNA, 19 bp, Homo sapiens
gcccatccctgcctggtca

SEQ ID NO: 5619774 - DNA, 15 bp, Homo sapiens
gcccatcctgaccag

SEQ ID NO: 5619775 - DNA, 15 bp, Homo sapiens
gcccatcctgactga

SEQ ID NO: 5619776 - DNA, 18 bp, Homo sapiens
gcccatcctgtctgttca

SEQ ID NO: 5619777 - DNA, 19 bp, Homo sapiens
gcccatcctgtggtcactg

SEQ ID NO: 5619778 - DNA, 18 bp, Homo sapiens
gcccatcgccacaaactc

SEQ ID NO: 5619779 - DNA, 17 bp, Homo sapiens
gcccatcgtgaagaagc

SEQ ID NO: 5619780 - DNA, 19 bp, Homo sapiens
gcccatcgtgaagaagcct

SEQ ID NO: 5619781 - DNA, 22 bp, Homo sapiens
gcccatctatgtcccttgctgt

SEQ ID NO: 5619782 - DNA, 17 bp, Homo sapiens
gcccatctcagcctcct

SEQ ID NO: 5619783 - DNA, 18 bp, Homo sapiens
gcccatctcaggtgccac

SEQ ID NO: 5619784 - DNA, 14 bp, Homo sapiens
gcccatctcggagc

SEQ ID NO: 5619785 - DNA, 18 bp, Homo sapiens
gcccatctcggagcatcc

SEQ ID NO: 5619786 - DNA, 20 bp, Homo sapiens
gcccatctcggagcatcccg

SEQ ID NO: 5619787 - DNA, 23 bp, Homo sapiens
gcccatctcggagcatcccggag

SEQ ID NO: 5619788 - DNA, 16 bp, Homo sapiens
gcccatctctccctgc

SEQ ID NO: 5619789 - DNA, 18 bp, Homo sapiens
gcccatctgggaaaatac

SEQ ID NO: 5619790 - DNA, 20 bp, Homo sapiens
gcccatcttgcctccatggt

SEQ ID NO: 5619791 - DNA, 21 bp, Homo sapiens
gcccatcttgcctccatggtg

SEQ ID NO: 5619792 - DNA, 19 bp, Homo sapiens
gcccatgagcaagcctagg

SEQ ID NO: 5619793 - DNA, 14 bp, Homo sapiens
gcccatgccaaggc

SEQ ID NO: 5619794 - DNA, 13 bp, Homo sapiens
gcccatgcccacc

SEQ ID NO: 5619795 - DNA, 19 bp, Homo sapiens
gcccatgcccacctgccca

SEQ ID NO: 5619796 - DNA, 13 bp, Homo sapiens
gcccatgccccct

SEQ ID NO: 5619797 - DNA, 13 bp, Homo sapiens
gcccatgccctcc

SEQ ID NO: 5619798 - DNA, 14 bp, Homo sapiens
gcccatgccctccg

SEQ ID NO: 5619799 - DNA, 23 bp, Homo sapiens
gcccatgccctccgtcctggcag

SEQ ID NO: 5619800 - DNA, 22 bp, Homo sapiens
gcccatgctcaaccactgtggc

SEQ ID NO: 5619801 - DNA, 12 bp, Homo sapiens
gcccatgctggc

SEQ ID NO: 5619802 - DNA, 14 bp, Homo sapiens
gcccatgctggctg

SEQ ID NO: 5619803 - DNA, 17 bp, Homo sapiens
gcccatgctggctgggg

SEQ ID NO: 5619804 - DNA, 12 bp, Homo sapiens
gcccatgctgtc

SEQ ID NO: 5619805 - DNA, 13 bp, Homo sapiens
gcccatgctgtcc

SEQ ID NO: 5619806 - DNA, 19 bp, Homo sapiens
gcccatggacaggctggct

SEQ ID NO: 5619807 - DNA, 21 bp, Homo sapiens
gcccatggagattgacctgga

SEQ ID NO: 5619808 - DNA, 23 bp, Homo sapiens
gcccatggagattgacctggatg

SEQ ID NO: 5619809 - DNA, 22 bp, Homo sapiens
gcccatggaggagacaggaagc

SEQ ID NO: 5619810 - DNA, 15 bp, Homo sapiens
gcccatggaggcaga

SEQ ID NO: 5619811 - DNA, 14 bp, Homo sapiens
gcccatggccccag

SEQ ID NO: 5619812 - DNA, 16 bp, Homo sapiens
gcccatggccccagct

SEQ ID NO: 5619813 - DNA, 18 bp, Homo sapiens
gcccatggccccagctgg

SEQ ID NO: 5619814 - DNA, 19 bp, Homo sapiens
gcccatggccccagctggc

SEQ ID NO: 5619815 - DNA, 20 bp, Homo sapiens
gcccatggcccccaataaag

SEQ ID NO: 5619816 - DNA, 23 bp, Homo sapiens
gcccatggcccccaataaaggca

SEQ ID NO: 5619817 - DNA, 22 bp, Homo sapiens
gcccatggccctcccagtacct

SEQ ID NO: 5619818 - DNA, 22 bp, Homo sapiens
gcccatggccttgggctctgat

SEQ ID NO: 5619819 - DNA, 17 bp, Homo sapiens
gcccatgggcagaagat

SEQ ID NO: 5619820 - DNA, 19 bp, Homo sapiens
gcccatggggtctctgcat

SEQ ID NO: 5619821 - DNA, 13 bp, Homo sapiens
gcccatgtagctg

SEQ ID NO: 5619822 - DNA, 16 bp, Homo sapiens
gcccatgtagctggca

SEQ ID NO: 5619823 - DNA, 19 bp, Homo sapiens
gcccatgtagctggcaagc

SEQ ID NO: 5619824 - DNA, 18 bp, Homo sapiens
gcccatgtatggccagga

SEQ ID NO: 5619825 - DNA, 20 bp, Homo sapiens
gcccatgtatggccaggaag

SEQ ID NO: 5619826 - DNA, 13 bp, Homo sapiens
gcccatgtcttct

SEQ ID NO: 5619827 - DNA, 16 bp, Homo sapiens
gcccatgtcttctgct

SEQ ID NO: 5619828 - DNA, 18 bp, Homo sapiens
gcccatgtcttctgctgt

SEQ ID NO: 5619829 - DNA, 18 bp, Homo sapiens
gcccatgtgactgtggca

SEQ ID NO: 5619830 - DNA, 14 bp, Homo sapiens
gcccatgtgtcccc

SEQ ID NO: 5619831 - DNA, 18 bp, Homo sapiens
gcccatgtgtcccctcac

SEQ ID NO: 5619832 - DNA, 22 bp, Homo sapiens
gcccatgtgtcccctcactctg

SEQ ID NO: 5619833 - DNA, 22 bp, Homo sapiens
gcccatgttaagtcctccctga

SEQ ID NO: 5619834 - DNA, 20 bp, Homo sapiens
gcccatgttctgcccccagc

SEQ ID NO: 5619835 - DNA, 22 bp, Homo sapiens
gcccatgttctgcccccagccc

SEQ ID NO: 5619836 - DNA, 15 bp, Homo sapiens
gcccattaatcttga

SEQ ID NO: 5619837 - DNA, 16 bp, Homo sapiens
gcccattaatcttgat

SEQ ID NO: 5619838 - DNA, 17 bp, Homo sapiens
gcccattcagagctatg

SEQ ID NO: 5619839 - DNA, 12 bp, Homo sapiens
gcccattcagcc

SEQ ID NO: 5619840 - DNA, 16 bp, Homo sapiens
gcccattcattagaag

SEQ ID NO: 5619841 - DNA, 15 bp, Homo sapiens
gcccattcccaaggg

SEQ ID NO: 5619842 - DNA, 16 bp, Homo sapiens
gcccattcctcacctt

SEQ ID NO: 5619843 - DNA, 20 bp, Homo sapiens
gcccattcgtctgtcccaga

SEQ ID NO: 5619844 - DNA, 23 bp, Homo sapiens
gcccattcgtctgtcccagagct

SEQ ID NO: 5619845 - DNA, 19 bp, Homo sapiens
gcccattctacttgctctg

SEQ ID NO: 5619846 - DNA, 20 bp, Homo sapiens
gcccattctctaagcctggc

SEQ ID NO: 5619847 - DNA, 14 bp, Homo sapiens
gcccattctctctc

SEQ ID NO: 5619848 - DNA, 16 bp, Homo sapiens
gcccattctgcatgcc

SEQ ID NO: 5619849 - DNA, 20 bp, Homo sapiens
gcccattctgccctgtggga

SEQ ID NO: 5619850 - DNA, 23 bp, Homo sapiens
gcccattgaagaagaaccagccc

SEQ ID NO: 5619851 - DNA, 19 bp, Homo sapiens
gcccattgctgcaaatgca

SEQ ID NO: 5619852 - DNA, 15 bp, Homo sapiens
gcccattgctgccaa

SEQ ID NO: 5619853 - DNA, 20 bp, Homo sapiens
gcccattggccgagctcctg

SEQ ID NO: 5619854 - DNA, 21 bp, Homo sapiens
gcccattggccgagctcctgg

SEQ ID NO: 5619855 - DNA, 17 bp, Homo sapiens
gcccattgtcctccttt

SEQ ID NO: 5619856 - DNA, 18 bp, Homo sapiens
gcccattgtcctcctttt

SEQ ID NO: 5619857 - DNA, 20 bp, Homo sapiens
gcccatttcaattctcaaaa

SEQ ID NO: 5619858 - DNA, 15 bp, Homo sapiens
gcccatttcgtgagc

SEQ ID NO: 5619859 - DNA, 14 bp, Homo sapiens
gcccatttctccag

SEQ ID NO: 5619860 - DNA, 16 bp, Homo sapiens
gcccatttggagggcc

SEQ ID NO: 5619861 - DNA, 17 bp, Homo sapiens
gcccatttggagggcct

SEQ ID NO: 5619862 - DNA, 16 bp, Homo sapiens
gcccatttgggctctg

SEQ ID NO: 5619863 - DNA, 16 bp, Homo sapiens
gcccatttttgctaat

SEQ ID NO: 5619864 - DNA, 15 bp, Homo sapiens
gccccaaaaccacag

SEQ ID NO: 5619865 - DNA, 16 bp, Homo sapiens
gccccaaaaccacagc

SEQ ID NO: 5619866 - DNA, 19 bp, Homo sapiens
gccccaaaaccacagccct

SEQ ID NO: 5619867 - DNA, 23 bp, Homo sapiens
gccccaaaaccacagccctgtca

SEQ ID NO: 5619868 - DNA, 20 bp, Homo sapiens
gccccaaaactctcctctgc

SEQ ID NO: 5619869 - DNA, 16 bp, Homo sapiens
gccccaaaagccttac

SEQ ID NO: 5619870 - DNA, 17 bp, Homo sapiens
gccccaaaccagggtgc

SEQ ID NO: 5619871 - DNA, 23 bp, Homo sapiens
gccccaaaccagggtgcatggct

SEQ ID NO: 5619872 - DNA, 22 bp, Homo sapiens
gccccaaactttctcataagca

SEQ ID NO: 5619873 - DNA, 22 bp, Homo sapiens
gccccaaagtaaaagaaaccac

SEQ ID NO: 5619874 - DNA, 16 bp, Homo sapiens
gccccaaagttgctca

SEQ ID NO: 5619875 - DNA, 21 bp, Homo sapiens
gccccaacccaaacctggaga

SEQ ID NO: 5619876 - DNA, 17 bp, Homo sapiens
gccccaacccccaccga

SEQ ID NO: 5619877 - DNA, 23 bp, Homo sapiens
gccccaacccccaccgaagagcc

SEQ ID NO: 5619878 - DNA, 16 bp, Homo sapiens
gccccaacccccagca

SEQ ID NO: 5619879 - DNA, 17 bp, Homo sapiens
gccccaacccccagcac

SEQ ID NO: 5619880 - DNA, 19 bp, Homo sapiens
gccccaacccgtggaggct

SEQ ID NO: 5619881 - DNA, 22 bp, Homo sapiens
gccccaacccgtggaggctgct

SEQ ID NO: 5619882 - DNA, 13 bp, Homo sapiens
gccccaaccctcg

SEQ ID NO: 5619883 - DNA, 14 bp, Homo sapiens
gccccaacccttct

SEQ ID NO: 5619884 - DNA, 15 bp, Homo sapiens
gccccaacctgctga

SEQ ID NO: 5619885 - DNA, 21 bp, Homo sapiens
gccccaactattaaagtgcca

SEQ ID NO: 5619886 - DNA, 18 bp, Homo sapiens
gccccaactccaggggca

SEQ ID NO: 5619887 - DNA, 19 bp, Homo sapiens
gccccaactccaggggcac

SEQ ID NO: 5619888 - DNA, 14 bp, Homo sapiens
gccccaactcctgg

SEQ ID NO: 5619889 - DNA, 16 bp, Homo sapiens
gccccaactcctggaa

SEQ ID NO: 5619890 - DNA, 17 bp, Homo sapiens
gccccaactcctggaag

SEQ ID NO: 5619891 - DNA, 17 bp, Homo sapiens
gccccaactccttccag

SEQ ID NO: 5619892 - DNA, 15 bp, Homo sapiens
gccccaagagcccaa

SEQ ID NO: 5619893 - DNA, 16 bp, Homo sapiens
gccccaagaggctagc

SEQ ID NO: 5619894 - DNA, 17 bp, Homo sapiens
gccccaagaggctagcc

SEQ ID NO: 5619895 - DNA, 22 bp, Homo sapiens
gccccaagaggctagccccagg

SEQ ID NO: 5619896 - DNA, 22 bp, Homo sapiens
gccccaagaggggcgggctcag

SEQ ID NO: 5619897 - DNA, 14 bp, Homo sapiens
gccccaagcagcca

SEQ ID NO: 5619898 - DNA, 16 bp, Homo sapiens
gccccaagctgggccg

SEQ ID NO: 5619899 - DNA, 13 bp, Homo sapiens
gccccaagcttct

SEQ ID NO: 5619900 - DNA, 18 bp, Homo sapiens
gccccaaggacaaggggc

SEQ ID NO: 5619901 - DNA, 18 bp, Homo sapiens
gccccaaggctgctcaga

SEQ ID NO: 5619902 - DNA, 16 bp, Homo sapiens
gccccaagggcccaga

SEQ ID NO: 5619903 - DNA, 22 bp, Homo sapiens
gccccaagggcccagaccctgg

SEQ ID NO: 5619904 - DNA, 13 bp, Homo sapiens
gccccaaggggtg

SEQ ID NO: 5619905 - DNA, 19 bp, Homo sapiens
gccccaaggggtttctgtt

SEQ ID NO: 5619906 - DNA, 21 bp, Homo sapiens
gccccaaggggtttctgtttc

SEQ ID NO: 5619907 - DNA, 22 bp, Homo sapiens
gccccaaggttccagaggccct

SEQ ID NO: 5619908 - DNA, 15 bp, Homo sapiens
gccccaagtcctgaa

SEQ ID NO: 5619909 - DNA, 20 bp, Homo sapiens
gccccaagtcctgaagaggc

SEQ ID NO: 5619910 - DNA, 21 bp, Homo sapiens
gccccaagtcctgaagaggcg

SEQ ID NO: 5619911 - DNA, 19 bp, Homo sapiens
gccccaatatggtggccct

SEQ ID NO: 5619912 - DNA, 20 bp, Homo sapiens
gccccaatatggtggccctg

SEQ ID NO: 5619913 - DNA, 17 bp, Homo sapiens
gccccaatccagagaag

SEQ ID NO: 5619914 - DNA, 18 bp, Homo sapiens
gccccaatccctttatta

SEQ ID NO: 5619915 - DNA, 14 bp, Homo sapiens
gcccccaccctgct

SEQ ID NO: 5619916 - DNA, 15 bp, Homo sapiens
gcccccaccctgctt

SEQ ID NO: 5619917 - DNA, 14 bp, Homo sapiens
gcccccaccctgtt

SEQ ID NO: 5619918 - DNA, 21 bp, Homo sapiens
gcccccaccgccggggtcctg

SEQ ID NO: 5619919 - DNA, 17 bp, Homo sapiens
gcccccaccggaactgg

SEQ ID NO: 5619920 - DNA, 20 bp, Homo sapiens
gcccccaccggaactgggct

SEQ ID NO: 5619921 - DNA, 17 bp, Homo sapiens
gcccccaccgggctgca

SEQ ID NO: 5619922 - DNA, 20 bp, Homo sapiens
gcccccaccgtgggcaggga

SEQ ID NO: 5619923 - DNA, 22 bp, Homo sapiens
gcccccaccgtgggcagggagc

SEQ ID NO: 5619924 - DNA, 15 bp, Homo sapiens
gcccccacctccacc

SEQ ID NO: 5619925 - DNA, 16 bp, Homo sapiens
gcccccacctctgtga

SEQ ID NO: 5619926 - DNA, 12 bp, Homo sapiens
gcccccactcct

SEQ ID NO: 5619927 - DNA, 13 bp, Homo sapiens
gcccccactgacc

SEQ ID NO: 5619928 - DNA, 19 bp, Homo sapiens
gcccccactgcctttgacc

SEQ ID NO: 5619929 - DNA, 15 bp, Homo sapiens
gcccccactggctgt

SEQ ID NO: 5619930 - DNA, 21 bp, Homo sapiens
gcccccactggctgtgggctc

SEQ ID NO: 5619931 - DNA, 12 bp, Homo sapiens
gcccccactggt

SEQ ID NO: 5619932 - DNA, 23 bp, Homo sapiens
gcccccactttcctacaaaatgg

SEQ ID NO: 5619933 - DNA, 16 bp, Homo sapiens
gcccccagaaagcctc

SEQ ID NO: 5619934 - DNA, 22 bp, Homo sapiens
gcccccagaaagcctcctgccc

SEQ ID NO: 5619935 - DNA, 22 bp, Homo sapiens
gcccccagagacctttgcccac

SEQ ID NO: 5619936 - DNA, 18 bp, Homo sapiens
gcccccagagcgcccctc

SEQ ID NO: 5619937 - DNA, 17 bp, Homo sapiens
gcccccagatagagctg

SEQ ID NO: 5619938 - DNA, 12 bp, Homo sapiens
gcccccagcaga

SEQ ID NO: 5619939 - DNA, 22 bp, Homo sapiens
gcccccagccatggtgaggaag

SEQ ID NO: 5619940 - DNA, 16 bp, Homo sapiens
gcccccagcccagagc

SEQ ID NO: 5619941 - DNA, 17 bp, Homo sapiens
gcccccagcccagggct

SEQ ID NO: 5619942 - DNA, 21 bp, Homo sapiens
gcccccagcccagggctcctg

SEQ ID NO: 5619943 - DNA, 22 bp, Homo sapiens
gcccccagcccagggctcctgc

SEQ ID NO: 5619944 - DNA, 14 bp, Homo sapiens
gcccccagcccctc

SEQ ID NO: 5619945 - DNA, 20 bp, Homo sapiens
gcccccagcccctcccccat

SEQ ID NO: 5619946 - DNA, 19 bp, Homo sapiens
gcccccagcccctcctccc

SEQ ID NO: 5619947 - DNA, 22 bp, Homo sapiens
gcccccagcccctcctccctca

SEQ ID NO: 5619948 - DNA, 18 bp, Homo sapiens
gcccccagccctgggaac

SEQ ID NO: 5619949 - DNA, 16 bp, Homo sapiens
gcccccagccctgggg

SEQ ID NO: 5619950 - DNA, 12 bp, Homo sapiens
gcccccagcctg

SEQ ID NO: 5619951 - DNA, 15 bp, Homo sapiens
gcccccagcctggcc

SEQ ID NO: 5619952 - DNA, 17 bp, Homo sapiens
gcccccagcctggccag

SEQ ID NO: 5619953 - DNA, 13 bp, Homo sapiens
gcccccagccttg

SEQ ID NO: 5619954 - DNA, 22 bp, Homo sapiens
gcccccagctaagaacctggaa

SEQ ID NO: 5619955 - DNA, 11 bp, Homo sapiens
gcccccagctt

SEQ ID NO: 5619956 - DNA, 18 bp, Homo sapiens
gcccccagcttccagcag

SEQ ID NO: 5619957 - DNA, 12 bp, Homo sapiens
gcccccaggacc

SEQ ID NO: 5619958 - DNA, 13 bp, Homo sapiens
gcccccaggaccc

SEQ ID NO: 5619959 - DNA, 16 bp, Homo sapiens
gcccccaggactgggc

SEQ ID NO: 5619960 - DNA, 21 bp, Homo sapiens
gcccccaggattcccccagcc

SEQ ID NO: 5619961 - DNA, 15 bp, Homo sapiens
gcccccaggcctgcc

SEQ ID NO: 5619962 - DNA, 15 bp, Homo sapiens
gcccccagggccccc

SEQ ID NO: 5619963 - DNA, 16 bp, Homo sapiens
gcccccagggcctcca

SEQ ID NO: 5619964 - DNA, 20 bp, Homo sapiens
gcccccagggcctccagggc

SEQ ID NO: 5619965 - DNA, 22 bp, Homo sapiens
gcccccagggcctccagggccc

SEQ ID NO: 5619966 - DNA, 13 bp, Homo sapiens
gcccccaggggca

SEQ ID NO: 5619967 - DNA, 16 bp, Homo sapiens
gcccccaggtgccagt

SEQ ID NO: 5619968 - DNA, 22 bp, Homo sapiens
gcccccagtatctcttcagtct

SEQ ID NO: 5619969 - DNA, 15 bp, Homo sapiens
gcccccagtccccac

SEQ ID NO: 5619970 - DNA, 19 bp, Homo sapiens
gcccccagtgcctcacctt

SEQ ID NO: 5619971 - DNA, 20 bp, Homo sapiens
gcccccagtgcctcaccttc

SEQ ID NO: 5619972 - DNA, 21 bp, Homo sapiens
gcccccagtgggaccacatgc

SEQ ID NO: 5619973 - DNA, 22 bp, Homo sapiens
gcccccagtgggaccacatgcc

SEQ ID NO: 5619974 - DNA, 23 bp, Homo sapiens
gcccccagtgggaccacatgcca

SEQ ID NO: 5619975 - DNA, 23 bp, Homo sapiens
gcccccagtgtgcacgagtggga

SEQ ID NO: 5619976 - DNA, 16 bp, Homo sapiens
gcccccatcagccctg

SEQ ID NO: 5619977 - DNA, 17 bp, Homo sapiens
gcccccatcagccctgc

SEQ ID NO: 5619978 - DNA, 18 bp, Homo sapiens
gcccccatcagccctgct

SEQ ID NO: 5619979 - DNA, 13 bp, Homo sapiens
gcccccatctcat

SEQ ID NO: 5619980 - DNA, 15 bp, Homo sapiens
gcccccatctcccca

SEQ ID NO: 5619981 - DNA, 16 bp, Homo sapiens
gcccccatctccccag

SEQ ID NO: 5619982 - DNA, 20 bp, Homo sapiens
gcccccatctccccaggcct

SEQ ID NO: 5619983 - DNA, 14 bp, Homo sapiens
gcccccatctgtct

SEQ ID NO: 5619984 - DNA, 16 bp, Homo sapiens
gcccccatctgtcttc

SEQ ID NO: 5619985 - DNA, 12 bp, Homo sapiens
gcccccatgcag

SEQ ID NO: 5619986 - DNA, 14 bp, Homo sapiens
gcccccatgcaggc

SEQ ID NO: 5619987 - DNA, 22 bp, Homo sapiens
gcccccatgcagtgaccgcttc

SEQ ID NO: 5619988 - DNA, 21 bp, Homo sapiens
gcccccatgctctctgtggcc

SEQ ID NO: 5619989 - DNA, 16 bp, Homo sapiens
gcccccatgggctcct

SEQ ID NO: 5619990 - DNA, 22 bp, Homo sapiens
gcccccatgggctcctgcccct

SEQ ID NO: 5619991 - DNA, 13 bp, Homo sapiens
gcccccattccca

SEQ ID NO: 5619992 - DNA, 15 bp, Homo sapiens
gcccccattcccagc

SEQ ID NO: 5619993 - DNA, 15 bp, Homo sapiens
gcccccattctccca

SEQ ID NO: 5619994 - DNA, 17 bp, Homo sapiens
gcccccatttcacccat

SEQ ID NO: 5619995 - DNA, 17 bp, Homo sapiens
gccccccaaagtgctgg

SEQ ID NO: 5619996 - DNA, 20 bp, Homo sapiens
gccccccaaatcccagggaa

SEQ ID NO: 5619997 - DNA, 18 bp, Homo sapiens
gccccccacacttccctg

SEQ ID NO: 5619998 - DNA, 19 bp, Homo sapiens
gccccccacacttccctgg

SEQ ID NO: 5619999 - DNA, 19 bp, Homo sapiens
gccccccacattctggctc

SEQ ID NO: 5620000 - DNA, 23 bp, Homo sapiens
gccccccacctttgggatcagcc

SEQ ID NO: 5620001 - DNA, 11 bp, Homo sapiens
gccccccactc

SEQ ID NO: 5620002 - DNA, 20 bp, Homo sapiens
gccccccagagagagctctg

SEQ ID NO: 5620003 - DNA, 23 bp, Homo sapiens
gccccccagagccagggctgtcc

SEQ ID NO: 5620004 - DNA, 16 bp, Homo sapiens
gccccccagcgcagag

SEQ ID NO: 5620005 - DNA, 21 bp, Homo sapiens
gccccccaggctgcccagagc

SEQ ID NO: 5620006 - DNA, 23 bp, Homo sapiens
gccccccaggctgcccagagctg

SEQ ID NO: 5620007 - DNA, 11 bp, Homo sapiens
gccccccaggg

SEQ ID NO: 5620008 - DNA, 13 bp, Homo sapiens
gccccccagggct

SEQ ID NO: 5620009 - DNA, 15 bp, Homo sapiens
gccccccagggctag

SEQ ID NO: 5620010 - DNA, 15 bp, Homo sapiens
gccccccatcctggc

SEQ ID NO: 5620011 - DNA, 16 bp, Homo sapiens
gccccccatcctggcc

SEQ ID NO: 5620012 - DNA, 20 bp, Homo sapiens
gccccccatcctggcccatc

SEQ ID NO: 5620013 - DNA, 13 bp, Homo sapiens
gcccccccaccca

SEQ ID NO: 5620014 - DNA, 14 bp, Homo sapiens
gcccccccacccac

SEQ ID NO: 5620015 - DNA, 20 bp, Homo sapiens
gcccccccacccacccccag

SEQ ID NO: 5620016 - DNA, 23 bp, Homo sapiens
gcccccccacccacccccaggcc

SEQ ID NO: 5620017 - DNA, 17 bp, Homo sapiens
gcccccccccacccctg

SEQ ID NO: 5620018 - DNA, 23 bp, Homo sapiens
gccccccccttgaatctgcaggg

SEQ ID NO: 5620019 - DNA, 13 bp, Homo sapiens
gccccccctatct

SEQ ID NO: 5620020 - DNA, 22 bp, Homo sapiens
gccccccctatctcttcctgtc

SEQ ID NO: 5620021 - DNA, 13 bp, Homo sapiens
gcccccccttcca

SEQ ID NO: 5620022 - DNA, 22 bp, Homo sapiens
gccccccgcacagccacccgtg

SEQ ID NO: 5620023 - DNA, 13 bp, Homo sapiens
gccccccgcagca

SEQ ID NO: 5620024 - DNA, 14 bp, Homo sapiens
gccccccgcagcac

SEQ ID NO: 5620025 - DNA, 16 bp, Homo sapiens
gccccccgcagcaccc

SEQ ID NO: 5620026 - DNA, 20 bp, Homo sapiens
gccccccgcccggcctccta

SEQ ID NO: 5620027 - DNA, 21 bp, Homo sapiens
gccccccgcgcgcccaccctc

SEQ ID NO: 5620028 - DNA, 23 bp, Homo sapiens
gccccccgcgctcgcccagcagg

SEQ ID NO: 5620029 - DNA, 16 bp, Homo sapiens
gccccccggcctggcc

SEQ ID NO: 5620030 - DNA, 20 bp, Homo sapiens
gccccccggcctggccccct

SEQ ID NO: 5620031 - DNA, 14 bp, Homo sapiens
gcccccctcaaacc

SEQ ID NO: 5620032 - DNA, 14 bp, Homo sapiens
gcccccctccaggc

SEQ ID NO: 5620033 - DNA, 11 bp, Homo sapiens
gcccccctcct

SEQ ID NO: 5620034 - DNA, 16 bp, Homo sapiens
gcccccctcctccagt

SEQ ID NO: 5620035 - DNA, 16 bp, Homo sapiens
gcccccctccttgctc

SEQ ID NO: 5620036 - DNA, 21 bp, Homo sapiens
gcccccctcctttccaaataa

SEQ ID NO: 5620037 - DNA, 19 bp, Homo sapiens
gcccccctctgcctttgag

SEQ ID NO: 5620038 - DNA, 23 bp, Homo sapiens
gcccccctgacgttaggaccagg

SEQ ID NO: 5620039 - DNA, 19 bp, Homo sapiens
gcccccctggcctccccca

SEQ ID NO: 5620040 - DNA, 20 bp, Homo sapiens
gcccccctggtcccctcctt

SEQ ID NO: 5620041 - DNA, 20 bp, Homo sapiens
gcccccctttggcactggat

SEQ ID NO: 5620042 - DNA, 17 bp, Homo sapiens
gcccccgacagcccagc

SEQ ID NO: 5620043 - DNA, 20 bp, Homo sapiens
gcccccgacagcccagccta

SEQ ID NO: 5620044 - DNA, 14 bp, Homo sapiens
gcccccgacccagc

SEQ ID NO: 5620045 - DNA, 18 bp, Homo sapiens
gcccccgacccagctcta

SEQ ID NO: 5620046 - DNA, 17 bp, Homo sapiens
gcccccgacggctgtga

SEQ ID NO: 5620047 - DNA, 15 bp, Homo sapiens
gcccccgagccctga

SEQ ID NO: 5620048 - DNA, 20 bp, Homo sapiens
gcccccgagccctgactcct

SEQ ID NO: 5620049 - DNA, 22 bp, Homo sapiens
gcccccgagctgggggccatga

SEQ ID NO: 5620050 - DNA, 15 bp, Homo sapiens
gcccccgcagtcgtc

SEQ ID NO: 5620051 - DNA, 22 bp, Homo sapiens
gcccccgcagtcgtcagcctcc

SEQ ID NO: 5620052 - DNA, 23 bp, Homo sapiens
gcccccgcagtcgtcagcctccc

SEQ ID NO: 5620053 - DNA, 14 bp, Homo sapiens
gcccccgcccaggc

SEQ ID NO: 5620054 - DNA, 15 bp, Homo sapiens
gcccccgcccaggcc

SEQ ID NO: 5620055 - DNA, 15 bp, Homo sapiens
gcccccgccccacag

SEQ ID NO: 5620056 - DNA, 13 bp, Homo sapiens
gcccccgccccag

SEQ ID NO: 5620057 - DNA, 14 bp, Homo sapiens
gcccccgccccagg

SEQ ID NO: 5620058 - DNA, 16 bp, Homo sapiens
gcccccgccccaggct

SEQ ID NO: 5620059 - DNA, 17 bp, Homo sapiens
gcccccgccccaggctt

SEQ ID NO: 5620060 - DNA, 18 bp, Homo sapiens
gcccccgccccaggcttc

SEQ ID NO: 5620061 - DNA, 19 bp, Homo sapiens
gcccccgccccaggcttcc

SEQ ID NO: 5620062 - DNA, 16 bp, Homo sapiens
gcccccgccccgcccc

SEQ ID NO: 5620063 - DNA, 15 bp, Homo sapiens
gcccccgccccgcgc

SEQ ID NO: 5620064 - DNA, 13 bp, Homo sapiens
gcccccgcccctc

SEQ ID NO: 5620065 - DNA, 14 bp, Homo sapiens
gcccccgcccctcc

SEQ ID NO: 5620066 - DNA, 19 bp, Homo sapiens
gcccccgccctcgctccgg

SEQ ID NO: 5620067 - DNA, 20 bp, Homo sapiens
gcccccgccctcgctccggg

SEQ ID NO: 5620068 - DNA, 15 bp, Homo sapiens
gcccccgccctctgc

SEQ ID NO: 5620069 - DNA, 16 bp, Homo sapiens
gcccccgccctctgcc

SEQ ID NO: 5620070 - DNA, 17 bp, Homo sapiens
gcccccgccttggcctg

SEQ ID NO: 5620071 - DNA, 18 bp, Homo sapiens
gcccccgcgatgccctgg

SEQ ID NO: 5620072 - DNA, 16 bp, Homo sapiens
gcccccgcgggttcta

SEQ ID NO: 5620073 - DNA, 20 bp, Homo sapiens
gcccccgcgggttctagacg

SEQ ID NO: 5620074 - DNA, 19 bp, Homo sapiens
gcccccggaggcgcccacc

SEQ ID NO: 5620075 - DNA, 19 bp, Homo sapiens
gcccccggccacgctccct

SEQ ID NO: 5620076 - DNA, 18 bp, Homo sapiens
gcccccggctcggcctct

SEQ ID NO: 5620077 - DNA, 23 bp, Homo sapiens
gcccccgtggggctcccggcatc

SEQ ID NO: 5620078 - DNA, 17 bp, Homo sapiens
gcccccgttccagctga

SEQ ID NO: 5620079 - DNA, 18 bp, Homo sapiens
gcccccgttccagctgac

SEQ ID NO: 5620080 - DNA, 19 bp, Homo sapiens
gccccctatcttgtcctgg

SEQ ID NO: 5620081 - DNA, 14 bp, Homo sapiens
gccccctcacctct

SEQ ID NO: 5620082 - DNA, 17 bp, Homo sapiens
gccccctcacctctcca

SEQ ID NO: 5620083 - DNA, 23 bp, Homo sapiens
gccccctcatctcactgcccagt

SEQ ID NO: 5620084 - DNA, 16 bp, Homo sapiens
gccccctcattcagag

SEQ ID NO: 5620085 - DNA, 16 bp, Homo sapiens
gccccctccagctcat

SEQ ID NO: 5620086 - DNA, 22 bp, Homo sapiens
gccccctcccaccgctgcctcg

SEQ ID NO: 5620087 - DNA, 23 bp, Homo sapiens
gccccctcccaccgctgcctcgt

SEQ ID NO: 5620088 - DNA, 12 bp, Homo sapiens
gccccctccccc

SEQ ID NO: 5620089 - DNA, 15 bp, Homo sapiens
gccccctccccccag

SEQ ID NO: 5620090 - DNA, 15 bp, Homo sapiens
gccccctcccccgca

SEQ ID NO: 5620091 - DNA, 17 bp, Homo sapiens
gccccctcccccgcaga

SEQ ID NO: 5620092 - DNA, 16 bp, Homo sapiens
gccccctccctgctcc

SEQ ID NO: 5620093 - DNA, 23 bp, Homo sapiens
gccccttcacttctgaccacact

SEQ ID NO: 5620094 - DNA, 21 bp, Homo sapiens
gccccttcattgatttcctgt

SEQ ID NO: 5620095 - DNA, 15 bp, Homo sapiens
gccccttccacgggg

SEQ ID NO: 5620096 - DNA, 12 bp, Homo sapiens
gccccttcccac

SEQ ID NO: 5620097 - DNA, 19 bp, Homo sapiens
gccccttcccactcacccc

SEQ ID NO: 5620098 - DNA, 14 bp, Homo sapiens
gccccttccccaag

SEQ ID NO: 5620099 - DNA, 21 bp, Homo sapiens
gccccttccccatctccattt

SEQ ID NO: 5620100 - DNA, 17 bp, Homo sapiens
gccccttccccctccaa

SEQ ID NO: 5620101 - DNA, 14 bp, Homo sapiens
gccccttcccctgg

SEQ ID NO: 5620102 - DNA, 22 bp, Homo sapiens
gccccttcccggtccgcccgct

SEQ ID NO: 5620103 - DNA, 23 bp, Homo sapiens
gccccttccctctctccctgcct

SEQ ID NO: 5620104 - DNA, 14 bp, Homo sapiens
gccccttccctggg

SEQ ID NO: 5620105 - DNA, 19 bp, Homo sapiens
gccccttccgccactgggg

SEQ ID NO: 5620106 - DNA, 14 bp, Homo sapiens
gccccttcctttaa

SEQ ID NO: 5620107 - DNA, 14 bp, Homo sapiens
gccccttcgggagc

SEQ ID NO: 5620108 - DNA, 21 bp, Homo sapiens
gccccttcgggagcagggctg

SEQ ID NO: 5620109 - DNA, 23 bp, Homo sapiens
gccccttctacactctcctgggc

SEQ ID NO: 5620110 - DNA, 22 bp, Homo sapiens
gccccttctaggggcaggtgaa

SEQ ID NO: 5620111 - DNA, 16 bp, Homo sapiens
gccccttctccccttc

SEQ ID NO: 5620112 - DNA, 19 bp, Homo sapiens
gccccttctccccttcctg

SEQ ID NO: 5620113 - DNA, 16 bp, Homo sapiens
gccccttctctccctg

SEQ ID NO: 5620114 - DNA, 23 bp, Homo sapiens
gccccttctctccctgccagagg

SEQ ID NO: 5620115 - DNA, 20 bp, Homo sapiens
gccccttctgacccatgctg

SEQ ID NO: 5620116 - DNA, 15 bp, Homo sapiens
gccccttctgctcag

SEQ ID NO: 5620117 - DNA, 18 bp, Homo sapiens
gccccttctgctcagctc

SEQ ID NO: 5620118 - DNA, 13 bp, Homo sapiens
gccccttctggcc

SEQ ID NO: 5620119 - DNA, 21 bp, Homo sapiens
gccccttctggccggtgctgg

SEQ ID NO: 5620120 - DNA, 23 bp, Homo sapiens
gccccttcttatttatgtgaaca

SEQ ID NO: 5620121 - DNA, 20 bp, Homo sapiens
gccccttcttccaaggagca

SEQ ID NO: 5620122 - DNA, 20 bp, Homo sapiens
gccccttcttgggccccaga

SEQ ID NO: 5620123 - DNA, 19 bp, Homo sapiens
gccccttgacaactggcag

SEQ ID NO: 5620124 - DNA, 15 bp, Homo sapiens
gccccttgaccccac

SEQ ID NO: 5620125 - DNA, 14 bp, Homo sapiens
gccccttgcaagcc

SEQ ID NO: 5620126 - DNA, 15 bp, Homo sapiens
gccccttgcaagcca

SEQ ID NO: 5620127 - DNA, 16 bp, Homo sapiens
gccccttgcaagccat

SEQ ID NO: 5620128 - DNA, 17 bp, Homo sapiens
gccccttgcaagccata

SEQ ID NO: 5620129 - DNA, 18 bp, Homo sapiens
gccccttgcaagccataa

SEQ ID NO: 5620130 - DNA, 20 bp, Homo sapiens
gccccttgctgatgctcctc

SEQ ID NO: 5620131 - DNA, 14 bp, Homo sapiens
gccccttgctgctg

SEQ ID NO: 5620132 - DNA, 16 bp, Homo sapiens
gccccttgctgctggc

SEQ ID NO: 5620133 - DNA, 19 bp, Homo sapiens
gccccttgctgctggctcc

SEQ ID NO: 5620134 - DNA, 16 bp, Homo sapiens
gccccttgcttctcaa

SEQ ID NO: 5620135 - DNA, 14 bp, Homo sapiens
gccccttggagaga

SEQ ID NO: 5620136 - DNA, 15 bp, Homo sapiens
gccccttggagagag

SEQ ID NO: 5620137 - DNA, 21 bp, Homo sapiens
gccccttggagagagaggctg

SEQ ID NO: 5620138 - DNA, 17 bp, Homo sapiens
gccccttggattcctgc

SEQ ID NO: 5620139 - DNA, 21 bp, Homo sapiens
gccccttggattcctgcacga

SEQ ID NO: 5620140 - DNA, 14 bp, Homo sapiens
gccccttggccctc

SEQ ID NO: 5620141 - DNA, 15 bp, Homo sapiens
gccccttggtcctgg

SEQ ID NO: 5620142 - DNA, 17 bp, Homo sapiens
gccccttgtcctgaagc

SEQ ID NO: 5620143 - DNA, 22 bp, Homo sapiens
gcccctttacggacaccccctc

SEQ ID NO: 5620144 - DNA, 12 bp, Homo sapiens
gcccctttcccc

SEQ ID NO: 5620145 - DNA, 15 bp, Homo sapiens
gcccctttccccacg

SEQ ID NO: 5620146 - DNA, 16 bp, Homo sapiens
gcccctttccccacgc

SEQ ID NO: 5620147 - DNA, 14 bp, Homo sapiens
gcccctttctcttg

SEQ ID NO: 5620148 - DNA, 15 bp, Homo sapiens
gcccctttcttcccc

SEQ ID NO: 5620149 - DNA, 18 bp, Homo sapiens
gcccctttcttccccacc

SEQ ID NO: 5620150 - DNA, 16 bp, Homo sapiens
gcccctttgcctctgt

SEQ ID NO: 5620151 - DNA, 17 bp, Homo sapiens
gcccctttgcctctgtc

SEQ ID NO: 5620152 - DNA, 21 bp, Homo sapiens
gcccctttgcctctgtcctcc

SEQ ID NO: 5620153 - DNA, 13 bp, Homo sapiens
gcccctttggacc

SEQ ID NO: 5620154 - DNA, 19 bp, Homo sapiens
gcccctttgggccctgcat

SEQ ID NO: 5620155 - DNA, 24 bp, Homo sapiens
gccccttttcgccccctgcctgcc

SEQ ID NO: 5620156 - DNA, 14 bp, Homo sapiens
gccccttttctctg

SEQ ID NO: 5620157 - DNA, 15 bp, Homo sapiens
gccccttttctctgc

SEQ ID NO: 5620158 - DNA, 19 bp, Homo sapiens
gccccttttctctgctctt

SEQ ID NO: 5620159 - DNA, 19 bp, Homo sapiens
gcccctttttactcccctt

SEQ ID NO: 5620160 - DNA, 17 bp, Homo sapiens
gcccgaaagctgagacc

SEQ ID NO: 5620161 - DNA, 15 bp, Homo sapiens
gcccgaacagggact

SEQ ID NO: 5620162 - DNA, 17 bp, Homo sapiens
gcccgaacagggacttg

SEQ ID NO: 5620163 - DNA, 24 bp, Homo sapiens
gcccgaagcatgaacagtgcacct

SEQ ID NO: 5620164 - DNA, 14 bp, Homo sapiens
gcccgaagcccagt

SEQ ID NO: 5620165 - DNA, 18 bp, Homo sapiens
gcccgaagcccagtttcc

SEQ ID NO: 5620166 - DNA, 19 bp, Homo sapiens
gcccgaagtctgctgctgt

SEQ ID NO: 5620167 - DNA, 15 bp, Homo sapiens
gcccgacagagagat

SEQ ID NO: 5620168 - DNA, 18 bp, Homo sapiens
gcccgacagagagatgaa

SEQ ID NO: 5620169 - DNA, 12 bp, Homo sapiens
gcccgacagcct

SEQ ID NO: 5620170 - DNA, 18 bp, Homo sapiens
gcccgacaggtgggcctg

SEQ ID NO: 5620171 - DNA, 19 bp, Homo sapiens
gcccgacaggtgggcctgg

SEQ ID NO: 5620172 - DNA, 14 bp, Homo sapiens
gcccgacagtgcca

SEQ ID NO: 5620173 - DNA, 17 bp, Homo sapiens
gcccgacagttctgaac

SEQ ID NO: 5620174 - DNA, 16 bp, Homo sapiens
gcccgacatggctccg

SEQ ID NO: 5620175 - DNA, 14 bp, Homo sapiens
gcccgaccccatct

SEQ ID NO: 5620176 - DNA, 15 bp, Homo sapiens
gcccgactagcaggc

SEQ ID NO: 5620177 - DNA, 17 bp, Homo sapiens
gcccgacttcgtttctg

SEQ ID NO: 5620178 - DNA, 13 bp, Homo sapiens
gcccgacttgctg

SEQ ID NO: 5620179 - DNA, 23 bp, Homo sapiens
gcccgacttgctgttttgttctg

SEQ ID NO: 5620180 - DNA, 16 bp, Homo sapiens
gcccgagagctgggac

SEQ ID NO: 5620181 - DNA, 16 bp, Homo sapiens
gcccgagcagctgagc

SEQ ID NO: 5620182 - DNA, 20 bp, Homo sapiens
gcccgagcagctgagcaggg

SEQ ID NO: 5620183 - DNA, 22 bp, Homo sapiens
gcccgagcagctgagcagggcc

SEQ ID NO: 5620184 - DNA, 20 bp, Homo sapiens
gcccgagccccttggggagc

SEQ ID NO: 5620185 - DNA, 21 bp, Homo sapiens
gcccgagcgcctgcgttccca

SEQ ID NO: 5620186 - DNA, 20 bp, Homo sapiens
gcccgagcgcgtgccttccc

SEQ ID NO: 5620187 - DNA, 12 bp, Homo sapiens
gcccgagctggt

SEQ ID NO: 5620188 - DNA, 15 bp, Homo sapiens
gcccgagctggtgca

SEQ ID NO: 5620189 - DNA, 22 bp, Homo sapiens
gcccgagctggtgcattacaga

SEQ ID NO: 5620190 - DNA, 14 bp, Homo sapiens
gcccgaggaggccg

SEQ ID NO: 5620191 - DNA, 19 bp, Homo sapiens
gcccgaggaggtgtctcag

SEQ ID NO: 5620192 - DNA, 20 bp, Homo sapiens
gcccgaggaggtgtctcagg

SEQ ID NO: 5620193 - DNA, 21 bp, Homo sapiens
gcccgaggaggtgtctcaggc

SEQ ID NO: 5620194 - DNA, 15 bp, Homo sapiens
gcccgaggcaccagt

SEQ ID NO: 5620195 - DNA, 13 bp, Homo sapiens
gcccgaggcaccg

SEQ ID NO: 5620196 - DNA, 23 bp, Homo sapiens
gcccgaggcagacgtctgtcagg

SEQ ID NO: 5620197 - DNA, 14 bp, Homo sapiens
gcccgaggccaggg

SEQ ID NO: 5620198 - DNA, 17 bp, Homo sapiens
gcccgaggccagggccg

SEQ ID NO: 5620199 - DNA, 18 bp, Homo sapiens
gcccgagggcagccccct

SEQ ID NO: 5620200 - DNA, 23 bp, Homo sapiens
gcccgagggcagccccctcccta

SEQ ID NO: 5620201 - DNA, 17 bp, Homo sapiens
gcccgagggcctgacag

SEQ ID NO: 5620202 - DNA, 18 bp, Homo sapiens
gcccgagggtcccaaggc

SEQ ID NO: 5620203 - DNA, 18 bp, Homo sapiens
gcccgaggtcgctgcagc

SEQ ID NO: 5620204 - DNA, 22 bp, Homo sapiens
gcccgaggtggctgcctggagc

SEQ ID NO: 5620205 - DNA, 20 bp, Homo sapiens
gcccgagtgcggcgtggaga

SEQ ID NO: 5620206 - DNA, 24 bp, Homo sapiens
gcccgagtgcggcgtggagactgg

SEQ ID NO: 5620207 - DNA, 22 bp, Homo sapiens
gcccgagtggtctcctctcagc

SEQ ID NO: 5620208 - DNA, 15 bp, Homo sapiens
gcccgatattctccc

SEQ ID NO: 5620209 - DNA, 17 bp, Homo sapiens
gcccgatattctccctg

SEQ ID NO: 5620210 - DNA, 15 bp, Homo sapiens
gcccgatccagattc

SEQ ID NO: 5620211 - DNA, 22 bp, Homo sapiens
gcccgatccagattcccaggcc

SEQ ID NO: 5620212 - DNA, 13 bp, Homo sapiens
gcccgatgtccct

SEQ ID NO: 5620213 - DNA, 19 bp, Homo sapiens
gcccgcaactctccagccg

SEQ ID NO: 5620214 - DNA, 19 bp, Homo sapiens
gcccgcaagagggacagag

SEQ ID NO: 5620215 - DNA, 20 bp, Homo sapiens
gcccgcaagagggacagagc

SEQ ID NO: 5620216 - DNA, 14 bp, Homo sapiens
gcccgcacaccctc

SEQ ID NO: 5620217 - DNA, 13 bp, Homo sapiens
gcccgcacagcag

SEQ ID NO: 5620218 - DNA, 18 bp, Homo sapiens
gcccgcaccccggcctca

SEQ ID NO: 5620219 - DNA, 18 bp, Homo sapiens
gcccgcaccctggcctgg

SEQ ID NO: 5620220 - DNA, 16 bp, Homo sapiens
gcccgcagacctctgg

SEQ ID NO: 5620221 - DNA, 13 bp, Homo sapiens
gcccgcagagccc

SEQ ID NO: 5620222 - DNA, 22 bp, Homo sapiens
gcccgcagagcgcgcccctagc

SEQ ID NO: 5620223 - DNA, 15 bp, Homo sapiens
gcccgcagcccagac

SEQ ID NO: 5620224 - DNA, 12 bp, Homo sapiens
gcccgcagggcc

SEQ ID NO: 5620225 - DNA, 20 bp, Homo sapiens
gcccgcagtgctgggaccag

SEQ ID NO: 5620226 - DNA, 13 bp, Homo sapiens
gcccgcatcagct

SEQ ID NO: 5620227 - DNA, 15 bp, Homo sapiens
gcccgcatcagctgc

SEQ ID NO: 5620228 - DNA, 19 bp, Homo sapiens
gcccgcatcagctgctcag

SEQ ID NO: 5620229 - DNA, 17 bp, Homo sapiens
gcccgcatgcagcagct

SEQ ID NO: 5620230 - DNA, 14 bp, Homo sapiens
gcccgcatgtgtgc

SEQ ID NO: 5620231 - DNA, 21 bp, Homo sapiens
gcccgccaaggtagccatccc

SEQ ID NO: 5620232 - DNA, 18 bp, Homo sapiens
gcccgccagcctcagtgc

SEQ ID NO: 5620233 - DNA, 12 bp, Homo sapiens
gcccgcccaccc

SEQ ID NO: 5620234 - DNA, 19 bp, Homo sapiens
gcccgcccaccccgctgcc

SEQ ID NO: 5620235 - DNA, 21 bp, Homo sapiens
gcccgcccaccccgctgcctg

SEQ ID NO: 5620236 - DNA, 22 bp, Homo sapiens
gcccgcccaccccgctgcctgg

SEQ ID NO: 5620237 - DNA, 14 bp, Homo sapiens
gcccgcccacctct

SEQ ID NO: 5620238 - DNA, 21 bp, Homo sapiens
gcccgcccacctgggccctag

SEQ ID NO: 5620239 - DNA, 22 bp, Homo sapiens
gcccgcccactgtcctgggcgc

SEQ ID NO: 5620240 - DNA, 20 bp, Homo sapiens
gcccgcccagaggagcccag

SEQ ID NO: 5620241 - DNA, 12 bp, Homo sapiens
gcccgcccccgc

SEQ ID NO: 5620242 - DNA, 14 bp, Homo sapiens
gcccgcccgccacc

SEQ ID NO: 5620243 - DNA, 15 bp, Homo sapiens
gcccgccctcacctc

SEQ ID NO: 5620244 - DNA, 14 bp, Homo sapiens
gcccgccctcctct

SEQ ID NO: 5620245 - DNA, 15 bp, Homo sapiens
gcccgccctcctctg

SEQ ID NO: 5620246 - DNA, 19 bp, Homo sapiens
gcccgccctcctctgcccc

SEQ ID NO: 5620247 - DNA, 22 bp, Homo sapiens
gcccgccctcctctgccccctc

SEQ ID NO: 5620248 - DNA, 21 bp, Homo sapiens
gcccgccctgcccctgcccca

SEQ ID NO: 5620249 - DNA, 18 bp, Homo sapiens
gcccgccgcccgcccctc

SEQ ID NO: 5620250 - DNA, 16 bp, Homo sapiens
gcccgccgcctccctc

SEQ ID NO: 5620251 - DNA, 23 bp, Homo sapiens
gcccgccggttggccggctggcc

SEQ ID NO: 5620252 - DNA, 15 bp, Homo sapiens
gcccgccgtctgcag

SEQ ID NO: 5620253 - DNA, 19 bp, Homo sapiens
gcccgccgtctgcaggggc

SEQ ID NO: 5620254 - DNA, 20 bp, Homo sapiens
gcccgccgtctgcaggggcc

SEQ ID NO: 5620255 - DNA, 16 bp, Homo sapiens
gcccgcctgccagtcc

SEQ ID NO: 5620256 - DNA, 17 bp, Homo sapiens
gcccgcctgccagtcct

SEQ ID NO: 5620257 - DNA, 15 bp, Homo sapiens
gcccgcctgcccacc

SEQ ID NO: 5620258 - DNA, 22 bp, Homo sapiens
gcccgcctgcccacctgcctgg

SEQ ID NO: 5620259 - DNA, 23 bp, Homo sapiens
gcccgcctgcccacctgcctggc

SEQ ID NO: 5620260 - DNA, 20 bp, Homo sapiens
gcccgcctgccgtgcatggc

SEQ ID NO: 5620261 - DNA, 16 bp, Homo sapiens
gcccgcgcagctgcct

SEQ ID NO: 5620262 - DNA, 15 bp, Homo sapiens
gcccgcgccacagga

SEQ ID NO: 5620263 - DNA, 23 bp, Homo sapiens
gcccgcgccacaggaccctcgcc

SEQ ID NO: 5620264 - DNA, 23 bp, Homo sapiens
gcccgcgccctcgcccccgcccc

SEQ ID NO: 5620265 - DNA, 14 bp, Homo sapiens
gcccgcgctcagga

SEQ ID NO: 5620266 - DNA, 15 bp, Homo sapiens
gcccgcgctcaggag

SEQ ID NO: 5620267 - DNA, 18 bp, Homo sapiens
gcccgcggcctgcaccga

SEQ ID NO: 5620268 - DNA, 20 bp, Homo sapiens
gcccgcggcctgcaccgacc

SEQ ID NO: 5620269 - DNA, 13 bp, Homo sapiens
gcccgcggcctgg

SEQ ID NO: 5620270 - DNA, 17 bp, Homo sapiens
gccctcccctcccctgc

SEQ ID NO: 5620271 - DNA, 19 bp, Homo sapiens
gccctcccctcccctgctg

SEQ ID NO: 5620272 - DNA, 22 bp, Homo sapiens
gccctcccctgcccctcacaac

SEQ ID NO: 5620273 - DNA, 17 bp, Homo sapiens
gccctcccctgctccca

SEQ ID NO: 5620274 - DNA, 18 bp, Homo sapiens
gccctcccgcaccttcct

SEQ ID NO: 5620275 - DNA, 21 bp, Homo sapiens
gccctccctatgtctgcaaag

SEQ ID NO: 5620276 - DNA, 12 bp, Homo sapiens
gccctccctccc

SEQ ID NO: 5620277 - DNA, 22 bp, Homo sapiens
gccctccctccctagcccttcc

SEQ ID NO: 5620278 - DNA, 19 bp, Homo sapiens
gccctccctccctccacac

SEQ ID NO: 5620279 - DNA, 20 bp, Homo sapiens
gccctccctccctccacacc

SEQ ID NO: 5620280 - DNA, 16 bp, Homo sapiens
gccctccctcctgcct

SEQ ID NO: 5620281 - DNA, 21 bp, Homo sapiens
gccctccctcctgcctgcgca

SEQ ID NO: 5620282 - DNA, 15 bp, Homo sapiens
gccctccctctctgc

SEQ ID NO: 5620283 - DNA, 14 bp, Homo sapiens
gccctccctcttcc

SEQ ID NO: 5620284 - DNA, 20 bp, Homo sapiens
gccctccctcttcccagcac

SEQ ID NO: 5620285 - DNA, 21 bp, Homo sapiens
gccctccctgcccctcccttc

SEQ ID NO: 5620286 - DNA, 13 bp, Homo sapiens
gccctccctgcgc

SEQ ID NO: 5620287 - DNA, 15 bp, Homo sapiens
gccctccctgctagc

SEQ ID NO: 5620288 - DNA, 22 bp, Homo sapiens
gccctccctgctagcacagagg

SEQ ID NO: 5620289 - DNA, 18 bp, Homo sapiens
gccctccctgctgccagg

SEQ ID NO: 5620290 - DNA, 20 bp, Homo sapiens
gccctccctggcatgtcaga

SEQ ID NO: 5620291 - DNA, 16 bp, Homo sapiens
gccctccctgtcctcc

SEQ ID NO: 5620292 - DNA, 18 bp, Homo sapiens
gccctccctgtcctcctc

SEQ ID NO: 5620293 - DNA, 19 bp, Homo sapiens
gccctccctgtctccaggg

SEQ ID NO: 5620294 - DNA, 22 bp, Homo sapiens
gccctccctgtctccagggccc

SEQ ID NO: 5620295 - DNA, 21 bp, Homo sapiens
gccctccctgttccccagaga

SEQ ID NO: 5620296 - DNA, 22 bp, Homo sapiens
gccctccgacagccccctctgc

SEQ ID NO: 5620297 - DNA, 18 bp, Homo sapiens
gccctccgaccctcatgg

SEQ ID NO: 5620298 - DNA, 15 bp, Homo sapiens
gccctccgccccgtc

SEQ ID NO: 5620299 - DNA, 14 bp, Homo sapiens
gccctccgcccttc

SEQ ID NO: 5620300 - DNA, 15 bp, Homo sapiens
gccctccgcccttcc

SEQ ID NO: 5620301 - DNA, 22 bp, Homo sapiens
gccctccggaggagcagcctcg

SEQ ID NO: 5620302 - DNA, 16 bp, Homo sapiens
gccctccgtcgggccc

SEQ ID NO: 5620303 - DNA, 19 bp, Homo sapiens
gccctccgtcgggcccctg

SEQ ID NO: 5620304 - DNA, 20 bp, Homo sapiens
gccctccgtcgggcccctgc

SEQ ID NO: 5620305 - DNA, 9 bp, Homo sapiens
gccctcctc

SEQ ID NO: 5620306 - DNA, 22 bp, Homo sapiens
gccctcctcagcgagaggcagc

SEQ ID NO: 5620307 - DNA, 14 bp, Homo sapiens
gccctcctcagctc

SEQ ID NO: 5620308 - DNA, 12 bp, Homo sapiens
gccctcctccac

SEQ ID NO: 5620309 - DNA, 18 bp, Homo sapiens
gccctcctccccagagct

SEQ ID NO: 5620310 - DNA, 15 bp, Homo sapiens
gccctcctcgctgtg

SEQ ID NO: 5620311 - DNA, 13 bp, Homo sapiens
gccctcctcgggc

SEQ ID NO: 5620312 - DNA, 23 bp, Homo sapiens
gccctcctcgggccgaggcccag

SEQ ID NO: 5620313 - DNA, 14 bp, Homo sapiens
gccctcctctccca

SEQ ID NO: 5620314 - DNA, 17 bp, Homo sapiens
gccctcctctcccgtct

SEQ ID NO: 5620315 - DNA, 13 bp, Homo sapiens
gccctcctctgcc

SEQ ID NO: 5620316 - DNA, 17 bp, Homo sapiens
gccctcctctgccccct

SEQ ID NO: 5620317 - DNA, 16 bp, Homo sapiens
gccctcctgagcctcc

SEQ ID NO: 5620318 - DNA, 13 bp, Homo sapiens
gccctcctgaggg

SEQ ID NO: 5620319 - DNA, 17 bp, Homo sapiens
gccctcctgagggccgg

SEQ ID NO: 5620320 - DNA, 13 bp, Homo sapiens
gccctcctgccca

SEQ ID NO: 5620321 - DNA, 23 bp, Homo sapiens
gccctcctgcccacgggaggaca

SEQ ID NO: 5620322 - DNA, 14 bp, Homo sapiens
gccctcctgctggc

SEQ ID NO: 5620323 - DNA, 18 bp, Homo sapiens
gccctcctgctggctgag

SEQ ID NO: 5620324 - DNA, 20 bp, Homo sapiens
gccctcctgctggctgaggc

SEQ ID NO: 5620325 - DNA, 11 bp, Homo sapiens
gccctcctggg

SEQ ID NO: 5620326 - DNA, 12 bp, Homo sapiens
gccctcctgggc

SEQ ID NO: 5620327 - DNA, 18 bp, Homo sapiens
gccctcctgtgctcagcc

SEQ ID NO: 5620328 - DNA, 13 bp, Homo sapiens
gccctccttccca

SEQ ID NO: 5620329 - DNA, 21 bp, Homo sapiens
gccctccttcccattggcttt

SEQ ID NO: 5620330 - DNA, 15 bp, Homo sapiens
gccctccttccctcc

SEQ ID NO: 5620331 - DNA, 16 bp, Homo sapiens
gccctccttccctcct

SEQ ID NO: 5620332 - DNA, 20 bp, Homo sapiens
gccctccttcttgccctgag

SEQ ID NO: 5620333 - DNA, 22 bp, Homo sapiens
gccctccttcttgccctgagct

SEQ ID NO: 5620334 - DNA, 17 bp, Homo sapiens
gccctccttgccacccc

SEQ ID NO: 5620335 - DNA, 15 bp, Homo sapiens
gccctccttgtccac

SEQ ID NO: 5620336 - DNA, 15 bp, Homo sapiens
gccctcctttccctt

SEQ ID NO: 5620337 - DNA, 16 bp, Homo sapiens
gccctcctttccctta

SEQ ID NO: 5620338 - DNA, 16 bp, Homo sapiens
gccctcgaaccaaggc

SEQ ID NO: 5620339 - DNA, 20 bp, Homo sapiens
gccctcgaaccaaggcagcc

SEQ ID NO: 5620340 - DNA, 21 bp, Homo sapiens
gccctcgaaccaaggcagcct

SEQ ID NO: 5620341 - DNA, 16 bp, Homo sapiens
gccctcgcccccgccc

SEQ ID NO: 5620342 - DNA, 15 bp, Homo sapiens
gccctcgcctcctcc

SEQ ID NO: 5620343 - DNA, 20 bp, Homo sapiens
gccctcgcctcctcctcctg

SEQ ID NO: 5620344 - DNA, 21 bp, Homo sapiens
gccctcgcctcctcctcctgc

SEQ ID NO: 5620345 - DNA, 22 bp, Homo sapiens
gccctcgcctcctcctcctgcc

SEQ ID NO: 5620346 - DNA, 17 bp, Homo sapiens
gccctcgcctctgcgag

SEQ ID NO: 5620347 - DNA, 15 bp, Homo sapiens
gccctcgctgccagc

SEQ ID NO: 5620348 - DNA, 16 bp, Homo sapiens
gccctcgctgcttctg

SEQ ID NO: 5620349 - DNA, 15 bp, Homo sapiens
gccctcggagctggc

SEQ ID NO: 5620350 - DNA, 18 bp, Homo sapiens
gccctcggagctggctgt

SEQ ID NO: 5620351 - DNA, 22 bp, Homo sapiens
gccctcggagctggctgtgcct

SEQ ID NO: 5620352 - DNA, 19 bp, Homo sapiens
gccctcggaggtccagctg

SEQ ID NO: 5620353 - DNA, 22 bp, Homo sapiens
gccctcggaggtccagctgggc

SEQ ID NO: 5620354 - DNA, 14 bp, Homo sapiens
gccctcggcctccg

SEQ ID NO: 5620355 - DNA, 20 bp, Homo sapiens
gccctcgggcccagccccca

SEQ ID NO: 5620356 - DNA, 14 bp, Homo sapiens
gccctcgggccctc

SEQ ID NO: 5620357 - DNA, 17 bp, Homo sapiens
gccctcgggccgggcac

SEQ ID NO: 5620358 - DNA, 18 bp, Homo sapiens
gccctcgggcgagtcact

SEQ ID NO: 5620359 - DNA, 22 bp, Homo sapiens
gccctcgtgcctgggggagaga

SEQ ID NO: 5620360 - DNA, 18 bp, Homo sapiens
gccctctagggcagggtg

SEQ ID NO: 5620361 - DNA, 16 bp, Homo sapiens
gccctctatgctggct

SEQ ID NO: 5620362 - DNA, 19 bp, Homo sapiens
gccctctatgctggctttt

SEQ ID NO: 5620363 - DNA, 14 bp, Homo sapiens
gccctctcactcca

SEQ ID NO: 5620364 - DNA, 16 bp, Homo sapiens
gccctctcactccagc

SEQ ID NO: 5620365 - DNA, 19 bp, Homo sapiens
gccctctcactccagccaa

SEQ ID NO: 5620366 - DNA, 21 bp, Homo sapiens
gccctctcactccagccaaag

SEQ ID NO: 5620367 - DNA, 22 bp, Homo sapiens
gccctctcactccagccaaaga

SEQ ID NO: 5620368 - DNA, 12 bp, Homo sapiens
gccctctccaca

SEQ ID NO: 5620369 - DNA, 13 bp, Homo sapiens
gccctctccacac

SEQ ID NO: 5620370 - DNA, 15 bp, Homo sapiens
gccctctccacaccc

SEQ ID NO: 5620371 - DNA, 14 bp, Homo sapiens
gccctctccaccca

SEQ ID NO: 5620372 - DNA, 18 bp, Homo sapiens
gccctctccacccagagg

SEQ ID NO: 5620373 - DNA, 19 bp, Homo sapiens
gccctctccacccagaggt

SEQ ID NO: 5620374 - DNA, 16 bp, Homo sapiens
gccctctcccaccctc

SEQ ID NO: 5620375 - DNA, 22 bp, Homo sapiens
gccctctccccacccctacccc

SEQ ID NO: 5620376 - DNA, 16 bp, Homo sapiens
gccctctcccctgccc

SEQ ID NO: 5620377 - DNA, 17 bp, Homo sapiens
gccctctcccctgcccc

SEQ ID NO: 5620378 - DNA, 20 bp, Homo sapiens
gccctctcccctgccccctg

SEQ ID NO: 5620379 - DNA, 22 bp, Homo sapiens
gccctctcccctgccccctgca

SEQ ID NO: 5620380 - DNA, 22 bp, Homo sapiens
gccctctccctgtgttctgggc

SEQ ID NO: 5620381 - DNA, 21 bp, Homo sapiens
gccctctcccttaccctggga

SEQ ID NO: 5620382 - DNA, 16 bp, Homo sapiens
gccctctcctccccct

SEQ ID NO: 5620383 - DNA, 20 bp, Homo sapiens
gccctctcctccccctccta

SEQ ID NO: 5620384 - DNA, 22 bp, Homo sapiens
gccctctcctccccctcctagg

SEQ ID NO: 5620385 - DNA, 23 bp, Homo sapiens
gccctctcctccccctcctaggg

SEQ ID NO: 5620386 - DNA, 14 bp, Homo sapiens
gccctctcctgggc

SEQ ID NO: 5620387 - DNA, 18 bp, Homo sapiens
gccctctcctgggcagct

SEQ ID NO: 5620388 - DNA, 11 bp, Homo sapiens
gccctctctca

SEQ ID NO: 5620389 - DNA, 13 bp, Homo sapiens
gccctctctcacc

SEQ ID NO: 5620390 - DNA, 17 bp, Homo sapiens
gccctctctcaccagcc

SEQ ID NO: 5620391 - DNA, 20 bp, Homo sapiens
gccctctctcaccagccttg

SEQ ID NO: 5620392 - DNA, 22 bp, Homo sapiens
gccctctctcgggagccctagc

SEQ ID NO: 5620393 - DNA, 15 bp, Homo sapiens
gccctctctctcact

SEQ ID NO: 5620394 - DNA, 13 bp, Homo sapiens
gccctctctctgg

SEQ ID NO: 5620395 - DNA, 22 bp, Homo sapiens
gccctctctgaaggaggccacc

SEQ ID NO: 5620396 - DNA, 13 bp, Homo sapiens
gccctctctgcag

SEQ ID NO: 5620397 - DNA, 14 bp, Homo sapiens
gccctctctgcagt

SEQ ID NO: 5620398 - DNA, 22 bp, Homo sapiens
gccctctctgcagtcctcggca

SEQ ID NO: 5620399 - DNA, 16 bp, Homo sapiens
gccctctctgctctgc

SEQ ID NO: 5620400 - DNA, 16 bp, Homo sapiens
gccctctgaaataatg

SEQ ID NO: 5620401 - DNA, 13 bp, Homo sapiens
gccctctgaaatt

SEQ ID NO: 5620402 - DNA, 23 bp, Homo sapiens
gccctctgaaattaaagaaatga

SEQ ID NO: 5620403 - DNA, 17 bp, Homo sapiens
gccctctgagcaactgt

SEQ ID NO: 5620404 - DNA, 21 bp, Homo sapiens
gccctctgagcaactgtgcag

SEQ ID NO: 5620405 - DNA, 13 bp, Homo sapiens
gccctctgaggct

SEQ ID NO: 5620406 - DNA, 17 bp, Homo sapiens
gccctctgcatcctctg

SEQ ID NO: 5620407 - DNA, 21 bp, Homo sapiens
gccctctgcatcctctggagc

SEQ ID NO: 5620408 - DNA, 12 bp, Homo sapiens
gccctctgccca

SEQ ID NO: 5620409 - DNA, 13 bp, Homo sapiens
gccctctgcccac

SEQ ID NO: 5620410 - DNA, 19 bp, Homo sapiens
gccctctgcccactccctg

SEQ ID NO: 5620411 - DNA, 19 bp, Homo sapiens
gccctctgcctcctcagcc

SEQ ID NO: 5620412 - DNA, 15 bp, Homo sapiens
gccctctgcctgcac

SEQ ID NO: 5620413 - DNA, 23 bp, Homo sapiens
gccctctgcctgcactccctggc

SEQ ID NO: 5620414 - DNA, 19 bp, Homo sapiens
gccctctgcgtcccccagc

SEQ ID NO: 5620415 - DNA, 15 bp, Homo sapiens
gccctctgctcaggc

SEQ ID NO: 5620416 - DNA, 17 bp, Homo sapiens
gccctctgctcaggcct

SEQ ID NO: 5620417 - DNA, 18 bp, Homo sapiens
gccctctgctcaggcctc

SEQ ID NO: 5620418 - DNA, 22 bp, Homo sapiens
gccctctgctcaggcctcccta

SEQ ID NO: 5620419 - DNA, 14 bp, Homo sapiens
gccctctggacagc

SEQ ID NO: 5620420 - DNA, 16 bp, Homo sapiens
gccctctggagtggcc

SEQ ID NO: 5620421 - DNA, 19 bp, Homo sapiens
gccctctggagtggccact

SEQ ID NO: 5620422 - DNA, 20 bp, Homo sapiens
gccctctggagtggccacta

SEQ ID NO: 5620423 - DNA, 20 bp, Homo sapiens
gccctctggatcctgctgtg

SEQ ID NO: 5620424 - DNA, 13 bp, Homo sapiens
gccctctgggctc

SEQ ID NO: 5620425 - DNA, 16 bp, Homo sapiens
gccctctgggctctga

SEQ ID NO: 5620426 - DNA, 17 bp, Homo sapiens
gccctctgggctctgag

SEQ ID NO: 5620427 - DNA, 18 bp, Homo sapiens
gccctctgggctctgagt

SEQ ID NO: 5620428 - DNA, 13 bp, Homo sapiens
gccctctggggct

SEQ ID NO: 5620429 - DNA, 15 bp, Homo sapiens
gccctctgtagctcc

SEQ ID NO: 5620430 - DNA, 19 bp, Homo sapiens
gccctctgtagctccctcc

SEQ ID NO: 5620431 - DNA, 14 bp, Homo sapiens
gccctctgtccaca

SEQ ID NO: 5620432 - DNA, 12 bp, Homo sapiens
gccctctgtcct

SEQ ID NO: 5620433 - DNA, 15 bp, Homo sapiens
gccctctgtcctgac

SEQ ID NO: 5620434 - DNA, 12 bp, Homo sapiens
gccctctgtgcc

SEQ ID NO: 5620435 - DNA, 13 bp, Homo sapiens
gccctctgtgcct

SEQ ID NO: 5620436 - DNA, 18 bp, Homo sapiens
gccctctgtgcctaataa

SEQ ID NO: 5620437 - DNA, 19 bp, Homo sapiens
gccctctgtgcctaataaa

SEQ ID NO: 5620438 - DNA, 15 bp, Homo sapiens
gccctctgtggccag

SEQ ID NO: 5620439 - DNA, 16 bp, Homo sapiens
gccctctgtggccagg

SEQ ID NO: 5620440 - DNA, 19 bp, Homo sapiens
gccctctgtggccaggagc

SEQ ID NO: 5620441 - DNA, 21 bp, Homo sapiens
gccctctgtggccaggagccc

SEQ ID NO: 5620442 - DNA, 24 bp, Homo sapiens
gccctctgtggccaggagccctgg

SEQ ID NO: 5620443 - DNA, 15 bp, Homo sapiens
gccctctgtggcctg

SEQ ID NO: 5620444 - DNA, 21 bp, Homo sapiens
gccctcttcccctctaatgct

SEQ ID NO: 5620445 - DNA, 13 bp, Homo sapiens
gccctcttcctga

SEQ ID NO: 5620446 - DNA, 14 bp, Homo sapiens
gccctcttcctgac

SEQ ID NO: 5620447 - DNA, 17 bp, Homo sapiens
gccctcttcttctcaag

SEQ ID NO: 5620448 - DNA, 17 bp, Homo sapiens
gcccttccatgtgcctt

SEQ ID NO: 5620449 - DNA, 19 bp, Homo sapiens
gcccttccatgtgcctttc

SEQ ID NO: 5620450 - DNA, 20 bp, Homo sapiens
gcccttccatgtgcctttct

SEQ ID NO: 5620451 - DNA, 15 bp, Homo sapiens
gcccttcccaacctc

SEQ ID NO: 5620452 - DNA, 20 bp, Homo sapiens
gcccttcccaacctcccctg

SEQ ID NO: 5620453 - DNA, 13 bp, Homo sapiens
gcccttcccaggg

SEQ ID NO: 5620454 - DNA, 17 bp, Homo sapiens
gcccttcccagggcacc

SEQ ID NO: 5620455 - DNA, 23 bp, Homo sapiens
gcccttccccctttctctgcctg

SEQ ID NO: 5620456 - DNA, 15 bp, Homo sapiens
gcccttccctctgtt

SEQ ID NO: 5620457 - DNA, 21 bp, Homo sapiens
gcccttccctgacactgtctg

SEQ ID NO: 5620458 - DNA, 22 bp, Homo sapiens
gcccttccctgagtgcgggctg

SEQ ID NO: 5620459 - DNA, 15 bp, Homo sapiens
gcccttccctgcctt

SEQ ID NO: 5620460 - DNA, 13 bp, Homo sapiens
gcccttccctgct

SEQ ID NO: 5620461 - DNA, 16 bp, Homo sapiens
gcccttccctgctttg

SEQ ID NO: 5620462 - DNA, 15 bp, Homo sapiens
gcccttccctgtccc

SEQ ID NO: 5620463 - DNA, 16 bp, Homo sapiens
gcccttccctgtccct

SEQ ID NO: 5620464 - DNA, 17 bp, Homo sapiens
gcccttccctgtccctc

SEQ ID NO: 5620465 - DNA, 23 bp, Homo sapiens
gcccttccgcagtgtggccaggc

SEQ ID NO: 5620466 - DNA, 12 bp, Homo sapiens
gcccttcctcag

SEQ ID NO: 5620467 - DNA, 21 bp, Homo sapiens
gcccttcctcagggcccctgg

SEQ ID NO: 5620468 - DNA, 13 bp, Homo sapiens
gcccttcctccag

SEQ ID NO: 5620469 - DNA, 13 bp, Homo sapiens
gcccttcctcctg

SEQ ID NO: 5620470 - DNA, 14 bp, Homo sapiens
gcccttcctcctga

SEQ ID NO: 5620471 - DNA, 23 bp, Homo sapiens
gcccttcctcctgaagcctctgc

SEQ ID NO: 5620472 - DNA, 22 bp, Homo sapiens
gcccttcctcctgcctttctca

SEQ ID NO: 5620473 - DNA, 22 bp, Homo sapiens
gcccttcctcgcacagggcatg

SEQ ID NO: 5620474 - DNA, 12 bp, Homo sapiens
gcccttcctctc

SEQ ID NO: 5620475 - DNA, 14 bp, Homo sapiens
gcccttcctctcac

SEQ ID NO: 5620476 - DNA, 20 bp, Homo sapiens
gcccttcctctcactcctgc

SEQ ID NO: 5620477 - DNA, 17 bp, Homo sapiens
gcccttcctctccactg

SEQ ID NO: 5620478 - DNA, 21 bp, Homo sapiens
gcccttcctctccactgcctt

SEQ ID NO: 5620479 - DNA, 15 bp, Homo sapiens
gcccttcctctgctc

SEQ ID NO: 5620480 - DNA, 17 bp, Homo sapiens
gcccttcctgctgcgca

SEQ ID NO: 5620481 - DNA, 18 bp, Homo sapiens
gcccttcctggacagctg

SEQ ID NO: 5620482 - DNA, 19 bp, Homo sapiens
gcccttcctggacagctgt

SEQ ID NO: 5620483 - DNA, 20 bp, Homo sapiens
gcccttcctggacagctgtg

SEQ ID NO: 5620484 - DNA, 22 bp, Homo sapiens
gcccttcctggacagctgtgcc

SEQ ID NO: 5620485 - DNA, 19 bp, Homo sapiens
gcccttccttcacccacca

SEQ ID NO: 5620486 - DNA, 17 bp, Homo sapiens
gcccttccttgggcgtc

SEQ ID NO: 5620487 - DNA, 22 bp, Homo sapiens
gcccttcctttccctggggtac

SEQ ID NO: 5620488 - DNA, 18 bp, Homo sapiens
gcccttcgctgccaggac

SEQ ID NO: 5620489 - DNA, 16 bp, Homo sapiens
gcccttcggtcacctg

SEQ ID NO: 5620490 - DNA, 17 bp, Homo sapiens
gcccttctaccccacct

SEQ ID NO: 5620491 - DNA, 18 bp, Homo sapiens
gcccttctaccccacctg

SEQ ID NO: 5620492 - DNA, 22 bp, Homo sapiens
gcccttctaccccacctgacct

SEQ ID NO: 5620493 - DNA, 23 bp, Homo sapiens
gcccttctaggcaaaagaaaagc

SEQ ID NO: 5620494 - DNA, 18 bp, Homo sapiens
gcccttctcacgggctct

SEQ ID NO: 5620495 - DNA, 18 bp, Homo sapiens
gcccttctcccggccctc

SEQ ID NO: 5620496 - DNA, 14 bp, Homo sapiens
gcccttctctccag

SEQ ID NO: 5620497 - DNA, 16 bp, Homo sapiens
gcccttctctccagcc

SEQ ID NO: 5620498 - DNA, 17 bp, Homo sapiens
gcccttctctccagccc

SEQ ID NO: 5620499 - DNA, 21 bp, Homo sapiens
gcccttctctccagcccctgg

SEQ ID NO: 5620500 - DNA, 22 bp, Homo sapiens
gcccttctctccagcccctgga

SEQ ID NO: 5620501 - DNA, 23 bp, Homo sapiens
gcccttctctccagcccctggat

SEQ ID NO: 5620502 - DNA, 14 bp, Homo sapiens
gcccttctctgtgt

SEQ ID NO: 5620503 - DNA, 18 bp, Homo sapiens
gcccttctgactgtttat

SEQ ID NO: 5620504 - DNA, 12 bp, Homo sapiens
gcccttctgccc

SEQ ID NO: 5620505 - DNA, 14 bp, Homo sapiens
gcccttctgtccaa

SEQ ID NO: 5620506 - DNA, 18 bp, Homo sapiens
gcccttctgtccaccaga

SEQ ID NO: 5620507 - DNA, 21 bp, Homo sapiens
gcccttctgtccaccagaccc

SEQ ID NO: 5620508 - DNA, 13 bp, Homo sapiens
gcccttctttcta

SEQ ID NO: 5620509 - DNA, 23 bp, Homo sapiens
gcccttgaattcttttcctctct

SEQ ID NO: 5620510 - DNA, 18 bp, Homo sapiens
gcccttgactgtacagag

SEQ ID NO: 5620511 - DNA, 20 bp, Homo sapiens
gcccttgactgtacagagac

SEQ ID NO: 5620512 - DNA, 21 bp, Homo sapiens
gcccttgactgtacagagact

SEQ ID NO: 5620513 - DNA, 17 bp, Homo sapiens
gcccttgagctccccaa

SEQ ID NO: 5620514 - DNA, 19 bp, Homo sapiens
gcccttgcacagctggaga

SEQ ID NO: 5620515 - DNA, 20 bp, Homo sapiens
gcccttgcacagctggagaa

SEQ ID NO: 5620516 - DNA, 11 bp, Homo sapiens
gcccttgccca

SEQ ID NO: 5620517 - DNA, 21 bp, Homo sapiens
gcccttgcccaactcccagcc

SEQ ID NO: 5620518 - DNA, 13 bp, Homo sapiens
gcccttgccccca

SEQ ID NO: 5620519 - DNA, 19 bp, Homo sapiens
gcccttgcccccatccctc

SEQ ID NO: 5620520 - DNA, 20 bp, Homo sapiens
gcccttgcccccatccctcg

SEQ ID NO: 5620521 - DNA, 15 bp, Homo sapiens
gcccttgccctgacc

SEQ ID NO: 5620522 - DNA, 20 bp, Homo sapiens
gcccttgcccttggagctgc

SEQ ID NO: 5620523 - DNA, 22 bp, Homo sapiens
gcccttgctccagcctgacaac

SEQ ID NO: 5620524 - DNA, 14 bp, Homo sapiens
gcccttgctctacc

SEQ ID NO: 5620525 - DNA, 13 bp, Homo sapiens
gcccttgctgggt

SEQ ID NO: 5620526 - DNA, 15 bp, Homo sapiens
gcccttgctgggtcc

SEQ ID NO: 5620527 - DNA, 18 bp, Homo sapiens
gcccttgcttacctctca

SEQ ID NO: 5620528 - DNA, 22 bp, Homo sapiens
gcccttgctttcggagctcctg

SEQ ID NO: 5620529 - DNA, 20 bp, Homo sapiens
gcccttggaacaccctggat

SEQ ID NO: 5620530 - DNA, 13 bp, Homo sapiens
gcccttggaataa

SEQ ID NO: 5620531 - DNA, 20 bp, Homo sapiens
gcccttggagccttccaccg

SEQ ID NO: 5620532 - DNA, 15 bp, Homo sapiens
gcccttggagcgtgg

SEQ ID NO: 5620533 - DNA, 16 bp, Homo sapiens
gcccttggaggccagc

SEQ ID NO: 5620534 - DNA, 19 bp, Homo sapiens
gcccttggccccagaggac

SEQ ID NO: 5620535 - DNA, 13 bp, Homo sapiens
gcccttggctgca

SEQ ID NO: 5620536 - DNA, 16 bp, Homo sapiens
gcccttggcttctgct

SEQ ID NO: 5620537 - DNA, 17 bp, Homo sapiens
gcccttggcttgtgtta

SEQ ID NO: 5620538 - DNA, 14 bp, Homo sapiens
gcccttgggacagc

SEQ ID NO: 5620539 - DNA, 22 bp, Homo sapiens
gcccttgggacagccagagctg

SEQ ID NO: 5620540 - DNA, 14 bp, Homo sapiens
gcccttggggcctg

SEQ ID NO: 5620541 - DNA, 15 bp, Homo sapiens
gcccttggggcctgg

SEQ ID NO: 5620542 - DNA, 17 bp, Homo sapiens
gcccttggggcctggct

SEQ ID NO: 5620543 - DNA, 21 bp, Homo sapiens
gcccttgggggtcctcctcca

SEQ ID NO: 5620544 - DNA, 19 bp, Homo sapiens
gcccttgggtccccccgag

SEQ ID NO: 5620545 - DNA, 18 bp, Homo sapiens
gcccttgggtttcctggt

SEQ ID NO: 5620546 - DNA, 20 bp, Homo sapiens
gcccttggtagcagcctggg

SEQ ID NO: 5620547 - DNA, 16 bp, Homo sapiens
gcccttgtcattgcct

SEQ ID NO: 5620548 - DNA, 18 bp, Homo sapiens
gcccttgtcattgccttc

SEQ ID NO: 5620549 - DNA, 24 bp, Homo sapiens
gcccttgtcccactcaagccaagc

SEQ ID NO: 5620550 - DNA, 15 bp, Homo sapiens
gcccttgtccctttt

SEQ ID NO: 5620551 - DNA, 13 bp, Homo sapiens
gcccttgtcctgc

SEQ ID NO: 5620552 - DNA, 16 bp, Homo sapiens
gcccttgtcctgccag

SEQ ID NO: 5620553 - DNA, 20 bp, Homo sapiens
gcccttgtcctgccagctgc

SEQ ID NO: 5620554 - DNA, 22 bp, Homo sapiens
gcccttgtcctgccagctgcct

SEQ ID NO: 5620555 - DNA, 16 bp, Homo sapiens
gcccttgtcggcccca

SEQ ID NO: 5620556 - DNA, 21 bp, Homo sapiens
gcccttgtcggccccaccagt

SEQ ID NO: 5620557 - DNA, 23 bp, Homo sapiens
gcccttgtgaatcaagggtcagg

SEQ ID NO: 5620558 - DNA, 21 bp, Homo sapiens
gcccttgtgtgtgccctgggc

SEQ ID NO: 5620559 - DNA, 22 bp, Homo sapiens
gcccttgtgtgtgccctgggcc

SEQ ID NO: 5620560 - DNA, 22 bp, Homo sapiens
gcccttgttgcctgcacccttc

SEQ ID NO: 5620561 - DNA, 22 bp, Homo sapiens
gcccttgtttacagtgaggact

SEQ ID NO: 5620562 - DNA, 17 bp, Homo sapiens
gcccttgtttggggcag

SEQ ID NO: 5620563 - DNA, 18 bp, Homo sapiens
gcccttgtttggggcagg

SEQ ID NO: 5620564 - DNA, 20 bp, Homo sapiens
gcccttgtttggggcaggag

SEQ ID NO: 5620565 - DNA, 15 bp, Homo sapiens
gccctttaatatttc

SEQ ID NO: 5620566 - DNA, 13 bp, Homo sapiens
gccctttccccac

SEQ ID NO: 5620567 - DNA, 14 bp, Homo sapiens
gccctttccccact

SEQ ID NO: 5620568 - DNA, 12 bp, Homo sapiens
gccctttcccct

SEQ ID NO: 5620569 - DNA, 14 bp, Homo sapiens
gccctttccccttc

SEQ ID NO: 5620570 - DNA, 17 bp, Homo sapiens
gccctttccccttcccc

SEQ ID NO: 5620571 - DNA, 20 bp, Homo sapiens
gccctttcctaggcccaggc

SEQ ID NO: 5620572 - DNA, 16 bp, Homo sapiens
gccctttcctcctcag

SEQ ID NO: 5620573 - DNA, 15 bp, Homo sapiens
gccctttcctggcag

SEQ ID NO: 5620574 - DNA, 16 bp, Homo sapiens
gccctttcctggcagt

SEQ ID NO: 5620575 - DNA, 16 bp, Homo sapiens
gccctttcttgcactg

SEQ ID NO: 5620576 - DNA, 17 bp, Homo sapiens
gccctttgaagcctcag

SEQ ID NO: 5620577 - DNA, 18 bp, Homo sapiens
gccctttgaagcctcagc

SEQ ID NO: 5620578 - DNA, 23 bp, Homo sapiens
gccctttgcaggcccagcagact

SEQ ID NO: 5620579 - DNA, 19 bp, Homo sapiens
gccctttgcagtgtgcagg

SEQ ID NO: 5620580 - DNA, 20 bp, Homo sapiens
gccctttgcatcgtcccctc

SEQ ID NO: 5620581 - DNA, 22 bp, Homo sapiens
gccctttgctgttcgcagcctc

SEQ ID NO: 5620582 - DNA, 15 bp, Homo sapiens
gccctttggccaaca

SEQ ID NO: 5620583 - DNA, 17 bp, Homo sapiens
gccctttggccaacagg

SEQ ID NO: 5620584 - DNA, 13 bp, Homo sapiens
gccctttggcttc

SEQ ID NO: 5620585 - DNA, 17 bp, Homo sapiens
gcccttttacagctctt

SEQ ID NO: 5620586 - DNA, 15 bp, Homo sapiens
gcccttttctggctc

SEQ ID NO: 5620587 - DNA, 16 bp, Homo sapiens
gcccttttctggctcc

SEQ ID NO: 5620588 - DNA, 14 bp, Homo sapiens
gccctttttaagga

SEQ ID NO: 5620589 - DNA, 19 bp, Homo sapiens
gccctttttcccttccctc

SEQ ID NO: 5620590 - DNA, 17 bp, Homo sapiens
gcccttttttctgcctc

SEQ ID NO: 5620591 - DNA, 20 bp, Homo sapiens
gccgaaacccttgactgtta

SEQ ID NO: 5620592 - DNA, 17 bp, Homo sapiens
gccgaacattaggaatt

SEQ ID NO: 5620593 - DNA, 12 bp, Homo sapiens
gccgaaccagga

SEQ ID NO: 5620594 - DNA, 19 bp, Homo sapiens
gccgaaccaggagctgctc

SEQ ID NO: 5620595 - DNA, 18 bp, Homo sapiens
gccgaaccccccactccc

SEQ ID NO: 5620596 - DNA, 15 bp, Homo sapiens
gccgaactccaggct

SEQ ID NO: 5620597 - DNA, 16 bp, Homo sapiens
gccgaactccaggctg

SEQ ID NO: 5620598 - DNA, 22 bp, Homo sapiens
gccgaagaagggtccttccctc

SEQ ID NO: 5620599 - DNA, 13 bp, Homo sapiens
gccgaagcccagg

SEQ ID NO: 5620600 - DNA, 14 bp, Homo sapiens
gccgaagctaacag

SEQ ID NO: 5620601 - DNA, 12 bp, Homo sapiens
gccgaagctctg

SEQ ID NO: 5620602 - DNA, 19 bp, Homo sapiens
gccgaagctctggctgaac

SEQ ID NO: 5620603 - DNA, 16 bp, Homo sapiens
gccgaagggcagcccc

SEQ ID NO: 5620604 - DNA, 15 bp, Homo sapiens
gccgaaggtgcctca

SEQ ID NO: 5620605 - DNA, 16 bp, Homo sapiens
gccgaaggtgcctcag

SEQ ID NO: 5620606 - DNA, 17 bp, Homo sapiens
gccgaaggtgcctcaga

SEQ ID NO: 5620607 - DNA, 19 bp, Homo sapiens
gccgaaggtgcctcagact

SEQ ID NO: 5620608 - DNA, 16 bp, Homo sapiens
gccgaagtccagcttt

SEQ ID NO: 5620609 - DNA, 16 bp, Homo sapiens
gccgaatcccccaggg

SEQ ID NO: 5620610 - DNA, 20 bp, Homo sapiens
gccgaatcccctccctgtca

SEQ ID NO: 5620611 - DNA, 20 bp, Homo sapiens
gccgaatttggtacacatgt

SEQ ID NO: 5620612 - DNA, 20 bp, Homo sapiens
gccgacaccactcctgccag

SEQ ID NO: 5620613 - DNA, 19 bp, Homo sapiens
gccgacatccctcccccag

SEQ ID NO: 5620614 - DNA, 16 bp, Homo sapiens
gccgacattgtctccc

SEQ ID NO: 5620615 - DNA, 17 bp, Homo sapiens
gccgaccagagccccac

SEQ ID NO: 5620616 - DNA, 12 bp, Homo sapiens
gccgaccagagg

SEQ ID NO: 5620617 - DNA, 23 bp, Homo sapiens
gccgaccaggctggacaccctct

SEQ ID NO: 5620618 - DNA, 24 bp, Homo sapiens
gccgaccccctctccctgcatggc

SEQ ID NO: 5620619 - DNA, 22 bp, Homo sapiens
gccgacccctagttccctctgc

SEQ ID NO: 5620620 - DNA, 13 bp, Homo sapiens
gccgaccctcctg

SEQ ID NO: 5620621 - DNA, 22 bp, Homo sapiens
gccgaccgaggctggagctggc

SEQ ID NO: 5620622 - DNA, 16 bp, Homo sapiens
gccgaccgcctgcttc

SEQ ID NO: 5620623 - DNA, 12 bp, Homo sapiens
gccgacctcagc

SEQ ID NO: 5620624 - DNA, 20 bp, Homo sapiens
gccgacctcgtcctccccct

SEQ ID NO: 5620625 - DNA, 12 bp, Homo sapiens
gccgtggagctt

SEQ ID NO: 5620626 - DNA, 15 bp, Homo sapiens
gccgtggagcttgga

SEQ ID NO: 5620627 - DNA, 13 bp, Homo sapiens
gccgtggatggcc

SEQ ID NO: 5620628 - DNA, 19 bp, Homo sapiens
gccgtggccggggtccagg

SEQ ID NO: 5620629 - DNA, 12 bp, Homo sapiens
gccgtggctcca

SEQ ID NO: 5620630 - DNA, 15 bp, Homo sapiens
gccgtggctccagaa

SEQ ID NO: 5620631 - DNA, 14 bp, Homo sapiens
gccgtggctgcggc

SEQ ID NO: 5620632 - DNA, 11 bp, Homo sapiens
gccgtggcttc

SEQ ID NO: 5620633 - DNA, 15 bp, Homo sapiens
gccgtggcttcccgc

SEQ ID NO: 5620634 - DNA, 21 bp, Homo sapiens
gccgtggcttcccgctcagcc

SEQ ID NO: 5620635 - DNA, 12 bp, Homo sapiens
gccgtggcttgg

SEQ ID NO: 5620636 - DNA, 18 bp, Homo sapiens
gccgtgggacccaggctc

SEQ ID NO: 5620637 - DNA, 21 bp, Homo sapiens
gccgtgggacccaggctccca

SEQ ID NO: 5620638 - DNA, 12 bp, Homo sapiens
gccgtgggcccg

SEQ ID NO: 5620639 - DNA, 18 bp, Homo sapiens
gccgtgggccgggaggca

SEQ ID NO: 5620640 - DNA, 23 bp, Homo sapiens
gccgtggggccgccgcctctttc

SEQ ID NO: 5620641 - DNA, 21 bp, Homo sapiens
gccgtggtccaaccaggagct

SEQ ID NO: 5620642 - DNA, 14 bp, Homo sapiens
gccgtggtccctga

SEQ ID NO: 5620643 - DNA, 20 bp, Homo sapiens
gccgtgtaaccatggaccca

SEQ ID NO: 5620644 - DNA, 13 bp, Homo sapiens
gccgtgtattttt

SEQ ID NO: 5620645 - DNA, 22 bp, Homo sapiens
gccgtgtcccgcggtgctgact

SEQ ID NO: 5620646 - DNA, 21 bp, Homo sapiens
gccgtgtctcagcctctgcca

SEQ ID NO: 5620647 - DNA, 19 bp, Homo sapiens
gccgtgtctgtggccctct

SEQ ID NO: 5620648 - DNA, 14 bp, Homo sapiens
gccgtgtgagtgtg

SEQ ID NO: 5620649 - DNA, 19 bp, Homo sapiens
gccgtgtgagtgtgacagg

SEQ ID NO: 5620650 - DNA, 21 bp, Homo sapiens
gccgtgtgtctgtcagcccaa

SEQ ID NO: 5620651 - DNA, 14 bp, Homo sapiens
gccgtgtgtgcatg

SEQ ID NO: 5620652 - DNA, 22 bp, Homo sapiens
gccgtgtgtgcatgtgccgagg

SEQ ID NO: 5620653 - DNA, 23 bp, Homo sapiens
gccgtgtgtgcatgtgccgaggt

SEQ ID NO: 5620654 - DNA, 22 bp, Homo sapiens
gccgtgttttatgactaatcct

SEQ ID NO: 5620655 - DNA, 15 bp, Homo sapiens
gccgttactctccaa

SEQ ID NO: 5620656 - DNA, 18 bp, Homo sapiens
gccgttactctccaacct

SEQ ID NO: 5620657 - DNA, 20 bp, Homo sapiens
gccgttactctccaacctgg

SEQ ID NO: 5620658 - DNA, 14 bp, Homo sapiens
gccgttcagcctgt

SEQ ID NO: 5620659 - DNA, 15 bp, Homo sapiens
gccgttccccttggc

SEQ ID NO: 5620660 - DNA, 12 bp, Homo sapiens
gccgttcctggg

SEQ ID NO: 5620661 - DNA, 12 bp, Homo sapiens
gccgttctgttc

SEQ ID NO: 5620662 - DNA, 18 bp, Homo sapiens
gccgttctgttccaacct

SEQ ID NO: 5620663 - DNA, 21 bp, Homo sapiens
gccgttctgttccaacctcct

SEQ ID NO: 5620664 - DNA, 19 bp, Homo sapiens
gccgttgatgttggctggg

SEQ ID NO: 5620665 - DNA, 19 bp, Homo sapiens
gccgttgattcacttcacg

SEQ ID NO: 5620666 - DNA, 14 bp, Homo sapiens
gccgttgcagacat

SEQ ID NO: 5620667 - DNA, 23 bp, Homo sapiens
gccgttgccaagaactgaaaaca

SEQ ID NO: 5620668 - DNA, 17 bp, Homo sapiens
gccgttgctgacttaga

SEQ ID NO: 5620669 - DNA, 22 bp, Homo sapiens
gccgtttgaatatattttatct

SEQ ID NO: 5620670 - DNA, 14 bp, Homo sapiens
gccgttttcctcat

SEQ ID NO: 5620671 - DNA, 17 bp, Homo sapiens
gccgttttcctcatcct

SEQ ID NO: 5620672 - DNA, 13 bp, Homo sapiens
gccgttttctggg

SEQ ID NO: 5620673 - DNA, 21 bp, Homo sapiens
gcctaaaaattcccttcctgt

SEQ ID NO: 5620674 - DNA, 16 bp, Homo sapiens
gcctaaaagtaaacat

SEQ ID NO: 5620675 - DNA, 13 bp, Homo sapiens
gcctaaaatgttc

SEQ ID NO: 5620676 - DNA, 18 bp, Homo sapiens
gcctaaaattgtatgaaa

SEQ ID NO: 5620677 - DNA, 24 bp, Homo sapiens
gcctaaaattttagatgtagatat

SEQ ID NO: 5620678 - DNA, 15 bp, Homo sapiens
gcctaaacctcagtt

SEQ ID NO: 5620679 - DNA, 23 bp, Homo sapiens
gcctaaagccagcatttcctcag

SEQ ID NO: 5620680 - DNA, 14 bp, Homo sapiens
gcctaaagggcagg

SEQ ID NO: 5620681 - DNA, 22 bp, Homo sapiens
gcctaaagtatacaactgcctg

SEQ ID NO: 5620682 - DNA, 15 bp, Homo sapiens
gcctaaatccaaaga

SEQ ID NO: 5620683 - DNA, 16 bp, Homo sapiens
gcctaaatccaaagaa

SEQ ID NO: 5620684 - DNA, 18 bp, Homo sapiens
gcctaaatttaatgctgc

SEQ ID NO: 5620685 - DNA, 20 bp, Homo sapiens
gcctaaatttaatgctgcct

SEQ ID NO: 5620686 - DNA, 17 bp, Homo sapiens
gcctaaatttattaaat

SEQ ID NO: 5620687 - DNA, 14 bp, Homo sapiens
gcctaaatttcaca

SEQ ID NO: 5620688 - DNA, 18 bp, Homo sapiens
gcctaaccaggcccagcc

SEQ ID NO: 5620689 - DNA, 19 bp, Homo sapiens
gcctaaccaggcccagcca

SEQ ID NO: 5620690 - DNA, 17 bp, Homo sapiens
gcctaaccatgggctca

SEQ ID NO: 5620691 - DNA, 18 bp, Homo sapiens
gcctaaccatgggctcag

SEQ ID NO: 5620692 - DNA, 23 bp, Homo sapiens
gcctaaccatgggctcagggcca

SEQ ID NO: 5620693 - DNA, 20 bp, Homo sapiens
gcctaacccccagcccctcc

SEQ ID NO: 5620694 - DNA, 21 bp, Homo sapiens
gcctaactccctccactaccg

SEQ ID NO: 5620695 - DNA, 19 bp, Homo sapiens
gcctaagaaaatcatcttg

SEQ ID NO: 5620696 - DNA, 24 bp, Homo sapiens
gcctaagaagttattttcttgttt

SEQ ID NO: 5620697 - DNA, 15 bp, Homo sapiens
gcctaagacatgtaa

SEQ ID NO: 5620698 - DNA, 19 bp, Homo sapiens
gcctaagacatgtgaggag

SEQ ID NO: 5620699 - DNA, 17 bp, Homo sapiens
gcctaagaccctgaatc

SEQ ID NO: 5620700 - DNA, 12 bp, Homo sapiens
gcctaagaggct

SEQ ID NO: 5620701 - DNA, 13 bp, Homo sapiens
gcctaagaggctg

SEQ ID NO: 5620702 - DNA, 20 bp, Homo sapiens
gcctaagaggctgccctcct

SEQ ID NO: 5620703 - DNA, 21 bp, Homo sapiens
gcctaagaggctgccctcctg

SEQ ID NO: 5620704 - DNA, 23 bp, Homo sapiens
gcctaaggaagccagtcaccttc

SEQ ID NO: 5620705 - DNA, 13 bp, Homo sapiens
gcctaaggaagct

SEQ ID NO: 5620706 - DNA, 14 bp, Homo sapiens
gcctaaggacttct

SEQ ID NO: 5620707 - DNA, 18 bp, Homo sapiens
gcctaaggacttctttaa

SEQ ID NO: 5620708 - DNA, 22 bp, Homo sapiens
gcctaaggttgtctacgggggc

SEQ ID NO: 5620709 - DNA, 18 bp, Homo sapiens
gcctaagtattaaaacat

SEQ ID NO: 5620710 - DNA, 14 bp, Homo sapiens
gcctaagtgcctct

SEQ ID NO: 5620711 - DNA, 15 bp, Homo sapiens
gcctaagtgcctctt

SEQ ID NO: 5620712 - DNA, 15 bp, Homo sapiens
gcctaataaaactga

SEQ ID NO: 5620713 - DNA, 17 bp, Homo sapiens
gcctaataaaactgatg

SEQ ID NO: 5620714 - DNA, 19 bp, Homo sapiens
gcctaataaaactgatgtg

SEQ ID NO: 5620715 - DNA, 22 bp, Homo sapiens
gcctaataaaactgatgtgaaa

SEQ ID NO: 5620716 - DNA, 16 bp, Homo sapiens
gcctaatacattaaag

SEQ ID NO: 5620717 - DNA, 21 bp, Homo sapiens
gcctaatacattaaagcagtc

SEQ ID NO: 5620718 - DNA, 18 bp, Homo sapiens
gcctaatatgatgactgt

SEQ ID NO: 5620719 - DNA, 19 bp, Homo sapiens
gcctaatattcatgctgcc

SEQ ID NO: 5620720 - DNA, 21 bp, Homo sapiens
gcctaatattcatgctgcctg

SEQ ID NO: 5620721 - DNA, 22 bp, Homo sapiens
gcctaatattcatgctgcctgc

SEQ ID NO: 5620722 - DNA, 15 bp, Homo sapiens
gcctaatattgaaaa

SEQ ID NO: 5620723 - DNA, 23 bp, Homo sapiens
gcctaatattgaaaatgtcactg

SEQ ID NO: 5620724 - DNA, 18 bp, Homo sapiens
gcctaatatttaggcaag

SEQ ID NO: 5620725 - DNA, 23 bp, Homo sapiens
gcctaatatttaggcaagagaaa

SEQ ID NO: 5620726 - DNA, 21 bp, Homo sapiens
gcctaatatttatgactttca

SEQ ID NO: 5620727 - DNA, 16 bp, Homo sapiens
gcctaatccctgggca

SEQ ID NO: 5620728 - DNA, 23 bp, Homo sapiens
gcctaatccctgggcattgcttt

SEQ ID NO: 5620729 - DNA, 20 bp, Homo sapiens
gcctaatcctttagattagg

SEQ ID NO: 5620730 - DNA, 22 bp, Homo sapiens
gcctaatgagagtgcactgctc

SEQ ID NO: 5620731 - DNA, 16 bp, Homo sapiens
gcctaatgcattattt

SEQ ID NO: 5620732 - DNA, 19 bp, Homo sapiens
gcctaatggctttcacttt

SEQ ID NO: 5620733 - DNA, 14 bp, Homo sapiens
gcctaattggaaag

SEQ ID NO: 5620734 - DNA, 14 bp, Homo sapiens
gcctaattgtcaca

SEQ ID NO: 5620735 - DNA, 23 bp, Homo sapiens
gcctaattttttaaagaatccaa

SEQ ID NO: 5620736 - DNA, 19 bp, Homo sapiens
gcctacaaccatccctgcc

SEQ ID NO: 5620737 - DNA, 14 bp, Homo sapiens
gcctacaagctggc

SEQ ID NO: 5620738 - DNA, 17 bp, Homo sapiens
gcctacaataaaaagaa

SEQ ID NO: 5620739 - DNA, 16 bp, Homo sapiens
gcctacactgccagcc

SEQ ID NO: 5620740 - DNA, 14 bp, Homo sapiens
gcctacagatgaac

SEQ ID NO: 5620741 - DNA, 19 bp, Homo sapiens
gcctacagccacatcccca

SEQ ID NO: 5620742 - DNA, 19 bp, Homo sapiens
gcctacatcccgggcctca

SEQ ID NO: 5620743 - DNA, 17 bp, Homo sapiens
gcctacattccctggcc

SEQ ID NO: 5620744 - DNA, 18 bp, Homo sapiens
gcctacattccctggcct

SEQ ID NO: 5620745 - DNA, 18 bp, Homo sapiens
gcctacattttagtttct

SEQ ID NO: 5620746 - DNA, 15 bp, Homo sapiens
gcctaccaatctctg

SEQ ID NO: 5620747 - DNA, 16 bp, Homo sapiens
gcctaccacagctgcc

SEQ ID NO: 5620748 - DNA, 20 bp, Homo sapiens
gcctaccagtcgccctctgt

SEQ ID NO: 5620749 - DNA, 13 bp, Homo sapiens
gcctaccatttca

SEQ ID NO: 5620750 - DNA, 17 bp, Homo sapiens
gcctaccatttcacaga

SEQ ID NO: 5620751 - DNA, 18 bp, Homo sapiens
gcctacccaccccttccc

SEQ ID NO: 5620752 - DNA, 14 bp, Homo sapiens
gcctaccccagttc

SEQ ID NO: 5620753 - DNA, 14 bp, Homo sapiens
gcctaccccctgaa

SEQ ID NO: 5620754 - DNA, 21 bp, Homo sapiens
gcctaccccgcagacaccttg

SEQ ID NO: 5620755 - DNA, 17 bp, Homo sapiens
gcctacccctcctgcgc

SEQ ID NO: 5620756 - DNA, 21 bp, Homo sapiens
gcctacccttgtaccccatcc

SEQ ID NO: 5620757 - DNA, 21 bp, Homo sapiens
gcctaccgctggccctgccgt

SEQ ID NO: 5620758 - DNA, 22 bp, Homo sapiens
gcctaccggcaatttccggcca

SEQ ID NO: 5620759 - DNA, 19 bp, Homo sapiens
gcctaccgggttctcctga

SEQ ID NO: 5620760 - DNA, 16 bp, Homo sapiens
gcctaccgtatttcag

SEQ ID NO: 5620761 - DNA, 23 bp, Homo sapiens
gcctaccgtatttcagccatgat

SEQ ID NO: 5620762 - DNA, 22 bp, Homo sapiens
gcctacctctcgtttctgccca

SEQ ID NO: 5620763 - DNA, 15 bp, Homo sapiens
gcctacctctgtctg

SEQ ID NO: 5620764 - DNA, 20 bp, Homo sapiens
gcctacctctgtctgagaca

SEQ ID NO: 5620765 - DNA, 17 bp, Homo sapiens
gcctaccttcaccacct

SEQ ID NO: 5620766 - DNA, 18 bp, Homo sapiens
gcctaccttcaccaccta

SEQ ID NO: 5620767 - DNA, 20 bp, Homo sapiens
gcctacgttggtgcaagtgt

SEQ ID NO: 5620768 - DNA, 20 bp, Homo sapiens
gcctactatacattaggaag

SEQ ID NO: 5620769 - DNA, 12 bp, Homo sapiens
gcctactcacga

SEQ ID NO: 5620770 - DNA, 17 bp, Homo sapiens
gcctactccaaaatgtt

SEQ ID NO: 5620771 - DNA, 17 bp, Homo sapiens
gcctactctttgttttc

SEQ ID NO: 5620772 - DNA, 19 bp, Homo sapiens
gcctactctttgttttctt

SEQ ID NO: 5620773 - DNA, 17 bp, Homo sapiens
gcctactgcccctgccc

SEQ ID NO: 5620774 - DNA, 20 bp, Homo sapiens
gcctactgcccctgccctga

SEQ ID NO: 5620775 - DNA, 21 bp, Homo sapiens
gcctactgcccctgccctgag

SEQ ID NO: 5620776 - DNA, 16 bp, Homo sapiens
gcctactgtctccttc

SEQ ID NO: 5620777 - DNA, 23 bp, Homo sapiens
gcctactgtctccttcccactgt

SEQ ID NO: 5620778 - DNA, 21 bp, Homo sapiens
gcctactttggggaaataaag

SEQ ID NO: 5620779 - DNA, 15 bp, Homo sapiens
gcctacttttggcct

SEQ ID NO: 5620780 - DNA, 17 bp, Homo sapiens
gcctagaaaatgcaaaa

SEQ ID NO: 5620781 - DNA, 20 bp, Homo sapiens
gcctagaaacaacactgtag

SEQ ID NO: 5620782 - DNA, 13 bp, Homo sapiens
gcctagaaagcaa

SEQ ID NO: 5620783 - DNA, 22 bp, Homo sapiens
gcctagaaagggcaaggggtga

SEQ ID NO: 5620784 - DNA, 19 bp, Homo sapiens
gcctagaaatatctttctc

SEQ ID NO: 5620785 - DNA, 17 bp, Homo sapiens
gcctagaacaagccaga

SEQ ID NO: 5620786 - DNA, 22 bp, Homo sapiens
gcctagaacatccctgggcaag

SEQ ID NO: 5620787 - DNA, 17 bp, Homo sapiens
gcctagaagctggtggc

SEQ ID NO: 5620788 - DNA, 16 bp, Homo sapiens
gcctagaatctttatt

SEQ ID NO: 5620789 - DNA, 16 bp, Homo sapiens
gcctagaccagcagac

SEQ ID NO: 5620790 - DNA, 23 bp, Homo sapiens
gcctagaccagcagacagagcca

SEQ ID NO: 5620791 - DNA, 18 bp, Homo sapiens
gcctagacttcccaacag

SEQ ID NO: 5620792 - DNA, 21 bp, Homo sapiens
gcctagacttcccaacagcct

SEQ ID NO: 5620793 - DNA, 19 bp, Homo sapiens
gcctagaggaggaaaaagg

SEQ ID NO: 5620794 - DNA, 20 bp, Homo sapiens
gcctagatccacgtgtggcc

SEQ ID NO: 5620795 - DNA, 18 bp, Homo sapiens
gcctagcaagctggcctc

SEQ ID NO: 5620796 - DNA, 12 bp, Homo sapiens
gcctagcacagc

SEQ ID NO: 5620797 - DNA, 14 bp, Homo sapiens
gcctagcacagcag

SEQ ID NO: 5620798 - DNA, 17 bp, Homo sapiens
gcctagcactcacatgc

SEQ ID NO: 5620799 - DNA, 12 bp, Homo sapiens
gcctagcatacg

SEQ ID NO: 5620800 - DNA, 19 bp, Homo sapiens
gcctagcatacgtacacat

SEQ ID NO: 5620801 - DNA, 16 bp, Homo sapiens
gcctcatgcctgctga

SEQ ID NO: 5620802 - DNA, 17 bp, Homo sapiens
gcctcatgcctgctgag

SEQ ID NO: 5620803 - DNA, 13 bp, Homo sapiens
gcctcatgctctg

SEQ ID NO: 5620804 - DNA, 14 bp, Homo sapiens
gcctcatggccagc

SEQ ID NO: 5620805 - DNA, 22 bp, Homo sapiens
gcctcatggccagcgcccctca

SEQ ID NO: 5620806 - DNA, 13 bp, Homo sapiens
gcctcatgggagt

SEQ ID NO: 5620807 - DNA, 16 bp, Homo sapiens
gcctcatgtggctgga

SEQ ID NO: 5620808 - DNA, 17 bp, Homo sapiens
gcctcatgtggctggaa

SEQ ID NO: 5620809 - DNA, 17 bp, Homo sapiens
gcctcatgttctcttcc

SEQ ID NO: 5620810 - DNA, 20 bp, Homo sapiens
gcctcatgttctcttcccag

SEQ ID NO: 5620811 - DNA, 21 bp, Homo sapiens
gcctcatgttctcttcccagg

SEQ ID NO: 5620812 - DNA, 13 bp, Homo sapiens
gcctcatgttctg

SEQ ID NO: 5620813 - DNA, 15 bp, Homo sapiens
gcctcatgttctgtg

SEQ ID NO: 5620814 - DNA, 21 bp, Homo sapiens
gcctcattactttaccacccc

SEQ ID NO: 5620815 - DNA, 15 bp, Homo sapiens
gcctcattcagcatg

SEQ ID NO: 5620816 - DNA, 22 bp, Homo sapiens
gcctcattcagcatgggtcctt

SEQ ID NO: 5620817 - DNA, 18 bp, Homo sapiens
gcctcattgtgccaagcc

SEQ ID NO: 5620818 - DNA, 16 bp, Homo sapiens
gcctcattgtgtctcc

SEQ ID NO: 5620819 - DNA, 13 bp, Homo sapiens
gcctcatttccct

SEQ ID NO: 5620820 - DNA, 20 bp, Homo sapiens
gcctcatttcttcctctgca

SEQ ID NO: 5620821 - DNA, 22 bp, Homo sapiens
gcctcatttctttgtctttttc

SEQ ID NO: 5620822 - DNA, 19 bp, Homo sapiens
gcctcattttgcttcccat

SEQ ID NO: 5620823 - DNA, 22 bp, Homo sapiens
gcctcattttgcttcccatctg

SEQ ID NO: 5620824 - DNA, 18 bp, Homo sapiens
gcctccaaagtggagctg

SEQ ID NO: 5620825 - DNA, 22 bp, Homo sapiens
gcctccaaagtggagctgggag

SEQ ID NO: 5620826 - DNA, 23 bp, Homo sapiens
gcctccaaagtggagctgggagg

SEQ ID NO: 5620827 - DNA, 21 bp, Homo sapiens
gcctccaacccctcgcccagt

SEQ ID NO: 5620828 - DNA, 18 bp, Homo sapiens
gcctccaaccttctgccc

SEQ ID NO: 5620829 - DNA, 17 bp, Homo sapiens
gcctccaacgcccctgt

SEQ ID NO: 5620830 - DNA, 12 bp, Homo sapiens
gcctccaagaaa

SEQ ID NO: 5620831 - DNA, 14 bp, Homo sapiens
gcctccaagaaact

SEQ ID NO: 5620832 - DNA, 19 bp, Homo sapiens
gcctccaagcacagagcct

SEQ ID NO: 5620833 - DNA, 23 bp, Homo sapiens
gcctccaagcacagagcctggcc

SEQ ID NO: 5620834 - DNA, 16 bp, Homo sapiens
gcctccaagcctgcct

SEQ ID NO: 5620835 - DNA, 20 bp, Homo sapiens
gcctccaagcctgcctccca

SEQ ID NO: 5620836 - DNA, 17 bp, Homo sapiens
gcctccaagcggccctg

SEQ ID NO: 5620837 - DNA, 22 bp, Homo sapiens
gcctccaaggaggggctgtaaa

SEQ ID NO: 5620838 - DNA, 15 bp, Homo sapiens
gcctccaagggtttc

SEQ ID NO: 5620839 - DNA, 17 bp, Homo sapiens
gcctccaagtcatggga

SEQ ID NO: 5620840 - DNA, 21 bp, Homo sapiens
gcctccaatgcattggcctct

SEQ ID NO: 5620841 - DNA, 20 bp, Homo sapiens
gcctccaattggtgcttcag

SEQ ID NO: 5620842 - DNA, 12 bp, Homo sapiens
gcctccacagcg

SEQ ID NO: 5620843 - DNA, 14 bp, Homo sapiens
gcctccacagcgag

SEQ ID NO: 5620844 - DNA, 21 bp, Homo sapiens
gcctccaccaccactggccac

SEQ ID NO: 5620845 - DNA, 12 bp, Homo sapiens
gcctccaccagc

SEQ ID NO: 5620846 - DNA, 13 bp, Homo sapiens
gcctccaccagca

SEQ ID NO: 5620847 - DNA, 18 bp, Homo sapiens
gcctccaccatccccgca

SEQ ID NO: 5620848 - DNA, 22 bp, Homo sapiens
gcctccacccacagtggagagg

SEQ ID NO: 5620849 - DNA, 21 bp, Homo sapiens
gcctccacccgtcctccctca

SEQ ID NO: 5620850 - DNA, 16 bp, Homo sapiens
gcctccaccctctgag

SEQ ID NO: 5620851 - DNA, 17 bp, Homo sapiens
gcctccaccctctgagc

SEQ ID NO: 5620852 - DNA, 18 bp, Homo sapiens
gcctccaccctctgagct

SEQ ID NO: 5620853 - DNA, 22 bp, Homo sapiens
gcctccaccctctgagctttgc

SEQ ID NO: 5620854 - DNA, 13 bp, Homo sapiens
gcctccaccctgc

SEQ ID NO: 5620855 - DNA, 14 bp, Homo sapiens
gcctccaccctgcc

SEQ ID NO: 5620856 - DNA, 15 bp, Homo sapiens
gcctccaccctgccc

SEQ ID NO: 5620857 - DNA, 17 bp, Homo sapiens
gcctccaccctgccctg

SEQ ID NO: 5620858 - DNA, 21 bp, Homo sapiens
gcctccaccctgccctgctga

SEQ ID NO: 5620859 - DNA, 18 bp, Homo sapiens
gcctccaccgagccagct

SEQ ID NO: 5620860 - DNA, 12 bp, Homo sapiens
gcctccacctct

SEQ ID NO: 5620861 - DNA, 18 bp, Homo sapiens
gcctccacctctccttgg

SEQ ID NO: 5620862 - DNA, 13 bp, Homo sapiens
gcctccacctctg

SEQ ID NO: 5620863 - DNA, 14 bp, Homo sapiens
gcctccacctctgt

SEQ ID NO: 5620864 - DNA, 14 bp, Homo sapiens
gcctccacctgcag

SEQ ID NO: 5620865 - DNA, 17 bp, Homo sapiens
gcctccacctgcagccc

SEQ ID NO: 5620866 - DNA, 21 bp, Homo sapiens
gcctccacctgcagccccagg

SEQ ID NO: 5620867 - DNA, 14 bp, Homo sapiens
gcctccacgggggc

SEQ ID NO: 5620868 - DNA, 12 bp, Homo sapiens
gcctccactccc

SEQ ID NO: 5620869 - DNA, 15 bp, Homo sapiens
gcctccactccctgt

SEQ ID NO: 5620870 - DNA, 17 bp, Homo sapiens
gcctccactccctgtct

SEQ ID NO: 5620871 - DNA, 19 bp, Homo sapiens
gcctccactctagttctag

SEQ ID NO: 5620872 - DNA, 19 bp, Homo sapiens
gcctccagaactcactggg

SEQ ID NO: 5620873 - DNA, 16 bp, Homo sapiens
gcctccagagccagcc

SEQ ID NO: 5620874 - DNA, 24 bp, Homo sapiens
gcctccagagccagcctgggactc

SEQ ID NO: 5620875 - DNA, 16 bp, Homo sapiens
gcctccagaggtcctc

SEQ ID NO: 5620876 - DNA, 20 bp, Homo sapiens
gcctccagcacatgcggctt

SEQ ID NO: 5620877 - DNA, 15 bp, Homo sapiens
gcctccagcaccaag

SEQ ID NO: 5620878 - DNA, 20 bp, Homo sapiens
gcctccagccaaacgggagc

SEQ ID NO: 5620879 - DNA, 11 bp, Homo sapiens
gcctccagcct

SEQ ID NO: 5620880 - DNA, 14 bp, Homo sapiens
gcctccagcctctc

SEQ ID NO: 5620881 - DNA, 18 bp, Homo sapiens
gcctccagcctctcccgg

SEQ ID NO: 5620882 - DNA, 20 bp, Homo sapiens
gcctccagcctctcccggct

SEQ ID NO: 5620883 - DNA, 22 bp, Homo sapiens
gcctccagcctctcccggctgc

SEQ ID NO: 5620884 - DNA, 16 bp, Homo sapiens
gcctccagcctgccca

SEQ ID NO: 5620885 - DNA, 13 bp, Homo sapiens
gcctccagcctgg

SEQ ID NO: 5620886 - DNA, 22 bp, Homo sapiens
gcctccagcctttgctccctcc

SEQ ID NO: 5620887 - DNA, 18 bp, Homo sapiens
gcctccagctgccccggg

SEQ ID NO: 5620888 - DNA, 16 bp, Homo sapiens
gcctccagctgttctt

SEQ ID NO: 5620889 - DNA, 19 bp, Homo sapiens
gcctccaggaccaggggcc

SEQ ID NO: 5620890 - DNA, 20 bp, Homo sapiens
gcctccaggagcctaccccc

SEQ ID NO: 5620891 - DNA, 15 bp, Homo sapiens
gcctccaggaggggc

SEQ ID NO: 5620892 - DNA, 20 bp, Homo sapiens
gcctccaggcaggacgagac

SEQ ID NO: 5620893 - DNA, 24 bp, Homo sapiens
gcctccaggcaggacgagactcct

SEQ ID NO: 5620894 - DNA, 21 bp, Homo sapiens
gcctccaggcccgtctgtcca

SEQ ID NO: 5620895 - DNA, 12 bp, Homo sapiens
gcctccaggctg

SEQ ID NO: 5620896 - DNA, 15 bp, Homo sapiens
gcctccaggctgggg

SEQ ID NO: 5620897 - DNA, 11 bp, Homo sapiens
gcctccagggc

SEQ ID NO: 5620898 - DNA, 12 bp, Homo sapiens
gcctccagggca

SEQ ID NO: 5620899 - DNA, 18 bp, Homo sapiens
gcctccagggcattgctc

SEQ ID NO: 5620900 - DNA, 12 bp, Homo sapiens
gcctccagggcc

SEQ ID NO: 5620901 - DNA, 21 bp, Homo sapiens
gcctccagggcgcaggggagg

SEQ ID NO: 5620902 - DNA, 13 bp, Homo sapiens
gcctccagggctg

SEQ ID NO: 5620903 - DNA, 21 bp, Homo sapiens
gcctccagggctggactgagg

SEQ ID NO: 5620904 - DNA, 24 bp, Homo sapiens
gcctccagggctggactgaggcct

SEQ ID NO: 5620905 - DNA, 12 bp, Homo sapiens
gcctccaggtgt

SEQ ID NO: 5620906 - DNA, 21 bp, Homo sapiens
gcctccaggttgcctcaacag

SEQ ID NO: 5620907 - DNA, 18 bp, Homo sapiens
gcctccagtcatggtact

SEQ ID NO: 5620908 - DNA, 20 bp, Homo sapiens
gcctccagtctgctctcagc

SEQ ID NO: 5620909 - DNA, 14 bp, Homo sapiens
gcctccagtgcagt

SEQ ID NO: 5620910 - DNA, 15 bp, Homo sapiens
gcctccagtgctggc

SEQ ID NO: 5620911 - DNA, 19 bp, Homo sapiens
gcctccagtgctggctgct

SEQ ID NO: 5620912 - DNA, 22 bp, Homo sapiens
gcctccagtgctggctgctggc

SEQ ID NO: 5620913 - DNA, 21 bp, Homo sapiens
gcctccagtgggaggacagag

SEQ ID NO: 5620914 - DNA, 20 bp, Homo sapiens
gcctccatccatctgtccgt

SEQ ID NO: 5620915 - DNA, 15 bp, Homo sapiens
gcctccatcctcatc

SEQ ID NO: 5620916 - DNA, 20 bp, Homo sapiens
gcctccatcctgaggctcca

SEQ ID NO: 5620917 - DNA, 11 bp, Homo sapiens
gcctccatctc

SEQ ID NO: 5620918 - DNA, 15 bp, Homo sapiens
gcctccatgccccag

SEQ ID NO: 5620919 - DNA, 17 bp, Homo sapiens
gcctccatgccccagct

SEQ ID NO: 5620920 - DNA, 18 bp, Homo sapiens
gcctccatggcagcagcc

SEQ ID NO: 5620921 - DNA, 21 bp, Homo sapiens
gcctccatggcagcagccagg

SEQ ID NO: 5620922 - DNA, 18 bp, Homo sapiens
gcctccatggtgcctctg

SEQ ID NO: 5620923 - DNA, 16 bp, Homo sapiens
gcctccatgttttaat

SEQ ID NO: 5620924 - DNA, 19 bp, Homo sapiens
gcctccattatccattccc

SEQ ID NO: 5620925 - DNA, 22 bp, Homo sapiens
gcctccattatccattcccaag

SEQ ID NO: 5620926 - DNA, 18 bp, Homo sapiens
gcctccattcctggagcc

SEQ ID NO: 5620927 - DNA, 21 bp, Homo sapiens
gcctccattcctggagcccga

SEQ ID NO: 5620928 - DNA, 17 bp, Homo sapiens
gcctccatttagttctt

SEQ ID NO: 5620929 - DNA, 13 bp, Homo sapiens
gcctcccaaagtg

SEQ ID NO: 5620930 - DNA, 20 bp, Homo sapiens
gcctcccaaagtgctgggat

SEQ ID NO: 5620931 - DNA, 21 bp, Homo sapiens
gcctcccaaatatgcccctcc

SEQ ID NO: 5620932 - DNA, 16 bp, Homo sapiens
gcctcccaactcaccc

SEQ ID NO: 5620933 - DNA, 14 bp, Homo sapiens
gcctcccaagcagc

SEQ ID NO: 5620934 - DNA, 20 bp, Homo sapiens
gcctcccaagcagctgaagg

SEQ ID NO: 5620935 - DNA, 19 bp, Homo sapiens
gcctcccaaggtcctctca

SEQ ID NO: 5620936 - DNA, 16 bp, Homo sapiens
gcctcccaagtagctg

SEQ ID NO: 5620937 - DNA, 18 bp, Homo sapiens
gcctcccaagtagctggg

SEQ ID NO: 5620938 - DNA, 16 bp, Homo sapiens
gcctcccaataaagct

SEQ ID NO: 5620939 - DNA, 22 bp, Homo sapiens
gcctcccacactgaaaccaaaa

SEQ ID NO: 5620940 - DNA, 20 bp, Homo sapiens
gcctcccacacttgctgggg

SEQ ID NO: 5620941 - DNA, 22 bp, Homo sapiens
gcctcccacacttgctggggct

SEQ ID NO: 5620942 - DNA, 14 bp, Homo sapiens
gcctcccacagtga

SEQ ID NO: 5620943 - DNA, 16 bp, Homo sapiens
gcctcccacagtgctg

SEQ ID NO: 5620944 - DNA, 17 bp, Homo sapiens
gcctcccacagtgctgg

SEQ ID NO: 5620945 - DNA, 15 bp, Homo sapiens
gcctcccaccagagc

SEQ ID NO: 5620946 - DNA, 22 bp, Homo sapiens
gcctcccaccagagccgggagg

SEQ ID NO: 5620947 - DNA, 20 bp, Homo sapiens
gcctcccacccgatgctgct

SEQ ID NO: 5620948 - DNA, 21 bp, Homo sapiens
gcctcccacccgatgctgctt

SEQ ID NO: 5620949 - DNA, 23 bp, Homo sapiens
gcctcccacccgatgctgctttc

SEQ ID NO: 5620950 - DNA, 15 bp, Homo sapiens
gcctcccacgctggg

SEQ ID NO: 5620951 - DNA, 13 bp, Homo sapiens
gcctcccacggca

SEQ ID NO: 5620952 - DNA, 14 bp, Homo sapiens
gcctcccacggcac

SEQ ID NO: 5620953 - DNA, 16 bp, Homo sapiens
gcctcccactcccatg

SEQ ID NO: 5620954 - DNA, 21 bp, Homo sapiens
gcctcccactcccatggctct

SEQ ID NO: 5620955 - DNA, 17 bp, Homo sapiens
gcctcccactcctgttc

SEQ ID NO: 5620956 - DNA, 12 bp, Homo sapiens
gcctcccactgg

SEQ ID NO: 5620957 - DNA, 13 bp, Homo sapiens
gcctcccactggg

SEQ ID NO: 5620958 - DNA, 13 bp, Homo sapiens
gcctcccagagtg

SEQ ID NO: 5620959 - DNA, 12 bp, Homo sapiens
gcctcccagcca

SEQ ID NO: 5620960 - DNA, 13 bp, Homo sapiens
gcctcccagccac

SEQ ID NO: 5620961 - DNA, 14 bp, Homo sapiens
gcctcccagccacc

SEQ ID NO: 5620962 - DNA, 13 bp, Homo sapiens
gcctcccagcccc

SEQ ID NO: 5620963 - DNA, 14 bp, Homo sapiens
gcctcccagccctg

SEQ ID NO: 5620964 - DNA, 18 bp, Homo sapiens
gcctcccagccctgccag

SEQ ID NO: 5620965 - DNA, 21 bp, Homo sapiens
gcctcccagccctgccaggag

SEQ ID NO: 5620966 - DNA, 19 bp, Homo sapiens
gcctcccagccctgcccag

SEQ ID NO: 5620967 - DNA, 14 bp, Homo sapiens
gcctcccagcctgg

SEQ ID NO: 5620968 - DNA, 12 bp, Homo sapiens
gcctcccagcta

SEQ ID NO: 5620969 - DNA, 20 bp, Homo sapiens
gcctcccaggcaagcagctg

SEQ ID NO: 5620970 - DNA, 12 bp, Homo sapiens
gcctcccaggtt

SEQ ID NO: 5620971 - DNA, 18 bp, Homo sapiens
gcctcccaggttcaagca

SEQ ID NO: 5620972 - DNA, 14 bp, Homo sapiens
gcctcccagtggcc

SEQ ID NO: 5620973 - DNA, 14 bp, Homo sapiens
gcctcccatagctg

SEQ ID NO: 5620974 - DNA, 16 bp, Homo sapiens
gcctcccatcacccgc

SEQ ID NO: 5620975 - DNA, 15 bp, Homo sapiens
gcctcccatccaggg

SEQ ID NO: 5620976 - DNA, 14 bp, Homo sapiens
gcctcccatgttca

SEQ ID NO: 5620977 - DNA, 22 bp, Homo sapiens
gcctcccattcactagaaaatg

SEQ ID NO: 5620978 - DNA, 17 bp, Homo sapiens
gcctccccaaccctgcc

SEQ ID NO: 5620979 - DNA, 17 bp, Homo sapiens
gcctgacgctcagcccc

SEQ ID NO: 5620980 - DNA, 20 bp, Homo sapiens
gcctgacgctcagccccagg

SEQ ID NO: 5620981 - DNA, 20 bp, Homo sapiens
gcctgacgtgggcatcattt

SEQ ID NO: 5620982 - DNA, 20 bp, Homo sapiens
gcctgactagggagccatgt

SEQ ID NO: 5620983 - DNA, 15 bp, Homo sapiens
gcctgactcctgggt

SEQ ID NO: 5620984 - DNA, 22 bp, Homo sapiens
gcctgactgcacacagctaggc

SEQ ID NO: 5620985 - DNA, 16 bp, Homo sapiens
gcctgactgccaggac

SEQ ID NO: 5620986 - DNA, 13 bp, Homo sapiens
gcctgactgctca

SEQ ID NO: 5620987 - DNA, 14 bp, Homo sapiens
gcctgactgctcgg

SEQ ID NO: 5620988 - DNA, 14 bp, Homo sapiens
gcctgacttgagcc

SEQ ID NO: 5620989 - DNA, 13 bp, Homo sapiens
gcctgacttgggg

SEQ ID NO: 5620990 - DNA, 22 bp, Homo sapiens
gcctgagaaacactatttgtga

SEQ ID NO: 5620991 - DNA, 23 bp, Homo sapiens
gcctgagaaacactatttgtgac

SEQ ID NO: 5620992 - DNA, 17 bp, Homo sapiens
gcctgagaagaagtggc

SEQ ID NO: 5620993 - DNA, 16 bp, Homo sapiens
gcctgagaaggggcag

SEQ ID NO: 5620994 - DNA, 16 bp, Homo sapiens
gcctgagaatgacctg

SEQ ID NO: 5620995 - DNA, 13 bp, Homo sapiens
gcctgagaatgag

SEQ ID NO: 5620996 - DNA, 21 bp, Homo sapiens
gcctgagaatgcctaggccag

SEQ ID NO: 5620997 - DNA, 22 bp, Homo sapiens
gcctgagaatgcctaggccagc

SEQ ID NO: 5620998 - DNA, 13 bp, Homo sapiens
gcctgagacagca

SEQ ID NO: 5620999 - DNA, 12 bp, Homo sapiens
gcctgagaccag

SEQ ID NO: 5621000 - DNA, 16 bp, Homo sapiens
gcctgagaccagggtg

SEQ ID NO: 5621001 - DNA, 17 bp, Homo sapiens
gcctgagaccagggtgg

SEQ ID NO: 5621002 - DNA, 19 bp, Homo sapiens
gcctgagagacatggcttt

SEQ ID NO: 5621003 - DNA, 18 bp, Homo sapiens
gcctgagagctggcccag

SEQ ID NO: 5621004 - DNA, 19 bp, Homo sapiens
gcctgagagctggcccagg

SEQ ID NO: 5621005 - DNA, 22 bp, Homo sapiens
gcctgagaggcaggcatagagg

SEQ ID NO: 5621006 - DNA, 21 bp, Homo sapiens
gcctgagatacaaggcccaga

SEQ ID NO: 5621007 - DNA, 22 bp, Homo sapiens
gcctgagatgtaggctccacct

SEQ ID NO: 5621008 - DNA, 18 bp, Homo sapiens
gcctgagattctttaagg

SEQ ID NO: 5621009 - DNA, 21 bp, Homo sapiens
gcctgagattctttaaggaga

SEQ ID NO: 5621010 - DNA, 16 bp, Homo sapiens
gcctgagatttcatct

SEQ ID NO: 5621011 - DNA, 21 bp, Homo sapiens
gcctgagcaacatctcgggag

SEQ ID NO: 5621012 - DNA, 16 bp, Homo sapiens
gcctgagcagtccttg

SEQ ID NO: 5621013 - DNA, 22 bp, Homo sapiens
gcctgagcatccagacctgagc

SEQ ID NO: 5621014 - DNA, 12 bp, Homo sapiens
gcctgagccaca

SEQ ID NO: 5621015 - DNA, 14 bp, Homo sapiens
gcctgagccacagt

SEQ ID NO: 5621016 - DNA, 18 bp, Homo sapiens
gcctgagccacagtgggg

SEQ ID NO: 5621017 - DNA, 20 bp, Homo sapiens
gcctgagccacagtggggcc

SEQ ID NO: 5621018 - DNA, 21 bp, Homo sapiens
gcctgagccacagtggggccc

SEQ ID NO: 5621019 - DNA, 14 bp, Homo sapiens
gcctgagcccaggg

SEQ ID NO: 5621020 - DNA, 16 bp, Homo sapiens
gcctgagcccagggag

SEQ ID NO: 5621021 - DNA, 19 bp, Homo sapiens
gcctgagcccagggaggcc

SEQ ID NO: 5621022 - DNA, 13 bp, Homo sapiens
gcctgagcccctc

SEQ ID NO: 5621023 - DNA, 22 bp, Homo sapiens
gcctgagcccctcagacagccc

SEQ ID NO: 5621024 - DNA, 22 bp, Homo sapiens
gcctgagccctactccctgcag

SEQ ID NO: 5621025 - DNA, 14 bp, Homo sapiens
gcctgagcctggcc

SEQ ID NO: 5621026 - DNA, 22 bp, Homo sapiens
gcctgagcgcagcgcctccacc

SEQ ID NO: 5621027 - DNA, 23 bp, Homo sapiens
gcctgagcgcagcgcctccaccc

SEQ ID NO: 5621028 - DNA, 16 bp, Homo sapiens
gcctgagctccaccct

SEQ ID NO: 5621029 - DNA, 19 bp, Homo sapiens
gcctgagctccaccctccc

SEQ ID NO: 5621030 - DNA, 21 bp, Homo sapiens
gcctgagctccaccctcccct

SEQ ID NO: 5621031 - DNA, 23 bp, Homo sapiens
gcctgagctccaccctcccctct

SEQ ID NO: 5621032 - DNA, 13 bp, Homo sapiens
gcctgagctgggg

SEQ ID NO: 5621033 - DNA, 14 bp, Homo sapiens
gcctgagctggggc

SEQ ID NO: 5621034 - DNA, 16 bp, Homo sapiens
gcctgagctggggcca

SEQ ID NO: 5621035 - DNA, 19 bp, Homo sapiens
gcctgagctggggccacaa

SEQ ID NO: 5621036 - DNA, 21 bp, Homo sapiens
gcctgagctggggcctggaga

SEQ ID NO: 5621037 - DNA, 23 bp, Homo sapiens
gcctgagctggggcctggagagg

SEQ ID NO: 5621038 - DNA, 21 bp, Homo sapiens
gcctgaggacagaaagaccct

SEQ ID NO: 5621039 - DNA, 12 bp, Homo sapiens
gcctgaggagga

SEQ ID NO: 5621040 - DNA, 19 bp, Homo sapiens
gcctgaggagtggcaggaa

SEQ ID NO: 5621041 - DNA, 14 bp, Homo sapiens
gcctgaggatgagc

SEQ ID NO: 5621042 - DNA, 18 bp, Homo sapiens
gcctgaggatgagctgga

SEQ ID NO: 5621043 - DNA, 21 bp, Homo sapiens
gcctgaggatgagctggaagg

SEQ ID NO: 5621044 - DNA, 14 bp, Homo sapiens
gcctgaggcaggag

SEQ ID NO: 5621045 - DNA, 17 bp, Homo sapiens
gcctgaggcaggagaat

SEQ ID NO: 5621046 - DNA, 17 bp, Homo sapiens
gcctgaggcctgtgcct

SEQ ID NO: 5621047 - DNA, 16 bp, Homo sapiens
gcctgaggctcaagag

SEQ ID NO: 5621048 - DNA, 19 bp, Homo sapiens
gcctgaggctcaagaggcc

SEQ ID NO: 5621049 - DNA, 20 bp, Homo sapiens
gcctgaggctcaagaggccc

SEQ ID NO: 5621050 - DNA, 21 bp, Homo sapiens
gcctgaggctcaagaggccca

SEQ ID NO: 5621051 - DNA, 13 bp, Homo sapiens
gcctgaggctgag

SEQ ID NO: 5621052 - DNA, 17 bp, Homo sapiens
gcctgaggctggctggg

SEQ ID NO: 5621053 - DNA, 15 bp, Homo sapiens
gcctgagggaaaggc

SEQ ID NO: 5621054 - DNA, 20 bp, Homo sapiens
gcctgagggaaaggccagca

SEQ ID NO: 5621055 - DNA, 22 bp, Homo sapiens
gcctgagggaagcccacccgcc

SEQ ID NO: 5621056 - DNA, 16 bp, Homo sapiens
gcctgagggcccctct

SEQ ID NO: 5621057 - DNA, 17 bp, Homo sapiens
gcctgagggcccctctg

SEQ ID NO: 5621058 - DNA, 12 bp, Homo sapiens
gcctgaggggaa

SEQ ID NO: 5621059 - DNA, 19 bp, Homo sapiens
gcctgaggggaaagagaga

SEQ ID NO: 5621060 - DNA, 12 bp, Homo sapiens
gcctgaggggca

SEQ ID NO: 5621061 - DNA, 19 bp, Homo sapiens
gcctgaggggcagcctgcc

SEQ ID NO: 5621062 - DNA, 16 bp, Homo sapiens
gcctgaggtcccctcg

SEQ ID NO: 5621063 - DNA, 16 bp, Homo sapiens
gcctgagtagaaaggc

SEQ ID NO: 5621064 - DNA, 18 bp, Homo sapiens
gcctgagtcagggcccag

SEQ ID NO: 5621065 - DNA, 17 bp, Homo sapiens
gcctgagtcagtgctct

SEQ ID NO: 5621066 - DNA, 13 bp, Homo sapiens
gcctgagtcctgg

SEQ ID NO: 5621067 - DNA, 15 bp, Homo sapiens
gcctgagtctcctgt

SEQ ID NO: 5621068 - DNA, 16 bp, Homo sapiens
gcctgagtgagtgtgt

SEQ ID NO: 5621069 - DNA, 21 bp, Homo sapiens
gcctgagtgagtgtgtgtgct

SEQ ID NO: 5621070 - DNA, 23 bp, Homo sapiens
gcctgagtgagtgtgtgtgcttg

SEQ ID NO: 5621071 - DNA, 15 bp, Homo sapiens
gcctgagtgcctggc

SEQ ID NO: 5621072 - DNA, 20 bp, Homo sapiens
gcctgagtggtgaggggcca

SEQ ID NO: 5621073 - DNA, 23 bp, Homo sapiens
gcctgagtggtgaggggccactg

SEQ ID NO: 5621074 - DNA, 14 bp, Homo sapiens
gcctgagttataaa

SEQ ID NO: 5621075 - DNA, 15 bp, Homo sapiens
gcctgagttgagggg

SEQ ID NO: 5621076 - DNA, 13 bp, Homo sapiens
gcctgagtttcca

SEQ ID NO: 5621077 - DNA, 15 bp, Homo sapiens
gcctgataccctgct

SEQ ID NO: 5621078 - DNA, 20 bp, Homo sapiens
gcctgatcagaccacggctc

SEQ ID NO: 5621079 - DNA, 14 bp, Homo sapiens
gcctgatcagcagg

SEQ ID NO: 5621080 - DNA, 21 bp, Homo sapiens
gcctgatctctgctccctgca

SEQ ID NO: 5621081 - DNA, 15 bp, Homo sapiens
gcctgatctcttcct

SEQ ID NO: 5621082 - DNA, 17 bp, Homo sapiens
gcctgatctcttcctgt

SEQ ID NO: 5621083 - DNA, 23 bp, Homo sapiens
gcctgatctgcccatcgtgaaga

SEQ ID NO: 5621084 - DNA, 19 bp, Homo sapiens
gcctgatgagactccactc

SEQ ID NO: 5621085 - DNA, 19 bp, Homo sapiens
gcctgatgagatttttaaa

SEQ ID NO: 5621086 - DNA, 20 bp, Homo sapiens
gcctgatgctccctcccctg

SEQ ID NO: 5621087 - DNA, 15 bp, Homo sapiens
gcctgatgctgcccc

SEQ ID NO: 5621088 - DNA, 16 bp, Homo sapiens
gcctgatggagaggag

SEQ ID NO: 5621089 - DNA, 14 bp, Homo sapiens
gcctgatggccaag

SEQ ID NO: 5621090 - DNA, 19 bp, Homo sapiens
gcctgatggccaagggggt

SEQ ID NO: 5621091 - DNA, 13 bp, Homo sapiens
gcctgatggccag

SEQ ID NO: 5621092 - DNA, 22 bp, Homo sapiens
gcctgatgggagtaggctccag

SEQ ID NO: 5621093 - DNA, 24 bp, Homo sapiens
gcctgatgggagtaggctccagac

SEQ ID NO: 5621094 - DNA, 17 bp, Homo sapiens
gcctgatggggagggtc

SEQ ID NO: 5621095 - DNA, 20 bp, Homo sapiens
gcctgatggtgctgctcagg

SEQ ID NO: 5621096 - DNA, 23 bp, Homo sapiens
gcctgatggtggggccataccca

SEQ ID NO: 5621097 - DNA, 16 bp, Homo sapiens
gcctgattaaagaatg

SEQ ID NO: 5621098 - DNA, 17 bp, Homo sapiens
gcctgattcactggcct

SEQ ID NO: 5621099 - DNA, 17 bp, Homo sapiens
gcctgattcggacggcc

SEQ ID NO: 5621100 - DNA, 18 bp, Homo sapiens
gcctgattcggacggcca

SEQ ID NO: 5621101 - DNA, 14 bp, Homo sapiens
gcctgattcggggc

SEQ ID NO: 5621102 - DNA, 21 bp, Homo sapiens
gcctgattcggggctgacctt

SEQ ID NO: 5621103 - DNA, 19 bp, Homo sapiens
gcctgattgccaagctcag

SEQ ID NO: 5621104 - DNA, 16 bp, Homo sapiens
gcctgatttcattcct

SEQ ID NO: 5621105 - DNA, 16 bp, Homo sapiens
gcctgcaaacgctgcc

SEQ ID NO: 5621106 - DNA, 23 bp, Homo sapiens
gcctgcaaactgggaaccccttt

SEQ ID NO: 5621107 - DNA, 17 bp, Homo sapiens
gcctgcaaatctagtgc

SEQ ID NO: 5621108 - DNA, 18 bp, Homo sapiens
gcctgcaagagaatctga

SEQ ID NO: 5621109 - DNA, 15 bp, Homo sapiens
gcctgcaatttcata

SEQ ID NO: 5621110 - DNA, 11 bp, Homo sapiens
gcctgcacaca

SEQ ID NO: 5621111 - DNA, 20 bp, Homo sapiens
gcctgcacacacctgcctgc

SEQ ID NO: 5621112 - DNA, 15 bp, Homo sapiens
gcctgcacacagagt

SEQ ID NO: 5621113 - DNA, 21 bp, Homo sapiens
gcctgcacagatacctcatca

SEQ ID NO: 5621114 - DNA, 15 bp, Homo sapiens
gcctgcaccaggaga

SEQ ID NO: 5621115 - DNA, 23 bp, Homo sapiens
gcctgcacccttccacagctggc

SEQ ID NO: 5621116 - DNA, 15 bp, Homo sapiens
gcctgcacccttcct

SEQ ID NO: 5621117 - DNA, 19 bp, Homo sapiens
gcctgcacccttcctcctc

SEQ ID NO: 5621118 - DNA, 23 bp, Homo sapiens
gcctgcaccgaccccgggccgga

SEQ ID NO: 5621119 - DNA, 23 bp, Homo sapiens
gcctgcaccgacccgaggcccag

SEQ ID NO: 5621120 - DNA, 13 bp, Homo sapiens
gcctgcacctgcc

SEQ ID NO: 5621121 - DNA, 16 bp, Homo sapiens
gcctgcacctgccccg

SEQ ID NO: 5621122 - DNA, 18 bp, Homo sapiens
gcctgcacctgccccgtg

SEQ ID NO: 5621123 - DNA, 15 bp, Homo sapiens
gcctgcacctggtgg

SEQ ID NO: 5621124 - DNA, 15 bp, Homo sapiens
gcctgcacctttcgg

SEQ ID NO: 5621125 - DNA, 21 bp, Homo sapiens
gcctgcacctttcggcagagg

SEQ ID NO: 5621126 - DNA, 23 bp, Homo sapiens
gcctgcacggtgaatggctttgt

SEQ ID NO: 5621127 - DNA, 14 bp, Homo sapiens
gcctgcactccctg

SEQ ID NO: 5621128 - DNA, 18 bp, Homo sapiens
gcctgcactccctggcct

SEQ ID NO: 5621129 - DNA, 19 bp, Homo sapiens
gcctgcactgagagggcaa

SEQ ID NO: 5621130 - DNA, 19 bp, Homo sapiens
gcctgcactgggaaggaaa

SEQ ID NO: 5621131 - DNA, 15 bp, Homo sapiens
gcctgcagaccctgc

SEQ ID NO: 5621132 - DNA, 18 bp, Homo sapiens
gcctgcagaccctgccag

SEQ ID NO: 5621133 - DNA, 20 bp, Homo sapiens
gcctgcagaccctgccaggg

SEQ ID NO: 5621134 - DNA, 16 bp, Homo sapiens
gcctgcagactcactg

SEQ ID NO: 5621135 - DNA, 11 bp, Homo sapiens
gcctgcagaga

SEQ ID NO: 5621136 - DNA, 14 bp, Homo sapiens
gcctgcagagagaa

SEQ ID NO: 5621137 - DNA, 19 bp, Homo sapiens
gcctgcagaggacagagct

SEQ ID NO: 5621138 - DNA, 20 bp, Homo sapiens
gcctgcagaggtctgtgctg

SEQ ID NO: 5621139 - DNA, 12 bp, Homo sapiens
gcctgcagcagg

SEQ ID NO: 5621140 - DNA, 13 bp, Homo sapiens
gcctgcagccagg

SEQ ID NO: 5621141 - DNA, 15 bp, Homo sapiens
gcctgcagccagggc

SEQ ID NO: 5621142 - DNA, 13 bp, Homo sapiens
gcctgcagcccag

SEQ ID NO: 5621143 - DNA, 14 bp, Homo sapiens
gcctgcagcccaga

SEQ ID NO: 5621144 - DNA, 20 bp, Homo sapiens
gcctgcagcccctaagtgca

SEQ ID NO: 5621145 - DNA, 18 bp, Homo sapiens
gcctgcagcgagctgaga

SEQ ID NO: 5621146 - DNA, 13 bp, Homo sapiens
gcctgcagcgcct

SEQ ID NO: 5621147 - DNA, 18 bp, Homo sapiens
gcctgcagcggcacaaat

SEQ ID NO: 5621148 - DNA, 14 bp, Homo sapiens
gcctgcaggacctg

SEQ ID NO: 5621149 - DNA, 17 bp, Homo sapiens
gcctgcaggacctgcct

SEQ ID NO: 5621150 - DNA, 18 bp, Homo sapiens
gcctgcaggacctgcctg

SEQ ID NO: 5621151 - DNA, 22 bp, Homo sapiens
gcctgcaggacctgcctgtagc

SEQ ID NO: 5621152 - DNA, 13 bp, Homo sapiens
gcctgcaggagaa

SEQ ID NO: 5621153 - DNA, 22 bp, Homo sapiens
gcctgcaggagagagcagcact

SEQ ID NO: 5621154 - DNA, 23 bp, Homo sapiens
gcctgcaggatctcaccaggcag

SEQ ID NO: 5621155 - DNA, 15 bp, Homo sapiens
gcctgcaggcagagc

SEQ ID NO: 5621156 - DNA, 20 bp, Homo sapiens
gcctggagacaaggtgctaa

SEQ ID NO: 5621157 - DNA, 24 bp, Homo sapiens
gcctggagacccaccccacctgca

SEQ ID NO: 5621158 - DNA, 16 bp, Homo sapiens
gcctggagaggcctgg

SEQ ID NO: 5621159 - DNA, 18 bp, Homo sapiens
gcctggagaggcctgggg

SEQ ID NO: 5621160 - DNA, 13 bp, Homo sapiens
gcctggagagggg

SEQ ID NO: 5621161 - DNA, 20 bp, Homo sapiens
gcctggagaggggcctggga

SEQ ID NO: 5621162 - DNA, 22 bp, Homo sapiens
gcctggagagggtctcgctgtc

SEQ ID NO: 5621163 - DNA, 20 bp, Homo sapiens
gcctggagatcctcctgcag

SEQ ID NO: 5621164 - DNA, 13 bp, Homo sapiens
gcctggagcaggc

SEQ ID NO: 5621165 - DNA, 14 bp, Homo sapiens
gcctggagcaggcc

SEQ ID NO: 5621166 - DNA, 20 bp, Homo sapiens
gcctggagcatggacagtgt

SEQ ID NO: 5621167 - DNA, 18 bp, Homo sapiens
gcctggagccccactgcc

SEQ ID NO: 5621168 - DNA, 20 bp, Homo sapiens
gcctggagccccactgccct

SEQ ID NO: 5621169 - DNA, 14 bp, Homo sapiens
gcctggagcccctg

SEQ ID NO: 5621170 - DNA, 14 bp, Homo sapiens
gcctggagcctggg

SEQ ID NO: 5621171 - DNA, 16 bp, Homo sapiens
gcctggagcctgggca

SEQ ID NO: 5621172 - DNA, 20 bp, Homo sapiens
gcctggagctcctgggaagg

SEQ ID NO: 5621173 - DNA, 13 bp, Homo sapiens
gcctggagctttc

SEQ ID NO: 5621174 - DNA, 16 bp, Homo sapiens
gcctggaggacctgag

SEQ ID NO: 5621175 - DNA, 22 bp, Homo sapiens
gcctggaggacctgagcctgcc

SEQ ID NO: 5621176 - DNA, 16 bp, Homo sapiens
gcctggaggagaagga

SEQ ID NO: 5621177 - DNA, 21 bp, Homo sapiens
gcctggaggagaaggaggaac

SEQ ID NO: 5621178 - DNA, 23 bp, Homo sapiens
gcctggaggatagcagagaagcc

SEQ ID NO: 5621179 - DNA, 19 bp, Homo sapiens
gcctggaggcaaaggcctg

SEQ ID NO: 5621180 - DNA, 15 bp, Homo sapiens
gcctggaggcccaga

SEQ ID NO: 5621181 - DNA, 22 bp, Homo sapiens
gcctggaggccgggtgctcagg

SEQ ID NO: 5621182 - DNA, 17 bp, Homo sapiens
gcctggaggctcctcta

SEQ ID NO: 5621183 - DNA, 20 bp, Homo sapiens
gcctggaggctcctctaggc

SEQ ID NO: 5621184 - DNA, 17 bp, Homo sapiens
gcctggagggatgcccc

SEQ ID NO: 5621185 - DNA, 19 bp, Homo sapiens
gcctggagggatgccccca

SEQ ID NO: 5621186 - DNA, 18 bp, Homo sapiens
gcctggagggcacttcct

SEQ ID NO: 5621187 - DNA, 19 bp, Homo sapiens
gcctggagggcacttcctc

SEQ ID NO: 5621188 - DNA, 20 bp, Homo sapiens
gcctggagggtaactggggg

SEQ ID NO: 5621189 - DNA, 22 bp, Homo sapiens
gcctggagggtaactggggggc

SEQ ID NO: 5621190 - DNA, 13 bp, Homo sapiens
gcctggaggtctg

SEQ ID NO: 5621191 - DNA, 22 bp, Homo sapiens
gcctggaggtctggctgagccc

SEQ ID NO: 5621192 - DNA, 16 bp, Homo sapiens
gcctggagtaggcctg

SEQ ID NO: 5621193 - DNA, 18 bp, Homo sapiens
gcctggagtaggcctggg

SEQ ID NO: 5621194 - DNA, 19 bp, Homo sapiens
gcctggagtcagtagccag

SEQ ID NO: 5621195 - DNA, 21 bp, Homo sapiens
gcctggagtcagtagccagag

SEQ ID NO: 5621196 - DNA, 21 bp, Homo sapiens
gcctggagtcgtgggaaggag

SEQ ID NO: 5621197 - DNA, 17 bp, Homo sapiens
gcctggagtgctgtgct

SEQ ID NO: 5621198 - DNA, 19 bp, Homo sapiens
gcctggagtgctgtgctgt

SEQ ID NO: 5621199 - DNA, 17 bp, Homo sapiens
gcctggagttgggctgg

SEQ ID NO: 5621200 - DNA, 18 bp, Homo sapiens
gcctggagttgggctggt

SEQ ID NO: 5621201 - DNA, 17 bp, Homo sapiens
gcctggatccatcctgc

SEQ ID NO: 5621202 - DNA, 12 bp, Homo sapiens
gcctggatgaga

SEQ ID NO: 5621203 - DNA, 16 bp, Homo sapiens
gcctggatgagaaaca

SEQ ID NO: 5621204 - DNA, 17 bp, Homo sapiens
gcctggatgagaaacag

SEQ ID NO: 5621205 - DNA, 22 bp, Homo sapiens
gcctggatgagaaacagctcag

SEQ ID NO: 5621206 - DNA, 18 bp, Homo sapiens
gcctggatgcacagtgcc

SEQ ID NO: 5621207 - DNA, 21 bp, Homo sapiens
gcctggatgcacagtgcctga

SEQ ID NO: 5621208 - DNA, 21 bp, Homo sapiens
gcctggatgccaaggagcccc

SEQ ID NO: 5621209 - DNA, 18 bp, Homo sapiens
gcctggatggcccctcct

SEQ ID NO: 5621210 - DNA, 15 bp, Homo sapiens
gcctggatggggctg

SEQ ID NO: 5621211 - DNA, 21 bp, Homo sapiens
gcctggatgggggtgcaggca

SEQ ID NO: 5621212 - DNA, 20 bp, Homo sapiens
gcctggatgttgctgtgcac

SEQ ID NO: 5621213 - DNA, 23 bp, Homo sapiens
gcctggattccagcagtgaatgc

SEQ ID NO: 5621214 - DNA, 14 bp, Homo sapiens
gcctggattccatt

SEQ ID NO: 5621215 - DNA, 17 bp, Homo sapiens
gcctggcaacagagcga

SEQ ID NO: 5621216 - DNA, 22 bp, Homo sapiens
gcctggcaacatcttacttgtc

SEQ ID NO: 5621217 - DNA, 18 bp, Homo sapiens
gcctggcaagtgggtgaa

SEQ ID NO: 5621218 - DNA, 13 bp, Homo sapiens
gcctggcacacat

SEQ ID NO: 5621219 - DNA, 14 bp, Homo sapiens
gcctggcacacatc

SEQ ID NO: 5621220 - DNA, 16 bp, Homo sapiens
gcctggcacagaccag

SEQ ID NO: 5621221 - DNA, 13 bp, Homo sapiens
gcctggcacagga

SEQ ID NO: 5621222 - DNA, 15 bp, Homo sapiens
gcctggcacaggact

SEQ ID NO: 5621223 - DNA, 18 bp, Homo sapiens
gcctggcacaggccgagg

SEQ ID NO: 5621224 - DNA, 22 bp, Homo sapiens
gcctggcacaggccgaggcagg

SEQ ID NO: 5621225 - DNA, 14 bp, Homo sapiens
gcctggcacagtgt

SEQ ID NO: 5621226 - DNA, 22 bp, Homo sapiens
gcctggcacagtgtctgggctg

SEQ ID NO: 5621227 - DNA, 22 bp, Homo sapiens
gcctggcacatttcagggagaa

SEQ ID NO: 5621228 - DNA, 17 bp, Homo sapiens
gcctggcacccaccgtc

SEQ ID NO: 5621229 - DNA, 18 bp, Homo sapiens
gcctggcacgaaggcccc

SEQ ID NO: 5621230 - DNA, 13 bp, Homo sapiens
gcctggcacgagg

SEQ ID NO: 5621231 - DNA, 18 bp, Homo sapiens
gcctggcagaactgagct

SEQ ID NO: 5621232 - DNA, 19 bp, Homo sapiens
gcctggcagaactgagctc

SEQ ID NO: 5621233 - DNA, 22 bp, Homo sapiens
gcctggcagccgtgccttcagc

SEQ ID NO: 5621234 - DNA, 20 bp, Homo sapiens
gcctggcagctcagcttccc

SEQ ID NO: 5621235 - DNA, 13 bp, Homo sapiens
gcctggcaggcca

SEQ ID NO: 5621236 - DNA, 17 bp, Homo sapiens
gcctggcaggccagtgt

SEQ ID NO: 5621237 - DNA, 14 bp, Homo sapiens
gcctggcaggctgt

SEQ ID NO: 5621238 - DNA, 20 bp, Homo sapiens
gcctggcagggaggtcaggc

SEQ ID NO: 5621239 - DNA, 16 bp, Homo sapiens
gcctggcaggtcccct

SEQ ID NO: 5621240 - DNA, 19 bp, Homo sapiens
gcctggcaggtcccctgcc

SEQ ID NO: 5621241 - DNA, 14 bp, Homo sapiens
gcctggcaggtgga

SEQ ID NO: 5621242 - DNA, 15 bp, Homo sapiens
gcctggcatctgtgc

SEQ ID NO: 5621243 - DNA, 18 bp, Homo sapiens
gcctggcatctgtgcgtg

SEQ ID NO: 5621244 - DNA, 18 bp, Homo sapiens
gcctggcatctgtgtgcg

SEQ ID NO: 5621245 - DNA, 20 bp, Homo sapiens
gcctggcatctgtgtgcgtg

SEQ ID NO: 5621246 - DNA, 17 bp, Homo sapiens
gcctggcatcttctgga

SEQ ID NO: 5621247 - DNA, 20 bp, Homo sapiens
gcctggcattcttgtacagt

SEQ ID NO: 5621248 - DNA, 15 bp, Homo sapiens
gcctggccaaaggga

SEQ ID NO: 5621249 - DNA, 18 bp, Homo sapiens
gcctggccaacatggcaa

SEQ ID NO: 5621250 - DNA, 20 bp, Homo sapiens
gcctggccaacatggcgaaa

SEQ ID NO: 5621251 - DNA, 16 bp, Homo sapiens
gcctggccaccagcca

SEQ ID NO: 5621252 - DNA, 15 bp, Homo sapiens
gcctggccacgcagc

SEQ ID NO: 5621253 - DNA, 18 bp, Homo sapiens
gcctggccacgcagccag

SEQ ID NO: 5621254 - DNA, 13 bp, Homo sapiens
gcctggccacgcc

SEQ ID NO: 5621255 - DNA, 21 bp, Homo sapiens
gcctggccagacacaggccct

SEQ ID NO: 5621256 - DNA, 14 bp, Homo sapiens
gcctggccagacca

SEQ ID NO: 5621257 - DNA, 15 bp, Homo sapiens
gcctggccagatgca

SEQ ID NO: 5621258 - DNA, 11 bp, Homo sapiens
gcctggccagg

SEQ ID NO: 5621259 - DNA, 15 bp, Homo sapiens
gcctggccaggagca

SEQ ID NO: 5621260 - DNA, 14 bp, Homo sapiens
gcctggccaggcag

SEQ ID NO: 5621261 - DNA, 17 bp, Homo sapiens
gcctggccaggcagatc

SEQ ID NO: 5621262 - DNA, 15 bp, Homo sapiens
gcctggccaggcagg

SEQ ID NO: 5621263 - DNA, 16 bp, Homo sapiens
gcctggccaggcaggg

SEQ ID NO: 5621264 - DNA, 15 bp, Homo sapiens
gcctggccaggccct

SEQ ID NO: 5621265 - DNA, 23 bp, Homo sapiens
gcctggccaggccctgggtcttg

SEQ ID NO: 5621266 - DNA, 13 bp, Homo sapiens
gcctggccagggc

SEQ ID NO: 5621267 - DNA, 18 bp, Homo sapiens
gcctggccagggcagggc

SEQ ID NO: 5621268 - DNA, 13 bp, Homo sapiens
gcctggccagtcc

SEQ ID NO: 5621269 - DNA, 14 bp, Homo sapiens
gcctggccagtcct

SEQ ID NO: 5621270 - DNA, 16 bp, Homo sapiens
gcctggccagtcctgg

SEQ ID NO: 5621271 - DNA, 20 bp, Homo sapiens
gcctggccagtcctggtcct

SEQ ID NO: 5621272 - DNA, 18 bp, Homo sapiens
gcctggccatactgtgtc

SEQ ID NO: 5621273 - DNA, 13 bp, Homo sapiens
gcctggccatgct

SEQ ID NO: 5621274 - DNA, 20 bp, Homo sapiens
gcctggccatgtcacctggc

SEQ ID NO: 5621275 - DNA, 14 bp, Homo sapiens
gcctggccatgtgg

SEQ ID NO: 5621276 - DNA, 14 bp, Homo sapiens
gcctggccatttcc

SEQ ID NO: 5621277 - DNA, 16 bp, Homo sapiens
gcctggccatttccaa

SEQ ID NO: 5621278 - DNA, 20 bp, Homo sapiens
gcctggcccaagccctccac

SEQ ID NO: 5621279 - DNA, 18 bp, Homo sapiens
gcctggcccaccccaccc

SEQ ID NO: 5621280 - DNA, 12 bp, Homo sapiens
gcctggcccagc

SEQ ID NO: 5621281 - DNA, 13 bp, Homo sapiens
gcctggcccagcc

SEQ ID NO: 5621282 - DNA, 14 bp, Homo sapiens
gcctggcccagcca

SEQ ID NO: 5621283 - DNA, 15 bp, Homo sapiens
gcctggcccagccag

SEQ ID NO: 5621284 - DNA, 14 bp, Homo sapiens
gcctggcccagctc

SEQ ID NO: 5621285 - DNA, 16 bp, Homo sapiens
gcctggcccagctccc

SEQ ID NO: 5621286 - DNA, 16 bp, Homo sapiens
gcctggcccagtgaga

SEQ ID NO: 5621287 - DNA, 19 bp, Homo sapiens
gcctggcccagtgagagtg

SEQ ID NO: 5621288 - DNA, 14 bp, Homo sapiens
gcctggcccataga

SEQ ID NO: 5621289 - DNA, 12 bp, Homo sapiens
gcctggcccatg

SEQ ID NO: 5621290 - DNA, 20 bp, Homo sapiens
gcctggccccagcctgggcc

SEQ ID NO: 5621291 - DNA, 15 bp, Homo sapiens
gcctggccccaggcc

SEQ ID NO: 5621292 - DNA, 17 bp, Homo sapiens
gcctggccccaggcccc

SEQ ID NO: 5621293 - DNA, 20 bp, Homo sapiens
gcctggccccaggccccaga

SEQ ID NO: 5621294 - DNA, 22 bp, Homo sapiens
gcctggccccaggccccagaca

SEQ ID NO: 5621295 - DNA, 19 bp, Homo sapiens
gcctggcccccctccaggc

SEQ ID NO: 5621296 - DNA, 14 bp, Homo sapiens
gcctggccccctcg

SEQ ID NO: 5621297 - DNA, 15 bp, Homo sapiens
gcctggccccctcgc

SEQ ID NO: 5621298 - DNA, 23 bp, Homo sapiens
gcctggccccctcgcgcccctgt

SEQ ID NO: 5621299 - DNA, 14 bp, Homo sapiens
gcctggcccctcag

SEQ ID NO: 5621300 - DNA, 20 bp, Homo sapiens
gcctggcccctcagggtccc

SEQ ID NO: 5621301 - DNA, 14 bp, Homo sapiens
gcctggccctccct

SEQ ID NO: 5621302 - DNA, 15 bp, Homo sapiens
gcctggccctccctc

SEQ ID NO: 5621303 - DNA, 12 bp, Homo sapiens
gcctggccctgc

SEQ ID NO: 5621304 - DNA, 19 bp, Homo sapiens
gcctggccctgccctgagg

SEQ ID NO: 5621305 - DNA, 13 bp, Homo sapiens
gcctggccctgct

SEQ ID NO: 5621306 - DNA, 13 bp, Homo sapiens
gcctggcccttgc

SEQ ID NO: 5621307 - DNA, 15 bp, Homo sapiens
gcctggccgcagggc

SEQ ID NO: 5621308 - DNA, 15 bp, Homo sapiens
gcctggccggcaacc

SEQ ID NO: 5621309 - DNA, 14 bp, Homo sapiens
gcctggccggccag

SEQ ID NO: 5621310 - DNA, 22 bp, Homo sapiens
gcctggccggccagccagccac

SEQ ID NO: 5621311 - DNA, 23 bp, Homo sapiens
gcctggccggccagccagccact

SEQ ID NO: 5621312 - DNA, 15 bp, Homo sapiens
gcctggccggctcca

SEQ ID NO: 5621313 - DNA, 17 bp, Homo sapiens
gcctggccgttcagcct

SEQ ID NO: 5621314 - DNA, 19 bp, Homo sapiens
gcctggccgttcagcctgt

SEQ ID NO: 5621315 - DNA, 14 bp, Homo sapiens
gcctggcctagact

SEQ ID NO: 5621316 - DNA, 11 bp, Homo sapiens
gcctggcctat

SEQ ID NO: 5621317 - DNA, 16 bp, Homo sapiens
gcctggcctatttaag

SEQ ID NO: 5621318 - DNA, 16 bp, Homo sapiens
gcctggcctcatctca

SEQ ID NO: 5621319 - DNA, 22 bp, Homo sapiens
gcctggcctcatctcagaccct

SEQ ID NO: 5621320 - DNA, 18 bp, Homo sapiens
gcctggcctccagctccc

SEQ ID NO: 5621321 - DNA, 16 bp, Homo sapiens
gcctggcctccaggcc

SEQ ID NO: 5621322 - DNA, 13 bp, Homo sapiens
gcctggcctcccc

SEQ ID NO: 5621323 - DNA, 17 bp, Homo sapiens
gcctggcctcccctgcg

SEQ ID NO: 5621324 - DNA, 22 bp, Homo sapiens
gcctggcctcctgcctctactg

SEQ ID NO: 5621325 - DNA, 12 bp, Homo sapiens
gcctggcctctg

SEQ ID NO: 5621326 - DNA, 19 bp, Homo sapiens
gcctggcctctgcctccac

SEQ ID NO: 5621327 - DNA, 14 bp, Homo sapiens
gcctggcctctggg

SEQ ID NO: 5621328 - DNA, 15 bp, Homo sapiens
gcctggcctctgggc

SEQ ID NO: 5621329 - DNA, 21 bp, Homo sapiens
gcctggcctctgggcagtgtg

SEQ ID NO: 5621330 - DNA, 22 bp, Homo sapiens
gcctggcctctgggcagtgtgg

SEQ ID NO: 5621331 - DNA, 15 bp, Homo sapiens
gcctggcctgccaga

SEQ ID NO: 5621332 - DNA, 12 bp, Homo sapiens
gcctggcctggc

SEQ ID NO: 5621333 - DNA, 13 bp, Homo sapiens
gcctggcctggca

SEQ ID NO: 5621334 - DNA, 16 bp, Homo sapiens
gcctggcctggcacac

SEQ ID NO: 5621335 - DNA, 20 bp, Homo sapiens
gcctgttaggagaagctgca

SEQ ID NO: 5621336 - DNA, 19 bp, Homo sapiens
gcctgttataactctgcac

SEQ ID NO: 5621337 - DNA, 14 bp, Homo sapiens
gcctgttcagctcc

SEQ ID NO: 5621338 - DNA, 20 bp, Homo sapiens
gcctgttcagctccagctca

SEQ ID NO: 5621339 - DNA, 24 bp, Homo sapiens
gcctgttcagttacagaaagtggt

SEQ ID NO: 5621340 - DNA, 19 bp, Homo sapiens
gcctgttcccattcttgca

SEQ ID NO: 5621341 - DNA, 14 bp, Homo sapiens
gcctgttcccccgc

SEQ ID NO: 5621342 - DNA, 17 bp, Homo sapiens
gcctgttcccctcactg

SEQ ID NO: 5621343 - DNA, 14 bp, Homo sapiens
gcctgttccctgag

SEQ ID NO: 5621344 - DNA, 11 bp, Homo sapiens
gcctgttcctt

SEQ ID NO: 5621345 - DNA, 20 bp, Homo sapiens
gcctgttccttcctgcagac

SEQ ID NO: 5621346 - DNA, 21 bp, Homo sapiens
gcctgttccttcctgcagacc

SEQ ID NO: 5621347 - DNA, 23 bp, Homo sapiens
gcctgttccttcctgcagacctg

SEQ ID NO: 5621348 - DNA, 14 bp, Homo sapiens
gcctgttctccaga

SEQ ID NO: 5621349 - DNA, 16 bp, Homo sapiens
gcctgttctgcttcga

SEQ ID NO: 5621350 - DNA, 17 bp, Homo sapiens
gcctgttctgtaggaga

SEQ ID NO: 5621351 - DNA, 18 bp, Homo sapiens
gcctgttctgtaggagag

SEQ ID NO: 5621352 - DNA, 15 bp, Homo sapiens
gcctgttgcaggcaa

SEQ ID NO: 5621353 - DNA, 22 bp, Homo sapiens
gcctgttgctttcttcctgcat

SEQ ID NO: 5621354 - DNA, 19 bp, Homo sapiens
gcctgttggacccgctctg

SEQ ID NO: 5621355 - DNA, 14 bp, Homo sapiens
gcctgttggcaggc

SEQ ID NO: 5621356 - DNA, 22 bp, Homo sapiens
gcctgttggcaggcccactccc

SEQ ID NO: 5621357 - DNA, 15 bp, Homo sapiens
gcctgttggctgctg

SEQ ID NO: 5621358 - DNA, 18 bp, Homo sapiens
gcctgttgggcagagctg

SEQ ID NO: 5621359 - DNA, 16 bp, Homo sapiens
gcctgttgggccagga

SEQ ID NO: 5621360 - DNA, 14 bp, Homo sapiens
gcctgttgtattta

SEQ ID NO: 5621361 - DNA, 12 bp, Homo sapiens
gcctgtttaaga

SEQ ID NO: 5621362 - DNA, 21 bp, Homo sapiens
gcctgtttcccgtaaggctgt

SEQ ID NO: 5621363 - DNA, 20 bp, Homo sapiens
gcctgtttgatgtatgtgtg

SEQ ID NO: 5621364 - DNA, 21 bp, Homo sapiens
gcctgtttgatgtatgtgtga

SEQ ID NO: 5621365 - DNA, 16 bp, Homo sapiens
gcctgtttggcctctc

SEQ ID NO: 5621366 - DNA, 19 bp, Homo sapiens
gcctgtttggggagggggg

SEQ ID NO: 5621367 - DNA, 16 bp, Homo sapiens
gcctgtttggtgagga

SEQ ID NO: 5621368 - DNA, 17 bp, Homo sapiens
gcctgtttggtgaggac

SEQ ID NO: 5621369 - DNA, 20 bp, Homo sapiens
gcctgttttagaaggttctc

SEQ ID NO: 5621370 - DNA, 15 bp, Homo sapiens
gccttaaaacatact

SEQ ID NO: 5621371 - DNA, 13 bp, Homo sapiens
gccttaaaacttt

SEQ ID NO: 5621372 - DNA, 22 bp, Homo sapiens
gccttaaaaggagagaagaaag

SEQ ID NO: 5621373 - DNA, 17 bp, Homo sapiens
gccttaaaaggggccca

SEQ ID NO: 5621374 - DNA, 14 bp, Homo sapiens
gccttaaaatggaa

SEQ ID NO: 5621375 - DNA, 22 bp, Homo sapiens
gccttaaaatggaattgaaaaa

SEQ ID NO: 5621376 - DNA, 23 bp, Homo sapiens
gccttaaacaattcttgtaactt

SEQ ID NO: 5621377 - DNA, 15 bp, Homo sapiens
gccttaaacacacat

SEQ ID NO: 5621378 - DNA, 20 bp, Homo sapiens
gccttaaacactcaccttct

SEQ ID NO: 5621379 - DNA, 16 bp, Homo sapiens
gccttaaagaaagtcg

SEQ ID NO: 5621380 - DNA, 13 bp, Homo sapiens
gccttaaattttt

SEQ ID NO: 5621381 - DNA, 21 bp, Homo sapiens
gccttaaatttttgtcatttt

SEQ ID NO: 5621382 - DNA, 17 bp, Homo sapiens
gccttaacacactggcc

SEQ ID NO: 5621383 - DNA, 18 bp, Homo sapiens
gccttaacacactggcca

SEQ ID NO: 5621384 - DNA, 14 bp, Homo sapiens
gccttaacctggga

SEQ ID NO: 5621385 - DNA, 15 bp, Homo sapiens
gccttaactgttgtt

SEQ ID NO: 5621386 - DNA, 16 bp, Homo sapiens
gccttaagaaagctat

SEQ ID NO: 5621387 - DNA, 18 bp, Homo sapiens
gccttaagaaagctatat

SEQ ID NO: 5621388 - DNA, 16 bp, Homo sapiens
gccttaagcacaatta

SEQ ID NO: 5621389 - DNA, 20 bp, Homo sapiens
gccttaagcagaacaaatgt

SEQ ID NO: 5621390 - DNA, 21 bp, Homo sapiens
gccttaagcagaacaaatgtg

SEQ ID NO: 5621391 - DNA, 22 bp, Homo sapiens
gccttaagcagaacaaatgtgt

SEQ ID NO: 5621392 - DNA, 16 bp, Homo sapiens
gccttaagctgatcct

SEQ ID NO: 5621393 - DNA, 19 bp, Homo sapiens
gccttaaggccacactggc

SEQ ID NO: 5621394 - DNA, 17 bp, Homo sapiens
gccttaaggccctcatt

SEQ ID NO: 5621395 - DNA, 20 bp, Homo sapiens
gccttaagtgaggaaatcaa

SEQ ID NO: 5621396 - DNA, 21 bp, Homo sapiens
gccttaagtgaggaaatcaaa

SEQ ID NO: 5621397 - DNA, 22 bp, Homo sapiens
gccttaagtgaggaaatcaaag

SEQ ID NO: 5621398 - DNA, 19 bp, Homo sapiens
gccttaataaaaaatgaaa

SEQ ID NO: 5621399 - DNA, 15 bp, Homo sapiens
gccttaataaatatg

SEQ ID NO: 5621400 - DNA, 15 bp, Homo sapiens
gccttaatacttttt

SEQ ID NO: 5621401 - DNA, 19 bp, Homo sapiens
gccttaatagacttctctt

SEQ ID NO: 5621402 - DNA, 20 bp, Homo sapiens
gccttaatagacttctctta

SEQ ID NO: 5621403 - DNA, 20 bp, Homo sapiens
gccttaatgacattcccctc

SEQ ID NO: 5621404 - DNA, 16 bp, Homo sapiens
gccttaatttagaaac

SEQ ID NO: 5621405 - DNA, 19 bp, Homo sapiens
gccttaatttagaaactga

SEQ ID NO: 5621406 - DNA, 23 bp, Homo sapiens
gccttaatttcctttttgacact

SEQ ID NO: 5621407 - DNA, 14 bp, Homo sapiens
gccttaatttttga

SEQ ID NO: 5621408 - DNA, 16 bp, Homo sapiens
gccttaatttttgaaa

SEQ ID NO: 5621409 - DNA, 20 bp, Homo sapiens
gccttacacaatggttttct

SEQ ID NO: 5621410 - DNA, 21 bp, Homo sapiens
gccttacacaatggttttctt

SEQ ID NO: 5621411 - DNA, 20 bp, Homo sapiens
gccttacagaaaattgttgt

SEQ ID NO: 5621412 - DNA, 13 bp, Homo sapiens
gccttacatctgg

SEQ ID NO: 5621413 - DNA, 16 bp, Homo sapiens
gccttacatcttttct

SEQ ID NO: 5621414 - DNA, 19 bp, Homo sapiens
gccttacatcttttctaat

SEQ ID NO: 5621415 - DNA, 18 bp, Homo sapiens
gccttaccaagactcctg

SEQ ID NO: 5621416 - DNA, 16 bp, Homo sapiens
gccttacctcccctgc

SEQ ID NO: 5621417 - DNA, 22 bp, Homo sapiens
gccttacctcccctgccagggc

SEQ ID NO: 5621418 - DNA, 12 bp, Homo sapiens
gccttacctcct

SEQ ID NO: 5621419 - DNA, 16 bp, Homo sapiens
gccttacctcctgccc

SEQ ID NO: 5621420 - DNA, 18 bp, Homo sapiens
gccttacctcctgcccag

SEQ ID NO: 5621421 - DNA, 20 bp, Homo sapiens
gccttacctcctgcccagga

SEQ ID NO: 5621422 - DNA, 22 bp, Homo sapiens
gccttacctcctgcccaggaga

SEQ ID NO: 5621423 - DNA, 16 bp, Homo sapiens
gccttactcacctctc

SEQ ID NO: 5621424 - DNA, 22 bp, Homo sapiens
gccttacttcaaagtgcctggg

SEQ ID NO: 5621425 - DNA, 15 bp, Homo sapiens
gccttactttgtatg

SEQ ID NO: 5621426 - DNA, 20 bp, Homo sapiens
gccttagaaatgtaaactgc

SEQ ID NO: 5621427 - DNA, 22 bp, Homo sapiens
gccttagaaatgtaaactgcca

SEQ ID NO: 5621428 - DNA, 23 bp, Homo sapiens
gccttagaaatgtaaactgccat

SEQ ID NO: 5621429 - DNA, 16 bp, Homo sapiens
gccttagaactttgca

SEQ ID NO: 5621430 - DNA, 17 bp, Homo sapiens
gccttagaagtcacaca

SEQ ID NO: 5621431 - DNA, 18 bp, Homo sapiens
gccttagaagtcacacag

SEQ ID NO: 5621432 - DNA, 20 bp, Homo sapiens
gccttagaagtcacacagta

SEQ ID NO: 5621433 - DNA, 15 bp, Homo sapiens
gccttagacaaatga

SEQ ID NO: 5621434 - DNA, 20 bp, Homo sapiens
gccttagagcatctctgcct

SEQ ID NO: 5621435 - DNA, 13 bp, Homo sapiens
gccttagagccag

SEQ ID NO: 5621436 - DNA, 15 bp, Homo sapiens
gccttagagccaggc

SEQ ID NO: 5621437 - DNA, 17 bp, Homo sapiens
gccttagagccaggcac

SEQ ID NO: 5621438 - DNA, 23 bp, Homo sapiens
gccttagagccaggcacacactg

SEQ ID NO: 5621439 - DNA, 14 bp, Homo sapiens
gccttagagctctt

SEQ ID NO: 5621440 - DNA, 13 bp, Homo sapiens
gccttagaggagc

SEQ ID NO: 5621441 - DNA, 15 bp, Homo sapiens
gccttagaggagccc

SEQ ID NO: 5621442 - DNA, 17 bp, Homo sapiens
gccttagcagccctgga

SEQ ID NO: 5621443 - DNA, 20 bp, Homo sapiens
gccttagccatgatctgcag

SEQ ID NO: 5621444 - DNA, 13 bp, Homo sapiens
gccttagcctctt

SEQ ID NO: 5621445 - DNA, 19 bp, Homo sapiens
gccttagctcccagctagg

SEQ ID NO: 5621446 - DNA, 23 bp, Homo sapiens
gccttagctcccagctagggggc

SEQ ID NO: 5621447 - DNA, 15 bp, Homo sapiens
gccttagctgccagt

SEQ ID NO: 5621448 - DNA, 15 bp, Homo sapiens
gccttagcttcagga

SEQ ID NO: 5621449 - DNA, 16 bp, Homo sapiens
gccttagcttcaggaa

SEQ ID NO: 5621450 - DNA, 19 bp, Homo sapiens
gccttaggaagagccttcc

SEQ ID NO: 5621451 - DNA, 23 bp, Homo sapiens
gccttaggaagtgacttgaatgt

SEQ ID NO: 5621452 - DNA, 14 bp, Homo sapiens
gccttaggaatact

SEQ ID NO: 5621453 - DNA, 18 bp, Homo sapiens
gccttaggaatactgttt

SEQ ID NO: 5621454 - DNA, 16 bp, Homo sapiens
gccttaggctgctggg

SEQ ID NO: 5621455 - DNA, 15 bp, Homo sapiens
gccttagggaagctg

SEQ ID NO: 5621456 - DNA, 17 bp, Homo sapiens
gccttagggcactgggc

SEQ ID NO: 5621457 - DNA, 16 bp, Homo sapiens
gccttagggctggcaa

SEQ ID NO: 5621458 - DNA, 18 bp, Homo sapiens
gccttagtctcagtttgt

SEQ ID NO: 5621459 - DNA, 22 bp, Homo sapiens
gccttagtctcagtttgtgtgt

SEQ ID NO: 5621460 - DNA, 16 bp, Homo sapiens
gccttagtgggccagg

SEQ ID NO: 5621461 - DNA, 17 bp, Homo sapiens
gccttagtgggccaggg

SEQ ID NO: 5621462 - DNA, 18 bp, Homo sapiens
gccttataaaccaatctt

SEQ ID NO: 5621463 - DNA, 13 bp, Homo sapiens
gccttatcaagtg

SEQ ID NO: 5621464 - DNA, 19 bp, Homo sapiens
gccttatcaagtgtcttcc

SEQ ID NO: 5621465 - DNA, 20 bp, Homo sapiens
gccttatcaagtgtcttcca

SEQ ID NO: 5621466 - DNA, 23 bp, Homo sapiens
gccttatccaggttggttttgct

SEQ ID NO: 5621467 - DNA, 13 bp, Homo sapiens
gccttatcctctg

SEQ ID NO: 5621468 - DNA, 23 bp, Homo sapiens
gccttatcgggctccagccatct

SEQ ID NO: 5621469 - DNA, 24 bp, Homo sapiens
gccttatctgaaaggccagcagct

SEQ ID NO: 5621470 - DNA, 20 bp, Homo sapiens
gccttatctgttccttttta

SEQ ID NO: 5621471 - DNA, 23 bp, Homo sapiens
gccttatgagggtcctctacttc

SEQ ID NO: 5621472 - DNA, 13 bp, Homo sapiens
gccttatgaggtc

SEQ ID NO: 5621473 - DNA, 16 bp, Homo sapiens
gccttatgaggtcaag

SEQ ID NO: 5621474 - DNA, 22 bp, Homo sapiens
gccttatggaacactctgagac

SEQ ID NO: 5621475 - DNA, 23 bp, Homo sapiens
gccttatggaacactctgagact

SEQ ID NO: 5621476 - DNA, 14 bp, Homo sapiens
gccttattaaaata

SEQ ID NO: 5621477 - DNA, 12 bp, Homo sapiens
gccttattaaag

SEQ ID NO: 5621478 - DNA, 22 bp, Homo sapiens
gccttattggaaagcagtcccc

SEQ ID NO: 5621479 - DNA, 14 bp, Homo sapiens
gccttatttctcat

SEQ ID NO: 5621480 - DNA, 16 bp, Homo sapiens
gccttatttgtctgta

SEQ ID NO: 5621481 - DNA, 20 bp, Homo sapiens
gccttatttttgaattcttt

SEQ ID NO: 5621482 - DNA, 20 bp, Homo sapiens
gccttcaaaaatgtgctgcc

SEQ ID NO: 5621483 - DNA, 19 bp, Homo sapiens
gccttcaaaactatagctt

SEQ ID NO: 5621484 - DNA, 22 bp, Homo sapiens
gccttcaagctctgagggaaag

SEQ ID NO: 5621485 - DNA, 16 bp, Homo sapiens
gccttcaaggactgtt

SEQ ID NO: 5621486 - DNA, 21 bp, Homo sapiens
gccttcaaggactgtttcagt

SEQ ID NO: 5621487 - DNA, 17 bp, Homo sapiens
gccttcaagtgccaaac

SEQ ID NO: 5621488 - DNA, 15 bp, Homo sapiens
gccttcaataaatgg

SEQ ID NO: 5621489 - DNA, 17 bp, Homo sapiens
gccttcacaaccagcca

SEQ ID NO: 5621490 - DNA, 19 bp, Homo sapiens
gccttcacaaccagccaca

SEQ ID NO: 5621491 - DNA, 22 bp, Homo sapiens
gccttcacaatctgtcagttct

SEQ ID NO: 5621492 - DNA, 14 bp, Homo sapiens
gccttcactgggcc

SEQ ID NO: 5621493 - DNA, 21 bp, Homo sapiens
gccttcactgtgctccaacct

SEQ ID NO: 5621494 - DNA, 23 bp, Homo sapiens
gccttcactgtgctccaacctga

SEQ ID NO: 5621495 - DNA, 19 bp, Homo sapiens
gccttcacttttctgagtt

SEQ ID NO: 5621496 - DNA, 19 bp, Homo sapiens
gccttcagaatgctcctga

SEQ ID NO: 5621497 - DNA, 22 bp, Homo sapiens
gccttcagacacatgctatgtt

SEQ ID NO: 5621498 - DNA, 23 bp, Homo sapiens
gccttcagacagagaggactgta

SEQ ID NO: 5621499 - DNA, 22 bp, Homo sapiens
gccttcagagtacgtcctgcct

SEQ ID NO: 5621500 - DNA, 20 bp, Homo sapiens
gccttcagcagcagctcaca

SEQ ID NO: 5621501 - DNA, 18 bp, Homo sapiens
gccttcagccaagaccat

SEQ ID NO: 5621502 - DNA, 12 bp, Homo sapiens
gccttcagcctc

SEQ ID NO: 5621503 - DNA, 14 bp, Homo sapiens
gccttcagcctccc

SEQ ID NO: 5621504 - DNA, 17 bp, Homo sapiens
gccttcagctgttgcag

SEQ ID NO: 5621505 - DNA, 21 bp, Homo sapiens
gccttcaggttcctcctaggc

SEQ ID NO: 5621506 - DNA, 13 bp, Homo sapiens
gccttcagtagga

SEQ ID NO: 5621507 - DNA, 23 bp, Homo sapiens
gccttcagtaggaacaagctggc

SEQ ID NO: 5621508 - DNA, 16 bp, Homo sapiens
gccttcagtcagggtt

SEQ ID NO: 5621509 - DNA, 22 bp, Homo sapiens
gccttcatcagaactcttcctc

SEQ ID NO: 5621510 - DNA, 15 bp, Homo sapiens
gcctttcctggaagc

SEQ ID NO: 5621511 - DNA, 12 bp, Homo sapiens
gcctttcctgtg

SEQ ID NO: 5621512 - DNA, 13 bp, Homo sapiens
gcctttcctgtgc

SEQ ID NO: 5621513 - DNA, 15 bp, Homo sapiens
gcctttcctgtgcca

SEQ ID NO: 5621514 - DNA, 19 bp, Homo sapiens
gcctttcctgttcagcatt

SEQ ID NO: 5621515 - DNA, 23 bp, Homo sapiens
gcctttccttttcgcctttcctc

SEQ ID NO: 5621516 - DNA, 19 bp, Homo sapiens
gcctttcgaggcctgaagc

SEQ ID NO: 5621517 - DNA, 22 bp, Homo sapiens
gcctttcgtgatcttattgctt

SEQ ID NO: 5621518 - DNA, 23 bp, Homo sapiens
gcctttctaagactcacttacat

SEQ ID NO: 5621519 - DNA, 20 bp, Homo sapiens
gcctttctccagcccatgct

SEQ ID NO: 5621520 - DNA, 21 bp, Homo sapiens
gcctttctccagcccatgctg

SEQ ID NO: 5621521 - DNA, 19 bp, Homo sapiens
gcctttctcgattttatct

SEQ ID NO: 5621522 - DNA, 22 bp, Homo sapiens
gcctttctctggcttccttggc

SEQ ID NO: 5621523 - DNA, 19 bp, Homo sapiens
gcctttctgcagtttttca

SEQ ID NO: 5621524 - DNA, 12 bp, Homo sapiens
gcctttctgtgg

SEQ ID NO: 5621525 - DNA, 15 bp, Homo sapiens
gcctttctgtgttta

SEQ ID NO: 5621526 - DNA, 16 bp, Homo sapiens
gcctttcttctgccct

SEQ ID NO: 5621527 - DNA, 17 bp, Homo sapiens
gcctttcttctgccctt

SEQ ID NO: 5621528 - DNA, 16 bp, Homo sapiens
gcctttctttgcctct

SEQ ID NO: 5621529 - DNA, 18 bp, Homo sapiens
gcctttctttgcctctgc

SEQ ID NO: 5621530 - DNA, 19 bp, Homo sapiens
gcctttgaaattcccccac

SEQ ID NO: 5621531 - DNA, 13 bp, Homo sapiens
gcctttgaatgta

SEQ ID NO: 5621532 - DNA, 15 bp, Homo sapiens
gcctttgaatgtaac

SEQ ID NO: 5621533 - DNA, 20 bp, Homo sapiens
gcctttgaatgttaattttt

SEQ ID NO: 5621534 - DNA, 15 bp, Homo sapiens
gcctttgacctgttc

SEQ ID NO: 5621535 - DNA, 19 bp, Homo sapiens
gcctttgagacagtttctt

SEQ ID NO: 5621536 - DNA, 21 bp, Homo sapiens
gcctttgagacagtttcttag

SEQ ID NO: 5621537 - DNA, 20 bp, Homo sapiens
gcctttgaggcaaaggccag

SEQ ID NO: 5621538 - DNA, 13 bp, Homo sapiens
gcctttgaggttt

SEQ ID NO: 5621539 - DNA, 22 bp, Homo sapiens
gcctttgagtgtgggactccag

SEQ ID NO: 5621540 - DNA, 15 bp, Homo sapiens
gcctttgatcttcag

SEQ ID NO: 5621541 - DNA, 15 bp, Homo sapiens
gcctttgcagaaaca

SEQ ID NO: 5621542 - DNA, 16 bp, Homo sapiens
gcctttgcagaaacag

SEQ ID NO: 5621543 - DNA, 16 bp, Homo sapiens
gcctttgcagctcaga

SEQ ID NO: 5621544 - DNA, 21 bp, Homo sapiens
gcctttgcagttggactctca

SEQ ID NO: 5621545 - DNA, 23 bp, Homo sapiens
gcctttgccagcagagccagggc

SEQ ID NO: 5621546 - DNA, 12 bp, Homo sapiens
gcctttgccctg

SEQ ID NO: 5621547 - DNA, 16 bp, Homo sapiens
gcctttgccgtgagca

SEQ ID NO: 5621548 - DNA, 19 bp, Homo sapiens
gcctttgccgtgagcatgc

SEQ ID NO: 5621549 - DNA, 15 bp, Homo sapiens
gcctttgcgctcctg

SEQ ID NO: 5621550 - DNA, 19 bp, Homo sapiens
gcctttgcgctcctggccc

SEQ ID NO: 5621551 - DNA, 13 bp, Homo sapiens
gcctttgctcctc

SEQ ID NO: 5621552 - DNA, 20 bp, Homo sapiens
gcctttgctgaagtctcccc

SEQ ID NO: 5621553 - DNA, 15 bp, Homo sapiens
gcctttgctgccctt

SEQ ID NO: 5621554 - DNA, 17 bp, Homo sapiens
gcctttgctgccttctg

SEQ ID NO: 5621555 - DNA, 21 bp, Homo sapiens
gcctttgctgtttagcttcct

SEQ ID NO: 5621556 - DNA, 22 bp, Homo sapiens
gcctttggaaacagctcgactt

SEQ ID NO: 5621557 - DNA, 16 bp, Homo sapiens
gcctttggaagaaaca

SEQ ID NO: 5621558 - DNA, 14 bp, Homo sapiens
gcctttggacccag

SEQ ID NO: 5621559 - DNA, 17 bp, Homo sapiens
gcctttggacccagggc

SEQ ID NO: 5621560 - DNA, 23 bp, Homo sapiens
gcctttggacccagggcctgact

SEQ ID NO: 5621561 - DNA, 13 bp, Homo sapiens
gcctttggcaggt

SEQ ID NO: 5621562 - DNA, 13 bp, Homo sapiens
gcctttgggcaca

SEQ ID NO: 5621563 - DNA, 22 bp, Homo sapiens
gcctttgggcacggccctcctt

SEQ ID NO: 5621564 - DNA, 18 bp, Homo sapiens
gcctttggggggccaccc

SEQ ID NO: 5621565 - DNA, 17 bp, Homo sapiens
gcctttgggtcctgggc

SEQ ID NO: 5621566 - DNA, 19 bp, Homo sapiens
gcctttgggtcgacatagt

SEQ ID NO: 5621567 - DNA, 16 bp, Homo sapiens
gcctttggtgaattcc

SEQ ID NO: 5621568 - DNA, 21 bp, Homo sapiens
gcctttgtaagacacacagcc

SEQ ID NO: 5621569 - DNA, 22 bp, Homo sapiens
gcctttgtaatatgagaatgta

SEQ ID NO: 5621570 - DNA, 23 bp, Homo sapiens
gcctttgtaatatgagaatgtat

SEQ ID NO: 5621571 - DNA, 15 bp, Homo sapiens
gcctttgtatctttc

SEQ ID NO: 5621572 - DNA, 23 bp, Homo sapiens
gcctttgtatctttctttctcta

SEQ ID NO: 5621573 - DNA, 19 bp, Homo sapiens
gcctttgtattataaaagc

SEQ ID NO: 5621574 - DNA, 16 bp, Homo sapiens
gcctttgtgctgcgcc

SEQ ID NO: 5621575 - DNA, 22 bp, Homo sapiens
gcctttgtgctgcgcctgcagg

SEQ ID NO: 5621576 - DNA, 14 bp, Homo sapiens
gcctttgtgctttt

SEQ ID NO: 5621577 - DNA, 19 bp, Homo sapiens
gcctttgtgctttttgtca

SEQ ID NO: 5621578 - DNA, 13 bp, Homo sapiens
gcctttgtggcct

SEQ ID NO: 5621579 - DNA, 14 bp, Homo sapiens
gcctttgtggcctt

SEQ ID NO: 5621580 - DNA, 18 bp, Homo sapiens
gcctttgttccccactgg

SEQ ID NO: 5621581 - DNA, 21 bp, Homo sapiens
gcctttgtttcggtgccctgt

SEQ ID NO: 5621582 - DNA, 14 bp, Homo sapiens
gccttttaaaagaa

SEQ ID NO: 5621583 - DNA, 15 bp, Homo sapiens
gccttttaaaagaaa

SEQ ID NO: 5621584 - DNA, 17 bp, Homo sapiens
gccttttaaattctttt

SEQ ID NO: 5621585 - DNA, 13 bp, Homo sapiens
gccttttaacatt

SEQ ID NO: 5621586 - DNA, 14 bp, Homo sapiens
gccttttatagcta

SEQ ID NO: 5621587 - DNA, 22 bp, Homo sapiens
gccttttatcccaaagttgttg

SEQ ID NO: 5621588 - DNA, 20 bp, Homo sapiens
gccttttatgtaatttcttt

SEQ ID NO: 5621589 - DNA, 16 bp, Homo sapiens
gccttttatttcttaa

SEQ ID NO: 5621590 - DNA, 19 bp, Homo sapiens
gccttttcacgttttcttt

SEQ ID NO: 5621591 - DNA, 13 bp, Homo sapiens
gccttttcagccc

SEQ ID NO: 5621592 - DNA, 18 bp, Homo sapiens
gccttttcccccaccctc

SEQ ID NO: 5621593 - DNA, 12 bp, Homo sapiens
gccttttcctga

SEQ ID NO: 5621594 - DNA, 22 bp, Homo sapiens
gccttttccttctggttctaac

SEQ ID NO: 5621595 - DNA, 14 bp, Homo sapiens
gccttttctagccc

SEQ ID NO: 5621596 - DNA, 13 bp, Homo sapiens
gccttttctcatt

SEQ ID NO: 5621597 - DNA, 15 bp, Homo sapiens
gccttttctggcacc

SEQ ID NO: 5621598 - DNA, 22 bp, Homo sapiens
gccttttctggcaccgcagttt

SEQ ID NO: 5621599 - DNA, 17 bp, Homo sapiens
gccttttctttaacttt

SEQ ID NO: 5621600 - DNA, 12 bp, Homo sapiens
gccttttgaaag

SEQ ID NO: 5621601 - DNA, 13 bp, Homo sapiens
gccttttgcaaat

SEQ ID NO: 5621602 - DNA, 14 bp, Homo sapiens
gccttttgcacccc

SEQ ID NO: 5621603 - DNA, 15 bp, Homo sapiens
gccttttgcacccct

SEQ ID NO: 5621604 - DNA, 16 bp, Homo sapiens
gccttttgcagaagag

SEQ ID NO: 5621605 - DNA, 13 bp, Homo sapiens
gccttttgctctc

SEQ ID NO: 5621606 - DNA, 15 bp, Homo sapiens
gccttttgctctctg

SEQ ID NO: 5621607 - DNA, 16 bp, Homo sapiens
gccttttgctctctgt

SEQ ID NO: 5621608 - DNA, 12 bp, Homo sapiens
gccttttgctgc

SEQ ID NO: 5621609 - DNA, 16 bp, Homo sapiens
gccttttgctgcgcac

SEQ ID NO: 5621610 - DNA, 22 bp, Homo sapiens
gccttttgggaataatagcaca

SEQ ID NO: 5621611 - DNA, 22 bp, Homo sapiens
gccttttggtttcaccttccct

SEQ ID NO: 5621612 - DNA, 12 bp, Homo sapiens
gccttttgtagc

SEQ ID NO: 5621613 - DNA, 13 bp, Homo sapiens
gccttttgtagct

SEQ ID NO: 5621614 - DNA, 16 bp, Homo sapiens
gccttttgtagctgtc

SEQ ID NO: 5621615 - DNA, 21 bp, Homo sapiens
gccttttgtgtaataagaaag

SEQ ID NO: 5621616 - DNA, 21 bp, Homo sapiens
gccttttgttcatttcatcct

SEQ ID NO: 5621617 - DNA, 14 bp, Homo sapiens
gccttttgtttaaa

SEQ ID NO: 5621618 - DNA, 21 bp, Homo sapiens
gcctttttacctggcctagaa

SEQ ID NO: 5621619 - DNA, 18 bp, Homo sapiens
gcctttttagatgtattt

SEQ ID NO: 5621620 - DNA, 17 bp, Homo sapiens
gcctttttcaccatggc

SEQ ID NO: 5621621 - DNA, 23 bp, Homo sapiens
gcctttttcataaactgagcctc

SEQ ID NO: 5621622 - DNA, 22 bp, Homo sapiens
gcctttttcattattttattat

SEQ ID NO: 5621623 - DNA, 14 bp, Homo sapiens
gcctttttcattta

SEQ ID NO: 5621624 - DNA, 19 bp, Homo sapiens
gcctttttcattttccaat

SEQ ID NO: 5621625 - DNA, 12 bp, Homo sapiens
gcctttttcctg

SEQ ID NO: 5621626 - DNA, 13 bp, Homo sapiens
gcctttttcctgc

SEQ ID NO: 5621627 - DNA, 23 bp, Homo sapiens
gcctttttcctgcgtcccagcct

SEQ ID NO: 5621628 - DNA, 16 bp, Homo sapiens
gcctttttctggcctt

SEQ ID NO: 5621629 - DNA, 22 bp, Homo sapiens
gcctttttggcctgtgatgttt

SEQ ID NO: 5621630 - DNA, 19 bp, Homo sapiens
gccttttttcacggaagtt

SEQ ID NO: 5621631 - DNA, 14 bp, Homo sapiens
gccttttttcccca

SEQ ID NO: 5621632 - DNA, 16 bp, Homo sapiens
gccttttttccccaga

SEQ ID NO: 5621633 - DNA, 20 bp, Homo sapiens
gccttttttccccagacttg

SEQ ID NO: 5621634 - DNA, 23 bp, Homo sapiens
gccttttttctgtataaatgtct

SEQ ID NO: 5621635 - DNA, 15 bp, Homo sapiens
gccttttttttcatg

SEQ ID NO: 5621636 - DNA, 23 bp, Homo sapiens
gcgaaaaactcaaccaaatggta

SEQ ID NO: 5621637 - DNA, 18 bp, Homo sapiens
gcgaaagagcaaagtcat

SEQ ID NO: 5621638 - DNA, 13 bp, Homo sapiens
gcgaaagtttctt

SEQ ID NO: 5621639 - DNA, 23 bp, Homo sapiens
gcgaaataaaaatggcaaatgca

SEQ ID NO: 5621640 - DNA, 21 bp, Homo sapiens
gcgaaatgttctcatgaacta

SEQ ID NO: 5621641 - DNA, 20 bp, Homo sapiens
gcgaacagccttagagctct

SEQ ID NO: 5621642 - DNA, 19 bp, Homo sapiens
gcgaacatcttcatataaa

SEQ ID NO: 5621643 - DNA, 17 bp, Homo sapiens
gcgaaccgtgaggaggg

SEQ ID NO: 5621644 - DNA, 21 bp, Homo sapiens
gcgaacggaacgttggacttt

SEQ ID NO: 5621645 - DNA, 17 bp, Homo sapiens
gcgaacgtatttctcca

SEQ ID NO: 5621646 - DNA, 17 bp, Homo sapiens
gcgaactctcagaaata

SEQ ID NO: 5621647 - DNA, 22 bp, Homo sapiens
gcgaactgggttctttggaagc

SEQ ID NO: 5621648 - DNA, 19 bp, Homo sapiens
gcgaagaccctcttgccca

SEQ ID NO: 5621649 - DNA, 16 bp, Homo sapiens
gcgaagactgagccag

SEQ ID NO: 5621650 - DNA, 16 bp, Homo sapiens
gcgaagcctgagcagg

SEQ ID NO: 5621651 - DNA, 15 bp, Homo sapiens
gcgaagccttctgca

SEQ ID NO: 5621652 - DNA, 21 bp, Homo sapiens
gcgaagccttctgcagcagga

SEQ ID NO: 5621653 - DNA, 17 bp, Homo sapiens
gcgaagcgttgtcctca

SEQ ID NO: 5621654 - DNA, 14 bp, Homo sapiens
gcgaaggtcccaca

SEQ ID NO: 5621655 - DNA, 15 bp, Homo sapiens
gcgaaggtcccacag

SEQ ID NO: 5621656 - DNA, 20 bp, Homo sapiens
gcgaagtagcttgctccctg

SEQ ID NO: 5621657 - DNA, 20 bp, Homo sapiens
gcgaagtatataaattggct

SEQ ID NO: 5621658 - DNA, 17 bp, Homo sapiens
gcgaagtccgaggcctg

SEQ ID NO: 5621659 - DNA, 14 bp, Homo sapiens
gcgaagtcctatgg

SEQ ID NO: 5621660 - DNA, 17 bp, Homo sapiens
gcgaagtcctatggaaa

SEQ ID NO: 5621661 - DNA, 16 bp, Homo sapiens
gcgaataaatgttcaa

SEQ ID NO: 5621662 - DNA, 21 bp, Homo sapiens
gcgaataaatgttcaaactgt

SEQ ID NO: 5621663 - DNA, 22 bp, Homo sapiens
gcgaatccaagctccctgcccc

SEQ ID NO: 5621664 - DNA, 16 bp, Homo sapiens
gcgaatctagaggagg

SEQ ID NO: 5621665 - DNA, 17 bp, Homo sapiens
gcgaatctagaggaggg

SEQ ID NO: 5621666 - DNA, 12 bp, Homo sapiens
gcgaatggacca

SEQ ID NO: 5621667 - DNA, 18 bp, Homo sapiens
gcgaattcttgcttgagg

SEQ ID NO: 5621668 - DNA, 17 bp, Homo sapiens
gcgaattgtagaattgt

SEQ ID NO: 5621669 - DNA, 16 bp, Homo sapiens
gcgaattttaaaagat

SEQ ID NO: 5621670 - DNA, 13 bp, Homo sapiens
gcgacaatgcaaa

SEQ ID NO: 5621671 - DNA, 23 bp, Homo sapiens
gcgacactaaaggaggaggagcc

SEQ ID NO: 5621672 - DNA, 22 bp, Homo sapiens
gcgacactcagggcagctgcct

SEQ ID NO: 5621673 - DNA, 24 bp, Homo sapiens
gcgacactcagggcagctgcctgg

SEQ ID NO: 5621674 - DNA, 12 bp, Homo sapiens
gcgacagagcaa

SEQ ID NO: 5621675 - DNA, 19 bp, Homo sapiens
gcgacagagcgagagtctg

SEQ ID NO: 5621676 - DNA, 22 bp, Homo sapiens
gcgaccaataaacagctcccag

SEQ ID NO: 5621677 - DNA, 14 bp, Homo sapiens
gcgaccaccaaagt

SEQ ID NO: 5621678 - DNA, 15 bp, Homo sapiens
gcgaccaccaaagtc

SEQ ID NO: 5621679 - DNA, 15 bp, Homo sapiens
gcgaccacccctgtg

SEQ ID NO: 5621680 - DNA, 21 bp, Homo sapiens
gcgaccagaggtgggaggccc

SEQ ID NO: 5621681 - DNA, 15 bp, Homo sapiens
gcgaccccatctgcc

SEQ ID NO: 5621682 - DNA, 14 bp, Homo sapiens
gcgaccccccaccc

SEQ ID NO: 5621683 - DNA, 19 bp, Homo sapiens
gcgaccctgggggcacagg

SEQ ID NO: 5621684 - DNA, 23 bp, Homo sapiens
gcgacccttggtgtttcccttcc

SEQ ID NO: 5621685 - DNA, 22 bp, Homo sapiens
gcgaccgccctccgcgaaaata

SEQ ID NO: 5621686 - DNA, 20 bp, Homo sapiens
gcgacctaaacagctgcttt

SEQ ID NO: 5621687 - DNA, 20 bp, Homo sapiens
gcggaggggtttgggagtca

SEQ ID NO: 5621688 - DNA, 16 bp, Homo sapiens
gcggaggtctctggga

SEQ ID NO: 5621689 - DNA, 20 bp, Homo sapiens
gcggaggtctctgggagccc

SEQ ID NO: 5621690 - DNA, 22 bp, Homo sapiens
gcggaggtctctgggagcccag

SEQ ID NO: 5621691 - DNA, 23 bp, Homo sapiens
gcggaggtctctgggagcccaga

SEQ ID NO: 5621692 - DNA, 17 bp, Homo sapiens
gcggaggtggagtggcc

SEQ ID NO: 5621693 - DNA, 16 bp, Homo sapiens
gcggaggttgcaggga

SEQ ID NO: 5621694 - DNA, 19 bp, Homo sapiens
gcggaggttgcagtgagct

SEQ ID NO: 5621695 - DNA, 21 bp, Homo sapiens
gcggagtccccggggttcccc

SEQ ID NO: 5621696 - DNA, 14 bp, Homo sapiens
gcggagtgaagagg

SEQ ID NO: 5621697 - DNA, 18 bp, Homo sapiens
gcggagtgaagaggggca

SEQ ID NO: 5621698 - DNA, 18 bp, Homo sapiens
gcggatcaaccaggcaga

SEQ ID NO: 5621699 - DNA, 20 bp, Homo sapiens
gcggatcaaccaggcagagt

SEQ ID NO: 5621700 - DNA, 14 bp, Homo sapiens
gcggatcctgctgg

SEQ ID NO: 5621701 - DNA, 19 bp, Homo sapiens
gcggattaatttgcatctg

SEQ ID NO: 5621702 - DNA, 19 bp, Homo sapiens
gcggattgctctggagcag

SEQ ID NO: 5621703 - DNA, 21 bp, Homo sapiens
gcggatttctctttctctctc

SEQ ID NO: 5621704 - DNA, 14 bp, Homo sapiens
gcggcaaaaggaaa

SEQ ID NO: 5621705 - DNA, 23 bp, Homo sapiens
gcggcaaacctttcccccttagc

SEQ ID NO: 5621706 - DNA, 17 bp, Homo sapiens
gcggcaaagatccagcg

SEQ ID NO: 5621707 - DNA, 16 bp, Homo sapiens
gcggcacagaggcagc

SEQ ID NO: 5621708 - DNA, 19 bp, Homo sapiens
gcggcacccaggcctccct

SEQ ID NO: 5621709 - DNA, 20 bp, Homo sapiens
gcggcacgccaacagccccc

SEQ ID NO: 5621710 - DNA, 17 bp, Homo sapiens
gcggcagcagccatcat

SEQ ID NO: 5621711 - DNA, 19 bp, Homo sapiens
gcggcagctcttctgggca

SEQ ID NO: 5621712 - DNA, 21 bp, Homo sapiens
gcggcagctcttctgggcaga

SEQ ID NO: 5621713 - DNA, 15 bp, Homo sapiens
gcggcagctggggcc

SEQ ID NO: 5621714 - DNA, 20 bp, Homo sapiens
gcggcaggagcaggaacaga

SEQ ID NO: 5621715 - DNA, 23 bp, Homo sapiens
gcggcaggagcaggaacagagac

SEQ ID NO: 5621716 - DNA, 22 bp, Homo sapiens
gcggcaggagggaggtttgtga

SEQ ID NO: 5621717 - DNA, 15 bp, Homo sapiens
gcggcaggggcctgg

SEQ ID NO: 5621718 - DNA, 17 bp, Homo sapiens
gcggcaggggttggcag

SEQ ID NO: 5621719 - DNA, 14 bp, Homo sapiens
gcggcagtgggcct

SEQ ID NO: 5621720 - DNA, 13 bp, Homo sapiens
gcggcatcaggct

SEQ ID NO: 5621721 - DNA, 16 bp, Homo sapiens
gcggcattaaagccat

SEQ ID NO: 5621722 - DNA, 13 bp, Homo sapiens
gcggccaccaccc

SEQ ID NO: 5621723 - DNA, 21 bp, Homo sapiens
gcggccacctcaccctctccg

SEQ ID NO: 5621724 - DNA, 20 bp, Homo sapiens
gcggccacgcactgggccac

SEQ ID NO: 5621725 - DNA, 11 bp, Homo sapiens
gcggccagagc

SEQ ID NO: 5621726 - DNA, 12 bp, Homo sapiens
gcggccagagcc

SEQ ID NO: 5621727 - DNA, 19 bp, Homo sapiens
gcggccagccccggccctg

SEQ ID NO: 5621728 - DNA, 21 bp, Homo sapiens
gcggccagccccggccctggg

SEQ ID NO: 5621729 - DNA, 14 bp, Homo sapiens
gcggccaggcacag

SEQ ID NO: 5621730 - DNA, 15 bp, Homo sapiens
gcggccaggcacagg

SEQ ID NO: 5621731 - DNA, 19 bp, Homo sapiens
gcggccaggcacagggccc

SEQ ID NO: 5621732 - DNA, 23 bp, Homo sapiens
gcggccaggcacagggcccgcag

SEQ ID NO: 5621733 - DNA, 15 bp, Homo sapiens
gcggccaggcaccca

SEQ ID NO: 5621734 - DNA, 12 bp, Homo sapiens
gcggccagggac

SEQ ID NO: 5621735 - DNA, 20 bp, Homo sapiens
gcggccagggacccaaagca

SEQ ID NO: 5621736 - DNA, 20 bp, Homo sapiens
gcggccagggacccccgagg

SEQ ID NO: 5621737 - DNA, 20 bp, Homo sapiens
gcggccagtgcggctgccag

SEQ ID NO: 5621738 - DNA, 22 bp, Homo sapiens
gcggcccaagcccgacttgctg

SEQ ID NO: 5621739 - DNA, 16 bp, Homo sapiens
gcggcccaatccaagg

SEQ ID NO: 5621740 - DNA, 22 bp, Homo sapiens
gcggcccaatccaaggtggggt

SEQ ID NO: 5621741 - DNA, 15 bp, Homo sapiens
gcggcccacgccagc

SEQ ID NO: 5621742 - DNA, 14 bp, Homo sapiens
gcggcccagaccca

SEQ ID NO: 5621743 - DNA, 15 bp, Homo sapiens
gcggcccagacccac

SEQ ID NO: 5621744 - DNA, 15 bp, Homo sapiens
gcggcccagcccggc

SEQ ID NO: 5621745 - DNA, 20 bp, Homo sapiens
gcggcccagcctctgagtcc

SEQ ID NO: 5621746 - DNA, 20 bp, Homo sapiens
gcggccccaactcgggctcc

SEQ ID NO: 5621747 - DNA, 18 bp, Homo sapiens
gcggccccccgcacagcc

SEQ ID NO: 5621748 - DNA, 20 bp, Homo sapiens
gcggccccccgcacagccac

SEQ ID NO: 5621749 - DNA, 22 bp, Homo sapiens
gcggccccccgcacagccaccc

SEQ ID NO: 5621750 - DNA, 16 bp, Homo sapiens
gcggccccgcacccct

SEQ ID NO: 5621751 - DNA, 21 bp, Homo sapiens
gcggccccgcacccctcctcc

SEQ ID NO: 5621752 - DNA, 16 bp, Homo sapiens
gcggccccgccgcaga

SEQ ID NO: 5621753 - DNA, 18 bp, Homo sapiens
gcggcccctcagcctgcc

SEQ ID NO: 5621754 - DNA, 19 bp, Homo sapiens
gcggcccctcagcctgcct

SEQ ID NO: 5621755 - DNA, 13 bp, Homo sapiens
gcggcccctcccg

SEQ ID NO: 5621756 - DNA, 19 bp, Homo sapiens
gcggcccgcgcagctgcct

SEQ ID NO: 5621757 - DNA, 18 bp, Homo sapiens
gcggcccggacgggggag

SEQ ID NO: 5621758 - DNA, 15 bp, Homo sapiens
gcggcccggccagcg

SEQ ID NO: 5621759 - DNA, 16 bp, Homo sapiens
gcggcccggccagcgg

SEQ ID NO: 5621760 - DNA, 22 bp, Homo sapiens
gcggcccggccagcgggcacag

SEQ ID NO: 5621761 - DNA, 23 bp, Homo sapiens
gcggcccggccagcgggcacagg

SEQ ID NO: 5621762 - DNA, 14 bp, Homo sapiens
gcggcccggcccac

SEQ ID NO: 5621763 - DNA, 20 bp, Homo sapiens
gcggcccgtgcgcagccgcg

SEQ ID NO: 5621764 - DNA, 15 bp, Homo sapiens
gcggcccgtggacac

SEQ ID NO: 5621765 - DNA, 17 bp, Homo sapiens
gcggcccgtggacaccc

SEQ ID NO: 5621766 - DNA, 22 bp, Homo sapiens
gcggcccgtggacaccccagac

SEQ ID NO: 5621767 - DNA, 14 bp, Homo sapiens
gcggccctcccagg

SEQ ID NO: 5621768 - DNA, 12 bp, Homo sapiens
gcggccctgaca

SEQ ID NO: 5621769 - DNA, 21 bp, Homo sapiens
gcggccctgatctccgcagag

SEQ ID NO: 5621770 - DNA, 24 bp, Homo sapiens
gcggccctgctgaagctgctgcag

SEQ ID NO: 5621771 - DNA, 15 bp, Homo sapiens
gcggccctggaggat

SEQ ID NO: 5621772 - DNA, 17 bp, Homo sapiens
gcggcccttcctgcagc

SEQ ID NO: 5621773 - DNA, 14 bp, Homo sapiens
gcggcccttctgac

SEQ ID NO: 5621774 - DNA, 19 bp, Homo sapiens
gcggcccttctgactgttt

SEQ ID NO: 5621775 - DNA, 20 bp, Homo sapiens
gcggccgacatcagcccggt

SEQ ID NO: 5621776 - DNA, 15 bp, Homo sapiens
gcggccgcattccct

SEQ ID NO: 5621777 - DNA, 16 bp, Homo sapiens
gcggccgcattccctg

SEQ ID NO: 5621778 - DNA, 18 bp, Homo sapiens
gcggccgcattccctgag

SEQ ID NO: 5621779 - DNA, 21 bp, Homo sapiens
gcggccggccgagctgcctgg

SEQ ID NO: 5621780 - DNA, 22 bp, Homo sapiens
gcggccggccgagctgcctggc

SEQ ID NO: 5621781 - DNA, 18 bp, Homo sapiens
gcggccggcctggggccg

SEQ ID NO: 5621782 - DNA, 23 bp, Homo sapiens
gcggccggcctggggccgggctg

SEQ ID NO: 5621783 - DNA, 23 bp, Homo sapiens
gcggcctatgacttgggcacccc

SEQ ID NO: 5621784 - DNA, 22 bp, Homo sapiens
gcggcctcaccaggcccacgag

SEQ ID NO: 5621785 - DNA, 21 bp, Homo sapiens
gcggcctcagggtctaaggag

SEQ ID NO: 5621786 - DNA, 12 bp, Homo sapiens
gcggcctccaca

SEQ ID NO: 5621787 - DNA, 21 bp, Homo sapiens
gcggcctcccgaggaggggcc

SEQ ID NO: 5621788 - DNA, 14 bp, Homo sapiens
gcggcctccttctg

SEQ ID NO: 5621789 - DNA, 18 bp, Homo sapiens
gcggcctcttctctcaga

SEQ ID NO: 5621790 - DNA, 14 bp, Homo sapiens
gcggcctgcagacc

SEQ ID NO: 5621791 - DNA, 12 bp, Homo sapiens
gcggcctggacc

SEQ ID NO: 5621792 - DNA, 18 bp, Homo sapiens
gcggcctggacccctgga

SEQ ID NO: 5621793 - DNA, 18 bp, Homo sapiens
gcggccttgtctgggtgc

SEQ ID NO: 5621794 - DNA, 14 bp, Homo sapiens
gcggcgcagagccc

SEQ ID NO: 5621795 - DNA, 15 bp, Homo sapiens
gcggcgcagagccct

SEQ ID NO: 5621796 - DNA, 19 bp, Homo sapiens
gcggcgcagagccctccag

SEQ ID NO: 5621797 - DNA, 13 bp, Homo sapiens
gcggcgcagaggg

SEQ ID NO: 5621798 - DNA, 13 bp, Homo sapiens
gcggcgccctgga

SEQ ID NO: 5621799 - DNA, 20 bp, Homo sapiens
gcggcggagctggccccgcc

SEQ ID NO: 5621800 - DNA, 14 bp, Homo sapiens
gcggcggtcccagc

SEQ ID NO: 5621801 - DNA, 16 bp, Homo sapiens
gcggcggtcccagctc

SEQ ID NO: 5621802 - DNA, 18 bp, Homo sapiens
gcggcggtgggcgcctgt

SEQ ID NO: 5621803 - DNA, 19 bp, Homo sapiens
gcggcgtggagactggcag

SEQ ID NO: 5621804 - DNA, 20 bp, Homo sapiens
gcggctactcagcagccctc

SEQ ID NO: 5621805 - DNA, 21 bp, Homo sapiens
gcggctactcagcagccctcc

SEQ ID NO: 5621806 - DNA, 19 bp, Homo sapiens
gcggctaggccggccagct

SEQ ID NO: 5621807 - DNA, 23 bp, Homo sapiens
gcggctaggccggccagctcccc

SEQ ID NO: 5621808 - DNA, 15 bp, Homo sapiens
gcggctccagcccag

SEQ ID NO: 5621809 - DNA, 13 bp, Homo sapiens
gcggctccaggtc

SEQ ID NO: 5621810 - DNA, 18 bp, Homo sapiens
gcggctccccctggacgg

SEQ ID NO: 5621811 - DNA, 22 bp, Homo sapiens
gcggctcccctctgcttctcat

SEQ ID NO: 5621812 - DNA, 15 bp, Homo sapiens
gcggctcctggtgct

SEQ ID NO: 5621813 - DNA, 15 bp, Homo sapiens
gcggctctagcccca

SEQ ID NO: 5621814 - DNA, 19 bp, Homo sapiens
gcggctctgagcaggggca

SEQ ID NO: 5621815 - DNA, 20 bp, Homo sapiens
gcggctctgagcaggggcag

SEQ ID NO: 5621816 - DNA, 14 bp, Homo sapiens
gcggctctgggaag

SEQ ID NO: 5621817 - DNA, 15 bp, Homo sapiens
gcggctcttcctgga

SEQ ID NO: 5621818 - DNA, 18 bp, Homo sapiens
gcggctgagagccccagc

SEQ ID NO: 5621819 - DNA, 21 bp, Homo sapiens
gcggctgagagccccagctga

SEQ ID NO: 5621820 - DNA, 23 bp, Homo sapiens
gcggctgagagccccagctgaca

SEQ ID NO: 5621821 - DNA, 17 bp, Homo sapiens
gcggctgagctccagcc

SEQ ID NO: 5621822 - DNA, 20 bp, Homo sapiens
gcggctgcacaacagccctg

SEQ ID NO: 5621823 - DNA, 15 bp, Homo sapiens
gcggctgctcaagcc

SEQ ID NO: 5621824 - DNA, 20 bp, Homo sapiens
gcggctgctcgcccaggaag

SEQ ID NO: 5621825 - DNA, 21 bp, Homo sapiens
gcggctgctcgcccaggaagg

SEQ ID NO: 5621826 - DNA, 22 bp, Homo sapiens
gcggctgctcgcccaggaaggc

SEQ ID NO: 5621827 - DNA, 15 bp, Homo sapiens
gcggctgctggcaca

SEQ ID NO: 5621828 - DNA, 14 bp, Homo sapiens
gcggctggaaagag

SEQ ID NO: 5621829 - DNA, 16 bp, Homo sapiens
gcggctggacttggag

SEQ ID NO: 5621830 - DNA, 23 bp, Homo sapiens
gcggctggatgggggctctgcac

SEQ ID NO: 5621831 - DNA, 15 bp, Homo sapiens
gcggctggcagccca

SEQ ID NO: 5621832 - DNA, 20 bp, Homo sapiens
gcggctggccatggagaaag

SEQ ID NO: 5621833 - DNA, 19 bp, Homo sapiens
gcggctgggagcctcgccc

SEQ ID NO: 5621834 - DNA, 13 bp, Homo sapiens
gcggctgggagga

SEQ ID NO: 5621835 - DNA, 14 bp, Homo sapiens
gcggctgggaggag

SEQ ID NO: 5621836 - DNA, 18 bp, Homo sapiens
gcggctgggaggagggca

SEQ ID NO: 5621837 - DNA, 17 bp, Homo sapiens
gcggctggggtcccagc

SEQ ID NO: 5621838 - DNA, 22 bp, Homo sapiens
gcggctggggtcccagcagctg

SEQ ID NO: 5621839 - DNA, 21 bp, Homo sapiens
gcggctgtgggcgagcatggg

SEQ ID NO: 5621840 - DNA, 21 bp, Homo sapiens
gcggctgtgggggaggtccct

SEQ ID NO: 5621841 - DNA, 16 bp, Homo sapiens
gcggcttccctgcgac

SEQ ID NO: 5621842 - DNA, 17 bp, Homo sapiens
gcggcttcctgtccact

SEQ ID NO: 5621843 - DNA, 22 bp, Homo sapiens
gcggctttatcattcctttcca

SEQ ID NO: 5621844 - DNA, 14 bp, Homo sapiens
gcggctttctctgc

SEQ ID NO: 5621845 - DNA, 17 bp, Homo sapiens
gcgggaaagccagtgac

SEQ ID NO: 5621846 - DNA, 15 bp, Homo sapiens
gcgggaaccctctgg

SEQ ID NO: 5621847 - DNA, 13 bp, Homo sapiens
gcgggaaggaggg

SEQ ID NO: 5621848 - DNA, 20 bp, Homo sapiens
gcgggaagggtgggccctgg

SEQ ID NO: 5621849 - DNA, 15 bp, Homo sapiens
gcgggacagcggccc

SEQ ID NO: 5621850 - DNA, 16 bp, Homo sapiens
gcgggacagcggcccc

SEQ ID NO: 5621851 - DNA, 14 bp, Homo sapiens
gcgggacaggactt

SEQ ID NO: 5621852 - DNA, 15 bp, Homo sapiens
gcgggacaggacttg

SEQ ID NO: 5621853 - DNA, 16 bp, Homo sapiens
gcgggacatgatgcta

SEQ ID NO: 5621854 - DNA, 19 bp, Homo sapiens
gcgggaccggtacagaaag

SEQ ID NO: 5621855 - DNA, 21 bp, Homo sapiens
gcgggacgtccctgcccatgt

SEQ ID NO: 5621856 - DNA, 14 bp, Homo sapiens
gcgggactgggggc

SEQ ID NO: 5621857 - DNA, 16 bp, Homo sapiens
gcgggagacctgtgct

SEQ ID NO: 5621858 - DNA, 23 bp, Homo sapiens
gcgggagagagtgagagagagtg

SEQ ID NO: 5621859 - DNA, 21 bp, Homo sapiens
gcgggagccatgcgccccctc

SEQ ID NO: 5621860 - DNA, 15 bp, Homo sapiens
gcgggagctctgtat

SEQ ID NO: 5621861 - DNA, 20 bp, Homo sapiens
gcgggaggaagccggtgtcc

SEQ ID NO: 5621862 - DNA, 20 bp, Homo sapiens
gcgggaggatgttctgggac

SEQ ID NO: 5621863 - DNA, 22 bp, Homo sapiens
gcgtgtgaagaacacctcctcc

SEQ ID NO: 5621864 - DNA, 23 bp, Homo sapiens
gcgtgtgatttgtctctgagccc

SEQ ID NO: 5621865 - DNA, 16 bp, Homo sapiens
gcgtgtgccaggcaga

SEQ ID NO: 5621866 - DNA, 18 bp, Homo sapiens
gcgtgtgcgtgcatgtgc

SEQ ID NO: 5621867 - DNA, 12 bp, Homo sapiens
gcgtgtggagca

SEQ ID NO: 5621868 - DNA, 17 bp, Homo sapiens
gcgtgtggagcagagct

SEQ ID NO: 5621869 - DNA, 18 bp, Homo sapiens
gcgtgtggccctgtggga

SEQ ID NO: 5621870 - DNA, 13 bp, Homo sapiens
gcgtgtggctcac

SEQ ID NO: 5621871 - DNA, 14 bp, Homo sapiens
gcgtgtggctcacg

SEQ ID NO: 5621872 - DNA, 19 bp, Homo sapiens
gcgtgtggctcacgtgtgt

SEQ ID NO: 5621873 - DNA, 21 bp, Homo sapiens
gcgtgtgggtctctgggcaca

SEQ ID NO: 5621874 - DNA, 21 bp, Homo sapiens
gcgtgtgtagagttaagaagc

SEQ ID NO: 5621875 - DNA, 22 bp, Homo sapiens
gcgtgtgtagagttaagaagct

SEQ ID NO: 5621876 - DNA, 14 bp, Homo sapiens
gcgtgtgtcaggga

SEQ ID NO: 5621877 - DNA, 23 bp, Homo sapiens
gcgtgtgtccatgtgtgtgcaag

SEQ ID NO: 5621878 - DNA, 19 bp, Homo sapiens
gcgtgtgtgacactgatga

SEQ ID NO: 5621879 - DNA, 13 bp, Homo sapiens
gcgtgtgtgtatg

SEQ ID NO: 5621880 - DNA, 19 bp, Homo sapiens
gcgtgttagtgtgtgtgca

SEQ ID NO: 5621881 - DNA, 21 bp, Homo sapiens
gcgtgttagtgtgtgtgcatg

SEQ ID NO: 5621882 - DNA, 18 bp, Homo sapiens
gcgttatagtaactccca

SEQ ID NO: 5621883 - DNA, 17 bp, Homo sapiens
gcgttcaccagtgacct

SEQ ID NO: 5621884 - DNA, 14 bp, Homo sapiens
gcgttcccttctcc

SEQ ID NO: 5621885 - DNA, 19 bp, Homo sapiens
gcgttcccttctccccctt

SEQ ID NO: 5621886 - DNA, 16 bp, Homo sapiens
gcgttcctttcttttc

SEQ ID NO: 5621887 - DNA, 23 bp, Homo sapiens
gcgttctaccaggcaaattcact

SEQ ID NO: 5621888 - DNA, 14 bp, Homo sapiens
gcgttctcaagaat

SEQ ID NO: 5621889 - DNA, 11 bp, Homo sapiens
gcgttctcagc

SEQ ID NO: 5621890 - DNA, 15 bp, Homo sapiens
gcgttctcatcccag

SEQ ID NO: 5621891 - DNA, 20 bp, Homo sapiens
gcgttctggactctgcccca

SEQ ID NO: 5621892 - DNA, 15 bp, Homo sapiens
gcgttcttgtaattt

SEQ ID NO: 5621893 - DNA, 17 bp, Homo sapiens
gcgttcttgtaatttta

SEQ ID NO: 5621894 - DNA, 24 bp, Homo sapiens
gcgttgaaattgtaattatatctg

SEQ ID NO: 5621895 - DNA, 20 bp, Homo sapiens
gcgttggaatcacctggagg

SEQ ID NO: 5621896 - DNA, 14 bp, Homo sapiens
gcgttggagccact

SEQ ID NO: 5621897 - DNA, 15 bp, Homo sapiens
gcgttggagccactc

SEQ ID NO: 5621898 - DNA, 17 bp, Homo sapiens
gcgttggagccactcct

SEQ ID NO: 5621899 - DNA, 21 bp, Homo sapiens
gcgttggagccactcctgtcc

SEQ ID NO: 5621900 - DNA, 22 bp, Homo sapiens
gcgttggatttaaaaatgccaa

SEQ ID NO: 5621901 - DNA, 23 bp, Homo sapiens
gcgttggatttaaaaatgccaaa

SEQ ID NO: 5621902 - DNA, 20 bp, Homo sapiens
gcgttggcttctccctgggg

SEQ ID NO: 5621903 - DNA, 21 bp, Homo sapiens
gcgttggcttctccctgggga

SEQ ID NO: 5621904 - DNA, 22 bp, Homo sapiens
gcgttggtccagagcggaggct

SEQ ID NO: 5621905 - DNA, 19 bp, Homo sapiens
gcgttgtaaaatatagctg

SEQ ID NO: 5621906 - DNA, 19 bp, Homo sapiens
gcgttgtgtatattacacc

SEQ ID NO: 5621907 - DNA, 21 bp, Homo sapiens
gcgtttacatatttacctgta

SEQ ID NO: 5621908 - DNA, 17 bp, Homo sapiens
gcgtttataattggctt

SEQ ID NO: 5621909 - DNA, 20 bp, Homo sapiens
gcgtttcaccatgttggcca

SEQ ID NO: 5621910 - DNA, 17 bp, Homo sapiens
gcgtttctatgacacat

SEQ ID NO: 5621911 - DNA, 18 bp, Homo sapiens
gcgtttctatgacacatg

SEQ ID NO: 5621912 - DNA, 21 bp, Homo sapiens
gcgtttgctgtgccaggaggc

SEQ ID NO: 5621913 - DNA, 16 bp, Homo sapiens
gcgtttggggccctct

SEQ ID NO: 5621914 - DNA, 15 bp, Homo sapiens
gcgtttgtaaattct

SEQ ID NO: 5621915 - DNA, 14 bp, Homo sapiens
gcgtttttacagtt

SEQ ID NO: 5621916 - DNA, 12 bp, Homo sapiens
gcgtttttcctt

SEQ ID NO: 5621917 - DNA, 14 bp, Homo sapiens
gcgtttttctcgtc

SEQ ID NO: 5621918 - DNA, 20 bp, Homo sapiens
gcgtttttttacaacattca

SEQ ID NO: 5621919 - DNA, 17 bp, Homo sapiens
gctaaaaaaagtgcatg

SEQ ID NO: 5621920 - DNA, 18 bp, Homo sapiens
gctaaaaaaagtgcatga

SEQ ID NO: 5621921 - DNA, 13 bp, Homo sapiens
gctaaaaaataaa

SEQ ID NO: 5621922 - DNA, 12 bp, Homo sapiens
gctaaaaacatt

SEQ ID NO: 5621923 - DNA, 11 bp, Homo sapiens
gctaaaaagaa

SEQ ID NO: 5621924 - DNA, 17 bp, Homo sapiens
gctaaaaagaatgcaga

SEQ ID NO: 5621925 - DNA, 19 bp, Homo sapiens
gctaaaaagaatgcagaga

SEQ ID NO: 5621926 - DNA, 18 bp, Homo sapiens
gctaaaaatgagcttgat

SEQ ID NO: 5621927 - DNA, 22 bp, Homo sapiens
gctaaaaatgagcttgattaaa

SEQ ID NO: 5621928 - DNA, 16 bp, Homo sapiens
gctaaaagaggcctgt

SEQ ID NO: 5621929 - DNA, 18 bp, Homo sapiens
gctaaaaggcttccaggc

SEQ ID NO: 5621930 - DNA, 15 bp, Homo sapiens
gctaaaagtgcattt

SEQ ID NO: 5621931 - DNA, 23 bp, Homo sapiens
gctaaaagtgcatttaaggagat

SEQ ID NO: 5621932 - DNA, 17 bp, Homo sapiens
gctaaaataaagaaata

SEQ ID NO: 5621933 - DNA, 12 bp, Homo sapiens
gctaaaatgtta

SEQ ID NO: 5621934 - DNA, 18 bp, Homo sapiens
gctaaacaagtaagaaaa

SEQ ID NO: 5621935 - DNA, 20 bp, Homo sapiens
gctaaacctatctgtattgg

SEQ ID NO: 5621936 - DNA, 22 bp, Homo sapiens
gctaaacctatctgtattggca

SEQ ID NO: 5621937 - DNA, 22 bp, Homo sapiens
gctaaacgtgtatgtttttcag

SEQ ID NO: 5621938 - DNA, 17 bp, Homo sapiens
gctaaactccttcctgg

SEQ ID NO: 5621939 - DNA, 21 bp, Homo sapiens
gctaaactgaatctatggctt

SEQ ID NO: 5621940 - DNA, 10 bp, Homo sapiens
gctaaacttg

SEQ ID NO: 5621941 - DNA, 17 bp, Homo sapiens
gctaaacttttctgata

SEQ ID NO: 5621942 - DNA, 15 bp, Homo sapiens
gctaaagaagtttga

SEQ ID NO: 5621943 - DNA, 18 bp, Homo sapiens
gctaaagaagtttgaaca

SEQ ID NO: 5621944 - DNA, 20 bp, Homo sapiens
gctaaagactgatctcaggg

SEQ ID NO: 5621945 - DNA, 14 bp, Homo sapiens
gctaaagagccctt

SEQ ID NO: 5621946 - DNA, 21 bp, Homo sapiens
gctaaagataattgctattta

SEQ ID NO: 5621947 - DNA, 14 bp, Homo sapiens
gctaaagatgatga

SEQ ID NO: 5621948 - DNA, 17 bp, Homo sapiens
gctaaagcaatatgcat

SEQ ID NO: 5621949 - DNA, 12 bp, Homo sapiens
gctaaagcctgt

SEQ ID NO: 5621950 - DNA, 17 bp, Homo sapiens
gctaaagcctgtgggtt

SEQ ID NO: 5621951 - DNA, 16 bp, Homo sapiens
gctaaaggaggccata

SEQ ID NO: 5621952 - DNA, 21 bp, Homo sapiens
gctaaagggaccatctgctgc

SEQ ID NO: 5621953 - DNA, 20 bp, Homo sapiens
gctaaagggagaaatgccag

SEQ ID NO: 5621954 - DNA, 18 bp, Homo sapiens
gctaaaggggagaaactg

SEQ ID NO: 5621955 - DNA, 22 bp, Homo sapiens
gctaaaggttaccgatttcaaa

SEQ ID NO: 5621956 - DNA, 20 bp, Homo sapiens
gctaaataaaatttgttgca

SEQ ID NO: 5621957 - DNA, 12 bp, Homo sapiens
gctaaataaaca

SEQ ID NO: 5621958 - DNA, 13 bp, Homo sapiens
gctaaataaacat

SEQ ID NO: 5621959 - DNA, 12 bp, Homo sapiens
gctaaataaatg

SEQ ID NO: 5621960 - DNA, 14 bp, Homo sapiens
gctaaataactata

SEQ ID NO: 5621961 - DNA, 16 bp, Homo sapiens
gctaaataactatata

SEQ ID NO: 5621962 - DNA, 21 bp, Homo sapiens
gctaaataactatataagaca

SEQ ID NO: 5621963 - DNA, 18 bp, Homo sapiens
gctaaataatcttactct

SEQ ID NO: 5621964 - DNA, 16 bp, Homo sapiens
gctaaatactgtacat

SEQ ID NO: 5621965 - DNA, 18 bp, Homo sapiens
gctaaatactgtacatag

SEQ ID NO: 5621966 - DNA, 19 bp, Homo sapiens
gctaaatcctttactgtta

SEQ ID NO: 5621967 - DNA, 23 bp, Homo sapiens
gctaaatgaagagacttaagaaa

SEQ ID NO: 5621968 - DNA, 18 bp, Homo sapiens
gctaaatggcaacaaaca

SEQ ID NO: 5621969 - DNA, 18 bp, Homo sapiens
gctaaatgtaacttattc

SEQ ID NO: 5621970 - DNA, 13 bp, Homo sapiens
gctaaatgtgaat

SEQ ID NO: 5621971 - DNA, 17 bp, Homo sapiens
gctaaatgtgagtattt

SEQ ID NO: 5621972 - DNA, 18 bp, Homo sapiens
gctaaattacaattgtca

SEQ ID NO: 5621973 - DNA, 19 bp, Homo sapiens
gctaaattataaaattgaa

SEQ ID NO: 5621974 - DNA, 17 bp, Homo sapiens
gctaaattgatgttgat

SEQ ID NO: 5621975 - DNA, 20 bp, Homo sapiens
gctaaattgatgttgatgca

SEQ ID NO: 5621976 - DNA, 13 bp, Homo sapiens
gctaaattttctg

SEQ ID NO: 5621977 - DNA, 12 bp, Homo sapiens
gctaaattttta

SEQ ID NO: 5621978 - DNA, 13 bp, Homo sapiens
gctaacaaaagat

SEQ ID NO: 5621979 - DNA, 14 bp, Homo sapiens
gctaacaaaagata

SEQ ID NO: 5621980 - DNA, 17 bp, Homo sapiens
gctaacaatttctcata

SEQ ID NO: 5621981 - DNA, 16 bp, Homo sapiens
gctaacactggcccct

SEQ ID NO: 5621982 - DNA, 22 bp, Homo sapiens
gctaacagggaaggcaggcagg

SEQ ID NO: 5621983 - DNA, 17 bp, Homo sapiens
gctaacagttgccacat

SEQ ID NO: 5621984 - DNA, 17 bp, Homo sapiens
gctaacatttaggagaa

SEQ ID NO: 5621985 - DNA, 18 bp, Homo sapiens
gctaacatttaggagaag

SEQ ID NO: 5621986 - DNA, 17 bp, Homo sapiens
gctaacattttaaataa

SEQ ID NO: 5621987 - DNA, 20 bp, Homo sapiens
gctaaccacttcgcacacac

SEQ ID NO: 5621988 - DNA, 18 bp, Homo sapiens
gctaaccatcgaaaagaa

SEQ ID NO: 5621989 - DNA, 22 bp, Homo sapiens
gctaaccccaagctgcctctgg

SEQ ID NO: 5621990 - DNA, 22 bp, Homo sapiens
gctaacccccttctactgagcc

SEQ ID NO: 5621991 - DNA, 16 bp, Homo sapiens
gctaacctcactgcct

SEQ ID NO: 5621992 - DNA, 17 bp, Homo sapiens
gctaacctcactgcctc

SEQ ID NO: 5621993 - DNA, 22 bp, Homo sapiens
gctaacctccaacacagtgcat

SEQ ID NO: 5621994 - DNA, 20 bp, Homo sapiens
gctaacctgttacactgggc

SEQ ID NO: 5621995 - DNA, 17 bp, Homo sapiens
gctaacgggaggctggg

SEQ ID NO: 5621996 - DNA, 21 bp, Homo sapiens
gctaacgggaggctgggcaca

SEQ ID NO: 5621997 - DNA, 18 bp, Homo sapiens
gctaactgaactttgaag

SEQ ID NO: 5621998 - DNA, 15 bp, Homo sapiens
gctaactgagagaag

SEQ ID NO: 5621999 - DNA, 12 bp, Homo sapiens
gctaactggaag

SEQ ID NO: 5622000 - DNA, 17 bp, Homo sapiens
gctaactggccccaggc

SEQ ID NO: 5622001 - DNA, 16 bp, Homo sapiens
gctaactgggaagaac

SEQ ID NO: 5622002 - DNA, 19 bp, Homo sapiens
gctaactgggaagaacaag

SEQ ID NO: 5622003 - DNA, 20 bp, Homo sapiens
gctaactgggttaaatattt

SEQ ID NO: 5622004 - DNA, 14 bp, Homo sapiens
gctaactggttaaa

SEQ ID NO: 5622005 - DNA, 14 bp, Homo sapiens
gctaactgtaaatc

SEQ ID NO: 5622006 - DNA, 15 bp, Homo sapiens
gctaactgtatgtgt

SEQ ID NO: 5622007 - DNA, 20 bp, Homo sapiens
gctaacttgcttaaatgtga

SEQ ID NO: 5622008 - DNA, 14 bp, Homo sapiens
gctaagaaaagatt

SEQ ID NO: 5622009 - DNA, 23 bp, Homo sapiens
gctaagaaaccaggagtaaaaga

SEQ ID NO: 5622010 - DNA, 16 bp, Homo sapiens
gctaagaatatttgaa

SEQ ID NO: 5622011 - DNA, 14 bp, Homo sapiens
gctaagagaagtag

SEQ ID NO: 5622012 - DNA, 17 bp, Homo sapiens
gctaagatactgctgat

SEQ ID NO: 5622013 - DNA, 19 bp, Homo sapiens
gctaagatagaaagctgga

SEQ ID NO: 5622014 - DNA, 22 bp, Homo sapiens
gctaagatagaaagctggactg

SEQ ID NO: 5622015 - DNA, 13 bp, Homo sapiens
gctaagatataat

SEQ ID NO: 5622016 - DNA, 23 bp, Homo sapiens
gctaagatgagatttgccagcac

SEQ ID NO: 5622017 - DNA, 19 bp, Homo sapiens
gctaagcaagctaacctta

SEQ ID NO: 5622018 - DNA, 18 bp, Homo sapiens
gctaagcatattttctct

SEQ ID NO: 5622019 - DNA, 20 bp, Homo sapiens
gctaagccccagcaagcaat

SEQ ID NO: 5622020 - DNA, 16 bp, Homo sapiens
gctaagcctgatgatg

SEQ ID NO: 5622021 - DNA, 21 bp, Homo sapiens
gctaagctaaagaaactgctt

SEQ ID NO: 5622022 - DNA, 11 bp, Homo sapiens
gctaagctacc

SEQ ID NO: 5622023 - DNA, 15 bp, Homo sapiens
gctaagctaggaatg

SEQ ID NO: 5622024 - DNA, 22 bp, Homo sapiens
gctaagctcacgtcctgagaaa

SEQ ID NO: 5622025 - DNA, 14 bp, Homo sapiens
gctaagctgcaggc

SEQ ID NO: 5622026 - DNA, 15 bp, Homo sapiens
gctaagctgcaggca

SEQ ID NO: 5622027 - DNA, 14 bp, Homo sapiens
gctaagctgccctg

SEQ ID NO: 5622028 - DNA, 15 bp, Homo sapiens
gctaaggaacaatgc

SEQ ID NO: 5622029 - DNA, 22 bp, Homo sapiens
gctaaggaagacacagcccaga

SEQ ID NO: 5622030 - DNA, 23 bp, Homo sapiens
gctaaggaagacacagcccagac

SEQ ID NO: 5622031 - DNA, 16 bp, Homo sapiens
gctaaggacaggcagg

SEQ ID NO: 5622032 - DNA, 20 bp, Homo sapiens
gctaaggacatttcccaggg

SEQ ID NO: 5622033 - DNA, 12 bp, Homo sapiens
gctaaggacttg

SEQ ID NO: 5622034 - DNA, 14 bp, Homo sapiens
gctaaggcaccagc

SEQ ID NO: 5622035 - DNA, 12 bp, Homo sapiens
gctaaggcagct

SEQ ID NO: 5622036 - DNA, 14 bp, Homo sapiens
gctaaggcagctga

SEQ ID NO: 5622037 - DNA, 15 bp, Homo sapiens
gctaaggcaggagga

SEQ ID NO: 5622038 - DNA, 18 bp, Homo sapiens
gctaaggcaggaggatca

SEQ ID NO: 5622039 - DNA, 16 bp, Homo sapiens
gctaaggccaatgggc

SEQ ID NO: 5622040 - DNA, 22 bp, Homo sapiens
gctaaggcctcttgctggtgca

SEQ ID NO: 5622041 - DNA, 22 bp, Homo sapiens
gctatcagaaacagtattttct

SEQ ID NO: 5622042 - DNA, 23 bp, Homo sapiens
gctatcagaaacagtattttctt

SEQ ID NO: 5622043 - DNA, 17 bp, Homo sapiens
gctatcagcaatactca

SEQ ID NO: 5622044 - DNA, 18 bp, Homo sapiens
gctatcagcaatactcat

SEQ ID NO: 5622045 - DNA, 22 bp, Homo sapiens
gctatcagcaatgccccaaact

SEQ ID NO: 5622046 - DNA, 17 bp, Homo sapiens
gctatcagggaggaaga

SEQ ID NO: 5622047 - DNA, 21 bp, Homo sapiens
gctatccacagaacctttgtc

SEQ ID NO: 5622048 - DNA, 22 bp, Homo sapiens
gctatccacagaacctttgtca

SEQ ID NO: 5622049 - DNA, 23 bp, Homo sapiens
gctatccacagaacctttgtcaa

SEQ ID NO: 5622050 - DNA, 12 bp, Homo sapiens
gctatccaccaa

SEQ ID NO: 5622051 - DNA, 12 bp, Homo sapiens
gctatccagccg

SEQ ID NO: 5622052 - DNA, 14 bp, Homo sapiens
gctatccagtgact

SEQ ID NO: 5622053 - DNA, 19 bp, Homo sapiens
gctatccccatctccctgc

SEQ ID NO: 5622054 - DNA, 21 bp, Homo sapiens
gctatccccatctccctgcct

SEQ ID NO: 5622055 - DNA, 13 bp, Homo sapiens
gctatcctgctga

SEQ ID NO: 5622056 - DNA, 14 bp, Homo sapiens
gctatcctggagac

SEQ ID NO: 5622057 - DNA, 15 bp, Homo sapiens
gctatcctggctctt

SEQ ID NO: 5622058 - DNA, 12 bp, Homo sapiens
gctatcctggga

SEQ ID NO: 5622059 - DNA, 13 bp, Homo sapiens
gctatccttggct

SEQ ID NO: 5622060 - DNA, 15 bp, Homo sapiens
gctatcctttcaaac

SEQ ID NO: 5622061 - DNA, 14 bp, Homo sapiens
gctatcgccctcct

SEQ ID NO: 5622062 - DNA, 19 bp, Homo sapiens
gctatcgccctcctttccc

SEQ ID NO: 5622063 - DNA, 22 bp, Homo sapiens
gctatcgccctcctttccctta

SEQ ID NO: 5622064 - DNA, 15 bp, Homo sapiens
gctatcgtaaaatta

SEQ ID NO: 5622065 - DNA, 14 bp, Homo sapiens
gctatctaaagttt

SEQ ID NO: 5622066 - DNA, 12 bp, Homo sapiens
gctatctactaa

SEQ ID NO: 5622067 - DNA, 20 bp, Homo sapiens
gctatctactaagtttcctt

SEQ ID NO: 5622068 - DNA, 22 bp, Homo sapiens
gctatctagatagctgactcat

SEQ ID NO: 5622069 - DNA, 15 bp, Homo sapiens
gctatctcccccagc

SEQ ID NO: 5622070 - DNA, 17 bp, Homo sapiens
gctatctcccccagccc

SEQ ID NO: 5622071 - DNA, 18 bp, Homo sapiens
gctatctcccccagcccc

SEQ ID NO: 5622072 - DNA, 19 bp, Homo sapiens
gctatctcccccagcccca

SEQ ID NO: 5622073 - DNA, 21 bp, Homo sapiens
gctatctcccccagccccatc

SEQ ID NO: 5622074 - DNA, 21 bp, Homo sapiens
gctatctctcaagagtgctga

SEQ ID NO: 5622075 - DNA, 23 bp, Homo sapiens
gctatctctcaagagtgctgaga

SEQ ID NO: 5622076 - DNA, 23 bp, Homo sapiens
gctatctctcagtgaactgtgag

SEQ ID NO: 5622077 - DNA, 16 bp, Homo sapiens
gctatctctgtgtgca

SEQ ID NO: 5622078 - DNA, 21 bp, Homo sapiens
gctatctgaactaattcattt

SEQ ID NO: 5622079 - DNA, 14 bp, Homo sapiens
gctatctgcctgac

SEQ ID NO: 5622080 - DNA, 16 bp, Homo sapiens
gctatctgcctgacag

SEQ ID NO: 5622081 - DNA, 20 bp, Homo sapiens
gctatctgttcctatctgca

SEQ ID NO: 5622082 - DNA, 14 bp, Homo sapiens
gctatcttaatttt

SEQ ID NO: 5622083 - DNA, 15 bp, Homo sapiens
gctatcttaattttg

SEQ ID NO: 5622084 - DNA, 14 bp, Homo sapiens
gctatcttcatgta

SEQ ID NO: 5622085 - DNA, 14 bp, Homo sapiens
gctatcttttctgg

SEQ ID NO: 5622086 - DNA, 19 bp, Homo sapiens
gctatgaaacaatcttcca

SEQ ID NO: 5622087 - DNA, 16 bp, Homo sapiens
gctatgaaaggaataa

SEQ ID NO: 5622088 - DNA, 14 bp, Homo sapiens
gctatgaagaaaac

SEQ ID NO: 5622089 - DNA, 19 bp, Homo sapiens
gctatgaagccaactgaca

SEQ ID NO: 5622090 - DNA, 16 bp, Homo sapiens
gctatgaatgttacta

SEQ ID NO: 5622091 - DNA, 17 bp, Homo sapiens
gctatgacagtgtgaga

SEQ ID NO: 5622092 - DNA, 14 bp, Homo sapiens
gctatgacatgcaa

SEQ ID NO: 5622093 - DNA, 16 bp, Homo sapiens
gctatgagaataactt

SEQ ID NO: 5622094 - DNA, 15 bp, Homo sapiens
gctatgatggtgaca

SEQ ID NO: 5622095 - DNA, 20 bp, Homo sapiens
gctatgattatgccactgct

SEQ ID NO: 5622096 - DNA, 12 bp, Homo sapiens
gctatgcacacc

SEQ ID NO: 5622097 - DNA, 13 bp, Homo sapiens
gctatgcacacca

SEQ ID NO: 5622098 - DNA, 23 bp, Homo sapiens
gctatgcacaccaaattgctgag

SEQ ID NO: 5622099 - DNA, 17 bp, Homo sapiens
gctatgcattttcttca

SEQ ID NO: 5622100 - DNA, 18 bp, Homo sapiens
gctatgccactaggccct

SEQ ID NO: 5622101 - DNA, 21 bp, Homo sapiens
gctatgccactaggccctggt

SEQ ID NO: 5622102 - DNA, 18 bp, Homo sapiens
gctatgcgcaatgtggca

SEQ ID NO: 5622103 - DNA, 19 bp, Homo sapiens
gctatgctagaggctttta

SEQ ID NO: 5622104 - DNA, 14 bp, Homo sapiens
gctatggaaataca

SEQ ID NO: 5622105 - DNA, 16 bp, Homo sapiens
gctatggaaatacatt

SEQ ID NO: 5622106 - DNA, 14 bp, Homo sapiens
gctatggaacataa

SEQ ID NO: 5622107 - DNA, 14 bp, Homo sapiens
gctatggacaattt

SEQ ID NO: 5622108 - DNA, 19 bp, Homo sapiens
gctatggagagaattaaaa

SEQ ID NO: 5622109 - DNA, 19 bp, Homo sapiens
gctatggagaggactctcc

SEQ ID NO: 5622110 - DNA, 19 bp, Homo sapiens
gctatggccccagggttga

SEQ ID NO: 5622111 - DNA, 15 bp, Homo sapiens
gctatggcctgtgcg

SEQ ID NO: 5622112 - DNA, 18 bp, Homo sapiens
gctatgggaatcagctgg

SEQ ID NO: 5622113 - DNA, 15 bp, Homo sapiens
gctatgggaggcagc

SEQ ID NO: 5622114 - DNA, 19 bp, Homo sapiens
gctatgggaggcagccgag

SEQ ID NO: 5622115 - DNA, 21 bp, Homo sapiens
gctatggggatagatgtgtgg

SEQ ID NO: 5622116 - DNA, 15 bp, Homo sapiens
gctatggtgagatgc

SEQ ID NO: 5622117 - DNA, 16 bp, Homo sapiens
gctatggtgagatgca

SEQ ID NO: 5622118 - DNA, 22 bp, Homo sapiens
gctatggtgagatgcagctgga

SEQ ID NO: 5622119 - DNA, 18 bp, Homo sapiens
gctatggtgctctgtcta

SEQ ID NO: 5622120 - DNA, 15 bp, Homo sapiens
gctatggttgccacc

SEQ ID NO: 5622121 - DNA, 12 bp, Homo sapiens
gctatgtaaggg

SEQ ID NO: 5622122 - DNA, 15 bp, Homo sapiens
gctatgtataaaata

SEQ ID NO: 5622123 - DNA, 16 bp, Homo sapiens
gctatgtataaaatac

SEQ ID NO: 5622124 - DNA, 13 bp, Homo sapiens
gctatgtctgtga

SEQ ID NO: 5622125 - DNA, 14 bp, Homo sapiens
gctatgtgaaacta

SEQ ID NO: 5622126 - DNA, 21 bp, Homo sapiens
gctatgttattttcagtgctt

SEQ ID NO: 5622127 - DNA, 18 bp, Homo sapiens
gctatgttctgtcttccc

SEQ ID NO: 5622128 - DNA, 19 bp, Homo sapiens
gctatgttttgacattttt

SEQ ID NO: 5622129 - DNA, 16 bp, Homo sapiens
gctattaaaaaagtct

SEQ ID NO: 5622130 - DNA, 19 bp, Homo sapiens
gctattaacaattaattgt

SEQ ID NO: 5622131 - DNA, 22 bp, Homo sapiens
gctattaactgccaaaacaaga

SEQ ID NO: 5622132 - DNA, 12 bp, Homo sapiens
gctattaagaaa

SEQ ID NO: 5622133 - DNA, 15 bp, Homo sapiens
gctattaagaaggca

SEQ ID NO: 5622134 - DNA, 23 bp, Homo sapiens
gctattactaaggagtaatctgt

SEQ ID NO: 5622135 - DNA, 15 bp, Homo sapiens
gctattactgtctgg

SEQ ID NO: 5622136 - DNA, 20 bp, Homo sapiens
gctattagaagggctgaata

SEQ ID NO: 5622137 - DNA, 18 bp, Homo sapiens
gctattagccaggatcat

SEQ ID NO: 5622138 - DNA, 16 bp, Homo sapiens
gctattagcggctcct

SEQ ID NO: 5622139 - DNA, 20 bp, Homo sapiens
gctattataatatagaaaga

SEQ ID NO: 5622140 - DNA, 19 bp, Homo sapiens
gctattatactgttatcca

SEQ ID NO: 5622141 - DNA, 22 bp, Homo sapiens
gctattatactgttatccatat

SEQ ID NO: 5622142 - DNA, 21 bp, Homo sapiens
gctattatgtaacatccagaa

SEQ ID NO: 5622143 - DNA, 14 bp, Homo sapiens
gctattcacacaca

SEQ ID NO: 5622144 - DNA, 19 bp, Homo sapiens
gctattcagtaataactct

SEQ ID NO: 5622145 - DNA, 21 bp, Homo sapiens
gctattcagttggtaagcttc

SEQ ID NO: 5622146 - DNA, 17 bp, Homo sapiens
gctattcccaggcaggg

SEQ ID NO: 5622147 - DNA, 15 bp, Homo sapiens
gctattcccttctga

SEQ ID NO: 5622148 - DNA, 21 bp, Homo sapiens
gctattcctttcccttcctct

SEQ ID NO: 5622149 - DNA, 17 bp, Homo sapiens
gctattcgtaagttctg

SEQ ID NO: 5622150 - DNA, 19 bp, Homo sapiens
gctattctagagcttttat

SEQ ID NO: 5622151 - DNA, 14 bp, Homo sapiens
gctattctgtccct

SEQ ID NO: 5622152 - DNA, 16 bp, Homo sapiens
gctattctgtccctag

SEQ ID NO: 5622153 - DNA, 16 bp, Homo sapiens
gctattctttgaccaa

SEQ ID NO: 5622154 - DNA, 21 bp, Homo sapiens
gctattctttgaccaaactgt

SEQ ID NO: 5622155 - DNA, 17 bp, Homo sapiens
gctattgaagatgctgc

SEQ ID NO: 5622156 - DNA, 19 bp, Homo sapiens
gctattgaagatgctgcct

SEQ ID NO: 5622157 - DNA, 13 bp, Homo sapiens
gctattgatgttt

SEQ ID NO: 5622158 - DNA, 18 bp, Homo sapiens
gctattgatgtttccaga

SEQ ID NO: 5622159 - DNA, 14 bp, Homo sapiens
gctattgcactcca

SEQ ID NO: 5622160 - DNA, 15 bp, Homo sapiens
gctattgcactccag

SEQ ID NO: 5622161 - DNA, 18 bp, Homo sapiens
gctattgcactccagtct

SEQ ID NO: 5622162 - DNA, 17 bp, Homo sapiens
gctattgcatgtaaaat

SEQ ID NO: 5622163 - DNA, 18 bp, Homo sapiens
gctattgcatgtaaaatg

SEQ ID NO: 5622164 - DNA, 12 bp, Homo sapiens
gctattgctgct

SEQ ID NO: 5622165 - DNA, 14 bp, Homo sapiens
gctattgctgtctg

SEQ ID NO: 5622166 - DNA, 19 bp, Homo sapiens
gctattggaggatcagttt

SEQ ID NO: 5622167 - DNA, 19 bp, Homo sapiens
gctattgtaaggtctttgt

SEQ ID NO: 5622168 - DNA, 12 bp, Homo sapiens
gctattgttgtg

SEQ ID NO: 5622169 - DNA, 18 bp, Homo sapiens
gctattgttgtgggcttt

SEQ ID NO: 5622170 - DNA, 21 bp, Homo sapiens
gctattgtttataggaaataa

SEQ ID NO: 5622171 - DNA, 19 bp, Homo sapiens
gctatttaaaaagctcttt

SEQ ID NO: 5622172 - DNA, 16 bp, Homo sapiens
gctatttaaaagtata

SEQ ID NO: 5622173 - DNA, 16 bp, Homo sapiens
gctatttacactatta

SEQ ID NO: 5622174 - DNA, 22 bp, Homo sapiens
gctatttagagatattttccat

SEQ ID NO: 5622175 - DNA, 22 bp, Homo sapiens
gctatttatccctttcctggtt

SEQ ID NO: 5622176 - DNA, 20 bp, Homo sapiens
gctatttattttcctaaaga

SEQ ID NO: 5622177 - DNA, 12 bp, Homo sapiens
gctatttcaata

SEQ ID NO: 5622178 - DNA, 22 bp, Homo sapiens
gctatttcaggccctcagctgt

SEQ ID NO: 5622179 - DNA, 18 bp, Homo sapiens
gctatttccattccagaa

SEQ ID NO: 5622180 - DNA, 16 bp, Homo sapiens
gctatttcccttttct

SEQ ID NO: 5622181 - DNA, 14 bp, Homo sapiens
gctatttccttcca

SEQ ID NO: 5622182 - DNA, 21 bp, Homo sapiens
gctatttctagtagaaagaaa

SEQ ID NO: 5622183 - DNA, 22 bp, Homo sapiens
gctatttctagtagaaagaaaa

SEQ ID NO: 5622184 - DNA, 11 bp, Homo sapiens
gctatttctat

SEQ ID NO: 5622185 - DNA, 15 bp, Homo sapiens
gctatttctatattt

SEQ ID NO: 5622186 - DNA, 18 bp, Homo sapiens
gctatttctattccttat

SEQ ID NO: 5622187 - DNA, 15 bp, Homo sapiens
gctatttctcttgct

SEQ ID NO: 5622188 - DNA, 14 bp, Homo sapiens
gctatttctggcct

SEQ ID NO: 5622189 - DNA, 17 bp, Homo sapiens
gctatttctggcctcag

SEQ ID NO: 5622190 - DNA, 20 bp, Homo sapiens
gctatttctggcctcagcag

SEQ ID NO: 5622191 - DNA, 17 bp, Homo sapiens
gctatttgcaattcctg

SEQ ID NO: 5622192 - DNA, 19 bp, Homo sapiens
gctatttgctttagagaca

SEQ ID NO: 5622193 - DNA, 12 bp, Homo sapiens
gctatttggaca

SEQ ID NO: 5622194 - DNA, 20 bp, Homo sapiens
gctatttgtacaaataaacc

SEQ ID NO: 5622195 - DNA, 14 bp, Homo sapiens
gctatttgttcaga

SEQ ID NO: 5622196 - DNA, 18 bp, Homo sapiens
gctatttgttcagagagg

SEQ ID NO: 5622197 - DNA, 15 bp, Homo sapiens
gctattttaataaag

SEQ ID NO: 5622198 - DNA, 15 bp, Homo sapiens
gctattttagaaagc

SEQ ID NO: 5622199 - DNA, 19 bp, Homo sapiens
gctattttagaaagctaaa

SEQ ID NO: 5622200 - DNA, 19 bp, Homo sapiens
gctattttatttgtattca

SEQ ID NO: 5622201 - DNA, 15 bp, Homo sapiens
gctattttcctctgg

SEQ ID NO: 5622202 - DNA, 14 bp, Homo sapiens
gctattttccttgc

SEQ ID NO: 5622203 - DNA, 13 bp, Homo sapiens
gctattttctgac

SEQ ID NO: 5622204 - DNA, 15 bp, Homo sapiens
gctattttctgacca

SEQ ID NO: 5622205 - DNA, 17 bp, Homo sapiens
gctatttttatacactg

SEQ ID NO: 5622206 - DNA, 22 bp, Homo sapiens
gctatttttatttgtttgtgca

SEQ ID NO: 5622207 - DNA, 16 bp, Homo sapiens
gctatttttccccctg

SEQ ID NO: 5622208 - DNA, 12 bp, Homo sapiens
gctatttttgta

SEQ ID NO: 5622209 - DNA, 18 bp, Homo sapiens
gctattttttttaaatca

SEQ ID NO: 5622210 - DNA, 19 bp, Homo sapiens
gctattttttttaaatcaa

SEQ ID NO: 5622211 - DNA, 13 bp, Homo sapiens
gctcaaaaagttt

SEQ ID NO: 5622212 - DNA, 13 bp, Homo sapiens
gctcaaaactttc

SEQ ID NO: 5622213 - DNA, 14 bp, Homo sapiens
gctcaaaattgctt

SEQ ID NO: 5622214 - DNA, 17 bp, Homo sapiens
gctcaaaattgcttcta

SEQ ID NO: 5622215 - DNA, 23 bp, Homo sapiens
gctcaaaatttgaagaatgaaca

SEQ ID NO: 5622216 - DNA, 21 bp, Homo sapiens
gctcaaacaatgacaaagcag

SEQ ID NO: 5622217 - DNA, 23 bp, Homo sapiens
gctcaaacaatgacaaagcagat

SEQ ID NO: 5622218 - DNA, 14 bp, Homo sapiens
gctcaaagaaatct

SEQ ID NO: 5622219 - DNA, 19 bp, Homo sapiens
gctcaaagagcctcacagt

SEQ ID NO: 5622220 - DNA, 14 bp, Homo sapiens
gctccacactcaga

SEQ ID NO: 5622221 - DNA, 16 bp, Homo sapiens
gctccacactcagaaa

SEQ ID NO: 5622222 - DNA, 19 bp, Homo sapiens
gctccacactcagaaaatt

SEQ ID NO: 5622223 - DNA, 14 bp, Homo sapiens
gctccacagggtgg

SEQ ID NO: 5622224 - DNA, 19 bp, Homo sapiens
gctccacagggtgggatga

SEQ ID NO: 5622225 - DNA, 12 bp, Homo sapiens
gctccaccacat

SEQ ID NO: 5622226 - DNA, 13 bp, Homo sapiens
gctccaccccact

SEQ ID NO: 5622227 - DNA, 19 bp, Homo sapiens
gctccaccccactcacaga

SEQ ID NO: 5622228 - DNA, 21 bp, Homo sapiens
gctccaccctcaccaggatga

SEQ ID NO: 5622229 - DNA, 17 bp, Homo sapiens
gctccaccctcccctct

SEQ ID NO: 5622230 - DNA, 16 bp, Homo sapiens
gctccaccctggccga

SEQ ID NO: 5622231 - DNA, 13 bp, Homo sapiens
gctccacccttgg

SEQ ID NO: 5622232 - DNA, 14 bp, Homo sapiens
gctccacccttggc

SEQ ID NO: 5622233 - DNA, 15 bp, Homo sapiens
gctccacccttggcc

SEQ ID NO: 5622234 - DNA, 16 bp, Homo sapiens
gctccacccttggcct

SEQ ID NO: 5622235 - DNA, 22 bp, Homo sapiens
gctccacccttggcctgtctca

SEQ ID NO: 5622236 - DNA, 23 bp, Homo sapiens
gctccaccgggagggacagtctg

SEQ ID NO: 5622237 - DNA, 22 bp, Homo sapiens
gctccacctctggtggctcctc

SEQ ID NO: 5622238 - DNA, 19 bp, Homo sapiens
gctccacctgttcaggagc

SEQ ID NO: 5622239 - DNA, 21 bp, Homo sapiens
gctccacctgttcaggagctg

SEQ ID NO: 5622240 - DNA, 14 bp, Homo sapiens
gctccacctttcag

SEQ ID NO: 5622241 - DNA, 15 bp, Homo sapiens
gctccacgaagcctt

SEQ ID NO: 5622242 - DNA, 23 bp, Homo sapiens
gctccacgccctggggagtgagc

SEQ ID NO: 5622243 - DNA, 19 bp, Homo sapiens
gctccactacccggcaggg

SEQ ID NO: 5622244 - DNA, 15 bp, Homo sapiens
gctccactcagggct

SEQ ID NO: 5622245 - DNA, 19 bp, Homo sapiens
gctccactcagggctggcc

SEQ ID NO: 5622246 - DNA, 22 bp, Homo sapiens
gctccactcagggctggcccgg

SEQ ID NO: 5622247 - DNA, 13 bp, Homo sapiens
gctccactctgaa

SEQ ID NO: 5622248 - DNA, 15 bp, Homo sapiens
gctccactctgaagt

SEQ ID NO: 5622249 - DNA, 23 bp, Homo sapiens
gctccactctgaagtcccttcct

SEQ ID NO: 5622250 - DNA, 17 bp, Homo sapiens
gctccactctgcttctc

SEQ ID NO: 5622251 - DNA, 20 bp, Homo sapiens
gctccactctgcttctctga

SEQ ID NO: 5622252 - DNA, 23 bp, Homo sapiens
gctccactctgcttctctgactt

SEQ ID NO: 5622253 - DNA, 14 bp, Homo sapiens
gctccactggcctg

SEQ ID NO: 5622254 - DNA, 15 bp, Homo sapiens
gctccactggcctgc

SEQ ID NO: 5622255 - DNA, 18 bp, Homo sapiens
gctccactggcctgcccg

SEQ ID NO: 5622256 - DNA, 20 bp, Homo sapiens
gctccagaaatgtctaaatg

SEQ ID NO: 5622257 - DNA, 19 bp, Homo sapiens
gctccagaagatgccagct

SEQ ID NO: 5622258 - DNA, 15 bp, Homo sapiens
gctccagacaggagg

SEQ ID NO: 5622259 - DNA, 14 bp, Homo sapiens
gctccagaccccca

SEQ ID NO: 5622260 - DNA, 15 bp, Homo sapiens
gctccagacccccag

SEQ ID NO: 5622261 - DNA, 22 bp, Homo sapiens
gctccagacctgatcctggagg

SEQ ID NO: 5622262 - DNA, 14 bp, Homo sapiens
gctccagaggacct

SEQ ID NO: 5622263 - DNA, 12 bp, Homo sapiens
gctccagagggc

SEQ ID NO: 5622264 - DNA, 19 bp, Homo sapiens
gctccagataactctcttt

SEQ ID NO: 5622265 - DNA, 15 bp, Homo sapiens
gctccagatcctctt

SEQ ID NO: 5622266 - DNA, 17 bp, Homo sapiens
gctccagatgcagggca

SEQ ID NO: 5622267 - DNA, 19 bp, Homo sapiens
gctccagatgcagggcagt

SEQ ID NO: 5622268 - DNA, 15 bp, Homo sapiens
gctccagattctgat

SEQ ID NO: 5622269 - DNA, 20 bp, Homo sapiens
gctccagattctgatgcata

SEQ ID NO: 5622270 - DNA, 18 bp, Homo sapiens
gctccagcaactgccctt

SEQ ID NO: 5622271 - DNA, 21 bp, Homo sapiens
gctccagcaactgcccttcca

SEQ ID NO: 5622272 - DNA, 22 bp, Homo sapiens
gctccagcaactgcccttccag

SEQ ID NO: 5622273 - DNA, 20 bp, Homo sapiens
gctccagcaccttctttctg

SEQ ID NO: 5622274 - DNA, 12 bp, Homo sapiens
gctccagcagca

SEQ ID NO: 5622275 - DNA, 22 bp, Homo sapiens
gctccagcagcacacctcagcc

SEQ ID NO: 5622276 - DNA, 11 bp, Homo sapiens
gctccagcagt

SEQ ID NO: 5622277 - DNA, 19 bp, Homo sapiens
gctccagcagtgctgggcc

SEQ ID NO: 5622278 - DNA, 21 bp, Homo sapiens
gctccagcagtgctgggccca

SEQ ID NO: 5622279 - DNA, 23 bp, Homo sapiens
gctccagcagtgctgggcccagc

SEQ ID NO: 5622280 - DNA, 16 bp, Homo sapiens
gctccagccaacccct

SEQ ID NO: 5622281 - DNA, 13 bp, Homo sapiens
gctccagccatct

SEQ ID NO: 5622282 - DNA, 21 bp, Homo sapiens
gctccagcccctttgcctctg

SEQ ID NO: 5622283 - DNA, 13 bp, Homo sapiens
gctccagcctctg

SEQ ID NO: 5622284 - DNA, 15 bp, Homo sapiens
gctccagcctctgcc

SEQ ID NO: 5622285 - DNA, 13 bp, Homo sapiens
gctccagcctgtc

SEQ ID NO: 5622286 - DNA, 16 bp, Homo sapiens
gctccagcctgtcggc

SEQ ID NO: 5622287 - DNA, 18 bp, Homo sapiens
gctccagctcaccagccc

SEQ ID NO: 5622288 - DNA, 17 bp, Homo sapiens
gctccagctctggcaca

SEQ ID NO: 5622289 - DNA, 16 bp, Homo sapiens
gctccagctgccccgg

SEQ ID NO: 5622290 - DNA, 21 bp, Homo sapiens
gctccagctgctctgtcttct

SEQ ID NO: 5622291 - DNA, 21 bp, Homo sapiens
gctccagctgtcgtctgactc

SEQ ID NO: 5622292 - DNA, 18 bp, Homo sapiens
gctccaggactccactgg

SEQ ID NO: 5622293 - DNA, 21 bp, Homo sapiens
gctccaggagcagcgtgcagg

SEQ ID NO: 5622294 - DNA, 17 bp, Homo sapiens
gctccaggagcctcatc

SEQ ID NO: 5622295 - DNA, 16 bp, Homo sapiens
gctccaggagggcttg

SEQ ID NO: 5622296 - DNA, 22 bp, Homo sapiens
gctccaggatgcattctgatag

SEQ ID NO: 5622297 - DNA, 17 bp, Homo sapiens
gctccaggcatcactga

SEQ ID NO: 5622298 - DNA, 20 bp, Homo sapiens
gctccaggcatcactgattc

SEQ ID NO: 5622299 - DNA, 20 bp, Homo sapiens
gctccaggctgactgggggc

SEQ ID NO: 5622300 - DNA, 23 bp, Homo sapiens
gctccaggcttcctgccctagca

SEQ ID NO: 5622301 - DNA, 22 bp, Homo sapiens
gctccagggaatccaagcctcc

SEQ ID NO: 5622302 - DNA, 18 bp, Homo sapiens
gctccagggagattttga

SEQ ID NO: 5622303 - DNA, 16 bp, Homo sapiens
gctccagggcagcctc

SEQ ID NO: 5622304 - DNA, 23 bp, Homo sapiens
gctccagggcagcctccaccttg

SEQ ID NO: 5622305 - DNA, 15 bp, Homo sapiens
gctccagggccagat

SEQ ID NO: 5622306 - DNA, 14 bp, Homo sapiens
gctccagggccagg

SEQ ID NO: 5622307 - DNA, 21 bp, Homo sapiens
gctccaggggcccttgggaca

SEQ ID NO: 5622308 - DNA, 22 bp, Homo sapiens
gctccagggtcaggcggagctg

SEQ ID NO: 5622309 - DNA, 17 bp, Homo sapiens
gctccagggtcttgggc

SEQ ID NO: 5622310 - DNA, 20 bp, Homo sapiens
gctccagggtcttgggctac

SEQ ID NO: 5622311 - DNA, 22 bp, Homo sapiens
gctccagggtcttgggctactg

SEQ ID NO: 5622312 - DNA, 23 bp, Homo sapiens
gctccagggtcttgggctactgg

SEQ ID NO: 5622313 - DNA, 24 bp, Homo sapiens
gctccagggtcttgggctactggc

SEQ ID NO: 5622314 - DNA, 14 bp, Homo sapiens
gctccaggtccgga

SEQ ID NO: 5622315 - DNA, 16 bp, Homo sapiens
gctccaggtccggagg

SEQ ID NO: 5622316 - DNA, 12 bp, Homo sapiens
gctccaggtgcc

SEQ ID NO: 5622317 - DNA, 16 bp, Homo sapiens
gctccaggtggctctg

SEQ ID NO: 5622318 - DNA, 14 bp, Homo sapiens
gctccagtagctcc

SEQ ID NO: 5622319 - DNA, 22 bp, Homo sapiens
gctccagtataaattacatgca

SEQ ID NO: 5622320 - DNA, 23 bp, Homo sapiens
gctccagtataaattacatgcat

SEQ ID NO: 5622321 - DNA, 21 bp, Homo sapiens
gctccagtcaacaaactattt

SEQ ID NO: 5622322 - DNA, 18 bp, Homo sapiens
gctccagtccccagaact

SEQ ID NO: 5622323 - DNA, 14 bp, Homo sapiens
gctccagtcctgct

SEQ ID NO: 5622324 - DNA, 15 bp, Homo sapiens
gctccagtctcatcc

SEQ ID NO: 5622325 - DNA, 20 bp, Homo sapiens
gctccagtctgctgccctcc

SEQ ID NO: 5622326 - DNA, 18 bp, Homo sapiens
gctccagtgccgctcctg

SEQ ID NO: 5622327 - DNA, 17 bp, Homo sapiens
gctccagtgggcagggg

SEQ ID NO: 5622328 - DNA, 22 bp, Homo sapiens
gctccagtgtcctgagctcagc

SEQ ID NO: 5622329 - DNA, 18 bp, Homo sapiens
gctccagtgttttcttgt

SEQ ID NO: 5622330 - DNA, 16 bp, Homo sapiens
gctccataccttttct

SEQ ID NO: 5622331 - DNA, 22 bp, Homo sapiens
gctccatactctgtccccccag

SEQ ID NO: 5622332 - DNA, 14 bp, Homo sapiens
gctccatagagcag

SEQ ID NO: 5622333 - DNA, 21 bp, Homo sapiens
gctccatatttgatttctaat

SEQ ID NO: 5622334 - DNA, 14 bp, Homo sapiens
gctccatcaatgag

SEQ ID NO: 5622335 - DNA, 23 bp, Homo sapiens
gctccatccaaactcagaaggct

SEQ ID NO: 5622336 - DNA, 17 bp, Homo sapiens
gctccatcccattcact

SEQ ID NO: 5622337 - DNA, 18 bp, Homo sapiens
gctccatccccctgcctc

SEQ ID NO: 5622338 - DNA, 21 bp, Homo sapiens
gctccatccgtgcctcttttt

SEQ ID NO: 5622339 - DNA, 18 bp, Homo sapiens
gctccatccttctcccca

SEQ ID NO: 5622340 - DNA, 19 bp, Homo sapiens
gctccatccttctccccaa

SEQ ID NO: 5622341 - DNA, 17 bp, Homo sapiens
gctccatcgcgccagcg

SEQ ID NO: 5622342 - DNA, 14 bp, Homo sapiens
gctccatcttattt

SEQ ID NO: 5622343 - DNA, 18 bp, Homo sapiens
gctccatgactggctgtc

SEQ ID NO: 5622344 - DNA, 16 bp, Homo sapiens
gctccatgattctctg

SEQ ID NO: 5622345 - DNA, 19 bp, Homo sapiens
gctccatgattctctgagt

SEQ ID NO: 5622346 - DNA, 14 bp, Homo sapiens
gctccatgcacagg

SEQ ID NO: 5622347 - DNA, 16 bp, Homo sapiens
gctccatgcacctccc

SEQ ID NO: 5622348 - DNA, 23 bp, Homo sapiens
gctccatgcacctcccttccctc

SEQ ID NO: 5622349 - DNA, 19 bp, Homo sapiens
gctccatgcagatctagcc

SEQ ID NO: 5622350 - DNA, 20 bp, Homo sapiens
gctccatgcagatctagcca

SEQ ID NO: 5622351 - DNA, 16 bp, Homo sapiens
gctccatgcctctgga

SEQ ID NO: 5622352 - DNA, 20 bp, Homo sapiens
gctccatgcctctggaggcc

SEQ ID NO: 5622353 - DNA, 12 bp, Homo sapiens
gctccatgctgg

SEQ ID NO: 5622354 - DNA, 15 bp, Homo sapiens
gctccatgctgggtc

SEQ ID NO: 5622355 - DNA, 19 bp, Homo sapiens
gctccatgctttcacctac

SEQ ID NO: 5622356 - DNA, 20 bp, Homo sapiens
gctccatggatgcatgccct

SEQ ID NO: 5622357 - DNA, 14 bp, Homo sapiens
gctccatggggaag

SEQ ID NO: 5622358 - DNA, 13 bp, Homo sapiens
gctccatgtgcat

SEQ ID NO: 5622359 - DNA, 15 bp, Homo sapiens
gctccatgtgcatat

SEQ ID NO: 5622360 - DNA, 18 bp, Homo sapiens
gctccatgtgccccctct

SEQ ID NO: 5622361 - DNA, 14 bp, Homo sapiens
gctccattcctgag

SEQ ID NO: 5622362 - DNA, 16 bp, Homo sapiens
gctccatttaaacaga

SEQ ID NO: 5622363 - DNA, 17 bp, Homo sapiens
gctccatttacaaacta

SEQ ID NO: 5622364 - DNA, 22 bp, Homo sapiens
gctccatttataaccccagcct

SEQ ID NO: 5622365 - DNA, 23 bp, Homo sapiens
gctccatttataaccccagcctg

SEQ ID NO: 5622366 - DNA, 21 bp, Homo sapiens
gctccatttcaattgctttgt

SEQ ID NO: 5622367 - DNA, 18 bp, Homo sapiens
gctcccaacccccctcct

SEQ ID NO: 5622368 - DNA, 23 bp, Homo sapiens
gctcccaacccccctcctgctcc

SEQ ID NO: 5622369 - DNA, 18 bp, Homo sapiens
gctcccaacgagcctcct

SEQ ID NO: 5622370 - DNA, 19 bp, Homo sapiens
gctcccaacgagcctcctc

SEQ ID NO: 5622371 - DNA, 21 bp, Homo sapiens
gctcccaacgagcctcctcag

SEQ ID NO: 5622372 - DNA, 18 bp, Homo sapiens
gctcccaactcccttctg

SEQ ID NO: 5622373 - DNA, 19 bp, Homo sapiens
gctcccaagcccctgaccc

SEQ ID NO: 5622374 - DNA, 23 bp, Homo sapiens
gctcccaagggatggtgccctgt

SEQ ID NO: 5622375 - DNA, 19 bp, Homo sapiens
gctcccaaggggcctgagc

SEQ ID NO: 5622376 - DNA, 14 bp, Homo sapiens
gctcccaatcagct

SEQ ID NO: 5622377 - DNA, 23 bp, Homo sapiens
gctcccacaagcctctgcccagg

SEQ ID NO: 5622378 - DNA, 15 bp, Homo sapiens
gctcccacaagcctg

SEQ ID NO: 5622379 - DNA, 16 bp, Homo sapiens
gctcccacaagcctga

SEQ ID NO: 5622380 - DNA, 17 bp, Homo sapiens
gctcccacaagcctgag

SEQ ID NO: 5622381 - DNA, 20 bp, Homo sapiens
gctcccacaccgcgtcccag

SEQ ID NO: 5622382 - DNA, 24 bp, Homo sapiens
gctcccacaccgcgtcccagctcc

SEQ ID NO: 5622383 - DNA, 16 bp, Homo sapiens
gctcccacacttgtgc

SEQ ID NO: 5622384 - DNA, 19 bp, Homo sapiens
gctcccacagaacacagca

SEQ ID NO: 5622385 - DNA, 20 bp, Homo sapiens
gctcccacagcttcctgagg

SEQ ID NO: 5622386 - DNA, 20 bp, Homo sapiens
gctcccacaggcccttcctc

SEQ ID NO: 5622387 - DNA, 16 bp, Homo sapiens
gctcccaccagcccac

SEQ ID NO: 5622388 - DNA, 19 bp, Homo sapiens
gctcccaccccagaaatca

SEQ ID NO: 5622389 - DNA, 23 bp, Homo sapiens
gctcccaccccagaaatcactgt

SEQ ID NO: 5622390 - DNA, 23 bp, Homo sapiens
gctcccaccctcaaggtgcgggg

SEQ ID NO: 5622391 - DNA, 17 bp, Homo sapiens
gctcccaccgcccccac

SEQ ID NO: 5622392 - DNA, 19 bp, Homo sapiens
gctcccaccgcccccaccc

SEQ ID NO: 5622393 - DNA, 15 bp, Homo sapiens
gctcccaccggtgcc

SEQ ID NO: 5622394 - DNA, 23 bp, Homo sapiens
gctcccacctagtgccccagact

SEQ ID NO: 5622395 - DNA, 15 bp, Homo sapiens
gctccttctgtccta

SEQ ID NO: 5622396 - DNA, 22 bp, Homo sapiens
gctccttgaagacatatcatgt

SEQ ID NO: 5622397 - DNA, 14 bp, Homo sapiens
gctccttgaataag

SEQ ID NO: 5622398 - DNA, 17 bp, Homo sapiens
gctccttgagaggagaa

SEQ ID NO: 5622399 - DNA, 17 bp, Homo sapiens
gctccttgagtaaaaag

SEQ ID NO: 5622400 - DNA, 18 bp, Homo sapiens
gctccttgagtaaaaagg

SEQ ID NO: 5622401 - DNA, 23 bp, Homo sapiens
gctccttgcagcagggctgggcc

SEQ ID NO: 5622402 - DNA, 19 bp, Homo sapiens
gctccttggcacccccatg

SEQ ID NO: 5622403 - DNA, 13 bp, Homo sapiens
gctccttggcgga

SEQ ID NO: 5622404 - DNA, 16 bp, Homo sapiens
gctccttggctgcagc

SEQ ID NO: 5622405 - DNA, 13 bp, Homo sapiens
gctccttgggagg

SEQ ID NO: 5622406 - DNA, 16 bp, Homo sapiens
gctccttgggaggaag

SEQ ID NO: 5622407 - DNA, 17 bp, Homo sapiens
gctccttgggaggaagc

SEQ ID NO: 5622408 - DNA, 21 bp, Homo sapiens
gctccttgggaggaagcagaa

SEQ ID NO: 5622409 - DNA, 22 bp, Homo sapiens
gctccttgggaggaagcagaat

SEQ ID NO: 5622410 - DNA, 21 bp, Homo sapiens
gctccttgggaggccccactg

SEQ ID NO: 5622411 - DNA, 17 bp, Homo sapiens
gctccttgggccctttg

SEQ ID NO: 5622412 - DNA, 18 bp, Homo sapiens
gctccttgggtcctgcaa

SEQ ID NO: 5622413 - DNA, 20 bp, Homo sapiens
gctccttgtcaatactgagc

SEQ ID NO: 5622414 - DNA, 15 bp, Homo sapiens
gctccttgtgccaga

SEQ ID NO: 5622415 - DNA, 16 bp, Homo sapiens
gctccttgtgggcctg

SEQ ID NO: 5622416 - DNA, 18 bp, Homo sapiens
gctccttgtgggcctggg

SEQ ID NO: 5622417 - DNA, 20 bp, Homo sapiens
gctccttgtgggcctgggct

SEQ ID NO: 5622418 - DNA, 16 bp, Homo sapiens
gctccttgttcctaga

SEQ ID NO: 5622419 - DNA, 17 bp, Homo sapiens
gctcctttcccacagtc

SEQ ID NO: 5622420 - DNA, 12 bp, Homo sapiens
gctcctttcccc

SEQ ID NO: 5622421 - DNA, 18 bp, Homo sapiens
gctcctttcccctctcat

SEQ ID NO: 5622422 - DNA, 17 bp, Homo sapiens
gctcctttcccttttcc

SEQ ID NO: 5622423 - DNA, 18 bp, Homo sapiens
gctcctttctccagccag

SEQ ID NO: 5622424 - DNA, 20 bp, Homo sapiens
gctcctttctccagccagca

SEQ ID NO: 5622425 - DNA, 19 bp, Homo sapiens
gctcctttctgatcttcac

SEQ ID NO: 5622426 - DNA, 17 bp, Homo sapiens
gctcctttctgcccagc

SEQ ID NO: 5622427 - DNA, 20 bp, Homo sapiens
gctccttttccgttctgttc

SEQ ID NO: 5622428 - DNA, 14 bp, Homo sapiens
gctccttttctgtg

SEQ ID NO: 5622429 - DNA, 20 bp, Homo sapiens
gctccttttgtatcttcctt

SEQ ID NO: 5622430 - DNA, 14 bp, Homo sapiens
gctccttttgtccc

SEQ ID NO: 5622431 - DNA, 18 bp, Homo sapiens
gctccttttgtccccagg

SEQ ID NO: 5622432 - DNA, 14 bp, Homo sapiens
gctcctttttctcc

SEQ ID NO: 5622433 - DNA, 16 bp, Homo sapiens
gctcctttttctccct

SEQ ID NO: 5622434 - DNA, 18 bp, Homo sapiens
gctcctttttctccctct

SEQ ID NO: 5622435 - DNA, 16 bp, Homo sapiens
gctcgaatctctgtgc

SEQ ID NO: 5622436 - DNA, 18 bp, Homo sapiens
gctcgactatagaaaact

SEQ ID NO: 5622437 - DNA, 20 bp, Homo sapiens
gctcgagcagtcctgcctca

SEQ ID NO: 5622438 - DNA, 21 bp, Homo sapiens
gctcgagcagtcctgcctcag

SEQ ID NO: 5622439 - DNA, 16 bp, Homo sapiens
gctcgagcatgcctgg

SEQ ID NO: 5622440 - DNA, 19 bp, Homo sapiens
gctcgaggctggtgccagg

SEQ ID NO: 5622441 - DNA, 16 bp, Homo sapiens
gctcgaggggtgggct

SEQ ID NO: 5622442 - DNA, 19 bp, Homo sapiens
gctcgagtcacattctgct

SEQ ID NO: 5622443 - DNA, 16 bp, Homo sapiens
gctcgatggacctcag

SEQ ID NO: 5622444 - DNA, 17 bp, Homo sapiens
gctcgatgtttgccatg

SEQ ID NO: 5622445 - DNA, 15 bp, Homo sapiens
gctcgcacccccact

SEQ ID NO: 5622446 - DNA, 14 bp, Homo sapiens
gctcgcacctgcct

SEQ ID NO: 5622447 - DNA, 17 bp, Homo sapiens
gctcgcagggtgcagga

SEQ ID NO: 5622448 - DNA, 15 bp, Homo sapiens
gctcgcatctataga

SEQ ID NO: 5622449 - DNA, 14 bp, Homo sapiens
gctcgccaaggcct

SEQ ID NO: 5622450 - DNA, 18 bp, Homo sapiens
gctcgccaaggcctagga

SEQ ID NO: 5622451 - DNA, 19 bp, Homo sapiens
gctcgccaaggcctaggac

SEQ ID NO: 5622452 - DNA, 20 bp, Homo sapiens
gctcgccacgctcagtgccc

SEQ ID NO: 5622453 - DNA, 21 bp, Homo sapiens
gctcgccatcaaggtccagtg

SEQ ID NO: 5622454 - DNA, 15 bp, Homo sapiens
gctcgcccagacacc

SEQ ID NO: 5622455 - DNA, 12 bp, Homo sapiens
gctcgcccagca

SEQ ID NO: 5622456 - DNA, 14 bp, Homo sapiens
gctcgcccaggaag

SEQ ID NO: 5622457 - DNA, 17 bp, Homo sapiens
gctcgcccaggaaggcc

SEQ ID NO: 5622458 - DNA, 13 bp, Homo sapiens
gctcgccccaccc

SEQ ID NO: 5622459 - DNA, 15 bp, Homo sapiens
gctcgccccacctcc

SEQ ID NO: 5622460 - DNA, 20 bp, Homo sapiens
gctcgccccacctccacctg

SEQ ID NO: 5622461 - DNA, 16 bp, Homo sapiens
gctcgcccctcccctc

SEQ ID NO: 5622462 - DNA, 17 bp, Homo sapiens
gctcgcccctcccctca

SEQ ID NO: 5622463 - DNA, 18 bp, Homo sapiens
gctcgcccctcccctcag

SEQ ID NO: 5622464 - DNA, 20 bp, Homo sapiens
gctcgccctcctttctgtgc

SEQ ID NO: 5622465 - DNA, 19 bp, Homo sapiens
gctcgccctgtgccctctc

SEQ ID NO: 5622466 - DNA, 12 bp, Homo sapiens
gctcgccttccc

SEQ ID NO: 5622467 - DNA, 13 bp, Homo sapiens
gctcgccttccct

SEQ ID NO: 5622468 - DNA, 22 bp, Homo sapiens
gctcgccttccctcctgctttg

SEQ ID NO: 5622469 - DNA, 21 bp, Homo sapiens
gctcgcgaaggtcccacagcc

SEQ ID NO: 5622470 - DNA, 12 bp, Homo sapiens
gctcgcgggcag

SEQ ID NO: 5622471 - DNA, 13 bp, Homo sapiens
gctcgcgggcagc

SEQ ID NO: 5622472 - DNA, 19 bp, Homo sapiens
gctcgcgggcagcgggcca

SEQ ID NO: 5622473 - DNA, 20 bp, Homo sapiens
gctcgctgacagcttgggag

SEQ ID NO: 5622474 - DNA, 19 bp, Homo sapiens
gctcgctggctttctctct

SEQ ID NO: 5622475 - DNA, 19 bp, Homo sapiens
gctcgcttctcctccaggt

SEQ ID NO: 5622476 - DNA, 14 bp, Homo sapiens
gctcgcttgctgga

SEQ ID NO: 5622477 - DNA, 14 bp, Homo sapiens
gctcggacacagtt

SEQ ID NO: 5622478 - DNA, 20 bp, Homo sapiens
gctcggacccaccccaactc

SEQ ID NO: 5622479 - DNA, 19 bp, Homo sapiens
gctcggacttactgcctga

SEQ ID NO: 5622480 - DNA, 22 bp, Homo sapiens
gctcggaggctacccgctgtgg

SEQ ID NO: 5622481 - DNA, 14 bp, Homo sapiens
gctcggaggctgcc

SEQ ID NO: 5622482 - DNA, 15 bp, Homo sapiens
gctcggaggctgccc

SEQ ID NO: 5622483 - DNA, 23 bp, Homo sapiens
gctcggaggctgcccccggcccc

SEQ ID NO: 5622484 - DNA, 18 bp, Homo sapiens
gctcggcaccgccagccg

SEQ ID NO: 5622485 - DNA, 18 bp, Homo sapiens
gctcggcaggaaggagcg

SEQ ID NO: 5622486 - DNA, 20 bp, Homo sapiens
gctcggcaggaaggagcggc

SEQ ID NO: 5622487 - DNA, 17 bp, Homo sapiens
gctcggcccagcacccc

SEQ ID NO: 5622488 - DNA, 23 bp, Homo sapiens
gctcggcctcttgagagccccac

SEQ ID NO: 5622489 - DNA, 14 bp, Homo sapiens
gctcggcctgcccc

SEQ ID NO: 5622490 - DNA, 17 bp, Homo sapiens
gctcggcctgcccccac

SEQ ID NO: 5622491 - DNA, 21 bp, Homo sapiens
gctcggcctgcccccacccca

SEQ ID NO: 5622492 - DNA, 13 bp, Homo sapiens
gctcggctcagct

SEQ ID NO: 5622493 - DNA, 16 bp, Homo sapiens
gctcgggaaggcctga

SEQ ID NO: 5622494 - DNA, 17 bp, Homo sapiens
gctcgggaaggcctgag

SEQ ID NO: 5622495 - DNA, 23 bp, Homo sapiens
gctcgggaaggcctgagggaagc

SEQ ID NO: 5622496 - DNA, 13 bp, Homo sapiens
gctcgggaaggga

SEQ ID NO: 5622497 - DNA, 19 bp, Homo sapiens
gctcgggaagggaggggaa

SEQ ID NO: 5622498 - DNA, 15 bp, Homo sapiens
gctcgggacttcaaa

SEQ ID NO: 5622499 - DNA, 12 bp, Homo sapiens
gctcgggcccag

SEQ ID NO: 5622500 - DNA, 13 bp, Homo sapiens
gctcgggcccagg

SEQ ID NO: 5622501 - DNA, 14 bp, Homo sapiens
gctcgggcccaggc

SEQ ID NO: 5622502 - DNA, 15 bp, Homo sapiens
gctcgggcccaggcc

SEQ ID NO: 5622503 - DNA, 15 bp, Homo sapiens
gctcggggctcccca

SEQ ID NO: 5622504 - DNA, 16 bp, Homo sapiens
gctcggggctgggcag

SEQ ID NO: 5622505 - DNA, 21 bp, Homo sapiens
gctcggggtccaccagtgtgt

SEQ ID NO: 5622506 - DNA, 16 bp, Homo sapiens
gctcggggtgcacagg

SEQ ID NO: 5622507 - DNA, 20 bp, Homo sapiens
gctcggggtgcacaggaggg

SEQ ID NO: 5622508 - DNA, 21 bp, Homo sapiens
gctcggggtgcacaggagggg

SEQ ID NO: 5622509 - DNA, 21 bp, Homo sapiens
gctcggggtgtgtcatttcta

SEQ ID NO: 5622510 - DNA, 14 bp, Homo sapiens
gctcgggtgcccag

SEQ ID NO: 5622511 - DNA, 16 bp, Homo sapiens
gctcgggtgcccagga

SEQ ID NO: 5622512 - DNA, 17 bp, Homo sapiens
gctcggtacccggggcc

SEQ ID NO: 5622513 - DNA, 14 bp, Homo sapiens
gctcggtggaccca

SEQ ID NO: 5622514 - DNA, 21 bp, Homo sapiens
gctcggttaagtacccgaggc

SEQ ID NO: 5622515 - DNA, 13 bp, Homo sapiens
gctcgtatcccaa

SEQ ID NO: 5622516 - DNA, 13 bp, Homo sapiens
gctcgtcctcact

SEQ ID NO: 5622517 - DNA, 16 bp, Homo sapiens
gctcgtggactgtgct

SEQ ID NO: 5622518 - DNA, 17 bp, Homo sapiens
gctcgtgtatcctgggg

SEQ ID NO: 5622519 - DNA, 14 bp, Homo sapiens
gctcgttcccccag

SEQ ID NO: 5622520 - DNA, 22 bp, Homo sapiens
gctcgttccggtccccacagac

SEQ ID NO: 5622521 - DNA, 15 bp, Homo sapiens
gctctaaaacataga

SEQ ID NO: 5622522 - DNA, 14 bp, Homo sapiens
gctctaaaaggtaa

SEQ ID NO: 5622523 - DNA, 13 bp, Homo sapiens
gctctaaaatatt

SEQ ID NO: 5622524 - DNA, 15 bp, Homo sapiens
gctctaaagtagcaa

SEQ ID NO: 5622525 - DNA, 18 bp, Homo sapiens
gctctaacacctgcctag

SEQ ID NO: 5622526 - DNA, 15 bp, Homo sapiens
gctctaacagccctc

SEQ ID NO: 5622527 - DNA, 15 bp, Homo sapiens
gctctaacgcctgag

SEQ ID NO: 5622528 - DNA, 20 bp, Homo sapiens
gctctaacgcctgagcccag

SEQ ID NO: 5622529 - DNA, 22 bp, Homo sapiens
gctctaacgtgataaacctgct

SEQ ID NO: 5622530 - DNA, 19 bp, Homo sapiens
gctctaagaagctgcaata

SEQ ID NO: 5622531 - DNA, 20 bp, Homo sapiens
gctctaagaagctgcaataa

SEQ ID NO: 5622532 - DNA, 23 bp, Homo sapiens
gctctaagaagctgcaataaagt

SEQ ID NO: 5622533 - DNA, 15 bp, Homo sapiens
gctctaagcagccag

SEQ ID NO: 5622534 - DNA, 16 bp, Homo sapiens
gctctaagcagccagg

SEQ ID NO: 5622535 - DNA, 18 bp, Homo sapiens
gctctaataagtttgtgt

SEQ ID NO: 5622536 - DNA, 12 bp, Homo sapiens
gctctaatacat

SEQ ID NO: 5622537 - DNA, 16 bp, Homo sapiens
gctctaatgtttgcat

SEQ ID NO: 5622538 - DNA, 17 bp, Homo sapiens
gctctaatgtttgcata

SEQ ID NO: 5622539 - DNA, 19 bp, Homo sapiens
gctctaattcacagtgctc

SEQ ID NO: 5622540 - DNA, 15 bp, Homo sapiens
gctctacacaacatg

SEQ ID NO: 5622541 - DNA, 18 bp, Homo sapiens
gctctacattctgctctg

SEQ ID NO: 5622542 - DNA, 14 bp, Homo sapiens
gctctacatttgca

SEQ ID NO: 5622543 - DNA, 17 bp, Homo sapiens
gctctaccaagacataa

SEQ ID NO: 5622544 - DNA, 15 bp, Homo sapiens
gctctacccagggcc

SEQ ID NO: 5622545 - DNA, 15 bp, Homo sapiens
gctctaccctgcagc

SEQ ID NO: 5622546 - DNA, 12 bp, Homo sapiens
gctctaccctgt

SEQ ID NO: 5622547 - DNA, 22 bp, Homo sapiens
gctctaccctgtctgtcccttt

SEQ ID NO: 5622548 - DNA, 16 bp, Homo sapiens
gctctacctctctttc

SEQ ID NO: 5622549 - DNA, 14 bp, Homo sapiens
gctctacctggccg

SEQ ID NO: 5622550 - DNA, 22 bp, Homo sapiens
gctctaccttcctgtccctgag

SEQ ID NO: 5622551 - DNA, 23 bp, Homo sapiens
gctctaccttcctgtccctgagg

SEQ ID NO: 5622552 - DNA, 19 bp, Homo sapiens
gctctactgaggtgctatg

SEQ ID NO: 5622553 - DNA, 21 bp, Homo sapiens
gctctactggtcttgtggaat

SEQ ID NO: 5622554 - DNA, 15 bp, Homo sapiens
gctctacttccccat

SEQ ID NO: 5622555 - DNA, 23 bp, Homo sapiens
gctctacttccccatggccctga

SEQ ID NO: 5622556 - DNA, 15 bp, Homo sapiens
gctctacttcttttt

SEQ ID NO: 5622557 - DNA, 16 bp, Homo sapiens
gctctactttgagaag

SEQ ID NO: 5622558 - DNA, 12 bp, Homo sapiens
gctctagaaagt

SEQ ID NO: 5622559 - DNA, 18 bp, Homo sapiens
gctctagacaaccctgca

SEQ ID NO: 5622560 - DNA, 13 bp, Homo sapiens
gctctagagagag

SEQ ID NO: 5622561 - DNA, 22 bp, Homo sapiens
gctctagatcataaggcttcaa

SEQ ID NO: 5622562 - DNA, 17 bp, Homo sapiens
gctctagatgagctggg

SEQ ID NO: 5622563 - DNA, 15 bp, Homo sapiens
gctctagattcataa

SEQ ID NO: 5622564 - DNA, 20 bp, Homo sapiens
gctctagattcataaataca

SEQ ID NO: 5622565 - DNA, 15 bp, Homo sapiens
gctctagccaggagt

SEQ ID NO: 5622566 - DNA, 24 bp, Homo sapiens
gctctagccaggagtctgtgctct

SEQ ID NO: 5622567 - DNA, 16 bp, Homo sapiens
gctctagcctctggac

SEQ ID NO: 5622568 - DNA, 14 bp, Homo sapiens
gctctagcctgggc

SEQ ID NO: 5622569 - DNA, 15 bp, Homo sapiens
gctctaggatggggc

SEQ ID NO: 5622570 - DNA, 16 bp, Homo sapiens
gctctaggatggggca

SEQ ID NO: 5622571 - DNA, 14 bp, Homo sapiens
gctctaggctgccc

SEQ ID NO: 5622572 - DNA, 13 bp, Homo sapiens
gctctaggcttca

SEQ ID NO: 5622573 - DNA, 12 bp, Homo sapiens
gctctagtgcct

SEQ ID NO: 5622574 - DNA, 21 bp, Homo sapiens
gctctgggggacccaggtggg

SEQ ID NO: 5622575 - DNA, 13 bp, Homo sapiens
gctctgggggcag

SEQ ID NO: 5622576 - DNA, 15 bp, Homo sapiens
gctctggggggcagt

SEQ ID NO: 5622577 - DNA, 21 bp, Homo sapiens
gctctggggggttgcctcgag

SEQ ID NO: 5622578 - DNA, 15 bp, Homo sapiens
gctctgggggtggga

SEQ ID NO: 5622579 - DNA, 20 bp, Homo sapiens
gctctggggtatgtgtgtgt

SEQ ID NO: 5622580 - DNA, 18 bp, Homo sapiens
gctctgggtgaggtaggc

SEQ ID NO: 5622581 - DNA, 16 bp, Homo sapiens
gctctgggtgctgccc

SEQ ID NO: 5622582 - DNA, 17 bp, Homo sapiens
gctctgggtgctgccct

SEQ ID NO: 5622583 - DNA, 13 bp, Homo sapiens
gctctgggtgggc

SEQ ID NO: 5622584 - DNA, 17 bp, Homo sapiens
gctctgggtgggcgggg

SEQ ID NO: 5622585 - DNA, 18 bp, Homo sapiens
gctctgggtgggcgtggc

SEQ ID NO: 5622586 - DNA, 21 bp, Homo sapiens
gctctgggtgggcgtggcctg

SEQ ID NO: 5622587 - DNA, 22 bp, Homo sapiens
gctctgggtgggcgtggcctgc

SEQ ID NO: 5622588 - DNA, 16 bp, Homo sapiens
gctctggtccaggccc

SEQ ID NO: 5622589 - DNA, 23 bp, Homo sapiens
gctctggtccaggccctgtggca

SEQ ID NO: 5622590 - DNA, 16 bp, Homo sapiens
gctctggtccatagag

SEQ ID NO: 5622591 - DNA, 16 bp, Homo sapiens
gctctggtcctcggag

SEQ ID NO: 5622592 - DNA, 17 bp, Homo sapiens
gctctggtctgtaggtt

SEQ ID NO: 5622593 - DNA, 19 bp, Homo sapiens
gctctggtgacaccagcct

SEQ ID NO: 5622594 - DNA, 14 bp, Homo sapiens
gctctggtgcacgc

SEQ ID NO: 5622595 - DNA, 17 bp, Homo sapiens
gctctggtggccactga

SEQ ID NO: 5622596 - DNA, 23 bp, Homo sapiens
gctctggtggccactgagctggc

SEQ ID NO: 5622597 - DNA, 24 bp, Homo sapiens
gctctggtggccactgagctggct

SEQ ID NO: 5622598 - DNA, 22 bp, Homo sapiens
gctctggtggcttaagtgagca

SEQ ID NO: 5622599 - DNA, 23 bp, Homo sapiens
gctctggtggcttaagtgagcag

SEQ ID NO: 5622600 - DNA, 16 bp, Homo sapiens
gctctggtgggaaaat

SEQ ID NO: 5622601 - DNA, 18 bp, Homo sapiens
gctctggtgggaaaatgt

SEQ ID NO: 5622602 - DNA, 22 bp, Homo sapiens
gctctggtgggaggcccggggc

SEQ ID NO: 5622603 - DNA, 15 bp, Homo sapiens
gctctggttcctcca

SEQ ID NO: 5622604 - DNA, 16 bp, Homo sapiens
gctctggttcctccag

SEQ ID NO: 5622605 - DNA, 20 bp, Homo sapiens
gctctggttgtttctgttcc

SEQ ID NO: 5622606 - DNA, 22 bp, Homo sapiens
gctctggttgtttctgttccaa

SEQ ID NO: 5622607 - DNA, 14 bp, Homo sapiens
gctctgtaacttac

SEQ ID NO: 5622608 - DNA, 19 bp, Homo sapiens
gctctgtaatctcgtttca

SEQ ID NO: 5622609 - DNA, 14 bp, Homo sapiens
gctctgtagcctgg

SEQ ID NO: 5622610 - DNA, 15 bp, Homo sapiens
gctctgtagcctggt

SEQ ID NO: 5622611 - DNA, 23 bp, Homo sapiens
gctctgtagcctggtctgtgcat

SEQ ID NO: 5622612 - DNA, 18 bp, Homo sapiens
gctctgtatcaggaccca

SEQ ID NO: 5622613 - DNA, 15 bp, Homo sapiens
gctctgtattctgca

SEQ ID NO: 5622614 - DNA, 16 bp, Homo sapiens
gctctgtcactccagg

SEQ ID NO: 5622615 - DNA, 20 bp, Homo sapiens
gctctgtccaattccagagc

SEQ ID NO: 5622616 - DNA, 13 bp, Homo sapiens
gctctgtccccag

SEQ ID NO: 5622617 - DNA, 15 bp, Homo sapiens
gctctgtccccagcc

SEQ ID NO: 5622618 - DNA, 15 bp, Homo sapiens
gctctgtcccccagg

SEQ ID NO: 5622619 - DNA, 18 bp, Homo sapiens
gctctgtcccccaggctg

SEQ ID NO: 5622620 - DNA, 14 bp, Homo sapiens
gctctgtcctggga

SEQ ID NO: 5622621 - DNA, 15 bp, Homo sapiens
gctctgtcctgggag

SEQ ID NO: 5622622 - DNA, 17 bp, Homo sapiens
gctctgtcgcccaggct

SEQ ID NO: 5622623 - DNA, 19 bp, Homo sapiens
gctctgtctacttgctcag

SEQ ID NO: 5622624 - DNA, 21 bp, Homo sapiens
gctctgtctacttgctcaggt

SEQ ID NO: 5622625 - DNA, 16 bp, Homo sapiens
gctctgtctcccaggc

SEQ ID NO: 5622626 - DNA, 19 bp, Homo sapiens
gctctgtctcccaggctgg

SEQ ID NO: 5622627 - DNA, 13 bp, Homo sapiens
gctctgtctgctc

SEQ ID NO: 5622628 - DNA, 14 bp, Homo sapiens
gctctgtcttcctg

SEQ ID NO: 5622629 - DNA, 23 bp, Homo sapiens
gctctgtgaaatcagaagtgcaa

SEQ ID NO: 5622630 - DNA, 17 bp, Homo sapiens
gctctgtgagccccaca

SEQ ID NO: 5622631 - DNA, 18 bp, Homo sapiens
gctctgtgagccccacag

SEQ ID NO: 5622632 - DNA, 19 bp, Homo sapiens
gctctgtgagccccacagc

SEQ ID NO: 5622633 - DNA, 23 bp, Homo sapiens
gctctgtgagccccacagccctg

SEQ ID NO: 5622634 - DNA, 19 bp, Homo sapiens
gctctgtgcagtcactgga

SEQ ID NO: 5622635 - DNA, 21 bp, Homo sapiens
gctctgtgcagtcactggagg

SEQ ID NO: 5622636 - DNA, 17 bp, Homo sapiens
gctctgtgcccaccctc

SEQ ID NO: 5622637 - DNA, 21 bp, Homo sapiens
gctctgtgcccggtgccatct

SEQ ID NO: 5622638 - DNA, 22 bp, Homo sapiens
gctctgtgcccggtgccatctt

SEQ ID NO: 5622639 - DNA, 17 bp, Homo sapiens
gctctgtgcctgggatc

SEQ ID NO: 5622640 - DNA, 12 bp, Homo sapiens
gctctgtgcctt

SEQ ID NO: 5622641 - DNA, 11 bp, Homo sapiens
gctctgtgctg

SEQ ID NO: 5622642 - DNA, 14 bp, Homo sapiens
gctctgtgctgacc

SEQ ID NO: 5622643 - DNA, 15 bp, Homo sapiens
gctctgtgctgaccc

SEQ ID NO: 5622644 - DNA, 21 bp, Homo sapiens
gctctgtgctgaccctcctgt

SEQ ID NO: 5622645 - DNA, 16 bp, Homo sapiens
gctctgtggccacatt

SEQ ID NO: 5622646 - DNA, 13 bp, Homo sapiens
gctctgtggcctg

SEQ ID NO: 5622647 - DNA, 14 bp, Homo sapiens
gctctgtggcctgt

SEQ ID NO: 5622648 - DNA, 19 bp, Homo sapiens
gctctgtggcctgtgtcca

SEQ ID NO: 5622649 - DNA, 20 bp, Homo sapiens
gctctgtggccttggccctg

SEQ ID NO: 5622650 - DNA, 20 bp, Homo sapiens
gctctgtgggaaaaaagaaa

SEQ ID NO: 5622651 - DNA, 21 bp, Homo sapiens
gctctgtgggaaaaaagaaaa

SEQ ID NO: 5622652 - DNA, 18 bp, Homo sapiens
gctctgtgggccctaccc

SEQ ID NO: 5622653 - DNA, 12 bp, Homo sapiens
gctctgtgggct

SEQ ID NO: 5622654 - DNA, 14 bp, Homo sapiens
gctctgtgggctgc

SEQ ID NO: 5622655 - DNA, 24 bp, Homo sapiens
gctctgtgggctgcactctgtgcc

SEQ ID NO: 5622656 - DNA, 15 bp, Homo sapiens
gctctgtgggtctct

SEQ ID NO: 5622657 - DNA, 13 bp, Homo sapiens
gctctgtgggtga

SEQ ID NO: 5622658 - DNA, 16 bp, Homo sapiens
gctctgtgtccgtctg

SEQ ID NO: 5622659 - DNA, 15 bp, Homo sapiens
gctctgtgtgttaaa

SEQ ID NO: 5622660 - DNA, 19 bp, Homo sapiens
gctctgtgttcccagaggc

SEQ ID NO: 5622661 - DNA, 17 bp, Homo sapiens
gctctgttacccaggct

SEQ ID NO: 5622662 - DNA, 18 bp, Homo sapiens
gctctgttatgcaagcac

SEQ ID NO: 5622663 - DNA, 14 bp, Homo sapiens
gctctgttctgcct

SEQ ID NO: 5622664 - DNA, 14 bp, Homo sapiens
gctctgttcttcct

SEQ ID NO: 5622665 - DNA, 16 bp, Homo sapiens
gctctgttgcaggtgt

SEQ ID NO: 5622666 - DNA, 20 bp, Homo sapiens
gctctgttgcaggtgtccgg

SEQ ID NO: 5622667 - DNA, 19 bp, Homo sapiens
gctctgttgcccaggctgg

SEQ ID NO: 5622668 - DNA, 23 bp, Homo sapiens
gctctgttgcccaggctggagtg

SEQ ID NO: 5622669 - DNA, 20 bp, Homo sapiens
gctctgtttcttcctttctg

SEQ ID NO: 5622670 - DNA, 16 bp, Homo sapiens
gctcttaaaaagacac

SEQ ID NO: 5622671 - DNA, 14 bp, Homo sapiens
gctcttaaaaatct

SEQ ID NO: 5622672 - DNA, 14 bp, Homo sapiens
gctcttaaaatatc

SEQ ID NO: 5622673 - DNA, 18 bp, Homo sapiens
gctcttaaaatatcttcc

SEQ ID NO: 5622674 - DNA, 19 bp, Homo sapiens
gctcttaaaatatcttcct

SEQ ID NO: 5622675 - DNA, 23 bp, Homo sapiens
gctcttaagcagcatggaaaaat

SEQ ID NO: 5622676 - DNA, 21 bp, Homo sapiens
gctcttaattaaaaattactg

SEQ ID NO: 5622677 - DNA, 14 bp, Homo sapiens
gctcttactctttc

SEQ ID NO: 5622678 - DNA, 20 bp, Homo sapiens
gctcttacttcccccaccct

SEQ ID NO: 5622679 - DNA, 16 bp, Homo sapiens
gctcttagaaactcag

SEQ ID NO: 5622680 - DNA, 16 bp, Homo sapiens
gctcttagcagcttcc

SEQ ID NO: 5622681 - DNA, 19 bp, Homo sapiens
gctcttagctttctcaggg

SEQ ID NO: 5622682 - DNA, 22 bp, Homo sapiens
gctcttagtcctccctgctcag

SEQ ID NO: 5622683 - DNA, 23 bp, Homo sapiens
gctcttagtcctccctgctcagc

SEQ ID NO: 5622684 - DNA, 22 bp, Homo sapiens
gctcttatagaagcttcagcag

SEQ ID NO: 5622685 - DNA, 14 bp, Homo sapiens
gctcttatccccag

SEQ ID NO: 5622686 - DNA, 16 bp, Homo sapiens
gctcttatccccagct

SEQ ID NO: 5622687 - DNA, 21 bp, Homo sapiens
gctcttatttctgaattcaaa

SEQ ID NO: 5622688 - DNA, 17 bp, Homo sapiens
gctcttatttttgtacc

SEQ ID NO: 5622689 - DNA, 23 bp, Homo sapiens
gctcttcaagctgtcccctctgt

SEQ ID NO: 5622690 - DNA, 16 bp, Homo sapiens
gctcttcaccaggaag

SEQ ID NO: 5622691 - DNA, 14 bp, Homo sapiens
gctcttcactcagc

SEQ ID NO: 5622692 - DNA, 19 bp, Homo sapiens
gctcttcactcagccacac

SEQ ID NO: 5622693 - DNA, 13 bp, Homo sapiens
gctcttcacttcc

SEQ ID NO: 5622694 - DNA, 17 bp, Homo sapiens
gctcttcacttcctcca

SEQ ID NO: 5622695 - DNA, 23 bp, Homo sapiens
gctcttcagaggagcatcagctg

SEQ ID NO: 5622696 - DNA, 18 bp, Homo sapiens
gctcttcaggcctccctc

SEQ ID NO: 5622697 - DNA, 19 bp, Homo sapiens
gctcttcagtgggagaaaa

SEQ ID NO: 5622698 - DNA, 17 bp, Homo sapiens
gctcttcataataaacc

SEQ ID NO: 5622699 - DNA, 18 bp, Homo sapiens
gctcttcatcccattcca

SEQ ID NO: 5622700 - DNA, 19 bp, Homo sapiens
gctcttcatcccattccag

SEQ ID NO: 5622701 - DNA, 17 bp, Homo sapiens
gctcttcatctgcccaa

SEQ ID NO: 5622702 - DNA, 16 bp, Homo sapiens
gctcttcatctgcctg

SEQ ID NO: 5622703 - DNA, 17 bp, Homo sapiens
gctcttcatctgcctgc

SEQ ID NO: 5622704 - DNA, 17 bp, Homo sapiens
gctcttccaaagctcct

SEQ ID NO: 5622705 - DNA, 15 bp, Homo sapiens
gctcttccaggctgg

SEQ ID NO: 5622706 - DNA, 20 bp, Homo sapiens
gctcttcccaagtcctcgcc

SEQ ID NO: 5622707 - DNA, 21 bp, Homo sapiens
gctcttcccaagtcctcgccc

SEQ ID NO: 5622708 - DNA, 22 bp, Homo sapiens
gctcttcccaagtcctcgcccc

SEQ ID NO: 5622709 - DNA, 17 bp, Homo sapiens
gctcttcccactccagc

SEQ ID NO: 5622710 - DNA, 19 bp, Homo sapiens
gctcttcccactccagctg

SEQ ID NO: 5622711 - DNA, 20 bp, Homo sapiens
gctcttcccactccagctga

SEQ ID NO: 5622712 - DNA, 15 bp, Homo sapiens
gctcttcccactttt

SEQ ID NO: 5622713 - DNA, 13 bp, Homo sapiens
gctcttccccatc

SEQ ID NO: 5622714 - DNA, 20 bp, Homo sapiens
gctcttcccccatgtgcctg

SEQ ID NO: 5622715 - DNA, 22 bp, Homo sapiens
gctcttcccccatgtgcctgtc

SEQ ID NO: 5622716 - DNA, 17 bp, Homo sapiens
gctcttcccctagacct

SEQ ID NO: 5622717 - DNA, 13 bp, Homo sapiens
gctcttcccttgc

SEQ ID NO: 5622718 - DNA, 20 bp, Homo sapiens
gctcttcctatccctctcct

SEQ ID NO: 5622719 - DNA, 15 bp, Homo sapiens
gctcttcctccccag

SEQ ID NO: 5622720 - DNA, 13 bp, Homo sapiens
gctcttcctctgg

SEQ ID NO: 5622721 - DNA, 22 bp, Homo sapiens
gctcttcctctggtttctgtgt

SEQ ID NO: 5622722 - DNA, 15 bp, Homo sapiens
gctcttcctggacct

SEQ ID NO: 5622723 - DNA, 18 bp, Homo sapiens
gctcttcctggacctgag

SEQ ID NO: 5622724 - DNA, 17 bp, Homo sapiens
gctcttctaacctcagc

SEQ ID NO: 5622725 - DNA, 20 bp, Homo sapiens
gctcttctaacctcagccaa

SEQ ID NO: 5622726 - DNA, 15 bp, Homo sapiens
gctcttctcatttca

SEQ ID NO: 5622727 - DNA, 14 bp, Homo sapiens
gctcttctcctcag

SEQ ID NO: 5622728 - DNA, 13 bp, Homo sapiens
gctcttctccttt

SEQ ID NO: 5622729 - DNA, 17 bp, Homo sapiens
gctcttctcctttcaca

SEQ ID NO: 5622730 - DNA, 13 bp, Homo sapiens
gctcttctctccc

SEQ ID NO: 5622731 - DNA, 17 bp, Homo sapiens
gctcttctctccccagc

SEQ ID NO: 5622732 - DNA, 19 bp, Homo sapiens
gctcttctctccccagccc

SEQ ID NO: 5622733 - DNA, 21 bp, Homo sapiens
gctcttctgactactgggcaa

SEQ ID NO: 5622734 - DNA, 15 bp, Homo sapiens
gctcttctgtcatcc

SEQ ID NO: 5622735 - DNA, 20 bp, Homo sapiens
gctcttctgttctcaaatgc

SEQ ID NO: 5622736 - DNA, 13 bp, Homo sapiens
gctcttcttcctc

SEQ ID NO: 5622737 - DNA, 14 bp, Homo sapiens
gctcttcttgtgaa

SEQ ID NO: 5622738 - DNA, 12 bp, Homo sapiens
gctcttctttct

SEQ ID NO: 5622739 - DNA, 19 bp, Homo sapiens
gctcttgaaatattcagaa

SEQ ID NO: 5622740 - DNA, 22 bp, Homo sapiens
gctcttgaaatattcagaaatt

SEQ ID NO: 5622741 - DNA, 14 bp, Homo sapiens
gctcttgaattcct

SEQ ID NO: 5622742 - DNA, 23 bp, Homo sapiens
gctcttgacagaaagcagttctg

SEQ ID NO: 5622743 - DNA, 22 bp, Homo sapiens
gctcttgatacccccctctgtc

SEQ ID NO: 5622744 - DNA, 23 bp, Homo sapiens
gctcttgatacccccctctgtct

SEQ ID NO: 5622745 - DNA, 14 bp, Homo sapiens
gctcttgatgcctg

SEQ ID NO: 5622746 - DNA, 22 bp, Homo sapiens
gctcttgcccttccctgtccct

SEQ ID NO: 5622747 - DNA, 12 bp, Homo sapiens
gctcttgcctgc

SEQ ID NO: 5622748 - DNA, 15 bp, Homo sapiens
gctcttgcctgcacc

SEQ ID NO: 5622749 - DNA, 13 bp, Homo sapiens
gctcttgcctgta

SEQ ID NO: 5622750 - DNA, 22 bp, Homo sapiens
gctcttgccttatctgttcctt

SEQ ID NO: 5622751 - DNA, 17 bp, Homo sapiens
gctgatggcccctccag

SEQ ID NO: 5622752 - DNA, 21 bp, Homo sapiens
gctgatggcccctccagcaca

SEQ ID NO: 5622753 - DNA, 21 bp, Homo sapiens
gctgatggcctggctgcctgg

SEQ ID NO: 5622754 - DNA, 23 bp, Homo sapiens
gctgatggctgctagattttaat

SEQ ID NO: 5622755 - DNA, 13 bp, Homo sapiens
gctgatgtagtat

SEQ ID NO: 5622756 - DNA, 19 bp, Homo sapiens
gctgatgtccctagaaaac

SEQ ID NO: 5622757 - DNA, 16 bp, Homo sapiens
gctgatgtggactgtc

SEQ ID NO: 5622758 - DNA, 17 bp, Homo sapiens
gctgatgttcagtgtaa

SEQ ID NO: 5622759 - DNA, 20 bp, Homo sapiens
gctgatgttggaagagaaag

SEQ ID NO: 5622760 - DNA, 14 bp, Homo sapiens
gctgatgtttacaa

SEQ ID NO: 5622761 - DNA, 19 bp, Homo sapiens
gctgatgtttataaactga

SEQ ID NO: 5622762 - DNA, 22 bp, Homo sapiens
gctgatgtttataaactgagag

SEQ ID NO: 5622763 - DNA, 22 bp, Homo sapiens
gctgatgtttatgtactgtaaa

SEQ ID NO: 5622764 - DNA, 14 bp, Homo sapiens
gctgatgtttcctg

SEQ ID NO: 5622765 - DNA, 20 bp, Homo sapiens
gctgattactgtcaataaac

SEQ ID NO: 5622766 - DNA, 22 bp, Homo sapiens
gctgattactgtcaataaacag

SEQ ID NO: 5622767 - DNA, 13 bp, Homo sapiens
gctgattatttag

SEQ ID NO: 5622768 - DNA, 19 bp, Homo sapiens
gctgattcctaaggcccag

SEQ ID NO: 5622769 - DNA, 15 bp, Homo sapiens
gctgattcctctcat

SEQ ID NO: 5622770 - DNA, 21 bp, Homo sapiens
gctgattctcagggtctctgc

SEQ ID NO: 5622771 - DNA, 14 bp, Homo sapiens
gctgattcttgtaa

SEQ ID NO: 5622772 - DNA, 17 bp, Homo sapiens
gctgattcttgtaaatc

SEQ ID NO: 5622773 - DNA, 15 bp, Homo sapiens
gctgattggaaaata

SEQ ID NO: 5622774 - DNA, 19 bp, Homo sapiens
gctgattggaaaataataa

SEQ ID NO: 5622775 - DNA, 21 bp, Homo sapiens
gctgattggaaaataataaaa

SEQ ID NO: 5622776 - DNA, 23 bp, Homo sapiens
gctgattggaaaataataaaaga

SEQ ID NO: 5622777 - DNA, 20 bp, Homo sapiens
gctgattgtttatttttcta

SEQ ID NO: 5622778 - DNA, 23 bp, Homo sapiens
gctgatttacatgtatggttact

SEQ ID NO: 5622779 - DNA, 18 bp, Homo sapiens
gctgatttactaacagta

SEQ ID NO: 5622780 - DNA, 18 bp, Homo sapiens
gctgatttcaaatgcagt

SEQ ID NO: 5622781 - DNA, 21 bp, Homo sapiens
gctgatttccaggcccctgag

SEQ ID NO: 5622782 - DNA, 15 bp, Homo sapiens
gctgatttcccctct

SEQ ID NO: 5622783 - DNA, 15 bp, Homo sapiens
gctgatttggtcacc

SEQ ID NO: 5622784 - DNA, 18 bp, Homo sapiens
gctgattttattcttgat

SEQ ID NO: 5622785 - DNA, 17 bp, Homo sapiens
gctgattttctctggca

SEQ ID NO: 5622786 - DNA, 18 bp, Homo sapiens
gctgattttgaccttgta

SEQ ID NO: 5622787 - DNA, 11 bp, Homo sapiens
gctgatttttt

SEQ ID NO: 5622788 - DNA, 14 bp, Homo sapiens
gctgattttttaaa

SEQ ID NO: 5622789 - DNA, 21 bp, Homo sapiens
gctgattttttttttaacttg

SEQ ID NO: 5622790 - DNA, 23 bp, Homo sapiens
gctgcaaaaccggcaacctgtaa

SEQ ID NO: 5622791 - DNA, 23 bp, Homo sapiens
gctgcaaacccatgaagctggcc

SEQ ID NO: 5622792 - DNA, 15 bp, Homo sapiens
gctgcaaagagaaac

SEQ ID NO: 5622793 - DNA, 22 bp, Homo sapiens
gctgcaaagagaaaccgctttt

SEQ ID NO: 5622794 - DNA, 18 bp, Homo sapiens
gctgcaaaggagaagcac

SEQ ID NO: 5622795 - DNA, 11 bp, Homo sapiens
gctgcaaagtg

SEQ ID NO: 5622796 - DNA, 13 bp, Homo sapiens
gctgcaaagtgca

SEQ ID NO: 5622797 - DNA, 19 bp, Homo sapiens
gctgcaaagtgcaaatact

SEQ ID NO: 5622798 - DNA, 13 bp, Homo sapiens
gctgcaaagtgtt

SEQ ID NO: 5622799 - DNA, 17 bp, Homo sapiens
gctgcaaataaggacag

SEQ ID NO: 5622800 - DNA, 18 bp, Homo sapiens
gctgcaaataaggacagc

SEQ ID NO: 5622801 - DNA, 12 bp, Homo sapiens
gctgcaaggtac

SEQ ID NO: 5622802 - DNA, 20 bp, Homo sapiens
gctgcaaggtactctggtga

SEQ ID NO: 5622803 - DNA, 19 bp, Homo sapiens
gctgcaaggtggcctctgc

SEQ ID NO: 5622804 - DNA, 22 bp, Homo sapiens
gctgcaagtcagattgctggga

SEQ ID NO: 5622805 - DNA, 13 bp, Homo sapiens
gctgcaatacatt

SEQ ID NO: 5622806 - DNA, 16 bp, Homo sapiens
gctgcaattccctgga

SEQ ID NO: 5622807 - DNA, 21 bp, Homo sapiens
gctgcaattgcagctcactgc

SEQ ID NO: 5622808 - DNA, 16 bp, Homo sapiens
gctgcacaaagtcagc

SEQ ID NO: 5622809 - DNA, 18 bp, Homo sapiens
gctgcacaacagccctgc

SEQ ID NO: 5622810 - DNA, 22 bp, Homo sapiens
gctgcacacagacggcctaggg

SEQ ID NO: 5622811 - DNA, 15 bp, Homo sapiens
gctgcacaccaaggc

SEQ ID NO: 5622812 - DNA, 19 bp, Homo sapiens
gctgcacaccaaggccctg

SEQ ID NO: 5622813 - DNA, 21 bp, Homo sapiens
gctgcacaccaaggccctgca

SEQ ID NO: 5622814 - DNA, 16 bp, Homo sapiens
gctgcacactgacata

SEQ ID NO: 5622815 - DNA, 13 bp, Homo sapiens
gctgcacagcagg

SEQ ID NO: 5622816 - DNA, 14 bp, Homo sapiens
gctgcacagcagga

SEQ ID NO: 5622817 - DNA, 13 bp, Homo sapiens
gctgcacaggctg

SEQ ID NO: 5622818 - DNA, 18 bp, Homo sapiens
gctgcacagggcagctgg

SEQ ID NO: 5622819 - DNA, 21 bp, Homo sapiens
gctgcacagggcagctgggcc

SEQ ID NO: 5622820 - DNA, 17 bp, Homo sapiens
gctgcacatagcagact

SEQ ID NO: 5622821 - DNA, 18 bp, Homo sapiens
gctgcacatagcagacta

SEQ ID NO: 5622822 - DNA, 22 bp, Homo sapiens
gctgcacatagcagactagaat

SEQ ID NO: 5622823 - DNA, 13 bp, Homo sapiens
gctgcacatgtgc

SEQ ID NO: 5622824 - DNA, 17 bp, Homo sapiens
gctgcacatgtgccaca

SEQ ID NO: 5622825 - DNA, 17 bp, Homo sapiens
gctgcacattcctggcc

SEQ ID NO: 5622826 - DNA, 16 bp, Homo sapiens
gctgcaccaacccagc

SEQ ID NO: 5622827 - DNA, 19 bp, Homo sapiens
gctgcaccaacccagccgc

SEQ ID NO: 5622828 - DNA, 14 bp, Homo sapiens
gctgcaccagagca

SEQ ID NO: 5622829 - DNA, 15 bp, Homo sapiens
gctgcaccaggtaga

SEQ ID NO: 5622830 - DNA, 15 bp, Homo sapiens
gctgcaccatcacac

SEQ ID NO: 5622831 - DNA, 13 bp, Homo sapiens
gctgcacccaact

SEQ ID NO: 5622832 - DNA, 18 bp, Homo sapiens
gctgcacccaactactga

SEQ ID NO: 5622833 - DNA, 20 bp, Homo sapiens
gctgcaccccagcgtcaggc

SEQ ID NO: 5622834 - DNA, 15 bp, Homo sapiens
gctgcacccctggtg

SEQ ID NO: 5622835 - DNA, 22 bp, Homo sapiens
gctgcacccctggtgtccctgc

SEQ ID NO: 5622836 - DNA, 19 bp, Homo sapiens
gctgcaccccttcctgggc

SEQ ID NO: 5622837 - DNA, 15 bp, Homo sapiens
gctgcaccctgcgcc

SEQ ID NO: 5622838 - DNA, 20 bp, Homo sapiens
gctgcacctcctaccctccc

SEQ ID NO: 5622839 - DNA, 21 bp, Homo sapiens
gctgcacctctggctagagcc

SEQ ID NO: 5622840 - DNA, 13 bp, Homo sapiens
gctgcacctgagg

SEQ ID NO: 5622841 - DNA, 16 bp, Homo sapiens
gctgcacctgcaggga

SEQ ID NO: 5622842 - DNA, 18 bp, Homo sapiens
gctgcacctttttgcatg

SEQ ID NO: 5622843 - DNA, 15 bp, Homo sapiens
gctgcacgctcccct

SEQ ID NO: 5622844 - DNA, 23 bp, Homo sapiens
gctgcacgggatgcgtgggaggc

SEQ ID NO: 5622845 - DNA, 24 bp, Homo sapiens
gctgcacgggatgcgtgggaggca

SEQ ID NO: 5622846 - DNA, 21 bp, Homo sapiens
gctgcacgtaggttccccaga

SEQ ID NO: 5622847 - DNA, 15 bp, Homo sapiens
gctgcacgtcaccct

SEQ ID NO: 5622848 - DNA, 17 bp, Homo sapiens
gctgcacgtcaccctcc

SEQ ID NO: 5622849 - DNA, 23 bp, Homo sapiens
gctgcacgtcaccctcctgagcc

SEQ ID NO: 5622850 - DNA, 18 bp, Homo sapiens
gctgcactaggacttggt

SEQ ID NO: 5622851 - DNA, 15 bp, Homo sapiens
gctgcactctgtgcc

SEQ ID NO: 5622852 - DNA, 20 bp, Homo sapiens
gctgcactctgtgcccatgg

SEQ ID NO: 5622853 - DNA, 14 bp, Homo sapiens
gctgcactgccctc

SEQ ID NO: 5622854 - DNA, 14 bp, Homo sapiens
gctgcactggagcc

SEQ ID NO: 5622855 - DNA, 17 bp, Homo sapiens
gctgcactggagccaca

SEQ ID NO: 5622856 - DNA, 18 bp, Homo sapiens
gctgcactggagccacag

SEQ ID NO: 5622857 - DNA, 20 bp, Homo sapiens
gctgcactggagccacaggc

SEQ ID NO: 5622858 - DNA, 12 bp, Homo sapiens
gctgcactgtga

SEQ ID NO: 5622859 - DNA, 14 bp, Homo sapiens
gctgcactgtgaac

SEQ ID NO: 5622860 - DNA, 21 bp, Homo sapiens
gctgcacttgacaccaaccag

SEQ ID NO: 5622861 - DNA, 17 bp, Homo sapiens
gctgcacttggcctcag

SEQ ID NO: 5622862 - DNA, 18 bp, Homo sapiens
gctgcacttggcctcagc

SEQ ID NO: 5622863 - DNA, 20 bp, Homo sapiens
gctgcacttggcctcagctg

SEQ ID NO: 5622864 - DNA, 24 bp, Homo sapiens
gctgcacttggcctcagctggctg

SEQ ID NO: 5622865 - DNA, 22 bp, Homo sapiens
gctgcagaaccagtccctctga

SEQ ID NO: 5622866 - DNA, 19 bp, Homo sapiens
gctgcagaaggccaagaat

SEQ ID NO: 5622867 - DNA, 17 bp, Homo sapiens
gctgcagacaaaaagaa

SEQ ID NO: 5622868 - DNA, 22 bp, Homo sapiens
gctgcagaccatgccagaccca

SEQ ID NO: 5622869 - DNA, 21 bp, Homo sapiens
gctgcagagagcacctggtgg

SEQ ID NO: 5622870 - DNA, 22 bp, Homo sapiens
gctgcagagagcacctggtggg

SEQ ID NO: 5622871 - DNA, 18 bp, Homo sapiens
gctgcagagatttctcat

SEQ ID NO: 5622872 - DNA, 13 bp, Homo sapiens
gctgcagagcagc

SEQ ID NO: 5622873 - DNA, 21 bp, Homo sapiens
gctgcagagcagtgggcctgg

SEQ ID NO: 5622874 - DNA, 14 bp, Homo sapiens
gctgcagagcccgg

SEQ ID NO: 5622875 - DNA, 20 bp, Homo sapiens
gctgcagagcccggccccac

SEQ ID NO: 5622876 - DNA, 15 bp, Homo sapiens
gctgcagagggagac

SEQ ID NO: 5622877 - DNA, 12 bp, Homo sapiens
gctgcagagggg

SEQ ID NO: 5622878 - DNA, 15 bp, Homo sapiens
gctgcagaggggcag

SEQ ID NO: 5622879 - DNA, 19 bp, Homo sapiens
gctgcagaggggcaggccc

SEQ ID NO: 5622880 - DNA, 22 bp, Homo sapiens
gctgcagaggggcaggccctgc

SEQ ID NO: 5622881 - DNA, 23 bp, Homo sapiens
gctgcagaggggcaggccctgca

SEQ ID NO: 5622882 - DNA, 20 bp, Homo sapiens
gctgcagataagtggccttg

SEQ ID NO: 5622883 - DNA, 19 bp, Homo sapiens
gctgcagatttcctgtgtg

SEQ ID NO: 5622884 - DNA, 16 bp, Homo sapiens
gctgcagcaccgaggg

SEQ ID NO: 5622885 - DNA, 23 bp, Homo sapiens
gctgcagcaccgaggggcctttg

SEQ ID NO: 5622886 - DNA, 21 bp, Homo sapiens
gctgcagcaggcagaggagag

SEQ ID NO: 5622887 - DNA, 16 bp, Homo sapiens
gctgcagcagggcagg

SEQ ID NO: 5622888 - DNA, 12 bp, Homo sapiens
gctgcagcatgt

SEQ ID NO: 5622889 - DNA, 22 bp, Homo sapiens
gctgcagcatgttgctgaggag

SEQ ID NO: 5622890 - DNA, 20 bp, Homo sapiens
gctgcagccaaccccatcct

SEQ ID NO: 5622891 - DNA, 11 bp, Homo sapiens
gctgcagccag

SEQ ID NO: 5622892 - DNA, 12 bp, Homo sapiens
gctgcagccagg

SEQ ID NO: 5622893 - DNA, 13 bp, Homo sapiens
gctgcagccaggc

SEQ ID NO: 5622894 - DNA, 15 bp, Homo sapiens
gctgcagccaggcca

SEQ ID NO: 5622895 - DNA, 23 bp, Homo sapiens
gctgcagccaggccactggcccc

SEQ ID NO: 5622896 - DNA, 16 bp, Homo sapiens
gctgcagccaggcctc

SEQ ID NO: 5622897 - DNA, 14 bp, Homo sapiens
gctgcagccatccc

SEQ ID NO: 5622898 - DNA, 15 bp, Homo sapiens
gctgcagccatcccg

SEQ ID NO: 5622899 - DNA, 22 bp, Homo sapiens
gctgcagccatcccgcttagcc

SEQ ID NO: 5622900 - DNA, 12 bp, Homo sapiens
gctgcagcccat

SEQ ID NO: 5622901 - DNA, 15 bp, Homo sapiens
gctgcagccccatct

SEQ ID NO: 5622902 - DNA, 20 bp, Homo sapiens
gctgcagccccctgcttctc

SEQ ID NO: 5622903 - DNA, 23 bp, Homo sapiens
gctgcagccccttgctctcagct

SEQ ID NO: 5622904 - DNA, 16 bp, Homo sapiens
gctgcagcctcaggac

SEQ ID NO: 5622905 - DNA, 18 bp, Homo sapiens
gctgcagcctcaggactg

SEQ ID NO: 5622906 - DNA, 16 bp, Homo sapiens
gctgcagcctctgcct

SEQ ID NO: 5622907 - DNA, 18 bp, Homo sapiens
gctgcagcgcctcctgga

SEQ ID NO: 5622908 - DNA, 15 bp, Homo sapiens
gctgcagctcaccca

SEQ ID NO: 5622909 - DNA, 16 bp, Homo sapiens
gctgcagctccctggc

SEQ ID NO: 5622910 - DNA, 16 bp, Homo sapiens
gctgcagctggacaga

SEQ ID NO: 5622911 - DNA, 13 bp, Homo sapiens
gctgcagctgggc

SEQ ID NO: 5622912 - DNA, 21 bp, Homo sapiens
gctgcagctgggccccatgct

SEQ ID NO: 5622913 - DNA, 22 bp, Homo sapiens
gctgcagctgggccccatgctc

SEQ ID NO: 5622914 - DNA, 13 bp, Homo sapiens
gctgcagcttggg

SEQ ID NO: 5622915 - DNA, 22 bp, Homo sapiens
gctgcagcttgggagagcccct

SEQ ID NO: 5622916 - DNA, 14 bp, Homo sapiens
gctgcaggaagaaa

SEQ ID NO: 5622917 - DNA, 17 bp, Homo sapiens
gctgcaggacttgagaa

SEQ ID NO: 5622918 - DNA, 13 bp, Homo sapiens
gctgcaggagggc

SEQ ID NO: 5622919 - DNA, 16 bp, Homo sapiens
gctgcaggagggcact

SEQ ID NO: 5622920 - DNA, 24 bp, Homo sapiens
gctgcaggcacacacgccttcatg

SEQ ID NO: 5622921 - DNA, 22 bp, Homo sapiens
gctgcaggcaccgctgggttct

SEQ ID NO: 5622922 - DNA, 13 bp, Homo sapiens
gctgcaggccctc

SEQ ID NO: 5622923 - DNA, 21 bp, Homo sapiens
gctgcagggagcaccacggcc

SEQ ID NO: 5622924 - DNA, 17 bp, Homo sapiens
gctgcagggctgggtca

SEQ ID NO: 5622925 - DNA, 19 bp, Homo sapiens
gctgcagggctttaaaatt

SEQ ID NO: 5622926 - DNA, 17 bp, Homo sapiens
gctgcaggggcaggaga

SEQ ID NO: 5622927 - DNA, 23 bp, Homo sapiens
gctgcaggggcaggagaggctgg

SEQ ID NO: 5622928 - DNA, 17 bp, Homo sapiens
gctgcctggagaaagga

SEQ ID NO: 5622929 - DNA, 16 bp, Homo sapiens
gctgcctggagcccca

SEQ ID NO: 5622930 - DNA, 22 bp, Homo sapiens
gctgcctggagccccactgccc

SEQ ID NO: 5622931 - DNA, 12 bp, Homo sapiens
gctgcctggagt

SEQ ID NO: 5622932 - DNA, 15 bp, Homo sapiens
gctgcctggagtcag

SEQ ID NO: 5622933 - DNA, 22 bp, Homo sapiens
gctgcctggcacagaccaggcc

SEQ ID NO: 5622934 - DNA, 14 bp, Homo sapiens
gctgcctggccagg

SEQ ID NO: 5622935 - DNA, 16 bp, Homo sapiens
gctgcctggccaggcc

SEQ ID NO: 5622936 - DNA, 17 bp, Homo sapiens
gctgcctggccaggccc

SEQ ID NO: 5622937 - DNA, 19 bp, Homo sapiens
gctgcctggccaggccctg

SEQ ID NO: 5622938 - DNA, 22 bp, Homo sapiens
gctgcctggccaggccctgggt

SEQ ID NO: 5622939 - DNA, 19 bp, Homo sapiens
gctgcctggcccccagctg

SEQ ID NO: 5622940 - DNA, 21 bp, Homo sapiens
gctgcctggcccccagctgtg

SEQ ID NO: 5622941 - DNA, 11 bp, Homo sapiens
gctgcctggcg

SEQ ID NO: 5622942 - DNA, 12 bp, Homo sapiens
gctgcctggcgg

SEQ ID NO: 5622943 - DNA, 21 bp, Homo sapiens
gctgcctgggatccctcatcc

SEQ ID NO: 5622944 - DNA, 12 bp, Homo sapiens
gctgcctgggct

SEQ ID NO: 5622945 - DNA, 18 bp, Homo sapiens
gctgcctgggctgttggc

SEQ ID NO: 5622946 - DNA, 23 bp, Homo sapiens
gctgcctgggctgttggcactca

SEQ ID NO: 5622947 - DNA, 21 bp, Homo sapiens
gctgcctgggtaggccccaca

SEQ ID NO: 5622948 - DNA, 23 bp, Homo sapiens
gctgcctgggtaggccccacaag

SEQ ID NO: 5622949 - DNA, 15 bp, Homo sapiens
gctgcctgtagttag

SEQ ID NO: 5622950 - DNA, 15 bp, Homo sapiens
gctgcctgtgccatg

SEQ ID NO: 5622951 - DNA, 16 bp, Homo sapiens
gctgcctgtgccatgc

SEQ ID NO: 5622952 - DNA, 17 bp, Homo sapiens
gctgcctgtgccatgcc

SEQ ID NO: 5622953 - DNA, 24 bp, Homo sapiens
gctgcctgtgcctgccatgggcca

SEQ ID NO: 5622954 - DNA, 13 bp, Homo sapiens
gctgcctgttcag

SEQ ID NO: 5622955 - DNA, 22 bp, Homo sapiens
gctgcctgttcagctccagctc

SEQ ID NO: 5622956 - DNA, 15 bp, Homo sapiens
gctgccttagaacct

SEQ ID NO: 5622957 - DNA, 14 bp, Homo sapiens
gctgccttagcttc

SEQ ID NO: 5622958 - DNA, 16 bp, Homo sapiens
gctgccttcaccctga

SEQ ID NO: 5622959 - DNA, 17 bp, Homo sapiens
gctgccttcaccctgaa

SEQ ID NO: 5622960 - DNA, 12 bp, Homo sapiens
gctgccttcagg

SEQ ID NO: 5622961 - DNA, 15 bp, Homo sapiens
gctgccttcagggag

SEQ ID NO: 5622962 - DNA, 13 bp, Homo sapiens
gctgccttcccta

SEQ ID NO: 5622963 - DNA, 15 bp, Homo sapiens
gctgccttcctcatc

SEQ ID NO: 5622964 - DNA, 20 bp, Homo sapiens
gctgccttcggtacccacca

SEQ ID NO: 5622965 - DNA, 17 bp, Homo sapiens
gctgccttctgtctctt

SEQ ID NO: 5622966 - DNA, 20 bp, Homo sapiens
gctgccttctgtctcttgca

SEQ ID NO: 5622967 - DNA, 14 bp, Homo sapiens
gctgccttggctca

SEQ ID NO: 5622968 - DNA, 16 bp, Homo sapiens
gctgccttggctcaga

SEQ ID NO: 5622969 - DNA, 23 bp, Homo sapiens
gctgccttggctcagacatgttt

SEQ ID NO: 5622970 - DNA, 20 bp, Homo sapiens
gctgccttgtagatggagca

SEQ ID NO: 5622971 - DNA, 22 bp, Homo sapiens
gctgcctttgatcacaggagca

SEQ ID NO: 5622972 - DNA, 17 bp, Homo sapiens
gctgcctttgtccccac

SEQ ID NO: 5622973 - DNA, 22 bp, Homo sapiens
gctgcctttgtccccacacagc

SEQ ID NO: 5622974 - DNA, 19 bp, Homo sapiens
gctgccttttgctgctgct

SEQ ID NO: 5622975 - DNA, 21 bp, Homo sapiens
gctgccttttgtttctagaat

SEQ ID NO: 5622976 - DNA, 15 bp, Homo sapiens
gctgcgaccgccaga

SEQ ID NO: 5622977 - DNA, 14 bp, Homo sapiens
gctgcgagcatttc

SEQ ID NO: 5622978 - DNA, 15 bp, Homo sapiens
gctgcgatactggca

SEQ ID NO: 5622979 - DNA, 17 bp, Homo sapiens
gctgcgatggatgttta

SEQ ID NO: 5622980 - DNA, 17 bp, Homo sapiens
gctgcgcaccaatgccc

SEQ ID NO: 5622981 - DNA, 21 bp, Homo sapiens
gctgcgcaccaatgcccagca

SEQ ID NO: 5622982 - DNA, 24 bp, Homo sapiens
gctgcgcaccaatgcccagcaggg

SEQ ID NO: 5622983 - DNA, 16 bp, Homo sapiens
gctgcgccccaggccc

SEQ ID NO: 5622984 - DNA, 18 bp, Homo sapiens
gctgcgccccaggccccg

SEQ ID NO: 5622985 - DNA, 17 bp, Homo sapiens
gctgcgcccccagcttc

SEQ ID NO: 5622986 - DNA, 23 bp, Homo sapiens
gctgcgccggacagagtggggag

SEQ ID NO: 5622987 - DNA, 14 bp, Homo sapiens
gctgcgcctgcagg

SEQ ID NO: 5622988 - DNA, 15 bp, Homo sapiens
gctgcgcctgcccgc

SEQ ID NO: 5622989 - DNA, 17 bp, Homo sapiens
gctgcgcggactcgccc

SEQ ID NO: 5622990 - DNA, 19 bp, Homo sapiens
gctgcgcggactcgccccc

SEQ ID NO: 5622991 - DNA, 20 bp, Homo sapiens
gctgcgcgtgtgggtctctg

SEQ ID NO: 5622992 - DNA, 22 bp, Homo sapiens
gctgcgctaacccccagcccac

SEQ ID NO: 5622993 - DNA, 13 bp, Homo sapiens
gctgcgctagcag

SEQ ID NO: 5622994 - DNA, 15 bp, Homo sapiens
gctgcgctagcagcc

SEQ ID NO: 5622995 - DNA, 17 bp, Homo sapiens
gctgcgctagcagccct

SEQ ID NO: 5622996 - DNA, 17 bp, Homo sapiens
gctgcgctcccacctcg

SEQ ID NO: 5622997 - DNA, 14 bp, Homo sapiens
gctgcgctgccctg

SEQ ID NO: 5622998 - DNA, 23 bp, Homo sapiens
gctgcggacaccgtggcctgggc

SEQ ID NO: 5622999 - DNA, 16 bp, Homo sapiens
gctgcggagcaagagg

SEQ ID NO: 5623000 - DNA, 15 bp, Homo sapiens
gctgcggcacccttg

SEQ ID NO: 5623001 - DNA, 15 bp, Homo sapiens
gctgcggccaggcct

SEQ ID NO: 5623002 - DNA, 17 bp, Homo sapiens
gctgcggcgtacaggct

SEQ ID NO: 5623003 - DNA, 20 bp, Homo sapiens
gctgcgggaggccctggccc

SEQ ID NO: 5623004 - DNA, 20 bp, Homo sapiens
gctgcgggctccctggcagg

SEQ ID NO: 5623005 - DNA, 14 bp, Homo sapiens
gctgcgggctgagg

SEQ ID NO: 5623006 - DNA, 15 bp, Homo sapiens
gctgcgggggcaggc

SEQ ID NO: 5623007 - DNA, 15 bp, Homo sapiens
gctgcgggtctgaag

SEQ ID NO: 5623008 - DNA, 16 bp, Homo sapiens
gctgcgggtctgaagg

SEQ ID NO: 5623009 - DNA, 23 bp, Homo sapiens
gctgcggtcactcaggcctctgc

SEQ ID NO: 5623010 - DNA, 14 bp, Homo sapiens
gctgcggtccaccc

SEQ ID NO: 5623011 - DNA, 22 bp, Homo sapiens
gctgcggtccacccaggagccc

SEQ ID NO: 5623012 - DNA, 15 bp, Homo sapiens
gctgcggtgtttggc

SEQ ID NO: 5623013 - DNA, 15 bp, Homo sapiens
gctgcgtccccactc

SEQ ID NO: 5623014 - DNA, 17 bp, Homo sapiens
gctgcgtccccactccc

SEQ ID NO: 5623015 - DNA, 16 bp, Homo sapiens
gctgcgtctggagggg

SEQ ID NO: 5623016 - DNA, 18 bp, Homo sapiens
gctgcgtgacatgtgcag

SEQ ID NO: 5623017 - DNA, 14 bp, Homo sapiens
gctgcgtgccatca

SEQ ID NO: 5623018 - DNA, 15 bp, Homo sapiens
gctgcgtgccatgag

SEQ ID NO: 5623019 - DNA, 16 bp, Homo sapiens
gctgcgtgcccctgct

SEQ ID NO: 5623020 - DNA, 14 bp, Homo sapiens
gctgcgtgcctgtg

SEQ ID NO: 5623021 - DNA, 13 bp, Homo sapiens
gctgcgtgtggga

SEQ ID NO: 5623022 - DNA, 13 bp, Homo sapiens
gctgctaaaataa

SEQ ID NO: 5623023 - DNA, 18 bp, Homo sapiens
gctgctaaaataaacctg

SEQ ID NO: 5623024 - DNA, 17 bp, Homo sapiens
gctgctaagtggaagac

SEQ ID NO: 5623025 - DNA, 18 bp, Homo sapiens
gctgctaatattttcctc

SEQ ID NO: 5623026 - DNA, 21 bp, Homo sapiens
gctgctaatattttcctcctg

SEQ ID NO: 5623027 - DNA, 22 bp, Homo sapiens
gctgctaatattttcctcctga

SEQ ID NO: 5623028 - DNA, 24 bp, Homo sapiens
gctgctaatattttcctcctgagt

SEQ ID NO: 5623029 - DNA, 23 bp, Homo sapiens
gctgctaatcctgaggctggtag

SEQ ID NO: 5623030 - DNA, 15 bp, Homo sapiens
gctgctaatcttcag

SEQ ID NO: 5623031 - DNA, 15 bp, Homo sapiens
gctgctaattcccaa

SEQ ID NO: 5623032 - DNA, 15 bp, Homo sapiens
gctgctacaaagaag

SEQ ID NO: 5623033 - DNA, 19 bp, Homo sapiens
gctgctacaaagaagacat

SEQ ID NO: 5623034 - DNA, 16 bp, Homo sapiens
gctgctaccctccctg

SEQ ID NO: 5623035 - DNA, 15 bp, Homo sapiens
gctgctaccgccctg

SEQ ID NO: 5623036 - DNA, 19 bp, Homo sapiens
gctgctaccgccctgggct

SEQ ID NO: 5623037 - DNA, 22 bp, Homo sapiens
gctgctaccgccctgggctgga

SEQ ID NO: 5623038 - DNA, 23 bp, Homo sapiens
gctgctactacccgagcccagct

SEQ ID NO: 5623039 - DNA, 14 bp, Homo sapiens
gctgctacttatat

SEQ ID NO: 5623040 - DNA, 16 bp, Homo sapiens
gctgctagaacttttt

SEQ ID NO: 5623041 - DNA, 22 bp, Homo sapiens
gctgctagaacttttttaaata

SEQ ID NO: 5623042 - DNA, 14 bp, Homo sapiens
gctgctagatcttt

SEQ ID NO: 5623043 - DNA, 15 bp, Homo sapiens
gctgctagatcttta

SEQ ID NO: 5623044 - DNA, 14 bp, Homo sapiens
gctgctagatttta

SEQ ID NO: 5623045 - DNA, 20 bp, Homo sapiens
gctgctagcacttggagcca

SEQ ID NO: 5623046 - DNA, 13 bp, Homo sapiens
gctgctaggccag

SEQ ID NO: 5623047 - DNA, 14 bp, Homo sapiens
gctgctagggcccc

SEQ ID NO: 5623048 - DNA, 18 bp, Homo sapiens
gctgctaggggaaggact

SEQ ID NO: 5623049 - DNA, 16 bp, Homo sapiens
gctgctagtatatgtc

SEQ ID NO: 5623050 - DNA, 16 bp, Homo sapiens
gctgctatacacaagc

SEQ ID NO: 5623051 - DNA, 22 bp, Homo sapiens
gctgctatacacaagcaatgca

SEQ ID NO: 5623052 - DNA, 17 bp, Homo sapiens
gctgctatatccactgt

SEQ ID NO: 5623053 - DNA, 21 bp, Homo sapiens
gctgctatccccatctccctg

SEQ ID NO: 5623054 - DNA, 21 bp, Homo sapiens
gctgctattgctgtctggtga

SEQ ID NO: 5623055 - DNA, 19 bp, Homo sapiens
gctgctcaacctctctcct

SEQ ID NO: 5623056 - DNA, 23 bp, Homo sapiens
gctgctcaacctctctccttctg

SEQ ID NO: 5623057 - DNA, 23 bp, Homo sapiens
gctgctcacccacctcttgtgca

SEQ ID NO: 5623058 - DNA, 20 bp, Homo sapiens
gctgctcactcccgctgagc

SEQ ID NO: 5623059 - DNA, 20 bp, Homo sapiens
gctgctcagggaaaagcagc

SEQ ID NO: 5623060 - DNA, 14 bp, Homo sapiens
gctgctcatcaccc

SEQ ID NO: 5623061 - DNA, 21 bp, Homo sapiens
gctgctcattacagttctttc

SEQ ID NO: 5623062 - DNA, 21 bp, Homo sapiens
gctgctcattccacactgttg

SEQ ID NO: 5623063 - DNA, 16 bp, Homo sapiens
gctgctccaggcctgc

SEQ ID NO: 5623064 - DNA, 16 bp, Homo sapiens
gctgctccatgcacag

SEQ ID NO: 5623065 - DNA, 10 bp, Homo sapiens
gctgctccca

SEQ ID NO: 5623066 - DNA, 22 bp, Homo sapiens
gctgctcccacctggctctgtg

SEQ ID NO: 5623067 - DNA, 15 bp, Homo sapiens
gctgctcccagccac

SEQ ID NO: 5623068 - DNA, 16 bp, Homo sapiens
gctgctcccagcctct

SEQ ID NO: 5623069 - DNA, 19 bp, Homo sapiens
gctgctccccaacacctgc

SEQ ID NO: 5623070 - DNA, 22 bp, Homo sapiens
gctgctccccacgtcagctggg

SEQ ID NO: 5623071 - DNA, 16 bp, Homo sapiens
gctgctccccagcagc

SEQ ID NO: 5623072 - DNA, 16 bp, Homo sapiens
gctgctccccaggcca

SEQ ID NO: 5623073 - DNA, 20 bp, Homo sapiens
gctgctcccctccctcctct

SEQ ID NO: 5623074 - DNA, 12 bp, Homo sapiens
gctgctccctca

SEQ ID NO: 5623075 - DNA, 15 bp, Homo sapiens
gctgctccctcagac

SEQ ID NO: 5623076 - DNA, 16 bp, Homo sapiens
gctgctccctcagact

SEQ ID NO: 5623077 - DNA, 19 bp, Homo sapiens
gctgctccctcagactggg

SEQ ID NO: 5623078 - DNA, 13 bp, Homo sapiens
gctgctccctgag

SEQ ID NO: 5623079 - DNA, 15 bp, Homo sapiens
gctgctccctgctcc

SEQ ID NO: 5623080 - DNA, 22 bp, Homo sapiens
gctgctccctgctcccagggac

SEQ ID NO: 5623081 - DNA, 14 bp, Homo sapiens
gctgctcctccagg

SEQ ID NO: 5623082 - DNA, 20 bp, Homo sapiens
gctgctcctcggccagagct

SEQ ID NO: 5623083 - DNA, 17 bp, Homo sapiens
gctgctcctctcttggg

SEQ ID NO: 5623084 - DNA, 20 bp, Homo sapiens
gctgctcctctttcccctcc

SEQ ID NO: 5623085 - DNA, 15 bp, Homo sapiens
gctgctccttggctt

SEQ ID NO: 5623086 - DNA, 13 bp, Homo sapiens
gctgctcctttgg

SEQ ID NO: 5623087 - DNA, 14 bp, Homo sapiens
gctgctcctttggg

SEQ ID NO: 5623088 - DNA, 15 bp, Homo sapiens
gctgctcctttgggg

SEQ ID NO: 5623089 - DNA, 15 bp, Homo sapiens
gctgctcgcccagga

SEQ ID NO: 5623090 - DNA, 17 bp, Homo sapiens
gctgctcgcccaggaag

SEQ ID NO: 5623091 - DNA, 18 bp, Homo sapiens
gctgctcggggtgcacag

SEQ ID NO: 5623092 - DNA, 20 bp, Homo sapiens
gctgctcggggtgcacagga

SEQ ID NO: 5623093 - DNA, 17 bp, Homo sapiens
gctgctctaagcccagg

SEQ ID NO: 5623094 - DNA, 23 bp, Homo sapiens
gctgctctaagcccaggatctct

SEQ ID NO: 5623095 - DNA, 12 bp, Homo sapiens
gctgctctatat

SEQ ID NO: 5623096 - DNA, 20 bp, Homo sapiens
gctgctctcaaacccctgac

SEQ ID NO: 5623097 - DNA, 13 bp, Homo sapiens
gctgctctcagcc

SEQ ID NO: 5623098 - DNA, 14 bp, Homo sapiens
gctgctctcccaag

SEQ ID NO: 5623099 - DNA, 16 bp, Homo sapiens
gctgctctcccaaggg

SEQ ID NO: 5623100 - DNA, 13 bp, Homo sapiens
gctgctctcccag

SEQ ID NO: 5623101 - DNA, 14 bp, Homo sapiens
gctgctctcccagg

SEQ ID NO: 5623102 - DNA, 15 bp, Homo sapiens
gctgctctcccctcc

SEQ ID NO: 5623103 - DNA, 19 bp, Homo sapiens
gctgctctcccctcccagt

SEQ ID NO: 5623104 - DNA, 23 bp, Homo sapiens
gctgctctccttcactctgacag

SEQ ID NO: 5623105 - DNA, 16 bp, Homo sapiens
gctgctctctaagaat

SEQ ID NO: 5623106 - DNA, 17 bp, Homo sapiens
gctggccctgccctccc

SEQ ID NO: 5623107 - DNA, 21 bp, Homo sapiens
gctggccctgccctcccccac

SEQ ID NO: 5623108 - DNA, 15 bp, Homo sapiens
gctggccctgcctcc

SEQ ID NO: 5623109 - DNA, 18 bp, Homo sapiens
gctggccctgcctcctgg

SEQ ID NO: 5623110 - DNA, 21 bp, Homo sapiens
gctggccctgcctcctgggaa

SEQ ID NO: 5623111 - DNA, 11 bp, Homo sapiens
gctggccctgt

SEQ ID NO: 5623112 - DNA, 15 bp, Homo sapiens
gctggccctgtgcag

SEQ ID NO: 5623113 - DNA, 17 bp, Homo sapiens
gctggccctgtgcagac

SEQ ID NO: 5623114 - DNA, 19 bp, Homo sapiens
gctggccctgtgcagacct

SEQ ID NO: 5623115 - DNA, 14 bp, Homo sapiens
gctggcccttagag

SEQ ID NO: 5623116 - DNA, 20 bp, Homo sapiens
gctggccgagggtcctggct

SEQ ID NO: 5623117 - DNA, 24 bp, Homo sapiens
gctggccgagggtcctggctcctg

SEQ ID NO: 5623118 - DNA, 18 bp, Homo sapiens
gctggccgcccccagccc

SEQ ID NO: 5623119 - DNA, 20 bp, Homo sapiens
gctggccgcctcaccccctc

SEQ ID NO: 5623120 - DNA, 19 bp, Homo sapiens
gctggccgctgtgccaggc

SEQ ID NO: 5623121 - DNA, 17 bp, Homo sapiens
gctggccggaaggagac

SEQ ID NO: 5623122 - DNA, 14 bp, Homo sapiens
gctggccggacacc

SEQ ID NO: 5623123 - DNA, 15 bp, Homo sapiens
gctggccggacaccc

SEQ ID NO: 5623124 - DNA, 22 bp, Homo sapiens
gctggccggggctctgggtgct

SEQ ID NO: 5623125 - DNA, 20 bp, Homo sapiens
gctggccgggggaggtgggt

SEQ ID NO: 5623126 - DNA, 21 bp, Homo sapiens
gctggcctcacccacccctgc

SEQ ID NO: 5623127 - DNA, 16 bp, Homo sapiens
gctggcctcagactca

SEQ ID NO: 5623128 - DNA, 21 bp, Homo sapiens
gctggcctcccaaatgagcca

SEQ ID NO: 5623129 - DNA, 18 bp, Homo sapiens
gctggcctcccaataaag

SEQ ID NO: 5623130 - DNA, 19 bp, Homo sapiens
gctggcctcccccaacacc

SEQ ID NO: 5623131 - DNA, 15 bp, Homo sapiens
gctggcctccctccg

SEQ ID NO: 5623132 - DNA, 21 bp, Homo sapiens
gctggcctccctccgtccctc

SEQ ID NO: 5623133 - DNA, 14 bp, Homo sapiens
gctggcctctacca

SEQ ID NO: 5623134 - DNA, 13 bp, Homo sapiens
gctggcctctaga

SEQ ID NO: 5623135 - DNA, 13 bp, Homo sapiens
gctggcctctgcg

SEQ ID NO: 5623136 - DNA, 14 bp, Homo sapiens
gctggcctctgcga

SEQ ID NO: 5623137 - DNA, 23 bp, Homo sapiens
gctggcctctggctctcatgggg

SEQ ID NO: 5623138 - DNA, 14 bp, Homo sapiens
gctggcctcttggc

SEQ ID NO: 5623139 - DNA, 20 bp, Homo sapiens
gctggcctcttggcacctgc

SEQ ID NO: 5623140 - DNA, 21 bp, Homo sapiens
gctggcctgactggttgtcag

SEQ ID NO: 5623141 - DNA, 11 bp, Homo sapiens
gctggcctgct

SEQ ID NO: 5623142 - DNA, 13 bp, Homo sapiens
gctggcctgctct

SEQ ID NO: 5623143 - DNA, 17 bp, Homo sapiens
gctggcctgctcttact

SEQ ID NO: 5623144 - DNA, 13 bp, Homo sapiens
gctggcctggagg

SEQ ID NO: 5623145 - DNA, 13 bp, Homo sapiens
gctggcctggcag

SEQ ID NO: 5623146 - DNA, 16 bp, Homo sapiens
gctggcctggcccctc

SEQ ID NO: 5623147 - DNA, 14 bp, Homo sapiens
gctggcctggccgg

SEQ ID NO: 5623148 - DNA, 20 bp, Homo sapiens
gctggcctggggtcaggccg

SEQ ID NO: 5623149 - DNA, 12 bp, Homo sapiens
gctggcctgtgg

SEQ ID NO: 5623150 - DNA, 13 bp, Homo sapiens
gctggcctgtggc

SEQ ID NO: 5623151 - DNA, 14 bp, Homo sapiens
gctggcctgtggca

SEQ ID NO: 5623152 - DNA, 18 bp, Homo sapiens
gctggcctgtggcacagc

SEQ ID NO: 5623153 - DNA, 19 bp, Homo sapiens
gctggcctgtggcacagcc

SEQ ID NO: 5623154 - DNA, 17 bp, Homo sapiens
gctggcctgtggcaggc

SEQ ID NO: 5623155 - DNA, 20 bp, Homo sapiens
gctggcctgtggcaggccta

SEQ ID NO: 5623156 - DNA, 21 bp, Homo sapiens
gctggcctgtggcaggcctag

SEQ ID NO: 5623157 - DNA, 19 bp, Homo sapiens
gctggccttcctgccctac

SEQ ID NO: 5623158 - DNA, 19 bp, Homo sapiens
gctggccttggtatgtgcc

SEQ ID NO: 5623159 - DNA, 22 bp, Homo sapiens
gctggccttggtatgtgccagg

SEQ ID NO: 5623160 - DNA, 18 bp, Homo sapiens
gctggccttgtggtccaa

SEQ ID NO: 5623161 - DNA, 21 bp, Homo sapiens
gctggccttgtggtccaaata

SEQ ID NO: 5623162 - DNA, 16 bp, Homo sapiens
gctggcgacactcagg

SEQ ID NO: 5623163 - DNA, 15 bp, Homo sapiens
gctggcgagagtctg

SEQ ID NO: 5623164 - DNA, 14 bp, Homo sapiens
gctggcgctcagca

SEQ ID NO: 5623165 - DNA, 17 bp, Homo sapiens
gctggcgctcagcagcc

SEQ ID NO: 5623166 - DNA, 15 bp, Homo sapiens
gctggcgcttggatc

SEQ ID NO: 5623167 - DNA, 19 bp, Homo sapiens
gctggcgcttggatctggg

SEQ ID NO: 5623168 - DNA, 15 bp, Homo sapiens
gctggcggaacctgg

SEQ ID NO: 5623169 - DNA, 20 bp, Homo sapiens
gctggcggaacctggctgcg

SEQ ID NO: 5623170 - DNA, 22 bp, Homo sapiens
gctggcggaggctgctcggcta

SEQ ID NO: 5623171 - DNA, 16 bp, Homo sapiens
gctggcggcgcagagg

SEQ ID NO: 5623172 - DNA, 16 bp, Homo sapiens
gctggcggctactcag

SEQ ID NO: 5623173 - DNA, 20 bp, Homo sapiens
gctggcggctactcagcagc

SEQ ID NO: 5623174 - DNA, 18 bp, Homo sapiens
gctggcggggtcccccct

SEQ ID NO: 5623175 - DNA, 14 bp, Homo sapiens
gctggcgtgcagtg

SEQ ID NO: 5623176 - DNA, 18 bp, Homo sapiens
gctggcgtgcagtggtgc

SEQ ID NO: 5623177 - DNA, 15 bp, Homo sapiens
gctggctagtccttt

SEQ ID NO: 5623178 - DNA, 23 bp, Homo sapiens
gctggctcacagtacagcatgtg

SEQ ID NO: 5623179 - DNA, 17 bp, Homo sapiens
gctggctcacgccccgc

SEQ ID NO: 5623180 - DNA, 23 bp, Homo sapiens
gctggctcacgccccgctgtgtc

SEQ ID NO: 5623181 - DNA, 20 bp, Homo sapiens
gctggctcaggaagaaaccc

SEQ ID NO: 5623182 - DNA, 17 bp, Homo sapiens
gctggctccagatgcag

SEQ ID NO: 5623183 - DNA, 21 bp, Homo sapiens
gctggctccagatgcagggca

SEQ ID NO: 5623184 - DNA, 14 bp, Homo sapiens
gctggctccagcct

SEQ ID NO: 5623185 - DNA, 20 bp, Homo sapiens
gctggctcccagggtggagg

SEQ ID NO: 5623186 - DNA, 16 bp, Homo sapiens
gctggctcccatctcc

SEQ ID NO: 5623187 - DNA, 13 bp, Homo sapiens
gctggctcccctg

SEQ ID NO: 5623188 - DNA, 16 bp, Homo sapiens
gctggctcccctgcag

SEQ ID NO: 5623189 - DNA, 19 bp, Homo sapiens
gctggctccctgggcagtg

SEQ ID NO: 5623190 - DNA, 14 bp, Homo sapiens
gctggctcctaggg

SEQ ID NO: 5623191 - DNA, 13 bp, Homo sapiens
gctggctcctgaa

SEQ ID NO: 5623192 - DNA, 14 bp, Homo sapiens
gctggctcctgatc

SEQ ID NO: 5623193 - DNA, 22 bp, Homo sapiens
gctggctcctggggatggccag

SEQ ID NO: 5623194 - DNA, 21 bp, Homo sapiens
gctggctctaccttcctgtcc

SEQ ID NO: 5623195 - DNA, 21 bp, Homo sapiens
gctggctctataaggcagcct

SEQ ID NO: 5623196 - DNA, 13 bp, Homo sapiens
gctggctctgaga

SEQ ID NO: 5623197 - DNA, 15 bp, Homo sapiens
gctggctctgagaat

SEQ ID NO: 5623198 - DNA, 17 bp, Homo sapiens
gctggctctgagaatca

SEQ ID NO: 5623199 - DNA, 14 bp, Homo sapiens
gctggctctgcact

SEQ ID NO: 5623200 - DNA, 20 bp, Homo sapiens
gctggctctgcactaagaga

SEQ ID NO: 5623201 - DNA, 22 bp, Homo sapiens
gctggctctgcactaagagaaa

SEQ ID NO: 5623202 - DNA, 16 bp, Homo sapiens
gctggctctgcagcac

SEQ ID NO: 5623203 - DNA, 19 bp, Homo sapiens
gctggctctgtgagggtgc

SEQ ID NO: 5623204 - DNA, 13 bp, Homo sapiens
gctggctcttctg

SEQ ID NO: 5623205 - DNA, 18 bp, Homo sapiens
gctggctcttctgcccaa

SEQ ID NO: 5623206 - DNA, 18 bp, Homo sapiens
gctggctgacctgggccc

SEQ ID NO: 5623207 - DNA, 19 bp, Homo sapiens
gctggctgactaagccccg

SEQ ID NO: 5623208 - DNA, 13 bp, Homo sapiens
gctggctgaggct

SEQ ID NO: 5623209 - DNA, 17 bp, Homo sapiens
gctggctgaggcttggg

SEQ ID NO: 5623210 - DNA, 15 bp, Homo sapiens
gctggctgagggcag

SEQ ID NO: 5623211 - DNA, 12 bp, Homo sapiens
gctggctgagtg

SEQ ID NO: 5623212 - DNA, 12 bp, Homo sapiens
gctggctgatca

SEQ ID NO: 5623213 - DNA, 13 bp, Homo sapiens
gctggctgcagtg

SEQ ID NO: 5623214 - DNA, 14 bp, Homo sapiens
gctggctgcagtga

SEQ ID NO: 5623215 - DNA, 20 bp, Homo sapiens
gctggctgccttagaacctt

SEQ ID NO: 5623216 - DNA, 15 bp, Homo sapiens
gctggctgctgacag

SEQ ID NO: 5623217 - DNA, 13 bp, Homo sapiens
gctggctgctggc

SEQ ID NO: 5623218 - DNA, 23 bp, Homo sapiens
gctggctgcttgcagccaggaga

SEQ ID NO: 5623219 - DNA, 14 bp, Homo sapiens
gctggctggcaggt

SEQ ID NO: 5623220 - DNA, 12 bp, Homo sapiens
gctggctggcct

SEQ ID NO: 5623221 - DNA, 14 bp, Homo sapiens
gctggctggcctca

SEQ ID NO: 5623222 - DNA, 16 bp, Homo sapiens
gctggctgggcatgga

SEQ ID NO: 5623223 - DNA, 20 bp, Homo sapiens
gctggctgggctggctgaag

SEQ ID NO: 5623224 - DNA, 11 bp, Homo sapiens
gctggctgggg

SEQ ID NO: 5623225 - DNA, 14 bp, Homo sapiens
gctggctggggccg

SEQ ID NO: 5623226 - DNA, 21 bp, Homo sapiens
gctggctgggggcctcactcc

SEQ ID NO: 5623227 - DNA, 22 bp, Homo sapiens
gctggctggggtggcctgtgtg

SEQ ID NO: 5623228 - DNA, 22 bp, Homo sapiens
gctggctggtgcctgagcccct

SEQ ID NO: 5623229 - DNA, 13 bp, Homo sapiens
gctggctgtgcct

SEQ ID NO: 5623230 - DNA, 13 bp, Homo sapiens
gctggctgtgtcc

SEQ ID NO: 5623231 - DNA, 15 bp, Homo sapiens
gctggctgtgtcctc

SEQ ID NO: 5623232 - DNA, 22 bp, Homo sapiens
gctggctgttggcccctctgct

SEQ ID NO: 5623233 - DNA, 19 bp, Homo sapiens
gctggctgttggctggggg

SEQ ID NO: 5623234 - DNA, 12 bp, Homo sapiens
gctggcttcagg

SEQ ID NO: 5623235 - DNA, 20 bp, Homo sapiens
gctggcttccagcgggccct

SEQ ID NO: 5623236 - DNA, 23 bp, Homo sapiens
gctggcttccagcgggccctctg

SEQ ID NO: 5623237 - DNA, 18 bp, Homo sapiens
gctggcttccagcttcag

SEQ ID NO: 5623238 - DNA, 19 bp, Homo sapiens
gctggcttccagcttcagg

SEQ ID NO: 5623239 - DNA, 20 bp, Homo sapiens
gctggcttccagcttcaggc

SEQ ID NO: 5623240 - DNA, 22 bp, Homo sapiens
gctggcttccagcttcaggcac

SEQ ID NO: 5623241 - DNA, 16 bp, Homo sapiens
gctggcttccgctgtc

SEQ ID NO: 5623242 - DNA, 16 bp, Homo sapiens
gctggcttctccctgg

SEQ ID NO: 5623243 - DNA, 19 bp, Homo sapiens
gctggcttctccctggact

SEQ ID NO: 5623244 - DNA, 21 bp, Homo sapiens
gctggcttctccctggactct

SEQ ID NO: 5623245 - DNA, 12 bp, Homo sapiens
gctggcttgcac

SEQ ID NO: 5623246 - DNA, 18 bp, Homo sapiens
gctggcttgtttgatttc

SEQ ID NO: 5623247 - DNA, 19 bp, Homo sapiens
gctggcttgtttgatttca

SEQ ID NO: 5623248 - DNA, 14 bp, Homo sapiens
gctggctttctctc

SEQ ID NO: 5623249 - DNA, 18 bp, Homo sapiens
gctggctttctctctggc

SEQ ID NO: 5623250 - DNA, 20 bp, Homo sapiens
gctggctttgaaacctcagg

SEQ ID NO: 5623251 - DNA, 21 bp, Homo sapiens
gctggctttgaaacctcaggg

SEQ ID NO: 5623252 - DNA, 19 bp, Homo sapiens
gctggctttgggaaagccc

SEQ ID NO: 5623253 - DNA, 23 bp, Homo sapiens
gctggctttgggaaagcccagac

SEQ ID NO: 5623254 - DNA, 12 bp, Homo sapiens
gctggcttttca

SEQ ID NO: 5623255 - DNA, 17 bp, Homo sapiens
gctggcttttcacccca

SEQ ID NO: 5623256 - DNA, 18 bp, Homo sapiens
gctggcttttctgtttcc

SEQ ID NO: 5623257 - DNA, 21 bp, Homo sapiens
gctggcttttctgtttcctgt

SEQ ID NO: 5623258 - DNA, 22 bp, Homo sapiens
gctggctttttgtcaaataaaa

SEQ ID NO: 5623259 - DNA, 18 bp, Homo sapiens
gctgggaaacagggagcc

SEQ ID NO: 5623260 - DNA, 15 bp, Homo sapiens
gctgggaacacagcc

SEQ ID NO: 5623261 - DNA, 18 bp, Homo sapiens
gctgggaaccccgcagcc

SEQ ID NO: 5623262 - DNA, 19 bp, Homo sapiens
gctgggaaccccgcagccc

SEQ ID NO: 5623263 - DNA, 20 bp, Homo sapiens
gctgggaacgtgtgtccagg

SEQ ID NO: 5623264 - DNA, 23 bp, Homo sapiens
gctgggaactcacctggggctgc

SEQ ID NO: 5623265 - DNA, 15 bp, Homo sapiens
gctgggaactgcaga

SEQ ID NO: 5623266 - DNA, 13 bp, Homo sapiens
gctgggaccagag

SEQ ID NO: 5623267 - DNA, 14 bp, Homo sapiens
gctgggaccagagc

SEQ ID NO: 5623268 - DNA, 15 bp, Homo sapiens
gctgggacccacctc

SEQ ID NO: 5623269 - DNA, 12 bp, Homo sapiens
gctgggaccctc

SEQ ID NO: 5623270 - DNA, 17 bp, Homo sapiens
gctgggacgtggctcag

SEQ ID NO: 5623271 - DNA, 20 bp, Homo sapiens
gctgggacgtggctcagcca

SEQ ID NO: 5623272 - DNA, 21 bp, Homo sapiens
gctgggacgtggctcagccag

SEQ ID NO: 5623273 - DNA, 14 bp, Homo sapiens
gctgggactacagg

SEQ ID NO: 5623274 - DNA, 18 bp, Homo sapiens
gctgggactacaggcacc

SEQ ID NO: 5623275 - DNA, 12 bp, Homo sapiens
gctgggactcag

SEQ ID NO: 5623276 - DNA, 16 bp, Homo sapiens
gctgggactcagcctt

SEQ ID NO: 5623277 - DNA, 19 bp, Homo sapiens
gctgggactcagccttcag

SEQ ID NO: 5623278 - DNA, 13 bp, Homo sapiens
gctgggactcctg

SEQ ID NO: 5623279 - DNA, 15 bp, Homo sapiens
gctgggactgagcca

SEQ ID NO: 5623280 - DNA, 23 bp, Homo sapiens
gctgggacttgaacaaagacatt

SEQ ID NO: 5623281 - DNA, 17 bp, Homo sapiens
gctgggagaaaagccag

SEQ ID NO: 5623282 - DNA, 19 bp, Homo sapiens
gctgggagaaggtgcttgg

SEQ ID NO: 5623283 - DNA, 21 bp, Homo sapiens
gctgggagaaggtgcttgggc

SEQ ID NO: 5623284 - DNA, 18 bp, Homo sapiens
gctggtcatccttggtgc

SEQ ID NO: 5623285 - DNA, 20 bp, Homo sapiens
gctggtccagggcctgggaa

SEQ ID NO: 5623286 - DNA, 14 bp, Homo sapiens
gctggtcccactca

SEQ ID NO: 5623287 - DNA, 19 bp, Homo sapiens
gctggtcccactcagtcca

SEQ ID NO: 5623288 - DNA, 20 bp, Homo sapiens
gctggtcccctcctcagtga

SEQ ID NO: 5623289 - DNA, 19 bp, Homo sapiens
gctggtccctgccctcccc

SEQ ID NO: 5623290 - DNA, 20 bp, Homo sapiens
gctggtccctgccctcccct

SEQ ID NO: 5623291 - DNA, 16 bp, Homo sapiens
gctggtccgtgcggga

SEQ ID NO: 5623292 - DNA, 16 bp, Homo sapiens
gctggtcctgaccagg

SEQ ID NO: 5623293 - DNA, 15 bp, Homo sapiens
gctggtcctgcacat

SEQ ID NO: 5623294 - DNA, 13 bp, Homo sapiens
gctggtcctggga

SEQ ID NO: 5623295 - DNA, 14 bp, Homo sapiens
gctggtcctgggag

SEQ ID NO: 5623296 - DNA, 12 bp, Homo sapiens
gctggtccttat

SEQ ID NO: 5623297 - DNA, 18 bp, Homo sapiens
gctggtccttatttattt

SEQ ID NO: 5623298 - DNA, 21 bp, Homo sapiens
gctggtcgtgaactcctgagc

SEQ ID NO: 5623299 - DNA, 18 bp, Homo sapiens
gctggtctagtcacgcat

SEQ ID NO: 5623300 - DNA, 13 bp, Homo sapiens
gctggtctccctc

SEQ ID NO: 5623301 - DNA, 20 bp, Homo sapiens
gctggtctccctccagctgg

SEQ ID NO: 5623302 - DNA, 16 bp, Homo sapiens
gctggtctcgaactcc

SEQ ID NO: 5623303 - DNA, 19 bp, Homo sapiens
gctggtctcgaactcctga

SEQ ID NO: 5623304 - DNA, 23 bp, Homo sapiens
gctggtctcgaactcctgacctt

SEQ ID NO: 5623305 - DNA, 19 bp, Homo sapiens
gctggtctctaggcctgaa

SEQ ID NO: 5623306 - DNA, 12 bp, Homo sapiens
gctggtctggag

SEQ ID NO: 5623307 - DNA, 19 bp, Homo sapiens
gctggtgaaaacaattttt

SEQ ID NO: 5623308 - DNA, 21 bp, Homo sapiens
gctggtgaacactgtgaccag

SEQ ID NO: 5623309 - DNA, 24 bp, Homo sapiens
gctggtgaacactgtgaccaggct

SEQ ID NO: 5623310 - DNA, 18 bp, Homo sapiens
gctggtgactttggggac

SEQ ID NO: 5623311 - DNA, 15 bp, Homo sapiens
gctggtgagaccccg

SEQ ID NO: 5623312 - DNA, 19 bp, Homo sapiens
gctggtgaggccggccctg

SEQ ID NO: 5623313 - DNA, 20 bp, Homo sapiens
gctggtgaggccggccctgc

SEQ ID NO: 5623314 - DNA, 21 bp, Homo sapiens
gctggtgaggccggccctgcc

SEQ ID NO: 5623315 - DNA, 18 bp, Homo sapiens
gctggtgagtgatgcggc

SEQ ID NO: 5623316 - DNA, 20 bp, Homo sapiens
gctggtgagtgatgcggcag

SEQ ID NO: 5623317 - DNA, 12 bp, Homo sapiens
gctggtgcacag

SEQ ID NO: 5623318 - DNA, 20 bp, Homo sapiens
gctggtgcacagccactccc

SEQ ID NO: 5623319 - DNA, 15 bp, Homo sapiens
gctggtgcagggcct

SEQ ID NO: 5623320 - DNA, 13 bp, Homo sapiens
gctggtgcattac

SEQ ID NO: 5623321 - DNA, 18 bp, Homo sapiens
gctggtgcattacagaga

SEQ ID NO: 5623322 - DNA, 22 bp, Homo sapiens
gctggtgcattacagagaggag

SEQ ID NO: 5623323 - DNA, 19 bp, Homo sapiens
gctggtgccaaatagcccc

SEQ ID NO: 5623324 - DNA, 13 bp, Homo sapiens
gctggtgccagcc

SEQ ID NO: 5623325 - DNA, 14 bp, Homo sapiens
gctggtgccagcct

SEQ ID NO: 5623326 - DNA, 23 bp, Homo sapiens
gctggtgccagccttcctctgca

SEQ ID NO: 5623327 - DNA, 15 bp, Homo sapiens
gctggtgccaggcgc

SEQ ID NO: 5623328 - DNA, 13 bp, Homo sapiens
gctggtgccaggg

SEQ ID NO: 5623329 - DNA, 14 bp, Homo sapiens
gctggtgcccatga

SEQ ID NO: 5623330 - DNA, 18 bp, Homo sapiens
gctggtgccccacagcta

SEQ ID NO: 5623331 - DNA, 21 bp, Homo sapiens
gctggtgccccacctgcctgg

SEQ ID NO: 5623332 - DNA, 13 bp, Homo sapiens
gctggtgcccgga

SEQ ID NO: 5623333 - DNA, 22 bp, Homo sapiens
gctggtgccctgctttcagata

SEQ ID NO: 5623334 - DNA, 18 bp, Homo sapiens
gctggtgcctgaagaccc

SEQ ID NO: 5623335 - DNA, 13 bp, Homo sapiens
gctggtgcctgag

SEQ ID NO: 5623336 - DNA, 18 bp, Homo sapiens
gctggtgcggctggccat

SEQ ID NO: 5623337 - DNA, 20 bp, Homo sapiens
gctggtgcggctggccatgg

SEQ ID NO: 5623338 - DNA, 15 bp, Homo sapiens
gctggtgctgcaagg

SEQ ID NO: 5623339 - DNA, 15 bp, Homo sapiens
gctggtgctgtggcc

SEQ ID NO: 5623340 - DNA, 19 bp, Homo sapiens
gctggtgctgtggccaggg

SEQ ID NO: 5623341 - DNA, 20 bp, Homo sapiens
gctggtggaaagcgattcac

SEQ ID NO: 5623342 - DNA, 21 bp, Homo sapiens
gctggtggacagacccagggt

SEQ ID NO: 5623343 - DNA, 19 bp, Homo sapiens
gctggtggaccacaggcat

SEQ ID NO: 5623344 - DNA, 21 bp, Homo sapiens
gctggtggagaactctggctt

SEQ ID NO: 5623345 - DNA, 19 bp, Homo sapiens
gctggtggagatgtaggaa

SEQ ID NO: 5623346 - DNA, 18 bp, Homo sapiens
gctggtggaggaagggct

SEQ ID NO: 5623347 - DNA, 20 bp, Homo sapiens
gctggtggaggaagggctgg

SEQ ID NO: 5623348 - DNA, 18 bp, Homo sapiens
gctggtggatggtgactt

SEQ ID NO: 5623349 - DNA, 18 bp, Homo sapiens
gctggtggattgggcaga

SEQ ID NO: 5623350 - DNA, 12 bp, Homo sapiens
gctggtggccac

SEQ ID NO: 5623351 - DNA, 20 bp, Homo sapiens
gctggtggccctgtgcctgg

SEQ ID NO: 5623352 - DNA, 13 bp, Homo sapiens
gctggtggccttg

SEQ ID NO: 5623353 - DNA, 14 bp, Homo sapiens
gctggtggccttgg

SEQ ID NO: 5623354 - DNA, 16 bp, Homo sapiens
gctggtggccttgggc

SEQ ID NO: 5623355 - DNA, 17 bp, Homo sapiens
gctggtggctaatggtg

SEQ ID NO: 5623356 - DNA, 21 bp, Homo sapiens
gctggtgggaagcgtctgtcc

SEQ ID NO: 5623357 - DNA, 13 bp, Homo sapiens
gctggtgggaagg

SEQ ID NO: 5623358 - DNA, 13 bp, Homo sapiens
gctggtgggaggg

SEQ ID NO: 5623359 - DNA, 14 bp, Homo sapiens
gctggtgggagggg

SEQ ID NO: 5623360 - DNA, 18 bp, Homo sapiens
gctggtgggataggaggg

SEQ ID NO: 5623361 - DNA, 15 bp, Homo sapiens
gctggtgggcaccaa

SEQ ID NO: 5623362 - DNA, 19 bp, Homo sapiens
gctggtgggcaccaagagc

SEQ ID NO: 5623363 - DNA, 23 bp, Homo sapiens
gctggtgggggcatccttgagga

SEQ ID NO: 5623364 - DNA, 20 bp, Homo sapiens
gctggtgggtctgagctgga

SEQ ID NO: 5623365 - DNA, 14 bp, Homo sapiens
gctggtggttgtgc

SEQ ID NO: 5623366 - DNA, 18 bp, Homo sapiens
gctggtggttgtgccttt

SEQ ID NO: 5623367 - DNA, 23 bp, Homo sapiens
gctggtggtttgatcatttctgc

SEQ ID NO: 5623368 - DNA, 20 bp, Homo sapiens
gctggtggttttcagagcag

SEQ ID NO: 5623369 - DNA, 17 bp, Homo sapiens
gctggtgtagtcttttt

SEQ ID NO: 5623370 - DNA, 16 bp, Homo sapiens
gctggtgtcacctgaa

SEQ ID NO: 5623371 - DNA, 19 bp, Homo sapiens
gctggtgtcactctgcctc

SEQ ID NO: 5623372 - DNA, 16 bp, Homo sapiens
gctggtgtccccttcc

SEQ ID NO: 5623373 - DNA, 15 bp, Homo sapiens
gctggtgtcctgacc

SEQ ID NO: 5623374 - DNA, 17 bp, Homo sapiens
gctggtgtcctgaccac

SEQ ID NO: 5623375 - DNA, 18 bp, Homo sapiens
gctggtgtggtacagaga

SEQ ID NO: 5623376 - DNA, 12 bp, Homo sapiens
gctggtgtgtca

SEQ ID NO: 5623377 - DNA, 18 bp, Homo sapiens
gctggtgttaacagaagg

SEQ ID NO: 5623378 - DNA, 17 bp, Homo sapiens
gctggtgtttatgtgaa

SEQ ID NO: 5623379 - DNA, 23 bp, Homo sapiens
gctggtgtttatgtgaacattcc

SEQ ID NO: 5623380 - DNA, 14 bp, Homo sapiens
gctggttaatgtag

SEQ ID NO: 5623381 - DNA, 14 bp, Homo sapiens
gctggttactcagg

SEQ ID NO: 5623382 - DNA, 23 bp, Homo sapiens
gctggttactcagggttcatctg

SEQ ID NO: 5623383 - DNA, 21 bp, Homo sapiens
gctggttagaggttccctttg

SEQ ID NO: 5623384 - DNA, 22 bp, Homo sapiens
gctggttcagggttggcccctg

SEQ ID NO: 5623385 - DNA, 18 bp, Homo sapiens
gctggttcctgactggca

SEQ ID NO: 5623386 - DNA, 16 bp, Homo sapiens
gctggttcctgctaga

SEQ ID NO: 5623387 - DNA, 18 bp, Homo sapiens
gctggttctccaacagag

SEQ ID NO: 5623388 - DNA, 21 bp, Homo sapiens
gctggttgctgtagaaacaca

SEQ ID NO: 5623389 - DNA, 16 bp, Homo sapiens
gctggttgctgtgtgg

SEQ ID NO: 5623390 - DNA, 20 bp, Homo sapiens
gctggttgtaccctctccag

SEQ ID NO: 5623391 - DNA, 22 bp, Homo sapiens
gctggttgtaccctctccaggc

SEQ ID NO: 5623392 - DNA, 21 bp, Homo sapiens
gctggttgttgccaggttgca

SEQ ID NO: 5623393 - DNA, 17 bp, Homo sapiens
gctggtttcctgcccag

SEQ ID NO: 5623394 - DNA, 22 bp, Homo sapiens
gctggtttgcccagagccaagc

SEQ ID NO: 5623395 - DNA, 19 bp, Homo sapiens
gctggtttggtggccaggc

SEQ ID NO: 5623396 - DNA, 22 bp, Homo sapiens
gctggtttggtggccaggctgg

SEQ ID NO: 5623397 - DNA, 19 bp, Homo sapiens
gctggttttgatggctggg

SEQ ID NO: 5623398 - DNA, 13 bp, Homo sapiens
gctggttttgctt

SEQ ID NO: 5623399 - DNA, 22 bp, Homo sapiens
gctggttttgcttccccgtgca

SEQ ID NO: 5623400 - DNA, 17 bp, Homo sapiens
gctggttttggcatctc

SEQ ID NO: 5623401 - DNA, 21 bp, Homo sapiens
gctggttttggcatctctgtc

SEQ ID NO: 5623402 - DNA, 21 bp, Homo sapiens
gctggttttgtaagatgctgg

SEQ ID NO: 5623403 - DNA, 22 bp, Homo sapiens
gctggttttgtaagatgctggg

SEQ ID NO: 5623404 - DNA, 12 bp, Homo sapiens
gctgtaaaaaca

SEQ ID NO: 5623405 - DNA, 15 bp, Homo sapiens
gctgtaaaacgctgt

SEQ ID NO: 5623406 - DNA, 12 bp, Homo sapiens
gctgtaaaagca

SEQ ID NO: 5623407 - DNA, 20 bp, Homo sapiens
gctgtaaaagcaagtcctgc

SEQ ID NO: 5623408 - DNA, 16 bp, Homo sapiens
gctgtaaaatgcatga

SEQ ID NO: 5623409 - DNA, 20 bp, Homo sapiens
gctgtaaaatgcatgatttt

SEQ ID NO: 5623410 - DNA, 14 bp, Homo sapiens
gctgtaaaatttgt

SEQ ID NO: 5623411 - DNA, 15 bp, Homo sapiens
gctgtaaataaatgc

SEQ ID NO: 5623412 - DNA, 16 bp, Homo sapiens
gctgtaaataggttca

SEQ ID NO: 5623413 - DNA, 22 bp, Homo sapiens
gctgtaaatcctagacttgaaa

SEQ ID NO: 5623414 - DNA, 21 bp, Homo sapiens
gctgtaactactttataacta

SEQ ID NO: 5623415 - DNA, 23 bp, Homo sapiens
gctgtaactcagacattccaagg

SEQ ID NO: 5623416 - DNA, 16 bp, Homo sapiens
gctgtaactgctgagc

SEQ ID NO: 5623417 - DNA, 17 bp, Homo sapiens
gctgtaactgctgagcc

SEQ ID NO: 5623418 - DNA, 19 bp, Homo sapiens
gctgtaagacggccttgga

SEQ ID NO: 5623419 - DNA, 16 bp, Homo sapiens
gctgtaagatgtctgt

SEQ ID NO: 5623420 - DNA, 19 bp, Homo sapiens
gctgtaagcattctgagct

SEQ ID NO: 5623421 - DNA, 14 bp, Homo sapiens
gctgtaagctcctt

SEQ ID NO: 5623422 - DNA, 17 bp, Homo sapiens
gctgtaaggctctagat

SEQ ID NO: 5623423 - DNA, 12 bp, Homo sapiens
gctgtaagggca

SEQ ID NO: 5623424 - DNA, 18 bp, Homo sapiens
gctgtaagggcagtgccc

SEQ ID NO: 5623425 - DNA, 13 bp, Homo sapiens
gctgtaatcaaga

SEQ ID NO: 5623426 - DNA, 15 bp, Homo sapiens
gctgtaatcatttgt

SEQ ID NO: 5623427 - DNA, 14 bp, Homo sapiens
gctgtaatgtaaca

SEQ ID NO: 5623428 - DNA, 19 bp, Homo sapiens
gctgtaatgttaatattga

SEQ ID NO: 5623429 - DNA, 22 bp, Homo sapiens
gctgtaatttcgccttaaactc

SEQ ID NO: 5623430 - DNA, 20 bp, Homo sapiens
gctgtacaaagggaagcaga

SEQ ID NO: 5623431 - DNA, 19 bp, Homo sapiens
gctgtacacaccctccagc

SEQ ID NO: 5623432 - DNA, 12 bp, Homo sapiens
gctgtacactgc

SEQ ID NO: 5623433 - DNA, 16 bp, Homo sapiens
gctgtacactgcacga

SEQ ID NO: 5623434 - DNA, 22 bp, Homo sapiens
gctgtacaggtacaggctggag

SEQ ID NO: 5623435 - DNA, 22 bp, Homo sapiens
gctgtacatactttttgggttt

SEQ ID NO: 5623436 - DNA, 13 bp, Homo sapiens
gctgtacatcaga

SEQ ID NO: 5623437 - DNA, 16 bp, Homo sapiens
gctgtacatctatttt

SEQ ID NO: 5623438 - DNA, 19 bp, Homo sapiens
gctgtacattactgtatgt

SEQ ID NO: 5623439 - DNA, 21 bp, Homo sapiens
gctgtaccacatctgctctag

SEQ ID NO: 5623440 - DNA, 15 bp, Homo sapiens
gctgtacccagatgc

SEQ ID NO: 5623441 - DNA, 16 bp, Homo sapiens
gctgtacccagatgcc

SEQ ID NO: 5623442 - DNA, 20 bp, Homo sapiens
gctgtacccagatgcctaca

SEQ ID NO: 5623443 - DNA, 18 bp, Homo sapiens
gctgtaccggccactgca

SEQ ID NO: 5623444 - DNA, 22 bp, Homo sapiens
gctgtacgcgtttgtctcgtgg

SEQ ID NO: 5623445 - DNA, 16 bp, Homo sapiens
gctgtacgtctggtgt

SEQ ID NO: 5623446 - DNA, 18 bp, Homo sapiens
gctgtactaacccagtct

SEQ ID NO: 5623447 - DNA, 13 bp, Homo sapiens
gctgtactataag

SEQ ID NO: 5623448 - DNA, 19 bp, Homo sapiens
gctgtactcagagcagagc

SEQ ID NO: 5623449 - DNA, 17 bp, Homo sapiens
gctgtactcttgctgat

SEQ ID NO: 5623450 - DNA, 22 bp, Homo sapiens
gctgtactcttgctgatggctg

SEQ ID NO: 5623451 - DNA, 19 bp, Homo sapiens
gctgtactgaagtaaaaca

SEQ ID NO: 5623452 - DNA, 17 bp, Homo sapiens
gctgtactgagcactga

SEQ ID NO: 5623453 - DNA, 20 bp, Homo sapiens
gctgtactgagttctcatcc

SEQ ID NO: 5623454 - DNA, 17 bp, Homo sapiens
gctgtactgccaaggta

SEQ ID NO: 5623455 - DNA, 23 bp, Homo sapiens
gctgtactgctcaggctgcagct

SEQ ID NO: 5623456 - DNA, 18 bp, Homo sapiens
gctgtacttcttgaatat

SEQ ID NO: 5623457 - DNA, 20 bp, Homo sapiens
gctgtacttcttgaatataa

SEQ ID NO: 5623458 - DNA, 13 bp, Homo sapiens
gctgtagaaaaaa

SEQ ID NO: 5623459 - DNA, 17 bp, Homo sapiens
gctgtagataacagcaa

SEQ ID NO: 5623460 - DNA, 16 bp, Homo sapiens
gctgtagatcaggttt

SEQ ID NO: 5623461 - DNA, 15 bp, Homo sapiens
gctgtggctggtgag

SEQ ID NO: 5623462 - DNA, 14 bp, Homo sapiens
gctgtgggaacgag

SEQ ID NO: 5623463 - DNA, 18 bp, Homo sapiens
gctgtgggaccaggtctg

SEQ ID NO: 5623464 - DNA, 18 bp, Homo sapiens
gctgtgggagtgattttg

SEQ ID NO: 5623465 - DNA, 17 bp, Homo sapiens
gctgtgggcaattgtta

SEQ ID NO: 5623466 - DNA, 13 bp, Homo sapiens
gctgtgggcagca

SEQ ID NO: 5623467 - DNA, 16 bp, Homo sapiens
gctgtgggcagcaccc

SEQ ID NO: 5623468 - DNA, 22 bp, Homo sapiens
gctgtgggcaggcaagcccttc

SEQ ID NO: 5623469 - DNA, 13 bp, Homo sapiens
gctgtgggcaggt

SEQ ID NO: 5623470 - DNA, 14 bp, Homo sapiens
gctgtgggcaggtg

SEQ ID NO: 5623471 - DNA, 17 bp, Homo sapiens
gctgtgggcaggtggga

SEQ ID NO: 5623472 - DNA, 23 bp, Homo sapiens
gctgtgggcaggtgggagcttga

SEQ ID NO: 5623473 - DNA, 17 bp, Homo sapiens
gctgtgggcggctcctg

SEQ ID NO: 5623474 - DNA, 12 bp, Homo sapiens
gctgtgggctcc

SEQ ID NO: 5623475 - DNA, 15 bp, Homo sapiens
gctgtgggctccctt

SEQ ID NO: 5623476 - DNA, 15 bp, Homo sapiens
gctgtggggagctgg

SEQ ID NO: 5623477 - DNA, 16 bp, Homo sapiens
gctgtggggagctggt

SEQ ID NO: 5623478 - DNA, 19 bp, Homo sapiens
gctgtggggcagctgagca

SEQ ID NO: 5623479 - DNA, 16 bp, Homo sapiens
gctgtggggctggtag

SEQ ID NO: 5623480 - DNA, 21 bp, Homo sapiens
gctgtggggctggtagctcag

SEQ ID NO: 5623481 - DNA, 22 bp, Homo sapiens
gctgtggggctggtagctcagg

SEQ ID NO: 5623482 - DNA, 18 bp, Homo sapiens
gctgtgggggaggtccct

SEQ ID NO: 5623483 - DNA, 17 bp, Homo sapiens
gctgtggggtcgggctc

SEQ ID NO: 5623484 - DNA, 14 bp, Homo sapiens
gctgtggggtctgg

SEQ ID NO: 5623485 - DNA, 16 bp, Homo sapiens
gctgtggggtctggct

SEQ ID NO: 5623486 - DNA, 17 bp, Homo sapiens
gctgtggggtctggctg

SEQ ID NO: 5623487 - DNA, 18 bp, Homo sapiens
gctgtggggtgggctgga

SEQ ID NO: 5623488 - DNA, 19 bp, Homo sapiens
gctgtggggtgggctggag

SEQ ID NO: 5623489 - DNA, 15 bp, Homo sapiens
gctgtgggtcagtgt

SEQ ID NO: 5623490 - DNA, 23 bp, Homo sapiens
gctgtgggtcagtgtgccaccct

SEQ ID NO: 5623491 - DNA, 16 bp, Homo sapiens
gctgtgggtgcagctg

SEQ ID NO: 5623492 - DNA, 22 bp, Homo sapiens
gctgtggtacaaatgtgataat

SEQ ID NO: 5623493 - DNA, 23 bp, Homo sapiens
gctgtggtagggggtgtctcagg

SEQ ID NO: 5623494 - DNA, 21 bp, Homo sapiens
gctgtggtctataaaataaac

SEQ ID NO: 5623495 - DNA, 16 bp, Homo sapiens
gctgtggtctgaagtg

SEQ ID NO: 5623496 - DNA, 17 bp, Homo sapiens
gctgtggtggctgtctc

SEQ ID NO: 5623497 - DNA, 19 bp, Homo sapiens
gctgtggtggctgtctctg

SEQ ID NO: 5623498 - DNA, 20 bp, Homo sapiens
gctgtggtggggagaggcat

SEQ ID NO: 5623499 - DNA, 23 bp, Homo sapiens
gctgtggtgtgtccccctctgtc

SEQ ID NO: 5623500 - DNA, 16 bp, Homo sapiens
gctgtggttcactgca

SEQ ID NO: 5623501 - DNA, 23 bp, Homo sapiens
gctgtggttttcttttgccatga

SEQ ID NO: 5623502 - DNA, 18 bp, Homo sapiens
gctgtgtaagatttgttt

SEQ ID NO: 5623503 - DNA, 23 bp, Homo sapiens
gctgtgtaagatttgtttttaaa

SEQ ID NO: 5623504 - DNA, 20 bp, Homo sapiens
gctgtgtaagctcacatcca

SEQ ID NO: 5623505 - DNA, 20 bp, Homo sapiens
gctgtgtacaacaatgcttt

SEQ ID NO: 5623506 - DNA, 17 bp, Homo sapiens
gctgtgtacaatgtgag

SEQ ID NO: 5623507 - DNA, 22 bp, Homo sapiens
gctgtgtacactgacacctttg

SEQ ID NO: 5623508 - DNA, 17 bp, Homo sapiens
gctgtgtagctctgtcc

SEQ ID NO: 5623509 - DNA, 21 bp, Homo sapiens
gctgtgtagttccctctgcct

SEQ ID NO: 5623510 - DNA, 22 bp, Homo sapiens
gctgtgtagttccctctgcctg

SEQ ID NO: 5623511 - DNA, 13 bp, Homo sapiens
gctgtgtatctgt

SEQ ID NO: 5623512 - DNA, 21 bp, Homo sapiens
gctgtgtatctgtttttccat

SEQ ID NO: 5623513 - DNA, 24 bp, Homo sapiens
gctgtgtcacactctgtgttttgt

SEQ ID NO: 5623514 - DNA, 17 bp, Homo sapiens
gctgtgtccaactccag

SEQ ID NO: 5623515 - DNA, 19 bp, Homo sapiens
gctgtgtccaactccagta

SEQ ID NO: 5623516 - DNA, 14 bp, Homo sapiens
gctgtgtcccagat

SEQ ID NO: 5623517 - DNA, 18 bp, Homo sapiens
gctgtgtcctccctccct

SEQ ID NO: 5623518 - DNA, 15 bp, Homo sapiens
gctgtgtccttcctc

SEQ ID NO: 5623519 - DNA, 14 bp, Homo sapiens
gctgtgtccttgca

SEQ ID NO: 5623520 - DNA, 20 bp, Homo sapiens
gctgtgtccttgcacctgca

SEQ ID NO: 5623521 - DNA, 21 bp, Homo sapiens
gctgtgtccttgcacctgcat

SEQ ID NO: 5623522 - DNA, 15 bp, Homo sapiens
gctgtgtctaaactg

SEQ ID NO: 5623523 - DNA, 11 bp, Homo sapiens
gctgtgtctct

SEQ ID NO: 5623524 - DNA, 15 bp, Homo sapiens
gctgtgtctctgcca

SEQ ID NO: 5623525 - DNA, 17 bp, Homo sapiens
gctgtgtctgagcccaa

SEQ ID NO: 5623526 - DNA, 19 bp, Homo sapiens
gctgtgtctgagcccaacc

SEQ ID NO: 5623527 - DNA, 20 bp, Homo sapiens
gctgtgtctgccaaacacat

SEQ ID NO: 5623528 - DNA, 9 bp, Homo sapiens
gctgtgtga

SEQ ID NO: 5623529 - DNA, 15 bp, Homo sapiens
gctgtgtgaaatctt

SEQ ID NO: 5623530 - DNA, 20 bp, Homo sapiens
gctgtgtgaaatctttcaag

SEQ ID NO: 5623531 - DNA, 20 bp, Homo sapiens
gctgtgtgaatacctgctca

SEQ ID NO: 5623532 - DNA, 23 bp, Homo sapiens
gctgtgtgaatccaggaggcagt

SEQ ID NO: 5623533 - DNA, 15 bp, Homo sapiens
gctgtgtgagaccag

SEQ ID NO: 5623534 - DNA, 12 bp, Homo sapiens
gctgtgtgccca

SEQ ID NO: 5623535 - DNA, 20 bp, Homo sapiens
gctgtgtgcccaagtgggca

SEQ ID NO: 5623536 - DNA, 22 bp, Homo sapiens
gctgtgtgccccactccagcct

SEQ ID NO: 5623537 - DNA, 20 bp, Homo sapiens
gctgtgtgtcccaggcaggg

SEQ ID NO: 5623538 - DNA, 16 bp, Homo sapiens
gctgtgtgtctgcttg

SEQ ID NO: 5623539 - DNA, 13 bp, Homo sapiens
gctgtgtgtctgt

SEQ ID NO: 5623540 - DNA, 12 bp, Homo sapiens
gctgtgtgtgag

SEQ ID NO: 5623541 - DNA, 14 bp, Homo sapiens
gctgtgtgtgcccg

SEQ ID NO: 5623542 - DNA, 19 bp, Homo sapiens
gctgtgttgaaacagaaaa

SEQ ID NO: 5623543 - DNA, 16 bp, Homo sapiens
gctgtgttgactgctg

SEQ ID NO: 5623544 - DNA, 19 bp, Homo sapiens
gctgtgttggtgtggccca

SEQ ID NO: 5623545 - DNA, 22 bp, Homo sapiens
gctgtgttgttgcttcttgtga

SEQ ID NO: 5623546 - DNA, 14 bp, Homo sapiens
gctgtgtttgctcc

SEQ ID NO: 5623547 - DNA, 17 bp, Homo sapiens
gctgtgtttgctcccct

SEQ ID NO: 5623548 - DNA, 23 bp, Homo sapiens
gctgtgtttggctttcagggagg

SEQ ID NO: 5623549 - DNA, 12 bp, Homo sapiens
gctgttaaactg

SEQ ID NO: 5623550 - DNA, 13 bp, Homo sapiens
gctgttaaactgt

SEQ ID NO: 5623551 - DNA, 22 bp, Homo sapiens
gctgttaaactgttagcactgt

SEQ ID NO: 5623552 - DNA, 21 bp, Homo sapiens
gctgttaaagatatttttatt

SEQ ID NO: 5623553 - DNA, 18 bp, Homo sapiens
gctgttaatctgatgtat

SEQ ID NO: 5623554 - DNA, 18 bp, Homo sapiens
gctgttaccattcacaat

SEQ ID NO: 5623555 - DNA, 20 bp, Homo sapiens
gctgttacttgctttgagtt

SEQ ID NO: 5623556 - DNA, 15 bp, Homo sapiens
gctgttagaatatgt

SEQ ID NO: 5623557 - DNA, 14 bp, Homo sapiens
gctgttaggacagc

SEQ ID NO: 5623558 - DNA, 15 bp, Homo sapiens
gctgttatgctgttt

SEQ ID NO: 5623559 - DNA, 16 bp, Homo sapiens
gctgttatgctgtttc

SEQ ID NO: 5623560 - DNA, 20 bp, Homo sapiens
gctgttatgtctgtttaaga

SEQ ID NO: 5623561 - DNA, 21 bp, Homo sapiens
gctgttattatatttgacatg

SEQ ID NO: 5623562 - DNA, 14 bp, Homo sapiens
gctgttattatgaa

SEQ ID NO: 5623563 - DNA, 15 bp, Homo sapiens
gctgttattatgaag

SEQ ID NO: 5623564 - DNA, 23 bp, Homo sapiens
gctgttatttaggtatttttctt

SEQ ID NO: 5623565 - DNA, 23 bp, Homo sapiens
gctgttcacagccagactggcac

SEQ ID NO: 5623566 - DNA, 13 bp, Homo sapiens
gctgttcagggca

SEQ ID NO: 5623567 - DNA, 13 bp, Homo sapiens
gctgttcatcttg

SEQ ID NO: 5623568 - DNA, 13 bp, Homo sapiens
gctgttcatgctc

SEQ ID NO: 5623569 - DNA, 14 bp, Homo sapiens
gctgttccccaccg

SEQ ID NO: 5623570 - DNA, 12 bp, Homo sapiens
gctgttcccttt

SEQ ID NO: 5623571 - DNA, 23 bp, Homo sapiens
gctgttcctgatttttcatatgt

SEQ ID NO: 5623572 - DNA, 20 bp, Homo sapiens
gctgttcctgtgttcttcgt

SEQ ID NO: 5623573 - DNA, 15 bp, Homo sapiens
gctgttctacttttt

SEQ ID NO: 5623574 - DNA, 15 bp, Homo sapiens
gctgttctcaatcat

SEQ ID NO: 5623575 - DNA, 16 bp, Homo sapiens
gctgttctcaggacag

SEQ ID NO: 5623576 - DNA, 23 bp, Homo sapiens
gctgttctcaggacagcatccct

SEQ ID NO: 5623577 - DNA, 19 bp, Homo sapiens
gctgttctcattcctgttc

SEQ ID NO: 5623578 - DNA, 20 bp, Homo sapiens
gctgttctccaggcttcaca

SEQ ID NO: 5623579 - DNA, 15 bp, Homo sapiens
gctgttctctttgct

SEQ ID NO: 5623580 - DNA, 16 bp, Homo sapiens
gctgttctgcactgaa

SEQ ID NO: 5623581 - DNA, 17 bp, Homo sapiens
gctgttctgcactgaaa

SEQ ID NO: 5623582 - DNA, 15 bp, Homo sapiens
gctgttcttcagtcc

SEQ ID NO: 5623583 - DNA, 18 bp, Homo sapiens
gctgttcttcagtccttt

SEQ ID NO: 5623584 - DNA, 13 bp, Homo sapiens
gctgttcttcctg

SEQ ID NO: 5623585 - DNA, 16 bp, Homo sapiens
gctgttcttgaagctg

SEQ ID NO: 5623586 - DNA, 21 bp, Homo sapiens
gctgttctttaaatgcgttcc

SEQ ID NO: 5623587 - DNA, 13 bp, Homo sapiens
gctgttgaaagca

SEQ ID NO: 5623588 - DNA, 16 bp, Homo sapiens
gctgttgaacttttta

SEQ ID NO: 5623589 - DNA, 16 bp, Homo sapiens
gctgttgaagtctcag

SEQ ID NO: 5623590 - DNA, 17 bp, Homo sapiens
gctgttgacatatttaa

SEQ ID NO: 5623591 - DNA, 13 bp, Homo sapiens
gctgttgaccagg

SEQ ID NO: 5623592 - DNA, 15 bp, Homo sapiens
gctgttgaccaggca

SEQ ID NO: 5623593 - DNA, 22 bp, Homo sapiens
gctgttgactctagtactgtga

SEQ ID NO: 5623594 - DNA, 12 bp, Homo sapiens
gctgttgagaaa

SEQ ID NO: 5623595 - DNA, 20 bp, Homo sapiens
gctgttgagatggtaacaga

SEQ ID NO: 5623596 - DNA, 19 bp, Homo sapiens
gctgttgagatgtgctttg

SEQ ID NO: 5623597 - DNA, 20 bp, Homo sapiens
gctgttgaggggtcccctct

SEQ ID NO: 5623598 - DNA, 16 bp, Homo sapiens
gctgttgattgctaaa

SEQ ID NO: 5623599 - DNA, 19 bp, Homo sapiens
gctgttgattgctaaatgt

SEQ ID NO: 5623600 - DNA, 15 bp, Homo sapiens
gctgttgcaggcagt

SEQ ID NO: 5623601 - DNA, 16 bp, Homo sapiens
gctgttgcaggcagtg

SEQ ID NO: 5623602 - DNA, 14 bp, Homo sapiens
gctgttgccatagc

SEQ ID NO: 5623603 - DNA, 22 bp, Homo sapiens
gctgttgccctgtttcctgctg

SEQ ID NO: 5623604 - DNA, 23 bp, Homo sapiens
gctgttgcgtaactggctgtgtt

SEQ ID NO: 5623605 - DNA, 18 bp, Homo sapiens
gctgttgctagggagagg

SEQ ID NO: 5623606 - DNA, 15 bp, Homo sapiens
gctgttgctgttgct

SEQ ID NO: 5623607 - DNA, 18 bp, Homo sapiens
gctgttgctgttgctgtt

SEQ ID NO: 5623608 - DNA, 21 bp, Homo sapiens
gctgttggcatcttgctgcta

SEQ ID NO: 5623609 - DNA, 14 bp, Homo sapiens
gctgttggcctcgc

SEQ ID NO: 5623610 - DNA, 18 bp, Homo sapiens
gctgttggcctcgcctgg

SEQ ID NO: 5623611 - DNA, 23 bp, Homo sapiens
gctgttggcctctgcaaaggaaa

SEQ ID NO: 5623612 - DNA, 14 bp, Homo sapiens
gctgttggcctggg

SEQ ID NO: 5623613 - DNA, 13 bp, Homo sapiens
gctgttggctggg

SEQ ID NO: 5623614 - DNA, 18 bp, Homo sapiens
gctgttgggtttttgctg

SEQ ID NO: 5623615 - DNA, 12 bp, Homo sapiens
gctgttggtcat

SEQ ID NO: 5623616 - DNA, 16 bp, Homo sapiens
gctgttggtcctctct

SEQ ID NO: 5623617 - DNA, 19 bp, Homo sapiens
gctgttggtcctctctctg

SEQ ID NO: 5623618 - DNA, 22 bp, Homo sapiens
gctgttggtcctctctctgtgg

SEQ ID NO: 5623619 - DNA, 12 bp, Homo sapiens
gctgttgtacat

SEQ ID NO: 5623620 - DNA, 16 bp, Homo sapiens
gctgttgtacatttat

SEQ ID NO: 5623621 - DNA, 21 bp, Homo sapiens
gctgttgtcacatctcaggga

SEQ ID NO: 5623622 - DNA, 17 bp, Homo sapiens
gctgttgtccctctgct

SEQ ID NO: 5623623 - DNA, 15 bp, Homo sapiens
gctgttgtctcttct

SEQ ID NO: 5623624 - DNA, 16 bp, Homo sapiens
gctgttgtctcttctc

SEQ ID NO: 5623625 - DNA, 17 bp, Homo sapiens
gctgttgtctcttctcc

SEQ ID NO: 5623626 - DNA, 21 bp, Homo sapiens
gctgttgtgaagctaatgtca

SEQ ID NO: 5623627 - DNA, 15 bp, Homo sapiens
gctgttgtgagcttt

SEQ ID NO: 5623628 - DNA, 14 bp, Homo sapiens
gctgttgttatgat

SEQ ID NO: 5623629 - DNA, 20 bp, Homo sapiens
gctgttgtttctataaatga

SEQ ID NO: 5623630 - DNA, 22 bp, Homo sapiens
gctgttgtttctataaatgact

SEQ ID NO: 5623631 - DNA, 17 bp, Homo sapiens
gctgtttaaagtcacat

SEQ ID NO: 5623632 - DNA, 15 bp, Homo sapiens
gctgtttactgacat

SEQ ID NO: 5623633 - DNA, 22 bp, Homo sapiens
gctgtttagagtaaataaactg

SEQ ID NO: 5623634 - DNA, 18 bp, Homo sapiens
gctgtttagatttattag

SEQ ID NO: 5623635 - DNA, 22 bp, Homo sapiens
gctgtttagcttcctccagagg

SEQ ID NO: 5623636 - DNA, 19 bp, Homo sapiens
gctgtttatgacacaatga

SEQ ID NO: 5623637 - DNA, 14 bp, Homo sapiens
gctgtttatggcct

SEQ ID NO: 5623638 - DNA, 15 bp, Homo sapiens
gctgtttatggcctc

SEQ ID NO: 5623639 - DNA, 14 bp, Homo sapiens
gcttcctcctccct

SEQ ID NO: 5623640 - DNA, 16 bp, Homo sapiens
gcttcctcctggaaat

SEQ ID NO: 5623641 - DNA, 17 bp, Homo sapiens
gcttcctctgagccgca

SEQ ID NO: 5623642 - DNA, 17 bp, Homo sapiens
gcttcctctgctgcatc

SEQ ID NO: 5623643 - DNA, 21 bp, Homo sapiens
gcttcctctgctgcatcccct

SEQ ID NO: 5623644 - DNA, 14 bp, Homo sapiens
gcttcctcttcttg

SEQ ID NO: 5623645 - DNA, 15 bp, Homo sapiens
gcttcctgaaagctg

SEQ ID NO: 5623646 - DNA, 18 bp, Homo sapiens
gcttcctgaaagctgttg

SEQ ID NO: 5623647 - DNA, 18 bp, Homo sapiens
gcttcctgaaataaacac

SEQ ID NO: 5623648 - DNA, 22 bp, Homo sapiens
gcttcctgaaataaacactggt

SEQ ID NO: 5623649 - DNA, 22 bp, Homo sapiens
gcttcctgactgacacaggcca

SEQ ID NO: 5623650 - DNA, 21 bp, Homo sapiens
gcttcctgagcagtccctgct

SEQ ID NO: 5623651 - DNA, 13 bp, Homo sapiens
gcttcctgcagga

SEQ ID NO: 5623652 - DNA, 16 bp, Homo sapiens
gcttcctgccctagca

SEQ ID NO: 5623653 - DNA, 17 bp, Homo sapiens
gcttcctgccctagcag

SEQ ID NO: 5623654 - DNA, 18 bp, Homo sapiens
gcttcctgcccttccctc

SEQ ID NO: 5623655 - DNA, 12 bp, Homo sapiens
gcttcctgctgg

SEQ ID NO: 5623656 - DNA, 18 bp, Homo sapiens
gcttcctgctgtatgtga

SEQ ID NO: 5623657 - DNA, 21 bp, Homo sapiens
gcttcctggaacttgctctca

SEQ ID NO: 5623658 - DNA, 23 bp, Homo sapiens
gcttcctggaccggggccttggt

SEQ ID NO: 5623659 - DNA, 13 bp, Homo sapiens
gcttcctggcctc

SEQ ID NO: 5623660 - DNA, 16 bp, Homo sapiens
gcttcctggcctccct

SEQ ID NO: 5623661 - DNA, 17 bp, Homo sapiens
gcttcctggctctgggg

SEQ ID NO: 5623662 - DNA, 23 bp, Homo sapiens
gcttcctggctgtaaatcctaga

SEQ ID NO: 5623663 - DNA, 16 bp, Homo sapiens
gcttcctggggaccaa

SEQ ID NO: 5623664 - DNA, 18 bp, Homo sapiens
gcttcctggggaccaaga

SEQ ID NO: 5623665 - DNA, 14 bp, Homo sapiens
gcttcctgggggaa

SEQ ID NO: 5623666 - DNA, 14 bp, Homo sapiens
gcttcctgggtcct

SEQ ID NO: 5623667 - DNA, 19 bp, Homo sapiens
gcttcctgggtcctgcctg

SEQ ID NO: 5623668 - DNA, 20 bp, Homo sapiens
gcttcctgggtcctgcctgg

SEQ ID NO: 5623669 - DNA, 22 bp, Homo sapiens
gcttcctgggtcctgcctggtc

SEQ ID NO: 5623670 - DNA, 16 bp, Homo sapiens
gcttcctggtgagaac

SEQ ID NO: 5623671 - DNA, 14 bp, Homo sapiens
gcttcctggtgctg

SEQ ID NO: 5623672 - DNA, 12 bp, Homo sapiens
gcttcctggtgt

SEQ ID NO: 5623673 - DNA, 22 bp, Homo sapiens
gcttcctggtgtatttttcagg

SEQ ID NO: 5623674 - DNA, 17 bp, Homo sapiens
gcttcctgtccactctc

SEQ ID NO: 5623675 - DNA, 21 bp, Homo sapiens
gcttcctgtcctcccagctcc

SEQ ID NO: 5623676 - DNA, 13 bp, Homo sapiens
gcttcctgtgccc

SEQ ID NO: 5623677 - DNA, 16 bp, Homo sapiens
gcttcctgtgccctca

SEQ ID NO: 5623678 - DNA, 20 bp, Homo sapiens
gcttcctgtgccctcacccc

SEQ ID NO: 5623679 - DNA, 20 bp, Homo sapiens
gcttcctgtgggccaggagc

SEQ ID NO: 5623680 - DNA, 16 bp, Homo sapiens
gcttccttcagagagc

SEQ ID NO: 5623681 - DNA, 17 bp, Homo sapiens
gcttccttcagtttgta

SEQ ID NO: 5623682 - DNA, 20 bp, Homo sapiens
gcttccttcagtttgtaaag

SEQ ID NO: 5623683 - DNA, 14 bp, Homo sapiens
gcttccttcatttc

SEQ ID NO: 5623684 - DNA, 22 bp, Homo sapiens
gcttccttctgtgaaagtacat

SEQ ID NO: 5623685 - DNA, 15 bp, Homo sapiens
gcttccttggttcat

SEQ ID NO: 5623686 - DNA, 15 bp, Homo sapiens
gcttcctttcaggcc

SEQ ID NO: 5623687 - DNA, 17 bp, Homo sapiens
gcttcctttcaggccaa

SEQ ID NO: 5623688 - DNA, 23 bp, Homo sapiens
gcttcctttcctgtgtgtactct

SEQ ID NO: 5623689 - DNA, 14 bp, Homo sapiens
gcttcctttctctc

SEQ ID NO: 5623690 - DNA, 19 bp, Homo sapiens
gcttcgactactgctcctg

SEQ ID NO: 5623691 - DNA, 15 bp, Homo sapiens
gcttcgagccaactc

SEQ ID NO: 5623692 - DNA, 17 bp, Homo sapiens
gcttcgaggacaggaaa

SEQ ID NO: 5623693 - DNA, 21 bp, Homo sapiens
gcttcgaggcccagcgacctc

SEQ ID NO: 5623694 - DNA, 12 bp, Homo sapiens
gcttcggacagt

SEQ ID NO: 5623695 - DNA, 21 bp, Homo sapiens
gcttcggagatggagtccctt

SEQ ID NO: 5623696 - DNA, 21 bp, Homo sapiens
gcttcggagggccgcagggcc

SEQ ID NO: 5623697 - DNA, 22 bp, Homo sapiens
gcttcggagggccgcagggccc

SEQ ID NO: 5623698 - DNA, 23 bp, Homo sapiens
gcttcggagggccgcagggccca

SEQ ID NO: 5623699 - DNA, 15 bp, Homo sapiens
gcttcggagtgaatg

SEQ ID NO: 5623700 - DNA, 21 bp, Homo sapiens
gcttcggagtgaatgtggcag

SEQ ID NO: 5623701 - DNA, 23 bp, Homo sapiens
gcttcggagtgaatgtggcagtt

SEQ ID NO: 5623702 - DNA, 16 bp, Homo sapiens
gcttcggccgcgccac

SEQ ID NO: 5623703 - DNA, 19 bp, Homo sapiens
gcttcgggaaaatattcat

SEQ ID NO: 5623704 - DNA, 20 bp, Homo sapiens
gcttcgggcccttcccacag

SEQ ID NO: 5623705 - DNA, 16 bp, Homo sapiens
gcttcggttctccaga

SEQ ID NO: 5623706 - DNA, 16 bp, Homo sapiens
gcttcgtctcagaagg

SEQ ID NO: 5623707 - DNA, 14 bp, Homo sapiens
gcttcgtttatttt

SEQ ID NO: 5623708 - DNA, 12 bp, Homo sapiens
gcttctaaagca

SEQ ID NO: 5623709 - DNA, 13 bp, Homo sapiens
gcttctaaagcag

SEQ ID NO: 5623710 - DNA, 16 bp, Homo sapiens
gcttctaaatgcccag

SEQ ID NO: 5623711 - DNA, 17 bp, Homo sapiens
gcttctaaatgcccagt

SEQ ID NO: 5623712 - DNA, 22 bp, Homo sapiens
gcttctaagggatccagagacc

SEQ ID NO: 5623713 - DNA, 16 bp, Homo sapiens
gcttctaagtaaatac

SEQ ID NO: 5623714 - DNA, 18 bp, Homo sapiens
gcttctaagtaaatacaa

SEQ ID NO: 5623715 - DNA, 14 bp, Homo sapiens
gcttctaatattag

SEQ ID NO: 5623716 - DNA, 13 bp, Homo sapiens
gcttctaatgacc

SEQ ID NO: 5623717 - DNA, 13 bp, Homo sapiens
gcttctaatgttc

SEQ ID NO: 5623718 - DNA, 15 bp, Homo sapiens
gcttctaattttgtg

SEQ ID NO: 5623719 - DNA, 17 bp, Homo sapiens
gcttctaattttgtgct

SEQ ID NO: 5623720 - DNA, 19 bp, Homo sapiens
gcttctaattttgtgctct

SEQ ID NO: 5623721 - DNA, 20 bp, Homo sapiens
gcttctaattttgtgctctt

SEQ ID NO: 5623722 - DNA, 20 bp, Homo sapiens
gcttctaccaactggaagca

SEQ ID NO: 5623723 - DNA, 14 bp, Homo sapiens
gcttctacctggaa

SEQ ID NO: 5623724 - DNA, 18 bp, Homo sapiens
gcttctacggccatgaga

SEQ ID NO: 5623725 - DNA, 16 bp, Homo sapiens
gcttctactttcatct

SEQ ID NO: 5623726 - DNA, 22 bp, Homo sapiens
gcttctagacactccttgaaat

SEQ ID NO: 5623727 - DNA, 20 bp, Homo sapiens
gcttctagaggctcatggcc

SEQ ID NO: 5623728 - DNA, 21 bp, Homo sapiens
gcttctagaggctcatggccc

SEQ ID NO: 5623729 - DNA, 22 bp, Homo sapiens
gcttctagaggctcatggccct

SEQ ID NO: 5623730 - DNA, 18 bp, Homo sapiens
gcttctagatctggaacc

SEQ ID NO: 5623731 - DNA, 22 bp, Homo sapiens
gcttctagtctggaactgctgc

SEQ ID NO: 5623732 - DNA, 23 bp, Homo sapiens
gcttctagtctggaactgctgct

SEQ ID NO: 5623733 - DNA, 16 bp, Homo sapiens
gcttctagttctgcca

SEQ ID NO: 5623734 - DNA, 18 bp, Homo sapiens
gcttctagtttgcaactt

SEQ ID NO: 5623735 - DNA, 19 bp, Homo sapiens
gcttctataattttgcctt

SEQ ID NO: 5623736 - DNA, 20 bp, Homo sapiens
gcttctatcagactcagttt

SEQ ID NO: 5623737 - DNA, 18 bp, Homo sapiens
gcttctatcccaggaggt

SEQ ID NO: 5623738 - DNA, 19 bp, Homo sapiens
gcttctatgtccaacagag

SEQ ID NO: 5623739 - DNA, 18 bp, Homo sapiens
gcttctattaaatgtata

SEQ ID NO: 5623740 - DNA, 14 bp, Homo sapiens
gcttctcacggcct

SEQ ID NO: 5623741 - DNA, 22 bp, Homo sapiens
gcttctcactgccatgccagct

SEQ ID NO: 5623742 - DNA, 22 bp, Homo sapiens
gcttctcagccccgggcctgcc

SEQ ID NO: 5623743 - DNA, 16 bp, Homo sapiens
gcttctcagctcgctg

SEQ ID NO: 5623744 - DNA, 19 bp, Homo sapiens
gcttctcagttgcagaaaa

SEQ ID NO: 5623745 - DNA, 12 bp, Homo sapiens
gcttctcagttt

SEQ ID NO: 5623746 - DNA, 20 bp, Homo sapiens
gcttctcagtttctgcctgg

SEQ ID NO: 5623747 - DNA, 21 bp, Homo sapiens
gcttctcagtttctgcctggg

SEQ ID NO: 5623748 - DNA, 23 bp, Homo sapiens
gcttctcagtttctgcctgggca

SEQ ID NO: 5623749 - DNA, 17 bp, Homo sapiens
gcttctcatcctgcagg

SEQ ID NO: 5623750 - DNA, 19 bp, Homo sapiens
gcttctcatgttaaatatt

SEQ ID NO: 5623751 - DNA, 15 bp, Homo sapiens
gcttctccacctccc

SEQ ID NO: 5623752 - DNA, 12 bp, Homo sapiens
gcttctccagcc

SEQ ID NO: 5623753 - DNA, 13 bp, Homo sapiens
gcttctccagcca

SEQ ID NO: 5623754 - DNA, 14 bp, Homo sapiens
gcttctccagccac

SEQ ID NO: 5623755 - DNA, 17 bp, Homo sapiens
gcttctccagcctggac

SEQ ID NO: 5623756 - DNA, 20 bp, Homo sapiens
gcttctcccaggcaaggctg

SEQ ID NO: 5623757 - DNA, 23 bp, Homo sapiens
gcttctcccaggcaaggctgtgg

SEQ ID NO: 5623758 - DNA, 11 bp, Homo sapiens
gcttctcccat

SEQ ID NO: 5623759 - DNA, 12 bp, Homo sapiens
gcttctcccatt

SEQ ID NO: 5623760 - DNA, 17 bp, Homo sapiens
gcttctcccatttcctg

SEQ ID NO: 5623761 - DNA, 20 bp, Homo sapiens
gcttctcccatttcctgatc

SEQ ID NO: 5623762 - DNA, 13 bp, Homo sapiens
gcttctccccaga

SEQ ID NO: 5623763 - DNA, 14 bp, Homo sapiens
gcttctccccagaa

SEQ ID NO: 5623764 - DNA, 22 bp, Homo sapiens
gcttctcccccaccccctaggg

SEQ ID NO: 5623765 - DNA, 13 bp, Homo sapiens
gcttctcccccca

SEQ ID NO: 5623766 - DNA, 21 bp, Homo sapiens
gcttctccccctcagctctcc

SEQ ID NO: 5623767 - DNA, 19 bp, Homo sapiens
gcttctcccgccattggcc

SEQ ID NO: 5623768 - DNA, 20 bp, Homo sapiens
gcttctcccgccattggcct

SEQ ID NO: 5623769 - DNA, 21 bp, Homo sapiens
gcttctcccgccattggcctt

SEQ ID NO: 5623770 - DNA, 22 bp, Homo sapiens
gcttctcccgccattggcctta

SEQ ID NO: 5623771 - DNA, 16 bp, Homo sapiens
gcttctccctggctga

SEQ ID NO: 5623772 - DNA, 23 bp, Homo sapiens
gcttctccctggggacggggctc

SEQ ID NO: 5623773 - DNA, 14 bp, Homo sapiens
gcttctccgccagc

SEQ ID NO: 5623774 - DNA, 19 bp, Homo sapiens
gcttctccgccagcctcct

SEQ ID NO: 5623775 - DNA, 21 bp, Homo sapiens
gcttctccgccagcctcctct

SEQ ID NO: 5623776 - DNA, 14 bp, Homo sapiens
gcttctcctctgct

SEQ ID NO: 5623777 - DNA, 11 bp, Homo sapiens
gcttctcctgc

SEQ ID NO: 5623778 - DNA, 12 bp, Homo sapiens
gcttctcctgca

SEQ ID NO: 5623779 - DNA, 15 bp, Homo sapiens
gcttctcctgcagtc

SEQ ID NO: 5623780 - DNA, 19 bp, Homo sapiens
gcttctcctgcagtggatg

SEQ ID NO: 5623781 - DNA, 14 bp, Homo sapiens
gcttctcctgcggg

SEQ ID NO: 5623782 - DNA, 15 bp, Homo sapiens
gcttctcctgtgtga

SEQ ID NO: 5623783 - DNA, 21 bp, Homo sapiens
gcttctcctgttttatatatt

SEQ ID NO: 5623784 - DNA, 17 bp, Homo sapiens
gcttctccttctccttc

SEQ ID NO: 5623785 - DNA, 16 bp, Homo sapiens
gcttctcctttggcat

SEQ ID NO: 5623786 - DNA, 21 bp, Homo sapiens
gcttctcgctgcgcagcctcc

SEQ ID NO: 5623787 - DNA, 23 bp, Homo sapiens
gcttctcgctgcgcagcctccag

SEQ ID NO: 5623788 - DNA, 21 bp, Homo sapiens
gcttctcggaggccaggccct

SEQ ID NO: 5623789 - DNA, 22 bp, Homo sapiens
gcttctcggaggccaggccctc

SEQ ID NO: 5623790 - DNA, 21 bp, Homo sapiens
gcttctctagctctctaggcc

SEQ ID NO: 5623791 - DNA, 18 bp, Homo sapiens
gcttctctccacagtgtt

SEQ ID NO: 5623792 - DNA, 17 bp, Homo sapiens
gcttctctccacccatg

SEQ ID NO: 5623793 - DNA, 12 bp, Homo sapiens
gcttctctctca

SEQ ID NO: 5623794 - DNA, 15 bp, Homo sapiens
gcttctctctccagg

SEQ ID NO: 5623795 - DNA, 16 bp, Homo sapiens
gcttctctctccaggg

SEQ ID NO: 5623796 - DNA, 17 bp, Homo sapiens
gcttctctctccagggt

SEQ ID NO: 5623797 - DNA, 14 bp, Homo sapiens
gcttctctctccct

SEQ ID NO: 5623798 - DNA, 16 bp, Homo sapiens
gcttctctctctctca

SEQ ID NO: 5623799 - DNA, 14 bp, Homo sapiens
gcttctctctgagc

SEQ ID NO: 5623800 - DNA, 16 bp, Homo sapiens
gcttctctcttttaaa

SEQ ID NO: 5623801 - DNA, 16 bp, Homo sapiens
gcttctctcttttcct

SEQ ID NO: 5623802 - DNA, 17 bp, Homo sapiens
gcttctctcttttcctc

SEQ ID NO: 5623803 - DNA, 17 bp, Homo sapiens
gcttctctgacttctgc

SEQ ID NO: 5623804 - DNA, 18 bp, Homo sapiens
gcttctctgacttctgcc

SEQ ID NO: 5623805 - DNA, 20 bp, Homo sapiens
gcttctctgacttctgcctg

SEQ ID NO: 5623806 - DNA, 20 bp, Homo sapiens
gcttctctgccctgccctgg

SEQ ID NO: 5623807 - DNA, 22 bp, Homo sapiens
gcttctctgccggtggggccag

SEQ ID NO: 5623808 - DNA, 17 bp, Homo sapiens
gcttctctgctgagaag

SEQ ID NO: 5623809 - DNA, 23 bp, Homo sapiens
gcttctctgggaccaggctccaa

SEQ ID NO: 5623810 - DNA, 14 bp, Homo sapiens
gcttctctgggctg

SEQ ID NO: 5623811 - DNA, 17 bp, Homo sapiens
gcttctctgtctctgtg

SEQ ID NO: 5623812 - DNA, 22 bp, Homo sapiens
gcttctctgtgcccctgtaaat

SEQ ID NO: 5623813 - DNA, 23 bp, Homo sapiens
gcttctcttgggtgggacagggc

SEQ ID NO: 5623814 - DNA, 19 bp, Homo sapiens
gcttctctttaactcagga

SEQ ID NO: 5623815 - DNA, 13 bp, Homo sapiens
gcttctcttttcc

SEQ ID NO: 5623816 - DNA, 14 bp, Homo sapiens
gctttatcaaaggg

SEQ ID NO: 5623817 - DNA, 15 bp, Homo sapiens
gctttatcaggggac

SEQ ID NO: 5623818 - DNA, 20 bp, Homo sapiens
gctttatccacattgtagcc

SEQ ID NO: 5623819 - DNA, 11 bp, Homo sapiens
gctttatccag

SEQ ID NO: 5623820 - DNA, 13 bp, Homo sapiens
gctttatctttgt

SEQ ID NO: 5623821 - DNA, 16 bp, Homo sapiens
gctttatcttttcata

SEQ ID NO: 5623822 - DNA, 19 bp, Homo sapiens
gctttatgaagtttgagtt

SEQ ID NO: 5623823 - DNA, 14 bp, Homo sapiens
gctttatgattttc

SEQ ID NO: 5623824 - DNA, 19 bp, Homo sapiens
gctttatgcaggattctct

SEQ ID NO: 5623825 - DNA, 13 bp, Homo sapiens
gctttatgctgaa

SEQ ID NO: 5623826 - DNA, 16 bp, Homo sapiens
gctttatgggggggag

SEQ ID NO: 5623827 - DNA, 22 bp, Homo sapiens
gctttatggtcctaaaagcaaa

SEQ ID NO: 5623828 - DNA, 17 bp, Homo sapiens
gctttattatggcttgt

SEQ ID NO: 5623829 - DNA, 20 bp, Homo sapiens
gctttattatggcttgtgaa

SEQ ID NO: 5623830 - DNA, 17 bp, Homo sapiens
gctttattccagaatgc

SEQ ID NO: 5623831 - DNA, 14 bp, Homo sapiens
gctttattgaagtc

SEQ ID NO: 5623832 - DNA, 14 bp, Homo sapiens
gctttattgaatta

SEQ ID NO: 5623833 - DNA, 18 bp, Homo sapiens
gctttattgcctctgtct

SEQ ID NO: 5623834 - DNA, 18 bp, Homo sapiens
gctttattgctgcatttt

SEQ ID NO: 5623835 - DNA, 23 bp, Homo sapiens
gctttattgttcacacaaagcct

SEQ ID NO: 5623836 - DNA, 21 bp, Homo sapiens
gctttatttatggcttataaa

SEQ ID NO: 5623837 - DNA, 23 bp, Homo sapiens
gctttatttatggcttataaatg

SEQ ID NO: 5623838 - DNA, 20 bp, Homo sapiens
gctttattttgagatgtaaa

SEQ ID NO: 5623839 - DNA, 13 bp, Homo sapiens
gctttatttttct

SEQ ID NO: 5623840 - DNA, 18 bp, Homo sapiens
gctttatttttctttaaa

SEQ ID NO: 5623841 - DNA, 17 bp, Homo sapiens
gctttattttttaagta

SEQ ID NO: 5623842 - DNA, 21 bp, Homo sapiens
gctttattttttaagtattta

SEQ ID NO: 5623843 - DNA, 14 bp, Homo sapiens
gctttcaaaataag

SEQ ID NO: 5623844 - DNA, 21 bp, Homo sapiens
gctttcaacttaaatcactga

SEQ ID NO: 5623845 - DNA, 20 bp, Homo sapiens
gctttcaagacccctgtctt

SEQ ID NO: 5623846 - DNA, 22 bp, Homo sapiens
gctttcaaggctggggcatggc

SEQ ID NO: 5623847 - DNA, 14 bp, Homo sapiens
gctttcacaaatat

SEQ ID NO: 5623848 - DNA, 14 bp, Homo sapiens
gctttcacattgta

SEQ ID NO: 5623849 - DNA, 15 bp, Homo sapiens
gctttcacatttaaa

SEQ ID NO: 5623850 - DNA, 20 bp, Homo sapiens
gctttcacatttaaatggtt

SEQ ID NO: 5623851 - DNA, 23 bp, Homo sapiens
gctttcacatttaaatggttctg

SEQ ID NO: 5623852 - DNA, 14 bp, Homo sapiens
gctttcactaggaa

SEQ ID NO: 5623853 - DNA, 17 bp, Homo sapiens
gctttcactaggaaaat

SEQ ID NO: 5623854 - DNA, 13 bp, Homo sapiens
gctttcagagcca

SEQ ID NO: 5623855 - DNA, 20 bp, Homo sapiens
gctttcagagccagcctggc

SEQ ID NO: 5623856 - DNA, 23 bp, Homo sapiens
gctttcagagccagcctggctct

SEQ ID NO: 5623857 - DNA, 16 bp, Homo sapiens
gctttcagagccagtg

SEQ ID NO: 5623858 - DNA, 17 bp, Homo sapiens
gctttcagagccagtga

SEQ ID NO: 5623859 - DNA, 14 bp, Homo sapiens
gctttcagatactg

SEQ ID NO: 5623860 - DNA, 23 bp, Homo sapiens
gctttcagatactggattgtact

SEQ ID NO: 5623861 - DNA, 17 bp, Homo sapiens
gctttcagcgcccccag

SEQ ID NO: 5623862 - DNA, 19 bp, Homo sapiens
gctttcagcgcccccaggc

SEQ ID NO: 5623863 - DNA, 15 bp, Homo sapiens
gctttcaggagctcc

SEQ ID NO: 5623864 - DNA, 21 bp, Homo sapiens
gctttcagggccatggttcac

SEQ ID NO: 5623865 - DNA, 22 bp, Homo sapiens
gctttcagtgatatctttctca

SEQ ID NO: 5623866 - DNA, 15 bp, Homo sapiens
gctttcagtgcctgc

SEQ ID NO: 5623867 - DNA, 18 bp, Homo sapiens
gctttcagtgcctgctgt

SEQ ID NO: 5623868 - DNA, 17 bp, Homo sapiens
gctttcatccaactcta

SEQ ID NO: 5623869 - DNA, 14 bp, Homo sapiens
gctttcatcctgtg

SEQ ID NO: 5623870 - DNA, 15 bp, Homo sapiens
gctttcatgtaaact

SEQ ID NO: 5623871 - DNA, 13 bp, Homo sapiens
gctttcatgtaat

SEQ ID NO: 5623872 - DNA, 21 bp, Homo sapiens
gctttcatgtttaagaaatga

SEQ ID NO: 5623873 - DNA, 14 bp, Homo sapiens
gctttccaaagcca

SEQ ID NO: 5623874 - DNA, 14 bp, Homo sapiens
gctttccatatttt

SEQ ID NO: 5623875 - DNA, 17 bp, Homo sapiens
gctttccatctgaggac

SEQ ID NO: 5623876 - DNA, 20 bp, Homo sapiens
gctttccatctgaggaccag

SEQ ID NO: 5623877 - DNA, 21 bp, Homo sapiens
gctttccatgttgctgccaac

SEQ ID NO: 5623878 - DNA, 16 bp, Homo sapiens
gctttcccaacagctc

SEQ ID NO: 5623879 - DNA, 22 bp, Homo sapiens
gctttcccaccagcatgtcact

SEQ ID NO: 5623880 - DNA, 21 bp, Homo sapiens
gctttcccacttcccaccctg

SEQ ID NO: 5623881 - DNA, 16 bp, Homo sapiens
gctttcccaggagaaa

SEQ ID NO: 5623882 - DNA, 17 bp, Homo sapiens
gctttcccaggagaaag

SEQ ID NO: 5623883 - DNA, 21 bp, Homo sapiens
gctttccccatgtctcgactc

SEQ ID NO: 5623884 - DNA, 22 bp, Homo sapiens
gctttcccccacttttctctct

SEQ ID NO: 5623885 - DNA, 20 bp, Homo sapiens
gctttcccccaggcgcctgc

SEQ ID NO: 5623886 - DNA, 21 bp, Homo sapiens
gctttccccgggggaggaagg

SEQ ID NO: 5623887 - DNA, 22 bp, Homo sapiens
gctttcccctcctccctgggat

SEQ ID NO: 5623888 - DNA, 17 bp, Homo sapiens
gctttcccctgtgggga

SEQ ID NO: 5623889 - DNA, 18 bp, Homo sapiens
gctttcccgcccagcctc

SEQ ID NO: 5623890 - DNA, 21 bp, Homo sapiens
gctttcccgcccagcctcact

SEQ ID NO: 5623891 - DNA, 16 bp, Homo sapiens
gctttccctgccaggc

SEQ ID NO: 5623892 - DNA, 13 bp, Homo sapiens
gctttccctgtgc

SEQ ID NO: 5623893 - DNA, 17 bp, Homo sapiens
gctttcccttccagttc

SEQ ID NO: 5623894 - DNA, 22 bp, Homo sapiens
gctttccgcgtggttctgccac

SEQ ID NO: 5623895 - DNA, 24 bp, Homo sapiens
gctttccgcgtggttctgccactt

SEQ ID NO: 5623896 - DNA, 14 bp, Homo sapiens
gctttccggggagg

SEQ ID NO: 5623897 - DNA, 19 bp, Homo sapiens
gctttcctaaagtctctgc

SEQ ID NO: 5623898 - DNA, 18 bp, Homo sapiens
gctttcctcaaaaagcag

SEQ ID NO: 5623899 - DNA, 19 bp, Homo sapiens
gctttcctcatcaggccat

SEQ ID NO: 5623900 - DNA, 11 bp, Homo sapiens
gctttcctccc

SEQ ID NO: 5623901 - DNA, 20 bp, Homo sapiens
gctttcctccctggcatgac

SEQ ID NO: 5623902 - DNA, 16 bp, Homo sapiens
gctttcctcttcctga

SEQ ID NO: 5623903 - DNA, 22 bp, Homo sapiens
gctttcctgaatccaaactaat

SEQ ID NO: 5623904 - DNA, 19 bp, Homo sapiens
gctttcctgatgatgctgg

SEQ ID NO: 5623905 - DNA, 13 bp, Homo sapiens
gctttcctgctgg

SEQ ID NO: 5623906 - DNA, 14 bp, Homo sapiens
gctttcctggaagt

SEQ ID NO: 5623907 - DNA, 14 bp, Homo sapiens
gctttcctggagcc

SEQ ID NO: 5623908 - DNA, 19 bp, Homo sapiens
gctttcctgggcctttgca

SEQ ID NO: 5623909 - DNA, 14 bp, Homo sapiens
gctttcctgggtct

SEQ ID NO: 5623910 - DNA, 14 bp, Homo sapiens
gctttcctgtgcca

SEQ ID NO: 5623911 - DNA, 17 bp, Homo sapiens
gctttcctgtgccaggt

SEQ ID NO: 5623912 - DNA, 15 bp, Homo sapiens
gctttcctgtttcca

SEQ ID NO: 5623913 - DNA, 13 bp, Homo sapiens
gctttccttcatc

SEQ ID NO: 5623914 - DNA, 14 bp, Homo sapiens
gctttccttcatct

SEQ ID NO: 5623915 - DNA, 20 bp, Homo sapiens
gctttccttcctcccctttt

SEQ ID NO: 5623916 - DNA, 13 bp, Homo sapiens
gctttccttctgc

SEQ ID NO: 5623917 - DNA, 22 bp, Homo sapiens
gctttccttgttttgatttatg

SEQ ID NO: 5623918 - DNA, 12 bp, Homo sapiens
gctttcctttcc

SEQ ID NO: 5623919 - DNA, 17 bp, Homo sapiens
gctttcctttccttttt

SEQ ID NO: 5623920 - DNA, 22 bp, Homo sapiens
gctttcctttttcccaataaat

SEQ ID NO: 5623921 - DNA, 17 bp, Homo sapiens
gctttccttttttaaaa

SEQ ID NO: 5623922 - DNA, 23 bp, Homo sapiens
gctttccttttttaaaaatgcaa

SEQ ID NO: 5623923 - DNA, 16 bp, Homo sapiens
gctttcgaactgctag

SEQ ID NO: 5623924 - DNA, 19 bp, Homo sapiens
gctttcggaattcctgcag

SEQ ID NO: 5623925 - DNA, 19 bp, Homo sapiens
gctttcgtctccagcccct

SEQ ID NO: 5623926 - DNA, 24 bp, Homo sapiens
gctttctaccacacacagcctgtc

SEQ ID NO: 5623927 - DNA, 13 bp, Homo sapiens
gctttctacccag

SEQ ID NO: 5623928 - DNA, 21 bp, Homo sapiens
gctttctagcaaatatgctgt

SEQ ID NO: 5623929 - DNA, 18 bp, Homo sapiens
gctttctatgctgtttgt

SEQ ID NO: 5623930 - DNA, 12 bp, Homo sapiens
gctttctcaatg

SEQ ID NO: 5623931 - DNA, 13 bp, Homo sapiens
gctttctcaatgt

SEQ ID NO: 5623932 - DNA, 20 bp, Homo sapiens
gctttctcagaatgttggca

SEQ ID NO: 5623933 - DNA, 16 bp, Homo sapiens
gctttctcagtgtgtg

SEQ ID NO: 5623934 - DNA, 22 bp, Homo sapiens
gctttctcctcatccatttctt

SEQ ID NO: 5623935 - DNA, 15 bp, Homo sapiens
gctttctcctgtgcc

SEQ ID NO: 5623936 - DNA, 11 bp, Homo sapiens
gctttctctcc

SEQ ID NO: 5623937 - DNA, 23 bp, Homo sapiens
gctttctctccgacttcccctgg

SEQ ID NO: 5623938 - DNA, 16 bp, Homo sapiens
gctttctctccttggc

SEQ ID NO: 5623939 - DNA, 16 bp, Homo sapiens
gctttctctctcatgc

SEQ ID NO: 5623940 - DNA, 16 bp, Homo sapiens
gctttctctgcctctg

SEQ ID NO: 5623941 - DNA, 18 bp, Homo sapiens
gctttctctgcctctggg

SEQ ID NO: 5623942 - DNA, 10 bp, Homo sapiens
gctttctctt

SEQ ID NO: 5623943 - DNA, 13 bp, Homo sapiens
gctttctcttcat

SEQ ID NO: 5623944 - DNA, 15 bp, Homo sapiens
gctttctcttcatat

SEQ ID NO: 5623945 - DNA, 21 bp, Homo sapiens
gctttctcttccccttcctgt

SEQ ID NO: 5623946 - DNA, 14 bp, Homo sapiens
gctttctcttttct

SEQ ID NO: 5623947 - DNA, 16 bp, Homo sapiens
gctttctgaacagctg

SEQ ID NO: 5623948 - DNA, 21 bp, Homo sapiens
gctttctgaacagctggtgta

SEQ ID NO: 5623949 - DNA, 15 bp, Homo sapiens
gctttctgccatcta

SEQ ID NO: 5623950 - DNA, 17 bp, Homo sapiens
gctttctgcctctcctc

SEQ ID NO: 5623951 - DNA, 19 bp, Homo sapiens
gctttctgctcagcttctc

SEQ ID NO: 5623952 - DNA, 21 bp, Homo sapiens
gctttctgctcagcttctcct

SEQ ID NO: 5623953 - DNA, 22 bp, Homo sapiens
gctttctggaaaagaggagttt

SEQ ID NO: 5623954 - DNA, 23 bp, Homo sapiens
gctttctggaaattcttccctgg

SEQ ID NO: 5623955 - DNA, 20 bp, Homo sapiens
gctttctgggatgtcacagt

SEQ ID NO: 5623956 - DNA, 21 bp, Homo sapiens
gctttctgggctctggactcc

SEQ ID NO: 5623957 - DNA, 22 bp, Homo sapiens
gctttctgggctctggactcca

SEQ ID NO: 5623958 - DNA, 23 bp, Homo sapiens
gctttctggggcctagcgatctc

SEQ ID NO: 5623959 - DNA, 17 bp, Homo sapiens
gctttctgggtgtgtcc

SEQ ID NO: 5623960 - DNA, 22 bp, Homo sapiens
gctttctggtataaagctctca

SEQ ID NO: 5623961 - DNA, 13 bp, Homo sapiens
gctttctgtgaaa

SEQ ID NO: 5623962 - DNA, 18 bp, Homo sapiens
gctttctgtgaaagcctt

SEQ ID NO: 5623963 - DNA, 21 bp, Homo sapiens
gctttctgtgaaagccttaag

SEQ ID NO: 5623964 - DNA, 14 bp, Homo sapiens
gctttctgtgcatg

SEQ ID NO: 5623965 - DNA, 13 bp, Homo sapiens
gctttctgttcca

SEQ ID NO: 5623966 - DNA, 16 bp, Homo sapiens
gctttctgttccaaat

SEQ ID NO: 5623967 - DNA, 22 bp, Homo sapiens
gctttctgttgtcattgctgtt

SEQ ID NO: 5623968 - DNA, 23 bp, Homo sapiens
gctttctgttgtcattgctgttg

SEQ ID NO: 5623969 - DNA, 16 bp, Homo sapiens
gctttcttcatgttca

SEQ ID NO: 5623970 - DNA, 20 bp, Homo sapiens
gctttcttctctgcctcctc

SEQ ID NO: 5623971 - DNA, 13 bp, Homo sapiens
gctttcttctttc

SEQ ID NO: 5623972 - DNA, 21 bp, Homo sapiens
gctttcttctttccagacccc

SEQ ID NO: 5623973 - DNA, 18 bp, Homo sapiens
gctttcttgccacacagt

SEQ ID NO: 5623974 - DNA, 20 bp, Homo sapiens
gctttcttgctcccttcagc

SEQ ID NO: 5623975 - DNA, 21 bp, Homo sapiens
gctttcttgctcccttcagcc

SEQ ID NO: 5623976 - DNA, 12 bp, Homo sapiens
gctttcttgctg

SEQ ID NO: 5623977 - DNA, 21 bp, Homo sapiens
gctttcttgtcttttcagaag

SEQ ID NO: 5623978 - DNA, 17 bp, Homo sapiens
gctttcttgtttcttat

SEQ ID NO: 5623979 - DNA, 19 bp, Homo sapiens
gctttctttagaattttta

SEQ ID NO: 5623980 - DNA, 23 bp, Homo sapiens
gctttctttagaatttttaccca

SEQ ID NO: 5623981 - DNA, 16 bp, Homo sapiens
gctttctttgacctct

SEQ ID NO: 5623982 - DNA, 17 bp, Homo sapiens
gctttctttgattctcc

SEQ ID NO: 5623983 - DNA, 21 bp, Homo sapiens
gctttctttggcctacattct

SEQ ID NO: 5623984 - DNA, 22 bp, Homo sapiens
gctttctttggtaggtaaatct

SEQ ID NO: 5623985 - DNA, 20 bp, Homo sapiens
gctttcttttctctatgaaa

SEQ ID NO: 5623986 - DNA, 18 bp, Homo sapiens
gctttgaaaaatctcatt

SEQ ID NO: 5623987 - DNA, 13 bp, Homo sapiens
gctttgaaaatgt

SEQ ID NO: 5623988 - DNA, 15 bp, Homo sapiens
gctttgaaagaagca

SEQ ID NO: 5623989 - DNA, 16 bp, Homo sapiens
gctttgaaagaagcaa

SEQ ID NO: 5623990 - DNA, 21 bp, Homo sapiens
gctttgaaagccccagaaatc

SEQ ID NO: 5623991 - DNA, 15 bp, Homo sapiens
gctttgaaggaacca

SEQ ID NO: 5623992 - DNA, 18 bp, Homo sapiens
gctttgacatgaaaagat

SEQ ID NO: 5623993 - DNA, 23 bp, Homo sapiens
ggaaaaaggacaggcagaaagag

SEQ ID NO: 5623994 - DNA, 19 bp, Homo sapiens
ggaaaaagtgggtttttta

SEQ ID NO: 5623995 - DNA, 11 bp, Homo sapiens
ggaaaaagttg

SEQ ID NO: 5623996 - DNA, 23 bp, Homo sapiens
ggaaaaataatcaagattttagg

SEQ ID NO: 5623997 - DNA, 14 bp, Homo sapiens
ggaaaaatatttaa

SEQ ID NO: 5623998 - DNA, 12 bp, Homo sapiens
ggaaaaatgtgt

SEQ ID NO: 5623999 - DNA, 13 bp, Homo sapiens
ggaaaaatgtttg

SEQ ID NO: 5624000 - DNA, 16 bp, Homo sapiens
ggaaaaattcttggtt

SEQ ID NO: 5624001 - DNA, 13 bp, Homo sapiens
ggaaaaatttgaa

SEQ ID NO: 5624002 - DNA, 13 bp, Homo sapiens
ggaaaacaaaaaa

SEQ ID NO: 5624003 - DNA, 17 bp, Homo sapiens
ggaaaacaaaaatatct

SEQ ID NO: 5624004 - DNA, 19 bp, Homo sapiens
ggaaaacacagcctccctg

SEQ ID NO: 5624005 - DNA, 20 bp, Homo sapiens
ggaaaacacctttattttat

SEQ ID NO: 5624006 - DNA, 20 bp, Homo sapiens
ggaaaacacggccctcctgg

SEQ ID NO: 5624007 - DNA, 21 bp, Homo sapiens
ggaaaacacggccctcctggg

SEQ ID NO: 5624008 - DNA, 13 bp, Homo sapiens
ggaaaacagaaaa

SEQ ID NO: 5624009 - DNA, 22 bp, Homo sapiens
ggaaaacagctagcttgaaaac

SEQ ID NO: 5624010 - DNA, 23 bp, Homo sapiens
ggaaaacatatgaaatataaatt

SEQ ID NO: 5624011 - DNA, 22 bp, Homo sapiens
ggaaaacattgcttttgaaaac

SEQ ID NO: 5624012 - DNA, 21 bp, Homo sapiens
ggaaaaccaagccgtggcttc

SEQ ID NO: 5624013 - DNA, 22 bp, Homo sapiens
ggaaaaccaagccgtggcttcc

SEQ ID NO: 5624014 - DNA, 12 bp, Homo sapiens
ggaaaaccagac

SEQ ID NO: 5624015 - DNA, 22 bp, Homo sapiens
ggaaaaccagactacttgggag

SEQ ID NO: 5624016 - DNA, 14 bp, Homo sapiens
ggaaaaccagggat

SEQ ID NO: 5624017 - DNA, 16 bp, Homo sapiens
ggaaaaccagggatag

SEQ ID NO: 5624018 - DNA, 22 bp, Homo sapiens
ggaaaacgtatcacctttccca

SEQ ID NO: 5624019 - DNA, 20 bp, Homo sapiens
ggaaaactccaccttcccac

SEQ ID NO: 5624020 - DNA, 15 bp, Homo sapiens
ggaaaactgcctgtt

SEQ ID NO: 5624021 - DNA, 19 bp, Homo sapiens
ggaaaactgcctgttcctt

SEQ ID NO: 5624022 - DNA, 19 bp, Homo sapiens
ggaaaacttaataaaaatt

SEQ ID NO: 5624023 - DNA, 13 bp, Homo sapiens
ggaaaacttattt

SEQ ID NO: 5624024 - DNA, 19 bp, Homo sapiens
ggaaaacttcactccaaag

SEQ ID NO: 5624025 - DNA, 23 bp, Homo sapiens
ggaaaacttttgttttttggggt

SEQ ID NO: 5624026 - DNA, 14 bp, Homo sapiens
ggaaaagaaaaaaa

SEQ ID NO: 5624027 - DNA, 18 bp, Homo sapiens
ggaaaagaaaaatttctg

SEQ ID NO: 5624028 - DNA, 17 bp, Homo sapiens
ggaaaagaaagaagtta

SEQ ID NO: 5624029 - DNA, 13 bp, Homo sapiens
ggaaaagaaatca

SEQ ID NO: 5624030 - DNA, 23 bp, Homo sapiens
ggaaaagaagaaactttgcctca

SEQ ID NO: 5624031 - DNA, 18 bp, Homo sapiens
ggaaaagaagctgtcaga

SEQ ID NO: 5624032 - DNA, 17 bp, Homo sapiens
ggaaaagacacattttt

SEQ ID NO: 5624033 - DNA, 17 bp, Homo sapiens
ggaaaagaccagggctt

SEQ ID NO: 5624034 - DNA, 19 bp, Homo sapiens
ggaaaagactcctcctggg

SEQ ID NO: 5624035 - DNA, 17 bp, Homo sapiens
ggaaaagactgtgggtg

SEQ ID NO: 5624036 - DNA, 21 bp, Homo sapiens
ggaaaagagtatcaaaggcag

SEQ ID NO: 5624037 - DNA, 17 bp, Homo sapiens
ggaaaagatccccaaga

SEQ ID NO: 5624038 - DNA, 18 bp, Homo sapiens
ggaaaagcagctctcccc

SEQ ID NO: 5624039 - DNA, 20 bp, Homo sapiens
ggaaaaggatgatggaaaaa

SEQ ID NO: 5624040 - DNA, 23 bp, Homo sapiens
ggaaaaggatgatggaaaaatca

SEQ ID NO: 5624041 - DNA, 20 bp, Homo sapiens
ggaaaaggcagggagcgagg

SEQ ID NO: 5624042 - DNA, 17 bp, Homo sapiens
ggaaaaggcccctgcaa

SEQ ID NO: 5624043 - DNA, 22 bp, Homo sapiens
ggaaaaggcctggggtgacccg

SEQ ID NO: 5624044 - DNA, 12 bp, Homo sapiens
ggaaaagggaag

SEQ ID NO: 5624045 - DNA, 19 bp, Homo sapiens
ggaaaagggtcttcttggc

SEQ ID NO: 5624046 - DNA, 20 bp, Homo sapiens
ggaaaagggtcttgggaaat

SEQ ID NO: 5624047 - DNA, 21 bp, Homo sapiens
ggaaaagggtcttgggaaata

SEQ ID NO: 5624048 - DNA, 17 bp, Homo sapiens
ggaaaaggtccttgcct

SEQ ID NO: 5624049 - DNA, 15 bp, Homo sapiens
ggaaaaggttgaata

SEQ ID NO: 5624050 - DNA, 20 bp, Homo sapiens
ggaaaaggttgaataatata

SEQ ID NO: 5624051 - DNA, 23 bp, Homo sapiens
ggaaaagtaagggaataaatttt

SEQ ID NO: 5624052 - DNA, 14 bp, Homo sapiens
ggaaaagtgcaatg

SEQ ID NO: 5624053 - DNA, 12 bp, Homo sapiens
ggaaaagtgtta

SEQ ID NO: 5624054 - DNA, 18 bp, Homo sapiens
ggaaaagttaaactaaaa

SEQ ID NO: 5624055 - DNA, 14 bp, Homo sapiens
ggaaaagtttaata

SEQ ID NO: 5624056 - DNA, 19 bp, Homo sapiens
ggaaaataaaaaaagaaaa

SEQ ID NO: 5624057 - DNA, 20 bp, Homo sapiens
ggaaaataaaaaaagaaaaa

SEQ ID NO: 5624058 - DNA, 21 bp, Homo sapiens
ggaaaataaaaaaagaaaaaa

SEQ ID NO: 5624059 - DNA, 19 bp, Homo sapiens
ggaaaataacagagctgga

SEQ ID NO: 5624060 - DNA, 13 bp, Homo sapiens
ggaaaataagtga

SEQ ID NO: 5624061 - DNA, 21 bp, Homo sapiens
ggaaaataatcaaaccaaaga

SEQ ID NO: 5624062 - DNA, 13 bp, Homo sapiens
ggaaaatacccca

SEQ ID NO: 5624063 - DNA, 19 bp, Homo sapiens
ggaaaatacctaattgtgg

SEQ ID NO: 5624064 - DNA, 19 bp, Homo sapiens
ggaaaatcagcctgctcca

SEQ ID NO: 5624065 - DNA, 18 bp, Homo sapiens
ggaaaatcatattgagaa

SEQ ID NO: 5624066 - DNA, 19 bp, Homo sapiens
ggaaaatctctttttgact

SEQ ID NO: 5624067 - DNA, 19 bp, Homo sapiens
ggaaaatctgtaaaaaaga

SEQ ID NO: 5624068 - DNA, 14 bp, Homo sapiens
ggaaaatgaataat

SEQ ID NO: 5624069 - DNA, 21 bp, Homo sapiens
ggaaaatgagtatttggtcca

SEQ ID NO: 5624070 - DNA, 22 bp, Homo sapiens
ggaaaatgagtatttggtccaa

SEQ ID NO: 5624071 - DNA, 16 bp, Homo sapiens
ggaaaatgcattgtat

SEQ ID NO: 5624072 - DNA, 20 bp, Homo sapiens
ggaaaatgctatcaaataac

SEQ ID NO: 5624073 - DNA, 20 bp, Homo sapiens
ggaaaatgcttaaaaaataa

SEQ ID NO: 5624074 - DNA, 17 bp, Homo sapiens
ggaaaatggccatgcag

SEQ ID NO: 5624075 - DNA, 17 bp, Homo sapiens
ggaaaatgtattgattc

SEQ ID NO: 5624076 - DNA, 19 bp, Homo sapiens
ggaaaatgtattgattcaa

SEQ ID NO: 5624077 - DNA, 16 bp, Homo sapiens
ggaaaatgtcctgtgg

SEQ ID NO: 5624078 - DNA, 22 bp, Homo sapiens
ggaaaatgtttccttgtgcctg

SEQ ID NO: 5624079 - DNA, 21 bp, Homo sapiens
ggaaaattaaaccaatgaaga

SEQ ID NO: 5624080 - DNA, 20 bp, Homo sapiens
ggaaaattaatatcacagca

SEQ ID NO: 5624081 - DNA, 19 bp, Homo sapiens
ggaaaattaattctaaact

SEQ ID NO: 5624082 - DNA, 21 bp, Homo sapiens
ggaaaattaattctaaactta

SEQ ID NO: 5624083 - DNA, 15 bp, Homo sapiens
ggaaaattattttga

SEQ ID NO: 5624084 - DNA, 18 bp, Homo sapiens
ggaaaattcaaaggtgga

SEQ ID NO: 5624085 - DNA, 15 bp, Homo sapiens
ggaaaattcattttt

SEQ ID NO: 5624086 - DNA, 18 bp, Homo sapiens
ggaaaattctaacccagg

SEQ ID NO: 5624087 - DNA, 17 bp, Homo sapiens
ggaaaattgaaagtatt

SEQ ID NO: 5624088 - DNA, 15 bp, Homo sapiens
ggaaaattttctcct

SEQ ID NO: 5624089 - DNA, 21 bp, Homo sapiens
ggaaacaaagtttacattgtc

SEQ ID NO: 5624090 - DNA, 22 bp, Homo sapiens
ggaaacaaataatttgaacttt

SEQ ID NO: 5624091 - DNA, 22 bp, Homo sapiens
ggaaacaacaaaggaagtgagg

SEQ ID NO: 5624092 - DNA, 18 bp, Homo sapiens
ggaaacaagaggtaccaa

SEQ ID NO: 5624093 - DNA, 20 bp, Homo sapiens
ggaaacaagtgaccccaggg

SEQ ID NO: 5624094 - DNA, 12 bp, Homo sapiens
ggaaacaatata

SEQ ID NO: 5624095 - DNA, 11 bp, Homo sapiens
ggaaacaatga

SEQ ID NO: 5624096 - DNA, 17 bp, Homo sapiens
ggaaacactaaatgtta

SEQ ID NO: 5624097 - DNA, 23 bp, Homo sapiens
ggaaacactaaatgttaaagatg

SEQ ID NO: 5624098 - DNA, 13 bp, Homo sapiens
ggaaacagaactc

SEQ ID NO: 5624099 - DNA, 20 bp, Homo sapiens
ggaaacagaccaatagacat

SEQ ID NO: 5624100 - DNA, 15 bp, Homo sapiens
ggaaacagaggacca

SEQ ID NO: 5624101 - DNA, 17 bp, Homo sapiens
ggaaacagaggaccagc

SEQ ID NO: 5624102 - DNA, 22 bp, Homo sapiens
ggaaacagagtccaatttaagg

SEQ ID NO: 5624103 - DNA, 13 bp, Homo sapiens
ggaaacagcatga

SEQ ID NO: 5624104 - DNA, 15 bp, Homo sapiens
ggaaacagcctctct

SEQ ID NO: 5624105 - DNA, 13 bp, Homo sapiens
ggaaacagctggt

SEQ ID NO: 5624106 - DNA, 20 bp, Homo sapiens
ggaaacaggctccaagaggc

SEQ ID NO: 5624107 - DNA, 12 bp, Homo sapiens
ggaaacagggca

SEQ ID NO: 5624108 - DNA, 16 bp, Homo sapiens
ggaaacagggcagtga

SEQ ID NO: 5624109 - DNA, 18 bp, Homo sapiens
ggaaacagttgcatgtag

SEQ ID NO: 5624110 - DNA, 18 bp, Homo sapiens
ggaaacatacagaggatg

SEQ ID NO: 5624111 - DNA, 18 bp, Homo sapiens
ggaaacattacagttcat

SEQ ID NO: 5624112 - DNA, 23 bp, Homo sapiens
ggaaacatttttgagatattaaa

SEQ ID NO: 5624113 - DNA, 18 bp, Homo sapiens
ggaaaccaaaaggccgtg

SEQ ID NO: 5624114 - DNA, 14 bp, Homo sapiens
ggaaaccaaaggaa

SEQ ID NO: 5624115 - DNA, 11 bp, Homo sapiens
ggaaaccaaat

SEQ ID NO: 5624116 - DNA, 15 bp, Homo sapiens
ggaaaccacagctgc

SEQ ID NO: 5624117 - DNA, 21 bp, Homo sapiens
ggaaaccacagctgctggaga

SEQ ID NO: 5624118 - DNA, 16 bp, Homo sapiens
ggaaaccaccctgagg

SEQ ID NO: 5624119 - DNA, 24 bp, Homo sapiens
ggaaacccataggcccacacacag

SEQ ID NO: 5624120 - DNA, 14 bp, Homo sapiens
ggaaaccctcttct

SEQ ID NO: 5624121 - DNA, 16 bp, Homo sapiens
ggaaaccgaaactgac

SEQ ID NO: 5624122 - DNA, 17 bp, Homo sapiens
ggaaaccgtgtgtccag

SEQ ID NO: 5624123 - DNA, 18 bp, Homo sapiens
ggaaaccttcacccagca

SEQ ID NO: 5624124 - DNA, 17 bp, Homo sapiens
ggaaaccttccacccag

SEQ ID NO: 5624125 - DNA, 13 bp, Homo sapiens
ggaaaccttgcag

SEQ ID NO: 5624126 - DNA, 16 bp, Homo sapiens
ggaaaccttggagagg

SEQ ID NO: 5624127 - DNA, 15 bp, Homo sapiens
ggaaaccttggtgta

SEQ ID NO: 5624128 - DNA, 14 bp, Homo sapiens
ggaaacctttgctt

SEQ ID NO: 5624129 - DNA, 15 bp, Homo sapiens
ggaaacgcacttaca

SEQ ID NO: 5624130 - DNA, 23 bp, Homo sapiens
ggaaacgcagttgtgtggcccag

SEQ ID NO: 5624131 - DNA, 22 bp, Homo sapiens
ggaaacgccccgggcaaagggt

SEQ ID NO: 5624132 - DNA, 23 bp, Homo sapiens
ggaaacgccccgggcaaagggtc

SEQ ID NO: 5624133 - DNA, 23 bp, Homo sapiens
ggaaacggtatcctccctgccca

SEQ ID NO: 5624134 - DNA, 14 bp, Homo sapiens
ggaaactaaaactt

SEQ ID NO: 5624135 - DNA, 19 bp, Homo sapiens
ggaaactaagattctttta

SEQ ID NO: 5624136 - DNA, 15 bp, Homo sapiens
ggaaactaagcattg

SEQ ID NO: 5624137 - DNA, 13 bp, Homo sapiens
ggaaactaataaa

SEQ ID NO: 5624138 - DNA, 17 bp, Homo sapiens
ggaaactaataaaatat

SEQ ID NO: 5624139 - DNA, 17 bp, Homo sapiens
ggaaactaccaggtgtg

SEQ ID NO: 5624140 - DNA, 19 bp, Homo sapiens
ggaaactatgtgtttttct

SEQ ID NO: 5624141 - DNA, 14 bp, Homo sapiens
ggaaactcagatgt

SEQ ID NO: 5624142 - DNA, 16 bp, Homo sapiens
ggaaactcagatgtcc

SEQ ID NO: 5624143 - DNA, 14 bp, Homo sapiens
ggaaactcagggct

SEQ ID NO: 5624144 - DNA, 23 bp, Homo sapiens
ggaaactcatacagtctctattt

SEQ ID NO: 5624145 - DNA, 18 bp, Homo sapiens
ggaaactccacatctgcc

SEQ ID NO: 5624146 - DNA, 15 bp, Homo sapiens
ggaaactctggagag

SEQ ID NO: 5624147 - DNA, 14 bp, Homo sapiens
ggaaactctggtgc

SEQ ID NO: 5624148 - DNA, 20 bp, Homo sapiens
ggaaactctggtgccgggga

SEQ ID NO: 5624149 - DNA, 17 bp, Homo sapiens
ggaaactcttatctcag

SEQ ID NO: 5624150 - DNA, 12 bp, Homo sapiens
ggaaactgaatg

SEQ ID NO: 5624151 - DNA, 20 bp, Homo sapiens
ggaaactgaggtgttatttt

SEQ ID NO: 5624152 - DNA, 13 bp, Homo sapiens
ggaaactgccagc

SEQ ID NO: 5624153 - DNA, 17 bp, Homo sapiens
ggaaactggatgaggtc

SEQ ID NO: 5624154 - DNA, 13 bp, Homo sapiens
ggaaactggctga

SEQ ID NO: 5624155 - DNA, 19 bp, Homo sapiens
ggaaactgggtttctcatt

SEQ ID NO: 5624156 - DNA, 13 bp, Homo sapiens
ggaaactgtgaat

SEQ ID NO: 5624157 - DNA, 16 bp, Homo sapiens
ggaaactgtgaatgct

SEQ ID NO: 5624158 - DNA, 21 bp, Homo sapiens
ggaaacttagcttttgatgtc

SEQ ID NO: 5624159 - DNA, 18 bp, Homo sapiens
ggaaacttgcctttttta

SEQ ID NO: 5624160 - DNA, 17 bp, Homo sapiens
ggaaacttgtcacttgc

SEQ ID NO: 5624161 - DNA, 13 bp, Homo sapiens
ggaaactttattt

SEQ ID NO: 5624162 - DNA, 19 bp, Homo sapiens
ggaaactttatttaaatgc

SEQ ID NO: 5624163 - DNA, 23 bp, Homo sapiens
ggaaactttttccacctttctga

SEQ ID NO: 5624164 - DNA, 14 bp, Homo sapiens
ggaaagaacattta

SEQ ID NO: 5624165 - DNA, 16 bp, Homo sapiens
ggaaagaacatttaaa

SEQ ID NO: 5624166 - DNA, 19 bp, Homo sapiens
ggaaagaagggatccctaa

SEQ ID NO: 5624167 - DNA, 21 bp, Homo sapiens
ggaaagaagggggccctgcta

SEQ ID NO: 5624168 - DNA, 16 bp, Homo sapiens
ggaaagaatataaagt

SEQ ID NO: 5624169 - DNA, 14 bp, Homo sapiens
ggaaagaatttgta

SEQ ID NO: 5624170 - DNA, 23 bp, Homo sapiens
ggaactcccaagaacagcaggcc

SEQ ID NO: 5624171 - DNA, 18 bp, Homo sapiens
ggaactcccccagaggtg

SEQ ID NO: 5624172 - DNA, 20 bp, Homo sapiens
ggaactcccccagaggtgga

SEQ ID NO: 5624173 - DNA, 21 bp, Homo sapiens
ggaactcctaaacctttgccc

SEQ ID NO: 5624174 - DNA, 22 bp, Homo sapiens
ggaactcctaaacctttgcccc

SEQ ID NO: 5624175 - DNA, 15 bp, Homo sapiens
ggaactcctggaaat

SEQ ID NO: 5624176 - DNA, 16 bp, Homo sapiens
ggaactccttggccta

SEQ ID NO: 5624177 - DNA, 16 bp, Homo sapiens
ggaactcgcctcagcc

SEQ ID NO: 5624178 - DNA, 17 bp, Homo sapiens
ggaactcgtgtctggca

SEQ ID NO: 5624179 - DNA, 16 bp, Homo sapiens
ggaactctccctctgg

SEQ ID NO: 5624180 - DNA, 20 bp, Homo sapiens
ggaactctcctgctcctcag

SEQ ID NO: 5624181 - DNA, 16 bp, Homo sapiens
ggaactctgacaaggg

SEQ ID NO: 5624182 - DNA, 21 bp, Homo sapiens
ggaactctgtgtgagagagag

SEQ ID NO: 5624183 - DNA, 14 bp, Homo sapiens
ggaactcttaagca

SEQ ID NO: 5624184 - DNA, 12 bp, Homo sapiens
ggaactgaaatc

SEQ ID NO: 5624185 - DNA, 20 bp, Homo sapiens
ggaactgaccccctcccctg

SEQ ID NO: 5624186 - DNA, 16 bp, Homo sapiens
ggaactgaccctcagg

SEQ ID NO: 5624187 - DNA, 17 bp, Homo sapiens
ggaactgagggcaaggg

SEQ ID NO: 5624188 - DNA, 21 bp, Homo sapiens
ggaactgattgctcccaggat

SEQ ID NO: 5624189 - DNA, 13 bp, Homo sapiens
ggaactgcacact

SEQ ID NO: 5624190 - DNA, 13 bp, Homo sapiens
ggaactgcagacc

SEQ ID NO: 5624191 - DNA, 14 bp, Homo sapiens
ggaactgcagacct

SEQ ID NO: 5624192 - DNA, 13 bp, Homo sapiens
ggaactgccacct

SEQ ID NO: 5624193 - DNA, 14 bp, Homo sapiens
ggaactgccacctt

SEQ ID NO: 5624194 - DNA, 21 bp, Homo sapiens
ggaactgccaccttgggtctg

SEQ ID NO: 5624195 - DNA, 23 bp, Homo sapiens
ggaactgccctactgggagactg

SEQ ID NO: 5624196 - DNA, 16 bp, Homo sapiens
ggaactgctgccactg

SEQ ID NO: 5624197 - DNA, 17 bp, Homo sapiens
ggaactgctgccactga

SEQ ID NO: 5624198 - DNA, 21 bp, Homo sapiens
ggaactgctgccactgagggg

SEQ ID NO: 5624199 - DNA, 13 bp, Homo sapiens
ggaactgctgctg

SEQ ID NO: 5624200 - DNA, 14 bp, Homo sapiens
ggaactgctgggct

SEQ ID NO: 5624201 - DNA, 15 bp, Homo sapiens
ggaactgctgggctt

SEQ ID NO: 5624202 - DNA, 15 bp, Homo sapiens
ggaactggaggcagg

SEQ ID NO: 5624203 - DNA, 22 bp, Homo sapiens
ggaactggccaagctgaggtgc

SEQ ID NO: 5624204 - DNA, 15 bp, Homo sapiens
ggaactgggaagatg

SEQ ID NO: 5624205 - DNA, 16 bp, Homo sapiens
ggaactgggaagatgc

SEQ ID NO: 5624206 - DNA, 17 bp, Homo sapiens
ggaactgggaagatgct

SEQ ID NO: 5624207 - DNA, 22 bp, Homo sapiens
ggaactgggaagatgctggccc

SEQ ID NO: 5624208 - DNA, 13 bp, Homo sapiens
ggaactgggccag

SEQ ID NO: 5624209 - DNA, 17 bp, Homo sapiens
ggaactgggccagcaga

SEQ ID NO: 5624210 - DNA, 14 bp, Homo sapiens
ggaactggtccagg

SEQ ID NO: 5624211 - DNA, 18 bp, Homo sapiens
ggaactggtccaggccag

SEQ ID NO: 5624212 - DNA, 19 bp, Homo sapiens
ggaactggtccaggccagg

SEQ ID NO: 5624213 - DNA, 16 bp, Homo sapiens
ggaactgtccagagag

SEQ ID NO: 5624214 - DNA, 15 bp, Homo sapiens
ggaactgtcccagct

SEQ ID NO: 5624215 - DNA, 23 bp, Homo sapiens
ggaactgtctgaatattctagaa

SEQ ID NO: 5624216 - DNA, 20 bp, Homo sapiens
ggaactgtgcaaagggctgc

SEQ ID NO: 5624217 - DNA, 14 bp, Homo sapiens
ggaactgtggcttt

SEQ ID NO: 5624218 - DNA, 15 bp, Homo sapiens
ggaactgtggctttg

SEQ ID NO: 5624219 - DNA, 13 bp, Homo sapiens
ggaacttaaaaca

SEQ ID NO: 5624220 - DNA, 14 bp, Homo sapiens
ggaacttcagagat

SEQ ID NO: 5624221 - DNA, 15 bp, Homo sapiens
ggaacttctaatata

SEQ ID NO: 5624222 - DNA, 18 bp, Homo sapiens
ggaacttgaactgattca

SEQ ID NO: 5624223 - DNA, 16 bp, Homo sapiens
ggaacttgccctgagc

SEQ ID NO: 5624224 - DNA, 20 bp, Homo sapiens
ggaacttgcctgcctttcca

SEQ ID NO: 5624225 - DNA, 14 bp, Homo sapiens
ggaacttgctgctg

SEQ ID NO: 5624226 - DNA, 17 bp, Homo sapiens
ggaacttgtagccagaa

SEQ ID NO: 5624227 - DNA, 18 bp, Homo sapiens
ggaactttagggggtggg

SEQ ID NO: 5624228 - DNA, 22 bp, Homo sapiens
ggaactttagggggtgggaggg

SEQ ID NO: 5624229 - DNA, 17 bp, Homo sapiens
ggaactttgatacaaat

SEQ ID NO: 5624230 - DNA, 14 bp, Homo sapiens
ggaagaaaaaggaa

SEQ ID NO: 5624231 - DNA, 11 bp, Homo sapiens
ggaagaaaacg

SEQ ID NO: 5624232 - DNA, 16 bp, Homo sapiens
ggaagaaaactatcct

SEQ ID NO: 5624233 - DNA, 14 bp, Homo sapiens
ggaagaaaagagct

SEQ ID NO: 5624234 - DNA, 14 bp, Homo sapiens
ggaagaaaatggtt

SEQ ID NO: 5624235 - DNA, 18 bp, Homo sapiens
ggaagaaaccccaagcag

SEQ ID NO: 5624236 - DNA, 17 bp, Homo sapiens
ggaagaaacctggaacc

SEQ ID NO: 5624237 - DNA, 23 bp, Homo sapiens
ggaagaaacctggaaccagaggg

SEQ ID NO: 5624238 - DNA, 15 bp, Homo sapiens
ggaagaaactgctga

SEQ ID NO: 5624239 - DNA, 12 bp, Homo sapiens
ggaagaaagaag

SEQ ID NO: 5624240 - DNA, 15 bp, Homo sapiens
ggaagaaagaagaca

SEQ ID NO: 5624241 - DNA, 14 bp, Homo sapiens
ggaagaaagaagca

SEQ ID NO: 5624242 - DNA, 19 bp, Homo sapiens
ggaagaaagagaaggagcc

SEQ ID NO: 5624243 - DNA, 18 bp, Homo sapiens
ggaagaaagagcttgagg

SEQ ID NO: 5624244 - DNA, 22 bp, Homo sapiens
ggaagaaagtaggagtggctga

SEQ ID NO: 5624245 - DNA, 16 bp, Homo sapiens
ggaagaaattcaggta

SEQ ID NO: 5624246 - DNA, 18 bp, Homo sapiens
ggaagaaattcctgtagc

SEQ ID NO: 5624247 - DNA, 23 bp, Homo sapiens
ggaagaacaaatatgattctcct

SEQ ID NO: 5624248 - DNA, 16 bp, Homo sapiens
ggaagaacaacaaaga

SEQ ID NO: 5624249 - DNA, 14 bp, Homo sapiens
ggaagaacagcccc

SEQ ID NO: 5624250 - DNA, 15 bp, Homo sapiens
ggaagaacagccccg

SEQ ID NO: 5624251 - DNA, 15 bp, Homo sapiens
ggaagaacaggcctc

SEQ ID NO: 5624252 - DNA, 13 bp, Homo sapiens
ggaagaacagtac

SEQ ID NO: 5624253 - DNA, 14 bp, Homo sapiens
ggaagaacatagaa

SEQ ID NO: 5624254 - DNA, 16 bp, Homo sapiens
ggaagaacatagaact

SEQ ID NO: 5624255 - DNA, 15 bp, Homo sapiens
ggaagaaccagaagt

SEQ ID NO: 5624256 - DNA, 23 bp, Homo sapiens
ggaagaactgcatggggagtaca

SEQ ID NO: 5624257 - DNA, 16 bp, Homo sapiens
ggaagaactgtgataa

SEQ ID NO: 5624258 - DNA, 12 bp, Homo sapiens
ggaagaagaaat

SEQ ID NO: 5624259 - DNA, 19 bp, Homo sapiens
ggaagaagaaccaggcatg

SEQ ID NO: 5624260 - DNA, 20 bp, Homo sapiens
ggaagaagagatcaggaaga

SEQ ID NO: 5624261 - DNA, 14 bp, Homo sapiens
ggaagaagcaaggg

SEQ ID NO: 5624262 - DNA, 19 bp, Homo sapiens
ggaagaagcaagggcaaga

SEQ ID NO: 5624263 - DNA, 13 bp, Homo sapiens
ggaagaagcagcg

SEQ ID NO: 5624264 - DNA, 14 bp, Homo sapiens
ggaagaaggaggaa

SEQ ID NO: 5624265 - DNA, 17 bp, Homo sapiens
ggaagaagggaagcctt

SEQ ID NO: 5624266 - DNA, 16 bp, Homo sapiens
ggaagaagggagaaga

SEQ ID NO: 5624267 - DNA, 19 bp, Homo sapiens
ggaagaatgggctgcagaa

SEQ ID NO: 5624268 - DNA, 11 bp, Homo sapiens
ggaagaattca

SEQ ID NO: 5624269 - DNA, 16 bp, Homo sapiens
ggaagaatttaatgga

SEQ ID NO: 5624270 - DNA, 21 bp, Homo sapiens
ggaagaatttaatggactgtg

SEQ ID NO: 5624271 - DNA, 19 bp, Homo sapiens
ggaagaatttactttggaa

SEQ ID NO: 5624272 - DNA, 19 bp, Homo sapiens
ggaagaattttaaaaatga

SEQ ID NO: 5624273 - DNA, 17 bp, Homo sapiens
ggaagacaaatacacat

SEQ ID NO: 5624274 - DNA, 19 bp, Homo sapiens
ggaagacaaatacacatac

SEQ ID NO: 5624275 - DNA, 16 bp, Homo sapiens
ggaagacaatgtgaaa

SEQ ID NO: 5624276 - DNA, 16 bp, Homo sapiens
ggaagacacttgctga

SEQ ID NO: 5624277 - DNA, 13 bp, Homo sapiens
ggaagacagagat

SEQ ID NO: 5624278 - DNA, 17 bp, Homo sapiens
ggaagacagagcaggct

SEQ ID NO: 5624279 - DNA, 13 bp, Homo sapiens
ggaagacagctct

SEQ ID NO: 5624280 - DNA, 23 bp, Homo sapiens
ggaagacatttcttttcttttta

SEQ ID NO: 5624281 - DNA, 19 bp, Homo sapiens
ggaagaccaaaggaaggaa

SEQ ID NO: 5624282 - DNA, 16 bp, Homo sapiens
ggaagaccaaggcctc

SEQ ID NO: 5624283 - DNA, 21 bp, Homo sapiens
ggaagaccaaggcctcggcag

SEQ ID NO: 5624284 - DNA, 23 bp, Homo sapiens
ggaagaccagaattcccttgaat

SEQ ID NO: 5624285 - DNA, 17 bp, Homo sapiens
ggaagacccattccttc

SEQ ID NO: 5624286 - DNA, 23 bp, Homo sapiens
ggaagaccccacccaagcttggc

SEQ ID NO: 5624287 - DNA, 18 bp, Homo sapiens
ggaagaccctcagttatt

SEQ ID NO: 5624288 - DNA, 14 bp, Homo sapiens
ggaagacctaaggc

SEQ ID NO: 5624289 - DNA, 12 bp, Homo sapiens
ggaagacctgaa

SEQ ID NO: 5624290 - DNA, 14 bp, Homo sapiens
ggaagacctggcaa

SEQ ID NO: 5624291 - DNA, 16 bp, Homo sapiens
ggaagacgaggccctc

SEQ ID NO: 5624292 - DNA, 18 bp, Homo sapiens
ggaagacgcaagggcctg

SEQ ID NO: 5624293 - DNA, 15 bp, Homo sapiens
ggaagacgcagagca

SEQ ID NO: 5624294 - DNA, 15 bp, Homo sapiens
ggaagacgcctgagc

SEQ ID NO: 5624295 - DNA, 18 bp, Homo sapiens
ggaagactcaggagtctg

SEQ ID NO: 5624296 - DNA, 22 bp, Homo sapiens
ggaagactcaggagtctgccac

SEQ ID NO: 5624297 - DNA, 13 bp, Homo sapiens
ggaagactggaga

SEQ ID NO: 5624298 - DNA, 19 bp, Homo sapiens
ggaagactggagactgtcc

SEQ ID NO: 5624299 - DNA, 20 bp, Homo sapiens
ggaagacttcatccctctgg

SEQ ID NO: 5624300 - DNA, 13 bp, Homo sapiens
ggaagactttgga

SEQ ID NO: 5624301 - DNA, 21 bp, Homo sapiens
ggaagacttttggtagagaag

SEQ ID NO: 5624302 - DNA, 14 bp, Homo sapiens
ggaagagaaacagg

SEQ ID NO: 5624303 - DNA, 13 bp, Homo sapiens
ggaagagaaatac

SEQ ID NO: 5624304 - DNA, 15 bp, Homo sapiens
ggaagagaagagaaa

SEQ ID NO: 5624305 - DNA, 21 bp, Homo sapiens
ggaagagacaaagtgggtgtg

SEQ ID NO: 5624306 - DNA, 16 bp, Homo sapiens
ggaagagacagcccag

SEQ ID NO: 5624307 - DNA, 16 bp, Homo sapiens
ggaagagacatgagaa

SEQ ID NO: 5624308 - DNA, 21 bp, Homo sapiens
ggaagagacatgagaaaggga

SEQ ID NO: 5624309 - DNA, 18 bp, Homo sapiens
ggaagagagagagagagg

SEQ ID NO: 5624310 - DNA, 19 bp, Homo sapiens
ggaagagagagagagaggt

SEQ ID NO: 5624311 - DNA, 18 bp, Homo sapiens
ggaagagagaggcctggg

SEQ ID NO: 5624312 - DNA, 18 bp, Homo sapiens
ggaagagagcctgcagga

SEQ ID NO: 5624313 - DNA, 18 bp, Homo sapiens
ggaagagaggagttcaat

SEQ ID NO: 5624314 - DNA, 12 bp, Homo sapiens
ggaagagaggca

SEQ ID NO: 5624315 - DNA, 18 bp, Homo sapiens
ggaagagaggcacctgct

SEQ ID NO: 5624316 - DNA, 19 bp, Homo sapiens
ggaagagaggcacctgctg

SEQ ID NO: 5624317 - DNA, 15 bp, Homo sapiens
ggaagagagggctga

SEQ ID NO: 5624318 - DNA, 17 bp, Homo sapiens
ggaagagatccaaagac

SEQ ID NO: 5624319 - DNA, 18 bp, Homo sapiens
ggaagagatccaaagact

SEQ ID NO: 5624320 - DNA, 20 bp, Homo sapiens
ggaagagattcctattactg

SEQ ID NO: 5624321 - DNA, 14 bp, Homo sapiens
ggaagagcacagcc

SEQ ID NO: 5624322 - DNA, 16 bp, Homo sapiens
ggaagagcacagccct

SEQ ID NO: 5624323 - DNA, 19 bp, Homo sapiens
ggaagagcagaacggagcc

SEQ ID NO: 5624324 - DNA, 22 bp, Homo sapiens
ggaagagcagcacctcctcagc

SEQ ID NO: 5624325 - DNA, 14 bp, Homo sapiens
ggaagagcaggcac

SEQ ID NO: 5624326 - DNA, 21 bp, Homo sapiens
ggaagagcaggtgactgtgct

SEQ ID NO: 5624327 - DNA, 17 bp, Homo sapiens
ggaagagccaaagaata

SEQ ID NO: 5624328 - DNA, 12 bp, Homo sapiens
ggaagagccacc

SEQ ID NO: 5624329 - DNA, 16 bp, Homo sapiens
ggaagagccacctgca

SEQ ID NO: 5624330 - DNA, 20 bp, Homo sapiens
ggaagagcccagtctgttga

SEQ ID NO: 5624331 - DNA, 18 bp, Homo sapiens
ggaagagccgagcacctg

SEQ ID NO: 5624332 - DNA, 13 bp, Homo sapiens
ggaagagccttgc

SEQ ID NO: 5624333 - DNA, 14 bp, Homo sapiens
ggaagagcctttat

SEQ ID NO: 5624334 - DNA, 22 bp, Homo sapiens
ggaagagctcccctccacagct

SEQ ID NO: 5624335 - DNA, 14 bp, Homo sapiens
ggaagaggagatgt

SEQ ID NO: 5624336 - DNA, 14 bp, Homo sapiens
ggaagaggagcctg

SEQ ID NO: 5624337 - DNA, 22 bp, Homo sapiens
ggaagaggcatcgcctgcagga

SEQ ID NO: 5624338 - DNA, 11 bp, Homo sapiens
ggaagaggccg

SEQ ID NO: 5624339 - DNA, 18 bp, Homo sapiens
ggaagaggccgctgcagg

SEQ ID NO: 5624340 - DNA, 22 bp, Homo sapiens
ggaagaggccgctgcagggtgg

SEQ ID NO: 5624341 - DNA, 16 bp, Homo sapiens
ggaagagggaaatgta

SEQ ID NO: 5624342 - DNA, 14 bp, Homo sapiens
ggaagagggagggg

SEQ ID NO: 5624343 - DNA, 20 bp, Homo sapiens
ggaagagggagggtcagtgc

SEQ ID NO: 5624344 - DNA, 16 bp, Homo sapiens
ggaagagggctgagct

SEQ ID NO: 5624345 - DNA, 19 bp, Homo sapiens
ggaagagggctgagctgag

SEQ ID NO: 5624346 - DNA, 14 bp, Homo sapiens
ggaagaggggacag

SEQ ID NO: 5624347 - DNA, 16 bp, Homo sapiens
ggaagaggtaattttt

SEQ ID NO: 5624348 - DNA, 16 bp, Homo sapiens
ggaagaggttctcagc

SEQ ID NO: 5624349 - DNA, 19 bp, Homo sapiens
ggaagaggttgcagtgagc

SEQ ID NO: 5624350 - DNA, 22 bp, Homo sapiens
ggacacactaaactctggggct

SEQ ID NO: 5624351 - DNA, 12 bp, Homo sapiens
ggacacactaat

SEQ ID NO: 5624352 - DNA, 19 bp, Homo sapiens
ggacacactgtaaacccct

SEQ ID NO: 5624353 - DNA, 11 bp, Homo sapiens
ggacacagacc

SEQ ID NO: 5624354 - DNA, 17 bp, Homo sapiens
ggacacagacccaggac

SEQ ID NO: 5624355 - DNA, 11 bp, Homo sapiens
ggacacagagg

SEQ ID NO: 5624356 - DNA, 23 bp, Homo sapiens
ggacacagaggacagcttcccca

SEQ ID NO: 5624357 - DNA, 23 bp, Homo sapiens
ggacacagaggacggcttcccca

SEQ ID NO: 5624358 - DNA, 14 bp, Homo sapiens
ggacacagatcccg

SEQ ID NO: 5624359 - DNA, 16 bp, Homo sapiens
ggacacagatcccggg

SEQ ID NO: 5624360 - DNA, 16 bp, Homo sapiens
ggacacagatgaaaca

SEQ ID NO: 5624361 - DNA, 21 bp, Homo sapiens
ggacacagcacaagggcacat

SEQ ID NO: 5624362 - DNA, 14 bp, Homo sapiens
ggacacagcagtat

SEQ ID NO: 5624363 - DNA, 16 bp, Homo sapiens
ggacacagcagtattg

SEQ ID NO: 5624364 - DNA, 18 bp, Homo sapiens
ggacacagcatcagctca

SEQ ID NO: 5624365 - DNA, 22 bp, Homo sapiens
ggacacagcccaccctctgtga

SEQ ID NO: 5624366 - DNA, 11 bp, Homo sapiens
ggacacagctc

SEQ ID NO: 5624367 - DNA, 20 bp, Homo sapiens
ggacacagctcttcattcca

SEQ ID NO: 5624368 - DNA, 18 bp, Homo sapiens
ggacacagctcttctcca

SEQ ID NO: 5624369 - DNA, 23 bp, Homo sapiens
ggacacagcttaacaatgcaact

SEQ ID NO: 5624370 - DNA, 17 bp, Homo sapiens
ggacacaggagaccacc

SEQ ID NO: 5624371 - DNA, 12 bp, Homo sapiens
ggacacaggcct

SEQ ID NO: 5624372 - DNA, 16 bp, Homo sapiens
ggacacaggcctgtgt

SEQ ID NO: 5624373 - DNA, 20 bp, Homo sapiens
ggacacagtttctattgtaa

SEQ ID NO: 5624374 - DNA, 15 bp, Homo sapiens
ggacacatcacatac

SEQ ID NO: 5624375 - DNA, 19 bp, Homo sapiens
ggacacatcccggcctctt

SEQ ID NO: 5624376 - DNA, 13 bp, Homo sapiens
ggacacatgtcca

SEQ ID NO: 5624377 - DNA, 19 bp, Homo sapiens
ggacacatgtccagtggga

SEQ ID NO: 5624378 - DNA, 21 bp, Homo sapiens
ggacacattggaatgccttgg

SEQ ID NO: 5624379 - DNA, 16 bp, Homo sapiens
ggacacattttctcct

SEQ ID NO: 5624380 - DNA, 21 bp, Homo sapiens
ggacacattttctcctaggag

SEQ ID NO: 5624381 - DNA, 23 bp, Homo sapiens
ggacacattttctcctaggagaa

SEQ ID NO: 5624382 - DNA, 22 bp, Homo sapiens
ggacaccaatggctgcatcaaa

SEQ ID NO: 5624383 - DNA, 18 bp, Homo sapiens
ggacaccacacccagcct

SEQ ID NO: 5624384 - DNA, 16 bp, Homo sapiens
ggacaccacccagagc

SEQ ID NO: 5624385 - DNA, 22 bp, Homo sapiens
ggacaccacccagagcaccctc

SEQ ID NO: 5624386 - DNA, 19 bp, Homo sapiens
ggacaccagccaggctctg

SEQ ID NO: 5624387 - DNA, 20 bp, Homo sapiens
ggacaccagccaggctctgt

SEQ ID NO: 5624388 - DNA, 13 bp, Homo sapiens
ggacaccaggagt

SEQ ID NO: 5624389 - DNA, 23 bp, Homo sapiens
ggacaccatcccctcctagcaca

SEQ ID NO: 5624390 - DNA, 19 bp, Homo sapiens
ggacaccatgttcccagct

SEQ ID NO: 5624391 - DNA, 16 bp, Homo sapiens
ggacacccagggtcta

SEQ ID NO: 5624392 - DNA, 23 bp, Homo sapiens
ggacaccccagaatcccctgggg

SEQ ID NO: 5624393 - DNA, 15 bp, Homo sapiens
ggacacccccagctg

SEQ ID NO: 5624394 - DNA, 20 bp, Homo sapiens
ggacaccccccaccatggtg

SEQ ID NO: 5624395 - DNA, 21 bp, Homo sapiens
ggacaccccccgccccccacc

SEQ ID NO: 5624396 - DNA, 22 bp, Homo sapiens
ggacaccccccgccccccacct

SEQ ID NO: 5624397 - DNA, 21 bp, Homo sapiens
ggacacccctacacacaccca

SEQ ID NO: 5624398 - DNA, 14 bp, Homo sapiens
ggacacccctgctc

SEQ ID NO: 5624399 - DNA, 21 bp, Homo sapiens
ggacaccccttatccaggact

SEQ ID NO: 5624400 - DNA, 12 bp, Homo sapiens
ggacaccctccc

SEQ ID NO: 5624401 - DNA, 21 bp, Homo sapiens
ggacaccctccctccagggtc

SEQ ID NO: 5624402 - DNA, 15 bp, Homo sapiens
ggacaccctctgccg

SEQ ID NO: 5624403 - DNA, 23 bp, Homo sapiens
ggacaccctgtgatggggccctg

SEQ ID NO: 5624404 - DNA, 18 bp, Homo sapiens
ggacaccgctcagtatta

SEQ ID NO: 5624405 - DNA, 15 bp, Homo sapiens
ggacaccgtggcctg

SEQ ID NO: 5624406 - DNA, 17 bp, Homo sapiens
ggacaccgtggggaagg

SEQ ID NO: 5624407 - DNA, 18 bp, Homo sapiens
ggacaccgtggggaaggg

SEQ ID NO: 5624408 - DNA, 19 bp, Homo sapiens
ggacaccgtggggaagggg

SEQ ID NO: 5624409 - DNA, 22 bp, Homo sapiens
ggacaccgtggggaaggggtgc

SEQ ID NO: 5624410 - DNA, 14 bp, Homo sapiens
ggacacctcccagg

SEQ ID NO: 5624411 - DNA, 15 bp, Homo sapiens
ggacacctcccaggg

SEQ ID NO: 5624412 - DNA, 12 bp, Homo sapiens
ggacacctcgcc

SEQ ID NO: 5624413 - DNA, 23 bp, Homo sapiens
ggacacctcgcccttcagcccac

SEQ ID NO: 5624414 - DNA, 12 bp, Homo sapiens
ggacacctgccc

SEQ ID NO: 5624415 - DNA, 22 bp, Homo sapiens
ggacacctgccccagcgcggct

SEQ ID NO: 5624416 - DNA, 14 bp, Homo sapiens
ggacacctgccctg

SEQ ID NO: 5624417 - DNA, 17 bp, Homo sapiens
ggacacctggccgcctc

SEQ ID NO: 5624418 - DNA, 23 bp, Homo sapiens
ggacacctggccgcctccaggag

SEQ ID NO: 5624419 - DNA, 17 bp, Homo sapiens
ggacacctgtacattct

SEQ ID NO: 5624420 - DNA, 19 bp, Homo sapiens
ggacacgaaggctgcccct

SEQ ID NO: 5624421 - DNA, 16 bp, Homo sapiens
ggacacgagccacaag

SEQ ID NO: 5624422 - DNA, 21 bp, Homo sapiens
ggacacgagccacaagctgca

SEQ ID NO: 5624423 - DNA, 22 bp, Homo sapiens
ggacacgagccacaagctgcac

SEQ ID NO: 5624424 - DNA, 23 bp, Homo sapiens
ggacacgagccacaagctgcact

SEQ ID NO: 5624425 - DNA, 23 bp, Homo sapiens
ggacacgcgcccccctcccagag

SEQ ID NO: 5624426 - DNA, 13 bp, Homo sapiens
ggacacggcctct

SEQ ID NO: 5624427 - DNA, 20 bp, Homo sapiens
ggacacggcttcactgacca

SEQ ID NO: 5624428 - DNA, 22 bp, Homo sapiens
ggacacggcttcactgaccagc

SEQ ID NO: 5624429 - DNA, 21 bp, Homo sapiens
ggacacggtttaactgtccca

SEQ ID NO: 5624430 - DNA, 22 bp, Homo sapiens
ggacactaaccacgctggacct

SEQ ID NO: 5624431 - DNA, 18 bp, Homo sapiens
ggacactacacccagcaa

SEQ ID NO: 5624432 - DNA, 19 bp, Homo sapiens
ggacactacacgtttcaac

SEQ ID NO: 5624433 - DNA, 13 bp, Homo sapiens
ggacactaggaga

SEQ ID NO: 5624434 - DNA, 17 bp, Homo sapiens
ggacactagggtcaggc

SEQ ID NO: 5624435 - DNA, 14 bp, Homo sapiens
ggacactccaggga

SEQ ID NO: 5624436 - DNA, 18 bp, Homo sapiens
ggacactccagggacaca

SEQ ID NO: 5624437 - DNA, 23 bp, Homo sapiens
ggacactcctcctcggaagagcc

SEQ ID NO: 5624438 - DNA, 20 bp, Homo sapiens
ggacactcgtcaccccagcc

SEQ ID NO: 5624439 - DNA, 19 bp, Homo sapiens
ggacactgaaccttgttga

SEQ ID NO: 5624440 - DNA, 17 bp, Homo sapiens
ggacactgacaaagtca

SEQ ID NO: 5624441 - DNA, 23 bp, Homo sapiens
ggacactgatgggtcctgctgct

SEQ ID NO: 5624442 - DNA, 17 bp, Homo sapiens
ggacactgccttagcct

SEQ ID NO: 5624443 - DNA, 14 bp, Homo sapiens
ggacactgcctttg

SEQ ID NO: 5624444 - DNA, 13 bp, Homo sapiens
ggacactggcccc

SEQ ID NO: 5624445 - DNA, 15 bp, Homo sapiens
ggacactggggtctg

SEQ ID NO: 5624446 - DNA, 17 bp, Homo sapiens
ggacactgtcagtgcta

SEQ ID NO: 5624447 - DNA, 21 bp, Homo sapiens
ggacactgtggcagcaggagg

SEQ ID NO: 5624448 - DNA, 16 bp, Homo sapiens
ggacacttaatactac

SEQ ID NO: 5624449 - DNA, 21 bp, Homo sapiens
ggacacttccctctgtttctc

SEQ ID NO: 5624450 - DNA, 16 bp, Homo sapiens
ggacacttcctgccta

SEQ ID NO: 5624451 - DNA, 13 bp, Homo sapiens
ggacacttcttta

SEQ ID NO: 5624452 - DNA, 21 bp, Homo sapiens
ggacacttggttagacgcctt

SEQ ID NO: 5624453 - DNA, 12 bp, Homo sapiens
ggacactttgtt

SEQ ID NO: 5624454 - DNA, 15 bp, Homo sapiens
ggacactttgttaga

SEQ ID NO: 5624455 - DNA, 16 bp, Homo sapiens
ggacacttttgaggac

SEQ ID NO: 5624456 - DNA, 14 bp, Homo sapiens
ggacagaaagagac

SEQ ID NO: 5624457 - DNA, 21 bp, Homo sapiens
ggacagaacattgccttcctc

SEQ ID NO: 5624458 - DNA, 23 bp, Homo sapiens
ggacagaactgaacgtcctgcag

SEQ ID NO: 5624459 - DNA, 16 bp, Homo sapiens
ggacagaagcaggagt

SEQ ID NO: 5624460 - DNA, 16 bp, Homo sapiens
ggacagaagcttgtgg

SEQ ID NO: 5624461 - DNA, 16 bp, Homo sapiens
ggacagaatgatggac

SEQ ID NO: 5624462 - DNA, 14 bp, Homo sapiens
ggacagacacagag

SEQ ID NO: 5624463 - DNA, 12 bp, Homo sapiens
ggacagacacct

SEQ ID NO: 5624464 - DNA, 15 bp, Homo sapiens
ggacagacacctccc

SEQ ID NO: 5624465 - DNA, 14 bp, Homo sapiens
ggacagacactgtt

SEQ ID NO: 5624466 - DNA, 18 bp, Homo sapiens
ggacagacactgttgcaa

SEQ ID NO: 5624467 - DNA, 13 bp, Homo sapiens
ggacagacagcag

SEQ ID NO: 5624468 - DNA, 21 bp, Homo sapiens
ggacagaccagcagcaatctg

SEQ ID NO: 5624469 - DNA, 13 bp, Homo sapiens
ggacagaccagcc

SEQ ID NO: 5624470 - DNA, 15 bp, Homo sapiens
ggacagaccagccct

SEQ ID NO: 5624471 - DNA, 23 bp, Homo sapiens
ggacagacccacccccagccttg

SEQ ID NO: 5624472 - DNA, 12 bp, Homo sapiens
ggacagacccag

SEQ ID NO: 5624473 - DNA, 18 bp, Homo sapiens
ggacagacccaggtcttc

SEQ ID NO: 5624474 - DNA, 15 bp, Homo sapiens
ggacagacctggaca

SEQ ID NO: 5624475 - DNA, 14 bp, Homo sapiens
ggacagactggccg

SEQ ID NO: 5624476 - DNA, 14 bp, Homo sapiens
ggacagagaacttt

SEQ ID NO: 5624477 - DNA, 17 bp, Homo sapiens
ggacagagaagatgact

SEQ ID NO: 5624478 - DNA, 17 bp, Homo sapiens
ggacagagacacctgca

SEQ ID NO: 5624479 - DNA, 21 bp, Homo sapiens
ggacagagcaagaccctgcct

SEQ ID NO: 5624480 - DNA, 20 bp, Homo sapiens
ggacagagcaggggctccag

SEQ ID NO: 5624481 - DNA, 16 bp, Homo sapiens
ggacagagccagcggc

SEQ ID NO: 5624482 - DNA, 19 bp, Homo sapiens
ggacagagccagcggctcc

SEQ ID NO: 5624483 - DNA, 13 bp, Homo sapiens
ggacagagccccc

SEQ ID NO: 5624484 - DNA, 22 bp, Homo sapiens
ggacagagcccgggagagactc

SEQ ID NO: 5624485 - DNA, 15 bp, Homo sapiens
ggacagagctgagga

SEQ ID NO: 5624486 - DNA, 17 bp, Homo sapiens
ggacagaggatttctgc

SEQ ID NO: 5624487 - DNA, 15 bp, Homo sapiens
ggacagaggccaagg

SEQ ID NO: 5624488 - DNA, 19 bp, Homo sapiens
ggacagaggccaaggactg

SEQ ID NO: 5624489 - DNA, 14 bp, Homo sapiens
ggacagaggcccca

SEQ ID NO: 5624490 - DNA, 16 bp, Homo sapiens
ggacagaggccccagc

SEQ ID NO: 5624491 - DNA, 17 bp, Homo sapiens
ggacagaggccccagcc

SEQ ID NO: 5624492 - DNA, 18 bp, Homo sapiens
ggacagaggccccagcct

SEQ ID NO: 5624493 - DNA, 14 bp, Homo sapiens
ggacagaggccggg

SEQ ID NO: 5624494 - DNA, 22 bp, Homo sapiens
ggacagaggcggggctacagat

SEQ ID NO: 5624495 - DNA, 22 bp, Homo sapiens
ggacagagggaagccagtcagg

SEQ ID NO: 5624496 - DNA, 14 bp, Homo sapiens
ggacagagggcaca

SEQ ID NO: 5624497 - DNA, 18 bp, Homo sapiens
ggacagagggcacatgaa

SEQ ID NO: 5624498 - DNA, 16 bp, Homo sapiens
ggacagaggggcaggg

SEQ ID NO: 5624499 - DNA, 20 bp, Homo sapiens
ggacagagggggtggcctcc

SEQ ID NO: 5624500 - DNA, 17 bp, Homo sapiens
ggacagagttcacagga

SEQ ID NO: 5624501 - DNA, 23 bp, Homo sapiens
ggacagagttcagggaggggctg

SEQ ID NO: 5624502 - DNA, 19 bp, Homo sapiens
ggacagatcaatggcgcag

SEQ ID NO: 5624503 - DNA, 23 bp, Homo sapiens
ggacagatccagggactgaagcc

SEQ ID NO: 5624504 - DNA, 15 bp, Homo sapiens
ggacagatgcctcct

SEQ ID NO: 5624505 - DNA, 12 bp, Homo sapiens
ggacagatggac

SEQ ID NO: 5624506 - DNA, 19 bp, Homo sapiens
ggacagatggaccaaaaga

SEQ ID NO: 5624507 - DNA, 22 bp, Homo sapiens
ggacagatggacgcaggccctg

SEQ ID NO: 5624508 - DNA, 16 bp, Homo sapiens
ggacagattcagtctt

SEQ ID NO: 5624509 - DNA, 18 bp, Homo sapiens
ggacagattcagtcttgc

SEQ ID NO: 5624510 - DNA, 19 bp, Homo sapiens
ggacagatttcagtaatgt

SEQ ID NO: 5624511 - DNA, 19 bp, Homo sapiens
ggacagatttgaggactga

SEQ ID NO: 5624512 - DNA, 14 bp, Homo sapiens
ggacagcacacggt

SEQ ID NO: 5624513 - DNA, 15 bp, Homo sapiens
ggacagcagaagcct

SEQ ID NO: 5624514 - DNA, 17 bp, Homo sapiens
ggacagcagattccaca

SEQ ID NO: 5624515 - DNA, 11 bp, Homo sapiens
ggacagcagct

SEQ ID NO: 5624516 - DNA, 13 bp, Homo sapiens
ggacagcagctgg

SEQ ID NO: 5624517 - DNA, 23 bp, Homo sapiens
ggacagcagctggactgggtggg

SEQ ID NO: 5624518 - DNA, 19 bp, Homo sapiens
ggacagcagctggtgcccc

SEQ ID NO: 5624519 - DNA, 19 bp, Homo sapiens
ggacagccacggccaggcc

SEQ ID NO: 5624520 - DNA, 17 bp, Homo sapiens
ggacagccagggcaggg

SEQ ID NO: 5624521 - DNA, 21 bp, Homo sapiens
ggacagcccacggtctggagg

SEQ ID NO: 5624522 - DNA, 22 bp, Homo sapiens
ggacagcccacggtctggaggc

SEQ ID NO: 5624523 - DNA, 14 bp, Homo sapiens
ggacagcccagagc

SEQ ID NO: 5624524 - DNA, 17 bp, Homo sapiens
ggacagcccagagcctg

SEQ ID NO: 5624525 - DNA, 21 bp, Homo sapiens
ggacagcccagagcctggctg

SEQ ID NO: 5624526 - DNA, 19 bp, Homo sapiens
ggacagcccatctgcctgt

SEQ ID NO: 5624527 - DNA, 20 bp, Homo sapiens
ggacccggcggccctgctga

SEQ ID NO: 5624528 - DNA, 20 bp, Homo sapiens
ggacccgggaccacagctgc

SEQ ID NO: 5624529 - DNA, 19 bp, Homo sapiens
ggacccggggtctcctgga

SEQ ID NO: 5624530 - DNA, 21 bp, Homo sapiens
ggacccggggtctcctggacc

SEQ ID NO: 5624531 - DNA, 19 bp, Homo sapiens
ggacccgttcatgggggag

SEQ ID NO: 5624532 - DNA, 14 bp, Homo sapiens
ggaccctcagcagc

SEQ ID NO: 5624533 - DNA, 16 bp, Homo sapiens
ggaccctcagcagctc

SEQ ID NO: 5624534 - DNA, 20 bp, Homo sapiens
ggaccctcagccccaggaga

SEQ ID NO: 5624535 - DNA, 16 bp, Homo sapiens
ggaccctccaaggcca

SEQ ID NO: 5624536 - DNA, 17 bp, Homo sapiens
ggaccctccaaggccag

SEQ ID NO: 5624537 - DNA, 18 bp, Homo sapiens
ggaccctccaaggccagg

SEQ ID NO: 5624538 - DNA, 19 bp, Homo sapiens
ggaccctccactcactgct

SEQ ID NO: 5624539 - DNA, 14 bp, Homo sapiens
ggaccctcccaggt

SEQ ID NO: 5624540 - DNA, 22 bp, Homo sapiens
ggaccctcccaggtttcccact

SEQ ID NO: 5624541 - DNA, 20 bp, Homo sapiens
ggaccctcgcagcaggtgca

SEQ ID NO: 5624542 - DNA, 15 bp, Homo sapiens
ggaccctcgctggcc

SEQ ID NO: 5624543 - DNA, 17 bp, Homo sapiens
ggaccctcgctggcccc

SEQ ID NO: 5624544 - DNA, 14 bp, Homo sapiens
ggaccctgaaatgt

SEQ ID NO: 5624545 - DNA, 13 bp, Homo sapiens
ggaccctgaaggg

SEQ ID NO: 5624546 - DNA, 11 bp, Homo sapiens
ggaccctgacc

SEQ ID NO: 5624547 - DNA, 11 bp, Homo sapiens
ggaccctgagg

SEQ ID NO: 5624548 - DNA, 18 bp, Homo sapiens
ggaccctgccaggcacag

SEQ ID NO: 5624549 - DNA, 22 bp, Homo sapiens
ggaccctgccaggcacaggcag

SEQ ID NO: 5624550 - DNA, 15 bp, Homo sapiens
ggaccctgcctcagc

SEQ ID NO: 5624551 - DNA, 16 bp, Homo sapiens
ggaccctgcctcagct

SEQ ID NO: 5624552 - DNA, 14 bp, Homo sapiens
ggaccctgctgact

SEQ ID NO: 5624553 - DNA, 13 bp, Homo sapiens
ggaccctgggccc

SEQ ID NO: 5624554 - DNA, 12 bp, Homo sapiens
ggaccctgtccg

SEQ ID NO: 5624555 - DNA, 16 bp, Homo sapiens
ggaccctgtgacatgg

SEQ ID NO: 5624556 - DNA, 13 bp, Homo sapiens
ggaccctgttgct

SEQ ID NO: 5624557 - DNA, 18 bp, Homo sapiens
ggaccctgttttccacac

SEQ ID NO: 5624558 - DNA, 20 bp, Homo sapiens
ggacccttctactttttcct

SEQ ID NO: 5624559 - DNA, 12 bp, Homo sapiens
ggacccttgcct

SEQ ID NO: 5624560 - DNA, 18 bp, Homo sapiens
ggacccttgcctgcctcc

SEQ ID NO: 5624561 - DNA, 18 bp, Homo sapiens
ggaccctttttgttatga

SEQ ID NO: 5624562 - DNA, 16 bp, Homo sapiens
ggaccgaaggtgacag

SEQ ID NO: 5624563 - DNA, 15 bp, Homo sapiens
ggaccgagatgtgag

SEQ ID NO: 5624564 - DNA, 23 bp, Homo sapiens
ggaccgagatgtgagtcctgttg

SEQ ID NO: 5624565 - DNA, 14 bp, Homo sapiens
ggaccgaggaacaa

SEQ ID NO: 5624566 - DNA, 16 bp, Homo sapiens
ggaccgagtagaggca

SEQ ID NO: 5624567 - DNA, 14 bp, Homo sapiens
ggaccgcatcctcc

SEQ ID NO: 5624568 - DNA, 16 bp, Homo sapiens
ggaccgcatcctccag

SEQ ID NO: 5624569 - DNA, 15 bp, Homo sapiens
ggaccgccagatggg

SEQ ID NO: 5624570 - DNA, 16 bp, Homo sapiens
ggaccgccccaaccct

SEQ ID NO: 5624571 - DNA, 18 bp, Homo sapiens
ggaccgcccttttcccct

SEQ ID NO: 5624572 - DNA, 13 bp, Homo sapiens
ggaccgcctggcc

SEQ ID NO: 5624573 - DNA, 16 bp, Homo sapiens
ggaccgcctggccctc

SEQ ID NO: 5624574 - DNA, 11 bp, Homo sapiens
ggaccggacgc

SEQ ID NO: 5624575 - DNA, 19 bp, Homo sapiens
ggaccggagagtgggggtg

SEQ ID NO: 5624576 - DNA, 19 bp, Homo sapiens
ggaccggagcggctgagga

SEQ ID NO: 5624577 - DNA, 19 bp, Homo sapiens
ggaccggccgcagccccca

SEQ ID NO: 5624578 - DNA, 22 bp, Homo sapiens
ggaccggccgcagcccccactg

SEQ ID NO: 5624579 - DNA, 20 bp, Homo sapiens
ggaccgggcccctctctagg

SEQ ID NO: 5624580 - DNA, 23 bp, Homo sapiens
ggaccgggccgctagatgggcat

SEQ ID NO: 5624581 - DNA, 18 bp, Homo sapiens
ggaccggggccttggtcc

SEQ ID NO: 5624582 - DNA, 17 bp, Homo sapiens
ggaccgggtgggcctgg

SEQ ID NO: 5624583 - DNA, 18 bp, Homo sapiens
ggaccgggtgggcctggc

SEQ ID NO: 5624584 - DNA, 20 bp, Homo sapiens
ggaccgggtgggcctggcct

SEQ ID NO: 5624585 - DNA, 22 bp, Homo sapiens
ggaccgggtgggcctggcctga

SEQ ID NO: 5624586 - DNA, 13 bp, Homo sapiens
ggaccggttccca

SEQ ID NO: 5624587 - DNA, 21 bp, Homo sapiens
ggaccggttcccacaagcctg

SEQ ID NO: 5624588 - DNA, 17 bp, Homo sapiens
ggaccgtcccctgccca

SEQ ID NO: 5624589 - DNA, 21 bp, Homo sapiens
ggaccgtctttacccctgctg

SEQ ID NO: 5624590 - DNA, 17 bp, Homo sapiens
ggaccgtgcgagctgcc

SEQ ID NO: 5624591 - DNA, 15 bp, Homo sapiens
ggaccgtggacaggc

SEQ ID NO: 5624592 - DNA, 18 bp, Homo sapiens
ggaccgtggacaggccca

SEQ ID NO: 5624593 - DNA, 20 bp, Homo sapiens
ggaccgtggacaggcccagc

SEQ ID NO: 5624594 - DNA, 17 bp, Homo sapiens
ggacctaatgctggcct

SEQ ID NO: 5624595 - DNA, 16 bp, Homo sapiens
ggacctacctccctcc

SEQ ID NO: 5624596 - DNA, 19 bp, Homo sapiens
ggacctactgaacccagag

SEQ ID NO: 5624597 - DNA, 22 bp, Homo sapiens
ggacctagcctggatggcccct

SEQ ID NO: 5624598 - DNA, 13 bp, Homo sapiens
ggacctaggctcc

SEQ ID NO: 5624599 - DNA, 15 bp, Homo sapiens
ggacctaggctcctc

SEQ ID NO: 5624600 - DNA, 22 bp, Homo sapiens
ggacctagggaggcatggtctg

SEQ ID NO: 5624601 - DNA, 23 bp, Homo sapiens
ggacctagggaggcatggtctgc

SEQ ID NO: 5624602 - DNA, 21 bp, Homo sapiens
ggacctatacagaacagaggg

SEQ ID NO: 5624603 - DNA, 16 bp, Homo sapiens
ggacctatgcagggag

SEQ ID NO: 5624604 - DNA, 17 bp, Homo sapiens
ggacctatgcagggagg

SEQ ID NO: 5624605 - DNA, 20 bp, Homo sapiens
ggacctatgcagggaggcca

SEQ ID NO: 5624606 - DNA, 17 bp, Homo sapiens
ggacctatgtcctaagg

SEQ ID NO: 5624607 - DNA, 13 bp, Homo sapiens
ggacctcagcaag

SEQ ID NO: 5624608 - DNA, 16 bp, Homo sapiens
ggacctcagcaagctg

SEQ ID NO: 5624609 - DNA, 19 bp, Homo sapiens
ggacctcagcaagctgccc

SEQ ID NO: 5624610 - DNA, 15 bp, Homo sapiens
ggacctcagcctgca

SEQ ID NO: 5624611 - DNA, 16 bp, Homo sapiens
ggacctcagcctgcac

SEQ ID NO: 5624612 - DNA, 17 bp, Homo sapiens
ggacctcaggagggcag

SEQ ID NO: 5624613 - DNA, 18 bp, Homo sapiens
ggacctcaggagggcagg

SEQ ID NO: 5624614 - DNA, 21 bp, Homo sapiens
ggacctcaggagggcaggctg

SEQ ID NO: 5624615 - DNA, 12 bp, Homo sapiens
ggacctcaggcc

SEQ ID NO: 5624616 - DNA, 21 bp, Homo sapiens
ggacctcagtttccctctgta

SEQ ID NO: 5624617 - DNA, 21 bp, Homo sapiens
ggacctcatatcttcctcatc

SEQ ID NO: 5624618 - DNA, 18 bp, Homo sapiens
ggacctcatccaaacaat

SEQ ID NO: 5624619 - DNA, 19 bp, Homo sapiens
ggacctccacctgggagat

SEQ ID NO: 5624620 - DNA, 11 bp, Homo sapiens
ggacctccagg

SEQ ID NO: 5624621 - DNA, 14 bp, Homo sapiens
ggacctccaggggc

SEQ ID NO: 5624622 - DNA, 15 bp, Homo sapiens
ggacctccaggggct

SEQ ID NO: 5624623 - DNA, 18 bp, Homo sapiens
ggacctccaggggctcct

SEQ ID NO: 5624624 - DNA, 23 bp, Homo sapiens
ggacctccaggggctcctgggtt

SEQ ID NO: 5624625 - DNA, 17 bp, Homo sapiens
ggacctccatccctgct

SEQ ID NO: 5624626 - DNA, 14 bp, Homo sapiens
ggacctccatgccc

SEQ ID NO: 5624627 - DNA, 16 bp, Homo sapiens
ggacctccccctgtgt

SEQ ID NO: 5624628 - DNA, 18 bp, Homo sapiens
ggacctccccctgtgtgg

SEQ ID NO: 5624629 - DNA, 13 bp, Homo sapiens
ggacctcccttcc

SEQ ID NO: 5624630 - DNA, 17 bp, Homo sapiens
ggacctcccttccgacc

SEQ ID NO: 5624631 - DNA, 21 bp, Homo sapiens
ggacctccggagcgccctgca

SEQ ID NO: 5624632 - DNA, 22 bp, Homo sapiens
ggacctccggagcgccctgcag

SEQ ID NO: 5624633 - DNA, 23 bp, Homo sapiens
ggacctcctccctcattcatctt

SEQ ID NO: 5624634 - DNA, 23 bp, Homo sapiens
ggacctcctcttcccccttccaa

SEQ ID NO: 5624635 - DNA, 14 bp, Homo sapiens
ggacctcctgagcg

SEQ ID NO: 5624636 - DNA, 13 bp, Homo sapiens
ggacctcgggctg

SEQ ID NO: 5624637 - DNA, 13 bp, Homo sapiens
ggacctcgtgcca

SEQ ID NO: 5624638 - DNA, 16 bp, Homo sapiens
ggacctcgtgctttaa

SEQ ID NO: 5624639 - DNA, 15 bp, Homo sapiens
ggacctctcccaggg

SEQ ID NO: 5624640 - DNA, 17 bp, Homo sapiens
ggacctctgctctgagg

SEQ ID NO: 5624641 - DNA, 20 bp, Homo sapiens
ggacctctgggggttgttgg

SEQ ID NO: 5624642 - DNA, 17 bp, Homo sapiens
ggacctctgtaggcagc

SEQ ID NO: 5624643 - DNA, 21 bp, Homo sapiens
ggacctctttactctctccga

SEQ ID NO: 5624644 - DNA, 22 bp, Homo sapiens
ggacctctttactctctccgat

SEQ ID NO: 5624645 - DNA, 17 bp, Homo sapiens
ggacctgaaatttaaac

SEQ ID NO: 5624646 - DNA, 22 bp, Homo sapiens
ggacctgaatgacctgcagtca

SEQ ID NO: 5624647 - DNA, 13 bp, Homo sapiens
ggacctgagagca

SEQ ID NO: 5624648 - DNA, 13 bp, Homo sapiens
ggacctgagcccg

SEQ ID NO: 5624649 - DNA, 20 bp, Homo sapiens
ggacctgagcctgccgagca

SEQ ID NO: 5624650 - DNA, 14 bp, Homo sapiens
ggacctgagcctgg

SEQ ID NO: 5624651 - DNA, 20 bp, Homo sapiens
ggacctgagctggccaggcc

SEQ ID NO: 5624652 - DNA, 21 bp, Homo sapiens
ggacctgagctggccaggccc

SEQ ID NO: 5624653 - DNA, 19 bp, Homo sapiens
ggacctgcacttggcctct

SEQ ID NO: 5624654 - DNA, 14 bp, Homo sapiens
ggacctgcagttgg

SEQ ID NO: 5624655 - DNA, 23 bp, Homo sapiens
ggacctgcagttggcctcagcag

SEQ ID NO: 5624656 - DNA, 20 bp, Homo sapiens
ggacctgcatatttagctgt

SEQ ID NO: 5624657 - DNA, 23 bp, Homo sapiens
ggacctgcatctaagcatctggg

SEQ ID NO: 5624658 - DNA, 15 bp, Homo sapiens
ggacctgccaccagg

SEQ ID NO: 5624659 - DNA, 14 bp, Homo sapiens
ggacctgccaggca

SEQ ID NO: 5624660 - DNA, 22 bp, Homo sapiens
ggacctgccccggacctacctc

SEQ ID NO: 5624661 - DNA, 22 bp, Homo sapiens
ggacctgccctccctcagccgt

SEQ ID NO: 5624662 - DNA, 16 bp, Homo sapiens
ggacctgcctagcatg

SEQ ID NO: 5624663 - DNA, 13 bp, Homo sapiens
ggacctgcctgca

SEQ ID NO: 5624664 - DNA, 17 bp, Homo sapiens
ggacctgctgctcagta

SEQ ID NO: 5624665 - DNA, 19 bp, Homo sapiens
ggacctggagctgccagca

SEQ ID NO: 5624666 - DNA, 18 bp, Homo sapiens
ggacctggccccaggctg

SEQ ID NO: 5624667 - DNA, 11 bp, Homo sapiens
ggacctgggaa

SEQ ID NO: 5624668 - DNA, 22 bp, Homo sapiens
ggacctgggaacgactggactg

SEQ ID NO: 5624669 - DNA, 19 bp, Homo sapiens
ggacctgggacaagcaggc

SEQ ID NO: 5624670 - DNA, 13 bp, Homo sapiens
ggacctggggcac

SEQ ID NO: 5624671 - DNA, 21 bp, Homo sapiens
ggacctggggcacagtccagg

SEQ ID NO: 5624672 - DNA, 13 bp, Homo sapiens
ggacctgtccccc

SEQ ID NO: 5624673 - DNA, 16 bp, Homo sapiens
ggacctgttttcttca

SEQ ID NO: 5624674 - DNA, 19 bp, Homo sapiens
ggaccttaaaatgtgtaca

SEQ ID NO: 5624675 - DNA, 21 bp, Homo sapiens
ggaccttaggccttcctctct

SEQ ID NO: 5624676 - DNA, 15 bp, Homo sapiens
ggaccttatctgtgc

SEQ ID NO: 5624677 - DNA, 21 bp, Homo sapiens
ggaccttcagggagagctggg

SEQ ID NO: 5624678 - DNA, 21 bp, Homo sapiens
ggaccttctttattctgtgtt

SEQ ID NO: 5624679 - DNA, 22 bp, Homo sapiens
ggaccttctttattctgtgtta

SEQ ID NO: 5624680 - DNA, 15 bp, Homo sapiens
ggaccttgaactggg

SEQ ID NO: 5624681 - DNA, 18 bp, Homo sapiens
ggaccttgcttccttctc

SEQ ID NO: 5624682 - DNA, 11 bp, Homo sapiens
ggaccttggcg

SEQ ID NO: 5624683 - DNA, 14 bp, Homo sapiens
ggaccttggtctga

SEQ ID NO: 5624684 - DNA, 22 bp, Homo sapiens
ggaccttgtgggaccagtccca

SEQ ID NO: 5624685 - DNA, 17 bp, Homo sapiens
ggacctttaaagagccc

SEQ ID NO: 5624686 - DNA, 21 bp, Homo sapiens
ggaccttttaaagtgtttcag

SEQ ID NO: 5624687 - DNA, 22 bp, Homo sapiens
ggaccttttaaagtgtttcagc

SEQ ID NO: 5624688 - DNA, 23 bp, Homo sapiens
ggacgaagcggagagagccaaga

SEQ ID NO: 5624689 - DNA, 15 bp, Homo sapiens
ggacgaatatgaatg

SEQ ID NO: 5624690 - DNA, 23 bp, Homo sapiens
ggacgagacccccatccagcctc

SEQ ID NO: 5624691 - DNA, 15 bp, Homo sapiens
ggacgagactcctcg

SEQ ID NO: 5624692 - DNA, 16 bp, Homo sapiens
ggacgagagggctgtg

SEQ ID NO: 5624693 - DNA, 23 bp, Homo sapiens
ggacgagcagagcgcagccccca

SEQ ID NO: 5624694 - DNA, 22 bp, Homo sapiens
ggacgagggatgggatttcatg

SEQ ID NO: 5624695 - DNA, 22 bp, Homo sapiens
ggacgagtgagctaccaggaag

SEQ ID NO: 5624696 - DNA, 23 bp, Homo sapiens
ggacgagtgagctaccaggaaga

SEQ ID NO: 5624697 - DNA, 15 bp, Homo sapiens
ggacgatcaggagga

SEQ ID NO: 5624698 - DNA, 23 bp, Homo sapiens
ggacgatcaggaggaagtgagca

SEQ ID NO: 5624699 - DNA, 23 bp, Homo sapiens
ggacgcacgctcgctgccatcac

SEQ ID NO: 5624700 - DNA, 14 bp, Homo sapiens
ggacgcactgagca

SEQ ID NO: 5624701 - DNA, 23 bp, Homo sapiens
ggacgcagcaggaggccaggccg

SEQ ID NO: 5624702 - DNA, 19 bp, Homo sapiens
ggacgcaggcccctctcct

SEQ ID NO: 5624703 - DNA, 16 bp, Homo sapiens
ggacgcaggccctgtc

SEQ ID NO: 5624704 - DNA, 19 bp, Homo sapiens
ggacttggagagcaaaggc

SEQ ID NO: 5624705 - DNA, 13 bp, Homo sapiens
ggacttggagggt

SEQ ID NO: 5624706 - DNA, 15 bp, Homo sapiens
ggacttggcctctct

SEQ ID NO: 5624707 - DNA, 15 bp, Homo sapiens
ggacttggcttcaga

SEQ ID NO: 5624708 - DNA, 15 bp, Homo sapiens
ggacttgggagctgg

SEQ ID NO: 5624709 - DNA, 21 bp, Homo sapiens
ggacttggtaagatgactctg

SEQ ID NO: 5624710 - DNA, 22 bp, Homo sapiens
ggacttggtaagatgactctga

SEQ ID NO: 5624711 - DNA, 18 bp, Homo sapiens
ggacttggtacagttgca

SEQ ID NO: 5624712 - DNA, 21 bp, Homo sapiens
ggacttggtacagttgcagga

SEQ ID NO: 5624713 - DNA, 22 bp, Homo sapiens
ggacttgtaggaatctgccttc

SEQ ID NO: 5624714 - DNA, 19 bp, Homo sapiens
ggacttgtatatttgtaca

SEQ ID NO: 5624715 - DNA, 15 bp, Homo sapiens
ggacttgtatgctgc

SEQ ID NO: 5624716 - DNA, 17 bp, Homo sapiens
ggacttgtatgctgccc

SEQ ID NO: 5624717 - DNA, 15 bp, Homo sapiens
ggacttgtgattggc

SEQ ID NO: 5624718 - DNA, 17 bp, Homo sapiens
ggacttgtgattggctg

SEQ ID NO: 5624719 - DNA, 21 bp, Homo sapiens
ggacttgtgcctcttgggaga

SEQ ID NO: 5624720 - DNA, 12 bp, Homo sapiens
ggacttgtgtct

SEQ ID NO: 5624721 - DNA, 12 bp, Homo sapiens
ggacttgttaga

SEQ ID NO: 5624722 - DNA, 20 bp, Homo sapiens
ggacttgtttagagagcctg

SEQ ID NO: 5624723 - DNA, 17 bp, Homo sapiens
ggacttgttttaatttt

SEQ ID NO: 5624724 - DNA, 14 bp, Homo sapiens
ggactttatttaat

SEQ ID NO: 5624725 - DNA, 23 bp, Homo sapiens
ggactttatttaatttcataaat

SEQ ID NO: 5624726 - DNA, 16 bp, Homo sapiens
ggactttatttatttc

SEQ ID NO: 5624727 - DNA, 17 bp, Homo sapiens
ggactttatttatttct

SEQ ID NO: 5624728 - DNA, 16 bp, Homo sapiens
ggactttccaccccct

SEQ ID NO: 5624729 - DNA, 17 bp, Homo sapiens
ggactttccagtgagga

SEQ ID NO: 5624730 - DNA, 20 bp, Homo sapiens
ggactttcctaaatgtttaa

SEQ ID NO: 5624731 - DNA, 22 bp, Homo sapiens
ggactttctctaataataaata

SEQ ID NO: 5624732 - DNA, 21 bp, Homo sapiens
ggactttcttttcgccgtggc

SEQ ID NO: 5624733 - DNA, 14 bp, Homo sapiens
ggactttgcacact

SEQ ID NO: 5624734 - DNA, 17 bp, Homo sapiens
ggactttgcagccggca

SEQ ID NO: 5624735 - DNA, 20 bp, Homo sapiens
ggactttggtaattggtttt

SEQ ID NO: 5624736 - DNA, 20 bp, Homo sapiens
ggactttgtatactttaaat

SEQ ID NO: 5624737 - DNA, 12 bp, Homo sapiens
ggactttgttac

SEQ ID NO: 5624738 - DNA, 13 bp, Homo sapiens
ggactttgttaca

SEQ ID NO: 5624739 - DNA, 17 bp, Homo sapiens
ggacttttaaacaaaag

SEQ ID NO: 5624740 - DNA, 18 bp, Homo sapiens
ggacttttatttccagtg

SEQ ID NO: 5624741 - DNA, 22 bp, Homo sapiens
ggacttttcgttaacattgacc

SEQ ID NO: 5624742 - DNA, 20 bp, Homo sapiens
ggacttttgcagcttccttc

SEQ ID NO: 5624743 - DNA, 18 bp, Homo sapiens
ggacttttgttcatggga

SEQ ID NO: 5624744 - DNA, 16 bp, Homo sapiens
ggacttttttgattaa

SEQ ID NO: 5624745 - DNA, 19 bp, Homo sapiens
ggagaaaaaaaaagcaaat

SEQ ID NO: 5624746 - DNA, 19 bp, Homo sapiens
ggagaaaaaaattgctctg

SEQ ID NO: 5624747 - DNA, 19 bp, Homo sapiens
ggagaaaaagaagaaaaga

SEQ ID NO: 5624748 - DNA, 15 bp, Homo sapiens
ggagaaaaagatatg

SEQ ID NO: 5624749 - DNA, 19 bp, Homo sapiens
ggagaaaagacaaatgtgc

SEQ ID NO: 5624750 - DNA, 13 bp, Homo sapiens
ggagaaaagcact

SEQ ID NO: 5624751 - DNA, 14 bp, Homo sapiens
ggagaaaagccaga

SEQ ID NO: 5624752 - DNA, 15 bp, Homo sapiens
ggagaaaagccagat

SEQ ID NO: 5624753 - DNA, 17 bp, Homo sapiens
ggagaaaagtgggctgc

SEQ ID NO: 5624754 - DNA, 23 bp, Homo sapiens
ggagaaaattggaactctactca

SEQ ID NO: 5624755 - DNA, 14 bp, Homo sapiens
ggagaaacagagac

SEQ ID NO: 5624756 - DNA, 15 bp, Homo sapiens
ggagaaacagagaca

SEQ ID NO: 5624757 - DNA, 14 bp, Homo sapiens
ggagaaaccagctt

SEQ ID NO: 5624758 - DNA, 21 bp, Homo sapiens
ggagaaacccacgacctgtcc

SEQ ID NO: 5624759 - DNA, 15 bp, Homo sapiens
ggagaaacccagaga

SEQ ID NO: 5624760 - DNA, 19 bp, Homo sapiens
ggagaaacccttgaaaaga

SEQ ID NO: 5624761 - DNA, 14 bp, Homo sapiens
ggagaaacctcgga

SEQ ID NO: 5624762 - DNA, 23 bp, Homo sapiens
ggagaaacctgcatgaaagcatt

SEQ ID NO: 5624763 - DNA, 16 bp, Homo sapiens
ggagaaaccttcactc

SEQ ID NO: 5624764 - DNA, 16 bp, Homo sapiens
ggagaaactccaaagt

SEQ ID NO: 5624765 - DNA, 14 bp, Homo sapiens
ggagaaactgaagc

SEQ ID NO: 5624766 - DNA, 15 bp, Homo sapiens
ggagaaagaaagtac

SEQ ID NO: 5624767 - DNA, 20 bp, Homo sapiens
ggagaaagaagtggagacag

SEQ ID NO: 5624768 - DNA, 13 bp, Homo sapiens
ggagaaagagctg

SEQ ID NO: 5624769 - DNA, 13 bp, Homo sapiens
ggagaaagccggg

SEQ ID NO: 5624770 - DNA, 19 bp, Homo sapiens
ggagaaagccgggggaggg

SEQ ID NO: 5624771 - DNA, 21 bp, Homo sapiens
ggagaaagccgggggaggggc

SEQ ID NO: 5624772 - DNA, 22 bp, Homo sapiens
ggagaaagccgggggaggggcc

SEQ ID NO: 5624773 - DNA, 15 bp, Homo sapiens
ggagaaagctgactt

SEQ ID NO: 5624774 - DNA, 24 bp, Homo sapiens
ggagaaagcttggttctgtgaaca

SEQ ID NO: 5624775 - DNA, 19 bp, Homo sapiens
ggagaaagggagcgaggtc

SEQ ID NO: 5624776 - DNA, 22 bp, Homo sapiens
ggagaaagggcagaggaagaga

SEQ ID NO: 5624777 - DNA, 22 bp, Homo sapiens
ggagaaaggggctagcactgga

SEQ ID NO: 5624778 - DNA, 21 bp, Homo sapiens
ggagaaaggtgaaacacacac

SEQ ID NO: 5624779 - DNA, 13 bp, Homo sapiens
ggagaaataaact

SEQ ID NO: 5624780 - DNA, 20 bp, Homo sapiens
ggagaaataatgcatttctg

SEQ ID NO: 5624781 - DNA, 13 bp, Homo sapiens
ggagaaataattg

SEQ ID NO: 5624782 - DNA, 22 bp, Homo sapiens
ggagaaatacttgaacttgcct

SEQ ID NO: 5624783 - DNA, 15 bp, Homo sapiens
ggagaaatgaaaagt

SEQ ID NO: 5624784 - DNA, 14 bp, Homo sapiens
ggagaaatgaagca

SEQ ID NO: 5624785 - DNA, 17 bp, Homo sapiens
ggagaaatgataagtga

SEQ ID NO: 5624786 - DNA, 20 bp, Homo sapiens
ggagaacaagaaagggccag

SEQ ID NO: 5624787 - DNA, 21 bp, Homo sapiens
ggagaacagtggttgcctggg

SEQ ID NO: 5624788 - DNA, 22 bp, Homo sapiens
ggagaacagtggttgcctgggg

SEQ ID NO: 5624789 - DNA, 22 bp, Homo sapiens
ggagaacagtttcatcaggacc

SEQ ID NO: 5624790 - DNA, 19 bp, Homo sapiens
ggagaacatctgccttgct

SEQ ID NO: 5624791 - DNA, 20 bp, Homo sapiens
ggagaaccaaatctggaagc

SEQ ID NO: 5624792 - DNA, 11 bp, Homo sapiens
ggagaaccagg

SEQ ID NO: 5624793 - DNA, 21 bp, Homo sapiens
ggagaacctcgttgacatgca

SEQ ID NO: 5624794 - DNA, 18 bp, Homo sapiens
ggagaaccttgtgcctgg

SEQ ID NO: 5624795 - DNA, 20 bp, Homo sapiens
ggagaactaggtttaaaaca

SEQ ID NO: 5624796 - DNA, 15 bp, Homo sapiens
ggagaactgtgctct

SEQ ID NO: 5624797 - DNA, 20 bp, Homo sapiens
ggagaacttgaacaaagtct

SEQ ID NO: 5624798 - DNA, 17 bp, Homo sapiens
ggagaactttccatctg

SEQ ID NO: 5624799 - DNA, 12 bp, Homo sapiens
ggagaagaaaat

SEQ ID NO: 5624800 - DNA, 18 bp, Homo sapiens
ggagaagaaagaaacttc

SEQ ID NO: 5624801 - DNA, 19 bp, Homo sapiens
ggagaagaaagaactatct

SEQ ID NO: 5624802 - DNA, 23 bp, Homo sapiens
ggagaagaaagaggtgaccccag

SEQ ID NO: 5624803 - DNA, 11 bp, Homo sapiens
ggagaagaact

SEQ ID NO: 5624804 - DNA, 15 bp, Homo sapiens
ggagaagaatggctt

SEQ ID NO: 5624805 - DNA, 14 bp, Homo sapiens
ggagaagacactgc

SEQ ID NO: 5624806 - DNA, 15 bp, Homo sapiens
ggagaagacactgca

SEQ ID NO: 5624807 - DNA, 19 bp, Homo sapiens
ggagaagacccctgcccaa

SEQ ID NO: 5624808 - DNA, 13 bp, Homo sapiens
ggagaagagaacc

SEQ ID NO: 5624809 - DNA, 14 bp, Homo sapiens
ggagaagagaggag

SEQ ID NO: 5624810 - DNA, 13 bp, Homo sapiens
ggagaagagccct

SEQ ID NO: 5624811 - DNA, 23 bp, Homo sapiens
ggagaagagctgttcacagccag

SEQ ID NO: 5624812 - DNA, 19 bp, Homo sapiens
ggagaagaggcatcctgcc

SEQ ID NO: 5624813 - DNA, 21 bp, Homo sapiens
ggagaagaggcatcctgcctg

SEQ ID NO: 5624814 - DNA, 23 bp, Homo sapiens
ggagaagaggcatcctgcctggg

SEQ ID NO: 5624815 - DNA, 18 bp, Homo sapiens
ggagaagagggaaaacag

SEQ ID NO: 5624816 - DNA, 18 bp, Homo sapiens
ggagaagagtatttttaa

SEQ ID NO: 5624817 - DNA, 21 bp, Homo sapiens
ggagaagagtatttttaacac

SEQ ID NO: 5624818 - DNA, 17 bp, Homo sapiens
ggagaagagtgccctgc

SEQ ID NO: 5624819 - DNA, 19 bp, Homo sapiens
ggagaagagtgccctgctt

SEQ ID NO: 5624820 - DNA, 21 bp, Homo sapiens
ggagaagatttcagagctgag

SEQ ID NO: 5624821 - DNA, 18 bp, Homo sapiens
ggagaagcacagctcctg

SEQ ID NO: 5624822 - DNA, 20 bp, Homo sapiens
ggagaagccacaggcctgag

SEQ ID NO: 5624823 - DNA, 12 bp, Homo sapiens
ggagaagccagg

SEQ ID NO: 5624824 - DNA, 15 bp, Homo sapiens
ggagaagccaggaat

SEQ ID NO: 5624825 - DNA, 12 bp, Homo sapiens
ggagaagccagt

SEQ ID NO: 5624826 - DNA, 13 bp, Homo sapiens
ggagaagccgcag

SEQ ID NO: 5624827 - DNA, 22 bp, Homo sapiens
ggagaagcctgggtggctcagc

SEQ ID NO: 5624828 - DNA, 18 bp, Homo sapiens
ggagaagcggctggcagc

SEQ ID NO: 5624829 - DNA, 14 bp, Homo sapiens
ggagaagcgggctg

SEQ ID NO: 5624830 - DNA, 15 bp, Homo sapiens
ggagaagcgggctgg

SEQ ID NO: 5624831 - DNA, 13 bp, Homo sapiens
ggagaagctgatg

SEQ ID NO: 5624832 - DNA, 13 bp, Homo sapiens
ggagaaggaaggg

SEQ ID NO: 5624833 - DNA, 19 bp, Homo sapiens
ggagaaggaagggcagaga

SEQ ID NO: 5624834 - DNA, 23 bp, Homo sapiens
ggagaaggaagggcagagaatgg

SEQ ID NO: 5624835 - DNA, 15 bp, Homo sapiens
ggagaaggagaggct

SEQ ID NO: 5624836 - DNA, 13 bp, Homo sapiens
ggagaaggaggaa

SEQ ID NO: 5624837 - DNA, 14 bp, Homo sapiens
ggagaaggaggaac

SEQ ID NO: 5624838 - DNA, 20 bp, Homo sapiens
ggagaaggatctagaatgtg

SEQ ID NO: 5624839 - DNA, 14 bp, Homo sapiens
ggagaaggcctccc

SEQ ID NO: 5624840 - DNA, 17 bp, Homo sapiens
ggagaaggcctcccctg

SEQ ID NO: 5624841 - DNA, 18 bp, Homo sapiens
ggagaaggcctcccctga

SEQ ID NO: 5624842 - DNA, 14 bp, Homo sapiens
ggagaaggcctgga

SEQ ID NO: 5624843 - DNA, 15 bp, Homo sapiens
ggagaagggacagcg

SEQ ID NO: 5624844 - DNA, 16 bp, Homo sapiens
ggagaagggacatggg

SEQ ID NO: 5624845 - DNA, 13 bp, Homo sapiens
ggagaagggaggg

SEQ ID NO: 5624846 - DNA, 14 bp, Homo sapiens
ggagaagggccagc

SEQ ID NO: 5624847 - DNA, 17 bp, Homo sapiens
ggagaagggccagccct

SEQ ID NO: 5624848 - DNA, 22 bp, Homo sapiens
ggagaagggccagccctacatc

SEQ ID NO: 5624849 - DNA, 14 bp, Homo sapiens
ggagaagggctggg

SEQ ID NO: 5624850 - DNA, 18 bp, Homo sapiens
ggagaagggctggggccg

SEQ ID NO: 5624851 - DNA, 19 bp, Homo sapiens
ggagaagggggctctgccc

SEQ ID NO: 5624852 - DNA, 20 bp, Homo sapiens
ggagaagggggtctctgtta

SEQ ID NO: 5624853 - DNA, 23 bp, Homo sapiens
ggagaagggttagacaagcctgg

SEQ ID NO: 5624854 - DNA, 15 bp, Homo sapiens
ggagaaggtcagcga

SEQ ID NO: 5624855 - DNA, 17 bp, Homo sapiens
ggagaaggtctgtggtg

SEQ ID NO: 5624856 - DNA, 20 bp, Homo sapiens
ggagaagtattcctgttgct

SEQ ID NO: 5624857 - DNA, 19 bp, Homo sapiens
ggagaagtcttctatttat

SEQ ID NO: 5624858 - DNA, 21 bp, Homo sapiens
ggagaagtcttctatttattt

SEQ ID NO: 5624859 - DNA, 22 bp, Homo sapiens
ggagaagtcttctatttattta

SEQ ID NO: 5624860 - DNA, 21 bp, Homo sapiens
ggagaagtgatatggtgaagg

SEQ ID NO: 5624861 - DNA, 22 bp, Homo sapiens
ggagaagtgctccctggaggca

SEQ ID NO: 5624862 - DNA, 20 bp, Homo sapiens
ggagaagtggggaccccacc

SEQ ID NO: 5624863 - DNA, 10 bp, Homo sapiens
ggagaagttt

SEQ ID NO: 5624864 - DNA, 16 bp, Homo sapiens
ggagaataattctttg

SEQ ID NO: 5624865 - DNA, 19 bp, Homo sapiens
ggagaatactttgcttcat

SEQ ID NO: 5624866 - DNA, 15 bp, Homo sapiens
ggagaatagcagaga

SEQ ID NO: 5624867 - DNA, 22 bp, Homo sapiens
ggagaatatgcgggacatgatg

SEQ ID NO: 5624868 - DNA, 19 bp, Homo sapiens
ggagaatcacttgaacccg

SEQ ID NO: 5624869 - DNA, 17 bp, Homo sapiens
ggagaatcatcaggacc

SEQ ID NO: 5624870 - DNA, 14 bp, Homo sapiens
ggagaatcatgtga

SEQ ID NO: 5624871 - DNA, 19 bp, Homo sapiens
ggagaatcatgtgaacccg

SEQ ID NO: 5624872 - DNA, 18 bp, Homo sapiens
ggagaatcctcccttccc

SEQ ID NO: 5624873 - DNA, 19 bp, Homo sapiens
ggagaatgagaagggaagg

SEQ ID NO: 5624874 - DNA, 14 bp, Homo sapiens
ggagaatgcagccc

SEQ ID NO: 5624875 - DNA, 14 bp, Homo sapiens
ggagaatgccagcc

SEQ ID NO: 5624876 - DNA, 15 bp, Homo sapiens
ggagaatgccagccc

SEQ ID NO: 5624877 - DNA, 17 bp, Homo sapiens
ggagaatgccagcccaa

SEQ ID NO: 5624878 - DNA, 16 bp, Homo sapiens
ggagaatggcatggca

SEQ ID NO: 5624879 - DNA, 21 bp, Homo sapiens
ggagaatggcatggcaggagt

SEQ ID NO: 5624880 - DNA, 24 bp, Homo sapiens
ggagaatggggttcctgctgtggg

SEQ ID NO: 5624881 - DNA, 12 bp, Homo sapiens
ggagccagcagg

SEQ ID NO: 5624882 - DNA, 21 bp, Homo sapiens
ggagccagcagggcgggccag

SEQ ID NO: 5624883 - DNA, 14 bp, Homo sapiens
ggagccagccaccc

SEQ ID NO: 5624884 - DNA, 14 bp, Homo sapiens
ggagccagccgagc

SEQ ID NO: 5624885 - DNA, 15 bp, Homo sapiens
ggagccagcctccct

SEQ ID NO: 5624886 - DNA, 15 bp, Homo sapiens
ggagccagcgcctgc

SEQ ID NO: 5624887 - DNA, 21 bp, Homo sapiens
ggagccagctccctctattta

SEQ ID NO: 5624888 - DNA, 15 bp, Homo sapiens
ggagccagctgcttg

SEQ ID NO: 5624889 - DNA, 23 bp, Homo sapiens
ggagccagctgcttgacctagct

SEQ ID NO: 5624890 - DNA, 18 bp, Homo sapiens
ggagccaggactcccaga

SEQ ID NO: 5624891 - DNA, 21 bp, Homo sapiens
ggagccaggactcccagaacc

SEQ ID NO: 5624892 - DNA, 11 bp, Homo sapiens
ggagccaggcg

SEQ ID NO: 5624893 - DNA, 13 bp, Homo sapiens
ggagccaggctct

SEQ ID NO: 5624894 - DNA, 21 bp, Homo sapiens
ggagccatcacctaggactga

SEQ ID NO: 5624895 - DNA, 22 bp, Homo sapiens
ggagccatgcgccccctccgcc

SEQ ID NO: 5624896 - DNA, 23 bp, Homo sapiens
ggagccatgcgccccctccgccc

SEQ ID NO: 5624897 - DNA, 21 bp, Homo sapiens
ggagccatggaaggtgccaga

SEQ ID NO: 5624898 - DNA, 23 bp, Homo sapiens
ggagccatgtctacaaaagcaaa

SEQ ID NO: 5624899 - DNA, 18 bp, Homo sapiens
ggagccattgaacagctg

SEQ ID NO: 5624900 - DNA, 13 bp, Homo sapiens
ggagcccacagcg

SEQ ID NO: 5624901 - DNA, 17 bp, Homo sapiens
ggagcccacagcgagcc

SEQ ID NO: 5624902 - DNA, 19 bp, Homo sapiens
ggagcccacagcgagcctg

SEQ ID NO: 5624903 - DNA, 12 bp, Homo sapiens
ggagcccactgt

SEQ ID NO: 5624904 - DNA, 18 bp, Homo sapiens
ggagcccactgtacttgc

SEQ ID NO: 5624905 - DNA, 14 bp, Homo sapiens
ggagcccactgtcc

SEQ ID NO: 5624906 - DNA, 20 bp, Homo sapiens
ggagcccactgtcctgggcc

SEQ ID NO: 5624907 - DNA, 13 bp, Homo sapiens
ggagcccagcaca

SEQ ID NO: 5624908 - DNA, 14 bp, Homo sapiens
ggagcccagccaga

SEQ ID NO: 5624909 - DNA, 17 bp, Homo sapiens
ggagcccagcctgggag

SEQ ID NO: 5624910 - DNA, 16 bp, Homo sapiens
ggagcccagctctgaa

SEQ ID NO: 5624911 - DNA, 18 bp, Homo sapiens
ggagcccaggagtcccac

SEQ ID NO: 5624912 - DNA, 16 bp, Homo sapiens
ggagcccaggccagga

SEQ ID NO: 5624913 - DNA, 12 bp, Homo sapiens
ggagcccagggc

SEQ ID NO: 5624914 - DNA, 13 bp, Homo sapiens
ggagcccagggca

SEQ ID NO: 5624915 - DNA, 13 bp, Homo sapiens
ggagcccagggtg

SEQ ID NO: 5624916 - DNA, 22 bp, Homo sapiens
ggagcccagtccactgagcaag

SEQ ID NO: 5624917 - DNA, 20 bp, Homo sapiens
ggagcccagtgaagcctctg

SEQ ID NO: 5624918 - DNA, 12 bp, Homo sapiens
ggagcccagtgg

SEQ ID NO: 5624919 - DNA, 17 bp, Homo sapiens
ggagcccagtgggctgc

SEQ ID NO: 5624920 - DNA, 22 bp, Homo sapiens
ggagccccaagactctgctctc

SEQ ID NO: 5624921 - DNA, 20 bp, Homo sapiens
ggagccccaccttgtctgct

SEQ ID NO: 5624922 - DNA, 14 bp, Homo sapiens
ggagccccactgcc

SEQ ID NO: 5624923 - DNA, 17 bp, Homo sapiens
ggagccccagccagccc

SEQ ID NO: 5624924 - DNA, 18 bp, Homo sapiens
ggagccccagccagccct

SEQ ID NO: 5624925 - DNA, 15 bp, Homo sapiens
ggagccccagccccc

SEQ ID NO: 5624926 - DNA, 16 bp, Homo sapiens
ggagccccagccccct

SEQ ID NO: 5624927 - DNA, 16 bp, Homo sapiens
ggagccccagccccgt

SEQ ID NO: 5624928 - DNA, 22 bp, Homo sapiens
ggagccccagccccgtcccaga

SEQ ID NO: 5624929 - DNA, 16 bp, Homo sapiens
ggagccccaggcaggg

SEQ ID NO: 5624930 - DNA, 14 bp, Homo sapiens
ggagccccatcgcc

SEQ ID NO: 5624931 - DNA, 20 bp, Homo sapiens
ggagcccccaacacaggcaa

SEQ ID NO: 5624932 - DNA, 21 bp, Homo sapiens
ggagcccccaacacaggcaag

SEQ ID NO: 5624933 - DNA, 22 bp, Homo sapiens
ggagcccccaccctgttcctgc

SEQ ID NO: 5624934 - DNA, 15 bp, Homo sapiens
ggagcccccagcaga

SEQ ID NO: 5624935 - DNA, 22 bp, Homo sapiens
ggagcccccagcagaggcaggc

SEQ ID NO: 5624936 - DNA, 14 bp, Homo sapiens
ggagcccccagcct

SEQ ID NO: 5624937 - DNA, 23 bp, Homo sapiens
ggagccccccgtgttcacacaca

SEQ ID NO: 5624938 - DNA, 14 bp, Homo sapiens
ggagcccccgcccc

SEQ ID NO: 5624939 - DNA, 17 bp, Homo sapiens
ggagccccctggcggca

SEQ ID NO: 5624940 - DNA, 20 bp, Homo sapiens
ggagccccctggcggcaggg

SEQ ID NO: 5624941 - DNA, 16 bp, Homo sapiens
ggagcccctaggaaag

SEQ ID NO: 5624942 - DNA, 21 bp, Homo sapiens
ggagcccctcctcccccggct

SEQ ID NO: 5624943 - DNA, 21 bp, Homo sapiens
ggagcccctcctctgagcagc

SEQ ID NO: 5624944 - DNA, 11 bp, Homo sapiens
ggagcccctga

SEQ ID NO: 5624945 - DNA, 21 bp, Homo sapiens
ggagcccctgaaagcctcacg

SEQ ID NO: 5624946 - DNA, 14 bp, Homo sapiens
ggagcccctgagtc

SEQ ID NO: 5624947 - DNA, 19 bp, Homo sapiens
ggagcccctggacatgcct

SEQ ID NO: 5624948 - DNA, 15 bp, Homo sapiens
ggagcccctgggtgg

SEQ ID NO: 5624949 - DNA, 13 bp, Homo sapiens
ggagcccctgtgt

SEQ ID NO: 5624950 - DNA, 21 bp, Homo sapiens
ggagcccgagggcctgacagg

SEQ ID NO: 5624951 - DNA, 20 bp, Homo sapiens
ggagcccgcacccccaccct

SEQ ID NO: 5624952 - DNA, 21 bp, Homo sapiens
ggagcccgcacccccaccctt

SEQ ID NO: 5624953 - DNA, 13 bp, Homo sapiens
ggagcccgcactg

SEQ ID NO: 5624954 - DNA, 18 bp, Homo sapiens
ggagcccgcactgtccca

SEQ ID NO: 5624955 - DNA, 16 bp, Homo sapiens
ggagcccgcctgcgcc

SEQ ID NO: 5624956 - DNA, 19 bp, Homo sapiens
ggagcccgcctgcgccccc

SEQ ID NO: 5624957 - DNA, 21 bp, Homo sapiens
ggagcccgcttcaagctctct

SEQ ID NO: 5624958 - DNA, 22 bp, Homo sapiens
ggagcccggggcagagctcaga

SEQ ID NO: 5624959 - DNA, 17 bp, Homo sapiens
ggagccctattgctgct

SEQ ID NO: 5624960 - DNA, 17 bp, Homo sapiens
ggagccctccctatgtc

SEQ ID NO: 5624961 - DNA, 22 bp, Homo sapiens
ggagccctgaccttggctgact

SEQ ID NO: 5624962 - DNA, 15 bp, Homo sapiens
ggagccctgagcctg

SEQ ID NO: 5624963 - DNA, 13 bp, Homo sapiens
ggagccctgggag

SEQ ID NO: 5624964 - DNA, 19 bp, Homo sapiens
ggagccctgggaggctctg

SEQ ID NO: 5624965 - DNA, 20 bp, Homo sapiens
ggagccctgggcggagtccc

SEQ ID NO: 5624966 - DNA, 19 bp, Homo sapiens
ggagccctggggtttccac

SEQ ID NO: 5624967 - DNA, 14 bp, Homo sapiens
ggagcccttctctt

SEQ ID NO: 5624968 - DNA, 17 bp, Homo sapiens
ggagcccttggcccctc

SEQ ID NO: 5624969 - DNA, 19 bp, Homo sapiens
ggagccgaagcccaggggc

SEQ ID NO: 5624970 - DNA, 21 bp, Homo sapiens
ggagccgagatcacgccactg

SEQ ID NO: 5624971 - DNA, 18 bp, Homo sapiens
ggagccgagggcgtcaga

SEQ ID NO: 5624972 - DNA, 17 bp, Homo sapiens
ggagccgcgggacagcc

SEQ ID NO: 5624973 - DNA, 14 bp, Homo sapiens
ggagccggaccaag

SEQ ID NO: 5624974 - DNA, 16 bp, Homo sapiens
ggagccggcggcctct

SEQ ID NO: 5624975 - DNA, 17 bp, Homo sapiens
ggagccggcggcctctc

SEQ ID NO: 5624976 - DNA, 14 bp, Homo sapiens
ggagccgggaaagc

SEQ ID NO: 5624977 - DNA, 16 bp, Homo sapiens
ggagccgggaccctca

SEQ ID NO: 5624978 - DNA, 15 bp, Homo sapiens
ggagccgggcctccc

SEQ ID NO: 5624979 - DNA, 16 bp, Homo sapiens
ggagccgggcctccca

SEQ ID NO: 5624980 - DNA, 17 bp, Homo sapiens
ggagccgggtctgcctc

SEQ ID NO: 5624981 - DNA, 19 bp, Homo sapiens
ggagccggtaactgtcctg

SEQ ID NO: 5624982 - DNA, 20 bp, Homo sapiens
ggagccggtaactgtcctgt

SEQ ID NO: 5624983 - DNA, 23 bp, Homo sapiens
ggagccggtaactgtcctgtcct

SEQ ID NO: 5624984 - DNA, 23 bp, Homo sapiens
ggagcctaccccctgaaagtgac

SEQ ID NO: 5624985 - DNA, 18 bp, Homo sapiens
ggagcctacctctgtctg

SEQ ID NO: 5624986 - DNA, 22 bp, Homo sapiens
ggagcctacctctgtctgagac

SEQ ID NO: 5624987 - DNA, 21 bp, Homo sapiens
ggagcctagagtgagggcctg

SEQ ID NO: 5624988 - DNA, 20 bp, Homo sapiens
ggagcctagcggagcccagc

SEQ ID NO: 5624989 - DNA, 21 bp, Homo sapiens
ggagcctagcggagcccagcc

SEQ ID NO: 5624990 - DNA, 23 bp, Homo sapiens
ggagcctagcggagcccagcctg

SEQ ID NO: 5624991 - DNA, 13 bp, Homo sapiens
ggagcctcagaag

SEQ ID NO: 5624992 - DNA, 20 bp, Homo sapiens
ggagcctccaattgcagtgg

SEQ ID NO: 5624993 - DNA, 20 bp, Homo sapiens
ggagcctccccatctgtcca

SEQ ID NO: 5624994 - DNA, 16 bp, Homo sapiens
ggagcctccccctcag

SEQ ID NO: 5624995 - DNA, 17 bp, Homo sapiens
ggagcctccccctcaga

SEQ ID NO: 5624996 - DNA, 14 bp, Homo sapiens
ggagcctcctgccc

SEQ ID NO: 5624997 - DNA, 14 bp, Homo sapiens
ggagcctctggctt

SEQ ID NO: 5624998 - DNA, 22 bp, Homo sapiens
ggagcctgaaccgtgtgctcct

SEQ ID NO: 5624999 - DNA, 18 bp, Homo sapiens
ggagcctgaagggtgcct

SEQ ID NO: 5625000 - DNA, 16 bp, Homo sapiens
ggagcctgacagccag

SEQ ID NO: 5625001 - DNA, 17 bp, Homo sapiens
ggagcctgaggcaggag

SEQ ID NO: 5625002 - DNA, 20 bp, Homo sapiens
ggagcctgagtcagggccca

SEQ ID NO: 5625003 - DNA, 22 bp, Homo sapiens
ggagcctgcaaactcactgctc

SEQ ID NO: 5625004 - DNA, 11 bp, Homo sapiens
ggagcctgcag

SEQ ID NO: 5625005 - DNA, 15 bp, Homo sapiens
ggagcctgcaggcag

SEQ ID NO: 5625006 - DNA, 16 bp, Homo sapiens
ggagcctgcagggtgg

SEQ ID NO: 5625007 - DNA, 22 bp, Homo sapiens
ggagcctgcagggtggtgctgg

SEQ ID NO: 5625008 - DNA, 12 bp, Homo sapiens
ggagcctgcctc

SEQ ID NO: 5625009 - DNA, 23 bp, Homo sapiens
ggagcctgcctccttcagtgaca

SEQ ID NO: 5625010 - DNA, 16 bp, Homo sapiens
ggagcctgcggctgct

SEQ ID NO: 5625011 - DNA, 18 bp, Homo sapiens
ggagcctgcgtggcctgg

SEQ ID NO: 5625012 - DNA, 23 bp, Homo sapiens
ggagcctgcgtggcctggggctg

SEQ ID NO: 5625013 - DNA, 13 bp, Homo sapiens
ggagcctgctggt

SEQ ID NO: 5625014 - DNA, 14 bp, Homo sapiens
ggagcctggaactg

SEQ ID NO: 5625015 - DNA, 14 bp, Homo sapiens
ggagcctggagccc

SEQ ID NO: 5625016 - DNA, 15 bp, Homo sapiens
ggagcctggagcccc

SEQ ID NO: 5625017 - DNA, 17 bp, Homo sapiens
ggagcctggagcccctg

SEQ ID NO: 5625018 - DNA, 14 bp, Homo sapiens
ggagcctggccagg

SEQ ID NO: 5625019 - DNA, 16 bp, Homo sapiens
ggagcctggccaggca

SEQ ID NO: 5625020 - DNA, 13 bp, Homo sapiens
ggagcctgggcag

SEQ ID NO: 5625021 - DNA, 15 bp, Homo sapiens
ggagcctgggcagca

SEQ ID NO: 5625022 - DNA, 12 bp, Homo sapiens
ggagcctggggt

SEQ ID NO: 5625023 - DNA, 17 bp, Homo sapiens
ggagcctgtgaacccag

SEQ ID NO: 5625024 - DNA, 20 bp, Homo sapiens
ggagcctgtgaacccaggac

SEQ ID NO: 5625025 - DNA, 16 bp, Homo sapiens
ggagcctgtgtaacag

SEQ ID NO: 5625026 - DNA, 21 bp, Homo sapiens
ggagcctgtgtaacagctcct

SEQ ID NO: 5625027 - DNA, 13 bp, Homo sapiens
ggagccttcccaa

SEQ ID NO: 5625028 - DNA, 22 bp, Homo sapiens
ggagccttcctttctcctgccc

SEQ ID NO: 5625029 - DNA, 19 bp, Homo sapiens
ggagccttgctgggccagg

SEQ ID NO: 5625030 - DNA, 20 bp, Homo sapiens
ggagcctttggttctggcca

SEQ ID NO: 5625031 - DNA, 16 bp, Homo sapiens
ggagccttttaactgt

SEQ ID NO: 5625032 - DNA, 23 bp, Homo sapiens
ggagcgaactggcgcctccgagg

SEQ ID NO: 5625033 - DNA, 13 bp, Homo sapiens
ggagcgcacctgc

SEQ ID NO: 5625034 - DNA, 19 bp, Homo sapiens
ggagcgcacctgccccctg

SEQ ID NO: 5625035 - DNA, 21 bp, Homo sapiens
ggagcgcacctgccccctggt

SEQ ID NO: 5625036 - DNA, 23 bp, Homo sapiens
ggagcgcacctgccccctggtgg

SEQ ID NO: 5625037 - DNA, 15 bp, Homo sapiens
ggagcgcaggcagcg

SEQ ID NO: 5625038 - DNA, 21 bp, Homo sapiens
ggagcgcccgccgtctgctcc

SEQ ID NO: 5625039 - DNA, 14 bp, Homo sapiens
ggagcgccctgcag

SEQ ID NO: 5625040 - DNA, 15 bp, Homo sapiens
ggagcgccctgcagg

SEQ ID NO: 5625041 - DNA, 18 bp, Homo sapiens
ggagcgccctgcagggcc

SEQ ID NO: 5625042 - DNA, 19 bp, Homo sapiens
ggagcgccctgcagggccg

SEQ ID NO: 5625043 - DNA, 14 bp, Homo sapiens
ggagcgctagtgcc

SEQ ID NO: 5625044 - DNA, 17 bp, Homo sapiens
ggagcgctagtgccttg

SEQ ID NO: 5625045 - DNA, 22 bp, Homo sapiens
ggagcggagcttgcctgcctgc

SEQ ID NO: 5625046 - DNA, 14 bp, Homo sapiens
ggagcggagcttgg

SEQ ID NO: 5625047 - DNA, 15 bp, Homo sapiens
ggagcggcagatggg

SEQ ID NO: 5625048 - DNA, 13 bp, Homo sapiens
ggagcggcatggg

SEQ ID NO: 5625049 - DNA, 19 bp, Homo sapiens
ggagcggccgcctgcgggc

SEQ ID NO: 5625050 - DNA, 20 bp, Homo sapiens
ggagcggccggccagcccct

SEQ ID NO: 5625051 - DNA, 17 bp, Homo sapiens
ggagcggcgccctggac

SEQ ID NO: 5625052 - DNA, 21 bp, Homo sapiens
ggagcggcgccctggacttgg

SEQ ID NO: 5625053 - DNA, 13 bp, Homo sapiens
ggagcggctgctc

SEQ ID NO: 5625054 - DNA, 21 bp, Homo sapiens
ggagcggctgctcgcccagga

SEQ ID NO: 5625055 - DNA, 14 bp, Homo sapiens
ggagcgggaggcag

SEQ ID NO: 5625056 - DNA, 20 bp, Homo sapiens
ggagcgggggctaactggcc

SEQ ID NO: 5625057 - DNA, 23 bp, Homo sapiens
ggagcgggggctaactggcccca

SEQ ID NO: 5625058 - DNA, 21 bp, Homo sapiens
ggagggatgcccccaggcagc

SEQ ID NO: 5625059 - DNA, 15 bp, Homo sapiens
ggagggatgctgctc

SEQ ID NO: 5625060 - DNA, 16 bp, Homo sapiens
ggagggatggagaggc

SEQ ID NO: 5625061 - DNA, 22 bp, Homo sapiens
ggagggatgtgggtaagaggag

SEQ ID NO: 5625062 - DNA, 16 bp, Homo sapiens
ggagggatgttccagt

SEQ ID NO: 5625063 - DNA, 19 bp, Homo sapiens
ggagggattgaacacaggc

SEQ ID NO: 5625064 - DNA, 20 bp, Homo sapiens
ggagggattgaacacaggca

SEQ ID NO: 5625065 - DNA, 23 bp, Homo sapiens
ggagggattgaacacaggcaaag

SEQ ID NO: 5625066 - DNA, 12 bp, Homo sapiens
ggagggatttgg

SEQ ID NO: 5625067 - DNA, 21 bp, Homo sapiens
ggagggcaaggggttcccttg

SEQ ID NO: 5625068 - DNA, 12 bp, Homo sapiens
ggagggcacagc

SEQ ID NO: 5625069 - DNA, 19 bp, Homo sapiens
ggagggcactggagctggg

SEQ ID NO: 5625070 - DNA, 17 bp, Homo sapiens
ggagggcacttggccag

SEQ ID NO: 5625071 - DNA, 10 bp, Homo sapiens
ggagggcaga

SEQ ID NO: 5625072 - DNA, 12 bp, Homo sapiens
ggagggcagaga

SEQ ID NO: 5625073 - DNA, 14 bp, Homo sapiens
ggagggcagagaca

SEQ ID NO: 5625074 - DNA, 14 bp, Homo sapiens
ggagggcagagcca

SEQ ID NO: 5625075 - DNA, 17 bp, Homo sapiens
ggagggcagagccatgg

SEQ ID NO: 5625076 - DNA, 12 bp, Homo sapiens
ggagggcagagt

SEQ ID NO: 5625077 - DNA, 20 bp, Homo sapiens
ggagggcagagtgggctgcc

SEQ ID NO: 5625078 - DNA, 23 bp, Homo sapiens
ggagggcagagtgggctgcctgg

SEQ ID NO: 5625079 - DNA, 16 bp, Homo sapiens
ggagggcagcagggct

SEQ ID NO: 5625080 - DNA, 13 bp, Homo sapiens
ggagggcagcccg

SEQ ID NO: 5625081 - DNA, 16 bp, Homo sapiens
ggagggcaggctgagg

SEQ ID NO: 5625082 - DNA, 22 bp, Homo sapiens
ggagggcatcagctttccctgg

SEQ ID NO: 5625083 - DNA, 19 bp, Homo sapiens
ggagggcccctgcgtgggg

SEQ ID NO: 5625084 - DNA, 15 bp, Homo sapiens
ggagggccctgagga

SEQ ID NO: 5625085 - DNA, 16 bp, Homo sapiens
ggagggccctgaggaa

SEQ ID NO: 5625086 - DNA, 18 bp, Homo sapiens
ggagggccctgaggaata

SEQ ID NO: 5625087 - DNA, 20 bp, Homo sapiens
ggagggccctgaggaataaa

SEQ ID NO: 5625088 - DNA, 22 bp, Homo sapiens
ggagggccgagacaggagcagc

SEQ ID NO: 5625089 - DNA, 15 bp, Homo sapiens
ggagggccgcagggc

SEQ ID NO: 5625090 - DNA, 18 bp, Homo sapiens
ggagggccggcggctctg

SEQ ID NO: 5625091 - DNA, 22 bp, Homo sapiens
ggagggccggcggctctgagca

SEQ ID NO: 5625092 - DNA, 15 bp, Homo sapiens
ggagggcctcagaga

SEQ ID NO: 5625093 - DNA, 18 bp, Homo sapiens
ggagggcctcagagacag

SEQ ID NO: 5625094 - DNA, 13 bp, Homo sapiens
ggagggcctctgg

SEQ ID NO: 5625095 - DNA, 15 bp, Homo sapiens
ggagggcctgcagtg

SEQ ID NO: 5625096 - DNA, 22 bp, Homo sapiens
ggagggcgaggcgggggagcct

SEQ ID NO: 5625097 - DNA, 14 bp, Homo sapiens
ggagggcgcccagc

SEQ ID NO: 5625098 - DNA, 21 bp, Homo sapiens
ggagggcgcccagcagcctgc

SEQ ID NO: 5625099 - DNA, 22 bp, Homo sapiens
ggagggcgcccagcagcctgcc

SEQ ID NO: 5625100 - DNA, 22 bp, Homo sapiens
ggagggcgttcttaggctgctg

SEQ ID NO: 5625101 - DNA, 16 bp, Homo sapiens
ggagggctagaacctg

SEQ ID NO: 5625102 - DNA, 19 bp, Homo sapiens
ggagggctagaactggaga

SEQ ID NO: 5625103 - DNA, 12 bp, Homo sapiens
ggagggctccag

SEQ ID NO: 5625104 - DNA, 14 bp, Homo sapiens
ggagggctccagac

SEQ ID NO: 5625105 - DNA, 17 bp, Homo sapiens
ggagggctcctggggca

SEQ ID NO: 5625106 - DNA, 19 bp, Homo sapiens
ggagggctcctggggcaga

SEQ ID NO: 5625107 - DNA, 13 bp, Homo sapiens
ggagggctctgag

SEQ ID NO: 5625108 - DNA, 21 bp, Homo sapiens
ggagggctctgaggcgcccca

SEQ ID NO: 5625109 - DNA, 14 bp, Homo sapiens
ggagggctgaaccc

SEQ ID NO: 5625110 - DNA, 20 bp, Homo sapiens
ggagggctggaatctggaga

SEQ ID NO: 5625111 - DNA, 14 bp, Homo sapiens
ggagggctgggcag

SEQ ID NO: 5625112 - DNA, 18 bp, Homo sapiens
ggagggctgggcagggcc

SEQ ID NO: 5625113 - DNA, 17 bp, Homo sapiens
ggagggcttggcccagc

SEQ ID NO: 5625114 - DNA, 22 bp, Homo sapiens
ggagggctttgaatctgggact

SEQ ID NO: 5625115 - DNA, 17 bp, Homo sapiens
ggaggggaaaaaaatgt

SEQ ID NO: 5625116 - DNA, 16 bp, Homo sapiens
ggaggggaagaaaaac

SEQ ID NO: 5625117 - DNA, 12 bp, Homo sapiens
ggaggggaaggg

SEQ ID NO: 5625118 - DNA, 11 bp, Homo sapiens
ggaggggacag

SEQ ID NO: 5625119 - DNA, 17 bp, Homo sapiens
ggaggggacagaggccc

SEQ ID NO: 5625120 - DNA, 20 bp, Homo sapiens
ggaggggacccagctcctct

SEQ ID NO: 5625121 - DNA, 13 bp, Homo sapiens
ggaggggacgctg

SEQ ID NO: 5625122 - DNA, 14 bp, Homo sapiens
ggaggggagacttt

SEQ ID NO: 5625123 - DNA, 13 bp, Homo sapiens
ggaggggagagac

SEQ ID NO: 5625124 - DNA, 12 bp, Homo sapiens
ggaggggagagg

SEQ ID NO: 5625125 - DNA, 13 bp, Homo sapiens
ggaggggagaggg

SEQ ID NO: 5625126 - DNA, 15 bp, Homo sapiens
ggaggggagcaaggc

SEQ ID NO: 5625127 - DNA, 19 bp, Homo sapiens
ggaggggagcatgggaagt

SEQ ID NO: 5625128 - DNA, 20 bp, Homo sapiens
ggaggggagcgtctgggaac

SEQ ID NO: 5625129 - DNA, 16 bp, Homo sapiens
ggaggggagctgctgg

SEQ ID NO: 5625130 - DNA, 17 bp, Homo sapiens
ggaggggagctgctggc

SEQ ID NO: 5625131 - DNA, 18 bp, Homo sapiens
ggaggggaggcagatgga

SEQ ID NO: 5625132 - DNA, 20 bp, Homo sapiens
ggaggggatgataaaggaaa

SEQ ID NO: 5625133 - DNA, 22 bp, Homo sapiens
ggaggggatgataaaggaaata

SEQ ID NO: 5625134 - DNA, 18 bp, Homo sapiens
ggaggggatggcagacag

SEQ ID NO: 5625135 - DNA, 13 bp, Homo sapiens
ggaggggcacctg

SEQ ID NO: 5625136 - DNA, 16 bp, Homo sapiens
ggaggggcacctgcca

SEQ ID NO: 5625137 - DNA, 13 bp, Homo sapiens
ggaggggcagagc

SEQ ID NO: 5625138 - DNA, 15 bp, Homo sapiens
ggaggggcagagcca

SEQ ID NO: 5625139 - DNA, 21 bp, Homo sapiens
ggaggggcaggagagcagtga

SEQ ID NO: 5625140 - DNA, 21 bp, Homo sapiens
ggaggggcccctgcttctcca

SEQ ID NO: 5625141 - DNA, 23 bp, Homo sapiens
ggaggggcccgcttgcctcggct

SEQ ID NO: 5625142 - DNA, 14 bp, Homo sapiens
ggaggggccctcag

SEQ ID NO: 5625143 - DNA, 18 bp, Homo sapiens
ggaggggccctcaggcca

SEQ ID NO: 5625144 - DNA, 18 bp, Homo sapiens
ggaggggcctagggagcc

SEQ ID NO: 5625145 - DNA, 15 bp, Homo sapiens
ggaggggcctctgaa

SEQ ID NO: 5625146 - DNA, 12 bp, Homo sapiens
ggaggggcctgg

SEQ ID NO: 5625147 - DNA, 13 bp, Homo sapiens
ggaggggcctggc

SEQ ID NO: 5625148 - DNA, 16 bp, Homo sapiens
ggaggggcctgggcag

SEQ ID NO: 5625149 - DNA, 16 bp, Homo sapiens
ggaggggcctttgctg

SEQ ID NO: 5625150 - DNA, 23 bp, Homo sapiens
ggaggggcgcaccccacagctgg

SEQ ID NO: 5625151 - DNA, 16 bp, Homo sapiens
ggaggggcgcccaggg

SEQ ID NO: 5625152 - DNA, 20 bp, Homo sapiens
ggaggggcgctggcccagcc

SEQ ID NO: 5625153 - DNA, 17 bp, Homo sapiens
ggaggggcggcaggagg

SEQ ID NO: 5625154 - DNA, 12 bp, Homo sapiens
ggaggggcggga

SEQ ID NO: 5625155 - DNA, 14 bp, Homo sapiens
ggaggggctgagga

SEQ ID NO: 5625156 - DNA, 23 bp, Homo sapiens
ggaggggctgtcctccttcctgg

SEQ ID NO: 5625157 - DNA, 12 bp, Homo sapiens
ggaggggcttgg

SEQ ID NO: 5625158 - DNA, 19 bp, Homo sapiens
ggagggggaatggcagcag

SEQ ID NO: 5625159 - DNA, 18 bp, Homo sapiens
ggagggggaatgtagtga

SEQ ID NO: 5625160 - DNA, 12 bp, Homo sapiens
ggagggggacct

SEQ ID NO: 5625161 - DNA, 15 bp, Homo sapiens
ggagggggagggggt

SEQ ID NO: 5625162 - DNA, 13 bp, Homo sapiens
ggagggggcaaag

SEQ ID NO: 5625163 - DNA, 14 bp, Homo sapiens
ggagggggcaagct

SEQ ID NO: 5625164 - DNA, 18 bp, Homo sapiens
ggagggggcacggcaggc

SEQ ID NO: 5625165 - DNA, 14 bp, Homo sapiens
ggagggggcggcag

SEQ ID NO: 5625166 - DNA, 21 bp, Homo sapiens
ggagggggctggctctgagag

SEQ ID NO: 5625167 - DNA, 14 bp, Homo sapiens
ggagggggctggga

SEQ ID NO: 5625168 - DNA, 17 bp, Homo sapiens
ggagggggctgggaaag

SEQ ID NO: 5625169 - DNA, 22 bp, Homo sapiens
ggagggggctggggtcacagag

SEQ ID NO: 5625170 - DNA, 16 bp, Homo sapiens
ggagggggcttgaagc

SEQ ID NO: 5625171 - DNA, 21 bp, Homo sapiens
ggagggggcttgaagccaaag

SEQ ID NO: 5625172 - DNA, 18 bp, Homo sapiens
ggaggggggagccagagg

SEQ ID NO: 5625173 - DNA, 16 bp, Homo sapiens
ggaggggggagggaag

SEQ ID NO: 5625174 - DNA, 14 bp, Homo sapiens
ggaggggggaggtg

SEQ ID NO: 5625175 - DNA, 16 bp, Homo sapiens
ggaggggggggtgggg

SEQ ID NO: 5625176 - DNA, 15 bp, Homo sapiens
ggaggggggtgctgg

SEQ ID NO: 5625177 - DNA, 21 bp, Homo sapiens
ggagggggtacctcatgagga

SEQ ID NO: 5625178 - DNA, 18 bp, Homo sapiens
ggagggggtaggtgatgg

SEQ ID NO: 5625179 - DNA, 16 bp, Homo sapiens
ggagggggtcctcctc

SEQ ID NO: 5625180 - DNA, 14 bp, Homo sapiens
ggagggggttcgca

SEQ ID NO: 5625181 - DNA, 23 bp, Homo sapiens
ggagggggtttgctggggaactg

SEQ ID NO: 5625182 - DNA, 23 bp, Homo sapiens
ggaggggtaaatatatgttttga

SEQ ID NO: 5625183 - DNA, 23 bp, Homo sapiens
ggaggggtcagcaggggggttgg

SEQ ID NO: 5625184 - DNA, 16 bp, Homo sapiens
ggaggggtcagctctg

SEQ ID NO: 5625185 - DNA, 14 bp, Homo sapiens
ggaggggtctgcct

SEQ ID NO: 5625186 - DNA, 17 bp, Homo sapiens
ggaggggtgtggcagtg

SEQ ID NO: 5625187 - DNA, 14 bp, Homo sapiens
ggaggggttgccac

SEQ ID NO: 5625188 - DNA, 16 bp, Homo sapiens
ggaggggttgccacag

SEQ ID NO: 5625189 - DNA, 23 bp, Homo sapiens
ggaggggttgcgggggagctgga

SEQ ID NO: 5625190 - DNA, 20 bp, Homo sapiens
ggaggggtttgggagtcagg

SEQ ID NO: 5625191 - DNA, 13 bp, Homo sapiens
ggagggtaaataa

SEQ ID NO: 5625192 - DNA, 15 bp, Homo sapiens
ggagggtagccctgg

SEQ ID NO: 5625193 - DNA, 14 bp, Homo sapiens
ggagggtcccaagc

SEQ ID NO: 5625194 - DNA, 21 bp, Homo sapiens
ggagggtcccaagctgggccc

SEQ ID NO: 5625195 - DNA, 22 bp, Homo sapiens
ggagggtcgccacacccggctc

SEQ ID NO: 5625196 - DNA, 18 bp, Homo sapiens
ggagggtctccctgggca

SEQ ID NO: 5625197 - DNA, 18 bp, Homo sapiens
ggagggtctgggggcagc

SEQ ID NO: 5625198 - DNA, 17 bp, Homo sapiens
ggagggtcttgagggga

SEQ ID NO: 5625199 - DNA, 22 bp, Homo sapiens
ggagggtcttgaggggaagctg

SEQ ID NO: 5625200 - DNA, 22 bp, Homo sapiens
ggagggtgacccacagctctgg

SEQ ID NO: 5625201 - DNA, 16 bp, Homo sapiens
ggagggtgacgcccag

SEQ ID NO: 5625202 - DNA, 17 bp, Homo sapiens
ggagggtgacgcccagc

SEQ ID NO: 5625203 - DNA, 15 bp, Homo sapiens
ggagggtgagctggt

SEQ ID NO: 5625204 - DNA, 15 bp, Homo sapiens
ggagggtgcagccct

SEQ ID NO: 5625205 - DNA, 16 bp, Homo sapiens
ggagggtgcccctggg

SEQ ID NO: 5625206 - DNA, 20 bp, Homo sapiens
ggagggtggcacttcgtgga

SEQ ID NO: 5625207 - DNA, 12 bp, Homo sapiens
ggagggtggcag

SEQ ID NO: 5625208 - DNA, 14 bp, Homo sapiens
ggagggtggcagag

SEQ ID NO: 5625209 - DNA, 13 bp, Homo sapiens
ggagggtggggcc

SEQ ID NO: 5625210 - DNA, 20 bp, Homo sapiens
ggagggtgggggccacctgc

SEQ ID NO: 5625211 - DNA, 22 bp, Homo sapiens
ggagggtgggggccacctgcct

SEQ ID NO: 5625212 - DNA, 17 bp, Homo sapiens
ggagggtgtctggggac

SEQ ID NO: 5625213 - DNA, 15 bp, Homo sapiens
ggagggttcccctgg

SEQ ID NO: 5625214 - DNA, 18 bp, Homo sapiens
ggagggtttgggcagagc

SEQ ID NO: 5625215 - DNA, 22 bp, Homo sapiens
ggaggtaacatagatgcctggg

SEQ ID NO: 5625216 - DNA, 22 bp, Homo sapiens
ggaggtaaggaatacctgtccc

SEQ ID NO: 5625217 - DNA, 17 bp, Homo sapiens
ggaggtactgagacagg

SEQ ID NO: 5625218 - DNA, 20 bp, Homo sapiens
ggaggtagaggttgtggtga

SEQ ID NO: 5625219 - DNA, 16 bp, Homo sapiens
ggaggtatgggctggg

SEQ ID NO: 5625220 - DNA, 22 bp, Homo sapiens
ggaggtattcgtaaggatggga

SEQ ID NO: 5625221 - DNA, 19 bp, Homo sapiens
ggaggtcacagctggatct

SEQ ID NO: 5625222 - DNA, 16 bp, Homo sapiens
ggaggtcaggccctgg

SEQ ID NO: 5625223 - DNA, 18 bp, Homo sapiens
ggaggtccaagcagagtg

SEQ ID NO: 5625224 - DNA, 22 bp, Homo sapiens
ggaggtccaaggtcaaggcacc

SEQ ID NO: 5625225 - DNA, 14 bp, Homo sapiens
ggaggtccagctgg

SEQ ID NO: 5625226 - DNA, 17 bp, Homo sapiens
ggaggtccagctgggcc

SEQ ID NO: 5625227 - DNA, 22 bp, Homo sapiens
ggaggtcccagacatgctgccc

SEQ ID NO: 5625228 - DNA, 16 bp, Homo sapiens
ggaggtcccagccctg

SEQ ID NO: 5625229 - DNA, 17 bp, Homo sapiens
ggaggtcccagccctgg

SEQ ID NO: 5625230 - DNA, 13 bp, Homo sapiens
ggaggtcccaggg

SEQ ID NO: 5625231 - DNA, 13 bp, Homo sapiens
ggaggtcctcctc

SEQ ID NO: 5625232 - DNA, 15 bp, Homo sapiens
ggaggtcgaagcaat

SEQ ID NO: 5625233 - DNA, 16 bp, Homo sapiens
ggaggtcgaagcaatc

SEQ ID NO: 5625234 - DNA, 21 bp, Homo sapiens
ggaggtcgaagcaatcagcaa

SEQ ID NO: 5625235 - DNA, 17 bp, Homo sapiens
ggaggtcgtgtatttgg

SEQ ID NO: 5625236 - DNA, 18 bp, Homo sapiens
ggaggtctccactgagga

SEQ ID NO: 5625237 - DNA, 16 bp, Homo sapiens
ggatacagtgcccacc

SEQ ID NO: 5625238 - DNA, 16 bp, Homo sapiens
ggatacatctgctgtg

SEQ ID NO: 5625239 - DNA, 18 bp, Homo sapiens
ggataccaatattctatt

SEQ ID NO: 5625240 - DNA, 16 bp, Homo sapiens
ggataccagctcaggg

SEQ ID NO: 5625241 - DNA, 13 bp, Homo sapiens
ggataccagctga

SEQ ID NO: 5625242 - DNA, 17 bp, Homo sapiens
ggataccttcttattta

SEQ ID NO: 5625243 - DNA, 15 bp, Homo sapiens
ggatacgtgtcaatg

SEQ ID NO: 5625244 - DNA, 18 bp, Homo sapiens
ggatactctgtcagatgg

SEQ ID NO: 5625245 - DNA, 15 bp, Homo sapiens
ggatactgcagggcc

SEQ ID NO: 5625246 - DNA, 16 bp, Homo sapiens
ggatactgcagggcca

SEQ ID NO: 5625247 - DNA, 21 bp, Homo sapiens
ggatactgcagggccaggact

SEQ ID NO: 5625248 - DNA, 18 bp, Homo sapiens
ggatactggggggcaggc

SEQ ID NO: 5625249 - DNA, 23 bp, Homo sapiens
ggatactgtgacctttgtctaga

SEQ ID NO: 5625250 - DNA, 17 bp, Homo sapiens
ggatacttaacaaatac

SEQ ID NO: 5625251 - DNA, 12 bp, Homo sapiens
ggatacttgaaa

SEQ ID NO: 5625252 - DNA, 21 bp, Homo sapiens
ggatacttgaaaccagtattt

SEQ ID NO: 5625253 - DNA, 14 bp, Homo sapiens
ggatagacactgga

SEQ ID NO: 5625254 - DNA, 15 bp, Homo sapiens
ggatagacactggac

SEQ ID NO: 5625255 - DNA, 14 bp, Homo sapiens
ggatagacttggga

SEQ ID NO: 5625256 - DNA, 14 bp, Homo sapiens
ggatagagacttgc

SEQ ID NO: 5625257 - DNA, 17 bp, Homo sapiens
ggatagagcagcctgct

SEQ ID NO: 5625258 - DNA, 18 bp, Homo sapiens
ggatagagcagcctgctg

SEQ ID NO: 5625259 - DNA, 14 bp, Homo sapiens
ggatagaggggctg

SEQ ID NO: 5625260 - DNA, 15 bp, Homo sapiens
ggatagaggggctgc

SEQ ID NO: 5625261 - DNA, 17 bp, Homo sapiens
ggatagataactctttg

SEQ ID NO: 5625262 - DNA, 15 bp, Homo sapiens
ggatagatgccctgc

SEQ ID NO: 5625263 - DNA, 13 bp, Homo sapiens
ggatagatgctgg

SEQ ID NO: 5625264 - DNA, 24 bp, Homo sapiens
ggatagatgtgattcctgcatttt

SEQ ID NO: 5625265 - DNA, 14 bp, Homo sapiens
ggatagatgtgtgg

SEQ ID NO: 5625266 - DNA, 13 bp, Homo sapiens
ggatagcattttt

SEQ ID NO: 5625267 - DNA, 14 bp, Homo sapiens
ggatagccttgaaa

SEQ ID NO: 5625268 - DNA, 17 bp, Homo sapiens
ggatagccttgaaaaca

SEQ ID NO: 5625269 - DNA, 18 bp, Homo sapiens
ggatagccttgaaaacaa

SEQ ID NO: 5625270 - DNA, 21 bp, Homo sapiens
ggatagccttgaaaacaaaca

SEQ ID NO: 5625271 - DNA, 15 bp, Homo sapiens
ggatagcctttgtag

SEQ ID NO: 5625272 - DNA, 19 bp, Homo sapiens
ggatagctaactgtaaatc

SEQ ID NO: 5625273 - DNA, 11 bp, Homo sapiens
ggataggaaaa

SEQ ID NO: 5625274 - DNA, 16 bp, Homo sapiens
ggataggacagaggga

SEQ ID NO: 5625275 - DNA, 18 bp, Homo sapiens
ggataggagcttccagat

SEQ ID NO: 5625276 - DNA, 19 bp, Homo sapiens
ggataggagggtgcccctg

SEQ ID NO: 5625277 - DNA, 22 bp, Homo sapiens
ggataggagggtgcccctggga

SEQ ID NO: 5625278 - DNA, 14 bp, Homo sapiens
ggataggccagccg

SEQ ID NO: 5625279 - DNA, 14 bp, Homo sapiens
ggatagtagatctg

SEQ ID NO: 5625280 - DNA, 23 bp, Homo sapiens
ggatagtagttaaataactgtgt

SEQ ID NO: 5625281 - DNA, 15 bp, Homo sapiens
ggatagtatgtaatt

SEQ ID NO: 5625282 - DNA, 19 bp, Homo sapiens
ggatagtccttcctggcat

SEQ ID NO: 5625283 - DNA, 13 bp, Homo sapiens
ggatataaaagga

SEQ ID NO: 5625284 - DNA, 17 bp, Homo sapiens
ggatataaaatgaaaga

SEQ ID NO: 5625285 - DNA, 20 bp, Homo sapiens
ggatataaaatgaaagattt

SEQ ID NO: 5625286 - DNA, 13 bp, Homo sapiens
ggatataaatata

SEQ ID NO: 5625287 - DNA, 16 bp, Homo sapiens
ggatataatgtatttt

SEQ ID NO: 5625288 - DNA, 14 bp, Homo sapiens
ggatatactgcagc

SEQ ID NO: 5625289 - DNA, 20 bp, Homo sapiens
ggatatagttttacttttaa

SEQ ID NO: 5625290 - DNA, 16 bp, Homo sapiens
ggatatattattgtaa

SEQ ID NO: 5625291 - DNA, 12 bp, Homo sapiens
ggatatatttga

SEQ ID NO: 5625292 - DNA, 13 bp, Homo sapiens
ggatatcagggta

SEQ ID NO: 5625293 - DNA, 23 bp, Homo sapiens
ggatatctacattataccgcaga

SEQ ID NO: 5625294 - DNA, 16 bp, Homo sapiens
ggatatctgaaaatat

SEQ ID NO: 5625295 - DNA, 14 bp, Homo sapiens
ggatatgagtagcc

SEQ ID NO: 5625296 - DNA, 22 bp, Homo sapiens
ggatatgccctcctggtgactc

SEQ ID NO: 5625297 - DNA, 16 bp, Homo sapiens
ggatatgcttagtaat

SEQ ID NO: 5625298 - DNA, 16 bp, Homo sapiens
ggatatgggctaccag

SEQ ID NO: 5625299 - DNA, 16 bp, Homo sapiens
ggatatgtaaaacatt

SEQ ID NO: 5625300 - DNA, 21 bp, Homo sapiens
ggatatgttgtattaactggg

SEQ ID NO: 5625301 - DNA, 13 bp, Homo sapiens
ggatattaaaatg

SEQ ID NO: 5625302 - DNA, 20 bp, Homo sapiens
ggatattaaacgtgtaaatt

SEQ ID NO: 5625303 - DNA, 9 bp, Homo sapiens
ggatattat

SEQ ID NO: 5625304 - DNA, 17 bp, Homo sapiens
ggatattctcctcggac

SEQ ID NO: 5625305 - DNA, 17 bp, Homo sapiens
ggatattgccttatttg

SEQ ID NO: 5625306 - DNA, 22 bp, Homo sapiens
ggatattgccttatttgtctgt

SEQ ID NO: 5625307 - DNA, 23 bp, Homo sapiens
ggatattgccttatttgtctgta

SEQ ID NO: 5625308 - DNA, 17 bp, Homo sapiens
ggatatttactgctctt

SEQ ID NO: 5625309 - DNA, 18 bp, Homo sapiens
ggatatttagaactttgt

SEQ ID NO: 5625310 - DNA, 21 bp, Homo sapiens
ggatattttcaacaattagag

SEQ ID NO: 5625311 - DNA, 23 bp, Homo sapiens
ggatattttttggtgtgccctgt

SEQ ID NO: 5625312 - DNA, 22 bp, Homo sapiens
ggatcaaacctttctggcctgt

SEQ ID NO: 5625313 - DNA, 19 bp, Homo sapiens
ggatcaacaacatccactg

SEQ ID NO: 5625314 - DNA, 15 bp, Homo sapiens
ggatcaaccaggcag

SEQ ID NO: 5625315 - DNA, 19 bp, Homo sapiens
ggatcaattttcattaaac

SEQ ID NO: 5625316 - DNA, 18 bp, Homo sapiens
ggatcacaaggtcaggag

SEQ ID NO: 5625317 - DNA, 19 bp, Homo sapiens
ggatcacacctcagtggga

SEQ ID NO: 5625318 - DNA, 22 bp, Homo sapiens
ggatcacaggtgtcagccattg

SEQ ID NO: 5625319 - DNA, 19 bp, Homo sapiens
ggatcacgacgctgcagag

SEQ ID NO: 5625320 - DNA, 18 bp, Homo sapiens
ggatcactctctgctggc

SEQ ID NO: 5625321 - DNA, 22 bp, Homo sapiens
ggatcacttgagcccaggaagt

SEQ ID NO: 5625322 - DNA, 21 bp, Homo sapiens
ggatcacttgggcccaggagg

SEQ ID NO: 5625323 - DNA, 14 bp, Homo sapiens
ggatcagaaataca

SEQ ID NO: 5625324 - DNA, 16 bp, Homo sapiens
ggatcagagcaggacc

SEQ ID NO: 5625325 - DNA, 16 bp, Homo sapiens
ggatcagagcaggagc

SEQ ID NO: 5625326 - DNA, 17 bp, Homo sapiens
ggatcagagtctggcct

SEQ ID NO: 5625327 - DNA, 21 bp, Homo sapiens
ggatcagatctggggcagcac

SEQ ID NO: 5625328 - DNA, 21 bp, Homo sapiens
ggatcagatgaactcttagaa

SEQ ID NO: 5625329 - DNA, 16 bp, Homo sapiens
ggatcagattgcatgt

SEQ ID NO: 5625330 - DNA, 23 bp, Homo sapiens
ggatcagatttggtgatggaaaa

SEQ ID NO: 5625331 - DNA, 21 bp, Homo sapiens
ggatcagccccgcctgtcaca

SEQ ID NO: 5625332 - DNA, 22 bp, Homo sapiens
ggatcagcctccgccattccaa

SEQ ID NO: 5625333 - DNA, 17 bp, Homo sapiens
ggatcagcgtggccttg

SEQ ID NO: 5625334 - DNA, 13 bp, Homo sapiens
ggatcaggaagcc

SEQ ID NO: 5625335 - DNA, 13 bp, Homo sapiens
ggatcaggagccc

SEQ ID NO: 5625336 - DNA, 21 bp, Homo sapiens
ggatcagggaatccagctccc

SEQ ID NO: 5625337 - DNA, 21 bp, Homo sapiens
ggatcagtctgattcccaagc

SEQ ID NO: 5625338 - DNA, 17 bp, Homo sapiens
ggatcagtgaaaaacat

SEQ ID NO: 5625339 - DNA, 14 bp, Homo sapiens
ggatcatatggagc

SEQ ID NO: 5625340 - DNA, 21 bp, Homo sapiens
ggatcatctaattctctgtgg

SEQ ID NO: 5625341 - DNA, 19 bp, Homo sapiens
ggatcatctgccgtgcctg

SEQ ID NO: 5625342 - DNA, 19 bp, Homo sapiens
ggatcatgaaagtagacag

SEQ ID NO: 5625343 - DNA, 19 bp, Homo sapiens
ggatcatggtgtaataaga

SEQ ID NO: 5625344 - DNA, 21 bp, Homo sapiens
ggatcatggtgtaataagaca

SEQ ID NO: 5625345 - DNA, 20 bp, Homo sapiens
ggatcatttttccaggactc

SEQ ID NO: 5625346 - DNA, 17 bp, Homo sapiens
ggatccaaactgatcca

SEQ ID NO: 5625347 - DNA, 22 bp, Homo sapiens
ggatccaataattttcctgtga

SEQ ID NO: 5625348 - DNA, 21 bp, Homo sapiens
ggatccaattttaatattaac

SEQ ID NO: 5625349 - DNA, 15 bp, Homo sapiens
ggatccactgtgcag

SEQ ID NO: 5625350 - DNA, 23 bp, Homo sapiens
ggatccacttcttggttcctggg

SEQ ID NO: 5625351 - DNA, 12 bp, Homo sapiens
ggatccagagac

SEQ ID NO: 5625352 - DNA, 18 bp, Homo sapiens
ggatccagagacctgctc

SEQ ID NO: 5625353 - DNA, 19 bp, Homo sapiens
ggatccagagacttgggga

SEQ ID NO: 5625354 - DNA, 13 bp, Homo sapiens
ggatccagagaga

SEQ ID NO: 5625355 - DNA, 21 bp, Homo sapiens
ggatccagccacttccccctc

SEQ ID NO: 5625356 - DNA, 18 bp, Homo sapiens
ggatccagccattcctga

SEQ ID NO: 5625357 - DNA, 12 bp, Homo sapiens
ggatccaggccc

SEQ ID NO: 5625358 - DNA, 13 bp, Homo sapiens
ggatccaggcccc

SEQ ID NO: 5625359 - DNA, 15 bp, Homo sapiens
ggatccatgggggga

SEQ ID NO: 5625360 - DNA, 13 bp, Homo sapiens
ggatcccaaagca

SEQ ID NO: 5625361 - DNA, 17 bp, Homo sapiens
ggatcccaaagcaagga

SEQ ID NO: 5625362 - DNA, 16 bp, Homo sapiens
ggatcccaagcctcct

SEQ ID NO: 5625363 - DNA, 14 bp, Homo sapiens
ggatcccacagccc

SEQ ID NO: 5625364 - DNA, 18 bp, Homo sapiens
ggatcccacagccctagt

SEQ ID NO: 5625365 - DNA, 23 bp, Homo sapiens
ggatcccaccccattttctgtgg

SEQ ID NO: 5625366 - DNA, 16 bp, Homo sapiens
ggatcccaccctgggg

SEQ ID NO: 5625367 - DNA, 19 bp, Homo sapiens
ggatcccagcatctcagag

SEQ ID NO: 5625368 - DNA, 16 bp, Homo sapiens
ggatcccatcaaagaa

SEQ ID NO: 5625369 - DNA, 20 bp, Homo sapiens
ggatcccatgagctccttaa

SEQ ID NO: 5625370 - DNA, 13 bp, Homo sapiens
ggatcccccgccc

SEQ ID NO: 5625371 - DNA, 13 bp, Homo sapiens
ggatccccctctt

SEQ ID NO: 5625372 - DNA, 22 bp, Homo sapiens
ggatccccgcctggccaggagc

SEQ ID NO: 5625373 - DNA, 22 bp, Homo sapiens
ggatcccctctgtctacaaata

SEQ ID NO: 5625374 - DNA, 12 bp, Homo sapiens
ggatcccctgct

SEQ ID NO: 5625375 - DNA, 16 bp, Homo sapiens
ggatcccctgtcccct

SEQ ID NO: 5625376 - DNA, 21 bp, Homo sapiens
ggatcccctgtcccctggggc

SEQ ID NO: 5625377 - DNA, 22 bp, Homo sapiens
ggatcccctgtcccctggggct

SEQ ID NO: 5625378 - DNA, 13 bp, Homo sapiens
ggatccctcatcc

SEQ ID NO: 5625379 - DNA, 18 bp, Homo sapiens
ggatccctcatctgtccc

SEQ ID NO: 5625380 - DNA, 22 bp, Homo sapiens
ggatccctcatctgtccctccg

SEQ ID NO: 5625381 - DNA, 18 bp, Homo sapiens
ggatccctccatccggct

SEQ ID NO: 5625382 - DNA, 15 bp, Homo sapiens
ggatccctcctgagc

SEQ ID NO: 5625383 - DNA, 16 bp, Homo sapiens
ggatccctcctgagct

SEQ ID NO: 5625384 - DNA, 17 bp, Homo sapiens
ggatccctcctgagctc

SEQ ID NO: 5625385 - DNA, 18 bp, Homo sapiens
ggatccctctgggcactg

SEQ ID NO: 5625386 - DNA, 15 bp, Homo sapiens
ggatccgaaacggca

SEQ ID NO: 5625387 - DNA, 19 bp, Homo sapiens
ggatccgactgctttggac

SEQ ID NO: 5625388 - DNA, 15 bp, Homo sapiens
ggatccgagggcccc

SEQ ID NO: 5625389 - DNA, 18 bp, Homo sapiens
ggatcctagccttatcct

SEQ ID NO: 5625390 - DNA, 15 bp, Homo sapiens
ggatcctcacaggag

SEQ ID NO: 5625391 - DNA, 23 bp, Homo sapiens
ggatcctcacaggagcagacaga

SEQ ID NO: 5625392 - DNA, 16 bp, Homo sapiens
ggatcctcataggtca

SEQ ID NO: 5625393 - DNA, 13 bp, Homo sapiens
ggatcctccacag

SEQ ID NO: 5625394 - DNA, 15 bp, Homo sapiens
ggatcctccacagag

SEQ ID NO: 5625395 - DNA, 12 bp, Homo sapiens
ggatcctccagg

SEQ ID NO: 5625396 - DNA, 15 bp, Homo sapiens
ggatcctccaggtgc

SEQ ID NO: 5625397 - DNA, 12 bp, Homo sapiens
ggatcctccctc

SEQ ID NO: 5625398 - DNA, 12 bp, Homo sapiens
ggatcctcctgg

SEQ ID NO: 5625399 - DNA, 15 bp, Homo sapiens
ggatcctgagccaga

SEQ ID NO: 5625400 - DNA, 20 bp, Homo sapiens
ggatcctgagccagatttca

SEQ ID NO: 5625401 - DNA, 23 bp, Homo sapiens
ggatcctgagccagatttcactc

SEQ ID NO: 5625402 - DNA, 12 bp, Homo sapiens
ggatcctgcccc

SEQ ID NO: 5625403 - DNA, 14 bp, Homo sapiens
ggatcctgccccca

SEQ ID NO: 5625404 - DNA, 17 bp, Homo sapiens
ggatcctgcccccaagt

SEQ ID NO: 5625405 - DNA, 21 bp, Homo sapiens
ggatcctgctgctttgggctg

SEQ ID NO: 5625406 - DNA, 14 bp, Homo sapiens
ggatcctgctgtgg

SEQ ID NO: 5625407 - DNA, 12 bp, Homo sapiens
ggatcctggagc

SEQ ID NO: 5625408 - DNA, 14 bp, Homo sapiens
ggatcctggcctga

SEQ ID NO: 5625409 - DNA, 16 bp, Homo sapiens
ggatcctggcctgaga

SEQ ID NO: 5625410 - DNA, 16 bp, Homo sapiens
ggatcctgtgtggaga

SEQ ID NO: 5625411 - DNA, 13 bp, Homo sapiens
ggatccttcccaa

SEQ ID NO: 5625412 - DNA, 20 bp, Homo sapiens
ggatccttcccaaggtacag

SEQ ID NO: 5625413 - DNA, 21 bp, Homo sapiens
ggatcgaagggtttttagaga

SEQ ID NO: 5625414 - DNA, 14 bp, Homo sapiens
ggatcgacaagaag

SEQ ID NO: 5625415 - DNA, 14 bp, Homo sapiens
ggatcgaggcatgg

SEQ ID NO: 5625416 - DNA, 14 bp, Homo sapiens
ggatttgttctctg

SEQ ID NO: 5625417 - DNA, 15 bp, Homo sapiens
ggatttgttctctgt

SEQ ID NO: 5625418 - DNA, 20 bp, Homo sapiens
ggattttaaaaaatcaatca

SEQ ID NO: 5625419 - DNA, 22 bp, Homo sapiens
ggattttaacaaaagcaagact

SEQ ID NO: 5625420 - DNA, 14 bp, Homo sapiens
ggattttaccaaag

SEQ ID NO: 5625421 - DNA, 16 bp, Homo sapiens
ggattttaccaaagca

SEQ ID NO: 5625422 - DNA, 20 bp, Homo sapiens
ggattttcaagttattcaga

SEQ ID NO: 5625423 - DNA, 17 bp, Homo sapiens
ggattttcatatattta

SEQ ID NO: 5625424 - DNA, 16 bp, Homo sapiens
ggattttcatcagggg

SEQ ID NO: 5625425 - DNA, 16 bp, Homo sapiens
ggattttgtcaagcag

SEQ ID NO: 5625426 - DNA, 13 bp, Homo sapiens
ggattttgtggct

SEQ ID NO: 5625427 - DNA, 16 bp, Homo sapiens
ggatttttcagaaaaa

SEQ ID NO: 5625428 - DNA, 16 bp, Homo sapiens
ggatttttccatgtgt

SEQ ID NO: 5625429 - DNA, 14 bp, Homo sapiens
ggatttttgtcttg

SEQ ID NO: 5625430 - DNA, 13 bp, Homo sapiens
ggattttttaaaa

SEQ ID NO: 5625431 - DNA, 12 bp, Homo sapiens
ggattttttcca

SEQ ID NO: 5625432 - DNA, 23 bp, Homo sapiens
ggatttttttataaacagtttta

SEQ ID NO: 5625433 - DNA, 14 bp, Homo sapiens
ggcaaaaaagaaca

SEQ ID NO: 5625434 - DNA, 23 bp, Homo sapiens
ggcaaaaatgtccagccaccccc

SEQ ID NO: 5625435 - DNA, 21 bp, Homo sapiens
ggcaaaaatttgacattgtca

SEQ ID NO: 5625436 - DNA, 17 bp, Homo sapiens
ggcaaaacagccctcag

SEQ ID NO: 5625437 - DNA, 11 bp, Homo sapiens
ggcaaaaccca

SEQ ID NO: 5625438 - DNA, 15 bp, Homo sapiens
ggcaaaacccaggac

SEQ ID NO: 5625439 - DNA, 18 bp, Homo sapiens
ggcaaaactttggcactg

SEQ ID NO: 5625440 - DNA, 15 bp, Homo sapiens
ggcaaaagaaaagct

SEQ ID NO: 5625441 - DNA, 18 bp, Homo sapiens
ggcaaaagacatcctcaa

SEQ ID NO: 5625442 - DNA, 13 bp, Homo sapiens
ggcaaaagactgg

SEQ ID NO: 5625443 - DNA, 16 bp, Homo sapiens
ggcaaaagccttgtgt

SEQ ID NO: 5625444 - DNA, 20 bp, Homo sapiens
ggcaaaagggcagctgtgat

SEQ ID NO: 5625445 - DNA, 18 bp, Homo sapiens
ggcaaaagtaatcatgtt

SEQ ID NO: 5625446 - DNA, 23 bp, Homo sapiens
ggcaaaagtctgaggcacctgca

SEQ ID NO: 5625447 - DNA, 18 bp, Homo sapiens
ggcaaaagtgtaacaacc

SEQ ID NO: 5625448 - DNA, 13 bp, Homo sapiens
ggcaaaattgcaa

SEQ ID NO: 5625449 - DNA, 10 bp, Homo sapiens
ggcaaacaat

SEQ ID NO: 5625450 - DNA, 20 bp, Homo sapiens
ggcaaacagagctactgaga

SEQ ID NO: 5625451 - DNA, 14 bp, Homo sapiens
ggcaaacagggcct

SEQ ID NO: 5625452 - DNA, 16 bp, Homo sapiens
ggcaaaccctggtgct

SEQ ID NO: 5625453 - DNA, 15 bp, Homo sapiens
ggcaaacctttcccc

SEQ ID NO: 5625454 - DNA, 17 bp, Homo sapiens
ggcaaactgaggcagca

SEQ ID NO: 5625455 - DNA, 17 bp, Homo sapiens
ggcaaacttcagactga

SEQ ID NO: 5625456 - DNA, 16 bp, Homo sapiens
ggcaaacttttatgca

SEQ ID NO: 5625457 - DNA, 12 bp, Homo sapiens
ggcaaagaaaac

SEQ ID NO: 5625458 - DNA, 20 bp, Homo sapiens
ggcaaagaactgccccatct

SEQ ID NO: 5625459 - DNA, 19 bp, Homo sapiens
ggcaaagagctcccgagga

SEQ ID NO: 5625460 - DNA, 22 bp, Homo sapiens
ggcaaagagctcccgaggaagc

SEQ ID NO: 5625461 - DNA, 21 bp, Homo sapiens
ggcaaagaggtgctgctttgc

SEQ ID NO: 5625462 - DNA, 19 bp, Homo sapiens
ggcaaagccacaaggctgg

SEQ ID NO: 5625463 - DNA, 11 bp, Homo sapiens
ggcaaagctga

SEQ ID NO: 5625464 - DNA, 18 bp, Homo sapiens
ggcaaagctgctgggcca

SEQ ID NO: 5625465 - DNA, 23 bp, Homo sapiens
ggcaaagctgctgggccagtggc

SEQ ID NO: 5625466 - DNA, 12 bp, Homo sapiens
ggcaaagctgga

SEQ ID NO: 5625467 - DNA, 18 bp, Homo sapiens
ggcaaagcttttagaaat

SEQ ID NO: 5625468 - DNA, 17 bp, Homo sapiens
ggcaaaggaaggtggat

SEQ ID NO: 5625469 - DNA, 19 bp, Homo sapiens
ggcaaaggaaggtggatgg

SEQ ID NO: 5625470 - DNA, 16 bp, Homo sapiens
ggcaaaggcagaggaa

SEQ ID NO: 5625471 - DNA, 16 bp, Homo sapiens
ggcaaaggcagggcca

SEQ ID NO: 5625472 - DNA, 21 bp, Homo sapiens
ggcaaaggcccggctgagccc

SEQ ID NO: 5625473 - DNA, 14 bp, Homo sapiens
ggcaaagtccagct

SEQ ID NO: 5625474 - DNA, 14 bp, Homo sapiens
ggcaaagtttaaat

SEQ ID NO: 5625475 - DNA, 16 bp, Homo sapiens
ggcaaagtttaaatgt

SEQ ID NO: 5625476 - DNA, 23 bp, Homo sapiens
ggcaaagtttaaatgtattttac

SEQ ID NO: 5625477 - DNA, 19 bp, Homo sapiens
ggcaaataatggaaaaata

SEQ ID NO: 5625478 - DNA, 19 bp, Homo sapiens
ggcaaatattttgtcactg

SEQ ID NO: 5625479 - DNA, 19 bp, Homo sapiens
ggcaaatcaggggccagag

SEQ ID NO: 5625480 - DNA, 17 bp, Homo sapiens
ggcaaatccgaaatcag

SEQ ID NO: 5625481 - DNA, 11 bp, Homo sapiens
ggcaaatctgc

SEQ ID NO: 5625482 - DNA, 19 bp, Homo sapiens
ggcaaatgacatgcactga

SEQ ID NO: 5625483 - DNA, 20 bp, Homo sapiens
ggcaaatgacatgcactgac

SEQ ID NO: 5625484 - DNA, 19 bp, Homo sapiens
ggcaaatgccaggacagct

SEQ ID NO: 5625485 - DNA, 22 bp, Homo sapiens
ggcaaatgccaggacagctgca

SEQ ID NO: 5625486 - DNA, 18 bp, Homo sapiens
ggcaaatgccagggcccg

SEQ ID NO: 5625487 - DNA, 13 bp, Homo sapiens
ggcaaatgcccaa

SEQ ID NO: 5625488 - DNA, 16 bp, Homo sapiens
ggcaaatgcccttcaa

SEQ ID NO: 5625489 - DNA, 17 bp, Homo sapiens
ggcaaatgcctgactca

SEQ ID NO: 5625490 - DNA, 23 bp, Homo sapiens
ggcaaatgtaaagtctagaaaat

SEQ ID NO: 5625491 - DNA, 22 bp, Homo sapiens
ggcaaatgtccaagcatcagca

SEQ ID NO: 5625492 - DNA, 16 bp, Homo sapiens
ggcaaatgtttacatt

SEQ ID NO: 5625493 - DNA, 18 bp, Homo sapiens
ggcaaatgtttacatttt

SEQ ID NO: 5625494 - DNA, 15 bp, Homo sapiens
ggcaaattaactgta

SEQ ID NO: 5625495 - DNA, 16 bp, Homo sapiens
ggcaaattaacttgag

SEQ ID NO: 5625496 - DNA, 21 bp, Homo sapiens
ggcaaatttttattttttagt

SEQ ID NO: 5625497 - DNA, 18 bp, Homo sapiens
ggcaacaaactgcacatg

SEQ ID NO: 5625498 - DNA, 20 bp, Homo sapiens
ggcaacaaagtgagactcca

SEQ ID NO: 5625499 - DNA, 14 bp, Homo sapiens
ggcaacacagaggc

SEQ ID NO: 5625500 - DNA, 18 bp, Homo sapiens
ggcaacactcactgcctg

SEQ ID NO: 5625501 - DNA, 22 bp, Homo sapiens
ggcaacactgcaggacagtcaa

SEQ ID NO: 5625502 - DNA, 18 bp, Homo sapiens
ggcaacactgctgtccac

SEQ ID NO: 5625503 - DNA, 21 bp, Homo sapiens
ggcaacactggaacatggcta

SEQ ID NO: 5625504 - DNA, 19 bp, Homo sapiens
ggcaacaggacagagttca

SEQ ID NO: 5625505 - DNA, 18 bp, Homo sapiens
ggcaacagtgttctgagc

SEQ ID NO: 5625506 - DNA, 19 bp, Homo sapiens
ggcaacatcttacttgtcc

SEQ ID NO: 5625507 - DNA, 14 bp, Homo sapiens
ggcaacatctttat

SEQ ID NO: 5625508 - DNA, 19 bp, Homo sapiens
ggcaacattacaaacaaag

SEQ ID NO: 5625509 - DNA, 11 bp, Homo sapiens
ggcaacattcc

SEQ ID NO: 5625510 - DNA, 18 bp, Homo sapiens
ggcaacattccaagaata

SEQ ID NO: 5625511 - DNA, 20 bp, Homo sapiens
ggcaaccacaggcagcattt

SEQ ID NO: 5625512 - DNA, 18 bp, Homo sapiens
ggcaaccacatgtcccag

SEQ ID NO: 5625513 - DNA, 19 bp, Homo sapiens
ggcaaccactaagaattca

SEQ ID NO: 5625514 - DNA, 13 bp, Homo sapiens
ggcaaccagccag

SEQ ID NO: 5625515 - DNA, 18 bp, Homo sapiens
ggcaaccccagttctgct

SEQ ID NO: 5625516 - DNA, 20 bp, Homo sapiens
ggcaaccccagttctgctcc

SEQ ID NO: 5625517 - DNA, 22 bp, Homo sapiens
ggcaaccccagttctgctcctc

SEQ ID NO: 5625518 - DNA, 17 bp, Homo sapiens
ggcaacccccagcctgc

SEQ ID NO: 5625519 - DNA, 20 bp, Homo sapiens
ggcaaccccctcggagcctg

SEQ ID NO: 5625520 - DNA, 22 bp, Homo sapiens
ggcaacctcccatcccaccccc

SEQ ID NO: 5625521 - DNA, 19 bp, Homo sapiens
ggcaacctggctctggccc

SEQ ID NO: 5625522 - DNA, 12 bp, Homo sapiens
ggcaacctgtaa

SEQ ID NO: 5625523 - DNA, 16 bp, Homo sapiens
ggcaacctgtaactgc

SEQ ID NO: 5625524 - DNA, 19 bp, Homo sapiens
ggcaaccttgtctctatgc

SEQ ID NO: 5625525 - DNA, 17 bp, Homo sapiens
ggcaacgaagaaaaaaa

SEQ ID NO: 5625526 - DNA, 17 bp, Homo sapiens
ggcaacgattcacagcc

SEQ ID NO: 5625527 - DNA, 15 bp, Homo sapiens
ggcaacgtagcctgg

SEQ ID NO: 5625528 - DNA, 20 bp, Homo sapiens
ggcaactgaggcagacagca

SEQ ID NO: 5625529 - DNA, 18 bp, Homo sapiens
ggcaactgcattggcttt

SEQ ID NO: 5625530 - DNA, 19 bp, Homo sapiens
ggcaactgcattggctttg

SEQ ID NO: 5625531 - DNA, 13 bp, Homo sapiens
ggcaactgctgat

SEQ ID NO: 5625532 - DNA, 22 bp, Homo sapiens
ggcaactgtattaaagaaaaat

SEQ ID NO: 5625533 - DNA, 23 bp, Homo sapiens
ggcaacttcagtcctgggagacc

SEQ ID NO: 5625534 - DNA, 18 bp, Homo sapiens
ggcaacttgggaactaga

SEQ ID NO: 5625535 - DNA, 22 bp, Homo sapiens
ggcaactttccttgttccccat

SEQ ID NO: 5625536 - DNA, 19 bp, Homo sapiens
ggcaagaaaagagttaagg

SEQ ID NO: 5625537 - DNA, 19 bp, Homo sapiens
ggcaagaaagcttccttca

SEQ ID NO: 5625538 - DNA, 21 bp, Homo sapiens
ggcaagaaagcttgagtctca

SEQ ID NO: 5625539 - DNA, 22 bp, Homo sapiens
ggcaagaaattcattaaagaaa

SEQ ID NO: 5625540 - DNA, 18 bp, Homo sapiens
ggcaagaacccaagtgcc

SEQ ID NO: 5625541 - DNA, 14 bp, Homo sapiens
ggcaagaacttgtt

SEQ ID NO: 5625542 - DNA, 19 bp, Homo sapiens
ggcaagaatgaaatactct

SEQ ID NO: 5625543 - DNA, 17 bp, Homo sapiens
ggcaagacagaaaagtg

SEQ ID NO: 5625544 - DNA, 16 bp, Homo sapiens
ggcaagacctcttccc

SEQ ID NO: 5625545 - DNA, 23 bp, Homo sapiens
ggcaagacctcttccctctgggc

SEQ ID NO: 5625546 - DNA, 21 bp, Homo sapiens
ggcaagagaaatgaggaagaa

SEQ ID NO: 5625547 - DNA, 13 bp, Homo sapiens
ggcaagagatcat

SEQ ID NO: 5625548 - DNA, 22 bp, Homo sapiens
ggcaagagatcatatcctcaga

SEQ ID NO: 5625549 - DNA, 24 bp, Homo sapiens
ggcaagagctctttgtctcaccag

SEQ ID NO: 5625550 - DNA, 17 bp, Homo sapiens
ggcaagaggcctcatgc

SEQ ID NO: 5625551 - DNA, 16 bp, Homo sapiens
ggcaagagggaaggtg

SEQ ID NO: 5625552 - DNA, 22 bp, Homo sapiens
ggcaagagggaggggacagagg

SEQ ID NO: 5625553 - DNA, 15 bp, Homo sapiens
ggcaagagggggacc

SEQ ID NO: 5625554 - DNA, 16 bp, Homo sapiens
ggcaagagggggtgga

SEQ ID NO: 5625555 - DNA, 17 bp, Homo sapiens
ggcaagaggtgcctggg

SEQ ID NO: 5625556 - DNA, 21 bp, Homo sapiens
ggcaagaggtgcctgggagga

SEQ ID NO: 5625557 - DNA, 17 bp, Homo sapiens
ggcaagatagctccttc

SEQ ID NO: 5625558 - DNA, 16 bp, Homo sapiens
ggcaagatccaggtgg

SEQ ID NO: 5625559 - DNA, 15 bp, Homo sapiens
ggcaagatgtttctt

SEQ ID NO: 5625560 - DNA, 19 bp, Homo sapiens
ggcaagattttcctttttt

SEQ ID NO: 5625561 - DNA, 17 bp, Homo sapiens
ggcaagcacctcctgcc

SEQ ID NO: 5625562 - DNA, 18 bp, Homo sapiens
ggcaagcacctcctgcct

SEQ ID NO: 5625563 - DNA, 14 bp, Homo sapiens
ggcaagcagatgac

SEQ ID NO: 5625564 - DNA, 13 bp, Homo sapiens
ggcaagcagctgg

SEQ ID NO: 5625565 - DNA, 14 bp, Homo sapiens
ggcaagccagggcc

SEQ ID NO: 5625566 - DNA, 16 bp, Homo sapiens
ggcaagccagggccca

SEQ ID NO: 5625567 - DNA, 17 bp, Homo sapiens
ggcaagccagggcccag

SEQ ID NO: 5625568 - DNA, 19 bp, Homo sapiens
ggcaagccagggcccagag

SEQ ID NO: 5625569 - DNA, 21 bp, Homo sapiens
ggcaagccagggcccagagcc

SEQ ID NO: 5625570 - DNA, 16 bp, Homo sapiens
ggcaagcccctcagcc

SEQ ID NO: 5625571 - DNA, 20 bp, Homo sapiens
ggcaagcccctcagcccttg

SEQ ID NO: 5625572 - DNA, 22 bp, Homo sapiens
ggcaagcccctcagcccttgcc

SEQ ID NO: 5625573 - DNA, 18 bp, Homo sapiens
ggcaagccctgcccacag

SEQ ID NO: 5625574 - DNA, 15 bp, Homo sapiens
ggcaagcctgagtgg

SEQ ID NO: 5625575 - DNA, 18 bp, Homo sapiens
ggcaagcctgagtggtga

SEQ ID NO: 5625576 - DNA, 19 bp, Homo sapiens
ggcaagcgcttctgctgaa

SEQ ID NO: 5625577 - DNA, 13 bp, Homo sapiens
ggcaagcgtgttc

SEQ ID NO: 5625578 - DNA, 18 bp, Homo sapiens
ggcaagctagaacctgga

SEQ ID NO: 5625579 - DNA, 20 bp, Homo sapiens
ggcaagctagaacctggagg

SEQ ID NO: 5625580 - DNA, 16 bp, Homo sapiens
ggcaagctaggcccca

SEQ ID NO: 5625581 - DNA, 22 bp, Homo sapiens
ggcaagctaggccccagaggcc

SEQ ID NO: 5625582 - DNA, 23 bp, Homo sapiens
ggcaagctgcaaaaggcctgtga

SEQ ID NO: 5625583 - DNA, 22 bp, Homo sapiens
ggcaagctggagttaataatct

SEQ ID NO: 5625584 - DNA, 17 bp, Homo sapiens
ggcaagcttgaggccaa

SEQ ID NO: 5625585 - DNA, 14 bp, Homo sapiens
ggcaaggaaaaaga

SEQ ID NO: 5625586 - DNA, 11 bp, Homo sapiens
ggcaaggaagt

SEQ ID NO: 5625587 - DNA, 18 bp, Homo sapiens
ggcaaggaatcctctggg

SEQ ID NO: 5625588 - DNA, 16 bp, Homo sapiens
ggcaaggacacagatg

SEQ ID NO: 5625589 - DNA, 14 bp, Homo sapiens
ggcaaggagaatat

SEQ ID NO: 5625590 - DNA, 15 bp, Homo sapiens
ggcaaggaggaggag

SEQ ID NO: 5625591 - DNA, 15 bp, Homo sapiens
ggcaaggccccttcc

SEQ ID NO: 5625592 - DNA, 16 bp, Homo sapiens
ggcaaggctgtggacc

SEQ ID NO: 5625593 - DNA, 23 bp, Homo sapiens
ggcactggcaaacagggcctctg

SEQ ID NO: 5625594 - DNA, 20 bp, Homo sapiens
ggcactggcattgtccctgt

SEQ ID NO: 5625595 - DNA, 21 bp, Homo sapiens
ggcactggcattgtccctgtg

SEQ ID NO: 5625596 - DNA, 21 bp, Homo sapiens
ggcactggccacccctcccca

SEQ ID NO: 5625597 - DNA, 22 bp, Homo sapiens
ggcactggccacccctccccag

SEQ ID NO: 5625598 - DNA, 13 bp, Homo sapiens
ggcactggcccag

SEQ ID NO: 5625599 - DNA, 19 bp, Homo sapiens
ggcactggctgaacttgga

SEQ ID NO: 5625600 - DNA, 19 bp, Homo sapiens
ggcactgggaggcagggct

SEQ ID NO: 5625601 - DNA, 20 bp, Homo sapiens
ggcactgggaggcagggctc

SEQ ID NO: 5625602 - DNA, 22 bp, Homo sapiens
ggcactgggccggcagcctggt

SEQ ID NO: 5625603 - DNA, 19 bp, Homo sapiens
ggcactgggcgtctgactc

SEQ ID NO: 5625604 - DNA, 12 bp, Homo sapiens
ggcactgggctg

SEQ ID NO: 5625605 - DNA, 18 bp, Homo sapiens
ggcactgggtacccaagt

SEQ ID NO: 5625606 - DNA, 21 bp, Homo sapiens
ggcactgggtacccaagtgaa

SEQ ID NO: 5625607 - DNA, 21 bp, Homo sapiens
ggcactggtaggttgggacac

SEQ ID NO: 5625608 - DNA, 23 bp, Homo sapiens
ggcactgtaaggtgcttgctccc

SEQ ID NO: 5625609 - DNA, 17 bp, Homo sapiens
ggcactgtagttctaag

SEQ ID NO: 5625610 - DNA, 12 bp, Homo sapiens
ggcactgtccag

SEQ ID NO: 5625611 - DNA, 18 bp, Homo sapiens
ggcactgtccagggccca

SEQ ID NO: 5625612 - DNA, 22 bp, Homo sapiens
ggcactgtccagggcccatgta

SEQ ID NO: 5625613 - DNA, 19 bp, Homo sapiens
ggcactgtgatacagtttt

SEQ ID NO: 5625614 - DNA, 16 bp, Homo sapiens
ggcactgtgcactcta

SEQ ID NO: 5625615 - DNA, 17 bp, Homo sapiens
ggcactgtggcactgcc

SEQ ID NO: 5625616 - DNA, 12 bp, Homo sapiens
ggcactgtggcc

SEQ ID NO: 5625617 - DNA, 15 bp, Homo sapiens
ggcactgtggccctt

SEQ ID NO: 5625618 - DNA, 13 bp, Homo sapiens
ggcactgtggcct

SEQ ID NO: 5625619 - DNA, 14 bp, Homo sapiens
ggcactgtggtcag

SEQ ID NO: 5625620 - DNA, 17 bp, Homo sapiens
ggcactgtggtcaggcc

SEQ ID NO: 5625621 - DNA, 19 bp, Homo sapiens
ggcactgtggtcaggccca

SEQ ID NO: 5625622 - DNA, 17 bp, Homo sapiens
ggcacttaagtgcactt

SEQ ID NO: 5625623 - DNA, 13 bp, Homo sapiens
ggcacttaatttg

SEQ ID NO: 5625624 - DNA, 17 bp, Homo sapiens
ggcacttagcccaagag

SEQ ID NO: 5625625 - DNA, 18 bp, Homo sapiens
ggcacttagtaggtcctc

SEQ ID NO: 5625626 - DNA, 23 bp, Homo sapiens
ggcacttagtaggtcctcaataa

SEQ ID NO: 5625627 - DNA, 18 bp, Homo sapiens
ggcacttatcgaagctga

SEQ ID NO: 5625628 - DNA, 11 bp, Homo sapiens
ggcacttcaca

SEQ ID NO: 5625629 - DNA, 14 bp, Homo sapiens
ggcacttcacagag

SEQ ID NO: 5625630 - DNA, 21 bp, Homo sapiens
ggcacttcatgtaaagtgtca

SEQ ID NO: 5625631 - DNA, 13 bp, Homo sapiens
ggcacttcctccc

SEQ ID NO: 5625632 - DNA, 14 bp, Homo sapiens
ggcacttgcctgct

SEQ ID NO: 5625633 - DNA, 16 bp, Homo sapiens
ggcacttgcctgggtc

SEQ ID NO: 5625634 - DNA, 22 bp, Homo sapiens
ggcacttgggacaaaaacaaac

SEQ ID NO: 5625635 - DNA, 10 bp, Homo sapiens
ggcacttgta

SEQ ID NO: 5625636 - DNA, 16 bp, Homo sapiens
ggcactttaaaacact

SEQ ID NO: 5625637 - DNA, 16 bp, Homo sapiens
ggcactttaaagcatt

SEQ ID NO: 5625638 - DNA, 12 bp, Homo sapiens
ggcactttgggg

SEQ ID NO: 5625639 - DNA, 23 bp, Homo sapiens
ggcacttttgaactcacgagcct

SEQ ID NO: 5625640 - DNA, 17 bp, Homo sapiens
ggcacttttgagctcct

SEQ ID NO: 5625641 - DNA, 16 bp, Homo sapiens
ggcacttttttaaata

SEQ ID NO: 5625642 - DNA, 19 bp, Homo sapiens
ggcagaaaacagagcctgc

SEQ ID NO: 5625643 - DNA, 22 bp, Homo sapiens
ggcagaaaactggcagtgcacc

SEQ ID NO: 5625644 - DNA, 16 bp, Homo sapiens
ggcagaaaagaggaga

SEQ ID NO: 5625645 - DNA, 21 bp, Homo sapiens
ggcagaaaagaggagaccctg

SEQ ID NO: 5625646 - DNA, 17 bp, Homo sapiens
ggcagaaacaataaaac

SEQ ID NO: 5625647 - DNA, 20 bp, Homo sapiens
ggcagaaacacaaccactca

SEQ ID NO: 5625648 - DNA, 16 bp, Homo sapiens
ggcagaaacaggaggc

SEQ ID NO: 5625649 - DNA, 23 bp, Homo sapiens
ggcagaaacctatctcagggagg

SEQ ID NO: 5625650 - DNA, 11 bp, Homo sapiens
ggcagaaagat

SEQ ID NO: 5625651 - DNA, 21 bp, Homo sapiens
ggcagaaagatacagacattc

SEQ ID NO: 5625652 - DNA, 21 bp, Homo sapiens
ggcagaaagatggagaggcat

SEQ ID NO: 5625653 - DNA, 19 bp, Homo sapiens
ggcagaaagatttggaaaa

SEQ ID NO: 5625654 - DNA, 21 bp, Homo sapiens
ggcagaaagatttggaaaatt

SEQ ID NO: 5625655 - DNA, 19 bp, Homo sapiens
ggcagaaagcagaggctgg

SEQ ID NO: 5625656 - DNA, 14 bp, Homo sapiens
ggcagaaaggagat

SEQ ID NO: 5625657 - DNA, 16 bp, Homo sapiens
ggcagaaaggctgcaa

SEQ ID NO: 5625658 - DNA, 16 bp, Homo sapiens
ggcagaaagtggccat

SEQ ID NO: 5625659 - DNA, 17 bp, Homo sapiens
ggcagaaatagttgtct

SEQ ID NO: 5625660 - DNA, 14 bp, Homo sapiens
ggcagaacctggtg

SEQ ID NO: 5625661 - DNA, 16 bp, Homo sapiens
ggcagaacctggtggc

SEQ ID NO: 5625662 - DNA, 17 bp, Homo sapiens
ggcagaactcctacctg

SEQ ID NO: 5625663 - DNA, 14 bp, Homo sapiens
ggcagaactgagct

SEQ ID NO: 5625664 - DNA, 21 bp, Homo sapiens
ggcagaactgagctcctctgg

SEQ ID NO: 5625665 - DNA, 18 bp, Homo sapiens
ggcagaactgctggggct

SEQ ID NO: 5625666 - DNA, 19 bp, Homo sapiens
ggcagaactgctggggctg

SEQ ID NO: 5625667 - DNA, 18 bp, Homo sapiens
ggcagaagaagctgggag

SEQ ID NO: 5625668 - DNA, 22 bp, Homo sapiens
ggcagaagaattgaacccagga

SEQ ID NO: 5625669 - DNA, 15 bp, Homo sapiens
ggcagaagacaccag

SEQ ID NO: 5625670 - DNA, 22 bp, Homo sapiens
ggcagaagacaccagagcagat

SEQ ID NO: 5625671 - DNA, 11 bp, Homo sapiens
ggcagaagaga

SEQ ID NO: 5625672 - DNA, 19 bp, Homo sapiens
ggcagaagagaaaggactc

SEQ ID NO: 5625673 - DNA, 22 bp, Homo sapiens
ggcagaagcattgcctggactg

SEQ ID NO: 5625674 - DNA, 20 bp, Homo sapiens
ggcagaagcttggaggaggg

SEQ ID NO: 5625675 - DNA, 12 bp, Homo sapiens
ggcagaaggaag

SEQ ID NO: 5625676 - DNA, 14 bp, Homo sapiens
ggcagaaggaggaa

SEQ ID NO: 5625677 - DNA, 17 bp, Homo sapiens
ggcagaaggcaaaccca

SEQ ID NO: 5625678 - DNA, 16 bp, Homo sapiens
ggcagaaggccaagag

SEQ ID NO: 5625679 - DNA, 15 bp, Homo sapiens
ggcagaagtgagccc

SEQ ID NO: 5625680 - DNA, 16 bp, Homo sapiens
ggcagaagtgctcttt

SEQ ID NO: 5625681 - DNA, 23 bp, Homo sapiens
ggcagaagtgtcaccctgtgggt

SEQ ID NO: 5625682 - DNA, 16 bp, Homo sapiens
ggcagaatcctgggcc

SEQ ID NO: 5625683 - DNA, 17 bp, Homo sapiens
ggcagaatgaaaatcag

SEQ ID NO: 5625684 - DNA, 22 bp, Homo sapiens
ggcagaatgacttttattgagc

SEQ ID NO: 5625685 - DNA, 20 bp, Homo sapiens
ggcagaatgctagctctgag

SEQ ID NO: 5625686 - DNA, 21 bp, Homo sapiens
ggcagaatgctagctctgagc

SEQ ID NO: 5625687 - DNA, 23 bp, Homo sapiens
ggcagaatgctagctctgagcca

SEQ ID NO: 5625688 - DNA, 16 bp, Homo sapiens
ggcagaatggtgggct

SEQ ID NO: 5625689 - DNA, 16 bp, Homo sapiens
ggcagacaaccttgtc

SEQ ID NO: 5625690 - DNA, 15 bp, Homo sapiens
ggcagacaagagctg

SEQ ID NO: 5625691 - DNA, 23 bp, Homo sapiens
ggcagacacaccgcggccaggca

SEQ ID NO: 5625692 - DNA, 17 bp, Homo sapiens
ggcagacacagggactt

SEQ ID NO: 5625693 - DNA, 19 bp, Homo sapiens
ggcagacacggatctgaga

SEQ ID NO: 5625694 - DNA, 17 bp, Homo sapiens
ggcagacaggaaggaag

SEQ ID NO: 5625695 - DNA, 18 bp, Homo sapiens
ggcagacaggaaggaagc

SEQ ID NO: 5625696 - DNA, 16 bp, Homo sapiens
ggcagacatggtgggg

SEQ ID NO: 5625697 - DNA, 21 bp, Homo sapiens
ggcagacatggtggggtctcc

SEQ ID NO: 5625698 - DNA, 19 bp, Homo sapiens
ggcagaccgggggccagac

SEQ ID NO: 5625699 - DNA, 23 bp, Homo sapiens
ggcagaccgggggccagacacag

SEQ ID NO: 5625700 - DNA, 22 bp, Homo sapiens
ggcagacgaggcctttgcttta

SEQ ID NO: 5625701 - DNA, 15 bp, Homo sapiens
ggcagactacacagg

SEQ ID NO: 5625702 - DNA, 17 bp, Homo sapiens
ggcagactacacaggat

SEQ ID NO: 5625703 - DNA, 23 bp, Homo sapiens
ggcagactctttaataaattgct

SEQ ID NO: 5625704 - DNA, 14 bp, Homo sapiens
ggcagactgggttt

SEQ ID NO: 5625705 - DNA, 14 bp, Homo sapiens
ggcagactgtgaac

SEQ ID NO: 5625706 - DNA, 17 bp, Homo sapiens
ggcagagaaagaagaga

SEQ ID NO: 5625707 - DNA, 13 bp, Homo sapiens
ggcagagaagaga

SEQ ID NO: 5625708 - DNA, 18 bp, Homo sapiens
ggcagagaaggcttcctc

SEQ ID NO: 5625709 - DNA, 22 bp, Homo sapiens
ggcagagaaggcttcctccagc

SEQ ID NO: 5625710 - DNA, 12 bp, Homo sapiens
ggcagagaataa

SEQ ID NO: 5625711 - DNA, 13 bp, Homo sapiens
ggcagagaataaa

SEQ ID NO: 5625712 - DNA, 17 bp, Homo sapiens
ggcagagaatctcttgg

SEQ ID NO: 5625713 - DNA, 20 bp, Homo sapiens
ggcagagaatggctgggtca

SEQ ID NO: 5625714 - DNA, 18 bp, Homo sapiens
ggcagagacaataaaaca

SEQ ID NO: 5625715 - DNA, 16 bp, Homo sapiens
ggcagagacagtgggc

SEQ ID NO: 5625716 - DNA, 20 bp, Homo sapiens
ggcagagaccataagagaaa

SEQ ID NO: 5625717 - DNA, 23 bp, Homo sapiens
ggcagagaccataagagaaacct

SEQ ID NO: 5625718 - DNA, 18 bp, Homo sapiens
ggcagagaccccaggatc

SEQ ID NO: 5625719 - DNA, 11 bp, Homo sapiens
ggcagagagag

SEQ ID NO: 5625720 - DNA, 10 bp, Homo sapiens
ggcagagagc

SEQ ID NO: 5625721 - DNA, 24 bp, Homo sapiens
ggcagagagcgaccagcaggctcc

SEQ ID NO: 5625722 - DNA, 19 bp, Homo sapiens
ggcagagagcggtctcagg

SEQ ID NO: 5625723 - DNA, 12 bp, Homo sapiens
ggcagagaggaa

SEQ ID NO: 5625724 - DNA, 16 bp, Homo sapiens
ggcagagaggctgtgg

SEQ ID NO: 5625725 - DNA, 20 bp, Homo sapiens
ggcagagatcaggtgggcag

SEQ ID NO: 5625726 - DNA, 17 bp, Homo sapiens
ggcagagcaattccagg

SEQ ID NO: 5625727 - DNA, 20 bp, Homo sapiens
ggcagagcaattccaggctg

SEQ ID NO: 5625728 - DNA, 22 bp, Homo sapiens
ggcagagcaattccaggctgag

SEQ ID NO: 5625729 - DNA, 23 bp, Homo sapiens
ggcagagcagtctaaacagagtc

SEQ ID NO: 5625730 - DNA, 12 bp, Homo sapiens
ggcagagccagg

SEQ ID NO: 5625731 - DNA, 13 bp, Homo sapiens
ggcagagccagga

SEQ ID NO: 5625732 - DNA, 16 bp, Homo sapiens
ggcagagccaggaaga

SEQ ID NO: 5625733 - DNA, 21 bp, Homo sapiens
ggcagagcccgcccacctggg

SEQ ID NO: 5625734 - DNA, 20 bp, Homo sapiens
ggcagagccctgctccctcc

SEQ ID NO: 5625735 - DNA, 13 bp, Homo sapiens
ggcagagcctgtc

SEQ ID NO: 5625736 - DNA, 15 bp, Homo sapiens
ggcagagcctgtccc

SEQ ID NO: 5625737 - DNA, 22 bp, Homo sapiens
ggcagagcctttttacctggcc

SEQ ID NO: 5625738 - DNA, 16 bp, Homo sapiens
ggcagagcgggaggga

SEQ ID NO: 5625739 - DNA, 13 bp, Homo sapiens
ggcagagctcaga

SEQ ID NO: 5625740 - DNA, 19 bp, Homo sapiens
ggcagagctctacaggcct

SEQ ID NO: 5625741 - DNA, 20 bp, Homo sapiens
ggcagagctctacaggcctg

SEQ ID NO: 5625742 - DNA, 24 bp, Homo sapiens
ggcagagctgacgggaggccccag

SEQ ID NO: 5625743 - DNA, 19 bp, Homo sapiens
ggcagagctgagggccctg

SEQ ID NO: 5625744 - DNA, 22 bp, Homo sapiens
ggcagagctgagtcggctgggc

SEQ ID NO: 5625745 - DNA, 23 bp, Homo sapiens
ggcagagctgagtcggctgggca

SEQ ID NO: 5625746 - DNA, 14 bp, Homo sapiens
ggcagagctgcatc

SEQ ID NO: 5625747 - DNA, 11 bp, Homo sapiens
ggcagagctgg

SEQ ID NO: 5625748 - DNA, 19 bp, Homo sapiens
ggcagagctggctctgagc

SEQ ID NO: 5625749 - DNA, 13 bp, Homo sapiens
ggcagagctggtg

SEQ ID NO: 5625750 - DNA, 17 bp, Homo sapiens
ggcagagcttggactgg

SEQ ID NO: 5625751 - DNA, 18 bp, Homo sapiens
ggcagagcttgtagccct

SEQ ID NO: 5625752 - DNA, 19 bp, Homo sapiens
ggcagagcttgtagccctg

SEQ ID NO: 5625753 - DNA, 21 bp, Homo sapiens
ggcagagcttgtagccctgga

SEQ ID NO: 5625754 - DNA, 23 bp, Homo sapiens
ggcagagcttgtagccctggatg

SEQ ID NO: 5625755 - DNA, 18 bp, Homo sapiens
ggcagaggaacccccacc

SEQ ID NO: 5625756 - DNA, 21 bp, Homo sapiens
ggcagaggaatgtgggctatg

SEQ ID NO: 5625757 - DNA, 15 bp, Homo sapiens
ggcagaggacagatc

SEQ ID NO: 5625758 - DNA, 22 bp, Homo sapiens
ggcagaggagaacttgctgcct

SEQ ID NO: 5625759 - DNA, 17 bp, Homo sapiens
ggcagaggcaaggatgg

SEQ ID NO: 5625760 - DNA, 18 bp, Homo sapiens
ggcagaggcaaggatggt

SEQ ID NO: 5625761 - DNA, 14 bp, Homo sapiens
ggcagaggcagggc

SEQ ID NO: 5625762 - DNA, 21 bp, Homo sapiens
ggcagaggcccaggctgccgt

SEQ ID NO: 5625763 - DNA, 14 bp, Homo sapiens
ggcagaggcctggg

SEQ ID NO: 5625764 - DNA, 18 bp, Homo sapiens
ggcagaggcctgggctgg

SEQ ID NO: 5625765 - DNA, 12 bp, Homo sapiens
ggcagaggctgg

SEQ ID NO: 5625766 - DNA, 22 bp, Homo sapiens
ggcagaggcttccgtgtcctct

SEQ ID NO: 5625767 - DNA, 22 bp, Homo sapiens
ggcagagggatgaaatgccaag

SEQ ID NO: 5625768 - DNA, 21 bp, Homo sapiens
ggcagagggcaagggaggggt

SEQ ID NO: 5625769 - DNA, 20 bp, Homo sapiens
ggcaggaggaaaaggcttgg

SEQ ID NO: 5625770 - DNA, 17 bp, Homo sapiens
ggcaggaggagcccgga

SEQ ID NO: 5625771 - DNA, 21 bp, Homo sapiens
ggcaggaggatcccctgaggt

SEQ ID NO: 5625772 - DNA, 22 bp, Homo sapiens
ggcaggaggatcccctgaggtc

SEQ ID NO: 5625773 - DNA, 23 bp, Homo sapiens
ggcaggaggccattccaggagtg

SEQ ID NO: 5625774 - DNA, 13 bp, Homo sapiens
ggcaggaggcctg

SEQ ID NO: 5625775 - DNA, 14 bp, Homo sapiens
ggcaggaggcctgg

SEQ ID NO: 5625776 - DNA, 15 bp, Homo sapiens
ggcaggaggcctggc

SEQ ID NO: 5625777 - DNA, 21 bp, Homo sapiens
ggcaggaggctttgggtggct

SEQ ID NO: 5625778 - DNA, 13 bp, Homo sapiens
ggcaggagggagg

SEQ ID NO: 5625779 - DNA, 21 bp, Homo sapiens
ggcaggagtcaccatgcaagg

SEQ ID NO: 5625780 - DNA, 15 bp, Homo sapiens
ggcaggagtgccagg

SEQ ID NO: 5625781 - DNA, 16 bp, Homo sapiens
ggcaggagtgccagga

SEQ ID NO: 5625782 - DNA, 17 bp, Homo sapiens
ggcaggagtgccaggac

SEQ ID NO: 5625783 - DNA, 20 bp, Homo sapiens
ggcaggagtgggctctgagc

SEQ ID NO: 5625784 - DNA, 18 bp, Homo sapiens
ggcaggagttgggggcag

SEQ ID NO: 5625785 - DNA, 18 bp, Homo sapiens
ggcaggatctcaagccag

SEQ ID NO: 5625786 - DNA, 15 bp, Homo sapiens
ggcaggatgacttta

SEQ ID NO: 5625787 - DNA, 14 bp, Homo sapiens
ggcaggatggcctt

SEQ ID NO: 5625788 - DNA, 17 bp, Homo sapiens
ggcaggatggcctttcc

SEQ ID NO: 5625789 - DNA, 14 bp, Homo sapiens
ggcaggattctctg

SEQ ID NO: 5625790 - DNA, 17 bp, Homo sapiens
ggcaggattggggaaga

SEQ ID NO: 5625791 - DNA, 15 bp, Homo sapiens
ggcaggcaagccctt

SEQ ID NO: 5625792 - DNA, 18 bp, Homo sapiens
ggcaggcacagcacaggg

SEQ ID NO: 5625793 - DNA, 10 bp, Homo sapiens
ggcaggcacc

SEQ ID NO: 5625794 - DNA, 20 bp, Homo sapiens
ggcaggcagaggcccaggct

SEQ ID NO: 5625795 - DNA, 14 bp, Homo sapiens
ggcaggcagcctga

SEQ ID NO: 5625796 - DNA, 10 bp, Homo sapiens
ggcaggcagg

SEQ ID NO: 5625797 - DNA, 18 bp, Homo sapiens
ggcaggcaggctcccagg

SEQ ID NO: 5625798 - DNA, 13 bp, Homo sapiens
ggcaggcagggct

SEQ ID NO: 5625799 - DNA, 15 bp, Homo sapiens
ggcaggcagggctct

SEQ ID NO: 5625800 - DNA, 23 bp, Homo sapiens
ggcaggcagggctctcctggctt

SEQ ID NO: 5625801 - DNA, 16 bp, Homo sapiens
ggcaggcatggccctg

SEQ ID NO: 5625802 - DNA, 13 bp, Homo sapiens
ggcaggcattgag

SEQ ID NO: 5625803 - DNA, 13 bp, Homo sapiens
ggcaggccagtgt

SEQ ID NO: 5625804 - DNA, 20 bp, Homo sapiens
ggcaggccagtgtctgggtt

SEQ ID NO: 5625805 - DNA, 22 bp, Homo sapiens
ggcaggcccccggggaggggcc

SEQ ID NO: 5625806 - DNA, 20 bp, Homo sapiens
ggcaggcccctttggacctg

SEQ ID NO: 5625807 - DNA, 10 bp, Homo sapiens
ggcaggccct

SEQ ID NO: 5625808 - DNA, 11 bp, Homo sapiens
ggcaggccctg

SEQ ID NO: 5625809 - DNA, 19 bp, Homo sapiens
ggcaggccctgcactgtcc

SEQ ID NO: 5625810 - DNA, 16 bp, Homo sapiens
ggcaggccctgcagtg

SEQ ID NO: 5625811 - DNA, 16 bp, Homo sapiens
ggcaggccctgcccag

SEQ ID NO: 5625812 - DNA, 19 bp, Homo sapiens
ggcaggccctgcccagcca

SEQ ID NO: 5625813 - DNA, 20 bp, Homo sapiens
ggcaggccctgcccagccag

SEQ ID NO: 5625814 - DNA, 16 bp, Homo sapiens
ggcaggcctcccaagc

SEQ ID NO: 5625815 - DNA, 12 bp, Homo sapiens
ggcaggcctgac

SEQ ID NO: 5625816 - DNA, 22 bp, Homo sapiens
ggcaggcctgacccacggggca

SEQ ID NO: 5625817 - DNA, 17 bp, Homo sapiens
ggcaggcctgagaatga

SEQ ID NO: 5625818 - DNA, 12 bp, Homo sapiens
ggcaggcctggg

SEQ ID NO: 5625819 - DNA, 14 bp, Homo sapiens
ggcaggcctgggac

SEQ ID NO: 5625820 - DNA, 16 bp, Homo sapiens
ggcaggcgcagaggtc

SEQ ID NO: 5625821 - DNA, 23 bp, Homo sapiens
ggcaggcgcagaggtcccagccc

SEQ ID NO: 5625822 - DNA, 23 bp, Homo sapiens
ggcaggcggggggggcgcctgga

SEQ ID NO: 5625823 - DNA, 23 bp, Homo sapiens
ggcaggcggtccccatccccacc

SEQ ID NO: 5625824 - DNA, 20 bp, Homo sapiens
ggcaggcgtgactcagcagc

SEQ ID NO: 5625825 - DNA, 23 bp, Homo sapiens
ggcaggcgtgactcagcagcctg

SEQ ID NO: 5625826 - DNA, 22 bp, Homo sapiens
ggcaggctaaggcgtggagctg

SEQ ID NO: 5625827 - DNA, 16 bp, Homo sapiens
ggcaggctcactgcca

SEQ ID NO: 5625828 - DNA, 18 bp, Homo sapiens
ggcaggctgacatctgtg

SEQ ID NO: 5625829 - DNA, 15 bp, Homo sapiens
ggcaggctgagggtc

SEQ ID NO: 5625830 - DNA, 18 bp, Homo sapiens
ggcaggctgaggtgggga

SEQ ID NO: 5625831 - DNA, 10 bp, Homo sapiens
ggcaggctgg

SEQ ID NO: 5625832 - DNA, 11 bp, Homo sapiens
ggcaggctggc

SEQ ID NO: 5625833 - DNA, 14 bp, Homo sapiens
ggcaggctgggcca

SEQ ID NO: 5625834 - DNA, 13 bp, Homo sapiens
ggcaggctgggtt

SEQ ID NO: 5625835 - DNA, 18 bp, Homo sapiens
ggcagggaaaggctctga

SEQ ID NO: 5625836 - DNA, 20 bp, Homo sapiens
ggcagggaacatggggagga

SEQ ID NO: 5625837 - DNA, 23 bp, Homo sapiens
ggcagggaaggggaggcagccgg

SEQ ID NO: 5625838 - DNA, 18 bp, Homo sapiens
ggcagggaagggtgcctg

SEQ ID NO: 5625839 - DNA, 19 bp, Homo sapiens
ggcagggaagggtgcctgg

SEQ ID NO: 5625840 - DNA, 20 bp, Homo sapiens
ggcagggaagggtgcctggc

SEQ ID NO: 5625841 - DNA, 23 bp, Homo sapiens
ggcagggaatgcctggagggtaa

SEQ ID NO: 5625842 - DNA, 22 bp, Homo sapiens
ggcagggacaagtctttctcct

SEQ ID NO: 5625843 - DNA, 22 bp, Homo sapiens
ggcagggacccggggtctcctg

SEQ ID NO: 5625844 - DNA, 20 bp, Homo sapiens
ggcagggaccggcagagctc

SEQ ID NO: 5625845 - DNA, 14 bp, Homo sapiens
ggcagggacctaaa

SEQ ID NO: 5625846 - DNA, 16 bp, Homo sapiens
ggcagggacctaaagg

SEQ ID NO: 5625847 - DNA, 18 bp, Homo sapiens
ggcagggacctgagagca

SEQ ID NO: 5625848 - DNA, 18 bp, Homo sapiens
ggcagggacttgcctcca

SEQ ID NO: 5625849 - DNA, 13 bp, Homo sapiens
ggcagggagagag

SEQ ID NO: 5625850 - DNA, 13 bp, Homo sapiens
ggcagggagcagt

SEQ ID NO: 5625851 - DNA, 22 bp, Homo sapiens
ggcagggagcggccggccagcc

SEQ ID NO: 5625852 - DNA, 11 bp, Homo sapiens
ggcagggaggc

SEQ ID NO: 5625853 - DNA, 15 bp, Homo sapiens
ggcagggaggcagcc

SEQ ID NO: 5625854 - DNA, 16 bp, Homo sapiens
ggcagggaggcagccg

SEQ ID NO: 5625855 - DNA, 15 bp, Homo sapiens
ggcagggagggaaac

SEQ ID NO: 5625856 - DNA, 18 bp, Homo sapiens
ggcagggagggcctgggc

SEQ ID NO: 5625857 - DNA, 20 bp, Homo sapiens
ggcagggagggcctgggccc

SEQ ID NO: 5625858 - DNA, 18 bp, Homo sapiens
ggcagggaggggctgggg

SEQ ID NO: 5625859 - DNA, 18 bp, Homo sapiens
ggcagggagggggctggg

SEQ ID NO: 5625860 - DNA, 19 bp, Homo sapiens
ggcagggagggggctggga

SEQ ID NO: 5625861 - DNA, 15 bp, Homo sapiens
ggcagggaggtcagg

SEQ ID NO: 5625862 - DNA, 22 bp, Homo sapiens
ggcagggaggtcaggccctgga

SEQ ID NO: 5625863 - DNA, 16 bp, Homo sapiens
ggcagggagtgtctgc

SEQ ID NO: 5625864 - DNA, 19 bp, Homo sapiens
ggcagggatccccaggagg

SEQ ID NO: 5625865 - DNA, 20 bp, Homo sapiens
ggcagggatgggggtggctg

SEQ ID NO: 5625866 - DNA, 21 bp, Homo sapiens
ggcagggatgggggtggctgg

SEQ ID NO: 5625867 - DNA, 23 bp, Homo sapiens
ggcagggatgggggtggctggga

SEQ ID NO: 5625868 - DNA, 15 bp, Homo sapiens
ggcagggatttgagg

SEQ ID NO: 5625869 - DNA, 12 bp, Homo sapiens
ggcagggcaaga

SEQ ID NO: 5625870 - DNA, 14 bp, Homo sapiens
ggcagggcacaggg

SEQ ID NO: 5625871 - DNA, 22 bp, Homo sapiens
ggcagggcacagggcctggccc

SEQ ID NO: 5625872 - DNA, 23 bp, Homo sapiens
ggcagggcacagggcctggccca

SEQ ID NO: 5625873 - DNA, 13 bp, Homo sapiens
ggcagggcagagg

SEQ ID NO: 5625874 - DNA, 13 bp, Homo sapiens
ggcagggcagggc

SEQ ID NO: 5625875 - DNA, 17 bp, Homo sapiens
ggcagggccaggctggt

SEQ ID NO: 5625876 - DNA, 13 bp, Homo sapiens
ggcagggcccagg

SEQ ID NO: 5625877 - DNA, 17 bp, Homo sapiens
ggcagggcccagggagg

SEQ ID NO: 5625878 - DNA, 19 bp, Homo sapiens
ggcagggcccccaataaac

SEQ ID NO: 5625879 - DNA, 20 bp, Homo sapiens
ggcagggcccccaataaacc

SEQ ID NO: 5625880 - DNA, 13 bp, Homo sapiens
ggcagggccctga

SEQ ID NO: 5625881 - DNA, 13 bp, Homo sapiens
ggcagggccctgt

SEQ ID NO: 5625882 - DNA, 20 bp, Homo sapiens
ggcagggcccttggggctgg

SEQ ID NO: 5625883 - DNA, 17 bp, Homo sapiens
ggcagggccgcagggcg

SEQ ID NO: 5625884 - DNA, 16 bp, Homo sapiens
ggcagggcctggcctt

SEQ ID NO: 5625885 - DNA, 16 bp, Homo sapiens
ggcagggcctggctcc

SEQ ID NO: 5625886 - DNA, 13 bp, Homo sapiens
ggcagggcctggg

SEQ ID NO: 5625887 - DNA, 15 bp, Homo sapiens
ggcagggcctgggcc

SEQ ID NO: 5625888 - DNA, 12 bp, Homo sapiens
ggcagggccttc

SEQ ID NO: 5625889 - DNA, 14 bp, Homo sapiens
ggcagggccttcct

SEQ ID NO: 5625890 - DNA, 14 bp, Homo sapiens
ggcagggcgagctg

SEQ ID NO: 5625891 - DNA, 16 bp, Homo sapiens
ggcagggcgagctgca

SEQ ID NO: 5625892 - DNA, 18 bp, Homo sapiens
ggcagggcgagctgcagg

SEQ ID NO: 5625893 - DNA, 22 bp, Homo sapiens
ggcagggcgccaagtctggcac

SEQ ID NO: 5625894 - DNA, 17 bp, Homo sapiens
ggcagggctcccacaga

SEQ ID NO: 5625895 - DNA, 14 bp, Homo sapiens
ggcagggctcctcc

SEQ ID NO: 5625896 - DNA, 16 bp, Homo sapiens
ggcagggctctcctgg

SEQ ID NO: 5625897 - DNA, 16 bp, Homo sapiens
ggcagggctctggggc

SEQ ID NO: 5625898 - DNA, 20 bp, Homo sapiens
ggcagggctgcagagggaga

SEQ ID NO: 5625899 - DNA, 14 bp, Homo sapiens
ggcagggctgggcc

SEQ ID NO: 5625900 - DNA, 21 bp, Homo sapiens
ggcagggctgttccctccagg

SEQ ID NO: 5625901 - DNA, 18 bp, Homo sapiens
ggcaggggaaactctggt

SEQ ID NO: 5625902 - DNA, 16 bp, Homo sapiens
ggcaggggaagccttg

SEQ ID NO: 5625903 - DNA, 20 bp, Homo sapiens
ggcaggggacaagggaggca

SEQ ID NO: 5625904 - DNA, 23 bp, Homo sapiens
ggcaggggacctggagctgccag

SEQ ID NO: 5625905 - DNA, 22 bp, Homo sapiens
ggcaggggagggtcagccaggg

SEQ ID NO: 5625906 - DNA, 11 bp, Homo sapiens
ggcaggggcag

SEQ ID NO: 5625907 - DNA, 16 bp, Homo sapiens
ggcaggggcagtggcc

SEQ ID NO: 5625908 - DNA, 19 bp, Homo sapiens
ggcaggggcagtggcctgg

SEQ ID NO: 5625909 - DNA, 14 bp, Homo sapiens
ggcaggggcatctg

SEQ ID NO: 5625910 - DNA, 15 bp, Homo sapiens
ggcaggggcccactt

SEQ ID NO: 5625911 - DNA, 21 bp, Homo sapiens
ggcaggggcccctcctctgtg

SEQ ID NO: 5625912 - DNA, 22 bp, Homo sapiens
ggcaggggcccctcctctgtgc

SEQ ID NO: 5625913 - DNA, 12 bp, Homo sapiens
ggcaggggccgg

SEQ ID NO: 5625914 - DNA, 21 bp, Homo sapiens
ggcaggggcctccatgggccc

SEQ ID NO: 5625915 - DNA, 13 bp, Homo sapiens
ggcaggggcctgg

SEQ ID NO: 5625916 - DNA, 14 bp, Homo sapiens
ggcaggggcctgga

SEQ ID NO: 5625917 - DNA, 15 bp, Homo sapiens
ggcaggggcctgggc

SEQ ID NO: 5625918 - DNA, 17 bp, Homo sapiens
ggcaggggcctgggccg

SEQ ID NO: 5625919 - DNA, 21 bp, Homo sapiens
ggcaggggcgggcggagggag

SEQ ID NO: 5625920 - DNA, 22 bp, Homo sapiens
ggcaggggcgggcggagggagg

SEQ ID NO: 5625921 - DNA, 23 bp, Homo sapiens
ggcaggggcgggcggagggaggg

SEQ ID NO: 5625922 - DNA, 13 bp, Homo sapiens
ggcaggggcttcc

SEQ ID NO: 5625923 - DNA, 14 bp, Homo sapiens
ggcaggggcttcct

SEQ ID NO: 5625924 - DNA, 18 bp, Homo sapiens
ggcaggggcttggctgcc

SEQ ID NO: 5625925 - DNA, 21 bp, Homo sapiens
ggcaggggcttggctgcccca

SEQ ID NO: 5625926 - DNA, 19 bp, Homo sapiens
ggcagggggacagcaggga

SEQ ID NO: 5625927 - DNA, 13 bp, Homo sapiens
ggcagggggccct

SEQ ID NO: 5625928 - DNA, 18 bp, Homo sapiens
ggcagggggccctgcccc

SEQ ID NO: 5625929 - DNA, 12 bp, Homo sapiens
ggcagggggctg

SEQ ID NO: 5625930 - DNA, 18 bp, Homo sapiens
ggcagggggctgctgctg

SEQ ID NO: 5625931 - DNA, 21 bp, Homo sapiens
ggcagggggtatgcagagctt

SEQ ID NO: 5625932 - DNA, 20 bp, Homo sapiens
ggcagggggtgaaggcagga

SEQ ID NO: 5625933 - DNA, 17 bp, Homo sapiens
ggcagggggttctggga

SEQ ID NO: 5625934 - DNA, 18 bp, Homo sapiens
ggcaggggtcagagcact

SEQ ID NO: 5625935 - DNA, 17 bp, Homo sapiens
ggcaggggtcctgcagg

SEQ ID NO: 5625936 - DNA, 23 bp, Homo sapiens
ggcaggggtcctgcaggtcctgg

SEQ ID NO: 5625937 - DNA, 17 bp, Homo sapiens
ggcaggggtgggagagc

SEQ ID NO: 5625938 - DNA, 18 bp, Homo sapiens
ggcaggggtgggagagcc

SEQ ID NO: 5625939 - DNA, 14 bp, Homo sapiens
ggcaggggtggtgg

SEQ ID NO: 5625940 - DNA, 20 bp, Homo sapiens
ggcaggggttggcagcgcct

SEQ ID NO: 5625941 - DNA, 15 bp, Homo sapiens
ggcagggtcaggaga

SEQ ID NO: 5625942 - DNA, 15 bp, Homo sapiens
ggcagggtccctcca

SEQ ID NO: 5625943 - DNA, 17 bp, Homo sapiens
ggcagggtctcactctg

SEQ ID NO: 5625944 - DNA, 16 bp, Homo sapiens
ggcagggtctctgctc

SEQ ID NO: 5625945 - DNA, 13 bp, Homo sapiens
ggcagggttctag

SEQ ID NO: 5625946 - DNA, 13 bp, Homo sapiens
ggcaggtacaggt

SEQ ID NO: 5625947 - DNA, 16 bp, Homo sapiens
ggcaggtagatcactt

SEQ ID NO: 5625948 - DNA, 20 bp, Homo sapiens
ggccactgtttggaaataaa

SEQ ID NO: 5625949 - DNA, 15 bp, Homo sapiens
ggccacttcattcca

SEQ ID NO: 5625950 - DNA, 18 bp, Homo sapiens
ggccacttcattccagca

SEQ ID NO: 5625951 - DNA, 21 bp, Homo sapiens
ggccacttctgggtggggcag

SEQ ID NO: 5625952 - DNA, 13 bp, Homo sapiens
ggccacttctgtc

SEQ ID NO: 5625953 - DNA, 14 bp, Homo sapiens
ggccacttctgtcc

SEQ ID NO: 5625954 - DNA, 14 bp, Homo sapiens
ggccacttgctcag

SEQ ID NO: 5625955 - DNA, 22 bp, Homo sapiens
ggccactttgcagacctgggac

SEQ ID NO: 5625956 - DNA, 15 bp, Homo sapiens
ggccagaaaaagaag

SEQ ID NO: 5625957 - DNA, 15 bp, Homo sapiens
ggccagaaggagggc

SEQ ID NO: 5625958 - DNA, 23 bp, Homo sapiens
ggccagaaggagggcagagccat

SEQ ID NO: 5625959 - DNA, 22 bp, Homo sapiens
ggccagaagtaacttattttgt

SEQ ID NO: 5625960 - DNA, 14 bp, Homo sapiens
ggccagacaagaag

SEQ ID NO: 5625961 - DNA, 22 bp, Homo sapiens
ggccagaccacgcccctgcctg

SEQ ID NO: 5625962 - DNA, 14 bp, Homo sapiens
ggccagaccagagc

SEQ ID NO: 5625963 - DNA, 16 bp, Homo sapiens
ggccagaccagagctc

SEQ ID NO: 5625964 - DNA, 16 bp, Homo sapiens
ggccagacgctgccgc

SEQ ID NO: 5625965 - DNA, 17 bp, Homo sapiens
ggccagacgctgccgct

SEQ ID NO: 5625966 - DNA, 16 bp, Homo sapiens
ggccagactggctgca

SEQ ID NO: 5625967 - DNA, 17 bp, Homo sapiens
ggccagactggctgcac

SEQ ID NO: 5625968 - DNA, 16 bp, Homo sapiens
ggccagagaaagcaaa

SEQ ID NO: 5625969 - DNA, 18 bp, Homo sapiens
ggccagagaaagcaaagg

SEQ ID NO: 5625970 - DNA, 13 bp, Homo sapiens
ggccagagagcag

SEQ ID NO: 5625971 - DNA, 23 bp, Homo sapiens
ggccagagagcctggtgctgctg

SEQ ID NO: 5625972 - DNA, 12 bp, Homo sapiens
ggccagagaggg

SEQ ID NO: 5625973 - DNA, 20 bp, Homo sapiens
ggccagagagggaaaaggca

SEQ ID NO: 5625974 - DNA, 22 bp, Homo sapiens
ggccagagagggaaaaggcagg

SEQ ID NO: 5625975 - DNA, 17 bp, Homo sapiens
ggccagagcacctcagg

SEQ ID NO: 5625976 - DNA, 13 bp, Homo sapiens
ggccagagcagct

SEQ ID NO: 5625977 - DNA, 12 bp, Homo sapiens
ggccagagccca

SEQ ID NO: 5625978 - DNA, 13 bp, Homo sapiens
ggccagagcccac

SEQ ID NO: 5625979 - DNA, 15 bp, Homo sapiens
ggccagagcccactc

SEQ ID NO: 5625980 - DNA, 17 bp, Homo sapiens
ggccagagcccactcca

SEQ ID NO: 5625981 - DNA, 14 bp, Homo sapiens
ggccagagcctctg

SEQ ID NO: 5625982 - DNA, 16 bp, Homo sapiens
ggccagagcctctggc

SEQ ID NO: 5625983 - DNA, 21 bp, Homo sapiens
ggccagagctagggctgctgc

SEQ ID NO: 5625984 - DNA, 14 bp, Homo sapiens
ggccagagctccca

SEQ ID NO: 5625985 - DNA, 20 bp, Homo sapiens
ggccagagctcccaggacgc

SEQ ID NO: 5625986 - DNA, 18 bp, Homo sapiens
ggccagagctgagtggca

SEQ ID NO: 5625987 - DNA, 20 bp, Homo sapiens
ggccagagctggaaggcagg

SEQ ID NO: 5625988 - DNA, 16 bp, Homo sapiens
ggccagagctgggagg

SEQ ID NO: 5625989 - DNA, 18 bp, Homo sapiens
ggccagaggaagggaggc

SEQ ID NO: 5625990 - DNA, 23 bp, Homo sapiens
ggccagaggaagggaggcctgag

SEQ ID NO: 5625991 - DNA, 15 bp, Homo sapiens
ggccagaggcagcta

SEQ ID NO: 5625992 - DNA, 13 bp, Homo sapiens
ggccagaggccca

SEQ ID NO: 5625993 - DNA, 23 bp, Homo sapiens
ggccagaggcccattagttgaga

SEQ ID NO: 5625994 - DNA, 18 bp, Homo sapiens
ggccagaggcccccagcc

SEQ ID NO: 5625995 - DNA, 19 bp, Homo sapiens
ggccagaggcccccagccc

SEQ ID NO: 5625996 - DNA, 13 bp, Homo sapiens
ggccagaggctgg

SEQ ID NO: 5625997 - DNA, 14 bp, Homo sapiens
ggccagagggagct

SEQ ID NO: 5625998 - DNA, 18 bp, Homo sapiens
ggccagagggagctggaa

SEQ ID NO: 5625999 - DNA, 16 bp, Homo sapiens
ggccagagtggcctgg

SEQ ID NO: 5626000 - DNA, 22 bp, Homo sapiens
ggccagatgattttcctccctg

SEQ ID NO: 5626001 - DNA, 20 bp, Homo sapiens
ggccagatgcacatccctgg

SEQ ID NO: 5626002 - DNA, 17 bp, Homo sapiens
ggccagatgcaccagcc

SEQ ID NO: 5626003 - DNA, 19 bp, Homo sapiens
ggccagatgcaccagccct

SEQ ID NO: 5626004 - DNA, 18 bp, Homo sapiens
ggccagatggcccctcca

SEQ ID NO: 5626005 - DNA, 21 bp, Homo sapiens
ggccagatgtcgctgggtcct

SEQ ID NO: 5626006 - DNA, 17 bp, Homo sapiens
ggccagcaacgcttgta

SEQ ID NO: 5626007 - DNA, 14 bp, Homo sapiens
ggccagcaaggcag

SEQ ID NO: 5626008 - DNA, 14 bp, Homo sapiens
ggccagcacagctg

SEQ ID NO: 5626009 - DNA, 17 bp, Homo sapiens
ggccagcacagctgagg

SEQ ID NO: 5626010 - DNA, 22 bp, Homo sapiens
ggccagcacagctgaggaccct

SEQ ID NO: 5626011 - DNA, 18 bp, Homo sapiens
ggccagcaccatctcttt

SEQ ID NO: 5626012 - DNA, 16 bp, Homo sapiens
ggccagcacccaaagg

SEQ ID NO: 5626013 - DNA, 18 bp, Homo sapiens
ggccagcacccaaagggt

SEQ ID NO: 5626014 - DNA, 12 bp, Homo sapiens
ggccagcaccct

SEQ ID NO: 5626015 - DNA, 13 bp, Homo sapiens
ggccagcaccctc

SEQ ID NO: 5626016 - DNA, 19 bp, Homo sapiens
ggccagcaccctctcctgg

SEQ ID NO: 5626017 - DNA, 15 bp, Homo sapiens
ggccagcactggagg

SEQ ID NO: 5626018 - DNA, 12 bp, Homo sapiens
ggccagcagagc

SEQ ID NO: 5626019 - DNA, 19 bp, Homo sapiens
ggccagcagcacctgccct

SEQ ID NO: 5626020 - DNA, 13 bp, Homo sapiens
ggccagcagcttg

SEQ ID NO: 5626021 - DNA, 15 bp, Homo sapiens
ggccagcaggcagcg

SEQ ID NO: 5626022 - DNA, 19 bp, Homo sapiens
ggccagcaggcagcgcctg

SEQ ID NO: 5626023 - DNA, 13 bp, Homo sapiens
ggccagcaggctc

SEQ ID NO: 5626024 - DNA, 14 bp, Homo sapiens
ggccagcaggctcc

SEQ ID NO: 5626025 - DNA, 23 bp, Homo sapiens
ggccagcaggctcctggctgtgc

SEQ ID NO: 5626026 - DNA, 19 bp, Homo sapiens
ggccagcataggggggagg

SEQ ID NO: 5626027 - DNA, 20 bp, Homo sapiens
ggccagcataggggggaggg

SEQ ID NO: 5626028 - DNA, 16 bp, Homo sapiens
ggccagccagccactc

SEQ ID NO: 5626029 - DNA, 17 bp, Homo sapiens
ggccagccagccactct

SEQ ID NO: 5626030 - DNA, 21 bp, Homo sapiens
ggccagccagccactctacca

SEQ ID NO: 5626031 - DNA, 14 bp, Homo sapiens
ggccagcccactgg

SEQ ID NO: 5626032 - DNA, 15 bp, Homo sapiens
ggccagcccactggg

SEQ ID NO: 5626033 - DNA, 22 bp, Homo sapiens
ggccagcccactgggccctggg

SEQ ID NO: 5626034 - DNA, 12 bp, Homo sapiens
ggccagcccaga

SEQ ID NO: 5626035 - DNA, 20 bp, Homo sapiens
ggccagcccagatggctccc

SEQ ID NO: 5626036 - DNA, 13 bp, Homo sapiens
ggccagccccaca

SEQ ID NO: 5626037 - DNA, 18 bp, Homo sapiens
ggccagccccacagccca

SEQ ID NO: 5626038 - DNA, 15 bp, Homo sapiens
ggccagccccaccca

SEQ ID NO: 5626039 - DNA, 16 bp, Homo sapiens
ggccagccccacccag

SEQ ID NO: 5626040 - DNA, 20 bp, Homo sapiens
ggccagccccacccaggagg

SEQ ID NO: 5626041 - DNA, 23 bp, Homo sapiens
ggccagccccacccccagccagg

SEQ ID NO: 5626042 - DNA, 22 bp, Homo sapiens
ggccagccccatcttggtcctg

SEQ ID NO: 5626043 - DNA, 20 bp, Homo sapiens
ggccagcccccccacccacc

SEQ ID NO: 5626044 - DNA, 14 bp, Homo sapiens
ggccagcccctccc

SEQ ID NO: 5626045 - DNA, 18 bp, Homo sapiens
ggccagcccctcccacca

SEQ ID NO: 5626046 - DNA, 16 bp, Homo sapiens
ggccagcccctccccg

SEQ ID NO: 5626047 - DNA, 20 bp, Homo sapiens
ggccagccccttagacagag

SEQ ID NO: 5626048 - DNA, 21 bp, Homo sapiens
ggccagccccttagacagagg

SEQ ID NO: 5626049 - DNA, 18 bp, Homo sapiens
ggccagccctcccagcag

SEQ ID NO: 5626050 - DNA, 16 bp, Homo sapiens
ggccagccctgcagcc

SEQ ID NO: 5626051 - DNA, 17 bp, Homo sapiens
ggccagccctgcagccc

SEQ ID NO: 5626052 - DNA, 18 bp, Homo sapiens
ggccagccctgcagccca

SEQ ID NO: 5626053 - DNA, 18 bp, Homo sapiens
ggccagcccttcctctca

SEQ ID NO: 5626054 - DNA, 19 bp, Homo sapiens
ggccagcccttcctctcac

SEQ ID NO: 5626055 - DNA, 24 bp, Homo sapiens
ggccagcccttcctctcactcctg

SEQ ID NO: 5626056 - DNA, 19 bp, Homo sapiens
ggccagccgctctcctgcc

SEQ ID NO: 5626057 - DNA, 15 bp, Homo sapiens
ggccagcctcaccct

SEQ ID NO: 5626058 - DNA, 20 bp, Homo sapiens
ggccagcctccgagagggag

SEQ ID NO: 5626059 - DNA, 12 bp, Homo sapiens
ggccagcctggc

SEQ ID NO: 5626060 - DNA, 13 bp, Homo sapiens
ggccagcctggca

SEQ ID NO: 5626061 - DNA, 14 bp, Homo sapiens
ggccagcctggcat

SEQ ID NO: 5626062 - DNA, 16 bp, Homo sapiens
ggccagcctggcatca

SEQ ID NO: 5626063 - DNA, 13 bp, Homo sapiens
ggccagcctggcc

SEQ ID NO: 5626064 - DNA, 14 bp, Homo sapiens
ggccagcctggcct

SEQ ID NO: 5626065 - DNA, 17 bp, Homo sapiens
ggccagcctggcctcct

SEQ ID NO: 5626066 - DNA, 20 bp, Homo sapiens
ggccagcctggcctcctgcc

SEQ ID NO: 5626067 - DNA, 16 bp, Homo sapiens
ggccagcctgtccctg

SEQ ID NO: 5626068 - DNA, 21 bp, Homo sapiens
ggccagcgaggcgaggctgcc

SEQ ID NO: 5626069 - DNA, 16 bp, Homo sapiens
ggccagcgccagggcc

SEQ ID NO: 5626070 - DNA, 23 bp, Homo sapiens
ggccagcgccagggcccaggcca

SEQ ID NO: 5626071 - DNA, 21 bp, Homo sapiens
ggccagcgcccctcagcctct

SEQ ID NO: 5626072 - DNA, 15 bp, Homo sapiens
ggccagcggccctcc

SEQ ID NO: 5626073 - DNA, 18 bp, Homo sapiens
ggccagcggggctgctca

SEQ ID NO: 5626074 - DNA, 16 bp, Homo sapiens
ggccagcggtgaccag

SEQ ID NO: 5626075 - DNA, 14 bp, Homo sapiens
ggccagcgtcccag

SEQ ID NO: 5626076 - DNA, 16 bp, Homo sapiens
ggccagcgtcccaggg

SEQ ID NO: 5626077 - DNA, 13 bp, Homo sapiens
ggccagcgtggct

SEQ ID NO: 5626078 - DNA, 20 bp, Homo sapiens
ggccagctatctgcctgaca

SEQ ID NO: 5626079 - DNA, 15 bp, Homo sapiens
ggccagctcaggaat

SEQ ID NO: 5626080 - DNA, 23 bp, Homo sapiens
ggccagctcaggaattccctgga

SEQ ID NO: 5626081 - DNA, 11 bp, Homo sapiens
ggccagctccg

SEQ ID NO: 5626082 - DNA, 11 bp, Homo sapiens
ggccagctcct

SEQ ID NO: 5626083 - DNA, 20 bp, Homo sapiens
ggccagctctgaggggaggc

SEQ ID NO: 5626084 - DNA, 23 bp, Homo sapiens
ggccagctgcatctactcaggcc

SEQ ID NO: 5626085 - DNA, 13 bp, Homo sapiens
ggccagctgcccc

SEQ ID NO: 5626086 - DNA, 20 bp, Homo sapiens
ggccagctgccccagccaga

SEQ ID NO: 5626087 - DNA, 19 bp, Homo sapiens
ggccagctgcggccaggcc

SEQ ID NO: 5626088 - DNA, 23 bp, Homo sapiens
ggccagctgcttgggcttcatcc

SEQ ID NO: 5626089 - DNA, 13 bp, Homo sapiens
ggccagctggagg

SEQ ID NO: 5626090 - DNA, 16 bp, Homo sapiens
ggccagctggcagcag

SEQ ID NO: 5626091 - DNA, 13 bp, Homo sapiens
ggccagctgggga

SEQ ID NO: 5626092 - DNA, 18 bp, Homo sapiens
ggccagctggggagatgg

SEQ ID NO: 5626093 - DNA, 20 bp, Homo sapiens
ggccagctggggagatgggg

SEQ ID NO: 5626094 - DNA, 20 bp, Homo sapiens
ggccagcttcgtgctggagg

SEQ ID NO: 5626095 - DNA, 22 bp, Homo sapiens
ggccagcttcgtgctggaggaa

SEQ ID NO: 5626096 - DNA, 15 bp, Homo sapiens
ggccagcttttcaaa

SEQ ID NO: 5626097 - DNA, 21 bp, Homo sapiens
ggccaggaaggacagactggc

SEQ ID NO: 5626098 - DNA, 14 bp, Homo sapiens
ggccaggaagggga

SEQ ID NO: 5626099 - DNA, 15 bp, Homo sapiens
ggccaggaaggggac

SEQ ID NO: 5626100 - DNA, 21 bp, Homo sapiens
ggccaggaagtagcacaggct

SEQ ID NO: 5626101 - DNA, 16 bp, Homo sapiens
ggccaggaatctgcca

SEQ ID NO: 5626102 - DNA, 16 bp, Homo sapiens
ggccaggacacactga

SEQ ID NO: 5626103 - DNA, 12 bp, Homo sapiens
ggccaggacacc

SEQ ID NO: 5626104 - DNA, 23 bp, Homo sapiens
ggccaggaccacacagtccccag

SEQ ID NO: 5626105 - DNA, 20 bp, Homo sapiens
ggccaggactctgcagcctc

SEQ ID NO: 5626106 - DNA, 13 bp, Homo sapiens
ggccaggactgag

SEQ ID NO: 5626107 - DNA, 15 bp, Homo sapiens
ggccaggagagagat

SEQ ID NO: 5626108 - DNA, 17 bp, Homo sapiens
ggccaggagagagatct

SEQ ID NO: 5626109 - DNA, 14 bp, Homo sapiens
ggccaggagccatg

SEQ ID NO: 5626110 - DNA, 13 bp, Homo sapiens
ggccaggagccct

SEQ ID NO: 5626111 - DNA, 18 bp, Homo sapiens
ggccaggagccgggcctc

SEQ ID NO: 5626112 - DNA, 14 bp, Homo sapiens
ggccaggagctcag

SEQ ID NO: 5626113 - DNA, 13 bp, Homo sapiens
ggccaggaggctg

SEQ ID NO: 5626114 - DNA, 11 bp, Homo sapiens
ggccaggaggt

SEQ ID NO: 5626115 - DNA, 17 bp, Homo sapiens
ggccaggagtaagccca

SEQ ID NO: 5626116 - DNA, 14 bp, Homo sapiens
ggccaggagtgggg

SEQ ID NO: 5626117 - DNA, 16 bp, Homo sapiens
ggccaggagtggggag

SEQ ID NO: 5626118 - DNA, 17 bp, Homo sapiens
ggccaggagtgggtttc

SEQ ID NO: 5626119 - DNA, 20 bp, Homo sapiens
ggccaggagtttgagaccag

SEQ ID NO: 5626120 - DNA, 18 bp, Homo sapiens
ggccaggatgcctgagcc

SEQ ID NO: 5626121 - DNA, 16 bp, Homo sapiens
ggccaggattcctctc

SEQ ID NO: 5626122 - DNA, 19 bp, Homo sapiens
ggccaggcacaatggctca

SEQ ID NO: 5626123 - DNA, 13 bp, Homo sapiens
ggccaggcacagg

SEQ ID NO: 5626124 - DNA, 16 bp, Homo sapiens
ggccaggcacagggcc

SEQ ID NO: 5626125 - DNA, 19 bp, Homo sapiens
ggccaggcacagggcccgc

SEQ ID NO: 5626126 - DNA, 12 bp, Homo sapiens
ggccaggcagaa

SEQ ID NO: 5626127 - DNA, 12 bp, Homo sapiens
ggcccagcgcgg

SEQ ID NO: 5626128 - DNA, 22 bp, Homo sapiens
ggcccagcgcggacatcccctg

SEQ ID NO: 5626129 - DNA, 17 bp, Homo sapiens
ggcccagcgctctcctg

SEQ ID NO: 5626130 - DNA, 17 bp, Homo sapiens
ggcccagcggcccctcc

SEQ ID NO: 5626131 - DNA, 15 bp, Homo sapiens
ggcccagcgggcaga

SEQ ID NO: 5626132 - DNA, 16 bp, Homo sapiens
ggcccagctcccccgg

SEQ ID NO: 5626133 - DNA, 20 bp, Homo sapiens
ggcccagctcctcacccagg

SEQ ID NO: 5626134 - DNA, 23 bp, Homo sapiens
ggcccagctgctcccctggagga

SEQ ID NO: 5626135 - DNA, 10 bp, Homo sapiens
ggcccaggaa

SEQ ID NO: 5626136 - DNA, 20 bp, Homo sapiens
ggcccaggaaaaacctgtgg

SEQ ID NO: 5626137 - DNA, 14 bp, Homo sapiens
ggcccaggaagccc

SEQ ID NO: 5626138 - DNA, 15 bp, Homo sapiens
ggcccaggaagccca

SEQ ID NO: 5626139 - DNA, 16 bp, Homo sapiens
ggcccaggaagcccac

SEQ ID NO: 5626140 - DNA, 16 bp, Homo sapiens
ggcccaggaccagctg

SEQ ID NO: 5626141 - DNA, 17 bp, Homo sapiens
ggcccaggaccagctgg

SEQ ID NO: 5626142 - DNA, 14 bp, Homo sapiens
ggcccaggactctg

SEQ ID NO: 5626143 - DNA, 17 bp, Homo sapiens
ggcccaggagagccccc

SEQ ID NO: 5626144 - DNA, 14 bp, Homo sapiens
ggcccaggagcgca

SEQ ID NO: 5626145 - DNA, 16 bp, Homo sapiens
ggcccaggagctctgc

SEQ ID NO: 5626146 - DNA, 13 bp, Homo sapiens
ggcccaggaggag

SEQ ID NO: 5626147 - DNA, 18 bp, Homo sapiens
ggcccaggaggtcaagcc

SEQ ID NO: 5626148 - DNA, 23 bp, Homo sapiens
ggcccaggaggtcaagcctgcag

SEQ ID NO: 5626149 - DNA, 11 bp, Homo sapiens
ggcccaggagt

SEQ ID NO: 5626150 - DNA, 16 bp, Homo sapiens
ggcccaggagtccagg

SEQ ID NO: 5626151 - DNA, 12 bp, Homo sapiens
ggcccaggcacc

SEQ ID NO: 5626152 - DNA, 15 bp, Homo sapiens
ggcccaggcaccacc

SEQ ID NO: 5626153 - DNA, 18 bp, Homo sapiens
ggcccaggcaccaccagg

SEQ ID NO: 5626154 - DNA, 19 bp, Homo sapiens
ggcccaggcaccaccagga

SEQ ID NO: 5626155 - DNA, 22 bp, Homo sapiens
ggcccaggcagacaaccttgtc

SEQ ID NO: 5626156 - DNA, 13 bp, Homo sapiens
ggcccaggcagcc

SEQ ID NO: 5626157 - DNA, 12 bp, Homo sapiens
ggcccaggcagg

SEQ ID NO: 5626158 - DNA, 14 bp, Homo sapiens
ggcccaggcaggcc

SEQ ID NO: 5626159 - DNA, 18 bp, Homo sapiens
ggcccaggcaggcccagc

SEQ ID NO: 5626160 - DNA, 20 bp, Homo sapiens
ggcccaggcaggcccagcct

SEQ ID NO: 5626161 - DNA, 20 bp, Homo sapiens
ggcccaggcaggtctgcaag

SEQ ID NO: 5626162 - DNA, 14 bp, Homo sapiens
ggcccaggccaggt

SEQ ID NO: 5626163 - DNA, 13 bp, Homo sapiens
ggcccaggccatc

SEQ ID NO: 5626164 - DNA, 17 bp, Homo sapiens
ggcccaggcccagcctc

SEQ ID NO: 5626165 - DNA, 12 bp, Homo sapiens
ggcccaggcccc

SEQ ID NO: 5626166 - DNA, 22 bp, Homo sapiens
ggcccaggccgggaagagccac

SEQ ID NO: 5626167 - DNA, 12 bp, Homo sapiens
ggcccaggcctg

SEQ ID NO: 5626168 - DNA, 16 bp, Homo sapiens
ggcccaggcctggagc

SEQ ID NO: 5626169 - DNA, 17 bp, Homo sapiens
ggcccaggctcccctgc

SEQ ID NO: 5626170 - DNA, 18 bp, Homo sapiens
ggcccaggctcccctgcc

SEQ ID NO: 5626171 - DNA, 14 bp, Homo sapiens
ggcccaggctctgg

SEQ ID NO: 5626172 - DNA, 20 bp, Homo sapiens
ggcccaggctctgggaaggg

SEQ ID NO: 5626173 - DNA, 10 bp, Homo sapiens
ggcccaggga

SEQ ID NO: 5626174 - DNA, 22 bp, Homo sapiens
ggcccagggagcaatgggaggg

SEQ ID NO: 5626175 - DNA, 20 bp, Homo sapiens
ggcccagggaggcagcgtgg

SEQ ID NO: 5626176 - DNA, 21 bp, Homo sapiens
ggcccagggaggcagcgtggg

SEQ ID NO: 5626177 - DNA, 19 bp, Homo sapiens
ggcccagggaggtggcagg

SEQ ID NO: 5626178 - DNA, 17 bp, Homo sapiens
ggcccagggcaagctcc

SEQ ID NO: 5626179 - DNA, 20 bp, Homo sapiens
ggcccagggcaagctccgca

SEQ ID NO: 5626180 - DNA, 16 bp, Homo sapiens
ggcccagggcatctgg

SEQ ID NO: 5626181 - DNA, 22 bp, Homo sapiens
ggcccagggcccagagcccagc

SEQ ID NO: 5626182 - DNA, 24 bp, Homo sapiens
ggcccagggcctctggcttccctg

SEQ ID NO: 5626183 - DNA, 16 bp, Homo sapiens
ggcccagggggcctgg

SEQ ID NO: 5626184 - DNA, 18 bp, Homo sapiens
ggcccagggggcctggag

SEQ ID NO: 5626185 - DNA, 20 bp, Homo sapiens
ggcccaggggtcccctggca

SEQ ID NO: 5626186 - DNA, 19 bp, Homo sapiens
ggcccagggtggccacacc

SEQ ID NO: 5626187 - DNA, 21 bp, Homo sapiens
ggcccagggtgtttgcagctg

SEQ ID NO: 5626188 - DNA, 12 bp, Homo sapiens
ggcccaggtgcc

SEQ ID NO: 5626189 - DNA, 13 bp, Homo sapiens
ggcccaggtggct

SEQ ID NO: 5626190 - DNA, 18 bp, Homo sapiens
ggcccaggtggctatttt

SEQ ID NO: 5626191 - DNA, 16 bp, Homo sapiens
ggcccagtcctggcct

SEQ ID NO: 5626192 - DNA, 21 bp, Homo sapiens
ggcccagtgacaaagactcct

SEQ ID NO: 5626193 - DNA, 19 bp, Homo sapiens
ggcccagtgagagtgaggc

SEQ ID NO: 5626194 - DNA, 21 bp, Homo sapiens
ggcccagtgcatggtggccag

SEQ ID NO: 5626195 - DNA, 22 bp, Homo sapiens
ggcccagtgcatggtggccaga

SEQ ID NO: 5626196 - DNA, 19 bp, Homo sapiens
ggcccagtgccactgcccc

SEQ ID NO: 5626197 - DNA, 13 bp, Homo sapiens
ggcccagtgccag

SEQ ID NO: 5626198 - DNA, 16 bp, Homo sapiens
ggcccagtgccagctc

SEQ ID NO: 5626199 - DNA, 19 bp, Homo sapiens
ggcccagtgccagctccag

SEQ ID NO: 5626200 - DNA, 23 bp, Homo sapiens
ggcccatagaaacatgacactga

SEQ ID NO: 5626201 - DNA, 15 bp, Homo sapiens
ggcccatatccctgg

SEQ ID NO: 5626202 - DNA, 16 bp, Homo sapiens
ggcccatatccctggt

SEQ ID NO: 5626203 - DNA, 14 bp, Homo sapiens
ggcccatcactgta

SEQ ID NO: 5626204 - DNA, 22 bp, Homo sapiens
ggcccatcagtgtacccccgcc

SEQ ID NO: 5626205 - DNA, 14 bp, Homo sapiens
ggcccatctcagcc

SEQ ID NO: 5626206 - DNA, 18 bp, Homo sapiens
ggcccatctcagcctcct

SEQ ID NO: 5626207 - DNA, 17 bp, Homo sapiens
ggcccatctctccctgc

SEQ ID NO: 5626208 - DNA, 19 bp, Homo sapiens
ggcccatctgtccatcctc

SEQ ID NO: 5626209 - DNA, 23 bp, Homo sapiens
ggcccatctgtccatcctcctct

SEQ ID NO: 5626210 - DNA, 20 bp, Homo sapiens
ggcccatgaagaaagcccct

SEQ ID NO: 5626211 - DNA, 16 bp, Homo sapiens
ggcccatgccaaggcc

SEQ ID NO: 5626212 - DNA, 16 bp, Homo sapiens
ggcccatggaggagac

SEQ ID NO: 5626213 - DNA, 18 bp, Homo sapiens
ggcccatggaggagacag

SEQ ID NO: 5626214 - DNA, 13 bp, Homo sapiens
ggcccatggccac

SEQ ID NO: 5626215 - DNA, 14 bp, Homo sapiens
ggcccatggcccca

SEQ ID NO: 5626216 - DNA, 18 bp, Homo sapiens
ggcccatggccccagctg

SEQ ID NO: 5626217 - DNA, 17 bp, Homo sapiens
ggcccatgggagggagc

SEQ ID NO: 5626218 - DNA, 19 bp, Homo sapiens
ggcccatgtatggccagga

SEQ ID NO: 5626219 - DNA, 20 bp, Homo sapiens
ggcccatgtatggccaggaa

SEQ ID NO: 5626220 - DNA, 14 bp, Homo sapiens
ggcccattcagcct

SEQ ID NO: 5626221 - DNA, 15 bp, Homo sapiens
ggcccattcagcctc

SEQ ID NO: 5626222 - DNA, 18 bp, Homo sapiens
ggcccattctacttgctc

SEQ ID NO: 5626223 - DNA, 17 bp, Homo sapiens
ggcccattgtcctcctt

SEQ ID NO: 5626224 - DNA, 15 bp, Homo sapiens
ggccccaaagcccag

SEQ ID NO: 5626225 - DNA, 17 bp, Homo sapiens
ggccccaaagcccagcc

SEQ ID NO: 5626226 - DNA, 18 bp, Homo sapiens
ggccccaaagcccagccc

SEQ ID NO: 5626227 - DNA, 16 bp, Homo sapiens
ggccccacaaggcctg

SEQ ID NO: 5626228 - DNA, 17 bp, Homo sapiens
ggccccacaaggcctgg

SEQ ID NO: 5626229 - DNA, 22 bp, Homo sapiens
ggccccacaggagttgtgagcc

SEQ ID NO: 5626230 - DNA, 12 bp, Homo sapiens
ggccccacccct

SEQ ID NO: 5626231 - DNA, 17 bp, Homo sapiens
ggccccaccctgggccc

SEQ ID NO: 5626232 - DNA, 21 bp, Homo sapiens
ggccccaccctgggccctggg

SEQ ID NO: 5626233 - DNA, 23 bp, Homo sapiens
ggccccaccctgggccctgggct

SEQ ID NO: 5626234 - DNA, 17 bp, Homo sapiens
ggccccaccggccaggc

SEQ ID NO: 5626235 - DNA, 17 bp, Homo sapiens
ggccccacctccctgcg

SEQ ID NO: 5626236 - DNA, 18 bp, Homo sapiens
ggccccacctccctgcgc

SEQ ID NO: 5626237 - DNA, 21 bp, Homo sapiens
ggccccacctccctgcgccct

SEQ ID NO: 5626238 - DNA, 21 bp, Homo sapiens
ggccccacctcggcacacact

SEQ ID NO: 5626239 - DNA, 18 bp, Homo sapiens
ggccccacctgaagggtg

SEQ ID NO: 5626240 - DNA, 13 bp, Homo sapiens
ggccccacctgca

SEQ ID NO: 5626241 - DNA, 19 bp, Homo sapiens
ggccccacctgcagctccc

SEQ ID NO: 5626242 - DNA, 13 bp, Homo sapiens
ggccccacctggc

SEQ ID NO: 5626243 - DNA, 15 bp, Homo sapiens
ggccccacctggccc

SEQ ID NO: 5626244 - DNA, 22 bp, Homo sapiens
ggccccacctggccctctctga

SEQ ID NO: 5626245 - DNA, 14 bp, Homo sapiens
ggccccacgccctc

SEQ ID NO: 5626246 - DNA, 13 bp, Homo sapiens
ggccccacggaga

SEQ ID NO: 5626247 - DNA, 20 bp, Homo sapiens
ggccccactggacaacactg

SEQ ID NO: 5626248 - DNA, 19 bp, Homo sapiens
ggccccactggctggagga

SEQ ID NO: 5626249 - DNA, 17 bp, Homo sapiens
ggccccactttgaaggg

SEQ ID NO: 5626250 - DNA, 17 bp, Homo sapiens
ggccccagaggccctgg

SEQ ID NO: 5626251 - DNA, 17 bp, Homo sapiens
ggccccagatctgcctg

SEQ ID NO: 5626252 - DNA, 20 bp, Homo sapiens
ggccccagatgatcccagtc

SEQ ID NO: 5626253 - DNA, 17 bp, Homo sapiens
ggccccagcaacacgtc

SEQ ID NO: 5626254 - DNA, 13 bp, Homo sapiens
ggccccagcacta

SEQ ID NO: 5626255 - DNA, 21 bp, Homo sapiens
ggccccagcactaaagcagtg

SEQ ID NO: 5626256 - DNA, 22 bp, Homo sapiens
ggccccagccaagtgccttccg

SEQ ID NO: 5626257 - DNA, 12 bp, Homo sapiens
ggccccagccag

SEQ ID NO: 5626258 - DNA, 12 bp, Homo sapiens
ggccccagccca

SEQ ID NO: 5626259 - DNA, 13 bp, Homo sapiens
ggccccagcccac

SEQ ID NO: 5626260 - DNA, 23 bp, Homo sapiens
ggccccagcccaccctcctgtct

SEQ ID NO: 5626261 - DNA, 15 bp, Homo sapiens
ggccccagccctgct

SEQ ID NO: 5626262 - DNA, 16 bp, Homo sapiens
ggccccagccctgctg

SEQ ID NO: 5626263 - DNA, 11 bp, Homo sapiens
ggccccagcct

SEQ ID NO: 5626264 - DNA, 13 bp, Homo sapiens
ggccccagcctcc

SEQ ID NO: 5626265 - DNA, 17 bp, Homo sapiens
ggccccagcctccaggc

SEQ ID NO: 5626266 - DNA, 13 bp, Homo sapiens
ggccccagcctgg

SEQ ID NO: 5626267 - DNA, 14 bp, Homo sapiens
ggccccagcctggc

SEQ ID NO: 5626268 - DNA, 17 bp, Homo sapiens
ggccccagcctggccca

SEQ ID NO: 5626269 - DNA, 18 bp, Homo sapiens
ggccccagcctggcccag

SEQ ID NO: 5626270 - DNA, 13 bp, Homo sapiens
ggccccagcgtct

SEQ ID NO: 5626271 - DNA, 18 bp, Homo sapiens
ggccccagcgtctgcagg

SEQ ID NO: 5626272 - DNA, 21 bp, Homo sapiens
ggccccagcgtctgcagggtg

SEQ ID NO: 5626273 - DNA, 12 bp, Homo sapiens
ggccccagctct

SEQ ID NO: 5626274 - DNA, 16 bp, Homo sapiens
ggccccagctctgagg

SEQ ID NO: 5626275 - DNA, 19 bp, Homo sapiens
ggccccagcttctcagctc

SEQ ID NO: 5626276 - DNA, 13 bp, Homo sapiens
ggccccaggaagc

SEQ ID NO: 5626277 - DNA, 13 bp, Homo sapiens
ggccccaggaggg

SEQ ID NO: 5626278 - DNA, 23 bp, Homo sapiens
ggccccaggaggggaactgagtc

SEQ ID NO: 5626279 - DNA, 19 bp, Homo sapiens
ggccccaggccccagacag

SEQ ID NO: 5626280 - DNA, 13 bp, Homo sapiens
ggccccaggccct

SEQ ID NO: 5626281 - DNA, 12 bp, Homo sapiens
ggccccaggctg

SEQ ID NO: 5626282 - DNA, 22 bp, Homo sapiens
ggccccaggctgagagccagat

SEQ ID NO: 5626283 - DNA, 22 bp, Homo sapiens
ggccccaggctggatgctgggt

SEQ ID NO: 5626284 - DNA, 17 bp, Homo sapiens
ggccccagggacagagg

SEQ ID NO: 5626285 - DNA, 20 bp, Homo sapiens
ggccccagggacagaggcca

SEQ ID NO: 5626286 - DNA, 14 bp, Homo sapiens
ggccccaggggcag

SEQ ID NO: 5626287 - DNA, 16 bp, Homo sapiens
ggccccaggggcagca

SEQ ID NO: 5626288 - DNA, 14 bp, Homo sapiens
ggccccagggttga

SEQ ID NO: 5626289 - DNA, 21 bp, Homo sapiens
ggccccagtcagcctctctcc

SEQ ID NO: 5626290 - DNA, 21 bp, Homo sapiens
ggccccatcagaggctggggg

SEQ ID NO: 5626291 - DNA, 18 bp, Homo sapiens
ggccccatcagcatccca

SEQ ID NO: 5626292 - DNA, 13 bp, Homo sapiens
ggccccatcccag

SEQ ID NO: 5626293 - DNA, 16 bp, Homo sapiens
ggccccatcctggccc

SEQ ID NO: 5626294 - DNA, 21 bp, Homo sapiens
ggccccatcgccccaccgcag

SEQ ID NO: 5626295 - DNA, 19 bp, Homo sapiens
ggccccatgctctgcccca

SEQ ID NO: 5626296 - DNA, 21 bp, Homo sapiens
ggccccatgctctgccccaag

SEQ ID NO: 5626297 - DNA, 11 bp, Homo sapiens
ggccccatggc

SEQ ID NO: 5626298 - DNA, 19 bp, Homo sapiens
ggccccatggcagctcctg

SEQ ID NO: 5626299 - DNA, 21 bp, Homo sapiens
ggccccattctccctccatgg

SEQ ID NO: 5626300 - DNA, 23 bp, Homo sapiens
ggccccattctccctccatggca

SEQ ID NO: 5626301 - DNA, 20 bp, Homo sapiens
ggcccccaaacatagcccct

SEQ ID NO: 5626302 - DNA, 21 bp, Homo sapiens
ggcccccaaattgccttcagc

SEQ ID NO: 5626303 - DNA, 20 bp, Homo sapiens
ggcccccaacccctcctccc

SEQ ID NO: 5626304 - DNA, 22 bp, Homo sapiens
ggcccccaacccctcctccctc

SEQ ID NO: 5626305 - DNA, 20 bp, Homo sapiens
ggcccccaacctcagggctc

SEQ ID NO: 5626306 - DNA, 21 bp, Homo sapiens
ggcccttcctggacagctgtg

SEQ ID NO: 5626307 - DNA, 20 bp, Homo sapiens
ggcccttcctggactggccc

SEQ ID NO: 5626308 - DNA, 14 bp, Homo sapiens
ggcccttcctggct

SEQ ID NO: 5626309 - DNA, 18 bp, Homo sapiens
ggcccttccttcacccac

SEQ ID NO: 5626310 - DNA, 14 bp, Homo sapiens
ggcccttccttttc

SEQ ID NO: 5626311 - DNA, 16 bp, Homo sapiens
ggcccttctctccagc

SEQ ID NO: 5626312 - DNA, 17 bp, Homo sapiens
ggcccttctctccagcc

SEQ ID NO: 5626313 - DNA, 18 bp, Homo sapiens
ggcccttctctccagccc

SEQ ID NO: 5626314 - DNA, 19 bp, Homo sapiens
ggcccttctgactgtttat

SEQ ID NO: 5626315 - DNA, 18 bp, Homo sapiens
ggcccttcttgctgccct

SEQ ID NO: 5626316 - DNA, 22 bp, Homo sapiens
ggcccttgatgcccagctcagt

SEQ ID NO: 5626317 - DNA, 18 bp, Homo sapiens
ggcccttgccggggcctg

SEQ ID NO: 5626318 - DNA, 18 bp, Homo sapiens
ggcccttggaaaaacagg

SEQ ID NO: 5626319 - DNA, 15 bp, Homo sapiens
ggcccttggaataaa

SEQ ID NO: 5626320 - DNA, 17 bp, Homo sapiens
ggcccttggaataaagt

SEQ ID NO: 5626321 - DNA, 18 bp, Homo sapiens
ggcccttggccccagagg

SEQ ID NO: 5626322 - DNA, 16 bp, Homo sapiens
ggcccttggctgcagg

SEQ ID NO: 5626323 - DNA, 17 bp, Homo sapiens
ggcccttggggcctggc

SEQ ID NO: 5626324 - DNA, 19 bp, Homo sapiens
ggcccttggggcctggctt

SEQ ID NO: 5626325 - DNA, 16 bp, Homo sapiens
ggcccttggggctggg

SEQ ID NO: 5626326 - DNA, 23 bp, Homo sapiens
ggcccttggtagagctggtgcca

SEQ ID NO: 5626327 - DNA, 14 bp, Homo sapiens
ggcccttggtgggg

SEQ ID NO: 5626328 - DNA, 15 bp, Homo sapiens
ggcccttgtcctgcc

SEQ ID NO: 5626329 - DNA, 17 bp, Homo sapiens
ggcccttgtcctgccag

SEQ ID NO: 5626330 - DNA, 20 bp, Homo sapiens
ggcccttgtcctgccagctg

SEQ ID NO: 5626331 - DNA, 15 bp, Homo sapiens
ggcccttgtcttttc

SEQ ID NO: 5626332 - DNA, 19 bp, Homo sapiens
ggccctttcacccctcttc

SEQ ID NO: 5626333 - DNA, 14 bp, Homo sapiens
ggccctttcccctt

SEQ ID NO: 5626334 - DNA, 18 bp, Homo sapiens
ggccctttccccttcccc

SEQ ID NO: 5626335 - DNA, 11 bp, Homo sapiens
ggccctttcct

SEQ ID NO: 5626336 - DNA, 18 bp, Homo sapiens
ggccctttcctcaggcaa

SEQ ID NO: 5626337 - DNA, 21 bp, Homo sapiens
ggccctttcttgcactgtcca

SEQ ID NO: 5626338 - DNA, 19 bp, Homo sapiens
ggccctttgaagcctcagc

SEQ ID NO: 5626339 - DNA, 20 bp, Homo sapiens
ggccctttgaagcctcagct

SEQ ID NO: 5626340 - DNA, 16 bp, Homo sapiens
ggcccttttctggctc

SEQ ID NO: 5626341 - DNA, 17 bp, Homo sapiens
ggcccttttctggctcc

SEQ ID NO: 5626342 - DNA, 19 bp, Homo sapiens
ggccgaaccccccactccc

SEQ ID NO: 5626343 - DNA, 18 bp, Homo sapiens
ggccgaagccccttggag

SEQ ID NO: 5626344 - DNA, 20 bp, Homo sapiens
ggccgaagccccttggagag

SEQ ID NO: 5626345 - DNA, 16 bp, Homo sapiens
ggccgaagctctggct

SEQ ID NO: 5626346 - DNA, 17 bp, Homo sapiens
ggccgaagctctggctg

SEQ ID NO: 5626347 - DNA, 18 bp, Homo sapiens
ggccgaagctctggctga

SEQ ID NO: 5626348 - DNA, 19 bp, Homo sapiens
ggccgaatcccctccctgt

SEQ ID NO: 5626349 - DNA, 21 bp, Homo sapiens
ggccgaatcccctccctgtca

SEQ ID NO: 5626350 - DNA, 20 bp, Homo sapiens
ggccgacaccactcctgcca

SEQ ID NO: 5626351 - DNA, 22 bp, Homo sapiens
ggccgacaccactcctgccagc

SEQ ID NO: 5626352 - DNA, 13 bp, Homo sapiens
ggccgaccaggct

SEQ ID NO: 5626353 - DNA, 14 bp, Homo sapiens
ggccgaccaggctg

SEQ ID NO: 5626354 - DNA, 15 bp, Homo sapiens
ggccgaccaggctgg

SEQ ID NO: 5626355 - DNA, 18 bp, Homo sapiens
ggccgaccctgcggcctc

SEQ ID NO: 5626356 - DNA, 20 bp, Homo sapiens
ggccgacggcggcggccctc

SEQ ID NO: 5626357 - DNA, 17 bp, Homo sapiens
ggccgacgttttctccg

SEQ ID NO: 5626358 - DNA, 19 bp, Homo sapiens
ggccgacgttttctccgca

SEQ ID NO: 5626359 - DNA, 16 bp, Homo sapiens
ggccgactctgcactc

SEQ ID NO: 5626360 - DNA, 22 bp, Homo sapiens
ggccgactgggctgctggggca

SEQ ID NO: 5626361 - DNA, 13 bp, Homo sapiens
ggccgagagcctt

SEQ ID NO: 5626362 - DNA, 13 bp, Homo sapiens
ggccgagccaggt

SEQ ID NO: 5626363 - DNA, 15 bp, Homo sapiens
ggccgagcccacacc

SEQ ID NO: 5626364 - DNA, 20 bp, Homo sapiens
ggccgagcccacaccatctg

SEQ ID NO: 5626365 - DNA, 12 bp, Homo sapiens
ggccgagctcct

SEQ ID NO: 5626366 - DNA, 15 bp, Homo sapiens
ggccgagctcctggg

SEQ ID NO: 5626367 - DNA, 21 bp, Homo sapiens
ggccgagctcctggggagctc

SEQ ID NO: 5626368 - DNA, 15 bp, Homo sapiens
ggccgagctggtttc

SEQ ID NO: 5626369 - DNA, 19 bp, Homo sapiens
ggccgagctggtttcctgc

SEQ ID NO: 5626370 - DNA, 23 bp, Homo sapiens
ggccgagctggtttcctgcccag

SEQ ID NO: 5626371 - DNA, 21 bp, Homo sapiens
ggccgaggaccaccagcaggc

SEQ ID NO: 5626372 - DNA, 20 bp, Homo sapiens
ggccgaggcaggaggatcct

SEQ ID NO: 5626373 - DNA, 12 bp, Homo sapiens
ggccgaggccca

SEQ ID NO: 5626374 - DNA, 12 bp, Homo sapiens
ggccgaggcggg

SEQ ID NO: 5626375 - DNA, 13 bp, Homo sapiens
ggccgagggccag

SEQ ID NO: 5626376 - DNA, 15 bp, Homo sapiens
ggccgagggccaggc

SEQ ID NO: 5626377 - DNA, 20 bp, Homo sapiens
ggccgagggccaggcagaat

SEQ ID NO: 5626378 - DNA, 22 bp, Homo sapiens
ggccgagtaccttaatctgcca

SEQ ID NO: 5626379 - DNA, 13 bp, Homo sapiens
ggccgagtccaag

SEQ ID NO: 5626380 - DNA, 16 bp, Homo sapiens
ggccgagtccaggagc

SEQ ID NO: 5626381 - DNA, 17 bp, Homo sapiens
ggccgagtccaggagcc

SEQ ID NO: 5626382 - DNA, 16 bp, Homo sapiens
ggccgagtctgtcctg

SEQ ID NO: 5626383 - DNA, 18 bp, Homo sapiens
ggccgagtctgtcctgga

SEQ ID NO: 5626384 - DNA, 15 bp, Homo sapiens
ggccgagtggctgcc

SEQ ID NO: 5626385 - DNA, 19 bp, Homo sapiens
ggccgatcggggcactgca

SEQ ID NO: 5626386 - DNA, 16 bp, Homo sapiens
ggccgcaagcgcaggg

SEQ ID NO: 5626387 - DNA, 22 bp, Homo sapiens
ggccgcaagcgcagggaggatg

SEQ ID NO: 5626388 - DNA, 19 bp, Homo sapiens
ggccgcaagtccccagccc

SEQ ID NO: 5626389 - DNA, 21 bp, Homo sapiens
ggccgcaccatttctgtcact

SEQ ID NO: 5626390 - DNA, 15 bp, Homo sapiens
ggccgcactgggagc

SEQ ID NO: 5626391 - DNA, 16 bp, Homo sapiens
ggccgcactgggagca

SEQ ID NO: 5626392 - DNA, 14 bp, Homo sapiens
ggccgcagagactg

SEQ ID NO: 5626393 - DNA, 18 bp, Homo sapiens
ggccgcagctcttgccct

SEQ ID NO: 5626394 - DNA, 20 bp, Homo sapiens
ggccgcagctcttgcccttc

SEQ ID NO: 5626395 - DNA, 12 bp, Homo sapiens
ggccgcaggagg

SEQ ID NO: 5626396 - DNA, 14 bp, Homo sapiens
ggccgcaggaggga

SEQ ID NO: 5626397 - DNA, 12 bp, Homo sapiens
ggccgcagggcg

SEQ ID NO: 5626398 - DNA, 17 bp, Homo sapiens
ggccgcataggcccagc

SEQ ID NO: 5626399 - DNA, 20 bp, Homo sapiens
ggccgcataggcccagccag

SEQ ID NO: 5626400 - DNA, 17 bp, Homo sapiens
ggccgcattccctgagt

SEQ ID NO: 5626401 - DNA, 13 bp, Homo sapiens
ggccgccaccccc

SEQ ID NO: 5626402 - DNA, 17 bp, Homo sapiens
ggccgccacggcctggc

SEQ ID NO: 5626403 - DNA, 16 bp, Homo sapiens
ggccgccagcgtgtgg

SEQ ID NO: 5626404 - DNA, 19 bp, Homo sapiens
ggccgccagcgtgtggagc

SEQ ID NO: 5626405 - DNA, 20 bp, Homo sapiens
ggccgccatccgggacgctt

SEQ ID NO: 5626406 - DNA, 22 bp, Homo sapiens
ggccgccatctgcgcagggtgg

SEQ ID NO: 5626407 - DNA, 16 bp, Homo sapiens
ggccgcccacctgcat

SEQ ID NO: 5626408 - DNA, 19 bp, Homo sapiens
ggccgcccagacaccacag

SEQ ID NO: 5626409 - DNA, 23 bp, Homo sapiens
ggccgcccccagccccctcctgg

SEQ ID NO: 5626410 - DNA, 20 bp, Homo sapiens
ggccgccccgccccagagct

SEQ ID NO: 5626411 - DNA, 22 bp, Homo sapiens
ggccgccccgccccagagctcc

SEQ ID NO: 5626412 - DNA, 13 bp, Homo sapiens
ggccgcccggcag

SEQ ID NO: 5626413 - DNA, 17 bp, Homo sapiens
ggccgcccgggcccaga

SEQ ID NO: 5626414 - DNA, 16 bp, Homo sapiens
ggccgccgtgacctat

SEQ ID NO: 5626415 - DNA, 12 bp, Homo sapiens
ggccgcctcacc

SEQ ID NO: 5626416 - DNA, 14 bp, Homo sapiens
ggccgcctcacccc

SEQ ID NO: 5626417 - DNA, 13 bp, Homo sapiens
ggccgcctccagg

SEQ ID NO: 5626418 - DNA, 19 bp, Homo sapiens
ggccgcctcctccagactc

SEQ ID NO: 5626419 - DNA, 15 bp, Homo sapiens
ggccgcctgccctgc

SEQ ID NO: 5626420 - DNA, 12 bp, Homo sapiens
ggccgcctgcct

SEQ ID NO: 5626421 - DNA, 17 bp, Homo sapiens
ggccgcgcaccgccatg

SEQ ID NO: 5626422 - DNA, 22 bp, Homo sapiens
ggccgcgccaaataatgtctct

SEQ ID NO: 5626423 - DNA, 15 bp, Homo sapiens
ggccgcgcccagcag

SEQ ID NO: 5626424 - DNA, 16 bp, Homo sapiens
ggccgcgccctttccc

SEQ ID NO: 5626425 - DNA, 18 bp, Homo sapiens
ggccgcgcgtccagctgc

SEQ ID NO: 5626426 - DNA, 19 bp, Homo sapiens
ggccgcgcgtccagctgcc

SEQ ID NO: 5626427 - DNA, 15 bp, Homo sapiens
ggccgcggcccagac

SEQ ID NO: 5626428 - DNA, 18 bp, Homo sapiens
ggccgcgtgccgggcccc

SEQ ID NO: 5626429 - DNA, 15 bp, Homo sapiens
ggccgctagaggcct

SEQ ID NO: 5626430 - DNA, 19 bp, Homo sapiens
ggccgctagaggcctgagg

SEQ ID NO: 5626431 - DNA, 14 bp, Homo sapiens
ggccgctccaccag

SEQ ID NO: 5626432 - DNA, 16 bp, Homo sapiens
ggccgctccaggggtg

SEQ ID NO: 5626433 - DNA, 15 bp, Homo sapiens
ggccgctcctccctg

SEQ ID NO: 5626434 - DNA, 19 bp, Homo sapiens
ggccgctctccccctgcag

SEQ ID NO: 5626435 - DNA, 16 bp, Homo sapiens
ggccgctctccgcccc

SEQ ID NO: 5626436 - DNA, 20 bp, Homo sapiens
ggccgctctccgccccccgg

SEQ ID NO: 5626437 - DNA, 17 bp, Homo sapiens
ggccgctgagtggcagg

SEQ ID NO: 5626438 - DNA, 15 bp, Homo sapiens
ggccgctgcagggtg

SEQ ID NO: 5626439 - DNA, 22 bp, Homo sapiens
ggccgctgcagtcagcacagag

SEQ ID NO: 5626440 - DNA, 13 bp, Homo sapiens
ggccgctgccacc

SEQ ID NO: 5626441 - DNA, 21 bp, Homo sapiens
ggccgctgccacccacctccc

SEQ ID NO: 5626442 - DNA, 12 bp, Homo sapiens
ggccgctgcccc

SEQ ID NO: 5626443 - DNA, 20 bp, Homo sapiens
ggccgctggcccagggtagg

SEQ ID NO: 5626444 - DNA, 21 bp, Homo sapiens
ggccgctggcccagggtaggg

SEQ ID NO: 5626445 - DNA, 14 bp, Homo sapiens
ggccgctggctggt

SEQ ID NO: 5626446 - DNA, 14 bp, Homo sapiens
ggccgcttctcctg

SEQ ID NO: 5626447 - DNA, 17 bp, Homo sapiens
ggccggaaaacaagcct

SEQ ID NO: 5626448 - DNA, 20 bp, Homo sapiens
ggccggaaccacagggccag

SEQ ID NO: 5626449 - DNA, 20 bp, Homo sapiens
ggccggacccccgtcagctg

SEQ ID NO: 5626450 - DNA, 15 bp, Homo sapiens
ggccggacctgagcc

SEQ ID NO: 5626451 - DNA, 17 bp, Homo sapiens
ggccggacgcaggtgct

SEQ ID NO: 5626452 - DNA, 14 bp, Homo sapiens
ggccggagagctgg

SEQ ID NO: 5626453 - DNA, 14 bp, Homo sapiens
ggccggagcccaga

SEQ ID NO: 5626454 - DNA, 19 bp, Homo sapiens
ggccggagggcaggaccct

SEQ ID NO: 5626455 - DNA, 18 bp, Homo sapiens
ggccggcagccccagcct

SEQ ID NO: 5626456 - DNA, 20 bp, Homo sapiens
ggccggcagccccagcctgc

SEQ ID NO: 5626457 - DNA, 14 bp, Homo sapiens
ggccggcagcctgg

SEQ ID NO: 5626458 - DNA, 13 bp, Homo sapiens
ggccggccagcca

SEQ ID NO: 5626459 - DNA, 13 bp, Homo sapiens
ggccggccagcct

SEQ ID NO: 5626460 - DNA, 16 bp, Homo sapiens
ggccggccagccttgc

SEQ ID NO: 5626461 - DNA, 14 bp, Homo sapiens
ggccggccagctcc

SEQ ID NO: 5626462 - DNA, 16 bp, Homo sapiens
ggccggccaggtgggc

SEQ ID NO: 5626463 - DNA, 17 bp, Homo sapiens
ggccggcccaggcctcc

SEQ ID NO: 5626464 - DNA, 17 bp, Homo sapiens
ggccggccccaggctcc

SEQ ID NO: 5626465 - DNA, 12 bp, Homo sapiens
ggccggccctgc

SEQ ID NO: 5626466 - DNA, 13 bp, Homo sapiens
ggccggccctgcc

SEQ ID NO: 5626467 - DNA, 14 bp, Homo sapiens
ggccggccctgccc

SEQ ID NO: 5626468 - DNA, 18 bp, Homo sapiens
ggccggccctgcccccca

SEQ ID NO: 5626469 - DNA, 16 bp, Homo sapiens
ggccggccctgcccct

SEQ ID NO: 5626470 - DNA, 17 bp, Homo sapiens
ggccggccctgcccctc

SEQ ID NO: 5626471 - DNA, 13 bp, Homo sapiens
ggccggccctggc

SEQ ID NO: 5626472 - DNA, 18 bp, Homo sapiens
ggccggccctggcttgga

SEQ ID NO: 5626473 - DNA, 14 bp, Homo sapiens
ggccggccctgtgt

SEQ ID NO: 5626474 - DNA, 15 bp, Homo sapiens
ggccggccctgtgtg

SEQ ID NO: 5626475 - DNA, 14 bp, Homo sapiens
ggccggcctggggc

SEQ ID NO: 5626476 - DNA, 17 bp, Homo sapiens
ggccggcgagccctgtg

SEQ ID NO: 5626477 - DNA, 18 bp, Homo sapiens
ggccggcgagccctgtgg

SEQ ID NO: 5626478 - DNA, 23 bp, Homo sapiens
ggccggcgcagcgcagagcgggc

SEQ ID NO: 5626479 - DNA, 16 bp, Homo sapiens
ggccggcggctctgag

SEQ ID NO: 5626480 - DNA, 18 bp, Homo sapiens
ggccggcggctctgagca

SEQ ID NO: 5626481 - DNA, 22 bp, Homo sapiens
ggccggcttcatgccagctact

SEQ ID NO: 5626482 - DNA, 22 bp, Homo sapiens
ggccggcttctgcctggggtgc

SEQ ID NO: 5626483 - DNA, 13 bp, Homo sapiens
ggccgggaagagc

SEQ ID NO: 5626484 - DNA, 18 bp, Homo sapiens
ggccgggaagagccacct

SEQ ID NO: 5626485 - DNA, 13 bp, Homo sapiens
ggcctgctgctga

SEQ ID NO: 5626486 - DNA, 15 bp, Homo sapiens
ggcctgctgctgaga

SEQ ID NO: 5626487 - DNA, 18 bp, Homo sapiens
ggcctgctgctgagaacc

SEQ ID NO: 5626488 - DNA, 16 bp, Homo sapiens
ggcctgctggaggcct

SEQ ID NO: 5626489 - DNA, 20 bp, Homo sapiens
ggcctgctggcatcaggtct

SEQ ID NO: 5626490 - DNA, 21 bp, Homo sapiens
ggcctgctgggaaccccgcag

SEQ ID NO: 5626491 - DNA, 23 bp, Homo sapiens
ggcctgctgggaaccccgcagcc

SEQ ID NO: 5626492 - DNA, 22 bp, Homo sapiens
ggcctgctgggctctccacctc

SEQ ID NO: 5626493 - DNA, 19 bp, Homo sapiens
ggcctgctgtgattccact

SEQ ID NO: 5626494 - DNA, 12 bp, Homo sapiens
ggcctgctgtgg

SEQ ID NO: 5626495 - DNA, 16 bp, Homo sapiens
ggcctgcttccccctc

SEQ ID NO: 5626496 - DNA, 24 bp, Homo sapiens
ggcctgcttttccaggatcctgca

SEQ ID NO: 5626497 - DNA, 13 bp, Homo sapiens
ggcctgcttttgt

SEQ ID NO: 5626498 - DNA, 20 bp, Homo sapiens
ggcctgcttttgtgtcccat

SEQ ID NO: 5626499 - DNA, 23 bp, Homo sapiens
ggcctggaattagcttggggcca

SEQ ID NO: 5626500 - DNA, 20 bp, Homo sapiens
ggcctggaatttgggcagat

SEQ ID NO: 5626501 - DNA, 14 bp, Homo sapiens
ggcctggacactta

SEQ ID NO: 5626502 - DNA, 16 bp, Homo sapiens
ggcctggaccgagatg

SEQ ID NO: 5626503 - DNA, 18 bp, Homo sapiens
ggcctggaccgagatgtg

SEQ ID NO: 5626504 - DNA, 21 bp, Homo sapiens
ggcctggaccgcttcccagag

SEQ ID NO: 5626505 - DNA, 22 bp, Homo sapiens
ggcctggacctatgcagggagg

SEQ ID NO: 5626506 - DNA, 13 bp, Homo sapiens
ggcctggacctgc

SEQ ID NO: 5626507 - DNA, 15 bp, Homo sapiens
ggcctggacctgcct

SEQ ID NO: 5626508 - DNA, 21 bp, Homo sapiens
ggcctggactgactgcagccc

SEQ ID NO: 5626509 - DNA, 13 bp, Homo sapiens
ggcctggactgca

SEQ ID NO: 5626510 - DNA, 19 bp, Homo sapiens
ggcctggactgcacaggca

SEQ ID NO: 5626511 - DNA, 14 bp, Homo sapiens
ggcctggagaggac

SEQ ID NO: 5626512 - DNA, 17 bp, Homo sapiens
ggcctggagaggggcct

SEQ ID NO: 5626513 - DNA, 21 bp, Homo sapiens
ggcctggagaggggcctggga

SEQ ID NO: 5626514 - DNA, 15 bp, Homo sapiens
ggcctggagatcctc

SEQ ID NO: 5626515 - DNA, 17 bp, Homo sapiens
ggcctggagatcctcct

SEQ ID NO: 5626516 - DNA, 18 bp, Homo sapiens
ggcctggagatcctcctg

SEQ ID NO: 5626517 - DNA, 16 bp, Homo sapiens
ggcctggagcaggccc

SEQ ID NO: 5626518 - DNA, 17 bp, Homo sapiens
ggcctggagcaggccca

SEQ ID NO: 5626519 - DNA, 20 bp, Homo sapiens
ggcctggagcgtttgctgtg

SEQ ID NO: 5626520 - DNA, 23 bp, Homo sapiens
ggcctggaggaatcactggggat

SEQ ID NO: 5626521 - DNA, 15 bp, Homo sapiens
ggcctggaggctcag

SEQ ID NO: 5626522 - DNA, 18 bp, Homo sapiens
ggcctggaggtctggctg

SEQ ID NO: 5626523 - DNA, 18 bp, Homo sapiens
ggcctggagttgggctgg

SEQ ID NO: 5626524 - DNA, 18 bp, Homo sapiens
ggcctggatccatcctgc

SEQ ID NO: 5626525 - DNA, 11 bp, Homo sapiens
ggcctggatgc

SEQ ID NO: 5626526 - DNA, 20 bp, Homo sapiens
ggcctggatgccccctgtgg

SEQ ID NO: 5626527 - DNA, 14 bp, Homo sapiens
ggcctggcagccgt

SEQ ID NO: 5626528 - DNA, 14 bp, Homo sapiens
ggcctggcagctca

SEQ ID NO: 5626529 - DNA, 16 bp, Homo sapiens
ggcctggcaggccagt

SEQ ID NO: 5626530 - DNA, 15 bp, Homo sapiens
ggcctggcagggagg

SEQ ID NO: 5626531 - DNA, 16 bp, Homo sapiens
ggcctggcatctgtgc

SEQ ID NO: 5626532 - DNA, 18 bp, Homo sapiens
ggcctggcatctgtgtgc

SEQ ID NO: 5626533 - DNA, 21 bp, Homo sapiens
ggcctggcatctgtgtgcgtg

SEQ ID NO: 5626534 - DNA, 13 bp, Homo sapiens
ggcctggcattct

SEQ ID NO: 5626535 - DNA, 15 bp, Homo sapiens
ggcctggcattcttg

SEQ ID NO: 5626536 - DNA, 19 bp, Homo sapiens
ggcctggcattcttgtaca

SEQ ID NO: 5626537 - DNA, 14 bp, Homo sapiens
ggcctggccagacc

SEQ ID NO: 5626538 - DNA, 16 bp, Homo sapiens
ggcctggccagatgca

SEQ ID NO: 5626539 - DNA, 14 bp, Homo sapiens
ggcctggccaggag

SEQ ID NO: 5626540 - DNA, 23 bp, Homo sapiens
ggcctggccaggagctcttcagg

SEQ ID NO: 5626541 - DNA, 13 bp, Homo sapiens
ggcctggccagtc

SEQ ID NO: 5626542 - DNA, 15 bp, Homo sapiens
ggcctggccagtcct

SEQ ID NO: 5626543 - DNA, 16 bp, Homo sapiens
ggcctggccagtcttc

SEQ ID NO: 5626544 - DNA, 10 bp, Homo sapiens
ggcctggccc

SEQ ID NO: 5626545 - DNA, 14 bp, Homo sapiens
ggcctggcccagcc

SEQ ID NO: 5626546 - DNA, 15 bp, Homo sapiens
ggcctggcccagcca

SEQ ID NO: 5626547 - DNA, 12 bp, Homo sapiens
ggcctggcccat

SEQ ID NO: 5626548 - DNA, 16 bp, Homo sapiens
ggcctggcccccagct

SEQ ID NO: 5626549 - DNA, 14 bp, Homo sapiens
ggcctggccccctc

SEQ ID NO: 5626550 - DNA, 15 bp, Homo sapiens
ggcctggccccctcg

SEQ ID NO: 5626551 - DNA, 15 bp, Homo sapiens
ggcctggcccctcag

SEQ ID NO: 5626552 - DNA, 17 bp, Homo sapiens
ggcctggcccctcaggg

SEQ ID NO: 5626553 - DNA, 11 bp, Homo sapiens
ggcctggccct

SEQ ID NO: 5626554 - DNA, 20 bp, Homo sapiens
ggcctggccctcctggctgt

SEQ ID NO: 5626555 - DNA, 12 bp, Homo sapiens
ggcctggccctg

SEQ ID NO: 5626556 - DNA, 14 bp, Homo sapiens
ggcctggccctgct

SEQ ID NO: 5626557 - DNA, 21 bp, Homo sapiens
ggcctggccctttcacccctc

SEQ ID NO: 5626558 - DNA, 17 bp, Homo sapiens
ggcctggcctatttaag

SEQ ID NO: 5626559 - DNA, 18 bp, Homo sapiens
ggcctggcctatttaagc

SEQ ID NO: 5626560 - DNA, 12 bp, Homo sapiens
ggcctggcctca

SEQ ID NO: 5626561 - DNA, 13 bp, Homo sapiens
ggcctggcctcaa

SEQ ID NO: 5626562 - DNA, 21 bp, Homo sapiens
ggcctggcctcatctcagacc

SEQ ID NO: 5626563 - DNA, 13 bp, Homo sapiens
ggcctggcctcca

SEQ ID NO: 5626564 - DNA, 19 bp, Homo sapiens
ggcctggcctcggggcagg

SEQ ID NO: 5626565 - DNA, 16 bp, Homo sapiens
ggcctggcctctgggc

SEQ ID NO: 5626566 - DNA, 11 bp, Homo sapiens
ggcctggcctg

SEQ ID NO: 5626567 - DNA, 17 bp, Homo sapiens
ggcctggcctgagctgg

SEQ ID NO: 5626568 - DNA, 15 bp, Homo sapiens
ggcctggcctgggtg

SEQ ID NO: 5626569 - DNA, 13 bp, Homo sapiens
ggcctggcctggt

SEQ ID NO: 5626570 - DNA, 15 bp, Homo sapiens
ggcctggcggcctgt

SEQ ID NO: 5626571 - DNA, 17 bp, Homo sapiens
ggcctggcggcctgtgg

SEQ ID NO: 5626572 - DNA, 19 bp, Homo sapiens
ggcctggcggcctgtgggt

SEQ ID NO: 5626573 - DNA, 18 bp, Homo sapiens
ggcctggcgtcggccaga

SEQ ID NO: 5626574 - DNA, 15 bp, Homo sapiens
ggcctggctccccac

SEQ ID NO: 5626575 - DNA, 23 bp, Homo sapiens
ggcctggctccctcactctcagg

SEQ ID NO: 5626576 - DNA, 17 bp, Homo sapiens
ggcctggctctggagcc

SEQ ID NO: 5626577 - DNA, 22 bp, Homo sapiens
ggcctggctggaggagcagcag

SEQ ID NO: 5626578 - DNA, 13 bp, Homo sapiens
ggcctggcttcac

SEQ ID NO: 5626579 - DNA, 18 bp, Homo sapiens
ggcctggcttgctccagg

SEQ ID NO: 5626580 - DNA, 23 bp, Homo sapiens
ggcctgggaaaggaaaaccaggg

SEQ ID NO: 5626581 - DNA, 22 bp, Homo sapiens
ggcctgggacccagctactctg

SEQ ID NO: 5626582 - DNA, 12 bp, Homo sapiens
ggcctgggaggg

SEQ ID NO: 5626583 - DNA, 20 bp, Homo sapiens
ggcctgggatgctagcccca

SEQ ID NO: 5626584 - DNA, 23 bp, Homo sapiens
ggcctgggcagagggcctggacc

SEQ ID NO: 5626585 - DNA, 17 bp, Homo sapiens
ggcctgggcagccccac

SEQ ID NO: 5626586 - DNA, 17 bp, Homo sapiens
ggcctgggcaggaggga

SEQ ID NO: 5626587 - DNA, 15 bp, Homo sapiens
ggcctgggccacacc

SEQ ID NO: 5626588 - DNA, 14 bp, Homo sapiens
ggcctgggccagag

SEQ ID NO: 5626589 - DNA, 11 bp, Homo sapiens
ggcctgggccc

SEQ ID NO: 5626590 - DNA, 23 bp, Homo sapiens
ggcctgggccgtatctccggctc

SEQ ID NO: 5626591 - DNA, 13 bp, Homo sapiens
ggcctgggcctca

SEQ ID NO: 5626592 - DNA, 18 bp, Homo sapiens
ggcctgggcctcatggct

SEQ ID NO: 5626593 - DNA, 17 bp, Homo sapiens
ggcctgggcctggctcc

SEQ ID NO: 5626594 - DNA, 13 bp, Homo sapiens
ggcctgggctagg

SEQ ID NO: 5626595 - DNA, 14 bp, Homo sapiens
ggcctgggctcctg

SEQ ID NO: 5626596 - DNA, 16 bp, Homo sapiens
ggcctgggctcctgga

SEQ ID NO: 5626597 - DNA, 12 bp, Homo sapiens
ggcctgggctgt

SEQ ID NO: 5626598 - DNA, 15 bp, Homo sapiens
ggcctgggctgtgag

SEQ ID NO: 5626599 - DNA, 20 bp, Homo sapiens
ggcctgggctgtgaggacag

SEQ ID NO: 5626600 - DNA, 21 bp, Homo sapiens
ggcctgggctgtgaggacagg

SEQ ID NO: 5626601 - DNA, 17 bp, Homo sapiens
ggcctgggcttccacag

SEQ ID NO: 5626602 - DNA, 20 bp, Homo sapiens
ggcctggggacggagcactg

SEQ ID NO: 5626603 - DNA, 15 bp, Homo sapiens
ggcctggggagccca

SEQ ID NO: 5626604 - DNA, 22 bp, Homo sapiens
ggcctggggagcccactgaggg

SEQ ID NO: 5626605 - DNA, 23 bp, Homo sapiens
ggcctggggatgtaaccaagctg

SEQ ID NO: 5626606 - DNA, 18 bp, Homo sapiens
ggcctggggatgtcccca

SEQ ID NO: 5626607 - DNA, 22 bp, Homo sapiens
ggcctggggccgggctggcttc

SEQ ID NO: 5626608 - DNA, 18 bp, Homo sapiens
ggcctggggcctgagaga

SEQ ID NO: 5626609 - DNA, 18 bp, Homo sapiens
ggcctggggctcctttct

SEQ ID NO: 5626610 - DNA, 10 bp, Homo sapiens
ggcctggggg

SEQ ID NO: 5626611 - DNA, 20 bp, Homo sapiens
ggcctgggggcagtgactgg

SEQ ID NO: 5626612 - DNA, 23 bp, Homo sapiens
ggcctgggggctgggcagaggaa

SEQ ID NO: 5626613 - DNA, 21 bp, Homo sapiens
ggcctgggggttttccaagcc

SEQ ID NO: 5626614 - DNA, 18 bp, Homo sapiens
ggcctggggtaccaagag

SEQ ID NO: 5626615 - DNA, 11 bp, Homo sapiens
ggcctggggtg

SEQ ID NO: 5626616 - DNA, 19 bp, Homo sapiens
ggcctggggtgacccggca

SEQ ID NO: 5626617 - DNA, 24 bp, Homo sapiens
ggcctggggtgcatcctcctcagc

SEQ ID NO: 5626618 - DNA, 19 bp, Homo sapiens
ggcctggggtgggacaggg

SEQ ID NO: 5626619 - DNA, 15 bp, Homo sapiens
ggcctgggtcccagg

SEQ ID NO: 5626620 - DNA, 17 bp, Homo sapiens
ggcctgggtcccagggc

SEQ ID NO: 5626621 - DNA, 20 bp, Homo sapiens
ggcctgggtcctcggccctg

SEQ ID NO: 5626622 - DNA, 22 bp, Homo sapiens
ggcctgggtcctcggccctgta

SEQ ID NO: 5626623 - DNA, 22 bp, Homo sapiens
ggcctggtagcacatgtctgtc

SEQ ID NO: 5626624 - DNA, 21 bp, Homo sapiens
ggcctggtccatgatggagtc

SEQ ID NO: 5626625 - DNA, 19 bp, Homo sapiens
ggcctggtctcaccctgga

SEQ ID NO: 5626626 - DNA, 23 bp, Homo sapiens
ggcctggtctcaccctggaggca

SEQ ID NO: 5626627 - DNA, 16 bp, Homo sapiens
ggcctggtctggagcc

SEQ ID NO: 5626628 - DNA, 16 bp, Homo sapiens
ggcctggtgccctggc

SEQ ID NO: 5626629 - DNA, 22 bp, Homo sapiens
ggcctggtggccatgtcgcctg

SEQ ID NO: 5626630 - DNA, 20 bp, Homo sapiens
ggcctggtgggtcaggggga

SEQ ID NO: 5626631 - DNA, 21 bp, Homo sapiens
ggcctggttaaataaggcagg

SEQ ID NO: 5626632 - DNA, 22 bp, Homo sapiens
ggcctggttaaataaggcaggg

SEQ ID NO: 5626633 - DNA, 15 bp, Homo sapiens
ggcctggtttcctcg

SEQ ID NO: 5626634 - DNA, 16 bp, Homo sapiens
ggcctgtactgcctgc

SEQ ID NO: 5626635 - DNA, 20 bp, Homo sapiens
ggcctgtcagctaaagaagt

SEQ ID NO: 5626636 - DNA, 22 bp, Homo sapiens
ggcctgtccacaggcttctgag

SEQ ID NO: 5626637 - DNA, 13 bp, Homo sapiens
ggcctgtccccca

SEQ ID NO: 5626638 - DNA, 20 bp, Homo sapiens
ggcctgtccctagggctctc

SEQ ID NO: 5626639 - DNA, 14 bp, Homo sapiens
ggcctgtccctggc

SEQ ID NO: 5626640 - DNA, 19 bp, Homo sapiens
ggcctgtcccttgcctctg

SEQ ID NO: 5626641 - DNA, 15 bp, Homo sapiens
ggcctgtcgtgccag

SEQ ID NO: 5626642 - DNA, 22 bp, Homo sapiens
ggcctgtctcaagctcttcctt

SEQ ID NO: 5626643 - DNA, 15 bp, Homo sapiens
ggcctgtctcagtga

SEQ ID NO: 5626644 - DNA, 19 bp, Homo sapiens
ggcctgtctcatccccagg

SEQ ID NO: 5626645 - DNA, 23 bp, Homo sapiens
ggcctgtctcatccccaggggtc

SEQ ID NO: 5626646 - DNA, 18 bp, Homo sapiens
ggcctgtctccctaggga

SEQ ID NO: 5626647 - DNA, 13 bp, Homo sapiens
ggcctgtctgtga

SEQ ID NO: 5626648 - DNA, 22 bp, Homo sapiens
ggcctgtctgtgaagagcaaga

SEQ ID NO: 5626649 - DNA, 21 bp, Homo sapiens
ggcctgtgaggggcccctggc

SEQ ID NO: 5626650 - DNA, 20 bp, Homo sapiens
ggcctgtgaggtaactggga

SEQ ID NO: 5626651 - DNA, 16 bp, Homo sapiens
ggcctgtgatccagga

SEQ ID NO: 5626652 - DNA, 15 bp, Homo sapiens
ggcctgtgcactggg

SEQ ID NO: 5626653 - DNA, 17 bp, Homo sapiens
ggcctgtgcactgggca

SEQ ID NO: 5626654 - DNA, 19 bp, Homo sapiens
ggcctgtgcactgggcagg

SEQ ID NO: 5626655 - DNA, 20 bp, Homo sapiens
ggcctgtgcactgggcaggt

SEQ ID NO: 5626656 - DNA, 19 bp, Homo sapiens
ggcctgtgcagcagcccag

SEQ ID NO: 5626657 - DNA, 19 bp, Homo sapiens
ggcctgtgccagcaccaca

SEQ ID NO: 5626658 - DNA, 17 bp, Homo sapiens
ggcctgtgcccactccc

SEQ ID NO: 5626659 - DNA, 15 bp, Homo sapiens
ggcctgtgcttggag

SEQ ID NO: 5626660 - DNA, 17 bp, Homo sapiens
ggcctgtgcttggaggc

SEQ ID NO: 5626661 - DNA, 19 bp, Homo sapiens
ggcctgtgcttggaggcct

SEQ ID NO: 5626662 - DNA, 20 bp, Homo sapiens
ggcctgtgcttggaggcctc

SEQ ID NO: 5626663 - DNA, 16 bp, Homo sapiens
ggctaagaccctgtgt

SEQ ID NO: 5626664 - DNA, 14 bp, Homo sapiens
ggctaagaggctgc

SEQ ID NO: 5626665 - DNA, 19 bp, Homo sapiens
ggctaagagtgtcctagga

SEQ ID NO: 5626666 - DNA, 18 bp, Homo sapiens
ggctaagatactgctgat

SEQ ID NO: 5626667 - DNA, 19 bp, Homo sapiens
ggctaagatactgctgatg

SEQ ID NO: 5626668 - DNA, 15 bp, Homo sapiens
ggctaagcctctgct

SEQ ID NO: 5626669 - DNA, 17 bp, Homo sapiens
ggctaagcggtggagga

SEQ ID NO: 5626670 - DNA, 22 bp, Homo sapiens
ggctaaggaagtatcagcacta

SEQ ID NO: 5626671 - DNA, 15 bp, Homo sapiens
ggctaaggcaccagc

SEQ ID NO: 5626672 - DNA, 19 bp, Homo sapiens
ggctaaggcgtggagctgc

SEQ ID NO: 5626673 - DNA, 13 bp, Homo sapiens
ggctaagggggac

SEQ ID NO: 5626674 - DNA, 23 bp, Homo sapiens
ggctaagttgggatctaggagag

SEQ ID NO: 5626675 - DNA, 16 bp, Homo sapiens
ggctaatcaataccct

SEQ ID NO: 5626676 - DNA, 22 bp, Homo sapiens
ggctaatggagtgtttgaaaac

SEQ ID NO: 5626677 - DNA, 17 bp, Homo sapiens
ggctaatgtttgtattt

SEQ ID NO: 5626678 - DNA, 12 bp, Homo sapiens
ggctaatttaac

SEQ ID NO: 5626679 - DNA, 19 bp, Homo sapiens
ggctacaaaccaggagcaa

SEQ ID NO: 5626680 - DNA, 16 bp, Homo sapiens
ggctacaaaggaggac

SEQ ID NO: 5626681 - DNA, 21 bp, Homo sapiens
ggctacaacaggattctaggt

SEQ ID NO: 5626682 - DNA, 23 bp, Homo sapiens
ggctacaattttctcccaggaag

SEQ ID NO: 5626683 - DNA, 13 bp, Homo sapiens
ggctacacagacc

SEQ ID NO: 5626684 - DNA, 17 bp, Homo sapiens
ggctacacagacccctc

SEQ ID NO: 5626685 - DNA, 15 bp, Homo sapiens
ggctacacagaccct

SEQ ID NO: 5626686 - DNA, 15 bp, Homo sapiens
ggctacacagggatg

SEQ ID NO: 5626687 - DNA, 22 bp, Homo sapiens
ggctacaccttagcctgccctc

SEQ ID NO: 5626688 - DNA, 18 bp, Homo sapiens
ggctacagagaagccttc

SEQ ID NO: 5626689 - DNA, 12 bp, Homo sapiens
ggctacagctcc

SEQ ID NO: 5626690 - DNA, 21 bp, Homo sapiens
ggctacagctccacacgcccc

SEQ ID NO: 5626691 - DNA, 18 bp, Homo sapiens
ggctaccattgtcactcg

SEQ ID NO: 5626692 - DNA, 23 bp, Homo sapiens
ggctacccctcgactcagcacca

SEQ ID NO: 5626693 - DNA, 19 bp, Homo sapiens
ggctacctcacctgggcag

SEQ ID NO: 5626694 - DNA, 17 bp, Homo sapiens
ggctaccttgtgggaat

SEQ ID NO: 5626695 - DNA, 20 bp, Homo sapiens
ggctaccttgtgggaataaa

SEQ ID NO: 5626696 - DNA, 13 bp, Homo sapiens
ggctacctttgta

SEQ ID NO: 5626697 - DNA, 17 bp, Homo sapiens
ggctactcagcagccct

SEQ ID NO: 5626698 - DNA, 21 bp, Homo sapiens
ggctactcagcagccctcctc

SEQ ID NO: 5626699 - DNA, 17 bp, Homo sapiens
ggctactccctggacca

SEQ ID NO: 5626700 - DNA, 20 bp, Homo sapiens
ggctactccctggaccacga

SEQ ID NO: 5626701 - DNA, 13 bp, Homo sapiens
ggctactctgccc

SEQ ID NO: 5626702 - DNA, 21 bp, Homo sapiens
ggctactctgtgccagagcct

SEQ ID NO: 5626703 - DNA, 22 bp, Homo sapiens
ggctactctgtgccagagcctg

SEQ ID NO: 5626704 - DNA, 23 bp, Homo sapiens
ggctactgcagctttacatgcaa

SEQ ID NO: 5626705 - DNA, 21 bp, Homo sapiens
ggctactgccactgtgtgcct

SEQ ID NO: 5626706 - DNA, 22 bp, Homo sapiens
ggctactgccactgtgtgcctt

SEQ ID NO: 5626707 - DNA, 23 bp, Homo sapiens
ggctactggcagctcctctcctt

SEQ ID NO: 5626708 - DNA, 20 bp, Homo sapiens
ggctactggttacctggaga

SEQ ID NO: 5626709 - DNA, 21 bp, Homo sapiens
ggctactggttacctggagaa

SEQ ID NO: 5626710 - DNA, 13 bp, Homo sapiens
ggctacttccctt

SEQ ID NO: 5626711 - DNA, 15 bp, Homo sapiens
ggctacttgctttga

SEQ ID NO: 5626712 - DNA, 16 bp, Homo sapiens
ggctagaacctggagg

SEQ ID NO: 5626713 - DNA, 22 bp, Homo sapiens
ggctagaacctgtagagctaga

SEQ ID NO: 5626714 - DNA, 15 bp, Homo sapiens
ggctagaactggaga

SEQ ID NO: 5626715 - DNA, 22 bp, Homo sapiens
ggctagaagaaagtaaaaagaa

SEQ ID NO: 5626716 - DNA, 22 bp, Homo sapiens
ggctagaataggagaaaatgaa

SEQ ID NO: 5626717 - DNA, 18 bp, Homo sapiens
ggctagaatatcctactt

SEQ ID NO: 5626718 - DNA, 18 bp, Homo sapiens
ggctagaatcagggtgga

SEQ ID NO: 5626719 - DNA, 22 bp, Homo sapiens
ggctagaatcagggtggagaag

SEQ ID NO: 5626720 - DNA, 16 bp, Homo sapiens
ggctagaatctggaga

SEQ ID NO: 5626721 - DNA, 22 bp, Homo sapiens
ggctagaatctggagagctaga

SEQ ID NO: 5626722 - DNA, 22 bp, Homo sapiens
ggctagacagaaacatgtcttg

SEQ ID NO: 5626723 - DNA, 15 bp, Homo sapiens
ggctagactgggctg

SEQ ID NO: 5626724 - DNA, 22 bp, Homo sapiens
ggctagaggacatattcacagt

SEQ ID NO: 5626725 - DNA, 18 bp, Homo sapiens
ggctagaggccagcccca

SEQ ID NO: 5626726 - DNA, 14 bp, Homo sapiens
ggctagagggccca

SEQ ID NO: 5626727 - DNA, 17 bp, Homo sapiens
ggctagaggttcaaaga

SEQ ID NO: 5626728 - DNA, 22 bp, Homo sapiens
ggctagaggttcaaagatattt

SEQ ID NO: 5626729 - DNA, 14 bp, Homo sapiens
ggctagagtcctca

SEQ ID NO: 5626730 - DNA, 20 bp, Homo sapiens
ggctagagtgcagtggtgcg

SEQ ID NO: 5626731 - DNA, 15 bp, Homo sapiens
ggctagatcatgaag

SEQ ID NO: 5626732 - DNA, 19 bp, Homo sapiens
ggctagcattcctcaggaa

SEQ ID NO: 5626733 - DNA, 13 bp, Homo sapiens
ggctagccccagg

SEQ ID NO: 5626734 - DNA, 12 bp, Homo sapiens
ggctagccctga

SEQ ID NO: 5626735 - DNA, 19 bp, Homo sapiens
ggctagccctgagcccggc

SEQ ID NO: 5626736 - DNA, 20 bp, Homo sapiens
ggctagcctttcttgtagcc

SEQ ID NO: 5626737 - DNA, 14 bp, Homo sapiens
ggctagctggagcc

SEQ ID NO: 5626738 - DNA, 15 bp, Homo sapiens
ggctagctggagcct

SEQ ID NO: 5626739 - DNA, 17 bp, Homo sapiens
ggctagctggagcctgg

SEQ ID NO: 5626740 - DNA, 14 bp, Homo sapiens
ggctagctgtgctg

SEQ ID NO: 5626741 - DNA, 20 bp, Homo sapiens
ggctagcttctgcttttctg

SEQ ID NO: 5626742 - DNA, 20 bp, Homo sapiens
ggctaggacagttgattcaa

SEQ ID NO: 5626743 - DNA, 16 bp, Homo sapiens
ggctaggagttcatag

SEQ ID NO: 5626744 - DNA, 15 bp, Homo sapiens
ggctaggccagcagg

SEQ ID NO: 5626745 - DNA, 16 bp, Homo sapiens
ggctaggccagcaggg

SEQ ID NO: 5626746 - DNA, 12 bp, Homo sapiens
ggctaggctctt

SEQ ID NO: 5626747 - DNA, 17 bp, Homo sapiens
ggctaggggagggggga

SEQ ID NO: 5626748 - DNA, 13 bp, Homo sapiens
ggctaggggctgg

SEQ ID NO: 5626749 - DNA, 15 bp, Homo sapiens
ggctaggggctgggg

SEQ ID NO: 5626750 - DNA, 16 bp, Homo sapiens
ggctagggtggggaga

SEQ ID NO: 5626751 - DNA, 21 bp, Homo sapiens
ggctaggtagaaaaagggtca

SEQ ID NO: 5626752 - DNA, 23 bp, Homo sapiens
ggctaggtatcattcaactctcc

SEQ ID NO: 5626753 - DNA, 22 bp, Homo sapiens
ggctagtcaagctcctcctccc

SEQ ID NO: 5626754 - DNA, 13 bp, Homo sapiens
ggctagtcagaga

SEQ ID NO: 5626755 - DNA, 15 bp, Homo sapiens
ggctagtcagagaga

SEQ ID NO: 5626756 - DNA, 19 bp, Homo sapiens
ggctagtctcttctcagag

SEQ ID NO: 5626757 - DNA, 20 bp, Homo sapiens
ggctagtctcttctcagagc

SEQ ID NO: 5626758 - DNA, 13 bp, Homo sapiens
ggctagtctgtgc

SEQ ID NO: 5626759 - DNA, 17 bp, Homo sapiens
ggctagtgaagtggcct

SEQ ID NO: 5626760 - DNA, 19 bp, Homo sapiens
ggctagtgaagtggcctct

SEQ ID NO: 5626761 - DNA, 20 bp, Homo sapiens
ggctagtgacttgtgtccca

SEQ ID NO: 5626762 - DNA, 23 bp, Homo sapiens
ggctagtgacttgtgtcccatga

SEQ ID NO: 5626763 - DNA, 18 bp, Homo sapiens
ggctagtgtgagtggcag

SEQ ID NO: 5626764 - DNA, 23 bp, Homo sapiens
ggctagtgtgagtggcagccatg

SEQ ID NO: 5626765 - DNA, 23 bp, Homo sapiens
ggctagtgtggtgtttcctggca

SEQ ID NO: 5626766 - DNA, 16 bp, Homo sapiens
ggctagttgggcttcc

SEQ ID NO: 5626767 - DNA, 21 bp, Homo sapiens
ggctatagatgggactgtgtc

SEQ ID NO: 5626768 - DNA, 17 bp, Homo sapiens
ggctatagatgtctttt

SEQ ID NO: 5626769 - DNA, 18 bp, Homo sapiens
ggctatagatgtcttttc

SEQ ID NO: 5626770 - DNA, 19 bp, Homo sapiens
ggctatagctacaggaagc

SEQ ID NO: 5626771 - DNA, 21 bp, Homo sapiens
ggctatatgcctatatttata

SEQ ID NO: 5626772 - DNA, 12 bp, Homo sapiens
ggctatatttac

SEQ ID NO: 5626773 - DNA, 15 bp, Homo sapiens
ggctatcccttctca

SEQ ID NO: 5626774 - DNA, 18 bp, Homo sapiens
ggctatcccttctcagaa

SEQ ID NO: 5626775 - DNA, 13 bp, Homo sapiens
ggctatcctgatt

SEQ ID NO: 5626776 - DNA, 18 bp, Homo sapiens
ggctatgaagggacagct

SEQ ID NO: 5626777 - DNA, 18 bp, Homo sapiens
ggctatgaggaaactgag

SEQ ID NO: 5626778 - DNA, 13 bp, Homo sapiens
ggctatgcatttg

SEQ ID NO: 5626779 - DNA, 14 bp, Homo sapiens
ggctatgcatttga

SEQ ID NO: 5626780 - DNA, 22 bp, Homo sapiens
ggctatggattttctaaggaag

SEQ ID NO: 5626781 - DNA, 23 bp, Homo sapiens
ggctatgggaatcagctggtggc

SEQ ID NO: 5626782 - DNA, 17 bp, Homo sapiens
ggctatgtataaaatac

SEQ ID NO: 5626783 - DNA, 19 bp, Homo sapiens
ggctatgtatggaatacag

SEQ ID NO: 5626784 - DNA, 15 bp, Homo sapiens
ggctatttaccaggg

SEQ ID NO: 5626785 - DNA, 13 bp, Homo sapiens
ggctatttgaaat

SEQ ID NO: 5626786 - DNA, 16 bp, Homo sapiens
ggctatttgtgtgtat

SEQ ID NO: 5626787 - DNA, 17 bp, Homo sapiens
ggctatttgtgtgtatg

SEQ ID NO: 5626788 - DNA, 16 bp, Homo sapiens
ggctatttgttcagag

SEQ ID NO: 5626789 - DNA, 18 bp, Homo sapiens
ggctattttctaaagact

SEQ ID NO: 5626790 - DNA, 13 bp, Homo sapiens
ggctcaaaacagg

SEQ ID NO: 5626791 - DNA, 12 bp, Homo sapiens
ggctcaaataaa

SEQ ID NO: 5626792 - DNA, 19 bp, Homo sapiens
ggctcaagaattagggccc

SEQ ID NO: 5626793 - DNA, 15 bp, Homo sapiens
ggctcaagaggccca

SEQ ID NO: 5626794 - DNA, 19 bp, Homo sapiens
ggctcaagaggcccaggga

SEQ ID NO: 5626795 - DNA, 23 bp, Homo sapiens
ggctcaagaggcccagggagcaa

SEQ ID NO: 5626796 - DNA, 20 bp, Homo sapiens
ggctcaagcaatcctcctgc

SEQ ID NO: 5626797 - DNA, 14 bp, Homo sapiens
ggctcaagcagtct

SEQ ID NO: 5626798 - DNA, 19 bp, Homo sapiens
ggctcaagcgattctcctg

SEQ ID NO: 5626799 - DNA, 23 bp, Homo sapiens
ggctcaagctatccttgcacctc

SEQ ID NO: 5626800 - DNA, 18 bp, Homo sapiens
ggctcaagctttcccgcc

SEQ ID NO: 5626801 - DNA, 18 bp, Homo sapiens
ggctcaaggcaccgcagc

SEQ ID NO: 5626802 - DNA, 21 bp, Homo sapiens
ggctcaagtcctcttttctga

SEQ ID NO: 5626803 - DNA, 13 bp, Homo sapiens
ggctcaatttggg

SEQ ID NO: 5626804 - DNA, 18 bp, Homo sapiens
ggctcaatttggtgctca

SEQ ID NO: 5626805 - DNA, 20 bp, Homo sapiens
ggctcaatttggtgctcacg

SEQ ID NO: 5626806 - DNA, 16 bp, Homo sapiens
ggctcacaaggcccag

SEQ ID NO: 5626807 - DNA, 18 bp, Homo sapiens
ggctcacacacctgtagc

SEQ ID NO: 5626808 - DNA, 14 bp, Homo sapiens
ggctcacaccagcc

SEQ ID NO: 5626809 - DNA, 15 bp, Homo sapiens
ggctcacaccagccc

SEQ ID NO: 5626810 - DNA, 17 bp, Homo sapiens
ggctcacaccagccctg

SEQ ID NO: 5626811 - DNA, 18 bp, Homo sapiens
ggctcacaccagccctgg

SEQ ID NO: 5626812 - DNA, 19 bp, Homo sapiens
ggctcacaccagccctggt

SEQ ID NO: 5626813 - DNA, 20 bp, Homo sapiens
ggctcacaccggcactgtgc

SEQ ID NO: 5626814 - DNA, 14 bp, Homo sapiens
ggctcacacctgca

SEQ ID NO: 5626815 - DNA, 13 bp, Homo sapiens
ggctcacacctgt

SEQ ID NO: 5626816 - DNA, 12 bp, Homo sapiens
ggctcacactcc

SEQ ID NO: 5626817 - DNA, 15 bp, Homo sapiens
ggctcacactcctgg

SEQ ID NO: 5626818 - DNA, 14 bp, Homo sapiens
ggctcacactgaga

SEQ ID NO: 5626819 - DNA, 12 bp, Homo sapiens
ggctcacagcca

SEQ ID NO: 5626820 - DNA, 17 bp, Homo sapiens
ggctcacaggcctctct

SEQ ID NO: 5626821 - DNA, 13 bp, Homo sapiens
ggctcacagggca

SEQ ID NO: 5626822 - DNA, 19 bp, Homo sapiens
ggctcacagggcaggcctt

SEQ ID NO: 5626823 - DNA, 13 bp, Homo sapiens
ggctcaccagaat

SEQ ID NO: 5626824 - DNA, 18 bp, Homo sapiens
ggctcaccttgtgctggg

SEQ ID NO: 5626825 - DNA, 22 bp, Homo sapiens
ggctcacctttagaacaggaga

SEQ ID NO: 5626826 - DNA, 22 bp, Homo sapiens
ggctcacctttgggcaaaggcc

SEQ ID NO: 5626827 - DNA, 16 bp, Homo sapiens
ggctcacgccccgctg

SEQ ID NO: 5626828 - DNA, 12 bp, Homo sapiens
ggctcacgcctg

SEQ ID NO: 5626829 - DNA, 21 bp, Homo sapiens
ggctcacgcctgtaatcccag

SEQ ID NO: 5626830 - DNA, 23 bp, Homo sapiens
ggctcacgcctgtaatcccagca

SEQ ID NO: 5626831 - DNA, 17 bp, Homo sapiens
ggctcacgcgttctggg

SEQ ID NO: 5626832 - DNA, 20 bp, Homo sapiens
ggctcacgtcgcggccgcct

SEQ ID NO: 5626833 - DNA, 22 bp, Homo sapiens
ggctcactacatgggccagccc

SEQ ID NO: 5626834 - DNA, 12 bp, Homo sapiens
ggctcactactg

SEQ ID NO: 5626835 - DNA, 18 bp, Homo sapiens
ggctcactatggtgccaa

SEQ ID NO: 5626836 - DNA, 14 bp, Homo sapiens
ggctcactctttcc

SEQ ID NO: 5626837 - DNA, 20 bp, Homo sapiens
ggctcactgcaacctccgcc

SEQ ID NO: 5626838 - DNA, 21 bp, Homo sapiens
ggctcactgcaacctctgcct

SEQ ID NO: 5626839 - DNA, 13 bp, Homo sapiens
ggctcactgcagc

SEQ ID NO: 5626840 - DNA, 15 bp, Homo sapiens
ggctgacccagtgtg

SEQ ID NO: 5626841 - DNA, 22 bp, Homo sapiens
ggctgacccagtgtgtgctcag

SEQ ID NO: 5626842 - DNA, 19 bp, Homo sapiens
ggctgacccctccttgtaa

SEQ ID NO: 5626843 - DNA, 19 bp, Homo sapiens
ggctgacctctcactgcct

SEQ ID NO: 5626844 - DNA, 16 bp, Homo sapiens
ggctgacctgctgtgg

SEQ ID NO: 5626845 - DNA, 14 bp, Homo sapiens
ggctgacctgggcc

SEQ ID NO: 5626846 - DNA, 19 bp, Homo sapiens
ggctgacctgggcccacag

SEQ ID NO: 5626847 - DNA, 21 bp, Homo sapiens
ggctgacctgggcccacagag

SEQ ID NO: 5626848 - DNA, 21 bp, Homo sapiens
ggctgaccttgaactcctggg

SEQ ID NO: 5626849 - DNA, 22 bp, Homo sapiens
ggctgactagaagggccagtcc

SEQ ID NO: 5626850 - DNA, 24 bp, Homo sapiens
ggctgactagaagggccagtcctg

SEQ ID NO: 5626851 - DNA, 17 bp, Homo sapiens
ggctgactctccaggga

SEQ ID NO: 5626852 - DNA, 20 bp, Homo sapiens
ggctgactggatgtccagag

SEQ ID NO: 5626853 - DNA, 14 bp, Homo sapiens
ggctgactggccag

SEQ ID NO: 5626854 - DNA, 21 bp, Homo sapiens
ggctgactgggccacagcccc

SEQ ID NO: 5626855 - DNA, 14 bp, Homo sapiens
ggctgactggggct

SEQ ID NO: 5626856 - DNA, 16 bp, Homo sapiens
ggctgactggggctgg

SEQ ID NO: 5626857 - DNA, 19 bp, Homo sapiens
ggctgactgggggcctctg

SEQ ID NO: 5626858 - DNA, 20 bp, Homo sapiens
ggctgacttcatctggggtt

SEQ ID NO: 5626859 - DNA, 19 bp, Homo sapiens
ggctgacttctctgaatca

SEQ ID NO: 5626860 - DNA, 20 bp, Homo sapiens
ggctgacttctctgaatcag

SEQ ID NO: 5626861 - DNA, 22 bp, Homo sapiens
ggctgacttgtgttcatgtgga

SEQ ID NO: 5626862 - DNA, 14 bp, Homo sapiens
ggctgagaacactg

SEQ ID NO: 5626863 - DNA, 13 bp, Homo sapiens
ggctgagaaggaa

SEQ ID NO: 5626864 - DNA, 12 bp, Homo sapiens
ggctgagacaca

SEQ ID NO: 5626865 - DNA, 18 bp, Homo sapiens
ggctgagacaggagaatc

SEQ ID NO: 5626866 - DNA, 14 bp, Homo sapiens
ggctgagagcccca

SEQ ID NO: 5626867 - DNA, 20 bp, Homo sapiens
ggctgagagggctgtggctg

SEQ ID NO: 5626868 - DNA, 21 bp, Homo sapiens
ggctgagcaaatattaaaatt

SEQ ID NO: 5626869 - DNA, 22 bp, Homo sapiens
ggctgagcaaatattaaaattg

SEQ ID NO: 5626870 - DNA, 16 bp, Homo sapiens
ggctgagcacctctca

SEQ ID NO: 5626871 - DNA, 19 bp, Homo sapiens
ggctgagccaaagccagag

SEQ ID NO: 5626872 - DNA, 23 bp, Homo sapiens
ggctgagccatgaggagcgtgga

SEQ ID NO: 5626873 - DNA, 18 bp, Homo sapiens
ggctgagcccagccacct

SEQ ID NO: 5626874 - DNA, 11 bp, Homo sapiens
ggctgagcccc

SEQ ID NO: 5626875 - DNA, 18 bp, Homo sapiens
ggctgagcccctacccca

SEQ ID NO: 5626876 - DNA, 15 bp, Homo sapiens
ggctgagcccctcct

SEQ ID NO: 5626877 - DNA, 15 bp, Homo sapiens
ggctgagcccctggg

SEQ ID NO: 5626878 - DNA, 12 bp, Homo sapiens
ggctgagccctg

SEQ ID NO: 5626879 - DNA, 13 bp, Homo sapiens
ggctgagccctgg

SEQ ID NO: 5626880 - DNA, 24 bp, Homo sapiens
ggctgagccctgtacccaccccag

SEQ ID NO: 5626881 - DNA, 16 bp, Homo sapiens
ggctgagcgtggaagg

SEQ ID NO: 5626882 - DNA, 23 bp, Homo sapiens
ggctgagcgtggaagggggagga

SEQ ID NO: 5626883 - DNA, 15 bp, Homo sapiens
ggctgagctgagctt

SEQ ID NO: 5626884 - DNA, 14 bp, Homo sapiens
ggctgagctgtgcc

SEQ ID NO: 5626885 - DNA, 20 bp, Homo sapiens
ggctgaggacgagaccccca

SEQ ID NO: 5626886 - DNA, 17 bp, Homo sapiens
ggctgaggacggggcag

SEQ ID NO: 5626887 - DNA, 22 bp, Homo sapiens
ggctgaggacggggcagagctg

SEQ ID NO: 5626888 - DNA, 13 bp, Homo sapiens
ggctgaggagcag

SEQ ID NO: 5626889 - DNA, 17 bp, Homo sapiens
ggctgaggagcagccag

SEQ ID NO: 5626890 - DNA, 18 bp, Homo sapiens
ggctgaggagcagccagg

SEQ ID NO: 5626891 - DNA, 21 bp, Homo sapiens
ggctgaggagcagccaggacc

SEQ ID NO: 5626892 - DNA, 21 bp, Homo sapiens
ggctgaggatttcaagcctgc

SEQ ID NO: 5626893 - DNA, 17 bp, Homo sapiens
ggctgaggcagaagaat

SEQ ID NO: 5626894 - DNA, 17 bp, Homo sapiens
ggctgaggcaggagaat

SEQ ID NO: 5626895 - DNA, 18 bp, Homo sapiens
ggctgaggcaggagaatc

SEQ ID NO: 5626896 - DNA, 14 bp, Homo sapiens
ggctgaggccagag

SEQ ID NO: 5626897 - DNA, 14 bp, Homo sapiens
ggctgaggcctgga

SEQ ID NO: 5626898 - DNA, 14 bp, Homo sapiens
ggctgaggctggca

SEQ ID NO: 5626899 - DNA, 15 bp, Homo sapiens
ggctgaggcttgggc

SEQ ID NO: 5626900 - DNA, 15 bp, Homo sapiens
ggctgagggacagga

SEQ ID NO: 5626901 - DNA, 14 bp, Homo sapiens
ggctgagggaggca

SEQ ID NO: 5626902 - DNA, 22 bp, Homo sapiens
ggctgagggatggactgatgct

SEQ ID NO: 5626903 - DNA, 13 bp, Homo sapiens
ggctgagggcagt

SEQ ID NO: 5626904 - DNA, 17 bp, Homo sapiens
ggctgagggcatctctg

SEQ ID NO: 5626905 - DNA, 18 bp, Homo sapiens
ggctgagggcctgctgga

SEQ ID NO: 5626906 - DNA, 14 bp, Homo sapiens
ggctgagggctgcc

SEQ ID NO: 5626907 - DNA, 23 bp, Homo sapiens
ggctgagggctgccagcagcccc

SEQ ID NO: 5626908 - DNA, 19 bp, Homo sapiens
ggctgaggggcctgcgccc

SEQ ID NO: 5626909 - DNA, 16 bp, Homo sapiens
ggctgaggggcttggg

SEQ ID NO: 5626910 - DNA, 13 bp, Homo sapiens
ggctgaggtggga

SEQ ID NO: 5626911 - DNA, 16 bp, Homo sapiens
ggctgaggtgggagga

SEQ ID NO: 5626912 - DNA, 19 bp, Homo sapiens
ggctgaggttcctctgcct

SEQ ID NO: 5626913 - DNA, 20 bp, Homo sapiens
ggctgaggttcctctgcctg

SEQ ID NO: 5626914 - DNA, 17 bp, Homo sapiens
ggctgagtgagggcata

SEQ ID NO: 5626915 - DNA, 13 bp, Homo sapiens
ggctgagtgcact

SEQ ID NO: 5626916 - DNA, 15 bp, Homo sapiens
ggctgagtgcagagg

SEQ ID NO: 5626917 - DNA, 17 bp, Homo sapiens
ggctgagtgcagaggct

SEQ ID NO: 5626918 - DNA, 13 bp, Homo sapiens
ggctgagtgcagg

SEQ ID NO: 5626919 - DNA, 20 bp, Homo sapiens
ggctgagtgcaggcccaccc

SEQ ID NO: 5626920 - DNA, 15 bp, Homo sapiens
ggctgagtggcagca

SEQ ID NO: 5626921 - DNA, 17 bp, Homo sapiens
ggctgagtggggagcag

SEQ ID NO: 5626922 - DNA, 14 bp, Homo sapiens
ggctgagtgttctg

SEQ ID NO: 5626923 - DNA, 22 bp, Homo sapiens
ggctgagttatgaaaagataac

SEQ ID NO: 5626924 - DNA, 21 bp, Homo sapiens
ggctgagttctggtcaaagaa

SEQ ID NO: 5626925 - DNA, 19 bp, Homo sapiens
ggctgagtttgcacagtgg

SEQ ID NO: 5626926 - DNA, 15 bp, Homo sapiens
ggctgataattttaa

SEQ ID NO: 5626927 - DNA, 14 bp, Homo sapiens
ggctgatctcaggg

SEQ ID NO: 5626928 - DNA, 18 bp, Homo sapiens
ggctgatggaagatggtc

SEQ ID NO: 5626929 - DNA, 20 bp, Homo sapiens
ggctgatgtcttcttggggg

SEQ ID NO: 5626930 - DNA, 18 bp, Homo sapiens
ggctgattcctctcattt

SEQ ID NO: 5626931 - DNA, 16 bp, Homo sapiens
ggctgattggaaaata

SEQ ID NO: 5626932 - DNA, 19 bp, Homo sapiens
ggctgattggaaaataata

SEQ ID NO: 5626933 - DNA, 16 bp, Homo sapiens
ggctgatttatttcta

SEQ ID NO: 5626934 - DNA, 14 bp, Homo sapiens
ggctgcaaaatgaa

SEQ ID NO: 5626935 - DNA, 17 bp, Homo sapiens
ggctgcaaaattaaatc

SEQ ID NO: 5626936 - DNA, 18 bp, Homo sapiens
ggctgcaaagggtatcag

SEQ ID NO: 5626937 - DNA, 22 bp, Homo sapiens
ggctgcaaagggtatcaggtgc

SEQ ID NO: 5626938 - DNA, 16 bp, Homo sapiens
ggctgcaagctgcagg

SEQ ID NO: 5626939 - DNA, 17 bp, Homo sapiens
ggctgcaagctgcaggg

SEQ ID NO: 5626940 - DNA, 14 bp, Homo sapiens
ggctgcaatgccct

SEQ ID NO: 5626941 - DNA, 13 bp, Homo sapiens
ggctgcacaacag

SEQ ID NO: 5626942 - DNA, 22 bp, Homo sapiens
ggctgcacaacagccctgcctg

SEQ ID NO: 5626943 - DNA, 13 bp, Homo sapiens
ggctgcacagccc

SEQ ID NO: 5626944 - DNA, 21 bp, Homo sapiens
ggctgcacagcccaaccagga

SEQ ID NO: 5626945 - DNA, 22 bp, Homo sapiens
ggctgcacattgcctgttctgc

SEQ ID NO: 5626946 - DNA, 17 bp, Homo sapiens
ggctgcacccctgggcc

SEQ ID NO: 5626947 - DNA, 18 bp, Homo sapiens
ggctgcaccggctggcct

SEQ ID NO: 5626948 - DNA, 16 bp, Homo sapiens
ggctgcacctctggct

SEQ ID NO: 5626949 - DNA, 22 bp, Homo sapiens
ggctgcacctctggctagagcc

SEQ ID NO: 5626950 - DNA, 17 bp, Homo sapiens
ggctgcacgctcccctc

SEQ ID NO: 5626951 - DNA, 20 bp, Homo sapiens
ggctgcacgggatgcgtggg

SEQ ID NO: 5626952 - DNA, 16 bp, Homo sapiens
ggctgcacgtcaccct

SEQ ID NO: 5626953 - DNA, 21 bp, Homo sapiens
ggctgcacgtcaccctcctga

SEQ ID NO: 5626954 - DNA, 12 bp, Homo sapiens
ggctgcactgca

SEQ ID NO: 5626955 - DNA, 18 bp, Homo sapiens
ggctgcactggagccaca

SEQ ID NO: 5626956 - DNA, 18 bp, Homo sapiens
ggctgcagagcccggccc

SEQ ID NO: 5626957 - DNA, 13 bp, Homo sapiens
ggctgcagagcct

SEQ ID NO: 5626958 - DNA, 15 bp, Homo sapiens
ggctgcagagcctgc

SEQ ID NO: 5626959 - DNA, 16 bp, Homo sapiens
ggctgcagagcctgca

SEQ ID NO: 5626960 - DNA, 18 bp, Homo sapiens
ggctgcagagctgaccca

SEQ ID NO: 5626961 - DNA, 10 bp, Homo sapiens
ggctgcagca

SEQ ID NO: 5626962 - DNA, 20 bp, Homo sapiens
ggctgcagcagcggtggcct

SEQ ID NO: 5626963 - DNA, 13 bp, Homo sapiens
ggctgcagcaggt

SEQ ID NO: 5626964 - DNA, 16 bp, Homo sapiens
ggctgcagcaggtgct

SEQ ID NO: 5626965 - DNA, 21 bp, Homo sapiens
ggctgcagcatgttgctgagg

SEQ ID NO: 5626966 - DNA, 22 bp, Homo sapiens
ggctgcagccaggccactggcc

SEQ ID NO: 5626967 - DNA, 17 bp, Homo sapiens
ggctgcagccaggcctc

SEQ ID NO: 5626968 - DNA, 14 bp, Homo sapiens
ggctgcagcctcag

SEQ ID NO: 5626969 - DNA, 18 bp, Homo sapiens
ggctgcagcctcaggact

SEQ ID NO: 5626970 - DNA, 14 bp, Homo sapiens
ggctgcagcctcca

SEQ ID NO: 5626971 - DNA, 24 bp, Homo sapiens
ggctgcagctggacagaggggact

SEQ ID NO: 5626972 - DNA, 19 bp, Homo sapiens
ggctgcaggaagaaacttt

SEQ ID NO: 5626973 - DNA, 14 bp, Homo sapiens
ggctgcaggcaccg

SEQ ID NO: 5626974 - DNA, 19 bp, Homo sapiens
ggctgcaggcaccgctggg

SEQ ID NO: 5626975 - DNA, 12 bp, Homo sapiens
ggctgcagggac

SEQ ID NO: 5626976 - DNA, 13 bp, Homo sapiens
ggctgcagggagt

SEQ ID NO: 5626977 - DNA, 17 bp, Homo sapiens
ggctgcagggagtccga

SEQ ID NO: 5626978 - DNA, 15 bp, Homo sapiens
ggctgcagggctggg

SEQ ID NO: 5626979 - DNA, 19 bp, Homo sapiens
ggctgcagggctgggtcag

SEQ ID NO: 5626980 - DNA, 14 bp, Homo sapiens
ggctgcaggtggga

SEQ ID NO: 5626981 - DNA, 22 bp, Homo sapiens
ggctgcagttcgactctgtgct

SEQ ID NO: 5626982 - DNA, 17 bp, Homo sapiens
ggctgcagttctactca

SEQ ID NO: 5626983 - DNA, 21 bp, Homo sapiens
ggctgcatacccgggcagggc

SEQ ID NO: 5626984 - DNA, 13 bp, Homo sapiens
ggctgcatagaag

SEQ ID NO: 5626985 - DNA, 19 bp, Homo sapiens
ggctgcatcctcagcccca

SEQ ID NO: 5626986 - DNA, 23 bp, Homo sapiens
ggctgcatcctcagccccagggc

SEQ ID NO: 5626987 - DNA, 20 bp, Homo sapiens
ggctgcatgcgggcttcctc

SEQ ID NO: 5626988 - DNA, 22 bp, Homo sapiens
ggctgcatgcgggcttcctcct

SEQ ID NO: 5626989 - DNA, 18 bp, Homo sapiens
ggctgccacacccagggg

SEQ ID NO: 5626990 - DNA, 18 bp, Homo sapiens
ggctgccacacggaagca

SEQ ID NO: 5626991 - DNA, 14 bp, Homo sapiens
ggctgccagacatg

SEQ ID NO: 5626992 - DNA, 13 bp, Homo sapiens
ggctgccagccca

SEQ ID NO: 5626993 - DNA, 14 bp, Homo sapiens
ggctgccagcgtct

SEQ ID NO: 5626994 - DNA, 11 bp, Homo sapiens
ggctgccaggg

SEQ ID NO: 5626995 - DNA, 18 bp, Homo sapiens
ggctgccaggggctctgt

SEQ ID NO: 5626996 - DNA, 22 bp, Homo sapiens
ggctgccaggggctctgtggca

SEQ ID NO: 5626997 - DNA, 15 bp, Homo sapiens
ggctgcccaatctga

SEQ ID NO: 5626998 - DNA, 16 bp, Homo sapiens
ggctgcccacagaggt

SEQ ID NO: 5626999 - DNA, 19 bp, Homo sapiens
ggctgcccacgctcctgcc

SEQ ID NO: 5627000 - DNA, 18 bp, Homo sapiens
ggctgcccactatggtca

SEQ ID NO: 5627001 - DNA, 20 bp, Homo sapiens
ggctgcccactctggggacc

SEQ ID NO: 5627002 - DNA, 22 bp, Homo sapiens
ggctgcccagccccgctcaggc

SEQ ID NO: 5627003 - DNA, 13 bp, Homo sapiens
ggctgcccagcgg

SEQ ID NO: 5627004 - DNA, 12 bp, Homo sapiens
ggctgcccagga

SEQ ID NO: 5627005 - DNA, 23 bp, Homo sapiens
ggctgcccaggagacagaccact

SEQ ID NO: 5627006 - DNA, 18 bp, Homo sapiens
ggctgccccacaggccac

SEQ ID NO: 5627007 - DNA, 17 bp, Homo sapiens
ggctgccccacccctcc

SEQ ID NO: 5627008 - DNA, 15 bp, Homo sapiens
ggctgccccaggccg

SEQ ID NO: 5627009 - DNA, 23 bp, Homo sapiens
ggctgccccattccagctctccc

SEQ ID NO: 5627010 - DNA, 20 bp, Homo sapiens
ggctgcccccaacactccag

SEQ ID NO: 5627011 - DNA, 22 bp, Homo sapiens
ggctgcccccaacactccaggc

SEQ ID NO: 5627012 - DNA, 13 bp, Homo sapiens
ggctgcccccatc

SEQ ID NO: 5627013 - DNA, 18 bp, Homo sapiens
ggctgcccccatccagcc

SEQ ID NO: 5627014 - DNA, 23 bp, Homo sapiens
ggctgcccccatccagccacgga

SEQ ID NO: 5627015 - DNA, 19 bp, Homo sapiens
ggctgcccccggccccctg

SEQ ID NO: 5627016 - DNA, 15 bp, Homo sapiens
ggctgcccctcacct

SEQ ID NO: 5627017 - DNA, 17 bp, Homo sapiens
ggctgcccctcaccttg

SEQ ID NO: 5627018 - DNA, 21 bp, Homo sapiens
ggctgtggagcaaaaggcagc

SEQ ID NO: 5627019 - DNA, 17 bp, Homo sapiens
ggctgtggatagcccat

SEQ ID NO: 5627020 - DNA, 21 bp, Homo sapiens
ggctgtggcatccagagtccc

SEQ ID NO: 5627021 - DNA, 12 bp, Homo sapiens
ggctgtggccct

SEQ ID NO: 5627022 - DNA, 16 bp, Homo sapiens
ggctgtggctctgggt

SEQ ID NO: 5627023 - DNA, 14 bp, Homo sapiens
ggctgtgggcaagc

SEQ ID NO: 5627024 - DNA, 16 bp, Homo sapiens
ggctgtgggctccctt

SEQ ID NO: 5627025 - DNA, 18 bp, Homo sapiens
ggctgtgggctcccttcc

SEQ ID NO: 5627026 - DNA, 22 bp, Homo sapiens
ggctgtgggctcccttcctccc

SEQ ID NO: 5627027 - DNA, 20 bp, Homo sapiens
ggctgtggggtgggctggag

SEQ ID NO: 5627028 - DNA, 16 bp, Homo sapiens
ggctgtgggtagatgt

SEQ ID NO: 5627029 - DNA, 14 bp, Homo sapiens
ggctgtgggtgggg

SEQ ID NO: 5627030 - DNA, 24 bp, Homo sapiens
ggctgtggtagggggtgtctcagg

SEQ ID NO: 5627031 - DNA, 15 bp, Homo sapiens
ggctgtggtcacagc

SEQ ID NO: 5627032 - DNA, 17 bp, Homo sapiens
ggctgtggtcagagagg

SEQ ID NO: 5627033 - DNA, 13 bp, Homo sapiens
ggctgtggtccta

SEQ ID NO: 5627034 - DNA, 12 bp, Homo sapiens
ggctgtggttcc

SEQ ID NO: 5627035 - DNA, 20 bp, Homo sapiens
ggctgtgtcctaaatgcaaa

SEQ ID NO: 5627036 - DNA, 14 bp, Homo sapiens
ggctgtgtctaaac

SEQ ID NO: 5627037 - DNA, 14 bp, Homo sapiens
ggctgtgtctctgc

SEQ ID NO: 5627038 - DNA, 14 bp, Homo sapiens
ggctgtgtgacaga

SEQ ID NO: 5627039 - DNA, 13 bp, Homo sapiens
ggctgtgtggcca

SEQ ID NO: 5627040 - DNA, 15 bp, Homo sapiens
ggctgtgtgtctgct

SEQ ID NO: 5627041 - DNA, 16 bp, Homo sapiens
ggctgtgttgactgct

SEQ ID NO: 5627042 - DNA, 20 bp, Homo sapiens
ggctgtgtttgcagcctgct

SEQ ID NO: 5627043 - DNA, 18 bp, Homo sapiens
ggctgtgttttcgatgat

SEQ ID NO: 5627044 - DNA, 17 bp, Homo sapiens
ggctgttaaaaaaaaga

SEQ ID NO: 5627045 - DNA, 20 bp, Homo sapiens
ggctgttagctcagaggaga

SEQ ID NO: 5627046 - DNA, 20 bp, Homo sapiens
ggctgttaggacagcaaagc

SEQ ID NO: 5627047 - DNA, 13 bp, Homo sapiens
ggctgttatctgt

SEQ ID NO: 5627048 - DNA, 18 bp, Homo sapiens
ggctgttcatggcaagtg

SEQ ID NO: 5627049 - DNA, 13 bp, Homo sapiens
ggctgttccatgt

SEQ ID NO: 5627050 - DNA, 19 bp, Homo sapiens
ggctgttcctcccctgtag

SEQ ID NO: 5627051 - DNA, 13 bp, Homo sapiens
ggctgttctcagc

SEQ ID NO: 5627052 - DNA, 14 bp, Homo sapiens
ggctgttctcagcg

SEQ ID NO: 5627053 - DNA, 17 bp, Homo sapiens
ggctgttctcagcgttt

SEQ ID NO: 5627054 - DNA, 15 bp, Homo sapiens
ggctgttctggtggc

SEQ ID NO: 5627055 - DNA, 18 bp, Homo sapiens
ggctgttctggtggcccc

SEQ ID NO: 5627056 - DNA, 21 bp, Homo sapiens
ggctgttctgtttcctgtgtc

SEQ ID NO: 5627057 - DNA, 22 bp, Homo sapiens
ggctgttctgtttcctgtgtct

SEQ ID NO: 5627058 - DNA, 20 bp, Homo sapiens
ggctgttgatttatgcttta

SEQ ID NO: 5627059 - DNA, 21 bp, Homo sapiens
ggctgttggacagctgcttgt

SEQ ID NO: 5627060 - DNA, 12 bp, Homo sapiens
ggctgttggcac

SEQ ID NO: 5627061 - DNA, 17 bp, Homo sapiens
ggctgttggcagtgagt

SEQ ID NO: 5627062 - DNA, 20 bp, Homo sapiens
ggctgttggctgggggcctc

SEQ ID NO: 5627063 - DNA, 17 bp, Homo sapiens
ggctgtttcaaaaaaat

SEQ ID NO: 5627064 - DNA, 11 bp, Homo sapiens
ggctgtttctt

SEQ ID NO: 5627065 - DNA, 20 bp, Homo sapiens
ggctgtttcttgtctgttat

SEQ ID NO: 5627066 - DNA, 17 bp, Homo sapiens
ggctgttttaacggcct

SEQ ID NO: 5627067 - DNA, 20 bp, Homo sapiens
ggctgttttaacggcctgca

SEQ ID NO: 5627068 - DNA, 19 bp, Homo sapiens
ggctgttttagtgccaggc

SEQ ID NO: 5627069 - DNA, 21 bp, Homo sapiens
ggctgttttccctctgctgct

SEQ ID NO: 5627070 - DNA, 18 bp, Homo sapiens
ggctgttttgcctcccca

SEQ ID NO: 5627071 - DNA, 18 bp, Homo sapiens
ggcttaaacaacacctcc

SEQ ID NO: 5627072 - DNA, 20 bp, Homo sapiens
ggcttaaacaacacctcctc

SEQ ID NO: 5627073 - DNA, 22 bp, Homo sapiens
ggcttaaacaacacctcctcct

SEQ ID NO: 5627074 - DNA, 19 bp, Homo sapiens
ggcttaaagcatcctcctc

SEQ ID NO: 5627075 - DNA, 15 bp, Homo sapiens
ggcttaaagggatgg

SEQ ID NO: 5627076 - DNA, 12 bp, Homo sapiens
ggcttaaagtga

SEQ ID NO: 5627077 - DNA, 14 bp, Homo sapiens
ggcttaaagtgaag

SEQ ID NO: 5627078 - DNA, 22 bp, Homo sapiens
ggcttaaagtgaaggaaataaa

SEQ ID NO: 5627079 - DNA, 23 bp, Homo sapiens
ggcttaactggactgaattcaaa

SEQ ID NO: 5627080 - DNA, 22 bp, Homo sapiens
ggcttaacttagtatattatta

SEQ ID NO: 5627081 - DNA, 14 bp, Homo sapiens
ggcttaagaactgc

SEQ ID NO: 5627082 - DNA, 14 bp, Homo sapiens
ggcttaataaaaat

SEQ ID NO: 5627083 - DNA, 22 bp, Homo sapiens
ggcttaataatattaataagaa

SEQ ID NO: 5627084 - DNA, 14 bp, Homo sapiens
ggcttaatcatttt

SEQ ID NO: 5627085 - DNA, 12 bp, Homo sapiens
ggcttaatgttt

SEQ ID NO: 5627086 - DNA, 15 bp, Homo sapiens
ggcttaattgttctg

SEQ ID NO: 5627087 - DNA, 22 bp, Homo sapiens
ggcttacaggggggtcggaagc

SEQ ID NO: 5627088 - DNA, 22 bp, Homo sapiens
ggcttactacatgtgggagctt

SEQ ID NO: 5627089 - DNA, 18 bp, Homo sapiens
ggcttagaccctcatgct

SEQ ID NO: 5627090 - DNA, 14 bp, Homo sapiens
ggcttagagagagg

SEQ ID NO: 5627091 - DNA, 21 bp, Homo sapiens
ggcttagctgccatcttgctt

SEQ ID NO: 5627092 - DNA, 18 bp, Homo sapiens
ggcttagctttgctctgc

SEQ ID NO: 5627093 - DNA, 16 bp, Homo sapiens
ggcttagtaatagatc

SEQ ID NO: 5627094 - DNA, 19 bp, Homo sapiens
ggcttagtatttctcagga

SEQ ID NO: 5627095 - DNA, 22 bp, Homo sapiens
ggcttagtttgtgtgttgtctc

SEQ ID NO: 5627096 - DNA, 19 bp, Homo sapiens
ggcttataaacacattgaa

SEQ ID NO: 5627097 - DNA, 17 bp, Homo sapiens
ggcttataattctttca

SEQ ID NO: 5627098 - DNA, 18 bp, Homo sapiens
ggcttatatctggcctct

SEQ ID NO: 5627099 - DNA, 15 bp, Homo sapiens
ggcttatattcaacc

SEQ ID NO: 5627100 - DNA, 22 bp, Homo sapiens
ggcttatattcaaccatggact

SEQ ID NO: 5627101 - DNA, 16 bp, Homo sapiens
ggcttatatttgtgta

SEQ ID NO: 5627102 - DNA, 21 bp, Homo sapiens
ggcttatcagggagttacagt

SEQ ID NO: 5627103 - DNA, 16 bp, Homo sapiens
ggcttatccagctggt

SEQ ID NO: 5627104 - DNA, 19 bp, Homo sapiens
ggcttatctagccaaagag

SEQ ID NO: 5627105 - DNA, 22 bp, Homo sapiens
ggcttatctagccaaagagctc

SEQ ID NO: 5627106 - DNA, 18 bp, Homo sapiens
ggcttatgagatctaatg

SEQ ID NO: 5627107 - DNA, 19 bp, Homo sapiens
ggcttatgctcagaagcca

SEQ ID NO: 5627108 - DNA, 23 bp, Homo sapiens
ggcttcaaaaagccacagcagag

SEQ ID NO: 5627109 - DNA, 23 bp, Homo sapiens
ggcttcaaagatatagggtgtgg

SEQ ID NO: 5627110 - DNA, 17 bp, Homo sapiens
ggcttcaacagccaagc

SEQ ID NO: 5627111 - DNA, 19 bp, Homo sapiens
ggcttcaacagccaagctg

SEQ ID NO: 5627112 - DNA, 21 bp, Homo sapiens
ggcttcaagttgtaaaaatga

SEQ ID NO: 5627113 - DNA, 20 bp, Homo sapiens
ggcttcaatctacgatgtta

SEQ ID NO: 5627114 - DNA, 14 bp, Homo sapiens
ggcttcacagtctg

SEQ ID NO: 5627115 - DNA, 19 bp, Homo sapiens
ggcttcaccagggttctga

SEQ ID NO: 5627116 - DNA, 17 bp, Homo sapiens
ggcttcaccgcattcca

SEQ ID NO: 5627117 - DNA, 19 bp, Homo sapiens
ggcttcaccgcattccagg

SEQ ID NO: 5627118 - DNA, 15 bp, Homo sapiens
ggcttcactcctgct

SEQ ID NO: 5627119 - DNA, 14 bp, Homo sapiens
ggcttcactgacca

SEQ ID NO: 5627120 - DNA, 20 bp, Homo sapiens
ggcttcactgaccagcggct

SEQ ID NO: 5627121 - DNA, 21 bp, Homo sapiens
ggcttcactgaccagcggctg

SEQ ID NO: 5627122 - DNA, 15 bp, Homo sapiens
ggcttcactgtataa

SEQ ID NO: 5627123 - DNA, 22 bp, Homo sapiens
ggcttcactgtataaataggag

SEQ ID NO: 5627124 - DNA, 19 bp, Homo sapiens
ggcttcagaggcctggcat

SEQ ID NO: 5627125 - DNA, 20 bp, Homo sapiens
ggcttcagcatatttatagc

SEQ ID NO: 5627126 - DNA, 24 bp, Homo sapiens
ggcttcagcctagtggcttgtcct

SEQ ID NO: 5627127 - DNA, 23 bp, Homo sapiens
ggcttcaggccgagccaggttca

SEQ ID NO: 5627128 - DNA, 14 bp, Homo sapiens
ggcttcagggaggg

SEQ ID NO: 5627129 - DNA, 16 bp, Homo sapiens
ggcttcagggcaggtg

SEQ ID NO: 5627130 - DNA, 18 bp, Homo sapiens
ggcttcaggtctctgtgg

SEQ ID NO: 5627131 - DNA, 17 bp, Homo sapiens
ggcttcaggttgcattg

SEQ ID NO: 5627132 - DNA, 20 bp, Homo sapiens
ggcttcagtggcagctgctt

SEQ ID NO: 5627133 - DNA, 9 bp, Homo sapiens
ggcttcata

SEQ ID NO: 5627134 - DNA, 12 bp, Homo sapiens
ggcttcatctct

SEQ ID NO: 5627135 - DNA, 20 bp, Homo sapiens
ggcttcatctctttagagaa

SEQ ID NO: 5627136 - DNA, 18 bp, Homo sapiens
ggcttcattccggactgg

SEQ ID NO: 5627137 - DNA, 14 bp, Homo sapiens
ggcttccaaggtgg

SEQ ID NO: 5627138 - DNA, 19 bp, Homo sapiens
ggcttccaaggtggtctgc

SEQ ID NO: 5627139 - DNA, 22 bp, Homo sapiens
ggcttccaaggtggtctgctcg

SEQ ID NO: 5627140 - DNA, 16 bp, Homo sapiens
ggcttccacacttctg

SEQ ID NO: 5627141 - DNA, 20 bp, Homo sapiens
ggcttccacccctctcctca

SEQ ID NO: 5627142 - DNA, 17 bp, Homo sapiens
ggcttccagaaggcagc

SEQ ID NO: 5627143 - DNA, 15 bp, Homo sapiens
ggcttccagctcagt

SEQ ID NO: 5627144 - DNA, 23 bp, Homo sapiens
ggcttcccaaatgtgtgcccagc

SEQ ID NO: 5627145 - DNA, 22 bp, Homo sapiens
ggcttcccacagcctcttcctc

SEQ ID NO: 5627146 - DNA, 13 bp, Homo sapiens
ggcttcccaggac

SEQ ID NO: 5627147 - DNA, 19 bp, Homo sapiens
ggcttcccaggaccctggg

SEQ ID NO: 5627148 - DNA, 19 bp, Homo sapiens
ggcttcccaggctgggctc

SEQ ID NO: 5627149 - DNA, 17 bp, Homo sapiens
ggcttcccatccccagc

SEQ ID NO: 5627150 - DNA, 15 bp, Homo sapiens
ggcttccccactccc

SEQ ID NO: 5627151 - DNA, 17 bp, Homo sapiens
ggcttccccatcagctc

SEQ ID NO: 5627152 - DNA, 12 bp, Homo sapiens
ggcttcccctcc

SEQ ID NO: 5627153 - DNA, 14 bp, Homo sapiens
ggcttcccctccac

SEQ ID NO: 5627154 - DNA, 14 bp, Homo sapiens
ggcttcccgctcag

SEQ ID NO: 5627155 - DNA, 15 bp, Homo sapiens
ggcttcccgctcagc

SEQ ID NO: 5627156 - DNA, 22 bp, Homo sapiens
ggcttcccgctcagccctccct

SEQ ID NO: 5627157 - DNA, 17 bp, Homo sapiens
ggcttccctctgctcca

SEQ ID NO: 5627158 - DNA, 15 bp, Homo sapiens
ggcttccctgagcca

SEQ ID NO: 5627159 - DNA, 13 bp, Homo sapiens
ggcttccctgccc

SEQ ID NO: 5627160 - DNA, 14 bp, Homo sapiens
ggcttccctgccca

SEQ ID NO: 5627161 - DNA, 11 bp, Homo sapiens
ggcttccctgg

SEQ ID NO: 5627162 - DNA, 16 bp, Homo sapiens
ggcttccctggcatga

SEQ ID NO: 5627163 - DNA, 13 bp, Homo sapiens
ggcttccctgggc

SEQ ID NO: 5627164 - DNA, 19 bp, Homo sapiens
ggcttcccttctccccagc

SEQ ID NO: 5627165 - DNA, 17 bp, Homo sapiens
ggcttccgtgagacaca

SEQ ID NO: 5627166 - DNA, 16 bp, Homo sapiens
ggcttccgtgtcctct

SEQ ID NO: 5627167 - DNA, 12 bp, Homo sapiens
ggcttcctcagg

SEQ ID NO: 5627168 - DNA, 16 bp, Homo sapiens
ggcttcctcatagtat

SEQ ID NO: 5627169 - DNA, 19 bp, Homo sapiens
ggcttcctccgtccaccca

SEQ ID NO: 5627170 - DNA, 12 bp, Homo sapiens
ggcttcctcctc

SEQ ID NO: 5627171 - DNA, 21 bp, Homo sapiens
ggcttcctctagaagccaagg

SEQ ID NO: 5627172 - DNA, 13 bp, Homo sapiens
ggcttcctctgct

SEQ ID NO: 5627173 - DNA, 17 bp, Homo sapiens
ggcttcctgagaaagcc

SEQ ID NO: 5627174 - DNA, 20 bp, Homo sapiens
ggcttcctgaggggagacag

SEQ ID NO: 5627175 - DNA, 13 bp, Homo sapiens
ggcttcctgccct

SEQ ID NO: 5627176 - DNA, 18 bp, Homo sapiens
ggcttcctgcccttccct

SEQ ID NO: 5627177 - DNA, 22 bp, Homo sapiens
ggcttcctgcccttccctctgg

SEQ ID NO: 5627178 - DNA, 20 bp, Homo sapiens
ggcttcctgcgtcctcctca

SEQ ID NO: 5627179 - DNA, 14 bp, Homo sapiens
ggcttcctggagca

SEQ ID NO: 5627180 - DNA, 15 bp, Homo sapiens
ggcttcctggagcag

SEQ ID NO: 5627181 - DNA, 10 bp, Homo sapiens
ggcttcctgt

SEQ ID NO: 5627182 - DNA, 17 bp, Homo sapiens
ggcttcctgtccactct

SEQ ID NO: 5627183 - DNA, 18 bp, Homo sapiens
ggcttcctgtccactctc

SEQ ID NO: 5627184 - DNA, 22 bp, Homo sapiens
ggcttcgcgctggaatccagaa

SEQ ID NO: 5627185 - DNA, 21 bp, Homo sapiens
ggcttcggagtgaatgtggca

SEQ ID NO: 5627186 - DNA, 13 bp, Homo sapiens
ggcttctcagccc

SEQ ID NO: 5627187 - DNA, 14 bp, Homo sapiens
ggcttctccccctc

SEQ ID NO: 5627188 - DNA, 13 bp, Homo sapiens
ggcttctcccgga

SEQ ID NO: 5627189 - DNA, 14 bp, Homo sapiens
ggcttctcctctgc

SEQ ID NO: 5627190 - DNA, 11 bp, Homo sapiens
ggcttctcctg

SEQ ID NO: 5627191 - DNA, 16 bp, Homo sapiens
ggcttctcctgaaatc

SEQ ID NO: 5627192 - DNA, 23 bp, Homo sapiens
ggcttctcctgcgggggcgaggc

SEQ ID NO: 5627193 - DNA, 14 bp, Homo sapiens
ggcttctcctgtga

SEQ ID NO: 5627194 - DNA, 14 bp, Homo sapiens
ggcttctcctgttt

SEQ ID NO: 5627195 - DNA, 21 bp, Homo sapiens
ggcttctccttctccttccca

SEQ ID NO: 5627196 - DNA, 16 bp, Homo sapiens
gggaagagtgtactgg

SEQ ID NO: 5627197 - DNA, 17 bp, Homo sapiens
gggaagagtgtactggg

SEQ ID NO: 5627198 - DNA, 22 bp, Homo sapiens
gggaagatgaaaccgtccctga

SEQ ID NO: 5627199 - DNA, 19 bp, Homo sapiens
gggaagatgaactttgtca

SEQ ID NO: 5627200 - DNA, 19 bp, Homo sapiens
gggaagatgacctgcccca

SEQ ID NO: 5627201 - DNA, 14 bp, Homo sapiens
gggaagatggagac

SEQ ID NO: 5627202 - DNA, 14 bp, Homo sapiens
gggaagatggtagc

SEQ ID NO: 5627203 - DNA, 20 bp, Homo sapiens
gggaagatgtctcagagcct

SEQ ID NO: 5627204 - DNA, 19 bp, Homo sapiens
gggaagcaccagcctcagt

SEQ ID NO: 5627205 - DNA, 14 bp, Homo sapiens
gggaagcagagcct

SEQ ID NO: 5627206 - DNA, 17 bp, Homo sapiens
gggaagcagccagctcc

SEQ ID NO: 5627207 - DNA, 13 bp, Homo sapiens
gggaagcaggcag

SEQ ID NO: 5627208 - DNA, 15 bp, Homo sapiens
gggaagcaggcagag

SEQ ID NO: 5627209 - DNA, 15 bp, Homo sapiens
gggaagcatcctccc

SEQ ID NO: 5627210 - DNA, 13 bp, Homo sapiens
gggaagcccaccc

SEQ ID NO: 5627211 - DNA, 15 bp, Homo sapiens
gggaagcccacccgc

SEQ ID NO: 5627212 - DNA, 16 bp, Homo sapiens
gggaagcccacccgcc

SEQ ID NO: 5627213 - DNA, 21 bp, Homo sapiens
gggaagcccacccgccccaga

SEQ ID NO: 5627214 - DNA, 19 bp, Homo sapiens
gggaagcccagctccaggg

SEQ ID NO: 5627215 - DNA, 18 bp, Homo sapiens
gggaagcccatcctgacc

SEQ ID NO: 5627216 - DNA, 20 bp, Homo sapiens
gggaagcctccgtcaggaga

SEQ ID NO: 5627217 - DNA, 12 bp, Homo sapiens
gggaagccttta

SEQ ID NO: 5627218 - DNA, 23 bp, Homo sapiens
gggaagcggaggttgcagggagc

SEQ ID NO: 5627219 - DNA, 16 bp, Homo sapiens
gggaagctacaggtta

SEQ ID NO: 5627220 - DNA, 15 bp, Homo sapiens
gggaagctagtcttt

SEQ ID NO: 5627221 - DNA, 22 bp, Homo sapiens
gggaagctcccacacccacctc

SEQ ID NO: 5627222 - DNA, 14 bp, Homo sapiens
gggaagctcccacc

SEQ ID NO: 5627223 - DNA, 19 bp, Homo sapiens
gggaagctcccaccccact

SEQ ID NO: 5627224 - DNA, 14 bp, Homo sapiens
gggaagctgaggcc

SEQ ID NO: 5627225 - DNA, 15 bp, Homo sapiens
gggaagctgaggccc

SEQ ID NO: 5627226 - DNA, 20 bp, Homo sapiens
gggaagctgccacccctctt

SEQ ID NO: 5627227 - DNA, 15 bp, Homo sapiens
gggaagctgccagcc

SEQ ID NO: 5627228 - DNA, 21 bp, Homo sapiens
gggaagctgccagcccagaac

SEQ ID NO: 5627229 - DNA, 15 bp, Homo sapiens
gggaagctggcctga

SEQ ID NO: 5627230 - DNA, 18 bp, Homo sapiens
gggaagctgggggaaggg

SEQ ID NO: 5627231 - DNA, 21 bp, Homo sapiens
gggaagctgggggaagggtgg

SEQ ID NO: 5627232 - DNA, 18 bp, Homo sapiens
gggaagctgtactcagag

SEQ ID NO: 5627233 - DNA, 21 bp, Homo sapiens
gggaagcttgagcctccccca

SEQ ID NO: 5627234 - DNA, 22 bp, Homo sapiens
gggaagcttgagcctcccccaa

SEQ ID NO: 5627235 - DNA, 20 bp, Homo sapiens
gggaagcttgctggcttctg

SEQ ID NO: 5627236 - DNA, 14 bp, Homo sapiens
gggaagctttcacc

SEQ ID NO: 5627237 - DNA, 13 bp, Homo sapiens
gggaaggaaacaa

SEQ ID NO: 5627238 - DNA, 17 bp, Homo sapiens
gggaaggaactctggct

SEQ ID NO: 5627239 - DNA, 22 bp, Homo sapiens
gggaaggaagcttggctgctca

SEQ ID NO: 5627240 - DNA, 13 bp, Homo sapiens
gggaaggacacag

SEQ ID NO: 5627241 - DNA, 16 bp, Homo sapiens
gggaaggacacagcag

SEQ ID NO: 5627242 - DNA, 19 bp, Homo sapiens
gggaaggacagaaaggaga

SEQ ID NO: 5627243 - DNA, 13 bp, Homo sapiens
gggaaggacagga

SEQ ID NO: 5627244 - DNA, 22 bp, Homo sapiens
gggaaggacaggaccctcagga

SEQ ID NO: 5627245 - DNA, 18 bp, Homo sapiens
gggaaggacttggcgcgc

SEQ ID NO: 5627246 - DNA, 18 bp, Homo sapiens
gggaaggagacaggatga

SEQ ID NO: 5627247 - DNA, 14 bp, Homo sapiens
gggaaggagctgtt

SEQ ID NO: 5627248 - DNA, 20 bp, Homo sapiens
gggaaggagggacttggctg

SEQ ID NO: 5627249 - DNA, 13 bp, Homo sapiens
gggaaggatacaa

SEQ ID NO: 5627250 - DNA, 12 bp, Homo sapiens
gggaaggatggg

SEQ ID NO: 5627251 - DNA, 22 bp, Homo sapiens
gggaaggattctgctggcctct

SEQ ID NO: 5627252 - DNA, 18 bp, Homo sapiens
gggaaggcacagggagaa

SEQ ID NO: 5627253 - DNA, 15 bp, Homo sapiens
gggaaggcagaggct

SEQ ID NO: 5627254 - DNA, 18 bp, Homo sapiens
gggaaggcagaggctggc

SEQ ID NO: 5627255 - DNA, 14 bp, Homo sapiens
gggaaggcaggcag

SEQ ID NO: 5627256 - DNA, 21 bp, Homo sapiens
gggaaggcaggcagggctctc

SEQ ID NO: 5627257 - DNA, 22 bp, Homo sapiens
gggaaggcagggagggcctggg

SEQ ID NO: 5627258 - DNA, 19 bp, Homo sapiens
gggaaggccacctcccact

SEQ ID NO: 5627259 - DNA, 15 bp, Homo sapiens
gggaaggccctgagg

SEQ ID NO: 5627260 - DNA, 16 bp, Homo sapiens
gggaaggccctgaggc

SEQ ID NO: 5627261 - DNA, 19 bp, Homo sapiens
gggaaggccctgaggcgga

SEQ ID NO: 5627262 - DNA, 22 bp, Homo sapiens
gggaaggcctgagggaagccca

SEQ ID NO: 5627263 - DNA, 22 bp, Homo sapiens
gggaaggctacttcggggctgg

SEQ ID NO: 5627264 - DNA, 16 bp, Homo sapiens
gggaaggctgctgtgt

SEQ ID NO: 5627265 - DNA, 23 bp, Homo sapiens
gggaagggaaccagccctccaga

SEQ ID NO: 5627266 - DNA, 16 bp, Homo sapiens
gggaagggagagggcc

SEQ ID NO: 5627267 - DNA, 21 bp, Homo sapiens
gggaagggagccaagggatgg

SEQ ID NO: 5627268 - DNA, 22 bp, Homo sapiens
gggaagggagccaagggatgga

SEQ ID NO: 5627269 - DNA, 12 bp, Homo sapiens
gggaagggcagg

SEQ ID NO: 5627270 - DNA, 16 bp, Homo sapiens
gggaagggccagtctg

SEQ ID NO: 5627271 - DNA, 14 bp, Homo sapiens
gggaaggggaatgg

SEQ ID NO: 5627272 - DNA, 23 bp, Homo sapiens
gggaaggggatggaggccagagt

SEQ ID NO: 5627273 - DNA, 21 bp, Homo sapiens
gggaaggggcctgggctgtga

SEQ ID NO: 5627274 - DNA, 21 bp, Homo sapiens
gggaaggggcgtgtccctcct

SEQ ID NO: 5627275 - DNA, 16 bp, Homo sapiens
gggaagggggctggga

SEQ ID NO: 5627276 - DNA, 16 bp, Homo sapiens
gggaagggtgcctggc

SEQ ID NO: 5627277 - DNA, 12 bp, Homo sapiens
gggaaggtcacc

SEQ ID NO: 5627278 - DNA, 13 bp, Homo sapiens
gggaaggtgaccg

SEQ ID NO: 5627279 - DNA, 15 bp, Homo sapiens
gggaaggtgctgaat

SEQ ID NO: 5627280 - DNA, 14 bp, Homo sapiens
gggaaggtggggcc

SEQ ID NO: 5627281 - DNA, 21 bp, Homo sapiens
gggaaggtggggccctgcccc

SEQ ID NO: 5627282 - DNA, 12 bp, Homo sapiens
gggaaggtgggt

SEQ ID NO: 5627283 - DNA, 18 bp, Homo sapiens
gggaaggttccatgaagc

SEQ ID NO: 5627284 - DNA, 16 bp, Homo sapiens
gggaagtacgtcccag

SEQ ID NO: 5627285 - DNA, 22 bp, Homo sapiens
gggaagtacgtcccagcggcct

SEQ ID NO: 5627286 - DNA, 15 bp, Homo sapiens
gggaagtagtccttg

SEQ ID NO: 5627287 - DNA, 16 bp, Homo sapiens
gggaagtagtccttgg

SEQ ID NO: 5627288 - DNA, 22 bp, Homo sapiens
gggaagtagttatcatgttagt

SEQ ID NO: 5627289 - DNA, 14 bp, Homo sapiens
gggaagtctcagcc

SEQ ID NO: 5627290 - DNA, 21 bp, Homo sapiens
gggaagtgacaaggccccaga

SEQ ID NO: 5627291 - DNA, 23 bp, Homo sapiens
gggaagtgacttagcagatgctg

SEQ ID NO: 5627292 - DNA, 16 bp, Homo sapiens
gggaagtgaggcccaa

SEQ ID NO: 5627293 - DNA, 17 bp, Homo sapiens
gggaagtgaggcccaag

SEQ ID NO: 5627294 - DNA, 21 bp, Homo sapiens
gggaagtgaggcccaaggagc

SEQ ID NO: 5627295 - DNA, 13 bp, Homo sapiens
gggaagtgcagag

SEQ ID NO: 5627296 - DNA, 18 bp, Homo sapiens
gggaagtgctccccacac

SEQ ID NO: 5627297 - DNA, 22 bp, Homo sapiens
gggaagtgctccccacacgtgc

SEQ ID NO: 5627298 - DNA, 14 bp, Homo sapiens
gggaagtggcttaa

SEQ ID NO: 5627299 - DNA, 14 bp, Homo sapiens
gggaagtgtgctga

SEQ ID NO: 5627300 - DNA, 16 bp, Homo sapiens
gggaagtgtgctgagg

SEQ ID NO: 5627301 - DNA, 21 bp, Homo sapiens
gggaagtgtgctgaggtgggc

SEQ ID NO: 5627302 - DNA, 15 bp, Homo sapiens
gggaagttcagcaag

SEQ ID NO: 5627303 - DNA, 22 bp, Homo sapiens
gggaagttgcattcctttgtct

SEQ ID NO: 5627304 - DNA, 18 bp, Homo sapiens
gggaagtttaaaacccaa

SEQ ID NO: 5627305 - DNA, 16 bp, Homo sapiens
gggaagtttatttgag

SEQ ID NO: 5627306 - DNA, 18 bp, Homo sapiens
gggaagtttgctgtgctt

SEQ ID NO: 5627307 - DNA, 23 bp, Homo sapiens
gggaatactcttggtcacctcaa

SEQ ID NO: 5627308 - DNA, 17 bp, Homo sapiens
gggaatagggagacagg

SEQ ID NO: 5627309 - DNA, 23 bp, Homo sapiens
gggaatagtctagatggctcctc

SEQ ID NO: 5627310 - DNA, 12 bp, Homo sapiens
gggaatcacatc

SEQ ID NO: 5627311 - DNA, 14 bp, Homo sapiens
gggaatcagaactc

SEQ ID NO: 5627312 - DNA, 15 bp, Homo sapiens
gggaatcagggacca

SEQ ID NO: 5627313 - DNA, 18 bp, Homo sapiens
gggaatcagggaccagct

SEQ ID NO: 5627314 - DNA, 13 bp, Homo sapiens
gggaatcagggag

SEQ ID NO: 5627315 - DNA, 23 bp, Homo sapiens
gggaatcagggagcactggaggc

SEQ ID NO: 5627316 - DNA, 15 bp, Homo sapiens
gggaatccaagcctc

SEQ ID NO: 5627317 - DNA, 21 bp, Homo sapiens
gggaatccaagcctccacagc

SEQ ID NO: 5627318 - DNA, 21 bp, Homo sapiens
gggaatccagctccctagact

SEQ ID NO: 5627319 - DNA, 13 bp, Homo sapiens
gggaatccgcctg

SEQ ID NO: 5627320 - DNA, 13 bp, Homo sapiens
gggaatcctgctg

SEQ ID NO: 5627321 - DNA, 22 bp, Homo sapiens
gggaatctaagagagctgccat

SEQ ID NO: 5627322 - DNA, 18 bp, Homo sapiens
gggaatctaagtgggaga

SEQ ID NO: 5627323 - DNA, 13 bp, Homo sapiens
gggaatgaagata

SEQ ID NO: 5627324 - DNA, 11 bp, Homo sapiens
gggaatgaggc

SEQ ID NO: 5627325 - DNA, 14 bp, Homo sapiens
gggaatgaggcttg

SEQ ID NO: 5627326 - DNA, 20 bp, Homo sapiens
gggaatgaggcttgctgaga

SEQ ID NO: 5627327 - DNA, 16 bp, Homo sapiens
gggaatgaggggaagc

SEQ ID NO: 5627328 - DNA, 18 bp, Homo sapiens
gggaatgcacctccccaa

SEQ ID NO: 5627329 - DNA, 17 bp, Homo sapiens
gggaatgcctgagtgcc

SEQ ID NO: 5627330 - DNA, 21 bp, Homo sapiens
gggaatgcctgagtgcctggc

SEQ ID NO: 5627331 - DNA, 23 bp, Homo sapiens
gggaatgcgctcttcaccaggaa

SEQ ID NO: 5627332 - DNA, 12 bp, Homo sapiens
gggaatgggaga

SEQ ID NO: 5627333 - DNA, 22 bp, Homo sapiens
gggaatgggggagagaagggaa

SEQ ID NO: 5627334 - DNA, 20 bp, Homo sapiens
gggaatgtattattctgcag

SEQ ID NO: 5627335 - DNA, 22 bp, Homo sapiens
gggaatgtcagtagtgccagaa

SEQ ID NO: 5627336 - DNA, 11 bp, Homo sapiens
gggaatgtgaa

SEQ ID NO: 5627337 - DNA, 17 bp, Homo sapiens
gggaatgtgtcctcctg

SEQ ID NO: 5627338 - DNA, 19 bp, Homo sapiens
gggaatgtgtcctcctgct

SEQ ID NO: 5627339 - DNA, 16 bp, Homo sapiens
gggaatgttccctgca

SEQ ID NO: 5627340 - DNA, 22 bp, Homo sapiens
gggaatgtttgggcagaaggga

SEQ ID NO: 5627341 - DNA, 11 bp, Homo sapiens
gggaatgtttt

SEQ ID NO: 5627342 - DNA, 12 bp, Homo sapiens
gggaattaaata

SEQ ID NO: 5627343 - DNA, 15 bp, Homo sapiens
gggaattcctggaac

SEQ ID NO: 5627344 - DNA, 20 bp, Homo sapiens
gggaattcctggaacctgga

SEQ ID NO: 5627345 - DNA, 20 bp, Homo sapiens
gggaattctcagtgccaact

SEQ ID NO: 5627346 - DNA, 13 bp, Homo sapiens
gggaattcttaca

SEQ ID NO: 5627347 - DNA, 17 bp, Homo sapiens
gggaattgcgctcaggg

SEQ ID NO: 5627348 - DNA, 13 bp, Homo sapiens
gggaattgggggg

SEQ ID NO: 5627349 - DNA, 17 bp, Homo sapiens
gggaatttcttcaactc

SEQ ID NO: 5627350 - DNA, 18 bp, Homo sapiens
gggacaaaacccaccttg

SEQ ID NO: 5627351 - DNA, 20 bp, Homo sapiens
gggacaaaaggtactggtga

SEQ ID NO: 5627352 - DNA, 21 bp, Homo sapiens
gggacaaaaggtactggtgag

SEQ ID NO: 5627353 - DNA, 14 bp, Homo sapiens
gggacaaagaaatc

SEQ ID NO: 5627354 - DNA, 16 bp, Homo sapiens
gggacaaagaggcctt

SEQ ID NO: 5627355 - DNA, 16 bp, Homo sapiens
gggacaaaggagcctg

SEQ ID NO: 5627356 - DNA, 22 bp, Homo sapiens
gggacaacaatgaatcagaaca

SEQ ID NO: 5627357 - DNA, 23 bp, Homo sapiens
gggacaacactttccctctctgg

SEQ ID NO: 5627358 - DNA, 13 bp, Homo sapiens
gggacaagcaggc

SEQ ID NO: 5627359 - DNA, 14 bp, Homo sapiens
gggacaagccaggc

SEQ ID NO: 5627360 - DNA, 13 bp, Homo sapiens
gggacaaggaagg

SEQ ID NO: 5627361 - DNA, 13 bp, Homo sapiens
gggacaagggatt

SEQ ID NO: 5627362 - DNA, 20 bp, Homo sapiens
gggacaagtagccacctgag

SEQ ID NO: 5627363 - DNA, 19 bp, Homo sapiens
gggacaagtggactcaggg

SEQ ID NO: 5627364 - DNA, 23 bp, Homo sapiens
gggacaattcttctcgacttcag

SEQ ID NO: 5627365 - DNA, 19 bp, Homo sapiens
gggacacaaaactccgccc

SEQ ID NO: 5627366 - DNA, 23 bp, Homo sapiens
gggacacaaaactccgcccccag

SEQ ID NO: 5627367 - DNA, 14 bp, Homo sapiens
gggacacacacaca

SEQ ID NO: 5627368 - DNA, 19 bp, Homo sapiens
gggacacacttagctggag

SEQ ID NO: 5627369 - DNA, 21 bp, Homo sapiens
gggacacagaccggccgcatg

SEQ ID NO: 5627370 - DNA, 18 bp, Homo sapiens
gggacacaggagaccacc

SEQ ID NO: 5627371 - DNA, 19 bp, Homo sapiens
gggacacaggagaccaccc

SEQ ID NO: 5627372 - DNA, 21 bp, Homo sapiens
gggacacaggatcctggcctg

SEQ ID NO: 5627373 - DNA, 16 bp, Homo sapiens
gggacacatgcccctc

SEQ ID NO: 5627374 - DNA, 14 bp, Homo sapiens
gggagagacacaga

SEQ ID NO: 5627375 - DNA, 13 bp, Homo sapiens
gggagagaccctt

SEQ ID NO: 5627376 - DNA, 20 bp, Homo sapiens
gggagagacttggatgagga

SEQ ID NO: 5627377 - DNA, 19 bp, Homo sapiens
gggagagagaagcaggcag

SEQ ID NO: 5627378 - DNA, 21 bp, Homo sapiens
gggagagagaagcaggcagat

SEQ ID NO: 5627379 - DNA, 23 bp, Homo sapiens
gggagagagagagagagaggaca

SEQ ID NO: 5627380 - DNA, 12 bp, Homo sapiens
gggagagagtag

SEQ ID NO: 5627381 - DNA, 19 bp, Homo sapiens
gggagagagtgagagagag

SEQ ID NO: 5627382 - DNA, 21 bp, Homo sapiens
gggagagatctccaactctct

SEQ ID NO: 5627383 - DNA, 12 bp, Homo sapiens
gggagagcaggc

SEQ ID NO: 5627384 - DNA, 13 bp, Homo sapiens
gggagagcaggct

SEQ ID NO: 5627385 - DNA, 22 bp, Homo sapiens
gggagagccaaggcctatgcca

SEQ ID NO: 5627386 - DNA, 12 bp, Homo sapiens
gggagagcccag

SEQ ID NO: 5627387 - DNA, 12 bp, Homo sapiens
gggagagccctg

SEQ ID NO: 5627388 - DNA, 12 bp, Homo sapiens
gggagagcctgc

SEQ ID NO: 5627389 - DNA, 13 bp, Homo sapiens
gggagagcctgct

SEQ ID NO: 5627390 - DNA, 16 bp, Homo sapiens
gggagagcctgctggc

SEQ ID NO: 5627391 - DNA, 18 bp, Homo sapiens
gggagagcgccacccgcc

SEQ ID NO: 5627392 - DNA, 13 bp, Homo sapiens
gggagagctggca

SEQ ID NO: 5627393 - DNA, 16 bp, Homo sapiens
gggagagctgggcaga

SEQ ID NO: 5627394 - DNA, 13 bp, Homo sapiens
gggagaggaaaga

SEQ ID NO: 5627395 - DNA, 14 bp, Homo sapiens
gggagaggaagcac

SEQ ID NO: 5627396 - DNA, 14 bp, Homo sapiens
gggagaggaagcca

SEQ ID NO: 5627397 - DNA, 12 bp, Homo sapiens
gggagaggcaga

SEQ ID NO: 5627398 - DNA, 12 bp, Homo sapiens
gggagaggcagc

SEQ ID NO: 5627399 - DNA, 17 bp, Homo sapiens
gggagaggctgggaggt

SEQ ID NO: 5627400 - DNA, 12 bp, Homo sapiens
gggagaggctgt

SEQ ID NO: 5627401 - DNA, 14 bp, Homo sapiens
gggagagggaagag

SEQ ID NO: 5627402 - DNA, 18 bp, Homo sapiens
gggagagggagcaagcct

SEQ ID NO: 5627403 - DNA, 18 bp, Homo sapiens
gggagagggtgaaggagg

SEQ ID NO: 5627404 - DNA, 16 bp, Homo sapiens
gggagaggtcaccagc

SEQ ID NO: 5627405 - DNA, 17 bp, Homo sapiens
gggagaggtcagccttg

SEQ ID NO: 5627406 - DNA, 21 bp, Homo sapiens
gggagaggtgattctcagggc

SEQ ID NO: 5627407 - DNA, 21 bp, Homo sapiens
gggagagtgtcaaccagacag

SEQ ID NO: 5627408 - DNA, 23 bp, Homo sapiens
gggagagttgtgatggaggggag

SEQ ID NO: 5627409 - DNA, 22 bp, Homo sapiens
gggagataaaagaaccccagac

SEQ ID NO: 5627410 - DNA, 16 bp, Homo sapiens
gggagatactctccct

SEQ ID NO: 5627411 - DNA, 16 bp, Homo sapiens
gggagatccgccctgg

SEQ ID NO: 5627412 - DNA, 15 bp, Homo sapiens
gggagatgctctctg

SEQ ID NO: 5627413 - DNA, 14 bp, Homo sapiens
gggagatggggagg

SEQ ID NO: 5627414 - DNA, 17 bp, Homo sapiens
gggagatgtcaggatgt

SEQ ID NO: 5627415 - DNA, 21 bp, Homo sapiens
gggagcaaatatctaaataat

SEQ ID NO: 5627416 - DNA, 14 bp, Homo sapiens
gggagcaagacaga

SEQ ID NO: 5627417 - DNA, 20 bp, Homo sapiens
gggagcacaggtgtctgcct

SEQ ID NO: 5627418 - DNA, 18 bp, Homo sapiens
gggagcaccacggccaga

SEQ ID NO: 5627419 - DNA, 11 bp, Homo sapiens
gggagcactgg

SEQ ID NO: 5627420 - DNA, 19 bp, Homo sapiens
gggagcagaaacagccatt

SEQ ID NO: 5627421 - DNA, 13 bp, Homo sapiens
gggagcagagaca

SEQ ID NO: 5627422 - DNA, 14 bp, Homo sapiens
gggagcagagagag

SEQ ID NO: 5627423 - DNA, 23 bp, Homo sapiens
gggagcagagagagccagacagc

SEQ ID NO: 5627424 - DNA, 12 bp, Homo sapiens
gggagcagcccc

SEQ ID NO: 5627425 - DNA, 20 bp, Homo sapiens
gggagcagcggctctggtcc

SEQ ID NO: 5627426 - DNA, 12 bp, Homo sapiens
gggagcagcttc

SEQ ID NO: 5627427 - DNA, 13 bp, Homo sapiens
gggagcagcttct

SEQ ID NO: 5627428 - DNA, 18 bp, Homo sapiens
gggagcagcttcttgggc

SEQ ID NO: 5627429 - DNA, 12 bp, Homo sapiens
gggagcaggaga

SEQ ID NO: 5627430 - DNA, 21 bp, Homo sapiens
gggagcaggagattgagaagg

SEQ ID NO: 5627431 - DNA, 22 bp, Homo sapiens
gggagcaggcagtggggctgga

SEQ ID NO: 5627432 - DNA, 22 bp, Homo sapiens
gggagcaggccggaaccacagg

SEQ ID NO: 5627433 - DNA, 19 bp, Homo sapiens
gggagcaggtgcccccagg

SEQ ID NO: 5627434 - DNA, 22 bp, Homo sapiens
gggagcaggtgcccccaggtga

SEQ ID NO: 5627435 - DNA, 11 bp, Homo sapiens
gggagcagtgt

SEQ ID NO: 5627436 - DNA, 18 bp, Homo sapiens
gggagcatagaaggcagg

SEQ ID NO: 5627437 - DNA, 19 bp, Homo sapiens
gggagcatagaaggcaggt

SEQ ID NO: 5627438 - DNA, 21 bp, Homo sapiens
gggagcatagcagaggggcca

SEQ ID NO: 5627439 - DNA, 22 bp, Homo sapiens
gggagcatagcagaggggccag

SEQ ID NO: 5627440 - DNA, 17 bp, Homo sapiens
gggagcatgagaggagg

SEQ ID NO: 5627441 - DNA, 21 bp, Homo sapiens
gggagcatgcttccctgcagc

SEQ ID NO: 5627442 - DNA, 22 bp, Homo sapiens
gggagcatgcttccctgcagct

SEQ ID NO: 5627443 - DNA, 18 bp, Homo sapiens
gggagcattctgcctgcc

SEQ ID NO: 5627444 - DNA, 21 bp, Homo sapiens
gggagcattctgcctgcctgg

SEQ ID NO: 5627445 - DNA, 18 bp, Homo sapiens
gggagccacatttacata

SEQ ID NO: 5627446 - DNA, 14 bp, Homo sapiens
gggagccactgcca

SEQ ID NO: 5627447 - DNA, 17 bp, Homo sapiens
gggagccactgccactc

SEQ ID NO: 5627448 - DNA, 19 bp, Homo sapiens
gggagccacttctccccag

SEQ ID NO: 5627449 - DNA, 20 bp, Homo sapiens
gggagccagaaatgggcagt

SEQ ID NO: 5627450 - DNA, 11 bp, Homo sapiens
gggagccagac

SEQ ID NO: 5627451 - DNA, 17 bp, Homo sapiens
gggagccagactgtcca

SEQ ID NO: 5627452 - DNA, 18 bp, Homo sapiens
gggagccagactgtccag

SEQ ID NO: 5627453 - DNA, 21 bp, Homo sapiens
gggagccagactgtccaggga

SEQ ID NO: 5627454 - DNA, 14 bp, Homo sapiens
gggagccagaggcc

SEQ ID NO: 5627455 - DNA, 15 bp, Homo sapiens
gggagccagaggcca

SEQ ID NO: 5627456 - DNA, 18 bp, Homo sapiens
gggagccagaggccagga

SEQ ID NO: 5627457 - DNA, 11 bp, Homo sapiens
gggagccagcc

SEQ ID NO: 5627458 - DNA, 15 bp, Homo sapiens
gggagccagctgctt

SEQ ID NO: 5627459 - DNA, 11 bp, Homo sapiens
gggagccaggg

SEQ ID NO: 5627460 - DNA, 12 bp, Homo sapiens
gggagccagtgt

SEQ ID NO: 5627461 - DNA, 13 bp, Homo sapiens
gggagccagttct

SEQ ID NO: 5627462 - DNA, 15 bp, Homo sapiens
gggagccatgctctt

SEQ ID NO: 5627463 - DNA, 12 bp, Homo sapiens
gggagcccagaa

SEQ ID NO: 5627464 - DNA, 22 bp, Homo sapiens
gggagcccagcacactgcttct

SEQ ID NO: 5627465 - DNA, 12 bp, Homo sapiens
gggagccccagg

SEQ ID NO: 5627466 - DNA, 13 bp, Homo sapiens
gggagccccaggg

SEQ ID NO: 5627467 - DNA, 15 bp, Homo sapiens
gggagcccccagcct

SEQ ID NO: 5627468 - DNA, 16 bp, Homo sapiens
gggagcccccagcctg

SEQ ID NO: 5627469 - DNA, 21 bp, Homo sapiens
gggagcccccagcctgtcaga

SEQ ID NO: 5627470 - DNA, 14 bp, Homo sapiens
gggagcccctagga

SEQ ID NO: 5627471 - DNA, 12 bp, Homo sapiens
gggagccctcag

SEQ ID NO: 5627472 - DNA, 11 bp, Homo sapiens
gggagcctccc

SEQ ID NO: 5627473 - DNA, 14 bp, Homo sapiens
gggagcctccccat

SEQ ID NO: 5627474 - DNA, 12 bp, Homo sapiens
gggagcctccct

SEQ ID NO: 5627475 - DNA, 21 bp, Homo sapiens
gggagcctccctgcctcaggc

SEQ ID NO: 5627476 - DNA, 13 bp, Homo sapiens
gggagcctcctgc

SEQ ID NO: 5627477 - DNA, 21 bp, Homo sapiens
gggagcctcgcaacccgtgcc

SEQ ID NO: 5627478 - DNA, 12 bp, Homo sapiens
gggagcctctgg

SEQ ID NO: 5627479 - DNA, 20 bp, Homo sapiens
gggagcctgaggcaggagaa

SEQ ID NO: 5627480 - DNA, 24 bp, Homo sapiens
gggagcctgcgtggcctggggctg

SEQ ID NO: 5627481 - DNA, 13 bp, Homo sapiens
gggagcctggagc

SEQ ID NO: 5627482 - DNA, 18 bp, Homo sapiens
gggagcctggagcccctg

SEQ ID NO: 5627483 - DNA, 13 bp, Homo sapiens
gggagcctgtcct

SEQ ID NO: 5627484 - DNA, 17 bp, Homo sapiens
gggagcctgtggccagc

SEQ ID NO: 5627485 - DNA, 23 bp, Homo sapiens
gggagccttaccaagactcctgc

SEQ ID NO: 5627486 - DNA, 18 bp, Homo sapiens
gggagccttagccgccca

SEQ ID NO: 5627487 - DNA, 16 bp, Homo sapiens
gggagccttgtcagtg

SEQ ID NO: 5627488 - DNA, 22 bp, Homo sapiens
gggagcctttggggggccaccc

SEQ ID NO: 5627489 - DNA, 14 bp, Homo sapiens
gggagcggagcttg

SEQ ID NO: 5627490 - DNA, 20 bp, Homo sapiens
gggagcgtgggctcagcagg

SEQ ID NO: 5627491 - DNA, 23 bp, Homo sapiens
gggagctagaggccacctatgcc

SEQ ID NO: 5627492 - DNA, 18 bp, Homo sapiens
gggagctcctctcctgga

SEQ ID NO: 5627493 - DNA, 22 bp, Homo sapiens
gggagctcctctcctggaggat

SEQ ID NO: 5627494 - DNA, 16 bp, Homo sapiens
gggagctcctggccag

SEQ ID NO: 5627495 - DNA, 17 bp, Homo sapiens
gggagctctggggacag

SEQ ID NO: 5627496 - DNA, 15 bp, Homo sapiens
gggagctgagctgga

SEQ ID NO: 5627497 - DNA, 18 bp, Homo sapiens
gggagctgaggagccctt

SEQ ID NO: 5627498 - DNA, 17 bp, Homo sapiens
gggagctgaggcctccc

SEQ ID NO: 5627499 - DNA, 15 bp, Homo sapiens
gggagctgaggggca

SEQ ID NO: 5627500 - DNA, 16 bp, Homo sapiens
gggagctgaggggcag

SEQ ID NO: 5627501 - DNA, 14 bp, Homo sapiens
gggagctgcagagc

SEQ ID NO: 5627502 - DNA, 12 bp, Homo sapiens
gggagctgccaa

SEQ ID NO: 5627503 - DNA, 13 bp, Homo sapiens
gggagctgcctgt

SEQ ID NO: 5627504 - DNA, 14 bp, Homo sapiens
gggagctgctggct

SEQ ID NO: 5627505 - DNA, 16 bp, Homo sapiens
gggagctgctgggcta

SEQ ID NO: 5627506 - DNA, 22 bp, Homo sapiens
gggagctgctgggtggcagggg

SEQ ID NO: 5627507 - DNA, 11 bp, Homo sapiens
gggagctggag

SEQ ID NO: 5627508 - DNA, 12 bp, Homo sapiens
gggagctgggag

SEQ ID NO: 5627509 - DNA, 23 bp, Homo sapiens
gggagctgggagaccctccccac

SEQ ID NO: 5627510 - DNA, 12 bp, Homo sapiens
gggagctgggcc

SEQ ID NO: 5627511 - DNA, 19 bp, Homo sapiens
gggagctgggcccgacatg

SEQ ID NO: 5627512 - DNA, 18 bp, Homo sapiens
gggagctgggccctgcct

SEQ ID NO: 5627513 - DNA, 17 bp, Homo sapiens
gggagcttccgctttga

SEQ ID NO: 5627514 - DNA, 22 bp, Homo sapiens
gggagcttccgctttgaaagaa

SEQ ID NO: 5627515 - DNA, 18 bp, Homo sapiens
gggagcttgggactcagg

SEQ ID NO: 5627516 - DNA, 21 bp, Homo sapiens
gggagctttttcagaaacagg

SEQ ID NO: 5627517 - DNA, 12 bp, Homo sapiens
gggaggaaaaaa

SEQ ID NO: 5627518 - DNA, 19 bp, Homo sapiens
gggaggaaacctgagatct

SEQ ID NO: 5627519 - DNA, 13 bp, Homo sapiens
gggaggaagcaga

SEQ ID NO: 5627520 - DNA, 15 bp, Homo sapiens
gggaggaaggcccag

SEQ ID NO: 5627521 - DNA, 16 bp, Homo sapiens
gggaggaagggccagg

SEQ ID NO: 5627522 - DNA, 19 bp, Homo sapiens
gggaggaagggccaggaga

SEQ ID NO: 5627523 - DNA, 22 bp, Homo sapiens
gggaggaatcttttactgtgga

SEQ ID NO: 5627524 - DNA, 20 bp, Homo sapiens
gggaggacatgcgtgtgtca

SEQ ID NO: 5627525 - DNA, 23 bp, Homo sapiens
gggaggacatgcgtgtgtcaggg

SEQ ID NO: 5627526 - DNA, 12 bp, Homo sapiens
gggaggacccct

SEQ ID NO: 5627527 - DNA, 19 bp, Homo sapiens
gggaggacctgaccctact

SEQ ID NO: 5627528 - DNA, 13 bp, Homo sapiens
gggaggacctggg

SEQ ID NO: 5627529 - DNA, 16 bp, Homo sapiens
gggaggacctggggca

SEQ ID NO: 5627530 - DNA, 17 bp, Homo sapiens
gggaggacgctctctgg

SEQ ID NO: 5627531 - DNA, 20 bp, Homo sapiens
gggaggacgctctctggcct

SEQ ID NO: 5627532 - DNA, 23 bp, Homo sapiens
gggaggagaagaaaatgttcttc

SEQ ID NO: 5627533 - DNA, 15 bp, Homo sapiens
gggaggagactcagg

SEQ ID NO: 5627534 - DNA, 19 bp, Homo sapiens
gggaggagagccactgggc

SEQ ID NO: 5627535 - DNA, 15 bp, Homo sapiens
gggaggagcagcaag

SEQ ID NO: 5627536 - DNA, 21 bp, Homo sapiens
gggaggagccccagtggtgag

SEQ ID NO: 5627537 - DNA, 14 bp, Homo sapiens
gggaggagcccctg

SEQ ID NO: 5627538 - DNA, 23 bp, Homo sapiens
gggaggagcctgtgcgtcccagc

SEQ ID NO: 5627539 - DNA, 22 bp, Homo sapiens
gggaggagccttggagtgtaat

SEQ ID NO: 5627540 - DNA, 12 bp, Homo sapiens
gggaggaggaaa

SEQ ID NO: 5627541 - DNA, 20 bp, Homo sapiens
gggaggaggaacgggcagcc

SEQ ID NO: 5627542 - DNA, 21 bp, Homo sapiens
gggaggaggaacgggcagcca

SEQ ID NO: 5627543 - DNA, 14 bp, Homo sapiens
gggaggagggagag

SEQ ID NO: 5627544 - DNA, 11 bp, Homo sapiens
gggaggagggg

SEQ ID NO: 5627545 - DNA, 12 bp, Homo sapiens
gggaggagggga

SEQ ID NO: 5627546 - DNA, 13 bp, Homo sapiens
gggaggatacaga

SEQ ID NO: 5627547 - DNA, 18 bp, Homo sapiens
gggaggatacagaggaga

SEQ ID NO: 5627548 - DNA, 23 bp, Homo sapiens
gggaggatcactggagcccagga

SEQ ID NO: 5627549 - DNA, 20 bp, Homo sapiens
gggaggatcctgagctgctg

SEQ ID NO: 5627550 - DNA, 23 bp, Homo sapiens
gggaggatctcttgagcctggga

SEQ ID NO: 5627551 - DNA, 21 bp, Homo sapiens
gggaggatgccacagccccac

SEQ ID NO: 5627552 - DNA, 22 bp, Homo sapiens
gggaggatgttctgggacacag

SEQ ID NO: 5627553 - DNA, 17 bp, Homo sapiens
gggaggcaagaaaagga

SEQ ID NO: 5627554 - DNA, 14 bp, Homo sapiens
gggcagaacactaa

SEQ ID NO: 5627555 - DNA, 14 bp, Homo sapiens
gggcagaaggaaga

SEQ ID NO: 5627556 - DNA, 16 bp, Homo sapiens
gggcagaagggagaag

SEQ ID NO: 5627557 - DNA, 14 bp, Homo sapiens
gggcagaatagctg

SEQ ID NO: 5627558 - DNA, 14 bp, Homo sapiens
gggcagaatcctgg

SEQ ID NO: 5627559 - DNA, 22 bp, Homo sapiens
gggcagaatcctgggcccccag

SEQ ID NO: 5627560 - DNA, 20 bp, Homo sapiens
gggcagaatgaattcgatgc

SEQ ID NO: 5627561 - DNA, 11 bp, Homo sapiens
gggcagacaca

SEQ ID NO: 5627562 - DNA, 16 bp, Homo sapiens
gggcagacaggtggga

SEQ ID NO: 5627563 - DNA, 19 bp, Homo sapiens
gggcagacaggtgggagat

SEQ ID NO: 5627564 - DNA, 19 bp, Homo sapiens
gggcagacattatgtaaaa

SEQ ID NO: 5627565 - DNA, 18 bp, Homo sapiens
gggcagactgtgaacttg

SEQ ID NO: 5627566 - DNA, 15 bp, Homo sapiens
gggcagagaccaccg

SEQ ID NO: 5627567 - DNA, 22 bp, Homo sapiens
gggcagagaccaccgcgcccct

SEQ ID NO: 5627568 - DNA, 11 bp, Homo sapiens
gggcagagagg

SEQ ID NO: 5627569 - DNA, 12 bp, Homo sapiens
gggcagagcaga

SEQ ID NO: 5627570 - DNA, 17 bp, Homo sapiens
gggcagagcagagacca

SEQ ID NO: 5627571 - DNA, 23 bp, Homo sapiens
gggcagagcagagaccatccctg

SEQ ID NO: 5627572 - DNA, 14 bp, Homo sapiens
gggcagagcaggaa

SEQ ID NO: 5627573 - DNA, 18 bp, Homo sapiens
gggcagagccatgggcct

SEQ ID NO: 5627574 - DNA, 13 bp, Homo sapiens
gggcagagccggg

SEQ ID NO: 5627575 - DNA, 14 bp, Homo sapiens
gggcagagctcaga

SEQ ID NO: 5627576 - DNA, 16 bp, Homo sapiens
gggcagagctcagagg

SEQ ID NO: 5627577 - DNA, 17 bp, Homo sapiens
gggcagagctcagagga

SEQ ID NO: 5627578 - DNA, 16 bp, Homo sapiens
gggcagagctggctct

SEQ ID NO: 5627579 - DNA, 19 bp, Homo sapiens
gggcagagcttgtagccct

SEQ ID NO: 5627580 - DNA, 14 bp, Homo sapiens
gggcagaggaagcc

SEQ ID NO: 5627581 - DNA, 15 bp, Homo sapiens
gggcagaggagaact

SEQ ID NO: 5627582 - DNA, 23 bp, Homo sapiens
gggcagaggagaacttgctgcct

SEQ ID NO: 5627583 - DNA, 22 bp, Homo sapiens
gggcagaggatgaggtgggctg

SEQ ID NO: 5627584 - DNA, 15 bp, Homo sapiens
gggcagaggcaagga

SEQ ID NO: 5627585 - DNA, 21 bp, Homo sapiens
gggcagaggctggaggcaggg

SEQ ID NO: 5627586 - DNA, 14 bp, Homo sapiens
gggcagagggcaga

SEQ ID NO: 5627587 - DNA, 17 bp, Homo sapiens
gggcagagtggagccca

SEQ ID NO: 5627588 - DNA, 18 bp, Homo sapiens
gggcagagtggcctgtga

SEQ ID NO: 5627589 - DNA, 20 bp, Homo sapiens
gggcagagtggcctgtgagc

SEQ ID NO: 5627590 - DNA, 21 bp, Homo sapiens
gggcagagtggcctgtgagca

SEQ ID NO: 5627591 - DNA, 16 bp, Homo sapiens
gggcagatctcccaca

SEQ ID NO: 5627592 - DNA, 22 bp, Homo sapiens
gggcagatcttggactcatgag

SEQ ID NO: 5627593 - DNA, 15 bp, Homo sapiens
gggcagatcttttct

SEQ ID NO: 5627594 - DNA, 17 bp, Homo sapiens
gggcagatgaaaagcta

SEQ ID NO: 5627595 - DNA, 23 bp, Homo sapiens
gggcagattggttcatgcctggg

SEQ ID NO: 5627596 - DNA, 13 bp, Homo sapiens
gggcagcaaggcc

SEQ ID NO: 5627597 - DNA, 15 bp, Homo sapiens
gggcagcaagggacc

SEQ ID NO: 5627598 - DNA, 18 bp, Homo sapiens
gggcagcaattcacgctg

SEQ ID NO: 5627599 - DNA, 13 bp, Homo sapiens
gggcagcacagca

SEQ ID NO: 5627600 - DNA, 17 bp, Homo sapiens
gggcagcacctccggga

SEQ ID NO: 5627601 - DNA, 15 bp, Homo sapiens
gggcagcacctctgc

SEQ ID NO: 5627602 - DNA, 19 bp, Homo sapiens
gggcagcactgggaagctg

SEQ ID NO: 5627603 - DNA, 10 bp, Homo sapiens
gggcagcaga

SEQ ID NO: 5627604 - DNA, 11 bp, Homo sapiens
gggcagcagag

SEQ ID NO: 5627605 - DNA, 12 bp, Homo sapiens
gggcagcagaga

SEQ ID NO: 5627606 - DNA, 14 bp, Homo sapiens
gggcagcagagaga

SEQ ID NO: 5627607 - DNA, 16 bp, Homo sapiens
gggcagcagagagaga

SEQ ID NO: 5627608 - DNA, 16 bp, Homo sapiens
gggcagcagcagccct

SEQ ID NO: 5627609 - DNA, 22 bp, Homo sapiens
gggcagcagcatcccagccttg

SEQ ID NO: 5627610 - DNA, 11 bp, Homo sapiens
gggcagcagcc

SEQ ID NO: 5627611 - DNA, 13 bp, Homo sapiens
gggcagcagccag

SEQ ID NO: 5627612 - DNA, 17 bp, Homo sapiens
gggcagcagccagccct

SEQ ID NO: 5627613 - DNA, 13 bp, Homo sapiens
gggcagcaggagc

SEQ ID NO: 5627614 - DNA, 11 bp, Homo sapiens
gggcagcaggg

SEQ ID NO: 5627615 - DNA, 12 bp, Homo sapiens
gggcagcagggg

SEQ ID NO: 5627616 - DNA, 19 bp, Homo sapiens
gggcagcagttgaggtggg

SEQ ID NO: 5627617 - DNA, 12 bp, Homo sapiens
gggcagccacac

SEQ ID NO: 5627618 - DNA, 22 bp, Homo sapiens
gggcagccacaggactgagccc

SEQ ID NO: 5627619 - DNA, 22 bp, Homo sapiens
gggcagccacccaagcctgctg

SEQ ID NO: 5627620 - DNA, 13 bp, Homo sapiens
gggcagccagcag

SEQ ID NO: 5627621 - DNA, 14 bp, Homo sapiens
gggcagccagccct

SEQ ID NO: 5627622 - DNA, 16 bp, Homo sapiens
gggcagccaggagtgc

SEQ ID NO: 5627623 - DNA, 16 bp, Homo sapiens
gggcagccaggctgcc

SEQ ID NO: 5627624 - DNA, 22 bp, Homo sapiens
gggcagccagggagagcccagg

SEQ ID NO: 5627625 - DNA, 16 bp, Homo sapiens
gggcagccaggggctg

SEQ ID NO: 5627626 - DNA, 20 bp, Homo sapiens
gggcagcccaacagcacttt

SEQ ID NO: 5627627 - DNA, 12 bp, Homo sapiens
gggcagcccaga

SEQ ID NO: 5627628 - DNA, 13 bp, Homo sapiens
gggcagcccagcc

SEQ ID NO: 5627629 - DNA, 16 bp, Homo sapiens
gggcagccccagagag

SEQ ID NO: 5627630 - DNA, 13 bp, Homo sapiens
gggcagccccagg

SEQ ID NO: 5627631 - DNA, 22 bp, Homo sapiens
gggcagccccgacccctgtcca

SEQ ID NO: 5627632 - DNA, 19 bp, Homo sapiens
gggcagccccgcgaccacc

SEQ ID NO: 5627633 - DNA, 23 bp, Homo sapiens
gggcagccccgttttggggacgt

SEQ ID NO: 5627634 - DNA, 12 bp, Homo sapiens
gggcagcccctc

SEQ ID NO: 5627635 - DNA, 16 bp, Homo sapiens
gggcagcccctcccca

SEQ ID NO: 5627636 - DNA, 16 bp, Homo sapiens
gggcagcccctgctgg

SEQ ID NO: 5627637 - DNA, 20 bp, Homo sapiens
gggcagccctccacttctgg

SEQ ID NO: 5627638 - DNA, 13 bp, Homo sapiens
gggcagccctcct

SEQ ID NO: 5627639 - DNA, 18 bp, Homo sapiens
gggcagccctccttacca

SEQ ID NO: 5627640 - DNA, 13 bp, Homo sapiens
gggcagccctgag

SEQ ID NO: 5627641 - DNA, 14 bp, Homo sapiens
gggcagcccttgct

SEQ ID NO: 5627642 - DNA, 17 bp, Homo sapiens
gggcagccgctaggaga

SEQ ID NO: 5627643 - DNA, 22 bp, Homo sapiens
gggcagccgctaggagagactg

SEQ ID NO: 5627644 - DNA, 15 bp, Homo sapiens
gggcagcctcccccg

SEQ ID NO: 5627645 - DNA, 11 bp, Homo sapiens
gggcagcctcg

SEQ ID NO: 5627646 - DNA, 15 bp, Homo sapiens
gggcagcctggctcc

SEQ ID NO: 5627647 - DNA, 22 bp, Homo sapiens
gggcagcctggctcccaggaca

SEQ ID NO: 5627648 - DNA, 17 bp, Homo sapiens
gggcagcctgtgggaga

SEQ ID NO: 5627649 - DNA, 23 bp, Homo sapiens
gggcagccttgggggggctgcct

SEQ ID NO: 5627650 - DNA, 15 bp, Homo sapiens
gggcagcgccaggct

SEQ ID NO: 5627651 - DNA, 17 bp, Homo sapiens
gggcagcggctccactt

SEQ ID NO: 5627652 - DNA, 16 bp, Homo sapiens
gggcagcgggccaggc

SEQ ID NO: 5627653 - DNA, 21 bp, Homo sapiens
gggcagcgggccaggcccgca

SEQ ID NO: 5627654 - DNA, 18 bp, Homo sapiens
gggcagcggggctggcca

SEQ ID NO: 5627655 - DNA, 17 bp, Homo sapiens
gggcagctccatcctct

SEQ ID NO: 5627656 - DNA, 14 bp, Homo sapiens
gggcagctcctgac

SEQ ID NO: 5627657 - DNA, 15 bp, Homo sapiens
gggcagctcctgacc

SEQ ID NO: 5627658 - DNA, 20 bp, Homo sapiens
gggcagctcctgaccaaaga

SEQ ID NO: 5627659 - DNA, 12 bp, Homo sapiens
gggcagctgcca

SEQ ID NO: 5627660 - DNA, 17 bp, Homo sapiens
gggcagctgcctggcca

SEQ ID NO: 5627661 - DNA, 12 bp, Homo sapiens
gggcagctgcta

SEQ ID NO: 5627662 - DNA, 18 bp, Homo sapiens
gggcagctggcaggagag

SEQ ID NO: 5627663 - DNA, 12 bp, Homo sapiens
gggcagctggcc

SEQ ID NO: 5627664 - DNA, 18 bp, Homo sapiens
gggcagctggcccccagc

SEQ ID NO: 5627665 - DNA, 13 bp, Homo sapiens
gggcagctggctc

SEQ ID NO: 5627666 - DNA, 17 bp, Homo sapiens
gggcagctgggcccaac

SEQ ID NO: 5627667 - DNA, 20 bp, Homo sapiens
gggcagcttagggccctgga

SEQ ID NO: 5627668 - DNA, 16 bp, Homo sapiens
gggcagcttgggctgg

SEQ ID NO: 5627669 - DNA, 17 bp, Homo sapiens
gggcagcttgggctggc

SEQ ID NO: 5627670 - DNA, 20 bp, Homo sapiens
gggcaggaaagccacatctt

SEQ ID NO: 5627671 - DNA, 15 bp, Homo sapiens
gggcaggaaggggaa

SEQ ID NO: 5627672 - DNA, 17 bp, Homo sapiens
gggcaggaccagcccac

SEQ ID NO: 5627673 - DNA, 19 bp, Homo sapiens
gggcaggagaggctgggct

SEQ ID NO: 5627674 - DNA, 14 bp, Homo sapiens
gggcaggagctgct

SEQ ID NO: 5627675 - DNA, 13 bp, Homo sapiens
gggcaggaggcct

SEQ ID NO: 5627676 - DNA, 20 bp, Homo sapiens
gggcaggagtagctgagctc

SEQ ID NO: 5627677 - DNA, 15 bp, Homo sapiens
gggcaggagtgccag

SEQ ID NO: 5627678 - DNA, 18 bp, Homo sapiens
gggcaggagtgccaggac

SEQ ID NO: 5627679 - DNA, 21 bp, Homo sapiens
gggcaggagtgccaggaccag

SEQ ID NO: 5627680 - DNA, 22 bp, Homo sapiens
gggcaggagtgccaggaccagc

SEQ ID NO: 5627681 - DNA, 21 bp, Homo sapiens
gggcaggatctcaagccagcc

SEQ ID NO: 5627682 - DNA, 22 bp, Homo sapiens
gggcaggatctcaagccagccc

SEQ ID NO: 5627683 - DNA, 13 bp, Homo sapiens
gggcaggcacagc

SEQ ID NO: 5627684 - DNA, 14 bp, Homo sapiens
gggcaggcacagca

SEQ ID NO: 5627685 - DNA, 15 bp, Homo sapiens
gggcaggcagctagg

SEQ ID NO: 5627686 - DNA, 11 bp, Homo sapiens
gggcaggccag

SEQ ID NO: 5627687 - DNA, 22 bp, Homo sapiens
gggcaggccagcttcgtgctgg

SEQ ID NO: 5627688 - DNA, 13 bp, Homo sapiens
gggcaggccaggg

SEQ ID NO: 5627689 - DNA, 13 bp, Homo sapiens
gggcaggccctgc

SEQ ID NO: 5627690 - DNA, 14 bp, Homo sapiens
gggcaggccctgca

SEQ ID NO: 5627691 - DNA, 19 bp, Homo sapiens
gggcaggccctgcactgtc

SEQ ID NO: 5627692 - DNA, 22 bp, Homo sapiens
gggcaggccctgcactgtcctg

SEQ ID NO: 5627693 - DNA, 13 bp, Homo sapiens
gggcaggcctccc

SEQ ID NO: 5627694 - DNA, 16 bp, Homo sapiens
gggcaggcctcccaag

SEQ ID NO: 5627695 - DNA, 23 bp, Homo sapiens
gggcaggcctgggacccagctac

SEQ ID NO: 5627696 - DNA, 12 bp, Homo sapiens
gggcaggccttt

SEQ ID NO: 5627697 - DNA, 12 bp, Homo sapiens
gggcaggcggtc

SEQ ID NO: 5627698 - DNA, 14 bp, Homo sapiens
gggcaggcgtgact

SEQ ID NO: 5627699 - DNA, 12 bp, Homo sapiens
gggcaggctgag

SEQ ID NO: 5627700 - DNA, 12 bp, Homo sapiens
gggcaggctggg

SEQ ID NO: 5627701 - DNA, 22 bp, Homo sapiens
gggcagggaaggaatcctggtg

SEQ ID NO: 5627702 - DNA, 15 bp, Homo sapiens
gggcagggaaggaca

SEQ ID NO: 5627703 - DNA, 23 bp, Homo sapiens
gggcagggacccggggtctcctg

SEQ ID NO: 5627704 - DNA, 12 bp, Homo sapiens
gggcagggagcg

SEQ ID NO: 5627705 - DNA, 18 bp, Homo sapiens
gggcagggagctgggccc

SEQ ID NO: 5627706 - DNA, 12 bp, Homo sapiens
gggcagggaggc

SEQ ID NO: 5627707 - DNA, 14 bp, Homo sapiens
gggcagggagtgat

SEQ ID NO: 5627708 - DNA, 19 bp, Homo sapiens
gggcagggatgatggcaga

SEQ ID NO: 5627709 - DNA, 23 bp, Homo sapiens
gggcagggatgatggcagagcca

SEQ ID NO: 5627710 - DNA, 14 bp, Homo sapiens
gggcagggcatgac

SEQ ID NO: 5627711 - DNA, 12 bp, Homo sapiens
gggcagggccca

SEQ ID NO: 5627712 - DNA, 18 bp, Homo sapiens
gggcagggcccagggagg

SEQ ID NO: 5627713 - DNA, 13 bp, Homo sapiens
gggcagggccctg

SEQ ID NO: 5627714 - DNA, 14 bp, Homo sapiens
gggcagggccctgt

SEQ ID NO: 5627715 - DNA, 21 bp, Homo sapiens
gggcagggccctgtggctcca

SEQ ID NO: 5627716 - DNA, 14 bp, Homo sapiens
gggcagggccgcag

SEQ ID NO: 5627717 - DNA, 20 bp, Homo sapiens
gggcagggccgcagggcgct

SEQ ID NO: 5627718 - DNA, 14 bp, Homo sapiens
gggcagggccgccc

SEQ ID NO: 5627719 - DNA, 18 bp, Homo sapiens
gggcagggctcccacaga

SEQ ID NO: 5627720 - DNA, 11 bp, Homo sapiens
gggcagggctg

SEQ ID NO: 5627721 - DNA, 16 bp, Homo sapiens
gggcaggggagccagg

SEQ ID NO: 5627722 - DNA, 21 bp, Homo sapiens
gggcaggggagccagggtaga

SEQ ID NO: 5627723 - DNA, 14 bp, Homo sapiens
gggcaggggcaggg

SEQ ID NO: 5627724 - DNA, 15 bp, Homo sapiens
gggcaggggcctggg

SEQ ID NO: 5627725 - DNA, 17 bp, Homo sapiens
gggcaggggcctgggcc

SEQ ID NO: 5627726 - DNA, 23 bp, Homo sapiens
gggcaggggcgggcggagggagg

SEQ ID NO: 5627727 - DNA, 18 bp, Homo sapiens
gggcagggggacagcagg

SEQ ID NO: 5627728 - DNA, 16 bp, Homo sapiens
gggcaggggtgtcctg

SEQ ID NO: 5627729 - DNA, 17 bp, Homo sapiens
gggcagggtctctgctc

SEQ ID NO: 5627730 - DNA, 16 bp, Homo sapiens
gggcagggtctgggct

SEQ ID NO: 5627731 - DNA, 11 bp, Homo sapiens
gggcagggtgg

SEQ ID NO: 5627732 - DNA, 13 bp, Homo sapiens
gggcagggtgggg

SEQ ID NO: 5627733 - DNA, 18 bp, Homo sapiens
gggcagggtggggggcca

SEQ ID NO: 5627734 - DNA, 16 bp, Homo sapiens
gggcaggtcctgccca

SEQ ID NO: 5627735 - DNA, 19 bp, Homo sapiens
gggcaggtcctggggaggc

SEQ ID NO: 5627736 - DNA, 14 bp, Homo sapiens
gggccccaggggca

SEQ ID NO: 5627737 - DNA, 21 bp, Homo sapiens
gggccccaggggcagcaaggc

SEQ ID NO: 5627738 - DNA, 14 bp, Homo sapiens
gggccccagtcagc

SEQ ID NO: 5627739 - DNA, 18 bp, Homo sapiens
gggccccagtcagcctct

SEQ ID NO: 5627740 - DNA, 19 bp, Homo sapiens
gggccccagtcagcctctc

SEQ ID NO: 5627741 - DNA, 17 bp, Homo sapiens
gggccccatcttgatct

SEQ ID NO: 5627742 - DNA, 23 bp, Homo sapiens
gggccccatcttgatctttgagc

SEQ ID NO: 5627743 - DNA, 17 bp, Homo sapiens
gggccccatgagggtgt

SEQ ID NO: 5627744 - DNA, 12 bp, Homo sapiens
gggccccatgct

SEQ ID NO: 5627745 - DNA, 13 bp, Homo sapiens
gggccccatgctc

SEQ ID NO: 5627746 - DNA, 17 bp, Homo sapiens
gggccccatgctctgcc

SEQ ID NO: 5627747 - DNA, 20 bp, Homo sapiens
gggccccatgctctgcccca

SEQ ID NO: 5627748 - DNA, 23 bp, Homo sapiens
gggccccattcagaactctcaga

SEQ ID NO: 5627749 - DNA, 13 bp, Homo sapiens
gggcccccacagg

SEQ ID NO: 5627750 - DNA, 23 bp, Homo sapiens
gggcccccaccgccggggtcctg

SEQ ID NO: 5627751 - DNA, 12 bp, Homo sapiens
gggcccccagag

SEQ ID NO: 5627752 - DNA, 15 bp, Homo sapiens
gggcccccagagacc

SEQ ID NO: 5627753 - DNA, 23 bp, Homo sapiens
gggcccccagcgagagtccctgc

SEQ ID NO: 5627754 - DNA, 14 bp, Homo sapiens
gggcccccatgcag

SEQ ID NO: 5627755 - DNA, 12 bp, Homo sapiens
gggccccccaac

SEQ ID NO: 5627756 - DNA, 17 bp, Homo sapiens
gggcccccctccttgct

SEQ ID NO: 5627757 - DNA, 13 bp, Homo sapiens
gggcccccgcccc

SEQ ID NO: 5627758 - DNA, 21 bp, Homo sapiens
gggcccccggccacgctccct

SEQ ID NO: 5627759 - DNA, 19 bp, Homo sapiens
gggccccctaccctgcccc

SEQ ID NO: 5627760 - DNA, 17 bp, Homo sapiens
gggccccctgggagagt

SEQ ID NO: 5627761 - DNA, 18 bp, Homo sapiens
gggccccgccagggctgg

SEQ ID NO: 5627762 - DNA, 19 bp, Homo sapiens
gggccccgccagggctggg

SEQ ID NO: 5627763 - DNA, 11 bp, Homo sapiens
gggccccgcct

SEQ ID NO: 5627764 - DNA, 14 bp, Homo sapiens
gggccccgcctcaa

SEQ ID NO: 5627765 - DNA, 18 bp, Homo sapiens
gggccccgggctggagaa

SEQ ID NO: 5627766 - DNA, 14 bp, Homo sapiens
gggccccggggctg

SEQ ID NO: 5627767 - DNA, 16 bp, Homo sapiens
gggccccggggctggc

SEQ ID NO: 5627768 - DNA, 19 bp, Homo sapiens
gggccccggggctggcaag

SEQ ID NO: 5627769 - DNA, 19 bp, Homo sapiens
gggccccgggttcagcctg

SEQ ID NO: 5627770 - DNA, 21 bp, Homo sapiens
gggccccgggttcagcctggc

SEQ ID NO: 5627771 - DNA, 12 bp, Homo sapiens
gggcccctcagg

SEQ ID NO: 5627772 - DNA, 22 bp, Homo sapiens
gggcccctcaggggaagctgct

SEQ ID NO: 5627773 - DNA, 13 bp, Homo sapiens
gggcccctccacg

SEQ ID NO: 5627774 - DNA, 18 bp, Homo sapiens
gggcccctccacgcctcc

SEQ ID NO: 5627775 - DNA, 15 bp, Homo sapiens
gggcccctccaggag

SEQ ID NO: 5627776 - DNA, 14 bp, Homo sapiens
gggcccctcccctc

SEQ ID NO: 5627777 - DNA, 18 bp, Homo sapiens
gggcccctccctacctca

SEQ ID NO: 5627778 - DNA, 19 bp, Homo sapiens
gggcccctccctacctcaa

SEQ ID NO: 5627779 - DNA, 16 bp, Homo sapiens
gggcccctccctctgc

SEQ ID NO: 5627780 - DNA, 18 bp, Homo sapiens
gggcccctccctctgccc

SEQ ID NO: 5627781 - DNA, 19 bp, Homo sapiens
gggcccctccctctgcccc

SEQ ID NO: 5627782 - DNA, 16 bp, Homo sapiens
gggcccctcctccaga

SEQ ID NO: 5627783 - DNA, 21 bp, Homo sapiens
gggcccctcctctgtgctccc

SEQ ID NO: 5627784 - DNA, 15 bp, Homo sapiens
gggcccctctcagcc

SEQ ID NO: 5627785 - DNA, 21 bp, Homo sapiens
gggcccctctccaagcgcctg

SEQ ID NO: 5627786 - DNA, 22 bp, Homo sapiens
gggcccctctccaagcgcctgg

SEQ ID NO: 5627787 - DNA, 23 bp, Homo sapiens
gggcccctctccaagcgcctggc

SEQ ID NO: 5627788 - DNA, 13 bp, Homo sapiens
gggcccctctccc

SEQ ID NO: 5627789 - DNA, 21 bp, Homo sapiens
gggcccctctccccagggaag

SEQ ID NO: 5627790 - DNA, 16 bp, Homo sapiens
gggcccctctgcccag

SEQ ID NO: 5627791 - DNA, 17 bp, Homo sapiens
gggcccctctgcccagc

SEQ ID NO: 5627792 - DNA, 23 bp, Homo sapiens
gggcccctctgcccagcttgggc

SEQ ID NO: 5627793 - DNA, 21 bp, Homo sapiens
gggcccctgaagtgaccccag

SEQ ID NO: 5627794 - DNA, 15 bp, Homo sapiens
gggcccctgaccctc

SEQ ID NO: 5627795 - DNA, 14 bp, Homo sapiens
gggcccctgaggag

SEQ ID NO: 5627796 - DNA, 15 bp, Homo sapiens
gggcccctgcctctc

SEQ ID NO: 5627797 - DNA, 17 bp, Homo sapiens
gggcccctgcctctctg

SEQ ID NO: 5627798 - DNA, 21 bp, Homo sapiens
gggcccctgcctctctgcagg

SEQ ID NO: 5627799 - DNA, 23 bp, Homo sapiens
gggcccctgctccgaggggctca

SEQ ID NO: 5627800 - DNA, 16 bp, Homo sapiens
gggcccctggcccagg

SEQ ID NO: 5627801 - DNA, 12 bp, Homo sapiens
gggcccctggga

SEQ ID NO: 5627802 - DNA, 14 bp, Homo sapiens
gggcccctgggatg

SEQ ID NO: 5627803 - DNA, 14 bp, Homo sapiens
gggcccctgggctt

SEQ ID NO: 5627804 - DNA, 16 bp, Homo sapiens
gggcccctggggacag

SEQ ID NO: 5627805 - DNA, 21 bp, Homo sapiens
gggcccctggggacagagcca

SEQ ID NO: 5627806 - DNA, 22 bp, Homo sapiens
gggccccttccaaatgtccctc

SEQ ID NO: 5627807 - DNA, 12 bp, Homo sapiens
gggccccttgct

SEQ ID NO: 5627808 - DNA, 18 bp, Homo sapiens
gggcccctttgctgaccc

SEQ ID NO: 5627809 - DNA, 19 bp, Homo sapiens
gggcccgaaagctgagacc

SEQ ID NO: 5627810 - DNA, 16 bp, Homo sapiens
gggcccgacaggtggg

SEQ ID NO: 5627811 - DNA, 20 bp, Homo sapiens
gggcccgacaggtgggcctg

SEQ ID NO: 5627812 - DNA, 20 bp, Homo sapiens
gggcccgcactcaggagcac

SEQ ID NO: 5627813 - DNA, 14 bp, Homo sapiens
gggcccgcggggca

SEQ ID NO: 5627814 - DNA, 15 bp, Homo sapiens
gggcccgctgcctct

SEQ ID NO: 5627815 - DNA, 16 bp, Homo sapiens
gggcccgctgcctctt

SEQ ID NO: 5627816 - DNA, 19 bp, Homo sapiens
gggcccgctgcctcttggc

SEQ ID NO: 5627817 - DNA, 11 bp, Homo sapiens
gggcccggacg

SEQ ID NO: 5627818 - DNA, 23 bp, Homo sapiens
gggcccggccacacccagcggcc

SEQ ID NO: 5627819 - DNA, 13 bp, Homo sapiens
gggcccggccagc

SEQ ID NO: 5627820 - DNA, 14 bp, Homo sapiens
gggcccggctgggc

SEQ ID NO: 5627821 - DNA, 19 bp, Homo sapiens
gggcccgggcgcggggagg

SEQ ID NO: 5627822 - DNA, 21 bp, Homo sapiens
gggcccgggttgggtcaccag

SEQ ID NO: 5627823 - DNA, 22 bp, Homo sapiens
gggcccgggttgggtcaccaga

SEQ ID NO: 5627824 - DNA, 15 bp, Homo sapiens
gggcccggtccacag

SEQ ID NO: 5627825 - DNA, 16 bp, Homo sapiens
gggcccgttgtctccc

SEQ ID NO: 5627826 - DNA, 18 bp, Homo sapiens
gggcccgttgtctccctg

SEQ ID NO: 5627827 - DNA, 23 bp, Homo sapiens
gggcccgttgtctccctggccct

SEQ ID NO: 5627828 - DNA, 22 bp, Homo sapiens
gggccctaccctcctgctgagc

SEQ ID NO: 5627829 - DNA, 23 bp, Homo sapiens
gggccctagaagatcacagcagg

SEQ ID NO: 5627830 - DNA, 23 bp, Homo sapiens
gggccctcactcaggaaccctgg

SEQ ID NO: 5627831 - DNA, 13 bp, Homo sapiens
gggccctcagccc

SEQ ID NO: 5627832 - DNA, 15 bp, Homo sapiens
gggccctcagccctc

SEQ ID NO: 5627833 - DNA, 12 bp, Homo sapiens
gggccctcagcg

SEQ ID NO: 5627834 - DNA, 12 bp, Homo sapiens
gggccctcaggc

SEQ ID NO: 5627835 - DNA, 16 bp, Homo sapiens
gggccctccgacagcc

SEQ ID NO: 5627836 - DNA, 19 bp, Homo sapiens
gggccctccgacagccccc

SEQ ID NO: 5627837 - DNA, 20 bp, Homo sapiens
gggccctcctgggcacccca

SEQ ID NO: 5627838 - DNA, 23 bp, Homo sapiens
gggccctccttccctcctgtgcc

SEQ ID NO: 5627839 - DNA, 16 bp, Homo sapiens
gggccctctctccgcc

SEQ ID NO: 5627840 - DNA, 21 bp, Homo sapiens
gggccctctctctgggcccag

SEQ ID NO: 5627841 - DNA, 17 bp, Homo sapiens
gggccctctctgcaccg

SEQ ID NO: 5627842 - DNA, 14 bp, Homo sapiens
gggccctctcttct

SEQ ID NO: 5627843 - DNA, 12 bp, Homo sapiens
gggccctctgta

SEQ ID NO: 5627844 - DNA, 13 bp, Homo sapiens
gggccctgaggaa

SEQ ID NO: 5627845 - DNA, 14 bp, Homo sapiens
gggccctgagtctg

SEQ ID NO: 5627846 - DNA, 9 bp, Homo sapiens
gggccctgc

SEQ ID NO: 5627847 - DNA, 10 bp, Homo sapiens
gggccctgca

SEQ ID NO: 5627848 - DNA, 19 bp, Homo sapiens
gggccctgcacctgtgcag

SEQ ID NO: 5627849 - DNA, 14 bp, Homo sapiens
gggccctgcagctc

SEQ ID NO: 5627850 - DNA, 11 bp, Homo sapiens
gggccctgcat

SEQ ID NO: 5627851 - DNA, 14 bp, Homo sapiens
gggccctgcatgta

SEQ ID NO: 5627852 - DNA, 18 bp, Homo sapiens
gggccctgcattggcctg

SEQ ID NO: 5627853 - DNA, 19 bp, Homo sapiens
gggccctgcattggcctgg

SEQ ID NO: 5627854 - DNA, 21 bp, Homo sapiens
gggccctgcattggcctggcc

SEQ ID NO: 5627855 - DNA, 19 bp, Homo sapiens
gggccctgccccaccccat

SEQ ID NO: 5627856 - DNA, 21 bp, Homo sapiens
gggccctgccccaggcctgga

SEQ ID NO: 5627857 - DNA, 12 bp, Homo sapiens
gggccctgcccg

SEQ ID NO: 5627858 - DNA, 13 bp, Homo sapiens
gggccctgcctcc

SEQ ID NO: 5627859 - DNA, 15 bp, Homo sapiens
gggccctgcctgagg

SEQ ID NO: 5627860 - DNA, 13 bp, Homo sapiens
gggccctgcctgc

SEQ ID NO: 5627861 - DNA, 23 bp, Homo sapiens
gggccctgcctgcagccagggct

SEQ ID NO: 5627862 - DNA, 10 bp, Homo sapiens
gggccctgct

SEQ ID NO: 5627863 - DNA, 15 bp, Homo sapiens
gggccctgctcaggc

SEQ ID NO: 5627864 - DNA, 11 bp, Homo sapiens
gggccctggag

SEQ ID NO: 5627865 - DNA, 15 bp, Homo sapiens
gggccctggagcagc

SEQ ID NO: 5627866 - DNA, 21 bp, Homo sapiens
gggccctggagcagccacccc

SEQ ID NO: 5627867 - DNA, 13 bp, Homo sapiens
gggccctggagct

SEQ ID NO: 5627868 - DNA, 13 bp, Homo sapiens
gggccctggccag

SEQ ID NO: 5627869 - DNA, 14 bp, Homo sapiens
gggccctggccagg

SEQ ID NO: 5627870 - DNA, 12 bp, Homo sapiens
gggccctgggca

SEQ ID NO: 5627871 - DNA, 16 bp, Homo sapiens
gggccctgggcagggc

SEQ ID NO: 5627872 - DNA, 12 bp, Homo sapiens
gggccctgggcc

SEQ ID NO: 5627873 - DNA, 13 bp, Homo sapiens
gggccctgggcct

SEQ ID NO: 5627874 - DNA, 15 bp, Homo sapiens
gggccctgggcctca

SEQ ID NO: 5627875 - DNA, 18 bp, Homo sapiens
gggccctgggcctcagtt

SEQ ID NO: 5627876 - DNA, 14 bp, Homo sapiens
gggccctggggcct

SEQ ID NO: 5627877 - DNA, 17 bp, Homo sapiens
gggccctggggcctgta

SEQ ID NO: 5627878 - DNA, 18 bp, Homo sapiens
gggccctggggcctgtac

SEQ ID NO: 5627879 - DNA, 20 bp, Homo sapiens
gggccctggggcctgtactg

SEQ ID NO: 5627880 - DNA, 20 bp, Homo sapiens
gggccctggggtccccactc

SEQ ID NO: 5627881 - DNA, 19 bp, Homo sapiens
gggccctggtccttccagg

SEQ ID NO: 5627882 - DNA, 21 bp, Homo sapiens
gggccctggtgtttctagcac

SEQ ID NO: 5627883 - DNA, 21 bp, Homo sapiens
gggccctgtgccaggccaaag

SEQ ID NO: 5627884 - DNA, 22 bp, Homo sapiens
gggccctgtggagtccagctct

SEQ ID NO: 5627885 - DNA, 18 bp, Homo sapiens
gggcccttacctgtgacc

SEQ ID NO: 5627886 - DNA, 12 bp, Homo sapiens
gggcccttcccc

SEQ ID NO: 5627887 - DNA, 22 bp, Homo sapiens
gggcccttcctcgcacagggca

SEQ ID NO: 5627888 - DNA, 24 bp, Homo sapiens
gggcccttcctcgcacagggcatg

SEQ ID NO: 5627889 - DNA, 19 bp, Homo sapiens
gggcccttcttgctgccct

SEQ ID NO: 5627890 - DNA, 19 bp, Homo sapiens
gggcccttggccccagagg

SEQ ID NO: 5627891 - DNA, 20 bp, Homo sapiens
gggcccttggccccagagga

SEQ ID NO: 5627892 - DNA, 15 bp, Homo sapiens
gggcccttggggcct

SEQ ID NO: 5627893 - DNA, 18 bp, Homo sapiens
gggcccttggggcctggc

SEQ ID NO: 5627894 - DNA, 19 bp, Homo sapiens
gggcccttggggcctggct

SEQ ID NO: 5627895 - DNA, 20 bp, Homo sapiens
gggcccttggggcctggctt

SEQ ID NO: 5627896 - DNA, 17 bp, Homo sapiens
gggcccttggggctggg

SEQ ID NO: 5627897 - DNA, 20 bp, Homo sapiens
gggccctttcttgcactgtc

SEQ ID NO: 5627898 - DNA, 14 bp, Homo sapiens
gggccctttttccc

SEQ ID NO: 5627899 - DNA, 14 bp, Homo sapiens
gggccgactaagag

SEQ ID NO: 5627900 - DNA, 15 bp, Homo sapiens
gggccgagccacctc

SEQ ID NO: 5627901 - DNA, 13 bp, Homo sapiens
gggccgaggccca

SEQ ID NO: 5627902 - DNA, 15 bp, Homo sapiens
gggccgaggcccagc

SEQ ID NO: 5627903 - DNA, 17 bp, Homo sapiens
gggccgagtccaggagc

SEQ ID NO: 5627904 - DNA, 16 bp, Homo sapiens
gggccgcaccataatg

SEQ ID NO: 5627905 - DNA, 23 bp, Homo sapiens
gggccgcagccacaccgctggct

SEQ ID NO: 5627906 - DNA, 14 bp, Homo sapiens
gggccgcagggcgc

SEQ ID NO: 5627907 - DNA, 18 bp, Homo sapiens
gggccgccacggcctggc

SEQ ID NO: 5627908 - DNA, 21 bp, Homo sapiens
gggccgccgaagggcagcccc

SEQ ID NO: 5627909 - DNA, 21 bp, Homo sapiens
gggccgccgctgaccctgggc

SEQ ID NO: 5627910 - DNA, 14 bp, Homo sapiens
gggccgcctcctcc

SEQ ID NO: 5627911 - DNA, 13 bp, Homo sapiens
gggccgcctgccc

SEQ ID NO: 5627912 - DNA, 14 bp, Homo sapiens
gggccgcctgccct

SEQ ID NO: 5627913 - DNA, 14 bp, Homo sapiens
gggccgcctgcctt

SEQ ID NO: 5627914 - DNA, 14 bp, Homo sapiens
gggccgcgagaggc

SEQ ID NO: 5627915 - DNA, 16 bp, Homo sapiens
gggccgcggccgcccg

SEQ ID NO: 5627916 - DNA, 19 bp, Homo sapiens
gggctatgtagtcataata

SEQ ID NO: 5627917 - DNA, 20 bp, Homo sapiens
gggctatgtgtcacagctct

SEQ ID NO: 5627918 - DNA, 17 bp, Homo sapiens
gggctattccctggaga

SEQ ID NO: 5627919 - DNA, 17 bp, Homo sapiens
gggctatttctctcccc

SEQ ID NO: 5627920 - DNA, 22 bp, Homo sapiens
gggctatttctctccccactga

SEQ ID NO: 5627921 - DNA, 12 bp, Homo sapiens
gggctatttgtg

SEQ ID NO: 5627922 - DNA, 21 bp, Homo sapiens
gggctattttgtttgcttcat

SEQ ID NO: 5627923 - DNA, 13 bp, Homo sapiens
gggctcaagcagt

SEQ ID NO: 5627924 - DNA, 16 bp, Homo sapiens
gggctcacaccagccc

SEQ ID NO: 5627925 - DNA, 17 bp, Homo sapiens
gggctcacaccagccct

SEQ ID NO: 5627926 - DNA, 18 bp, Homo sapiens
gggctcacaccagccctg

SEQ ID NO: 5627927 - DNA, 15 bp, Homo sapiens
gggctcacaggcctc

SEQ ID NO: 5627928 - DNA, 16 bp, Homo sapiens
gggctcacaggcctct

SEQ ID NO: 5627929 - DNA, 19 bp, Homo sapiens
gggctcacagggcaggcct

SEQ ID NO: 5627930 - DNA, 19 bp, Homo sapiens
gggctcaccttaaaggtca

SEQ ID NO: 5627931 - DNA, 20 bp, Homo sapiens
gggctcactacatgggccag

SEQ ID NO: 5627932 - DNA, 18 bp, Homo sapiens
gggctcactgcaggcatg

SEQ ID NO: 5627933 - DNA, 13 bp, Homo sapiens
gggctcagagagg

SEQ ID NO: 5627934 - DNA, 17 bp, Homo sapiens
gggctcagagaggacaa

SEQ ID NO: 5627935 - DNA, 18 bp, Homo sapiens
gggctcagagaggacaaa

SEQ ID NO: 5627936 - DNA, 18 bp, Homo sapiens
gggctcagagctgctgag

SEQ ID NO: 5627937 - DNA, 21 bp, Homo sapiens
gggctcagagctgctgagcag

SEQ ID NO: 5627938 - DNA, 20 bp, Homo sapiens
gggctcagagctttgtcact

SEQ ID NO: 5627939 - DNA, 20 bp, Homo sapiens
gggctcagagtgaccctcag

SEQ ID NO: 5627940 - DNA, 18 bp, Homo sapiens
gggctcagagtggggtag

SEQ ID NO: 5627941 - DNA, 19 bp, Homo sapiens
gggctcagatggactggga

SEQ ID NO: 5627942 - DNA, 19 bp, Homo sapiens
gggctcagatggggcctgg

SEQ ID NO: 5627943 - DNA, 13 bp, Homo sapiens
gggctcagcaagg

SEQ ID NO: 5627944 - DNA, 21 bp, Homo sapiens
gggctcagcaaggccacctct

SEQ ID NO: 5627945 - DNA, 14 bp, Homo sapiens
gggctcagcaaggt

SEQ ID NO: 5627946 - DNA, 15 bp, Homo sapiens
gggctcagcagggct

SEQ ID NO: 5627947 - DNA, 12 bp, Homo sapiens
gggctcagcctg

SEQ ID NO: 5627948 - DNA, 20 bp, Homo sapiens
gggctcagcctggtgggcct

SEQ ID NO: 5627949 - DNA, 23 bp, Homo sapiens
gggctcagctagacattgcaatt

SEQ ID NO: 5627950 - DNA, 22 bp, Homo sapiens
gggctcagctctggctcacaga

SEQ ID NO: 5627951 - DNA, 23 bp, Homo sapiens
gggctcagctctggctcacagac

SEQ ID NO: 5627952 - DNA, 13 bp, Homo sapiens
gggctcaggaaaa

SEQ ID NO: 5627953 - DNA, 20 bp, Homo sapiens
gggctcagggaccacagcaa

SEQ ID NO: 5627954 - DNA, 21 bp, Homo sapiens
gggctcagggagggagggcgg

SEQ ID NO: 5627955 - DNA, 12 bp, Homo sapiens
gggctcagggcc

SEQ ID NO: 5627956 - DNA, 13 bp, Homo sapiens
gggctcagggcca

SEQ ID NO: 5627957 - DNA, 16 bp, Homo sapiens
gggctcagggccaggt

SEQ ID NO: 5627958 - DNA, 19 bp, Homo sapiens
gggctcagggccaggtcct

SEQ ID NO: 5627959 - DNA, 16 bp, Homo sapiens
gggctcagggcctcag

SEQ ID NO: 5627960 - DNA, 14 bp, Homo sapiens
gggctcagggctgg

SEQ ID NO: 5627961 - DNA, 15 bp, Homo sapiens
gggctcagggctgga

SEQ ID NO: 5627962 - DNA, 18 bp, Homo sapiens
gggctcagttctggactg

SEQ ID NO: 5627963 - DNA, 15 bp, Homo sapiens
gggctcatgcctgta

SEQ ID NO: 5627964 - DNA, 18 bp, Homo sapiens
gggctccacacagcagtg

SEQ ID NO: 5627965 - DNA, 16 bp, Homo sapiens
gggctccacgggcagg

SEQ ID NO: 5627966 - DNA, 10 bp, Homo sapiens
gggctccaga

SEQ ID NO: 5627967 - DNA, 23 bp, Homo sapiens
gggctccagcatccagcctgtgt

SEQ ID NO: 5627968 - DNA, 12 bp, Homo sapiens
gggctccagcct

SEQ ID NO: 5627969 - DNA, 14 bp, Homo sapiens
gggctccagcctgt

SEQ ID NO: 5627970 - DNA, 22 bp, Homo sapiens
gggctccatgctgggtctgagg

SEQ ID NO: 5627971 - DNA, 16 bp, Homo sapiens
gggctccatggaggag

SEQ ID NO: 5627972 - DNA, 18 bp, Homo sapiens
gggctccatggaggaggt

SEQ ID NO: 5627973 - DNA, 19 bp, Homo sapiens
gggctcccacgccctcctc

SEQ ID NO: 5627974 - DNA, 13 bp, Homo sapiens
gggctccccccag

SEQ ID NO: 5627975 - DNA, 10 bp, Homo sapiens
gggctccccg

SEQ ID NO: 5627976 - DNA, 18 bp, Homo sapiens
gggctccccttgcccttc

SEQ ID NO: 5627977 - DNA, 19 bp, Homo sapiens
gggctcccgcctccaaccc

SEQ ID NO: 5627978 - DNA, 23 bp, Homo sapiens
gggctcccggagagggagtcagt

SEQ ID NO: 5627979 - DNA, 16 bp, Homo sapiens
gggctcccggcatcct

SEQ ID NO: 5627980 - DNA, 19 bp, Homo sapiens
gggctcccggcatcctgaa

SEQ ID NO: 5627981 - DNA, 15 bp, Homo sapiens
gggctcccgggcccc

SEQ ID NO: 5627982 - DNA, 18 bp, Homo sapiens
gggctccctcctctggca

SEQ ID NO: 5627983 - DNA, 22 bp, Homo sapiens
gggctccctcctctggcaggct

SEQ ID NO: 5627984 - DNA, 15 bp, Homo sapiens
gggctccctcctgga

SEQ ID NO: 5627985 - DNA, 19 bp, Homo sapiens
gggctccctctctggtttc

SEQ ID NO: 5627986 - DNA, 15 bp, Homo sapiens
gggctccctgcctgg

SEQ ID NO: 5627987 - DNA, 14 bp, Homo sapiens
gggctccctggccc

SEQ ID NO: 5627988 - DNA, 17 bp, Homo sapiens
gggctccctggcccagc

SEQ ID NO: 5627989 - DNA, 13 bp, Homo sapiens
gggctcccttccc

SEQ ID NO: 5627990 - DNA, 18 bp, Homo sapiens
gggctcccttcccacctc

SEQ ID NO: 5627991 - DNA, 23 bp, Homo sapiens
gggctccggaggggacccagctc

SEQ ID NO: 5627992 - DNA, 18 bp, Homo sapiens
gggctccgggtcactgct

SEQ ID NO: 5627993 - DNA, 15 bp, Homo sapiens
gggctcctacctggg

SEQ ID NO: 5627994 - DNA, 16 bp, Homo sapiens
gggctcctacctgggg

SEQ ID NO: 5627995 - DNA, 12 bp, Homo sapiens
gggctcctccat

SEQ ID NO: 5627996 - DNA, 12 bp, Homo sapiens
gggctcctccca

SEQ ID NO: 5627997 - DNA, 14 bp, Homo sapiens
gggctcctccctgg

SEQ ID NO: 5627998 - DNA, 19 bp, Homo sapiens
gggctcctcttagctcagc

SEQ ID NO: 5627999 - DNA, 23 bp, Homo sapiens
gggctcctcttagctcagctgag

SEQ ID NO: 5628000 - DNA, 11 bp, Homo sapiens
gggctcctgcc

SEQ ID NO: 5628001 - DNA, 12 bp, Homo sapiens
gggctcctgccc

SEQ ID NO: 5628002 - DNA, 15 bp, Homo sapiens
gggctcctgcccagg

SEQ ID NO: 5628003 - DNA, 17 bp, Homo sapiens
gggctcctgcccaggcc

SEQ ID NO: 5628004 - DNA, 19 bp, Homo sapiens
gggctcctgcccaggccac

SEQ ID NO: 5628005 - DNA, 21 bp, Homo sapiens
gggctcctgcccaggccacag

SEQ ID NO: 5628006 - DNA, 14 bp, Homo sapiens
gggctcctggaacc

SEQ ID NO: 5628007 - DNA, 16 bp, Homo sapiens
gggctcctggcagtga

SEQ ID NO: 5628008 - DNA, 16 bp, Homo sapiens
gggctcctggctgcca

SEQ ID NO: 5628009 - DNA, 18 bp, Homo sapiens
gggctcctggctgccagg

SEQ ID NO: 5628010 - DNA, 20 bp, Homo sapiens
gggctcctggctgccaggcg

SEQ ID NO: 5628011 - DNA, 20 bp, Homo sapiens
gggctcctggggcagagaag

SEQ ID NO: 5628012 - DNA, 21 bp, Homo sapiens
gggctcctgggggtggggagg

SEQ ID NO: 5628013 - DNA, 15 bp, Homo sapiens
gggctcctgggttgg

SEQ ID NO: 5628014 - DNA, 16 bp, Homo sapiens
gggctcctggtggcct

SEQ ID NO: 5628015 - DNA, 14 bp, Homo sapiens
gggctcctgtgccc

SEQ ID NO: 5628016 - DNA, 14 bp, Homo sapiens
gggctccttcccct

SEQ ID NO: 5628017 - DNA, 18 bp, Homo sapiens
gggctccttgtgggcctg

SEQ ID NO: 5628018 - DNA, 19 bp, Homo sapiens
gggctccttgtgggcctgg

SEQ ID NO: 5628019 - DNA, 20 bp, Homo sapiens
gggctccttgtgggcctggg

SEQ ID NO: 5628020 - DNA, 20 bp, Homo sapiens
gggctcctttctccagccag

SEQ ID NO: 5628021 - DNA, 21 bp, Homo sapiens
gggctcctttctccagccagc

SEQ ID NO: 5628022 - DNA, 15 bp, Homo sapiens
gggctcgaggctggt

SEQ ID NO: 5628023 - DNA, 18 bp, Homo sapiens
gggctcgaggctggtgcc

SEQ ID NO: 5628024 - DNA, 21 bp, Homo sapiens
gggctcgagtgcccctgcagg

SEQ ID NO: 5628025 - DNA, 20 bp, Homo sapiens
gggctcgccatgccgggggt

SEQ ID NO: 5628026 - DNA, 23 bp, Homo sapiens
gggctcgccgtgtctcagcctct

SEQ ID NO: 5628027 - DNA, 14 bp, Homo sapiens
gggctcggaggctg

SEQ ID NO: 5628028 - DNA, 18 bp, Homo sapiens
gggctcgggcgctgtggc

SEQ ID NO: 5628029 - DNA, 21 bp, Homo sapiens
gggctcgggcgctgtggctcc

SEQ ID NO: 5628030 - DNA, 16 bp, Homo sapiens
gggctcggggaggcag

SEQ ID NO: 5628031 - DNA, 18 bp, Homo sapiens
gggctcgggtctgggcag

SEQ ID NO: 5628032 - DNA, 14 bp, Homo sapiens
gggctcgtctttgc

SEQ ID NO: 5628033 - DNA, 15 bp, Homo sapiens
gggctctaacgcctg

SEQ ID NO: 5628034 - DNA, 17 bp, Homo sapiens
gggctctaacgcctgag

SEQ ID NO: 5628035 - DNA, 19 bp, Homo sapiens
gggctctaacgcctgagcc

SEQ ID NO: 5628036 - DNA, 18 bp, Homo sapiens
gggctctaggatggggca

SEQ ID NO: 5628037 - DNA, 19 bp, Homo sapiens
gggctctatgcctgcactg

SEQ ID NO: 5628038 - DNA, 16 bp, Homo sapiens
gggctctccaaagggg

SEQ ID NO: 5628039 - DNA, 18 bp, Homo sapiens
gggctctccaaaggggct

SEQ ID NO: 5628040 - DNA, 12 bp, Homo sapiens
gggctctcctgg

SEQ ID NO: 5628041 - DNA, 13 bp, Homo sapiens
gggctctcctggc

SEQ ID NO: 5628042 - DNA, 20 bp, Homo sapiens
gggctctctcacccagcctg

SEQ ID NO: 5628043 - DNA, 19 bp, Homo sapiens
gggctctctgctgtacata

SEQ ID NO: 5628044 - DNA, 15 bp, Homo sapiens
gggctctgaacacac

SEQ ID NO: 5628045 - DNA, 11 bp, Homo sapiens
gggctctgagg

SEQ ID NO: 5628046 - DNA, 14 bp, Homo sapiens
gggctctgcagcac

SEQ ID NO: 5628047 - DNA, 15 bp, Homo sapiens
gggctctgccaccct

SEQ ID NO: 5628048 - DNA, 11 bp, Homo sapiens
gggctctgccc

SEQ ID NO: 5628049 - DNA, 12 bp, Homo sapiens
gggctctgccca

SEQ ID NO: 5628050 - DNA, 20 bp, Homo sapiens
gggctctgccccaggcccta

SEQ ID NO: 5628051 - DNA, 17 bp, Homo sapiens
gggctctgcctcccatc

SEQ ID NO: 5628052 - DNA, 12 bp, Homo sapiens
gggctctgcctt

SEQ ID NO: 5628053 - DNA, 23 bp, Homo sapiens
gggctctgccttctcaggccccg

SEQ ID NO: 5628054 - DNA, 13 bp, Homo sapiens
gggctctgcgtcc

SEQ ID NO: 5628055 - DNA, 19 bp, Homo sapiens
gggctctgcgttggcttct

SEQ ID NO: 5628056 - DNA, 17 bp, Homo sapiens
gggctctggacctcagg

SEQ ID NO: 5628057 - DNA, 13 bp, Homo sapiens
gggctctggagag

SEQ ID NO: 5628058 - DNA, 15 bp, Homo sapiens
gggctctggagagaa

SEQ ID NO: 5628059 - DNA, 16 bp, Homo sapiens
gggctctggccaccct

SEQ ID NO: 5628060 - DNA, 17 bp, Homo sapiens
gggctctggccaccctg

SEQ ID NO: 5628061 - DNA, 14 bp, Homo sapiens
gggctctggcccca

SEQ ID NO: 5628062 - DNA, 17 bp, Homo sapiens
gggctctggctccctgg

SEQ ID NO: 5628063 - DNA, 13 bp, Homo sapiens
gggctctgggttc

SEQ ID NO: 5628064 - DNA, 22 bp, Homo sapiens
gggctctggtgggggctcctga

SEQ ID NO: 5628065 - DNA, 13 bp, Homo sapiens
gggctctgtggca

SEQ ID NO: 5628066 - DNA, 15 bp, Homo sapiens
gggctctgtggcaaa

SEQ ID NO: 5628067 - DNA, 23 bp, Homo sapiens
gggctcttcatctgcctgcgctc

SEQ ID NO: 5628068 - DNA, 13 bp, Homo sapiens
gggctcttcccct

SEQ ID NO: 5628069 - DNA, 12 bp, Homo sapiens
gggctcttctca

SEQ ID NO: 5628070 - DNA, 14 bp, Homo sapiens
gggctctttccctc

SEQ ID NO: 5628071 - DNA, 12 bp, Homo sapiens
gggctgaaccct

SEQ ID NO: 5628072 - DNA, 12 bp, Homo sapiens
gggctgaagcca

SEQ ID NO: 5628073 - DNA, 19 bp, Homo sapiens
gggctgaaggttgaagagg

SEQ ID NO: 5628074 - DNA, 17 bp, Homo sapiens
gggctgaatgacagtga

SEQ ID NO: 5628075 - DNA, 14 bp, Homo sapiens
gggctgacacccag

SEQ ID NO: 5628076 - DNA, 21 bp, Homo sapiens
gggctgacacctaccatgctg

SEQ ID NO: 5628077 - DNA, 22 bp, Homo sapiens
gggctgacacctaccatgctgc

SEQ ID NO: 5628078 - DNA, 23 bp, Homo sapiens
gggctgacacctaccatgctgct

SEQ ID NO: 5628079 - DNA, 16 bp, Homo sapiens
gggctgacccagcatc

SEQ ID NO: 5628080 - DNA, 23 bp, Homo sapiens
gggctgaccttcctcgcagagag

SEQ ID NO: 5628081 - DNA, 20 bp, Homo sapiens
gggctgactgggccagggga

SEQ ID NO: 5628082 - DNA, 18 bp, Homo sapiens
gggctgagagaacctcac

SEQ ID NO: 5628083 - DNA, 15 bp, Homo sapiens
gggctgagagggctg

SEQ ID NO: 5628084 - DNA, 20 bp, Homo sapiens
gggctgagagggctgtggct

SEQ ID NO: 5628085 - DNA, 13 bp, Homo sapiens
gggctgagccatg

SEQ ID NO: 5628086 - DNA, 11 bp, Homo sapiens
gggctgagccc

SEQ ID NO: 5628087 - DNA, 12 bp, Homo sapiens
gggctgagcccc

SEQ ID NO: 5628088 - DNA, 14 bp, Homo sapiens
gggctgagcccctg

SEQ ID NO: 5628089 - DNA, 17 bp, Homo sapiens
gggctgagccctcctga

SEQ ID NO: 5628090 - DNA, 12 bp, Homo sapiens
gggctgagcctg

SEQ ID NO: 5628091 - DNA, 15 bp, Homo sapiens
gggctgagcctggtc

SEQ ID NO: 5628092 - DNA, 15 bp, Homo sapiens
gggctgagctagcct

SEQ ID NO: 5628093 - DNA, 10 bp, Homo sapiens
gggctgagga

SEQ ID NO: 5628094 - DNA, 11 bp, Homo sapiens
gggctgaggaa

SEQ ID NO: 5628095 - DNA, 18 bp, Homo sapiens
gggctgaggacgagaccc

SEQ ID NO: 5628096 - DNA, 18 bp, Homo sapiens
ggggccccgggttcagcc

SEQ ID NO: 5628097 - DNA, 20 bp, Homo sapiens
ggggccccgggttcagcctg

SEQ ID NO: 5628098 - DNA, 22 bp, Homo sapiens
ggggccccgggttcagcctggc

SEQ ID NO: 5628099 - DNA, 20 bp, Homo sapiens
ggggccccgtctcaggtctg

SEQ ID NO: 5628100 - DNA, 17 bp, Homo sapiens
ggggcccctcccctccc

SEQ ID NO: 5628101 - DNA, 17 bp, Homo sapiens
ggggcccctcctctgtg

SEQ ID NO: 5628102 - DNA, 14 bp, Homo sapiens
ggggcccctcggct

SEQ ID NO: 5628103 - DNA, 15 bp, Homo sapiens
ggggcccctctcagc

SEQ ID NO: 5628104 - DNA, 19 bp, Homo sapiens
ggggcccctctcagccctc

SEQ ID NO: 5628105 - DNA, 18 bp, Homo sapiens
ggggcccctggcccagga

SEQ ID NO: 5628106 - DNA, 19 bp, Homo sapiens
ggggcccctggcccaggag

SEQ ID NO: 5628107 - DNA, 21 bp, Homo sapiens
ggggcccctggcccaggagga

SEQ ID NO: 5628108 - DNA, 21 bp, Homo sapiens
ggggcccctttttactcccct

SEQ ID NO: 5628109 - DNA, 22 bp, Homo sapiens
ggggcccctttttactcccctt

SEQ ID NO: 5628110 - DNA, 21 bp, Homo sapiens
ggggcccgcgatgtggaactg

SEQ ID NO: 5628111 - DNA, 22 bp, Homo sapiens
ggggcccggtggcggcagggcc

SEQ ID NO: 5628112 - DNA, 23 bp, Homo sapiens
ggggcccgttgtctccctggccc

SEQ ID NO: 5628113 - DNA, 13 bp, Homo sapiens
ggggccctacctg

SEQ ID NO: 5628114 - DNA, 15 bp, Homo sapiens
ggggccctacctggg

SEQ ID NO: 5628115 - DNA, 16 bp, Homo sapiens
ggggccctacctgggg

SEQ ID NO: 5628116 - DNA, 16 bp, Homo sapiens
ggggccctcttgccag

SEQ ID NO: 5628117 - DNA, 21 bp, Homo sapiens
ggggccctcttgccagcctcc

SEQ ID NO: 5628118 - DNA, 14 bp, Homo sapiens
ggggccctgccctg

SEQ ID NO: 5628119 - DNA, 15 bp, Homo sapiens
ggggccctgcctcct

SEQ ID NO: 5628120 - DNA, 11 bp, Homo sapiens
ggggccctgct

SEQ ID NO: 5628121 - DNA, 16 bp, Homo sapiens
ggggccctggagcagc

SEQ ID NO: 5628122 - DNA, 18 bp, Homo sapiens
ggggccctggagcagcca

SEQ ID NO: 5628123 - DNA, 12 bp, Homo sapiens
ggggccctggtc

SEQ ID NO: 5628124 - DNA, 21 bp, Homo sapiens
ggggccctggtccttccaggc

SEQ ID NO: 5628125 - DNA, 18 bp, Homo sapiens
ggggcccttggggcctgg

SEQ ID NO: 5628126 - DNA, 17 bp, Homo sapiens
ggggccgaggggccagg

SEQ ID NO: 5628127 - DNA, 22 bp, Homo sapiens
ggggccgagtccaggagcccca

SEQ ID NO: 5628128 - DNA, 19 bp, Homo sapiens
ggggccgccgctgaccctg

SEQ ID NO: 5628129 - DNA, 14 bp, Homo sapiens
ggggccgcctgccc

SEQ ID NO: 5628130 - DNA, 16 bp, Homo sapiens
ggggccgcctgccctg

SEQ ID NO: 5628131 - DNA, 21 bp, Homo sapiens
ggggccgctctccccctgcag

SEQ ID NO: 5628132 - DNA, 19 bp, Homo sapiens
ggggccgcttcgccatgtg

SEQ ID NO: 5628133 - DNA, 14 bp, Homo sapiens
ggggccggctggcc

SEQ ID NO: 5628134 - DNA, 22 bp, Homo sapiens
ggggccggttttcctcagctct

SEQ ID NO: 5628135 - DNA, 20 bp, Homo sapiens
ggggcctaataaaactgatg

SEQ ID NO: 5628136 - DNA, 23 bp, Homo sapiens
ggggcctaggcctcagccagaga

SEQ ID NO: 5628137 - DNA, 17 bp, Homo sapiens
ggggcctagtggcttca

SEQ ID NO: 5628138 - DNA, 19 bp, Homo sapiens
ggggcctatcagtgtgccc

SEQ ID NO: 5628139 - DNA, 13 bp, Homo sapiens
ggggcctcagacg

SEQ ID NO: 5628140 - DNA, 14 bp, Homo sapiens
ggggcctcagacga

SEQ ID NO: 5628141 - DNA, 17 bp, Homo sapiens
ggggcctccagaagctg

SEQ ID NO: 5628142 - DNA, 12 bp, Homo sapiens
ggggcctccctg

SEQ ID NO: 5628143 - DNA, 12 bp, Homo sapiens
ggggcctcctcc

SEQ ID NO: 5628144 - DNA, 22 bp, Homo sapiens
ggggcctctggctgcctggccc

SEQ ID NO: 5628145 - DNA, 23 bp, Homo sapiens
ggggcctgaaaaggaaggaccag

SEQ ID NO: 5628146 - DNA, 12 bp, Homo sapiens
ggggcctgagca

SEQ ID NO: 5628147 - DNA, 17 bp, Homo sapiens
ggggcctgagcagtcct

SEQ ID NO: 5628148 - DNA, 11 bp, Homo sapiens
ggggcctgcaa

SEQ ID NO: 5628149 - DNA, 17 bp, Homo sapiens
ggggcctgcaggccagt

SEQ ID NO: 5628150 - DNA, 12 bp, Homo sapiens
ggggcctgccac

SEQ ID NO: 5628151 - DNA, 15 bp, Homo sapiens
ggggcctgcgcaggc

SEQ ID NO: 5628152 - DNA, 21 bp, Homo sapiens
ggggcctgcgcccagagctgg

SEQ ID NO: 5628153 - DNA, 12 bp, Homo sapiens
ggggcctggaca

SEQ ID NO: 5628154 - DNA, 13 bp, Homo sapiens
ggggcctggacag

SEQ ID NO: 5628155 - DNA, 21 bp, Homo sapiens
ggggcctggacctatgcaggg

SEQ ID NO: 5628156 - DNA, 15 bp, Homo sapiens
ggggcctggacctgc

SEQ ID NO: 5628157 - DNA, 16 bp, Homo sapiens
ggggcctggacctgcc

SEQ ID NO: 5628158 - DNA, 13 bp, Homo sapiens
ggggcctggaggt

SEQ ID NO: 5628159 - DNA, 12 bp, Homo sapiens
ggggcctggatg

SEQ ID NO: 5628160 - DNA, 12 bp, Homo sapiens
ggggcctggcct

SEQ ID NO: 5628161 - DNA, 14 bp, Homo sapiens
ggggcctggcctat

SEQ ID NO: 5628162 - DNA, 22 bp, Homo sapiens
ggggcctggcctatttaagccc

SEQ ID NO: 5628163 - DNA, 13 bp, Homo sapiens
ggggcctggcctg

SEQ ID NO: 5628164 - DNA, 13 bp, Homo sapiens
ggggcctggcttg

SEQ ID NO: 5628165 - DNA, 17 bp, Homo sapiens
ggggcctgggaaaggaa

SEQ ID NO: 5628166 - DNA, 14 bp, Homo sapiens
ggggcctgggctgt

SEQ ID NO: 5628167 - DNA, 14 bp, Homo sapiens
ggggcctgtactgc

SEQ ID NO: 5628168 - DNA, 17 bp, Homo sapiens
ggggcctgtactgcctg

SEQ ID NO: 5628169 - DNA, 12 bp, Homo sapiens
ggggcctgtctc

SEQ ID NO: 5628170 - DNA, 19 bp, Homo sapiens
ggggcctgtgtagccagtg

SEQ ID NO: 5628171 - DNA, 12 bp, Homo sapiens
ggggccttcctg

SEQ ID NO: 5628172 - DNA, 19 bp, Homo sapiens
ggggccttgctctgagcac

SEQ ID NO: 5628173 - DNA, 13 bp, Homo sapiens
ggggcgaggcaga

SEQ ID NO: 5628174 - DNA, 14 bp, Homo sapiens
ggggcgagggcggc

SEQ ID NO: 5628175 - DNA, 19 bp, Homo sapiens
ggggcgatcaagtccagag

SEQ ID NO: 5628176 - DNA, 14 bp, Homo sapiens
ggggcgatgctccc

SEQ ID NO: 5628177 - DNA, 15 bp, Homo sapiens
ggggcgcagaggaca

SEQ ID NO: 5628178 - DNA, 18 bp, Homo sapiens
ggggcgcccacccggccc

SEQ ID NO: 5628179 - DNA, 14 bp, Homo sapiens
ggggcgcccacctc

SEQ ID NO: 5628180 - DNA, 17 bp, Homo sapiens
ggggcgccccaagagcc

SEQ ID NO: 5628181 - DNA, 22 bp, Homo sapiens
ggggcgccgcaaaccacactgg

SEQ ID NO: 5628182 - DNA, 13 bp, Homo sapiens
ggggcgcctggag

SEQ ID NO: 5628183 - DNA, 14 bp, Homo sapiens
ggggcgcctggaga

SEQ ID NO: 5628184 - DNA, 15 bp, Homo sapiens
ggggcgcctggagag

SEQ ID NO: 5628185 - DNA, 18 bp, Homo sapiens
ggggcgcctggagggatg

SEQ ID NO: 5628186 - DNA, 12 bp, Homo sapiens
ggggcgctcagg

SEQ ID NO: 5628187 - DNA, 20 bp, Homo sapiens
ggggcgctcaggacccaggc

SEQ ID NO: 5628188 - DNA, 22 bp, Homo sapiens
ggggcgctcaggacccaggccc

SEQ ID NO: 5628189 - DNA, 13 bp, Homo sapiens
ggggcgctggccc

SEQ ID NO: 5628190 - DNA, 14 bp, Homo sapiens
ggggcgctggccca

SEQ ID NO: 5628191 - DNA, 13 bp, Homo sapiens
ggggcgctgtcct

SEQ ID NO: 5628192 - DNA, 13 bp, Homo sapiens
ggggcggaggagg

SEQ ID NO: 5628193 - DNA, 15 bp, Homo sapiens
ggggcggcagggctg

SEQ ID NO: 5628194 - DNA, 21 bp, Homo sapiens
ggggcggcatccgagcccctg

SEQ ID NO: 5628195 - DNA, 12 bp, Homo sapiens
ggggcggctctg

SEQ ID NO: 5628196 - DNA, 15 bp, Homo sapiens
ggggcggctctggga

SEQ ID NO: 5628197 - DNA, 13 bp, Homo sapiens
ggggcgggaggcc

SEQ ID NO: 5628198 - DNA, 13 bp, Homo sapiens
ggggcgggagtga

SEQ ID NO: 5628199 - DNA, 19 bp, Homo sapiens
ggggcgggcagccaggctg

SEQ ID NO: 5628200 - DNA, 17 bp, Homo sapiens
ggggcgggccctgcctg

SEQ ID NO: 5628201 - DNA, 14 bp, Homo sapiens
ggggcgggctcaga

SEQ ID NO: 5628202 - DNA, 13 bp, Homo sapiens
ggggcggggccag

SEQ ID NO: 5628203 - DNA, 20 bp, Homo sapiens
ggggcggggttagagccaag

SEQ ID NO: 5628204 - DNA, 21 bp, Homo sapiens
ggggcggggttagagccaagc

SEQ ID NO: 5628205 - DNA, 19 bp, Homo sapiens
ggggcgggtgacgcccacc

SEQ ID NO: 5628206 - DNA, 18 bp, Homo sapiens
ggggcgtctgttccccct

SEQ ID NO: 5628207 - DNA, 20 bp, Homo sapiens
ggggcgtgagacccagtgca

SEQ ID NO: 5628208 - DNA, 13 bp, Homo sapiens
ggggcgtggctgg

SEQ ID NO: 5628209 - DNA, 15 bp, Homo sapiens
ggggcgtggctggcc

SEQ ID NO: 5628210 - DNA, 20 bp, Homo sapiens
ggggcgttatttatggacca

SEQ ID NO: 5628211 - DNA, 21 bp, Homo sapiens
ggggctaaaggggagaaactg

SEQ ID NO: 5628212 - DNA, 16 bp, Homo sapiens
ggggctaactggcccc

SEQ ID NO: 5628213 - DNA, 17 bp, Homo sapiens
ggggctaactggcccca

SEQ ID NO: 5628214 - DNA, 14 bp, Homo sapiens
ggggctacaagagg

SEQ ID NO: 5628215 - DNA, 15 bp, Homo sapiens
ggggctacaagaggg

SEQ ID NO: 5628216 - DNA, 16 bp, Homo sapiens
ggggctacaagaggga

SEQ ID NO: 5628217 - DNA, 17 bp, Homo sapiens
ggggctacaagagggaa

SEQ ID NO: 5628218 - DNA, 21 bp, Homo sapiens
ggggctagaacctagagaagc

SEQ ID NO: 5628219 - DNA, 15 bp, Homo sapiens
ggggctagcagaagt

SEQ ID NO: 5628220 - DNA, 16 bp, Homo sapiens
ggggctaggggctggg

SEQ ID NO: 5628221 - DNA, 22 bp, Homo sapiens
ggggctatcctgggacctcccc

SEQ ID NO: 5628222 - DNA, 18 bp, Homo sapiens
ggggctattccctggaga

SEQ ID NO: 5628223 - DNA, 15 bp, Homo sapiens
ggggctcactctggc

SEQ ID NO: 5628224 - DNA, 18 bp, Homo sapiens
ggggctcactctggcccc

SEQ ID NO: 5628225 - DNA, 11 bp, Homo sapiens
ggggctcagag

SEQ ID NO: 5628226 - DNA, 12 bp, Homo sapiens
ggggctcagcaa

SEQ ID NO: 5628227 - DNA, 18 bp, Homo sapiens
ggggctcagccctgagct

SEQ ID NO: 5628228 - DNA, 12 bp, Homo sapiens
ggggctcaggat

SEQ ID NO: 5628229 - DNA, 12 bp, Homo sapiens
ggggctcccagc

SEQ ID NO: 5628230 - DNA, 16 bp, Homo sapiens
ggggctcccagccagg

SEQ ID NO: 5628231 - DNA, 19 bp, Homo sapiens
ggggctccctccgccccca

SEQ ID NO: 5628232 - DNA, 14 bp, Homo sapiens
ggggctcctacctg

SEQ ID NO: 5628233 - DNA, 18 bp, Homo sapiens
ggggctcctacctggggg

SEQ ID NO: 5628234 - DNA, 13 bp, Homo sapiens
ggggctcctcctg

SEQ ID NO: 5628235 - DNA, 13 bp, Homo sapiens
ggggctcctgagt

SEQ ID NO: 5628236 - DNA, 14 bp, Homo sapiens
ggggctcctgccca

SEQ ID NO: 5628237 - DNA, 18 bp, Homo sapiens
ggggctcctgcccaggcc

SEQ ID NO: 5628238 - DNA, 20 bp, Homo sapiens
ggggctcctgcccaggccac

SEQ ID NO: 5628239 - DNA, 13 bp, Homo sapiens
ggggctcctggaa

SEQ ID NO: 5628240 - DNA, 12 bp, Homo sapiens
ggggctcctggc

SEQ ID NO: 5628241 - DNA, 14 bp, Homo sapiens
ggggctcctgggtt

SEQ ID NO: 5628242 - DNA, 21 bp, Homo sapiens
ggggctcctttctccagccag

SEQ ID NO: 5628243 - DNA, 18 bp, Homo sapiens
ggggctcgaggctggtgc

SEQ ID NO: 5628244 - DNA, 22 bp, Homo sapiens
ggggctcgagtgcccctgcagg

SEQ ID NO: 5628245 - DNA, 18 bp, Homo sapiens
ggggctctaacgcctgag

SEQ ID NO: 5628246 - DNA, 20 bp, Homo sapiens
ggggctctaacgcctgagcc

SEQ ID NO: 5628247 - DNA, 21 bp, Homo sapiens
ggggctctaacgcctgagccc

SEQ ID NO: 5628248 - DNA, 23 bp, Homo sapiens
ggggctctaacgcctgagcccag

SEQ ID NO: 5628249 - DNA, 22 bp, Homo sapiens
ggggctctagggttgctggagc

SEQ ID NO: 5628250 - DNA, 23 bp, Homo sapiens
ggggctctagggttgctggagcc

SEQ ID NO: 5628251 - DNA, 24 bp, Homo sapiens
ggggctctcatgttttcaactgcc

SEQ ID NO: 5628252 - DNA, 18 bp, Homo sapiens
ggggctctccaaaggggc

SEQ ID NO: 5628253 - DNA, 14 bp, Homo sapiens
ggggctctctgaga

SEQ ID NO: 5628254 - DNA, 13 bp, Homo sapiens
ggggctctgcacc

SEQ ID NO: 5628255 - DNA, 14 bp, Homo sapiens
ggggctctgcaccc

SEQ ID NO: 5628256 - DNA, 12 bp, Homo sapiens
ggggctctgccc

SEQ ID NO: 5628257 - DNA, 19 bp, Homo sapiens
ggggctctgcccacctggg

SEQ ID NO: 5628258 - DNA, 22 bp, Homo sapiens
ggggctctgcccacctggggtc

SEQ ID NO: 5628259 - DNA, 20 bp, Homo sapiens
ggggctctgcttcctcagcc

SEQ ID NO: 5628260 - DNA, 17 bp, Homo sapiens
ggggctctggagagaaa

SEQ ID NO: 5628261 - DNA, 20 bp, Homo sapiens
ggggctctgggtgctgccct

SEQ ID NO: 5628262 - DNA, 13 bp, Homo sapiens
ggggctcttcccc

SEQ ID NO: 5628263 - DNA, 16 bp, Homo sapiens
ggggctcttctgagca

SEQ ID NO: 5628264 - DNA, 11 bp, Homo sapiens
ggggctcttga

SEQ ID NO: 5628265 - DNA, 15 bp, Homo sapiens
ggggctctttccctc

SEQ ID NO: 5628266 - DNA, 18 bp, Homo sapiens
ggggctgaacggggagaa

SEQ ID NO: 5628267 - DNA, 23 bp, Homo sapiens
ggggctgaagttgctctgtaccc

SEQ ID NO: 5628268 - DNA, 18 bp, Homo sapiens
ggggctgacacccaggcc

SEQ ID NO: 5628269 - DNA, 15 bp, Homo sapiens
ggggctgaggagcag

SEQ ID NO: 5628270 - DNA, 21 bp, Homo sapiens
ggggctgaggataccccaaag

SEQ ID NO: 5628271 - DNA, 17 bp, Homo sapiens
ggggctgaggtgggagg

SEQ ID NO: 5628272 - DNA, 12 bp, Homo sapiens
ggggctgcaccg

SEQ ID NO: 5628273 - DNA, 19 bp, Homo sapiens
ggggctgcacctcctaccc

SEQ ID NO: 5628274 - DNA, 23 bp, Homo sapiens
ggggctgcacctcctaccctccc

SEQ ID NO: 5628275 - DNA, 13 bp, Homo sapiens
ggggctgcagcat

SEQ ID NO: 5628276 - DNA, 12 bp, Homo sapiens
ggggctgcaggg

SEQ ID NO: 5628277 - DNA, 23 bp, Homo sapiens
ggggttcccttttttggctgctg

SEQ ID NO: 5628278 - DNA, 21 bp, Homo sapiens
ggggttccgtgtccaccccca

SEQ ID NO: 5628279 - DNA, 20 bp, Homo sapiens
ggggttccttccacttctgg

SEQ ID NO: 5628280 - DNA, 22 bp, Homo sapiens
ggggttctttcttcctctgctg

SEQ ID NO: 5628281 - DNA, 16 bp, Homo sapiens
ggggttgccagaggcc

SEQ ID NO: 5628282 - DNA, 17 bp, Homo sapiens
ggggttgcgggggagct

SEQ ID NO: 5628283 - DNA, 23 bp, Homo sapiens
ggggttgcgggggagctggaaat

SEQ ID NO: 5628284 - DNA, 16 bp, Homo sapiens
ggggttggcagcccac

SEQ ID NO: 5628285 - DNA, 17 bp, Homo sapiens
ggggttgtgaggcctgg

SEQ ID NO: 5628286 - DNA, 23 bp, Homo sapiens
ggggtttaaatatccaggtgtgc

SEQ ID NO: 5628287 - DNA, 16 bp, Homo sapiens
ggggtttgagccctgg

SEQ ID NO: 5628288 - DNA, 18 bp, Homo sapiens
ggggtttgggagtcaggc

SEQ ID NO: 5628289 - DNA, 23 bp, Homo sapiens
ggggtttgggcccctcagagccc

SEQ ID NO: 5628290 - DNA, 20 bp, Homo sapiens
ggggtttgtgtttgattggc

SEQ ID NO: 5628291 - DNA, 20 bp, Homo sapiens
ggggttttatggtggatgag

SEQ ID NO: 5628292 - DNA, 17 bp, Homo sapiens
ggggttttcaatgtgaa

SEQ ID NO: 5628293 - DNA, 16 bp, Homo sapiens
gggtaaaaagtggctg

SEQ ID NO: 5628294 - DNA, 21 bp, Homo sapiens
gggtaaaccctcacatcagag

SEQ ID NO: 5628295 - DNA, 23 bp, Homo sapiens
gggtaaagggcgcaaagggcatg

SEQ ID NO: 5628296 - DNA, 15 bp, Homo sapiens
gggtaaataaatgct

SEQ ID NO: 5628297 - DNA, 15 bp, Homo sapiens
gggtaaatcagggac

SEQ ID NO: 5628298 - DNA, 20 bp, Homo sapiens
gggtaaattataaatgtttc

SEQ ID NO: 5628299 - DNA, 19 bp, Homo sapiens
gggtaacagtgaggctggg

SEQ ID NO: 5628300 - DNA, 20 bp, Homo sapiens
gggtaacagtgaggctggga

SEQ ID NO: 5628301 - DNA, 13 bp, Homo sapiens
gggtaagagagga

SEQ ID NO: 5628302 - DNA, 14 bp, Homo sapiens
gggtaagaggagca

SEQ ID NO: 5628303 - DNA, 16 bp, Homo sapiens
gggtaaggccccctct

SEQ ID NO: 5628304 - DNA, 23 bp, Homo sapiens
gggtaagggactccagaagcagc

SEQ ID NO: 5628305 - DNA, 14 bp, Homo sapiens
gggtaagggaggga

SEQ ID NO: 5628306 - DNA, 16 bp, Homo sapiens
gggtaagggagggaag

SEQ ID NO: 5628307 - DNA, 20 bp, Homo sapiens
gggtaagggatttcttaggg

SEQ ID NO: 5628308 - DNA, 14 bp, Homo sapiens
gggtaaggtgcctt

SEQ ID NO: 5628309 - DNA, 17 bp, Homo sapiens
gggtaagtgagagaggg

SEQ ID NO: 5628310 - DNA, 22 bp, Homo sapiens
gggtaagttgaagggaaatcaa

SEQ ID NO: 5628311 - DNA, 17 bp, Homo sapiens
gggtaattgtacaataa

SEQ ID NO: 5628312 - DNA, 21 bp, Homo sapiens
gggtacagatccccagcccct

SEQ ID NO: 5628313 - DNA, 13 bp, Homo sapiens
gggtacagctggg

SEQ ID NO: 5628314 - DNA, 19 bp, Homo sapiens
gggtacatttctctgagca

SEQ ID NO: 5628315 - DNA, 22 bp, Homo sapiens
gggtaccactgaatctgtacag

SEQ ID NO: 5628316 - DNA, 14 bp, Homo sapiens
gggtaccaggccac

SEQ ID NO: 5628317 - DNA, 19 bp, Homo sapiens
gggtaccatggacggcccc

SEQ ID NO: 5628318 - DNA, 15 bp, Homo sapiens
gggtacccactgctc

SEQ ID NO: 5628319 - DNA, 18 bp, Homo sapiens
gggtacccactgctctgg

SEQ ID NO: 5628320 - DNA, 17 bp, Homo sapiens
gggtacctgcaagcaga

SEQ ID NO: 5628321 - DNA, 12 bp, Homo sapiens
gggtactaaatt

SEQ ID NO: 5628322 - DNA, 17 bp, Homo sapiens
gggtactcagtcagccc

SEQ ID NO: 5628323 - DNA, 22 bp, Homo sapiens
gggtactcagtcagcccagtgg

SEQ ID NO: 5628324 - DNA, 15 bp, Homo sapiens
gggtactccagcagg

SEQ ID NO: 5628325 - DNA, 20 bp, Homo sapiens
gggtactcttgatgtgaaga

SEQ ID NO: 5628326 - DNA, 21 bp, Homo sapiens
gggtactgactgagataagaa

SEQ ID NO: 5628327 - DNA, 11 bp, Homo sapiens
gggtagaaaaa

SEQ ID NO: 5628328 - DNA, 16 bp, Homo sapiens
gggtagaaaatgtttt

SEQ ID NO: 5628329 - DNA, 14 bp, Homo sapiens
gggtagaagccacc

SEQ ID NO: 5628330 - DNA, 23 bp, Homo sapiens
gggtagaagccacccttccctgc

SEQ ID NO: 5628331 - DNA, 24 bp, Homo sapiens
gggtagaccttgagggtgggccag

SEQ ID NO: 5628332 - DNA, 16 bp, Homo sapiens
gggtagacttggagct

SEQ ID NO: 5628333 - DNA, 23 bp, Homo sapiens
gggtagagcggagaaaggaaggg

SEQ ID NO: 5628334 - DNA, 17 bp, Homo sapiens
gggtagaggctgggagg

SEQ ID NO: 5628335 - DNA, 24 bp, Homo sapiens
gggtagatgggtgggggctcctgg

SEQ ID NO: 5628336 - DNA, 19 bp, Homo sapiens
gggtagcagcagaggcagg

SEQ ID NO: 5628337 - DNA, 21 bp, Homo sapiens
gggtagccactggactgacga

SEQ ID NO: 5628338 - DNA, 19 bp, Homo sapiens
gggtagccccgccccagcc

SEQ ID NO: 5628339 - DNA, 14 bp, Homo sapiens
gggtagcccgcctg

SEQ ID NO: 5628340 - DNA, 20 bp, Homo sapiens
gggtagctagcgtgtgccag

SEQ ID NO: 5628341 - DNA, 19 bp, Homo sapiens
gggtagcttctgacctcag

SEQ ID NO: 5628342 - DNA, 13 bp, Homo sapiens
gggtaggcaggat

SEQ ID NO: 5628343 - DNA, 20 bp, Homo sapiens
gggtaggcaggattggggaa

SEQ ID NO: 5628344 - DNA, 22 bp, Homo sapiens
gggtaggctgtctgtgccatgg

SEQ ID NO: 5628345 - DNA, 13 bp, Homo sapiens
gggtagggcagac

SEQ ID NO: 5628346 - DNA, 16 bp, Homo sapiens
gggtagggcagcagat

SEQ ID NO: 5628347 - DNA, 13 bp, Homo sapiens
gggtaggggaagg

SEQ ID NO: 5628348 - DNA, 16 bp, Homo sapiens
gggtaggggagtgtgg

SEQ ID NO: 5628349 - DNA, 14 bp, Homo sapiens
gggtagggggcctg

SEQ ID NO: 5628350 - DNA, 15 bp, Homo sapiens
gggtagggggcctga

SEQ ID NO: 5628351 - DNA, 18 bp, Homo sapiens
gggtaggggtagggagcc

SEQ ID NO: 5628352 - DNA, 22 bp, Homo sapiens
gggtagtgaattggcttccttg

SEQ ID NO: 5628353 - DNA, 17 bp, Homo sapiens
gggtatataaattgggg

SEQ ID NO: 5628354 - DNA, 23 bp, Homo sapiens
gggtatatttttgataccttcaa

SEQ ID NO: 5628355 - DNA, 16 bp, Homo sapiens
gggtatcatgcttcta

SEQ ID NO: 5628356 - DNA, 20 bp, Homo sapiens
gggtatccaagttggactgg

SEQ ID NO: 5628357 - DNA, 21 bp, Homo sapiens
gggtatcccacctccagccca

SEQ ID NO: 5628358 - DNA, 14 bp, Homo sapiens
gggtatcctgtgca

SEQ ID NO: 5628359 - DNA, 22 bp, Homo sapiens
gggtatctcaaatctgctttca

SEQ ID NO: 5628360 - DNA, 22 bp, Homo sapiens
gggtatggcgtaagtacagaga

SEQ ID NO: 5628361 - DNA, 21 bp, Homo sapiens
gggtatgtgtgtgtgggtgtg

SEQ ID NO: 5628362 - DNA, 18 bp, Homo sapiens
gggtatgtgttgccaaag

SEQ ID NO: 5628363 - DNA, 21 bp, Homo sapiens
gggtatgttaacctaggcagt

SEQ ID NO: 5628364 - DNA, 17 bp, Homo sapiens
gggtattagcacctctt

SEQ ID NO: 5628365 - DNA, 23 bp, Homo sapiens
gggtattcccactcaccagccct

SEQ ID NO: 5628366 - DNA, 23 bp, Homo sapiens
gggtattgttaatattaatttat

SEQ ID NO: 5628367 - DNA, 15 bp, Homo sapiens
gggtattttctaatt

SEQ ID NO: 5628368 - DNA, 16 bp, Homo sapiens
gggtattttgtcagtt

SEQ ID NO: 5628369 - DNA, 10 bp, Homo sapiens
gggtattttt

SEQ ID NO: 5628370 - DNA, 16 bp, Homo sapiens
gggtcaaaagagccct

SEQ ID NO: 5628371 - DNA, 17 bp, Homo sapiens
gggtcaactccaaggca

SEQ ID NO: 5628372 - DNA, 12 bp, Homo sapiens
gggtcaagcctc

SEQ ID NO: 5628373 - DNA, 15 bp, Homo sapiens
gggtcaagctgagct

SEQ ID NO: 5628374 - DNA, 16 bp, Homo sapiens
gggtcaagctgagctg

SEQ ID NO: 5628375 - DNA, 13 bp, Homo sapiens
gggtcaagttatt

SEQ ID NO: 5628376 - DNA, 23 bp, Homo sapiens
gggtcaagttattaatttcttca

SEQ ID NO: 5628377 - DNA, 20 bp, Homo sapiens
gggtcacaagtctaaacaat

SEQ ID NO: 5628378 - DNA, 20 bp, Homo sapiens
gggtcacacaaaggcatgct

SEQ ID NO: 5628379 - DNA, 11 bp, Homo sapiens
gggtcacagag

SEQ ID NO: 5628380 - DNA, 13 bp, Homo sapiens
gggtcacaggccc

SEQ ID NO: 5628381 - DNA, 14 bp, Homo sapiens
gggtcacaggccca

SEQ ID NO: 5628382 - DNA, 15 bp, Homo sapiens
gggtcacaggcccag

SEQ ID NO: 5628383 - DNA, 18 bp, Homo sapiens
gggtcacaggcccagaag

SEQ ID NO: 5628384 - DNA, 15 bp, Homo sapiens
gggtcacccatggcc

SEQ ID NO: 5628385 - DNA, 18 bp, Homo sapiens
gggtcacccatggcctca

SEQ ID NO: 5628386 - DNA, 17 bp, Homo sapiens
gggtcaccctctccagc

SEQ ID NO: 5628387 - DNA, 12 bp, Homo sapiens
gggtcaccctgg

SEQ ID NO: 5628388 - DNA, 14 bp, Homo sapiens
gggtcacgcttgcc

SEQ ID NO: 5628389 - DNA, 21 bp, Homo sapiens
gggtcacgttttgcctcatga

SEQ ID NO: 5628390 - DNA, 23 bp, Homo sapiens
gggtcactgaggcctgagaccca

SEQ ID NO: 5628391 - DNA, 18 bp, Homo sapiens
gggtcactggcctctccc

SEQ ID NO: 5628392 - DNA, 23 bp, Homo sapiens
gggtcagaagaagtgggagcagc

SEQ ID NO: 5628393 - DNA, 20 bp, Homo sapiens
gggtcagaggacctgtattt

SEQ ID NO: 5628394 - DNA, 14 bp, Homo sapiens
gggtcagcaggccc

SEQ ID NO: 5628395 - DNA, 20 bp, Homo sapiens
gggtcagcaggggggttggg

SEQ ID NO: 5628396 - DNA, 12 bp, Homo sapiens
gggtcagccagg

SEQ ID NO: 5628397 - DNA, 13 bp, Homo sapiens
gggtcagccaggg

SEQ ID NO: 5628398 - DNA, 17 bp, Homo sapiens
gggtcagccagggccag

SEQ ID NO: 5628399 - DNA, 12 bp, Homo sapiens
gggtcagcccag

SEQ ID NO: 5628400 - DNA, 13 bp, Homo sapiens
gggtcagcccagc

SEQ ID NO: 5628401 - DNA, 12 bp, Homo sapiens
gggtcagctctg

SEQ ID NO: 5628402 - DNA, 19 bp, Homo sapiens
gggtcaggaaggatgagca

SEQ ID NO: 5628403 - DNA, 14 bp, Homo sapiens
gggtcaggagaggg

SEQ ID NO: 5628404 - DNA, 18 bp, Homo sapiens
gggtcaggccgggcagag

SEQ ID NO: 5628405 - DNA, 14 bp, Homo sapiens
gggtcagggggagt

SEQ ID NO: 5628406 - DNA, 19 bp, Homo sapiens
gggtcaggtgtcaggcccg

SEQ ID NO: 5628407 - DNA, 13 bp, Homo sapiens
gggtcagtgctgc

SEQ ID NO: 5628408 - DNA, 17 bp, Homo sapiens
gggtcagtggccaggtg

SEQ ID NO: 5628409 - DNA, 16 bp, Homo sapiens
gggtcagttgggcccc

SEQ ID NO: 5628410 - DNA, 21 bp, Homo sapiens
gggtcatcccagcacctgcca

SEQ ID NO: 5628411 - DNA, 16 bp, Homo sapiens
gggtcatgccctcctc

SEQ ID NO: 5628412 - DNA, 15 bp, Homo sapiens
gggtcatgggcctgt

SEQ ID NO: 5628413 - DNA, 13 bp, Homo sapiens
gggtcatttttaa

SEQ ID NO: 5628414 - DNA, 15 bp, Homo sapiens
gggtccaagagacat

SEQ ID NO: 5628415 - DNA, 12 bp, Homo sapiens
gggtccacagct

SEQ ID NO: 5628416 - DNA, 16 bp, Homo sapiens
gggtccaccctagcct

SEQ ID NO: 5628417 - DNA, 15 bp, Homo sapiens
gggtccacctggaga

SEQ ID NO: 5628418 - DNA, 15 bp, Homo sapiens
gggtccacttgccag

SEQ ID NO: 5628419 - DNA, 21 bp, Homo sapiens
gggtccacttgccagggctct

SEQ ID NO: 5628420 - DNA, 14 bp, Homo sapiens
gggtccagccctcc

SEQ ID NO: 5628421 - DNA, 16 bp, Homo sapiens
gggtccaggaaggcag

SEQ ID NO: 5628422 - DNA, 19 bp, Homo sapiens
gggtccaggaaggcagctg

SEQ ID NO: 5628423 - DNA, 11 bp, Homo sapiens
gggtccaggag

SEQ ID NO: 5628424 - DNA, 20 bp, Homo sapiens
gggtccaggagaagtgctcc

SEQ ID NO: 5628425 - DNA, 18 bp, Homo sapiens
gggtccaggattcctctt

SEQ ID NO: 5628426 - DNA, 20 bp, Homo sapiens
gggtccaggattcctctttt

SEQ ID NO: 5628427 - DNA, 13 bp, Homo sapiens
gggtccaggcccc

SEQ ID NO: 5628428 - DNA, 17 bp, Homo sapiens
gggtccagggagcaggc

SEQ ID NO: 5628429 - DNA, 13 bp, Homo sapiens
gggtccagggctg

SEQ ID NO: 5628430 - DNA, 24 bp, Homo sapiens
gggtccagtctgtgatccttggtg

SEQ ID NO: 5628431 - DNA, 11 bp, Homo sapiens
gggtcccaccc

SEQ ID NO: 5628432 - DNA, 13 bp, Homo sapiens
gggtcccaccccc

SEQ ID NO: 5628433 - DNA, 13 bp, Homo sapiens
gggtcccagcagc

SEQ ID NO: 5628434 - DNA, 16 bp, Homo sapiens
gggtcccagccacccc

SEQ ID NO: 5628435 - DNA, 15 bp, Homo sapiens
gggtcccagctactc

SEQ ID NO: 5628436 - DNA, 11 bp, Homo sapiens
gggtcccagga

SEQ ID NO: 5628437 - DNA, 14 bp, Homo sapiens
gggtcccagggctg

SEQ ID NO: 5628438 - DNA, 16 bp, Homo sapiens
gggtcccagtgggagg

SEQ ID NO: 5628439 - DNA, 15 bp, Homo sapiens
gggtccccactccct

SEQ ID NO: 5628440 - DNA, 18 bp, Homo sapiens
gggtccccagctccccag

SEQ ID NO: 5628441 - DNA, 13 bp, Homo sapiens
gggtccccagggc

SEQ ID NO: 5628442 - DNA, 22 bp, Homo sapiens
gggtccccatcatcccagctgc

SEQ ID NO: 5628443 - DNA, 17 bp, Homo sapiens
gggtcccccctgagtgg

SEQ ID NO: 5628444 - DNA, 19 bp, Homo sapiens
gggtcccccctgagtgggc

SEQ ID NO: 5628445 - DNA, 17 bp, Homo sapiens
gggtccccctcccactt

SEQ ID NO: 5628446 - DNA, 19 bp, Homo sapiens
gggtccccctcccacttga

SEQ ID NO: 5628447 - DNA, 13 bp, Homo sapiens
gggtccccctcct

SEQ ID NO: 5628448 - DNA, 14 bp, Homo sapiens
gggtccccctcctg

SEQ ID NO: 5628449 - DNA, 19 bp, Homo sapiens
gggtcccccttcgtggagc

SEQ ID NO: 5628450 - DNA, 12 bp, Homo sapiens
gggtccccggac

SEQ ID NO: 5628451 - DNA, 14 bp, Homo sapiens
gggtcccctccgcc

SEQ ID NO: 5628452 - DNA, 16 bp, Homo sapiens
gggtcccggccgcgcc

SEQ ID NO: 5628453 - DNA, 23 bp, Homo sapiens
gggtccctcctctcacctctccc

SEQ ID NO: 5628454 - DNA, 23 bp, Homo sapiens
gggtccctgcgtctcctgcccac

SEQ ID NO: 5628455 - DNA, 12 bp, Homo sapiens
gggttttcttaa

SEQ ID NO: 5628456 - DNA, 15 bp, Homo sapiens
gggttttcttttctt

SEQ ID NO: 5628457 - DNA, 23 bp, Homo sapiens
gggttttgccatgttggccaggc

SEQ ID NO: 5628458 - DNA, 18 bp, Homo sapiens
gggttttgtattctctga

SEQ ID NO: 5628459 - DNA, 10 bp, Homo sapiens
gggttttgtt

SEQ ID NO: 5628460 - DNA, 23 bp, Homo sapiens
gggtttttaatctttgtgacagg

SEQ ID NO: 5628461 - DNA, 20 bp, Homo sapiens
gggtttttgtatccagagct

SEQ ID NO: 5628462 - DNA, 21 bp, Homo sapiens
gggttttttttttctgaataa

SEQ ID NO: 5628463 - DNA, 19 bp, Homo sapiens
gggttttttttttttcctt

SEQ ID NO: 5628464 - DNA, 22 bp, Homo sapiens
gggtttttttttttttttctgt

SEQ ID NO: 5628465 - DNA, 22 bp, Homo sapiens
ggtaaaaaaaaattactgttta

SEQ ID NO: 5628466 - DNA, 18 bp, Homo sapiens
ggtaaaaaagaaatgaaa

SEQ ID NO: 5628467 - DNA, 19 bp, Homo sapiens
ggtaaaaacagcagctcat

SEQ ID NO: 5628468 - DNA, 15 bp, Homo sapiens
ggtaaaaagagaagg

SEQ ID NO: 5628469 - DNA, 20 bp, Homo sapiens
ggtaaaaagagaaggcaagc

SEQ ID NO: 5628470 - DNA, 19 bp, Homo sapiens
ggtaaaactcactgtgatc

SEQ ID NO: 5628471 - DNA, 12 bp, Homo sapiens
ggtaaaagtgtt

SEQ ID NO: 5628472 - DNA, 13 bp, Homo sapiens
ggtaaaatacttc

SEQ ID NO: 5628473 - DNA, 23 bp, Homo sapiens
ggtaaaatacttttactctgcct

SEQ ID NO: 5628474 - DNA, 12 bp, Homo sapiens
ggtaaaatcact

SEQ ID NO: 5628475 - DNA, 20 bp, Homo sapiens
ggtaaaatcacttcagatct

SEQ ID NO: 5628476 - DNA, 17 bp, Homo sapiens
ggtaaaatctctgaagg

SEQ ID NO: 5628477 - DNA, 12 bp, Homo sapiens
ggtaaaatgaag

SEQ ID NO: 5628478 - DNA, 13 bp, Homo sapiens
ggtaaaatgaaga

SEQ ID NO: 5628479 - DNA, 14 bp, Homo sapiens
ggtaaaatgaagaa

SEQ ID NO: 5628480 - DNA, 20 bp, Homo sapiens
ggtaaaatgaagaatttaaa

SEQ ID NO: 5628481 - DNA, 17 bp, Homo sapiens
ggtaaaatgtatttttc

SEQ ID NO: 5628482 - DNA, 14 bp, Homo sapiens
ggtaaaattctaaa

SEQ ID NO: 5628483 - DNA, 22 bp, Homo sapiens
ggtaaacagaaatcctttcata

SEQ ID NO: 5628484 - DNA, 23 bp, Homo sapiens
ggtaaacattcctccagcctccc

SEQ ID NO: 5628485 - DNA, 21 bp, Homo sapiens
ggtaaactgatgctttcagat

SEQ ID NO: 5628486 - DNA, 19 bp, Homo sapiens
ggtaaagaaaagcctcagc

SEQ ID NO: 5628487 - DNA, 15 bp, Homo sapiens
ggtaaaggatgaggg

SEQ ID NO: 5628488 - DNA, 13 bp, Homo sapiens
ggtaaagggacag

SEQ ID NO: 5628489 - DNA, 20 bp, Homo sapiens
ggtaaagttaagttgagata

SEQ ID NO: 5628490 - DNA, 16 bp, Homo sapiens
ggtaaagttacacttt

SEQ ID NO: 5628491 - DNA, 19 bp, Homo sapiens
ggtaaataaaaagaaaggc

SEQ ID NO: 5628492 - DNA, 13 bp, Homo sapiens
ggtaaataaagct

SEQ ID NO: 5628493 - DNA, 14 bp, Homo sapiens
ggtaaataaagctc

SEQ ID NO: 5628494 - DNA, 15 bp, Homo sapiens
ggtaaataaatgctg

SEQ ID NO: 5628495 - DNA, 21 bp, Homo sapiens
ggtaaataaatgctgctttgg

SEQ ID NO: 5628496 - DNA, 14 bp, Homo sapiens
ggtaaataactgtg

SEQ ID NO: 5628497 - DNA, 15 bp, Homo sapiens
ggtaaataactgtga

SEQ ID NO: 5628498 - DNA, 18 bp, Homo sapiens
ggtaaatacaagtgaaca

SEQ ID NO: 5628499 - DNA, 20 bp, Homo sapiens
ggtaaataccaagtatttat

SEQ ID NO: 5628500 - DNA, 20 bp, Homo sapiens
ggtaaatagagtgcataaat

SEQ ID NO: 5628501 - DNA, 20 bp, Homo sapiens
ggtaaatatatgttttgaga

SEQ ID NO: 5628502 - DNA, 21 bp, Homo sapiens
ggtaaatatatgttttgagaa

SEQ ID NO: 5628503 - DNA, 13 bp, Homo sapiens
ggtaaatgccaca

SEQ ID NO: 5628504 - DNA, 21 bp, Homo sapiens
ggtaaatgtttcttttaaaga

SEQ ID NO: 5628505 - DNA, 15 bp, Homo sapiens
ggtaaattaagacat

SEQ ID NO: 5628506 - DNA, 11 bp, Homo sapiens
ggtaaattatt

SEQ ID NO: 5628507 - DNA, 12 bp, Homo sapiens
ggtaaattcaga

SEQ ID NO: 5628508 - DNA, 14 bp, Homo sapiens
ggtaaattcttaat

SEQ ID NO: 5628509 - DNA, 22 bp, Homo sapiens
ggtaaattgtcgggggagagag

SEQ ID NO: 5628510 - DNA, 12 bp, Homo sapiens
ggtaaatttttg

SEQ ID NO: 5628511 - DNA, 23 bp, Homo sapiens
ggtaacaaataacctataaagtg

SEQ ID NO: 5628512 - DNA, 12 bp, Homo sapiens
ggtaacactgat

SEQ ID NO: 5628513 - DNA, 14 bp, Homo sapiens
ggtaacagaacagc

SEQ ID NO: 5628514 - DNA, 13 bp, Homo sapiens
ggtaacaggcaga

SEQ ID NO: 5628515 - DNA, 20 bp, Homo sapiens
ggtaacaggcagatacagga

SEQ ID NO: 5628516 - DNA, 19 bp, Homo sapiens
ggtaacagtgaggctggga

SEQ ID NO: 5628517 - DNA, 22 bp, Homo sapiens
ggtaacatagatgcctgggcct

SEQ ID NO: 5628518 - DNA, 22 bp, Homo sapiens
ggtaacatcctttctattgaaa

SEQ ID NO: 5628519 - DNA, 18 bp, Homo sapiens
ggtaacattataaatgac

SEQ ID NO: 5628520 - DNA, 19 bp, Homo sapiens
ggtaacatttatagaagaa

SEQ ID NO: 5628521 - DNA, 15 bp, Homo sapiens
ggtaaccagccacag

SEQ ID NO: 5628522 - DNA, 22 bp, Homo sapiens
ggtaacctagacttcagagaga

SEQ ID NO: 5628523 - DNA, 14 bp, Homo sapiens
ggtaacctgtggtg

SEQ ID NO: 5628524 - DNA, 22 bp, Homo sapiens
ggtaaccttagggacaggtgga

SEQ ID NO: 5628525 - DNA, 18 bp, Homo sapiens
ggtaaccttatatttaca

SEQ ID NO: 5628526 - DNA, 18 bp, Homo sapiens
ggtaactagggaagataa

SEQ ID NO: 5628527 - DNA, 19 bp, Homo sapiens
ggtaactcgaggtggaggg

SEQ ID NO: 5628528 - DNA, 21 bp, Homo sapiens
ggtaactcttggccagagctg

SEQ ID NO: 5628529 - DNA, 19 bp, Homo sapiens
ggtaactgcacctgggcag

SEQ ID NO: 5628530 - DNA, 17 bp, Homo sapiens
ggtaacttgctgtgaaa

SEQ ID NO: 5628531 - DNA, 15 bp, Homo sapiens
ggtaacttttgtagt

SEQ ID NO: 5628532 - DNA, 24 bp, Homo sapiens
ggtaacttttgtgaattaggctgt

SEQ ID NO: 5628533 - DNA, 21 bp, Homo sapiens
ggtaagaaaaagcaaaaggca

SEQ ID NO: 5628534 - DNA, 13 bp, Homo sapiens
ggtaagaaagctg

SEQ ID NO: 5628535 - DNA, 17 bp, Homo sapiens
ggtaagagaatgttata

SEQ ID NO: 5628536 - DNA, 23 bp, Homo sapiens
ggtaagagacagaatgtatctgt

SEQ ID NO: 5628537 - DNA, 14 bp, Homo sapiens
ggtaagaggagcag

SEQ ID NO: 5628538 - DNA, 15 bp, Homo sapiens
ggtaagaggagcaga

SEQ ID NO: 5628539 - DNA, 22 bp, Homo sapiens
ggtaagaggagcagagggcagg

SEQ ID NO: 5628540 - DNA, 20 bp, Homo sapiens
ggtaagagggaaactctgga

SEQ ID NO: 5628541 - DNA, 15 bp, Homo sapiens
ggtaagatgactctg

SEQ ID NO: 5628542 - DNA, 17 bp, Homo sapiens
ggtaagatgactctgag

SEQ ID NO: 5628543 - DNA, 15 bp, Homo sapiens
ggtaagattgttatt

SEQ ID NO: 5628544 - DNA, 16 bp, Homo sapiens
ggtaagcaacatggct

SEQ ID NO: 5628545 - DNA, 15 bp, Homo sapiens
ggtaagcggaataaa

SEQ ID NO: 5628546 - DNA, 21 bp, Homo sapiens
ggtaagctagagagaaaaaga

SEQ ID NO: 5628547 - DNA, 16 bp, Homo sapiens
ggtaaggaggagaaaa

SEQ ID NO: 5628548 - DNA, 11 bp, Homo sapiens
ggtaagggaag

SEQ ID NO: 5628549 - DNA, 16 bp, Homo sapiens
ggtaagggactccaga

SEQ ID NO: 5628550 - DNA, 14 bp, Homo sapiens
ggtaagggagggaa

SEQ ID NO: 5628551 - DNA, 14 bp, Homo sapiens
ggtaagtaaacaga

SEQ ID NO: 5628552 - DNA, 16 bp, Homo sapiens
ggtaagtgttctcatg

SEQ ID NO: 5628553 - DNA, 18 bp, Homo sapiens
ggtaagtgttctcatgaa

SEQ ID NO: 5628554 - DNA, 22 bp, Homo sapiens
ggtaagttccactttggttatt

SEQ ID NO: 5628555 - DNA, 19 bp, Homo sapiens
ggtaagttgttaagagtgg

SEQ ID NO: 5628556 - DNA, 13 bp, Homo sapiens
ggtaataaaactc

SEQ ID NO: 5628557 - DNA, 17 bp, Homo sapiens
ggtaataaatgtgactc

SEQ ID NO: 5628558 - DNA, 19 bp, Homo sapiens
ggtaataagtactgtgtac

SEQ ID NO: 5628559 - DNA, 23 bp, Homo sapiens
ggtaatacccgtcctctcggctg

SEQ ID NO: 5628560 - DNA, 16 bp, Homo sapiens
ggtaataggaagaaca

SEQ ID NO: 5628561 - DNA, 13 bp, Homo sapiens
ggtaatatatata

SEQ ID NO: 5628562 - DNA, 20 bp, Homo sapiens
ggtaatcaatgaatattgaa

SEQ ID NO: 5628563 - DNA, 22 bp, Homo sapiens
ggtaatcaatgaatattgaagt

SEQ ID NO: 5628564 - DNA, 14 bp, Homo sapiens
ggtaatcgacctgc

SEQ ID NO: 5628565 - DNA, 12 bp, Homo sapiens
ggtaatctacac

SEQ ID NO: 5628566 - DNA, 18 bp, Homo sapiens
ggtaatctacaccaatga

SEQ ID NO: 5628567 - DNA, 20 bp, Homo sapiens
ggtaatctacaccaatgaaa

SEQ ID NO: 5628568 - DNA, 13 bp, Homo sapiens
ggtaatctgaaac

SEQ ID NO: 5628569 - DNA, 18 bp, Homo sapiens
ggtaatctgacttctcac

SEQ ID NO: 5628570 - DNA, 15 bp, Homo sapiens
ggtaatgcacatcct

SEQ ID NO: 5628571 - DNA, 18 bp, Homo sapiens
ggtaatggaggccaagcc

SEQ ID NO: 5628572 - DNA, 21 bp, Homo sapiens
ggtaatggaggccaagcctgc

SEQ ID NO: 5628573 - DNA, 18 bp, Homo sapiens
ggtaatgttttgtatata

SEQ ID NO: 5628574 - DNA, 12 bp, Homo sapiens
ggtaattaaaag

SEQ ID NO: 5628575 - DNA, 17 bp, Homo sapiens
ggtaattgtacaataaa

SEQ ID NO: 5628576 - DNA, 18 bp, Homo sapiens
ggtaattgtacaataaat

SEQ ID NO: 5628577 - DNA, 21 bp, Homo sapiens
ggtaatttataaagaaaaata

SEQ ID NO: 5628578 - DNA, 11 bp, Homo sapiens
ggtaattttgg

SEQ ID NO: 5628579 - DNA, 21 bp, Homo sapiens
ggtaattttttttgttttttg

SEQ ID NO: 5628580 - DNA, 20 bp, Homo sapiens
ggtaatttttttttgtaaag

SEQ ID NO: 5628581 - DNA, 13 bp, Homo sapiens
ggtacaaatgtga

SEQ ID NO: 5628582 - DNA, 23 bp, Homo sapiens
ggtacaacctgttctgctttcct

SEQ ID NO: 5628583 - DNA, 16 bp, Homo sapiens
ggtacaacggaggcct

SEQ ID NO: 5628584 - DNA, 18 bp, Homo sapiens
ggtacaactgtatttatt

SEQ ID NO: 5628585 - DNA, 19 bp, Homo sapiens
ggtacaaggggcccagtgc

SEQ ID NO: 5628586 - DNA, 18 bp, Homo sapiens
ggtacaagttctggcaag

SEQ ID NO: 5628587 - DNA, 17 bp, Homo sapiens
ggtacaatctttcacca

SEQ ID NO: 5628588 - DNA, 20 bp, Homo sapiens
ggtacaatctttcaccaagt

SEQ ID NO: 5628589 - DNA, 12 bp, Homo sapiens
ggtacacagagc

SEQ ID NO: 5628590 - DNA, 14 bp, Homo sapiens
ggtacacagagcta

SEQ ID NO: 5628591 - DNA, 14 bp, Homo sapiens
ggtacacagtgaga

SEQ ID NO: 5628592 - DNA, 21 bp, Homo sapiens
ggtacacatgtgttatctacc

SEQ ID NO: 5628593 - DNA, 21 bp, Homo sapiens
ggtacactcttctccattccc

SEQ ID NO: 5628594 - DNA, 10 bp, Homo sapiens
ggtacagaga

SEQ ID NO: 5628595 - DNA, 15 bp, Homo sapiens
ggtacagagaagcca

SEQ ID NO: 5628596 - DNA, 16 bp, Homo sapiens
ggtacagatccccagc

SEQ ID NO: 5628597 - DNA, 23 bp, Homo sapiens
ggtacagcaacaggaatctcaga

SEQ ID NO: 5628598 - DNA, 13 bp, Homo sapiens
ggtacagcagggt

SEQ ID NO: 5628599 - DNA, 21 bp, Homo sapiens
ggtacaggcagttaggtgctg

SEQ ID NO: 5628600 - DNA, 14 bp, Homo sapiens
ggtacagtaaagag

SEQ ID NO: 5628601 - DNA, 17 bp, Homo sapiens
ggtacagttgcaggagc

SEQ ID NO: 5628602 - DNA, 18 bp, Homo sapiens
ggtacagttgcaggagcg

SEQ ID NO: 5628603 - DNA, 15 bp, Homo sapiens
ggtacatatatacca

SEQ ID NO: 5628604 - DNA, 19 bp, Homo sapiens
ggtacattggtaaacattt

SEQ ID NO: 5628605 - DNA, 18 bp, Homo sapiens
ggtacatttctctgagca

SEQ ID NO: 5628606 - DNA, 17 bp, Homo sapiens
ggtaccaaacaaggaag

SEQ ID NO: 5628607 - DNA, 21 bp, Homo sapiens
ggtaccaagatcacaaatagt

SEQ ID NO: 5628608 - DNA, 21 bp, Homo sapiens
ggtaccagcagaaaggttagt

SEQ ID NO: 5628609 - DNA, 13 bp, Homo sapiens
ggtaccagctcac

SEQ ID NO: 5628610 - DNA, 19 bp, Homo sapiens
ggtaccagctcactccctg

SEQ ID NO: 5628611 - DNA, 16 bp, Homo sapiens
ggtaccaggccaccca

SEQ ID NO: 5628612 - DNA, 17 bp, Homo sapiens
ggtaccaggccacccac

SEQ ID NO: 5628613 - DNA, 20 bp, Homo sapiens
ggtaccaggtgtcaggaaac

SEQ ID NO: 5628614 - DNA, 16 bp, Homo sapiens
ggtacccaattcaatt

SEQ ID NO: 5628615 - DNA, 16 bp, Homo sapiens
ggtacccactgctctg

SEQ ID NO: 5628616 - DNA, 12 bp, Homo sapiens
ggtacccagcca

SEQ ID NO: 5628617 - DNA, 18 bp, Homo sapiens
ggtacccccaaaccccca

SEQ ID NO: 5628618 - DNA, 16 bp, Homo sapiens
ggtacccccttctggg

SEQ ID NO: 5628619 - DNA, 14 bp, Homo sapiens
ggtaccctcctggc

SEQ ID NO: 5628620 - DNA, 11 bp, Homo sapiens
ggtaccctggg

SEQ ID NO: 5628621 - DNA, 13 bp, Homo sapiens
ggtaccgatttct

SEQ ID NO: 5628622 - DNA, 14 bp, Homo sapiens
ggtacctcagtttc

SEQ ID NO: 5628623 - DNA, 16 bp, Homo sapiens
ggtacctcagtttctc

SEQ ID NO: 5628624 - DNA, 20 bp, Homo sapiens
ggtacctcatgaggaccagg

SEQ ID NO: 5628625 - DNA, 18 bp, Homo sapiens
ggtacctgcaagcagaac

SEQ ID NO: 5628626 - DNA, 12 bp, Homo sapiens
ggtacctgccct

SEQ ID NO: 5628627 - DNA, 11 bp, Homo sapiens
ggtaccttgca

SEQ ID NO: 5628628 - DNA, 14 bp, Homo sapiens
ggtacggtggcacg

SEQ ID NO: 5628629 - DNA, 14 bp, Homo sapiens
ggtacgtctgggcc

SEQ ID NO: 5628630 - DNA, 13 bp, Homo sapiens
ggtacgtgaccct

SEQ ID NO: 5628631 - DNA, 14 bp, Homo sapiens
ggtactaaatttaa

SEQ ID NO: 5628632 - DNA, 13 bp, Homo sapiens
ggtactaccccag

SEQ ID NO: 5628633 - DNA, 23 bp, Homo sapiens
ggtactactgctgcaaagtgcaa

SEQ ID NO: 5628634 - DNA, 16 bp, Homo sapiens
ggtccatggagtacgg

SEQ ID NO: 5628635 - DNA, 13 bp, Homo sapiens
ggtccatgggcag

SEQ ID NO: 5628636 - DNA, 14 bp, Homo sapiens
ggtccatgggcaga

SEQ ID NO: 5628637 - DNA, 16 bp, Homo sapiens
ggtccatgggcagagc

SEQ ID NO: 5628638 - DNA, 22 bp, Homo sapiens
ggtccatgggggaaatcaagga

SEQ ID NO: 5628639 - DNA, 19 bp, Homo sapiens
ggtccatgtaaatactttc

SEQ ID NO: 5628640 - DNA, 16 bp, Homo sapiens
ggtccatttcatgtga

SEQ ID NO: 5628641 - DNA, 18 bp, Homo sapiens
ggtccatttcatgtgatc

SEQ ID NO: 5628642 - DNA, 16 bp, Homo sapiens
ggtccatttgttcctg

SEQ ID NO: 5628643 - DNA, 19 bp, Homo sapiens
ggtcccaagctgggcccca

SEQ ID NO: 5628644 - DNA, 21 bp, Homo sapiens
ggtcccaattcggggcctgct

SEQ ID NO: 5628645 - DNA, 16 bp, Homo sapiens
ggtcccacatccctgg

SEQ ID NO: 5628646 - DNA, 20 bp, Homo sapiens
ggtcccacatccctgggcct

SEQ ID NO: 5628647 - DNA, 21 bp, Homo sapiens
ggtcccacatccctgggcctg

SEQ ID NO: 5628648 - DNA, 14 bp, Homo sapiens
ggtcccaccccaca

SEQ ID NO: 5628649 - DNA, 16 bp, Homo sapiens
ggtcccaccccacaca

SEQ ID NO: 5628650 - DNA, 12 bp, Homo sapiens
ggtcccacccct

SEQ ID NO: 5628651 - DNA, 17 bp, Homo sapiens
ggtcccacgccaggcca

SEQ ID NO: 5628652 - DNA, 12 bp, Homo sapiens
ggtcccactcag

SEQ ID NO: 5628653 - DNA, 22 bp, Homo sapiens
ggtcccactcagtccatagcag

SEQ ID NO: 5628654 - DNA, 19 bp, Homo sapiens
ggtcccagacagctggacc

SEQ ID NO: 5628655 - DNA, 11 bp, Homo sapiens
ggtcccagccc

SEQ ID NO: 5628656 - DNA, 14 bp, Homo sapiens
ggtcccagccccag

SEQ ID NO: 5628657 - DNA, 21 bp, Homo sapiens
ggtcccagccccaggcctggc

SEQ ID NO: 5628658 - DNA, 17 bp, Homo sapiens
ggtcccagcccctcctc

SEQ ID NO: 5628659 - DNA, 18 bp, Homo sapiens
ggtcccagcccctcctcc

SEQ ID NO: 5628660 - DNA, 22 bp, Homo sapiens
ggtcccagcccctcctccctca

SEQ ID NO: 5628661 - DNA, 14 bp, Homo sapiens
ggtcccagcctggg

SEQ ID NO: 5628662 - DNA, 17 bp, Homo sapiens
ggtcccagcctgggctc

SEQ ID NO: 5628663 - DNA, 20 bp, Homo sapiens
ggtcccagcctgggctcctc

SEQ ID NO: 5628664 - DNA, 12 bp, Homo sapiens
ggtcccagctcc

SEQ ID NO: 5628665 - DNA, 20 bp, Homo sapiens
ggtcccagctccctggctcc

SEQ ID NO: 5628666 - DNA, 17 bp, Homo sapiens
ggtcccaggaagcaggg

SEQ ID NO: 5628667 - DNA, 18 bp, Homo sapiens
ggtcccaggaagcaggga

SEQ ID NO: 5628668 - DNA, 20 bp, Homo sapiens
ggtcccaggaagcagggaga

SEQ ID NO: 5628669 - DNA, 20 bp, Homo sapiens
ggtcccaggacctgagcctg

SEQ ID NO: 5628670 - DNA, 19 bp, Homo sapiens
ggtcccaggatcccctgct

SEQ ID NO: 5628671 - DNA, 12 bp, Homo sapiens
ggtcccaggccg

SEQ ID NO: 5628672 - DNA, 16 bp, Homo sapiens
ggtcccagggccctag

SEQ ID NO: 5628673 - DNA, 14 bp, Homo sapiens
ggtcccagggctgc

SEQ ID NO: 5628674 - DNA, 19 bp, Homo sapiens
ggtcccagggctggcccta

SEQ ID NO: 5628675 - DNA, 19 bp, Homo sapiens
ggtcccagtccggtgcctt

SEQ ID NO: 5628676 - DNA, 16 bp, Homo sapiens
ggtcccagtgccattg

SEQ ID NO: 5628677 - DNA, 20 bp, Homo sapiens
ggtcccagtgggaggggcag

SEQ ID NO: 5628678 - DNA, 22 bp, Homo sapiens
ggtcccagtgggaggggcaggc

SEQ ID NO: 5628679 - DNA, 18 bp, Homo sapiens
ggtcccagttgctgtcac

SEQ ID NO: 5628680 - DNA, 23 bp, Homo sapiens
ggtcccagttttgttgccccaga

SEQ ID NO: 5628681 - DNA, 13 bp, Homo sapiens
ggtcccatccagg

SEQ ID NO: 5628682 - DNA, 16 bp, Homo sapiens
ggtcccatccaggcag

SEQ ID NO: 5628683 - DNA, 17 bp, Homo sapiens
ggtcccatccaggcagt

SEQ ID NO: 5628684 - DNA, 20 bp, Homo sapiens
ggtcccatctgcagggcccc

SEQ ID NO: 5628685 - DNA, 20 bp, Homo sapiens
ggtcccatggctgaagctgg

SEQ ID NO: 5628686 - DNA, 21 bp, Homo sapiens
ggtcccattttccccctgtgt

SEQ ID NO: 5628687 - DNA, 22 bp, Homo sapiens
ggtccccacagactgccccagc

SEQ ID NO: 5628688 - DNA, 12 bp, Homo sapiens
ggtccccactgc

SEQ ID NO: 5628689 - DNA, 14 bp, Homo sapiens
ggtccccactgctg

SEQ ID NO: 5628690 - DNA, 21 bp, Homo sapiens
ggtccccactgctgagctggc

SEQ ID NO: 5628691 - DNA, 22 bp, Homo sapiens
ggtccccactgctgagctggcc

SEQ ID NO: 5628692 - DNA, 13 bp, Homo sapiens
ggtccccagcaga

SEQ ID NO: 5628693 - DNA, 16 bp, Homo sapiens
ggtccccatcatccca

SEQ ID NO: 5628694 - DNA, 14 bp, Homo sapiens
ggtccccatcccca

SEQ ID NO: 5628695 - DNA, 21 bp, Homo sapiens
ggtcccccactctaaagcaaa

SEQ ID NO: 5628696 - DNA, 13 bp, Homo sapiens
ggtcccccagagc

SEQ ID NO: 5628697 - DNA, 23 bp, Homo sapiens
ggtcccccagagcatctgcccca

SEQ ID NO: 5628698 - DNA, 12 bp, Homo sapiens
ggtcccccctcc

SEQ ID NO: 5628699 - DNA, 15 bp, Homo sapiens
ggtcccccctccctg

SEQ ID NO: 5628700 - DNA, 23 bp, Homo sapiens
ggtcccccgaccaatccccagcc

SEQ ID NO: 5628701 - DNA, 17 bp, Homo sapiens
ggtccccgagtgcctag

SEQ ID NO: 5628702 - DNA, 19 bp, Homo sapiens
ggtccccggacgctggctc

SEQ ID NO: 5628703 - DNA, 20 bp, Homo sapiens
ggtccccggacgctggctcg

SEQ ID NO: 5628704 - DNA, 21 bp, Homo sapiens
ggtccccggacgctggctcgg

SEQ ID NO: 5628705 - DNA, 22 bp, Homo sapiens
ggtccccgttccaccccaagag

SEQ ID NO: 5628706 - DNA, 10 bp, Homo sapiens
ggtcccctcc

SEQ ID NO: 5628707 - DNA, 19 bp, Homo sapiens
ggtcccctccacatcccag

SEQ ID NO: 5628708 - DNA, 11 bp, Homo sapiens
ggtcccctccc

SEQ ID NO: 5628709 - DNA, 13 bp, Homo sapiens
ggtcccctcccca

SEQ ID NO: 5628710 - DNA, 14 bp, Homo sapiens
ggtcccctccccag

SEQ ID NO: 5628711 - DNA, 22 bp, Homo sapiens
ggtcccctccctcgtgggcttg

SEQ ID NO: 5628712 - DNA, 18 bp, Homo sapiens
ggtcccctccctctgtct

SEQ ID NO: 5628713 - DNA, 12 bp, Homo sapiens
ggtcccctcctt

SEQ ID NO: 5628714 - DNA, 22 bp, Homo sapiens
ggtcccctctgccccaccctca

SEQ ID NO: 5628715 - DNA, 12 bp, Homo sapiens
ggtcccctgagg

SEQ ID NO: 5628716 - DNA, 22 bp, Homo sapiens
ggtcccctgccaccgactgccc

SEQ ID NO: 5628717 - DNA, 13 bp, Homo sapiens
ggtcccctgccct

SEQ ID NO: 5628718 - DNA, 16 bp, Homo sapiens
ggtcccctgcctggaa

SEQ ID NO: 5628719 - DNA, 18 bp, Homo sapiens
ggtccccttcccaggggc

SEQ ID NO: 5628720 - DNA, 21 bp, Homo sapiens
ggtcccgaatggagtccagac

SEQ ID NO: 5628721 - DNA, 20 bp, Homo sapiens
ggtcccgagccccctgtcct

SEQ ID NO: 5628722 - DNA, 21 bp, Homo sapiens
ggtcccgaggatgctgtcagg

SEQ ID NO: 5628723 - DNA, 17 bp, Homo sapiens
ggtcccgcttagttctt

SEQ ID NO: 5628724 - DNA, 19 bp, Homo sapiens
ggtcccggccgcgccgccg

SEQ ID NO: 5628725 - DNA, 17 bp, Homo sapiens
ggtcccggctctgtggg

SEQ ID NO: 5628726 - DNA, 18 bp, Homo sapiens
ggtcccggctctgtgggt

SEQ ID NO: 5628727 - DNA, 12 bp, Homo sapiens
ggtccctaataa

SEQ ID NO: 5628728 - DNA, 13 bp, Homo sapiens
ggtccctaataaa

SEQ ID NO: 5628729 - DNA, 20 bp, Homo sapiens
ggtccctccagaaccacccc

SEQ ID NO: 5628730 - DNA, 18 bp, Homo sapiens
ggtccctccgcggctgga

SEQ ID NO: 5628731 - DNA, 19 bp, Homo sapiens
ggtccctccgcggctggag

SEQ ID NO: 5628732 - DNA, 21 bp, Homo sapiens
ggtccctccgcggctggagcg

SEQ ID NO: 5628733 - DNA, 13 bp, Homo sapiens
ggtccctctcaga

SEQ ID NO: 5628734 - DNA, 12 bp, Homo sapiens
ggtccctctctt

SEQ ID NO: 5628735 - DNA, 19 bp, Homo sapiens
ggtccctcttctctcctca

SEQ ID NO: 5628736 - DNA, 20 bp, Homo sapiens
ggtccctgataacaacctgg

SEQ ID NO: 5628737 - DNA, 19 bp, Homo sapiens
ggtccctgcagaagccaga

SEQ ID NO: 5628738 - DNA, 21 bp, Homo sapiens
ggtccctgcagaagccagaag

SEQ ID NO: 5628739 - DNA, 12 bp, Homo sapiens
ggtccctgccag

SEQ ID NO: 5628740 - DNA, 15 bp, Homo sapiens
ggtccctgccctccc

SEQ ID NO: 5628741 - DNA, 13 bp, Homo sapiens
ggtccctgcctta

SEQ ID NO: 5628742 - DNA, 13 bp, Homo sapiens
ggtccctgctccc

SEQ ID NO: 5628743 - DNA, 15 bp, Homo sapiens
ggtccctggaagctt

SEQ ID NO: 5628744 - DNA, 22 bp, Homo sapiens
ggtccctggtggcagctcacct

SEQ ID NO: 5628745 - DNA, 21 bp, Homo sapiens
ggtcccttgagacctcagcca

SEQ ID NO: 5628746 - DNA, 13 bp, Homo sapiens
ggtcccttgctgc

SEQ ID NO: 5628747 - DNA, 19 bp, Homo sapiens
ggtcccttgtatcccctgc

SEQ ID NO: 5628748 - DNA, 23 bp, Homo sapiens
ggtccgagagggaagctggctgg

SEQ ID NO: 5628749 - DNA, 16 bp, Homo sapiens
ggtccgagctctgtcc

SEQ ID NO: 5628750 - DNA, 14 bp, Homo sapiens
ggtccgcaccagct

SEQ ID NO: 5628751 - DNA, 17 bp, Homo sapiens
ggtccgcaccagctgct

SEQ ID NO: 5628752 - DNA, 20 bp, Homo sapiens
ggtccgcaccagctgctctg

SEQ ID NO: 5628753 - DNA, 14 bp, Homo sapiens
ggtccgcaccctgt

SEQ ID NO: 5628754 - DNA, 18 bp, Homo sapiens
ggtccgccacgaggagct

SEQ ID NO: 5628755 - DNA, 14 bp, Homo sapiens
ggtccgcggcctgc

SEQ ID NO: 5628756 - DNA, 17 bp, Homo sapiens
ggtccgctttcctggag

SEQ ID NO: 5628757 - DNA, 18 bp, Homo sapiens
ggtccggcctctccctgc

SEQ ID NO: 5628758 - DNA, 15 bp, Homo sapiens
ggtccggcgccccgc

SEQ ID NO: 5628759 - DNA, 15 bp, Homo sapiens
ggtccggggaggagg

SEQ ID NO: 5628760 - DNA, 17 bp, Homo sapiens
ggtccggtgtccttttc

SEQ ID NO: 5628761 - DNA, 14 bp, Homo sapiens
ggtccgtagctccc

SEQ ID NO: 5628762 - DNA, 17 bp, Homo sapiens
ggtccgtagctcccctg

SEQ ID NO: 5628763 - DNA, 19 bp, Homo sapiens
ggtccgtccggtgtgtcag

SEQ ID NO: 5628764 - DNA, 20 bp, Homo sapiens
ggtccgtgcccaggcccttg

SEQ ID NO: 5628765 - DNA, 14 bp, Homo sapiens
ggtccgtgcgggaa

SEQ ID NO: 5628766 - DNA, 21 bp, Homo sapiens
ggtccgtgcgggaaattcagt

SEQ ID NO: 5628767 - DNA, 16 bp, Homo sapiens
ggtccgtgctaaggac

SEQ ID NO: 5628768 - DNA, 17 bp, Homo sapiens
ggtcctacccatccccg

SEQ ID NO: 5628769 - DNA, 17 bp, Homo sapiens
ggtcctactcctggagc

SEQ ID NO: 5628770 - DNA, 22 bp, Homo sapiens
ggtcctagcactgcacactcag

SEQ ID NO: 5628771 - DNA, 19 bp, Homo sapiens
ggtcctagcccagtgcttc

SEQ ID NO: 5628772 - DNA, 16 bp, Homo sapiens
ggtcctatggcctcat

SEQ ID NO: 5628773 - DNA, 22 bp, Homo sapiens
ggtcctcacaagcctcttctga

SEQ ID NO: 5628774 - DNA, 14 bp, Homo sapiens
ggtcctcacagcag

SEQ ID NO: 5628775 - DNA, 16 bp, Homo sapiens
ggtcctcacagcagtc

SEQ ID NO: 5628776 - DNA, 23 bp, Homo sapiens
ggtcctcacccctcgccaccttt

SEQ ID NO: 5628777 - DNA, 22 bp, Homo sapiens
ggtcctcacttctgtctcctgt

SEQ ID NO: 5628778 - DNA, 14 bp, Homo sapiens
ggtcctcagagaat

SEQ ID NO: 5628779 - DNA, 22 bp, Homo sapiens
ggtcctcagatgggaattgcac

SEQ ID NO: 5628780 - DNA, 13 bp, Homo sapiens
ggtcctcagctgc

SEQ ID NO: 5628781 - DNA, 16 bp, Homo sapiens
ggtcctcagctgctcc

SEQ ID NO: 5628782 - DNA, 20 bp, Homo sapiens
ggtcctcaggcagtggccca

SEQ ID NO: 5628783 - DNA, 15 bp, Homo sapiens
ggtcctcaggtcagc

SEQ ID NO: 5628784 - DNA, 19 bp, Homo sapiens
ggtcctcaggtcagctggg

SEQ ID NO: 5628785 - DNA, 23 bp, Homo sapiens
ggtcctccatttcaactccagaa

SEQ ID NO: 5628786 - DNA, 19 bp, Homo sapiens
ggtcctcctatctccctgg

SEQ ID NO: 5628787 - DNA, 20 bp, Homo sapiens
ggtcctcctatctccctggc

SEQ ID NO: 5628788 - DNA, 21 bp, Homo sapiens
ggtcctcctatctccctggct

SEQ ID NO: 5628789 - DNA, 19 bp, Homo sapiens
ggtcctcctccagggacag

SEQ ID NO: 5628790 - DNA, 17 bp, Homo sapiens
ggtcctcctcgctcctc

SEQ ID NO: 5628791 - DNA, 19 bp, Homo sapiens
ggtcctcctcgctcctcct

SEQ ID NO: 5628792 - DNA, 15 bp, Homo sapiens
ggtcctcctggcctg

SEQ ID NO: 5628793 - DNA, 16 bp, Homo sapiens
ggtcctcctggcctga

SEQ ID NO: 5628794 - DNA, 12 bp, Homo sapiens
ggtcctcctgtg

SEQ ID NO: 5628795 - DNA, 14 bp, Homo sapiens
ggtcctcggccctg

SEQ ID NO: 5628796 - DNA, 18 bp, Homo sapiens
ggtcctcgggatgccgtt

SEQ ID NO: 5628797 - DNA, 12 bp, Homo sapiens
ggtcctctcagt

SEQ ID NO: 5628798 - DNA, 19 bp, Homo sapiens
ggtcctctcttccacagtg

SEQ ID NO: 5628799 - DNA, 21 bp, Homo sapiens
ggtcctctcttccacagtggc

SEQ ID NO: 5628800 - DNA, 22 bp, Homo sapiens
ggtcctctcttccacagtggcg

SEQ ID NO: 5628801 - DNA, 15 bp, Homo sapiens
ggtcctctggagccc

SEQ ID NO: 5628802 - DNA, 19 bp, Homo sapiens
ggtcctcttaggtcccggg

SEQ ID NO: 5628803 - DNA, 14 bp, Homo sapiens
ggtcctcttcctca

SEQ ID NO: 5628804 - DNA, 19 bp, Homo sapiens
ggtcctcttttcctggcag

SEQ ID NO: 5628805 - DNA, 17 bp, Homo sapiens
ggtcctgaaagtaactc

SEQ ID NO: 5628806 - DNA, 20 bp, Homo sapiens
ggtcctgaaagtctgtgtcc

SEQ ID NO: 5628807 - DNA, 21 bp, Homo sapiens
ggtcctgaagtgacctcactg

SEQ ID NO: 5628808 - DNA, 18 bp, Homo sapiens
ggtcctgaggctggggct

SEQ ID NO: 5628809 - DNA, 17 bp, Homo sapiens
ggtcctgagggtcccca

SEQ ID NO: 5628810 - DNA, 20 bp, Homo sapiens
ggtcctgagtcttggcctgc

SEQ ID NO: 5628811 - DNA, 23 bp, Homo sapiens
ggtcctgagtcttggcctgcctc

SEQ ID NO: 5628812 - DNA, 16 bp, Homo sapiens
ggtcttgcagtggctt

SEQ ID NO: 5628813 - DNA, 17 bp, Homo sapiens
ggtcttgccctattata

SEQ ID NO: 5628814 - DNA, 12 bp, Homo sapiens
ggtcttgctctg

SEQ ID NO: 5628815 - DNA, 20 bp, Homo sapiens
ggtcttgctctgtcccccag

SEQ ID NO: 5628816 - DNA, 23 bp, Homo sapiens
ggtcttgctctgtcccccaggct

SEQ ID NO: 5628817 - DNA, 17 bp, Homo sapiens
ggtcttggaacttgcct

SEQ ID NO: 5628818 - DNA, 22 bp, Homo sapiens
ggtcttggaagtgtgtggaagg

SEQ ID NO: 5628819 - DNA, 14 bp, Homo sapiens
ggtcttggagagga

SEQ ID NO: 5628820 - DNA, 20 bp, Homo sapiens
ggtcttggagaggaggtgtg

SEQ ID NO: 5628821 - DNA, 23 bp, Homo sapiens
ggtcttggagctgagcctctcac

SEQ ID NO: 5628822 - DNA, 22 bp, Homo sapiens
ggtcttggattggtaccagagc

SEQ ID NO: 5628823 - DNA, 15 bp, Homo sapiens
ggtcttggctgcctg

SEQ ID NO: 5628824 - DNA, 20 bp, Homo sapiens
ggtcttgggaaatatgaatg

SEQ ID NO: 5628825 - DNA, 20 bp, Homo sapiens
ggtcttgggctactggcagc

SEQ ID NO: 5628826 - DNA, 21 bp, Homo sapiens
ggtcttgggggtcagggggga

SEQ ID NO: 5628827 - DNA, 21 bp, Homo sapiens
ggtcttggttccagcctgcca

SEQ ID NO: 5628828 - DNA, 13 bp, Homo sapiens
ggtcttgtaagag

SEQ ID NO: 5628829 - DNA, 23 bp, Homo sapiens
ggtcttgtggttgtgtgtgttct

SEQ ID NO: 5628830 - DNA, 16 bp, Homo sapiens
ggtctttagccccact

SEQ ID NO: 5628831 - DNA, 14 bp, Homo sapiens
ggtctttccacttt

SEQ ID NO: 5628832 - DNA, 22 bp, Homo sapiens
ggtctttccatctatcactgca

SEQ ID NO: 5628833 - DNA, 19 bp, Homo sapiens
ggtctttcctatcatggag

SEQ ID NO: 5628834 - DNA, 13 bp, Homo sapiens
ggtctttgaataa

SEQ ID NO: 5628835 - DNA, 17 bp, Homo sapiens
ggtctttgaataaagtc

SEQ ID NO: 5628836 - DNA, 18 bp, Homo sapiens
ggtctttgaataaagtct

SEQ ID NO: 5628837 - DNA, 19 bp, Homo sapiens
ggtctttgaataaagtctg

SEQ ID NO: 5628838 - DNA, 10 bp, Homo sapiens
ggtctttgag

SEQ ID NO: 5628839 - DNA, 17 bp, Homo sapiens
ggtctttgagctcccac

SEQ ID NO: 5628840 - DNA, 17 bp, Homo sapiens
ggtctttgcacatgtga

SEQ ID NO: 5628841 - DNA, 22 bp, Homo sapiens
ggtctttgctaggcctcttgct

SEQ ID NO: 5628842 - DNA, 15 bp, Homo sapiens
ggtctttgctccaga

SEQ ID NO: 5628843 - DNA, 13 bp, Homo sapiens
ggtctttgtaaga

SEQ ID NO: 5628844 - DNA, 14 bp, Homo sapiens
ggtctttgtaagaa

SEQ ID NO: 5628845 - DNA, 19 bp, Homo sapiens
ggtctttgtaagagtgtag

SEQ ID NO: 5628846 - DNA, 15 bp, Homo sapiens
ggtctttgtgtgctg

SEQ ID NO: 5628847 - DNA, 22 bp, Homo sapiens
ggtcttttacatacagtgatat

SEQ ID NO: 5628848 - DNA, 18 bp, Homo sapiens
ggtcttttaccctgtgtc

SEQ ID NO: 5628849 - DNA, 20 bp, Homo sapiens
ggtcttttaccctgtgtcag

SEQ ID NO: 5628850 - DNA, 21 bp, Homo sapiens
ggtcttttaccctgtgtcaga

SEQ ID NO: 5628851 - DNA, 16 bp, Homo sapiens
ggtcttttcatctggg

SEQ ID NO: 5628852 - DNA, 22 bp, Homo sapiens
ggtcttttcctcgcttctttca

SEQ ID NO: 5628853 - DNA, 19 bp, Homo sapiens
ggtcttttgagggctaaaa

SEQ ID NO: 5628854 - DNA, 18 bp, Homo sapiens
ggtctttttctcttctgt

SEQ ID NO: 5628855 - DNA, 17 bp, Homo sapiens
ggtctttttgtaagtga

SEQ ID NO: 5628856 - DNA, 21 bp, Homo sapiens
ggtcttttttcatttcttcct

SEQ ID NO: 5628857 - DNA, 23 bp, Homo sapiens
ggtcttttttcatttcttcctca

SEQ ID NO: 5628858 - DNA, 14 bp, Homo sapiens
ggtgaaacacacac

SEQ ID NO: 5628859 - DNA, 15 bp, Homo sapiens
ggtgaaacacacaca

SEQ ID NO: 5628860 - DNA, 21 bp, Homo sapiens
ggtgaaacacacacacattct

SEQ ID NO: 5628861 - DNA, 18 bp, Homo sapiens
ggtgaaaccctgtctcta

SEQ ID NO: 5628862 - DNA, 13 bp, Homo sapiens
ggtgaaagaacaa

SEQ ID NO: 5628863 - DNA, 11 bp, Homo sapiens
ggtgaaagagt

SEQ ID NO: 5628864 - DNA, 13 bp, Homo sapiens
ggtgaaaggaaat

SEQ ID NO: 5628865 - DNA, 13 bp, Homo sapiens
ggtgaaagggagc

SEQ ID NO: 5628866 - DNA, 14 bp, Homo sapiens
ggtgaaagggagct

SEQ ID NO: 5628867 - DNA, 14 bp, Homo sapiens
ggtgaaatccaggt

SEQ ID NO: 5628868 - DNA, 23 bp, Homo sapiens
ggtgaaattataactattacagt

SEQ ID NO: 5628869 - DNA, 14 bp, Homo sapiens
ggtgaacagagaga

SEQ ID NO: 5628870 - DNA, 21 bp, Homo sapiens
ggtgaacagcaggatgccctg

SEQ ID NO: 5628871 - DNA, 18 bp, Homo sapiens
ggtgaaccacttcattct

SEQ ID NO: 5628872 - DNA, 13 bp, Homo sapiens
ggtgaactccagg

SEQ ID NO: 5628873 - DNA, 20 bp, Homo sapiens
ggtgaactgaagcagagtca

SEQ ID NO: 5628874 - DNA, 21 bp, Homo sapiens
ggtgaactgagctgggcagga

SEQ ID NO: 5628875 - DNA, 12 bp, Homo sapiens
ggtgaactttgt

SEQ ID NO: 5628876 - DNA, 17 bp, Homo sapiens
ggtgaagaaccctctgt

SEQ ID NO: 5628877 - DNA, 20 bp, Homo sapiens
ggtgaagaaccctctgtccc

SEQ ID NO: 5628878 - DNA, 22 bp, Homo sapiens
ggtgaagaggaggggaagaggc

SEQ ID NO: 5628879 - DNA, 18 bp, Homo sapiens
ggtgaagaggctgcttct

SEQ ID NO: 5628880 - DNA, 15 bp, Homo sapiens
ggtgaagatgaagaa

SEQ ID NO: 5628881 - DNA, 15 bp, Homo sapiens
ggtgaagcgcctcag

SEQ ID NO: 5628882 - DNA, 23 bp, Homo sapiens
ggtgaaggaggctccaggcagca

SEQ ID NO: 5628883 - DNA, 16 bp, Homo sapiens
ggtgaaggcctggctg

SEQ ID NO: 5628884 - DNA, 13 bp, Homo sapiens
ggtgaagggaagt

SEQ ID NO: 5628885 - DNA, 13 bp, Homo sapiens
ggtgaagtccctg

SEQ ID NO: 5628886 - DNA, 17 bp, Homo sapiens
ggtgaagtgcctgctgg

SEQ ID NO: 5628887 - DNA, 16 bp, Homo sapiens
ggtgaataaagcaggg

SEQ ID NO: 5628888 - DNA, 18 bp, Homo sapiens
ggtgaatatggtggaaaa

SEQ ID NO: 5628889 - DNA, 13 bp, Homo sapiens
ggtgaatattaca

SEQ ID NO: 5628890 - DNA, 13 bp, Homo sapiens
ggtgaatattttc

SEQ ID NO: 5628891 - DNA, 15 bp, Homo sapiens
ggtgaatcacctggc

SEQ ID NO: 5628892 - DNA, 16 bp, Homo sapiens
ggtgaatcacctggct

SEQ ID NO: 5628893 - DNA, 18 bp, Homo sapiens
ggtgaatcacctggctga

SEQ ID NO: 5628894 - DNA, 13 bp, Homo sapiens
ggtgaatctgtct

SEQ ID NO: 5628895 - DNA, 12 bp, Homo sapiens
ggtgaatcttga

SEQ ID NO: 5628896 - DNA, 14 bp, Homo sapiens
ggtgaattttcaag

SEQ ID NO: 5628897 - DNA, 19 bp, Homo sapiens
ggtgaattttcaaggcctt

SEQ ID NO: 5628898 - DNA, 13 bp, Homo sapiens
ggtgacaagagcc

SEQ ID NO: 5628899 - DNA, 13 bp, Homo sapiens
ggtgacacagact

SEQ ID NO: 5628900 - DNA, 15 bp, Homo sapiens
ggtgacacaggtcag

SEQ ID NO: 5628901 - DNA, 20 bp, Homo sapiens
ggtgacacaggtcagggctc

SEQ ID NO: 5628902 - DNA, 16 bp, Homo sapiens
ggtgacacgcttctga

SEQ ID NO: 5628903 - DNA, 18 bp, Homo sapiens
ggtgacactgctccctga

SEQ ID NO: 5628904 - DNA, 13 bp, Homo sapiens
ggtgacagagcga

SEQ ID NO: 5628905 - DNA, 23 bp, Homo sapiens
ggtgacagagcgagattccgtct

SEQ ID NO: 5628906 - DNA, 14 bp, Homo sapiens
ggtgacagagggac

SEQ ID NO: 5628907 - DNA, 21 bp, Homo sapiens
ggtgacagagggacagtgggc

SEQ ID NO: 5628908 - DNA, 18 bp, Homo sapiens
ggtgacagtcatcatcag

SEQ ID NO: 5628909 - DNA, 15 bp, Homo sapiens
ggtgacagtcctcca

SEQ ID NO: 5628910 - DNA, 22 bp, Homo sapiens
ggtgacagtgaagatagaagaa

SEQ ID NO: 5628911 - DNA, 18 bp, Homo sapiens
ggtgacagtgccttctct

SEQ ID NO: 5628912 - DNA, 12 bp, Homo sapiens
ggtgacagtggc

SEQ ID NO: 5628913 - DNA, 20 bp, Homo sapiens
ggtgacagtggctgctctgg

SEQ ID NO: 5628914 - DNA, 19 bp, Homo sapiens
ggtgacagttcccagagtg

SEQ ID NO: 5628915 - DNA, 14 bp, Homo sapiens
ggtgacatcccagg

SEQ ID NO: 5628916 - DNA, 20 bp, Homo sapiens
ggtgacatggggaaggcaga

SEQ ID NO: 5628917 - DNA, 17 bp, Homo sapiens
ggtgaccagaccaaggc

SEQ ID NO: 5628918 - DNA, 20 bp, Homo sapiens
ggtgaccagaccaaggcagg

SEQ ID NO: 5628919 - DNA, 19 bp, Homo sapiens
ggtgaccagccactcaaag

SEQ ID NO: 5628920 - DNA, 22 bp, Homo sapiens
ggtgaccagcctgtcacccagc

SEQ ID NO: 5628921 - DNA, 15 bp, Homo sapiens
ggtgacccacagctc

SEQ ID NO: 5628922 - DNA, 16 bp, Homo sapiens
ggtgacccacagctct

SEQ ID NO: 5628923 - DNA, 22 bp, Homo sapiens
ggtgacccacagctctgggcct

SEQ ID NO: 5628924 - DNA, 20 bp, Homo sapiens
ggtgacccatttcaggaggt

SEQ ID NO: 5628925 - DNA, 14 bp, Homo sapiens
ggtgaccccagggc

SEQ ID NO: 5628926 - DNA, 21 bp, Homo sapiens
ggtgaccccagggcacaggag

SEQ ID NO: 5628927 - DNA, 23 bp, Homo sapiens
ggtgaccccagggcacaggagct

SEQ ID NO: 5628928 - DNA, 23 bp, Homo sapiens
ggtgaccccatcactcgcaggac

SEQ ID NO: 5628929 - DNA, 23 bp, Homo sapiens
ggtgacccctgctttgccccact

SEQ ID NO: 5628930 - DNA, 20 bp, Homo sapiens
ggtgacccggcaccccctgc

SEQ ID NO: 5628931 - DNA, 18 bp, Homo sapiens
ggtgacctccggccaggt

SEQ ID NO: 5628932 - DNA, 20 bp, Homo sapiens
ggtgacctccgtcctctccc

SEQ ID NO: 5628933 - DNA, 14 bp, Homo sapiens
ggtgacctctagag

SEQ ID NO: 5628934 - DNA, 21 bp, Homo sapiens
ggtgacctctagccctgcccg

SEQ ID NO: 5628935 - DNA, 14 bp, Homo sapiens
ggtgacctctgcct

SEQ ID NO: 5628936 - DNA, 16 bp, Homo sapiens
ggtgacctctgcctga

SEQ ID NO: 5628937 - DNA, 21 bp, Homo sapiens
ggtgacctctgcctgaagtca

SEQ ID NO: 5628938 - DNA, 16 bp, Homo sapiens
ggtgacgcccaccttc

SEQ ID NO: 5628939 - DNA, 20 bp, Homo sapiens
ggtgacgcctgagacagcac

SEQ ID NO: 5628940 - DNA, 18 bp, Homo sapiens
ggtgacgcctgccctccc

SEQ ID NO: 5628941 - DNA, 21 bp, Homo sapiens
ggtgacggtcctttaggcagc

SEQ ID NO: 5628942 - DNA, 23 bp, Homo sapiens
ggtgacggtcctttaggcagcct

SEQ ID NO: 5628943 - DNA, 14 bp, Homo sapiens
ggtgactgccaccg

SEQ ID NO: 5628944 - DNA, 12 bp, Homo sapiens
ggtgactgtccc

SEQ ID NO: 5628945 - DNA, 23 bp, Homo sapiens
ggtgactgtcccaccgggagcct

SEQ ID NO: 5628946 - DNA, 23 bp, Homo sapiens
ggtgactgtgtaactttctctta

SEQ ID NO: 5628947 - DNA, 18 bp, Homo sapiens
ggtgacttccctggtcac

SEQ ID NO: 5628948 - DNA, 17 bp, Homo sapiens
ggtgacttgtctgcctc

SEQ ID NO: 5628949 - DNA, 16 bp, Homo sapiens
ggtgactttctgaaac

SEQ ID NO: 5628950 - DNA, 15 bp, Homo sapiens
ggtgactttggggac

SEQ ID NO: 5628951 - DNA, 17 bp, Homo sapiens
ggtgactttggggacag

SEQ ID NO: 5628952 - DNA, 23 bp, Homo sapiens
ggtgactttgtctctcctggctg

SEQ ID NO: 5628953 - DNA, 13 bp, Homo sapiens
ggtgagaacccag

SEQ ID NO: 5628954 - DNA, 16 bp, Homo sapiens
ggtgagaacccagaga

SEQ ID NO: 5628955 - DNA, 15 bp, Homo sapiens
ggtgagaactcagaa

SEQ ID NO: 5628956 - DNA, 12 bp, Homo sapiens
ggtgagaattca

SEQ ID NO: 5628957 - DNA, 15 bp, Homo sapiens
ggtgagacagtgggg

SEQ ID NO: 5628958 - DNA, 22 bp, Homo sapiens
ggtgagacagtgggggtgcctg

SEQ ID NO: 5628959 - DNA, 15 bp, Homo sapiens
ggtgagaccacctct

SEQ ID NO: 5628960 - DNA, 18 bp, Homo sapiens
ggtgagacccatggctgt

SEQ ID NO: 5628961 - DNA, 23 bp, Homo sapiens
ggtgagacgtgatgggctaggcc

SEQ ID NO: 5628962 - DNA, 17 bp, Homo sapiens
ggtgagagacctgctca

SEQ ID NO: 5628963 - DNA, 12 bp, Homo sapiens
ggtgagagagac

SEQ ID NO: 5628964 - DNA, 16 bp, Homo sapiens
ggtgagagaggaaaga

SEQ ID NO: 5628965 - DNA, 12 bp, Homo sapiens
ggtgagagctgc

SEQ ID NO: 5628966 - DNA, 16 bp, Homo sapiens
ggtgagaggggaacag

SEQ ID NO: 5628967 - DNA, 17 bp, Homo sapiens
ggtgagagtcaaagctg

SEQ ID NO: 5628968 - DNA, 12 bp, Homo sapiens
ggtgagagtggg

SEQ ID NO: 5628969 - DNA, 21 bp, Homo sapiens
ggtgagatacccagagagaaa

SEQ ID NO: 5628970 - DNA, 17 bp, Homo sapiens
ggtgagatgctggagaa

SEQ ID NO: 5628971 - DNA, 17 bp, Homo sapiens
ggtgagcactctggggt

SEQ ID NO: 5628972 - DNA, 18 bp, Homo sapiens
ggtgagcagggccctcag

SEQ ID NO: 5628973 - DNA, 16 bp, Homo sapiens
ggtgagcagtaactgt

SEQ ID NO: 5628974 - DNA, 19 bp, Homo sapiens
ggtgagcattacaggcaag

SEQ ID NO: 5628975 - DNA, 13 bp, Homo sapiens
ggtgagccagtgg

SEQ ID NO: 5628976 - DNA, 12 bp, Homo sapiens
ggtgagcctggg

SEQ ID NO: 5628977 - DNA, 14 bp, Homo sapiens
ggtgagcctgggca

SEQ ID NO: 5628978 - DNA, 23 bp, Homo sapiens
ggtgagcgatcatttatttcatg

SEQ ID NO: 5628979 - DNA, 20 bp, Homo sapiens
ggtgagctatagtgaagaat

SEQ ID NO: 5628980 - DNA, 18 bp, Homo sapiens
ggtgagctctcaggccga

SEQ ID NO: 5628981 - DNA, 21 bp, Homo sapiens
ggtgagctctcaggccgagag

SEQ ID NO: 5628982 - DNA, 16 bp, Homo sapiens
ggtgagctgcacctga

SEQ ID NO: 5628983 - DNA, 19 bp, Homo sapiens
ggtgaggaatttgaagctc

SEQ ID NO: 5628984 - DNA, 13 bp, Homo sapiens
ggtgaggaggagg

SEQ ID NO: 5628985 - DNA, 16 bp, Homo sapiens
ggtgaggaggaggcag

SEQ ID NO: 5628986 - DNA, 20 bp, Homo sapiens
ggtgaggcagtgggtcccac

SEQ ID NO: 5628987 - DNA, 20 bp, Homo sapiens
ggtgaggcatggcaattctg

SEQ ID NO: 5628988 - DNA, 21 bp, Homo sapiens
ggtgaggcccaagagccctgt

SEQ ID NO: 5628989 - DNA, 14 bp, Homo sapiens
ggtgaggcccagcc

SEQ ID NO: 5628990 - DNA, 18 bp, Homo sapiens
ggtggccccgacaggtct

SEQ ID NO: 5628991 - DNA, 18 bp, Homo sapiens
ggtggcccgacagcctgg

SEQ ID NO: 5628992 - DNA, 20 bp, Homo sapiens
ggtggcccgacagcctggca

SEQ ID NO: 5628993 - DNA, 20 bp, Homo sapiens
ggtggccctctcccctgccc

SEQ ID NO: 5628994 - DNA, 12 bp, Homo sapiens
ggtggccctggg

SEQ ID NO: 5628995 - DNA, 11 bp, Homo sapiens
ggtggcccttg

SEQ ID NO: 5628996 - DNA, 23 bp, Homo sapiens
ggtggccgcccacccgcccgagg

SEQ ID NO: 5628997 - DNA, 18 bp, Homo sapiens
ggtggccgctcctccctg

SEQ ID NO: 5628998 - DNA, 21 bp, Homo sapiens
ggtggccgctgagtggcaggg

SEQ ID NO: 5628999 - DNA, 15 bp, Homo sapiens
ggtggccggccctgc

SEQ ID NO: 5629000 - DNA, 17 bp, Homo sapiens
ggtggccggccctgccc

SEQ ID NO: 5629001 - DNA, 19 bp, Homo sapiens
ggtggccggccctgccccc

SEQ ID NO: 5629002 - DNA, 22 bp, Homo sapiens
ggtggccggcttgctgctccgg

SEQ ID NO: 5629003 - DNA, 16 bp, Homo sapiens
ggtggccgtcacgctt

SEQ ID NO: 5629004 - DNA, 19 bp, Homo sapiens
ggtggcctaaggctgctgt

SEQ ID NO: 5629005 - DNA, 20 bp, Homo sapiens
ggtggcctatttcagctgct

SEQ ID NO: 5629006 - DNA, 13 bp, Homo sapiens
ggtggcctcccaa

SEQ ID NO: 5629007 - DNA, 22 bp, Homo sapiens
ggtggcctcccaactcacccca

SEQ ID NO: 5629008 - DNA, 23 bp, Homo sapiens
ggtggcctcccaactcaccccag

SEQ ID NO: 5629009 - DNA, 17 bp, Homo sapiens
ggtggcctccctccaga

SEQ ID NO: 5629010 - DNA, 22 bp, Homo sapiens
ggtggcctcgggacacctgccc

SEQ ID NO: 5629011 - DNA, 19 bp, Homo sapiens
ggtggcctctgcctggggc

SEQ ID NO: 5629012 - DNA, 15 bp, Homo sapiens
ggtggcctctgctgg

SEQ ID NO: 5629013 - DNA, 13 bp, Homo sapiens
ggtggcctgcggg

SEQ ID NO: 5629014 - DNA, 18 bp, Homo sapiens
ggtggcctggccctcctg

SEQ ID NO: 5629015 - DNA, 23 bp, Homo sapiens
ggtggcctgtgaggggcccctgg

SEQ ID NO: 5629016 - DNA, 18 bp, Homo sapiens
ggtggcctgttccctaga

SEQ ID NO: 5629017 - DNA, 15 bp, Homo sapiens
ggtggccttctgctg

SEQ ID NO: 5629018 - DNA, 12 bp, Homo sapiens
ggtggccttgag

SEQ ID NO: 5629019 - DNA, 20 bp, Homo sapiens
ggtggccttgagtctctgaa

SEQ ID NO: 5629020 - DNA, 21 bp, Homo sapiens
ggtggcgactctatagactct

SEQ ID NO: 5629021 - DNA, 12 bp, Homo sapiens
ggtggcgcccag

SEQ ID NO: 5629022 - DNA, 14 bp, Homo sapiens
ggtggcgccctgcg

SEQ ID NO: 5629023 - DNA, 16 bp, Homo sapiens
ggtggcgcgcctgcct

SEQ ID NO: 5629024 - DNA, 15 bp, Homo sapiens
ggtggcgctggtgca

SEQ ID NO: 5629025 - DNA, 12 bp, Homo sapiens
ggtggcggcagg

SEQ ID NO: 5629026 - DNA, 19 bp, Homo sapiens
ggtggcgggcacctatagt

SEQ ID NO: 5629027 - DNA, 21 bp, Homo sapiens
ggtggcgggcgcctgtaatcc

SEQ ID NO: 5629028 - DNA, 14 bp, Homo sapiens
ggtggcggtggacc

SEQ ID NO: 5629029 - DNA, 17 bp, Homo sapiens
ggtggcgttatggcagc

SEQ ID NO: 5629030 - DNA, 22 bp, Homo sapiens
ggtggcgttatggcagcccggc

SEQ ID NO: 5629031 - DNA, 18 bp, Homo sapiens
ggtggctactctgtgcca

SEQ ID NO: 5629032 - DNA, 18 bp, Homo sapiens
ggtggctccccctctgct

SEQ ID NO: 5629033 - DNA, 20 bp, Homo sapiens
ggtggctcccggagggccct

SEQ ID NO: 5629034 - DNA, 15 bp, Homo sapiens
ggtggctcctgccac

SEQ ID NO: 5629035 - DNA, 23 bp, Homo sapiens
ggtggctctgggaatgggagagg

SEQ ID NO: 5629036 - DNA, 13 bp, Homo sapiens
ggtggctctgggg

SEQ ID NO: 5629037 - DNA, 14 bp, Homo sapiens
ggtggctctggggt

SEQ ID NO: 5629038 - DNA, 17 bp, Homo sapiens
ggtggctcttgcctgta

SEQ ID NO: 5629039 - DNA, 21 bp, Homo sapiens
ggtggctgacccagtccctgg

SEQ ID NO: 5629040 - DNA, 23 bp, Homo sapiens
ggtggctgacccagtccctgggg

SEQ ID NO: 5629041 - DNA, 13 bp, Homo sapiens
ggtggctgcaggc

SEQ ID NO: 5629042 - DNA, 18 bp, Homo sapiens
ggtggctgccccggcctc

SEQ ID NO: 5629043 - DNA, 21 bp, Homo sapiens
ggtggctgccccggcctcctc

SEQ ID NO: 5629044 - DNA, 13 bp, Homo sapiens
ggtggctggagat

SEQ ID NO: 5629045 - DNA, 14 bp, Homo sapiens
ggtggctggaggca

SEQ ID NO: 5629046 - DNA, 18 bp, Homo sapiens
ggtggctgggactcctgg

SEQ ID NO: 5629047 - DNA, 12 bp, Homo sapiens
ggtggctgggca

SEQ ID NO: 5629048 - DNA, 18 bp, Homo sapiens
ggtggctgggcccagcag

SEQ ID NO: 5629049 - DNA, 12 bp, Homo sapiens
ggtggctgggct

SEQ ID NO: 5629050 - DNA, 13 bp, Homo sapiens
ggtggctgggctg

SEQ ID NO: 5629051 - DNA, 12 bp, Homo sapiens
ggtggctgggtt

SEQ ID NO: 5629052 - DNA, 14 bp, Homo sapiens
ggtggctgtctctg

SEQ ID NO: 5629053 - DNA, 17 bp, Homo sapiens
ggtggctgtctctgtcc

SEQ ID NO: 5629054 - DNA, 13 bp, Homo sapiens
ggtggctgtgtct

SEQ ID NO: 5629055 - DNA, 15 bp, Homo sapiens
ggtggcttcagctcc

SEQ ID NO: 5629056 - DNA, 16 bp, Homo sapiens
ggtggcttcagctcca

SEQ ID NO: 5629057 - DNA, 23 bp, Homo sapiens
ggtggcttcggcctgcttcccgg

SEQ ID NO: 5629058 - DNA, 22 bp, Homo sapiens
ggtggcttgggacttgggagag

SEQ ID NO: 5629059 - DNA, 23 bp, Homo sapiens
ggtggcttttgcggttcaggaaa

SEQ ID NO: 5629060 - DNA, 14 bp, Homo sapiens
ggtgggaagtgggg

SEQ ID NO: 5629061 - DNA, 12 bp, Homo sapiens
ggtgggaatcag

SEQ ID NO: 5629062 - DNA, 16 bp, Homo sapiens
ggtgggaatcagatct

SEQ ID NO: 5629063 - DNA, 18 bp, Homo sapiens
ggtgggacagccccaggg

SEQ ID NO: 5629064 - DNA, 13 bp, Homo sapiens
ggtgggacagcct

SEQ ID NO: 5629065 - DNA, 16 bp, Homo sapiens
ggtgggacagcctctt

SEQ ID NO: 5629066 - DNA, 18 bp, Homo sapiens
ggtgggactcttccctgg

SEQ ID NO: 5629067 - DNA, 21 bp, Homo sapiens
ggtgggactcttccctgggaa

SEQ ID NO: 5629068 - DNA, 13 bp, Homo sapiens
ggtgggagagaca

SEQ ID NO: 5629069 - DNA, 20 bp, Homo sapiens
ggtgggaggatctcttgagc

SEQ ID NO: 5629070 - DNA, 17 bp, Homo sapiens
ggtgggaggatgtgaat

SEQ ID NO: 5629071 - DNA, 20 bp, Homo sapiens
ggtgggaggattgcttgagc

SEQ ID NO: 5629072 - DNA, 16 bp, Homo sapiens
ggtgggaggccaggcg

SEQ ID NO: 5629073 - DNA, 13 bp, Homo sapiens
ggtgggaggctcc

SEQ ID NO: 5629074 - DNA, 12 bp, Homo sapiens
ggtgggagggag

SEQ ID NO: 5629075 - DNA, 11 bp, Homo sapiens
ggtgggagggg

SEQ ID NO: 5629076 - DNA, 12 bp, Homo sapiens
ggtgggaggggc

SEQ ID NO: 5629077 - DNA, 17 bp, Homo sapiens
ggtgggagtaacagggc

SEQ ID NO: 5629078 - DNA, 16 bp, Homo sapiens
ggtgggataggagggt

SEQ ID NO: 5629079 - DNA, 22 bp, Homo sapiens
ggtgggatccacgctgggccta

SEQ ID NO: 5629080 - DNA, 17 bp, Homo sapiens
ggtgggatggaggagaa

SEQ ID NO: 5629081 - DNA, 16 bp, Homo sapiens
ggtgggcacctataat

SEQ ID NO: 5629082 - DNA, 23 bp, Homo sapiens
ggtgggcagcagcatcccagcct

SEQ ID NO: 5629083 - DNA, 14 bp, Homo sapiens
ggtgggcagcagct

SEQ ID NO: 5629084 - DNA, 21 bp, Homo sapiens
ggtgggcagggaggggctggg

SEQ ID NO: 5629085 - DNA, 18 bp, Homo sapiens
ggtgggcatgccaccctc

SEQ ID NO: 5629086 - DNA, 16 bp, Homo sapiens
ggtgggccagcccctc

SEQ ID NO: 5629087 - DNA, 14 bp, Homo sapiens
ggtgggccaggctg

SEQ ID NO: 5629088 - DNA, 12 bp, Homo sapiens
ggtgggcccagg

SEQ ID NO: 5629089 - DNA, 17 bp, Homo sapiens
ggtgggcccaggaccag

SEQ ID NO: 5629090 - DNA, 15 bp, Homo sapiens
ggtgggcccagggac

SEQ ID NO: 5629091 - DNA, 17 bp, Homo sapiens
ggtgggcctggcctgag

SEQ ID NO: 5629092 - DNA, 19 bp, Homo sapiens
ggtgggcctggcctgagct

SEQ ID NO: 5629093 - DNA, 12 bp, Homo sapiens
ggtgggcctggt

SEQ ID NO: 5629094 - DNA, 22 bp, Homo sapiens
ggtgggcggacaaaagggccag

SEQ ID NO: 5629095 - DNA, 20 bp, Homo sapiens
ggtgggcggatcacaaggtc

SEQ ID NO: 5629096 - DNA, 23 bp, Homo sapiens
ggtgggcggatcacttgaggtcg

SEQ ID NO: 5629097 - DNA, 18 bp, Homo sapiens
ggtgggctccagagtagg

SEQ ID NO: 5629098 - DNA, 18 bp, Homo sapiens
ggtgggctggggactctg

SEQ ID NO: 5629099 - DNA, 16 bp, Homo sapiens
ggtgggctggtatctc

SEQ ID NO: 5629100 - DNA, 22 bp, Homo sapiens
ggtgggctgtcactgcttgagg

SEQ ID NO: 5629101 - DNA, 16 bp, Homo sapiens
ggtgggcttcagggca

SEQ ID NO: 5629102 - DNA, 15 bp, Homo sapiens
ggtgggcttcctgcc

SEQ ID NO: 5629103 - DNA, 22 bp, Homo sapiens
ggtgggcttcctgcccttccct

SEQ ID NO: 5629104 - DNA, 22 bp, Homo sapiens
ggtgggcttgtcatagccagtg

SEQ ID NO: 5629105 - DNA, 12 bp, Homo sapiens
ggtggggaagag

SEQ ID NO: 5629106 - DNA, 17 bp, Homo sapiens
ggtggggaagagagcct

SEQ ID NO: 5629107 - DNA, 19 bp, Homo sapiens
ggtggggaagagagcctgc

SEQ ID NO: 5629108 - DNA, 12 bp, Homo sapiens
ggtggggaccaa

SEQ ID NO: 5629109 - DNA, 21 bp, Homo sapiens
ggtggggagcccaggcctggc

SEQ ID NO: 5629110 - DNA, 23 bp, Homo sapiens
ggtggggagcccaggcctggcct

SEQ ID NO: 5629111 - DNA, 21 bp, Homo sapiens
ggtggggagctagaggccacc

SEQ ID NO: 5629112 - DNA, 11 bp, Homo sapiens
ggtggggaggg

SEQ ID NO: 5629113 - DNA, 15 bp, Homo sapiens
ggtggggagggcctc

SEQ ID NO: 5629114 - DNA, 22 bp, Homo sapiens
ggtggggagggtgacccacagc

SEQ ID NO: 5629115 - DNA, 18 bp, Homo sapiens
ggtggggagtcagtcatg

SEQ ID NO: 5629116 - DNA, 21 bp, Homo sapiens
ggtggggcaatggggagaggc

SEQ ID NO: 5629117 - DNA, 10 bp, Homo sapiens
ggtggggcag

SEQ ID NO: 5629118 - DNA, 15 bp, Homo sapiens
ggtggggcagaaagg

SEQ ID NO: 5629119 - DNA, 19 bp, Homo sapiens
ggtggggcagaaaggctgc

SEQ ID NO: 5629120 - DNA, 13 bp, Homo sapiens
ggtggggcagctt

SEQ ID NO: 5629121 - DNA, 21 bp, Homo sapiens
ggtggggccaggccaggacca

SEQ ID NO: 5629122 - DNA, 23 bp, Homo sapiens
ggtggggccataaacggttcctg

SEQ ID NO: 5629123 - DNA, 22 bp, Homo sapiens
ggtggggcccatggggtctctg

SEQ ID NO: 5629124 - DNA, 20 bp, Homo sapiens
ggtggggcccccagcaccct

SEQ ID NO: 5629125 - DNA, 14 bp, Homo sapiens
ggtggggccctgcc

SEQ ID NO: 5629126 - DNA, 16 bp, Homo sapiens
ggtggggcctcagcct

SEQ ID NO: 5629127 - DNA, 15 bp, Homo sapiens
ggtggggcgaggcag

SEQ ID NO: 5629128 - DNA, 12 bp, Homo sapiens
ggtggggcggga

SEQ ID NO: 5629129 - DNA, 12 bp, Homo sapiens
ggtggggctcct

SEQ ID NO: 5629130 - DNA, 15 bp, Homo sapiens
ggtggggctgagcct

SEQ ID NO: 5629131 - DNA, 21 bp, Homo sapiens
ggtggggctgcatccaaggct

SEQ ID NO: 5629132 - DNA, 13 bp, Homo sapiens
ggtggggctgctc

SEQ ID NO: 5629133 - DNA, 18 bp, Homo sapiens
ggtggggctgctcctcca

SEQ ID NO: 5629134 - DNA, 11 bp, Homo sapiens
ggtggggctgg

SEQ ID NO: 5629135 - DNA, 14 bp, Homo sapiens
ggtggggctgtcct

SEQ ID NO: 5629136 - DNA, 17 bp, Homo sapiens
ggtggggctgtcctgct

SEQ ID NO: 5629137 - DNA, 19 bp, Homo sapiens
ggtgggggagaggggagac

SEQ ID NO: 5629138 - DNA, 16 bp, Homo sapiens
ggtgggggagcctctg

SEQ ID NO: 5629139 - DNA, 14 bp, Homo sapiens
ggtgggggagcctg

SEQ ID NO: 5629140 - DNA, 17 bp, Homo sapiens
ggtgggggagcctggag

SEQ ID NO: 5629141 - DNA, 13 bp, Homo sapiens
ggtgggggagggg

SEQ ID NO: 5629142 - DNA, 21 bp, Homo sapiens
ggtgggggcagcggccccgca

SEQ ID NO: 5629143 - DNA, 13 bp, Homo sapiens
ggtgggggccagg

SEQ ID NO: 5629144 - DNA, 15 bp, Homo sapiens
ggtgggggcctcctc

SEQ ID NO: 5629145 - DNA, 13 bp, Homo sapiens
ggtgggggcctcg

SEQ ID NO: 5629146 - DNA, 21 bp, Homo sapiens
ggtgggggctcctggtggcct

SEQ ID NO: 5629147 - DNA, 12 bp, Homo sapiens
ggtgggggctgt

SEQ ID NO: 5629148 - DNA, 15 bp, Homo sapiens
ggtgggggctgtcct

SEQ ID NO: 5629149 - DNA, 16 bp, Homo sapiens
ggtgggggctgtcctg

SEQ ID NO: 5629150 - DNA, 17 bp, Homo sapiens
ggtgggggctgtcctgc

SEQ ID NO: 5629151 - DNA, 18 bp, Homo sapiens
ggtggggggagggcaccc

SEQ ID NO: 5629152 - DNA, 18 bp, Homo sapiens
ggtggggggcttcataca

SEQ ID NO: 5629153 - DNA, 22 bp, Homo sapiens
ggtgggggggagaaggcctccc

SEQ ID NO: 5629154 - DNA, 14 bp, Homo sapiens
ggtggggggtccag

SEQ ID NO: 5629155 - DNA, 15 bp, Homo sapiens
ggtggggggtccagt

SEQ ID NO: 5629156 - DNA, 21 bp, Homo sapiens
ggtggggggtccagtctgtga

SEQ ID NO: 5629157 - DNA, 15 bp, Homo sapiens
ggtgggggtgccgct

SEQ ID NO: 5629158 - DNA, 22 bp, Homo sapiens
ggtgggggtgccgctgtctctg

SEQ ID NO: 5629159 - DNA, 13 bp, Homo sapiens
ggtgggggtggga

SEQ ID NO: 5629160 - DNA, 17 bp, Homo sapiens
ggtgggggtgggtcaga

SEQ ID NO: 5629161 - DNA, 19 bp, Homo sapiens
ggtgggggttctggcagga

SEQ ID NO: 5629162 - DNA, 18 bp, Homo sapiens
ggtggggtaaggaggaga

SEQ ID NO: 5629163 - DNA, 15 bp, Homo sapiens
ggtggggtcatgccc

SEQ ID NO: 5629164 - DNA, 23 bp, Homo sapiens
ggtggggtcctggagcagaccac

SEQ ID NO: 5629165 - DNA, 15 bp, Homo sapiens
ggtggggtgaagctg

SEQ ID NO: 5629166 - DNA, 20 bp, Homo sapiens
ggtggggtgagggcttgagg

SEQ ID NO: 5629167 - DNA, 18 bp, Homo sapiens
ggtggggtgatggccaga

SEQ ID NO: 5629168 - DNA, 20 bp, Homo sapiens
ggtggggtgctggggctgca

SEQ ID NO: 5629169 - DNA, 19 bp, Homo sapiens
ggttcaagtattaagcagt

SEQ ID NO: 5629170 - DNA, 16 bp, Homo sapiens
ggttcacacagcccag

SEQ ID NO: 5629171 - DNA, 14 bp, Homo sapiens
ggttcacctgtgac

SEQ ID NO: 5629172 - DNA, 14 bp, Homo sapiens
ggttcaccttgccg

SEQ ID NO: 5629173 - DNA, 22 bp, Homo sapiens
ggttcacgtaatcctcctgagt

SEQ ID NO: 5629174 - DNA, 19 bp, Homo sapiens
ggttcacgtcactgccaga

SEQ ID NO: 5629175 - DNA, 13 bp, Homo sapiens
ggttcactagagc

SEQ ID NO: 5629176 - DNA, 20 bp, Homo sapiens
ggttcactcttggagcctgc

SEQ ID NO: 5629177 - DNA, 19 bp, Homo sapiens
ggttcagaaatagctcctc

SEQ ID NO: 5629178 - DNA, 20 bp, Homo sapiens
ggttcagaaatagctcctca

SEQ ID NO: 5629179 - DNA, 18 bp, Homo sapiens
ggttcagaattaaacttt

SEQ ID NO: 5629180 - DNA, 19 bp, Homo sapiens
ggttcagaattaaactttt

SEQ ID NO: 5629181 - DNA, 15 bp, Homo sapiens
ggttcagacacagct

SEQ ID NO: 5629182 - DNA, 17 bp, Homo sapiens
ggttcagacacagctct

SEQ ID NO: 5629183 - DNA, 17 bp, Homo sapiens
ggttcagacccctgcct

SEQ ID NO: 5629184 - DNA, 19 bp, Homo sapiens
ggttcagagactggcagcc

SEQ ID NO: 5629185 - DNA, 14 bp, Homo sapiens
ggttcagcccctcc

SEQ ID NO: 5629186 - DNA, 18 bp, Homo sapiens
ggttcagcccctcctctg

SEQ ID NO: 5629187 - DNA, 14 bp, Homo sapiens
ggttcagcctggcc

SEQ ID NO: 5629188 - DNA, 12 bp, Homo sapiens
ggttcagcttgt

SEQ ID NO: 5629189 - DNA, 12 bp, Homo sapiens
ggttcaggacca

SEQ ID NO: 5629190 - DNA, 17 bp, Homo sapiens
ggttcagggaactgctt

SEQ ID NO: 5629191 - DNA, 18 bp, Homo sapiens
ggttcagggaactgcttg

SEQ ID NO: 5629192 - DNA, 21 bp, Homo sapiens
ggttcagggttggcccctgcc

SEQ ID NO: 5629193 - DNA, 22 bp, Homo sapiens
ggttcagggttggcccctgccc

SEQ ID NO: 5629194 - DNA, 17 bp, Homo sapiens
ggttcaggtcagggcta

SEQ ID NO: 5629195 - DNA, 20 bp, Homo sapiens
ggttcagtctagaagaatta

SEQ ID NO: 5629196 - DNA, 12 bp, Homo sapiens
ggttcagtttct

SEQ ID NO: 5629197 - DNA, 20 bp, Homo sapiens
ggttcatacgcatcccatct

SEQ ID NO: 5629198 - DNA, 21 bp, Homo sapiens
ggttcataggtcactggctct

SEQ ID NO: 5629199 - DNA, 13 bp, Homo sapiens
ggttcatatttat

SEQ ID NO: 5629200 - DNA, 22 bp, Homo sapiens
ggttcatcagtgttaaaaaatt

SEQ ID NO: 5629201 - DNA, 17 bp, Homo sapiens
ggttcatccagaagtgt

SEQ ID NO: 5629202 - DNA, 13 bp, Homo sapiens
ggttcatgatgca

SEQ ID NO: 5629203 - DNA, 13 bp, Homo sapiens
ggttcatgcctgg

SEQ ID NO: 5629204 - DNA, 16 bp, Homo sapiens
ggttcatgcctggggt

SEQ ID NO: 5629205 - DNA, 21 bp, Homo sapiens
ggttcattttcagattcaggc

SEQ ID NO: 5629206 - DNA, 14 bp, Homo sapiens
ggttcattttgcac

SEQ ID NO: 5629207 - DNA, 19 bp, Homo sapiens
ggttcattttttttccctt

SEQ ID NO: 5629208 - DNA, 23 bp, Homo sapiens
ggttccaaattatcctggtcttt

SEQ ID NO: 5629209 - DNA, 16 bp, Homo sapiens
ggttccaaccaggcag

SEQ ID NO: 5629210 - DNA, 18 bp, Homo sapiens
ggttccaatcctggctct

SEQ ID NO: 5629211 - DNA, 13 bp, Homo sapiens
ggttccacagagt

SEQ ID NO: 5629212 - DNA, 19 bp, Homo sapiens
ggttccacagagtaagaca

SEQ ID NO: 5629213 - DNA, 22 bp, Homo sapiens
ggttccacagagtaagacattg

SEQ ID NO: 5629214 - DNA, 24 bp, Homo sapiens
ggttccagcaattctcctgcctca

SEQ ID NO: 5629215 - DNA, 15 bp, Homo sapiens
ggttccagcctgcca

SEQ ID NO: 5629216 - DNA, 22 bp, Homo sapiens
ggttccagggactgtacctgta

SEQ ID NO: 5629217 - DNA, 17 bp, Homo sapiens
ggttccatccaccacct

SEQ ID NO: 5629218 - DNA, 18 bp, Homo sapiens
ggttccatccaccacctt

SEQ ID NO: 5629219 - DNA, 18 bp, Homo sapiens
ggttccatgcctgagggt

SEQ ID NO: 5629220 - DNA, 14 bp, Homo sapiens
ggttcccaataaaa

SEQ ID NO: 5629221 - DNA, 18 bp, Homo sapiens
ggttcccaataaaagtga

SEQ ID NO: 5629222 - DNA, 19 bp, Homo sapiens
ggttcccacaagcctgcct

SEQ ID NO: 5629223 - DNA, 16 bp, Homo sapiens
ggttcccactggctcc

SEQ ID NO: 5629224 - DNA, 13 bp, Homo sapiens
ggttcccagcagc

SEQ ID NO: 5629225 - DNA, 15 bp, Homo sapiens
ggttcccagcagctg

SEQ ID NO: 5629226 - DNA, 16 bp, Homo sapiens
ggttccccacacaggg

SEQ ID NO: 5629227 - DNA, 18 bp, Homo sapiens
ggttccccacacagggca

SEQ ID NO: 5629228 - DNA, 19 bp, Homo sapiens
ggttccccacacagggcac

SEQ ID NO: 5629229 - DNA, 23 bp, Homo sapiens
ggttccccacagtgacagtcact

SEQ ID NO: 5629230 - DNA, 13 bp, Homo sapiens
ggttccccagaga

SEQ ID NO: 5629231 - DNA, 14 bp, Homo sapiens
ggttccccagagag

SEQ ID NO: 5629232 - DNA, 22 bp, Homo sapiens
ggttccccagagagcaggcagg

SEQ ID NO: 5629233 - DNA, 15 bp, Homo sapiens
ggttcccccagccct

SEQ ID NO: 5629234 - DNA, 17 bp, Homo sapiens
ggttcccccaggaccct

SEQ ID NO: 5629235 - DNA, 19 bp, Homo sapiens
ggttcccccaggaccctga

SEQ ID NO: 5629236 - DNA, 19 bp, Homo sapiens
ggttcccccgaccaggttg

SEQ ID NO: 5629237 - DNA, 22 bp, Homo sapiens
ggttccccgcaacccacagctc

SEQ ID NO: 5629238 - DNA, 15 bp, Homo sapiens
ggttcccctgttcac

SEQ ID NO: 5629239 - DNA, 17 bp, Homo sapiens
ggttcccgagggagctg

SEQ ID NO: 5629240 - DNA, 20 bp, Homo sapiens
ggttcccgtgtgcctgagcg

SEQ ID NO: 5629241 - DNA, 20 bp, Homo sapiens
ggttccctccccagctcctc

SEQ ID NO: 5629242 - DNA, 19 bp, Homo sapiens
ggttccctcctagctctcc

SEQ ID NO: 5629243 - DNA, 16 bp, Homo sapiens
ggttccctctgagaat

SEQ ID NO: 5629244 - DNA, 16 bp, Homo sapiens
ggttccctctttcctg

SEQ ID NO: 5629245 - DNA, 18 bp, Homo sapiens
ggttccctgttcttcctc

SEQ ID NO: 5629246 - DNA, 12 bp, Homo sapiens
ggttcccttcct

SEQ ID NO: 5629247 - DNA, 17 bp, Homo sapiens
ggttccctttccttcca

SEQ ID NO: 5629248 - DNA, 21 bp, Homo sapiens
ggttccctttgacgccatccc

SEQ ID NO: 5629249 - DNA, 23 bp, Homo sapiens
ggttccgccaggcgctgcagggc

SEQ ID NO: 5629250 - DNA, 22 bp, Homo sapiens
ggttccgcttggagcagagggg

SEQ ID NO: 5629251 - DNA, 23 bp, Homo sapiens
ggttccgcttggagcagaggggc

SEQ ID NO: 5629252 - DNA, 21 bp, Homo sapiens
ggttccggaatcctgtcctca

SEQ ID NO: 5629253 - DNA, 16 bp, Homo sapiens
ggttccggcatggaca

SEQ ID NO: 5629254 - DNA, 17 bp, Homo sapiens
ggttcctacacaggaca

SEQ ID NO: 5629255 - DNA, 22 bp, Homo sapiens
ggttcctagatgtgttctaagc

SEQ ID NO: 5629256 - DNA, 18 bp, Homo sapiens
ggttcctatggctggcca

SEQ ID NO: 5629257 - DNA, 13 bp, Homo sapiens
ggttcctcctagg

SEQ ID NO: 5629258 - DNA, 23 bp, Homo sapiens
ggttcctcctaggcgctcagagg

SEQ ID NO: 5629259 - DNA, 19 bp, Homo sapiens
ggttcctcgttctccctgg

SEQ ID NO: 5629260 - DNA, 14 bp, Homo sapiens
ggttcctctctccc

SEQ ID NO: 5629261 - DNA, 14 bp, Homo sapiens
ggttcctctgcctg

SEQ ID NO: 5629262 - DNA, 17 bp, Homo sapiens
ggttcctcttaggtcag

SEQ ID NO: 5629263 - DNA, 17 bp, Homo sapiens
ggttcctgctgtcctgg

SEQ ID NO: 5629264 - DNA, 20 bp, Homo sapiens
ggttcctgctgtcctggtgg

SEQ ID NO: 5629265 - DNA, 11 bp, Homo sapiens
ggttcctggga

SEQ ID NO: 5629266 - DNA, 22 bp, Homo sapiens
ggttcctggggcatccatgggg

SEQ ID NO: 5629267 - DNA, 19 bp, Homo sapiens
ggttcctggggccgcctgc

SEQ ID NO: 5629268 - DNA, 20 bp, Homo sapiens
ggttcctggggccgcctgcc

SEQ ID NO: 5629269 - DNA, 20 bp, Homo sapiens
ggttcctgtatggtggaagc

SEQ ID NO: 5629270 - DNA, 18 bp, Homo sapiens
ggttcctgtgcagatgct

SEQ ID NO: 5629271 - DNA, 23 bp, Homo sapiens
ggttcctgtttgaacccaggaga

SEQ ID NO: 5629272 - DNA, 16 bp, Homo sapiens
ggttccttctgggcat

SEQ ID NO: 5629273 - DNA, 16 bp, Homo sapiens
ggttcctttgttccct

SEQ ID NO: 5629274 - DNA, 20 bp, Homo sapiens
ggttcctttgttccctaagt

SEQ ID NO: 5629275 - DNA, 13 bp, Homo sapiens
ggttcgagactcc

SEQ ID NO: 5629276 - DNA, 17 bp, Homo sapiens
ggttcgagactccatct

SEQ ID NO: 5629277 - DNA, 22 bp, Homo sapiens
ggttcgcgcaccaggtgtcttt

SEQ ID NO: 5629278 - DNA, 18 bp, Homo sapiens
ggttcggttgcagggctg

SEQ ID NO: 5629279 - DNA, 23 bp, Homo sapiens
ggttcgtggaaagggtgctgctt

SEQ ID NO: 5629280 - DNA, 13 bp, Homo sapiens
ggttctaaagttc

SEQ ID NO: 5629281 - DNA, 12 bp, Homo sapiens
ggttctaaatat

SEQ ID NO: 5629282 - DNA, 17 bp, Homo sapiens
ggttctaaatgcaataa

SEQ ID NO: 5629283 - DNA, 16 bp, Homo sapiens
ggttctaagtgggaga

SEQ ID NO: 5629284 - DNA, 13 bp, Homo sapiens
ggttctagaaggg

SEQ ID NO: 5629285 - DNA, 18 bp, Homo sapiens
ggttctagaaggggcgag

SEQ ID NO: 5629286 - DNA, 10 bp, Homo sapiens
ggttctagac

SEQ ID NO: 5629287 - DNA, 19 bp, Homo sapiens
ggttctagacgcccctccc

SEQ ID NO: 5629288 - DNA, 20 bp, Homo sapiens
ggttctagcatggcatattt

SEQ ID NO: 5629289 - DNA, 18 bp, Homo sapiens
ggttctaggcatctctgt

SEQ ID NO: 5629290 - DNA, 23 bp, Homo sapiens
ggttctaggcatctctgtacttt

SEQ ID NO: 5629291 - DNA, 16 bp, Homo sapiens
ggttctaggctgctgc

SEQ ID NO: 5629292 - DNA, 23 bp, Homo sapiens
ggttctagtctcctttgcactga

SEQ ID NO: 5629293 - DNA, 13 bp, Homo sapiens
ggttctataataa

SEQ ID NO: 5629294 - DNA, 20 bp, Homo sapiens
ggttctatgctaaactgtga

SEQ ID NO: 5629295 - DNA, 11 bp, Homo sapiens
ggttctatttt

SEQ ID NO: 5629296 - DNA, 22 bp, Homo sapiens
ggttctcaattccaacagttta

SEQ ID NO: 5629297 - DNA, 12 bp, Homo sapiens
ggttctcaattt

SEQ ID NO: 5629298 - DNA, 13 bp, Homo sapiens
ggttctcagcaag

SEQ ID NO: 5629299 - DNA, 17 bp, Homo sapiens
ggttctccccctcctga

SEQ ID NO: 5629300 - DNA, 21 bp, Homo sapiens
ggttctcttcattcccactgc

SEQ ID NO: 5629301 - DNA, 13 bp, Homo sapiens
ggttctgaacagc

SEQ ID NO: 5629302 - DNA, 15 bp, Homo sapiens
ggttctgactctgga

SEQ ID NO: 5629303 - DNA, 23 bp, Homo sapiens
ggttctgagaagcgctgccctgt

SEQ ID NO: 5629304 - DNA, 14 bp, Homo sapiens
ggttctgagaccag

SEQ ID NO: 5629305 - DNA, 21 bp, Homo sapiens
ggttctgatgatgtgcctggg

SEQ ID NO: 5629306 - DNA, 16 bp, Homo sapiens
ggttctgccctgcctg

SEQ ID NO: 5629307 - DNA, 19 bp, Homo sapiens
ggttctgccctgcctgagg

SEQ ID NO: 5629308 - DNA, 23 bp, Homo sapiens
ggttctgccctgcctgaggagga

SEQ ID NO: 5629309 - DNA, 12 bp, Homo sapiens
ggttctgcctct

SEQ ID NO: 5629310 - DNA, 20 bp, Homo sapiens
ggttctgcctgccagctgca

SEQ ID NO: 5629311 - DNA, 16 bp, Homo sapiens
ggttctgctttctgat

SEQ ID NO: 5629312 - DNA, 12 bp, Homo sapiens
ggttctggcagg

SEQ ID NO: 5629313 - DNA, 13 bp, Homo sapiens
ggttctggcagga

SEQ ID NO: 5629314 - DNA, 21 bp, Homo sapiens
ggttctggcaggacctgccta

SEQ ID NO: 5629315 - DNA, 12 bp, Homo sapiens
ggttctggctgc

SEQ ID NO: 5629316 - DNA, 13 bp, Homo sapiens
ggttctggctgtt

SEQ ID NO: 5629317 - DNA, 15 bp, Homo sapiens
ggttctgggcctctg

SEQ ID NO: 5629318 - DNA, 17 bp, Homo sapiens
ggttctggggctgagag

SEQ ID NO: 5629319 - DNA, 18 bp, Homo sapiens
ggttctggggctgggcct

SEQ ID NO: 5629320 - DNA, 20 bp, Homo sapiens
ggttctggttagctcagccc

SEQ ID NO: 5629321 - DNA, 22 bp, Homo sapiens
ggttctggttagctcagcccca

SEQ ID NO: 5629322 - DNA, 12 bp, Homo sapiens
ggttctgtaaaa

SEQ ID NO: 5629323 - DNA, 22 bp, Homo sapiens
ggttctgtctgtgccaagggca

SEQ ID NO: 5629324 - DNA, 19 bp, Homo sapiens
ggttctgtgacccatctgt

SEQ ID NO: 5629325 - DNA, 15 bp, Homo sapiens
ggttctgtttcagag

SEQ ID NO: 5629326 - DNA, 14 bp, Homo sapiens
ggttcttacagcac

SEQ ID NO: 5629327 - DNA, 20 bp, Homo sapiens
ggttcttcagatgctcttgg

SEQ ID NO: 5629328 - DNA, 14 bp, Homo sapiens
ggttcttcctcacc

SEQ ID NO: 5629329 - DNA, 12 bp, Homo sapiens
ggttcttcttat

SEQ ID NO: 5629330 - DNA, 12 bp, Homo sapiens
ggttcttgaaaa

SEQ ID NO: 5629331 - DNA, 13 bp, Homo sapiens
ggttcttgaaaat

SEQ ID NO: 5629332 - DNA, 19 bp, Homo sapiens
ggttcttgaggggaccagg

SEQ ID NO: 5629333 - DNA, 16 bp, Homo sapiens
ggttcttgcctttctt

SEQ ID NO: 5629334 - DNA, 17 bp, Homo sapiens
ggttcttggtagagatt

SEQ ID NO: 5629335 - DNA, 17 bp, Homo sapiens
ggttctttggaaggagt

SEQ ID NO: 5629336 - DNA, 13 bp, Homo sapiens
ggttctttgtgta

SEQ ID NO: 5629337 - DNA, 19 bp, Homo sapiens
ggttgaaaaccacagtcag

SEQ ID NO: 5629338 - DNA, 23 bp, Homo sapiens
ggttgaaaagattccattttata

SEQ ID NO: 5629339 - DNA, 16 bp, Homo sapiens
ggttgaactctggtgg

SEQ ID NO: 5629340 - DNA, 22 bp, Homo sapiens
ggttgaactctggtggcacagg

SEQ ID NO: 5629341 - DNA, 15 bp, Homo sapiens
ggttgaatatagcct

SEQ ID NO: 5629342 - DNA, 19 bp, Homo sapiens
ggttgaatatagcctgcct

SEQ ID NO: 5629343 - DNA, 18 bp, Homo sapiens
ggttgacagcaacaaagc

SEQ ID NO: 5629344 - DNA, 23 bp, Homo sapiens
ggttgacctgtttctctttgtct

SEQ ID NO: 5629345 - DNA, 13 bp, Homo sapiens
ggttgaggacagg

SEQ ID NO: 5629346 - DNA, 16 bp, Homo sapiens
ggttgaggacaggaga

SEQ ID NO: 5629347 - DNA, 21 bp, Homo sapiens
gtaaaacacatacaaaagaat

SEQ ID NO: 5629348 - DNA, 17 bp, Homo sapiens
gtaaaacagggccacat

SEQ ID NO: 5629349 - DNA, 15 bp, Homo sapiens
gtaaaaccacagcag

SEQ ID NO: 5629350 - DNA, 18 bp, Homo sapiens
gtaaaaccacagcagttg

SEQ ID NO: 5629351 - DNA, 15 bp, Homo sapiens
gtaaaacccaaaaca

SEQ ID NO: 5629352 - DNA, 21 bp, Homo sapiens
gtaaaaccttgttctattttt

SEQ ID NO: 5629353 - DNA, 17 bp, Homo sapiens
gtaaaaccttttttctt

SEQ ID NO: 5629354 - DNA, 16 bp, Homo sapiens
gtaaaactcgctttta

SEQ ID NO: 5629355 - DNA, 15 bp, Homo sapiens
gtaaaactgaggcac

SEQ ID NO: 5629356 - DNA, 11 bp, Homo sapiens
gtaaaactgtg

SEQ ID NO: 5629357 - DNA, 21 bp, Homo sapiens
gtaaaacttgtattggaagta

SEQ ID NO: 5629358 - DNA, 20 bp, Homo sapiens
gtaaaagaaatcatgtccat

SEQ ID NO: 5629359 - DNA, 15 bp, Homo sapiens
gtaaaagactttttt

SEQ ID NO: 5629360 - DNA, 15 bp, Homo sapiens
gtaaaagagccaagt

SEQ ID NO: 5629361 - DNA, 22 bp, Homo sapiens
gtaaaagagccaagttcaaaga

SEQ ID NO: 5629362 - DNA, 13 bp, Homo sapiens
gtaaaagagctgt

SEQ ID NO: 5629363 - DNA, 22 bp, Homo sapiens
gtaaaagataaatttgttgaat

SEQ ID NO: 5629364 - DNA, 17 bp, Homo sapiens
gtaaaagattaaactgc

SEQ ID NO: 5629365 - DNA, 18 bp, Homo sapiens
gtaaaagcaacatcagct

SEQ ID NO: 5629366 - DNA, 19 bp, Homo sapiens
gtaaaagcaacatcagctt

SEQ ID NO: 5629367 - DNA, 20 bp, Homo sapiens
gtaaaagcaacatcagcttg

SEQ ID NO: 5629368 - DNA, 16 bp, Homo sapiens
gtaaaagcattttgta

SEQ ID NO: 5629369 - DNA, 20 bp, Homo sapiens
gtaaaaggccaaacctctgt

SEQ ID NO: 5629370 - DNA, 22 bp, Homo sapiens
gtaaaaggccaaacctctgttc

SEQ ID NO: 5629371 - DNA, 18 bp, Homo sapiens
gtaaaagtctagttacct

SEQ ID NO: 5629372 - DNA, 15 bp, Homo sapiens
gtaaaagtgtgagca

SEQ ID NO: 5629373 - DNA, 16 bp, Homo sapiens
gtaaaagttactaata

SEQ ID NO: 5629374 - DNA, 19 bp, Homo sapiens
gtaaaataaaaccaccaaa

SEQ ID NO: 5629375 - DNA, 20 bp, Homo sapiens
gtaaaataaaggctctgtgc

SEQ ID NO: 5629376 - DNA, 12 bp, Homo sapiens
gtaaaataaata

SEQ ID NO: 5629377 - DNA, 19 bp, Homo sapiens
gtaaaataaatattgtctt

SEQ ID NO: 5629378 - DNA, 20 bp, Homo sapiens
gtaaaatacatgtacctata

SEQ ID NO: 5629379 - DNA, 18 bp, Homo sapiens
gtaaaatactattggaca

SEQ ID NO: 5629380 - DNA, 20 bp, Homo sapiens
gtaaaatatctacctgccct

SEQ ID NO: 5629381 - DNA, 14 bp, Homo sapiens
gtaaaatatgtaaa

SEQ ID NO: 5629382 - DNA, 18 bp, Homo sapiens
gtaaaatatgtaaaacta

SEQ ID NO: 5629383 - DNA, 18 bp, Homo sapiens
gtaaaatattttgaatca

SEQ ID NO: 5629384 - DNA, 19 bp, Homo sapiens
gtaaaatattttgaatcaa

SEQ ID NO: 5629385 - DNA, 12 bp, Homo sapiens
gtaaaatcactt

SEQ ID NO: 5629386 - DNA, 16 bp, Homo sapiens
gtaaaatcacttcaga

SEQ ID NO: 5629387 - DNA, 19 bp, Homo sapiens
gtaaaatcctacagtgaaa

SEQ ID NO: 5629388 - DNA, 20 bp, Homo sapiens
gtaaaatcctacagtgaaat

SEQ ID NO: 5629389 - DNA, 14 bp, Homo sapiens
gtaaaatcttcagc

SEQ ID NO: 5629390 - DNA, 12 bp, Homo sapiens
gtaaaatcttgt

SEQ ID NO: 5629391 - DNA, 16 bp, Homo sapiens
gtaaaatgaattgaaa

SEQ ID NO: 5629392 - DNA, 22 bp, Homo sapiens
gtaaaatgacaatcatgtgtgt

SEQ ID NO: 5629393 - DNA, 20 bp, Homo sapiens
gtaaaatgcttttcactttc

SEQ ID NO: 5629394 - DNA, 13 bp, Homo sapiens
gtaaaatggaaaa

SEQ ID NO: 5629395 - DNA, 11 bp, Homo sapiens
gtaaaatggag

SEQ ID NO: 5629396 - DNA, 15 bp, Homo sapiens
gtaaaatggaggtgg

SEQ ID NO: 5629397 - DNA, 19 bp, Homo sapiens
gtaaaatgtattatgtcct

SEQ ID NO: 5629398 - DNA, 18 bp, Homo sapiens
gtaaaatgtgaaaaacta

SEQ ID NO: 5629399 - DNA, 22 bp, Homo sapiens
gtaaaatgtgaagtgaatgaaa

SEQ ID NO: 5629400 - DNA, 15 bp, Homo sapiens
gtaaaatgttgaata

SEQ ID NO: 5629401 - DNA, 12 bp, Homo sapiens
gtaaaatgttta

SEQ ID NO: 5629402 - DNA, 10 bp, Homo sapiens
gtaaaattaa

SEQ ID NO: 5629403 - DNA, 18 bp, Homo sapiens
gtaaaattaatgtaataa

SEQ ID NO: 5629404 - DNA, 19 bp, Homo sapiens
gtaaaattaatgtaataaa

SEQ ID NO: 5629405 - DNA, 17 bp, Homo sapiens
gtaaaattacagaagaa

SEQ ID NO: 5629406 - DNA, 16 bp, Homo sapiens
gtaaaattagaaaaaa

SEQ ID NO: 5629407 - DNA, 19 bp, Homo sapiens
gtaaaattagaaaaaaaca

SEQ ID NO: 5629408 - DNA, 16 bp, Homo sapiens
gtaaaattagagcaag

SEQ ID NO: 5629409 - DNA, 18 bp, Homo sapiens
gtaaaattataaactttt

SEQ ID NO: 5629410 - DNA, 20 bp, Homo sapiens
gtaaaattataaacttttat

SEQ ID NO: 5629411 - DNA, 14 bp, Homo sapiens
gtaaaattatctgt

SEQ ID NO: 5629412 - DNA, 19 bp, Homo sapiens
gtaaaattatctgttctat

SEQ ID NO: 5629413 - DNA, 21 bp, Homo sapiens
gtaaaattatctgttctatgg

SEQ ID NO: 5629414 - DNA, 13 bp, Homo sapiens
gtaaaattctaaa

SEQ ID NO: 5629415 - DNA, 22 bp, Homo sapiens
gtaaaattctaaataaaatata

SEQ ID NO: 5629416 - DNA, 16 bp, Homo sapiens
gtaaaattgaaaggca

SEQ ID NO: 5629417 - DNA, 20 bp, Homo sapiens
gtaaaattgagtttcagaat

SEQ ID NO: 5629418 - DNA, 15 bp, Homo sapiens
gtaaaattgccatat

SEQ ID NO: 5629419 - DNA, 15 bp, Homo sapiens
gtaaaattgtataga

SEQ ID NO: 5629420 - DNA, 17 bp, Homo sapiens
gtaaaatttatttatat

SEQ ID NO: 5629421 - DNA, 17 bp, Homo sapiens
gtaaaatttcaggatta

SEQ ID NO: 5629422 - DNA, 19 bp, Homo sapiens
gtaaaatttgtgtaaattt

SEQ ID NO: 5629423 - DNA, 22 bp, Homo sapiens
gtaaaatttgtgtaaatttgta

SEQ ID NO: 5629424 - DNA, 13 bp, Homo sapiens
gtaaaattttagg

SEQ ID NO: 5629425 - DNA, 23 bp, Homo sapiens
gtaaacaaaatttagtttttgtt

SEQ ID NO: 5629426 - DNA, 19 bp, Homo sapiens
gtaaacaaactcttgaaga

SEQ ID NO: 5629427 - DNA, 21 bp, Homo sapiens
gtaaacaaagactttgatcca

SEQ ID NO: 5629428 - DNA, 14 bp, Homo sapiens
gtaaacaaatattt

SEQ ID NO: 5629429 - DNA, 11 bp, Homo sapiens
gtaaacaaatt

SEQ ID NO: 5629430 - DNA, 12 bp, Homo sapiens
gtaaacaacata

SEQ ID NO: 5629431 - DNA, 12 bp, Homo sapiens
gtaaacacataa

SEQ ID NO: 5629432 - DNA, 17 bp, Homo sapiens
gtaaacacataaatgaa

SEQ ID NO: 5629433 - DNA, 11 bp, Homo sapiens
gtaaacactgt

SEQ ID NO: 5629434 - DNA, 22 bp, Homo sapiens
gtaaacagaaatcctttcataa

SEQ ID NO: 5629435 - DNA, 17 bp, Homo sapiens
gtaaacagaaattgcaa

SEQ ID NO: 5629436 - DNA, 20 bp, Homo sapiens
gtaaacagaagcctgtttca

SEQ ID NO: 5629437 - DNA, 13 bp, Homo sapiens
gtaaacagaagga

SEQ ID NO: 5629438 - DNA, 19 bp, Homo sapiens
gtaaacagcctctttttga

SEQ ID NO: 5629439 - DNA, 22 bp, Homo sapiens
gtaaacaggtatttttttaaat

SEQ ID NO: 5629440 - DNA, 13 bp, Homo sapiens
gtaaacagtgcct

SEQ ID NO: 5629441 - DNA, 18 bp, Homo sapiens
gtaaacagtgcctgctga

SEQ ID NO: 5629442 - DNA, 20 bp, Homo sapiens
gtaaacagtttttattaaaa

SEQ ID NO: 5629443 - DNA, 16 bp, Homo sapiens
gtaaacataccaacat

SEQ ID NO: 5629444 - DNA, 23 bp, Homo sapiens
gtaaacatatttatttttacctg

SEQ ID NO: 5629445 - DNA, 22 bp, Homo sapiens
gtaaacatcataaatagtaaat

SEQ ID NO: 5629446 - DNA, 21 bp, Homo sapiens
gtaaacattaagtaaatgctg

SEQ ID NO: 5629447 - DNA, 12 bp, Homo sapiens
gtaaacatttat

SEQ ID NO: 5629448 - DNA, 14 bp, Homo sapiens
gtaaacatttgtaa

SEQ ID NO: 5629449 - DNA, 19 bp, Homo sapiens
gtaaacatttgtaaaaata

SEQ ID NO: 5629450 - DNA, 19 bp, Homo sapiens
gtaaaccaattttttgttc

SEQ ID NO: 5629451 - DNA, 12 bp, Homo sapiens
gtaaaccactga

SEQ ID NO: 5629452 - DNA, 18 bp, Homo sapiens
gtaaaccactgaaaaaat

SEQ ID NO: 5629453 - DNA, 14 bp, Homo sapiens
gtaaaccagatctg

SEQ ID NO: 5629454 - DNA, 18 bp, Homo sapiens
gtaaaccagatctgtctc

SEQ ID NO: 5629455 - DNA, 22 bp, Homo sapiens
gtaaaccattcttgggaggaca

SEQ ID NO: 5629456 - DNA, 14 bp, Homo sapiens
gtaaaccattgtaa

SEQ ID NO: 5629457 - DNA, 22 bp, Homo sapiens
gtaaacccctttagtggcttca

SEQ ID NO: 5629458 - DNA, 20 bp, Homo sapiens
gtaaaccctatctgtgattc

SEQ ID NO: 5629459 - DNA, 20 bp, Homo sapiens
gtaaacctagtaaaaccttg

SEQ ID NO: 5629460 - DNA, 22 bp, Homo sapiens
gtaaacctgaaatatattttaa

SEQ ID NO: 5629461 - DNA, 14 bp, Homo sapiens
gtaaacctgtctga

SEQ ID NO: 5629462 - DNA, 13 bp, Homo sapiens
gtaaaccttttat

SEQ ID NO: 5629463 - DNA, 20 bp, Homo sapiens
gtaaacgctgtccctagtaa

SEQ ID NO: 5629464 - DNA, 21 bp, Homo sapiens
gtaaacggcccaggccaggtg

SEQ ID NO: 5629465 - DNA, 21 bp, Homo sapiens
gtaaacgtttcagtaataaaa

SEQ ID NO: 5629466 - DNA, 23 bp, Homo sapiens
gtaaacgtttcagtaataaaaca

SEQ ID NO: 5629467 - DNA, 15 bp, Homo sapiens
gtaaactaaagtgtg

SEQ ID NO: 5629468 - DNA, 16 bp, Homo sapiens
gtaaactaaagtgtgc

SEQ ID NO: 5629469 - DNA, 23 bp, Homo sapiens
gtaaactaatgagtttcttttat

SEQ ID NO: 5629470 - DNA, 15 bp, Homo sapiens
gtaaactataaacta

SEQ ID NO: 5629471 - DNA, 22 bp, Homo sapiens
gtaaactataaactactgtaat

SEQ ID NO: 5629472 - DNA, 22 bp, Homo sapiens
gtaaactatcttggtgaatttt

SEQ ID NO: 5629473 - DNA, 15 bp, Homo sapiens
gtaaactattcttaa

SEQ ID NO: 5629474 - DNA, 15 bp, Homo sapiens
gtaaactcaaaactt

SEQ ID NO: 5629475 - DNA, 23 bp, Homo sapiens
gtaaactcaaaatatttgtacat

SEQ ID NO: 5629476 - DNA, 12 bp, Homo sapiens
gtaaactctctt

SEQ ID NO: 5629477 - DNA, 16 bp, Homo sapiens
gtaaactctcttctct

SEQ ID NO: 5629478 - DNA, 17 bp, Homo sapiens
gtaaactcttcaccttg

SEQ ID NO: 5629479 - DNA, 15 bp, Homo sapiens
gtaaactgatgtact

SEQ ID NO: 5629480 - DNA, 13 bp, Homo sapiens
gtaaactgccctg

SEQ ID NO: 5629481 - DNA, 19 bp, Homo sapiens
gtaaactgtactagtctgt

SEQ ID NO: 5629482 - DNA, 20 bp, Homo sapiens
gtaaactgtgtattccaaga

SEQ ID NO: 5629483 - DNA, 23 bp, Homo sapiens
gtaaactgttgttttgtatgagc

SEQ ID NO: 5629484 - DNA, 15 bp, Homo sapiens
gtaaactgtttcttt

SEQ ID NO: 5629485 - DNA, 21 bp, Homo sapiens
gtaaacttcctattttcttga

SEQ ID NO: 5629486 - DNA, 14 bp, Homo sapiens
gtaaacttgtacat

SEQ ID NO: 5629487 - DNA, 12 bp, Homo sapiens
gtaaactttaac

SEQ ID NO: 5629488 - DNA, 16 bp, Homo sapiens
gtaaactttgaaatat

SEQ ID NO: 5629489 - DNA, 16 bp, Homo sapiens
gtaaactttttcaatg

SEQ ID NO: 5629490 - DNA, 17 bp, Homo sapiens
gtaaagaaaaatattta

SEQ ID NO: 5629491 - DNA, 14 bp, Homo sapiens
gtaaagaaaaccat

SEQ ID NO: 5629492 - DNA, 21 bp, Homo sapiens
gtaaagaaatacacagggagg

SEQ ID NO: 5629493 - DNA, 21 bp, Homo sapiens
gtaaagaaatttaaaagacac

SEQ ID NO: 5629494 - DNA, 23 bp, Homo sapiens
gtaaagaacgcgacttccacaaa

SEQ ID NO: 5629495 - DNA, 17 bp, Homo sapiens
gtaaagaactttttctt

SEQ ID NO: 5629496 - DNA, 22 bp, Homo sapiens
gtaaagaagggatattaagaat

SEQ ID NO: 5629497 - DNA, 13 bp, Homo sapiens
gtaaagaattatt

SEQ ID NO: 5629498 - DNA, 11 bp, Homo sapiens
gtaaagacaga

SEQ ID NO: 5629499 - DNA, 14 bp, Homo sapiens
gtaaagagaaactt

SEQ ID NO: 5629500 - DNA, 21 bp, Homo sapiens
gtaaagagacctacctcaggt

SEQ ID NO: 5629501 - DNA, 22 bp, Homo sapiens
gtaaagagatgtcaaaatgtga

SEQ ID NO: 5629502 - DNA, 19 bp, Homo sapiens
gtaaagatatttttatctt

SEQ ID NO: 5629503 - DNA, 22 bp, Homo sapiens
gtaaagatatttttatctttat

SEQ ID NO: 5629504 - DNA, 18 bp, Homo sapiens
gtaaagcaaactggggct

SEQ ID NO: 5629505 - DNA, 22 bp, Homo sapiens
gtaaagcaaactggggctgtgt

SEQ ID NO: 5629506 - DNA, 16 bp, Homo sapiens
gtaaagccaaaaccat

SEQ ID NO: 5629507 - DNA, 21 bp, Homo sapiens
gtaaagccatgttaaatgact

SEQ ID NO: 5629508 - DNA, 19 bp, Homo sapiens
gtaaagcgggaaggacatt

SEQ ID NO: 5629509 - DNA, 20 bp, Homo sapiens
gtaaagctaaaataaagaaa

SEQ ID NO: 5629510 - DNA, 12 bp, Homo sapiens
gtaaagctccta

SEQ ID NO: 5629511 - DNA, 12 bp, Homo sapiens
gtaaagctggcc

SEQ ID NO: 5629512 - DNA, 22 bp, Homo sapiens
gtaaagctgttaaaatacataa

SEQ ID NO: 5629513 - DNA, 17 bp, Homo sapiens
gtaaagcttaaattgct

SEQ ID NO: 5629514 - DNA, 12 bp, Homo sapiens
gtaaaggaaata

SEQ ID NO: 5629515 - DNA, 18 bp, Homo sapiens
gtaaaggaaataagagca

SEQ ID NO: 5629516 - DNA, 19 bp, Homo sapiens
gtaaaggatattaaatgtt

SEQ ID NO: 5629517 - DNA, 16 bp, Homo sapiens
gtaaaggcctcctccc

SEQ ID NO: 5629518 - DNA, 16 bp, Homo sapiens
gtaaagggacactgga

SEQ ID NO: 5629519 - DNA, 18 bp, Homo sapiens
gtaaagggcaaataatga

SEQ ID NO: 5629520 - DNA, 19 bp, Homo sapiens
gtaaagggttaatagccag

SEQ ID NO: 5629521 - DNA, 15 bp, Homo sapiens
gtaaaggtaggtgca

SEQ ID NO: 5629522 - DNA, 15 bp, Homo sapiens
gtaaagtaaaatatg

SEQ ID NO: 5629523 - DNA, 18 bp, Homo sapiens
gtaaagtacaagctgtaa

SEQ ID NO: 5629524 - DNA, 16 bp, Homo sapiens
gtaaagtatgtaaaca

SEQ ID NO: 5629525 - DNA, 14 bp, Homo sapiens
gtaatataatgtat

SEQ ID NO: 5629526 - DNA, 15 bp, Homo sapiens
gtaatatagaaaaaa

SEQ ID NO: 5629527 - DNA, 23 bp, Homo sapiens
gtaatatagggtttgtttgctgc

SEQ ID NO: 5629528 - DNA, 13 bp, Homo sapiens
gtaatatatacat

SEQ ID NO: 5629529 - DNA, 11 bp, Homo sapiens
gtaatatatat

SEQ ID NO: 5629530 - DNA, 22 bp, Homo sapiens
gtaatatatatatttttgtgaa

SEQ ID NO: 5629531 - DNA, 22 bp, Homo sapiens
gtaatatattctgaagcaacat

SEQ ID NO: 5629532 - DNA, 22 bp, Homo sapiens
gtaatatattgccagtatataa

SEQ ID NO: 5629533 - DNA, 12 bp, Homo sapiens
gtaatatattta

SEQ ID NO: 5629534 - DNA, 19 bp, Homo sapiens
gtaatatcaaagcatttta

SEQ ID NO: 5629535 - DNA, 18 bp, Homo sapiens
gtaatatcagttacagtg

SEQ ID NO: 5629536 - DNA, 20 bp, Homo sapiens
gtaatatcatttcataaaaa

SEQ ID NO: 5629537 - DNA, 16 bp, Homo sapiens
gtaatatcattttata

SEQ ID NO: 5629538 - DNA, 20 bp, Homo sapiens
gtaatatcttactaaggcct

SEQ ID NO: 5629539 - DNA, 12 bp, Homo sapiens
gtaatatcttta

SEQ ID NO: 5629540 - DNA, 13 bp, Homo sapiens
gtaatatctttaa

SEQ ID NO: 5629541 - DNA, 12 bp, Homo sapiens
gtaatatgaaat

SEQ ID NO: 5629542 - DNA, 13 bp, Homo sapiens
gtaatatgacaga

SEQ ID NO: 5629543 - DNA, 13 bp, Homo sapiens
gtaatatgagaat

SEQ ID NO: 5629544 - DNA, 18 bp, Homo sapiens
gtaatatgagaatgtatt

SEQ ID NO: 5629545 - DNA, 14 bp, Homo sapiens
gtaatatgcacaca

SEQ ID NO: 5629546 - DNA, 15 bp, Homo sapiens
gtaatatgctctcat

SEQ ID NO: 5629547 - DNA, 20 bp, Homo sapiens
gtaatatggaaatcttttac

SEQ ID NO: 5629548 - DNA, 14 bp, Homo sapiens
gtaatattaaaaag

SEQ ID NO: 5629549 - DNA, 15 bp, Homo sapiens
gtaatattaaaaaga

SEQ ID NO: 5629550 - DNA, 16 bp, Homo sapiens
gtaatattaaaaagaa

SEQ ID NO: 5629551 - DNA, 13 bp, Homo sapiens
gtaatattacatt

SEQ ID NO: 5629552 - DNA, 17 bp, Homo sapiens
gtaatattacatttcat

SEQ ID NO: 5629553 - DNA, 20 bp, Homo sapiens
gtaatattacatttcattta

SEQ ID NO: 5629554 - DNA, 20 bp, Homo sapiens
gtaatattgacttgtatatt

SEQ ID NO: 5629555 - DNA, 20 bp, Homo sapiens
gtaatatttacataaagact

SEQ ID NO: 5629556 - DNA, 14 bp, Homo sapiens
gtaatatttattaa

SEQ ID NO: 5629557 - DNA, 18 bp, Homo sapiens
gtaatatttattaaattt

SEQ ID NO: 5629558 - DNA, 13 bp, Homo sapiens
gtaatattttgta

SEQ ID NO: 5629559 - DNA, 14 bp, Homo sapiens
gtaatcaaacttct

SEQ ID NO: 5629560 - DNA, 20 bp, Homo sapiens
gtaatcaataaacgatttaa

SEQ ID NO: 5629561 - DNA, 16 bp, Homo sapiens
gtaatcaataaagaaa

SEQ ID NO: 5629562 - DNA, 22 bp, Homo sapiens
gtaatcaatatcccaacattct

SEQ ID NO: 5629563 - DNA, 14 bp, Homo sapiens
gtaatcaatgtttc

SEQ ID NO: 5629564 - DNA, 18 bp, Homo sapiens
gtaatcacaactcagcat

SEQ ID NO: 5629565 - DNA, 22 bp, Homo sapiens
gtaatcactcccatttttactt

SEQ ID NO: 5629566 - DNA, 16 bp, Homo sapiens
gtaatcatctaagtca

SEQ ID NO: 5629567 - DNA, 15 bp, Homo sapiens
gtaatcatgttttaa

SEQ ID NO: 5629568 - DNA, 20 bp, Homo sapiens
gtaatcatttatcttatcta

SEQ ID NO: 5629569 - DNA, 20 bp, Homo sapiens
gtaatcatttcttgggccct

SEQ ID NO: 5629570 - DNA, 22 bp, Homo sapiens
gtaatcatttcttgggccctcc

SEQ ID NO: 5629571 - DNA, 20 bp, Homo sapiens
gtaatcattttaaattccac

SEQ ID NO: 5629572 - DNA, 14 bp, Homo sapiens
gtaatcattttaat

SEQ ID NO: 5629573 - DNA, 18 bp, Homo sapiens
gtaatccaggcacagctg

SEQ ID NO: 5629574 - DNA, 13 bp, Homo sapiens
gtaatcccagcac

SEQ ID NO: 5629575 - DNA, 15 bp, Homo sapiens
gtaatcccagcactt

SEQ ID NO: 5629576 - DNA, 17 bp, Homo sapiens
gtaatcccagctactca

SEQ ID NO: 5629577 - DNA, 15 bp, Homo sapiens
gtaatcccagtgact

SEQ ID NO: 5629578 - DNA, 13 bp, Homo sapiens
gtaatcctaaatt

SEQ ID NO: 5629579 - DNA, 23 bp, Homo sapiens
gtaatcctagcactttgggaggc

SEQ ID NO: 5629580 - DNA, 13 bp, Homo sapiens
gtaatcctcctga

SEQ ID NO: 5629581 - DNA, 17 bp, Homo sapiens
gtaatcctcttctaaaa

SEQ ID NO: 5629582 - DNA, 18 bp, Homo sapiens
gtaatcctgtatattatg

SEQ ID NO: 5629583 - DNA, 16 bp, Homo sapiens
gtaatcgttatgtgtg

SEQ ID NO: 5629584 - DNA, 17 bp, Homo sapiens
gtaatctacaccaatga

SEQ ID NO: 5629585 - DNA, 18 bp, Homo sapiens
gtaatctacaccaatgaa

SEQ ID NO: 5629586 - DNA, 15 bp, Homo sapiens
gtaatctactgtaaa

SEQ ID NO: 5629587 - DNA, 20 bp, Homo sapiens
gtaatctagttgtcaataaa

SEQ ID NO: 5629588 - DNA, 20 bp, Homo sapiens
gtaatctatgtgtttctgta

SEQ ID NO: 5629589 - DNA, 14 bp, Homo sapiens
gtaatctatgttta

SEQ ID NO: 5629590 - DNA, 15 bp, Homo sapiens
gtaatctatgtttat

SEQ ID NO: 5629591 - DNA, 16 bp, Homo sapiens
gtaatctatgtttata

SEQ ID NO: 5629592 - DNA, 19 bp, Homo sapiens
gtaatctcacagcatttgc

SEQ ID NO: 5629593 - DNA, 21 bp, Homo sapiens
gtaatctcggaaggctgaggc

SEQ ID NO: 5629594 - DNA, 14 bp, Homo sapiens
gtaatctctctgca

SEQ ID NO: 5629595 - DNA, 16 bp, Homo sapiens
gtaatctgacttctca

SEQ ID NO: 5629596 - DNA, 14 bp, Homo sapiens
gtaatctgagaaac

SEQ ID NO: 5629597 - DNA, 19 bp, Homo sapiens
gtaatctgagaaacaatga

SEQ ID NO: 5629598 - DNA, 22 bp, Homo sapiens
gtaatctgagggttaatttcta

SEQ ID NO: 5629599 - DNA, 24 bp, Homo sapiens
gtaatctgatcgttctttctagct

SEQ ID NO: 5629600 - DNA, 16 bp, Homo sapiens
gtaatctgatggcttc

SEQ ID NO: 5629601 - DNA, 18 bp, Homo sapiens
gtaatctgctttgttaat

SEQ ID NO: 5629602 - DNA, 16 bp, Homo sapiens
gtaatctgtataatac

SEQ ID NO: 5629603 - DNA, 20 bp, Homo sapiens
gtaatctgtgtacaaagaaa

SEQ ID NO: 5629604 - DNA, 20 bp, Homo sapiens
gtaatctttacctgtataca

SEQ ID NO: 5629605 - DNA, 14 bp, Homo sapiens
gtaatctttatact

SEQ ID NO: 5629606 - DNA, 16 bp, Homo sapiens
gtaatctttatactgg

SEQ ID NO: 5629607 - DNA, 13 bp, Homo sapiens
gtaatcttttctg

SEQ ID NO: 5629608 - DNA, 10 bp, Homo sapiens
gtaatgaaac

SEQ ID NO: 5629609 - DNA, 16 bp, Homo sapiens
gtaatgaaacttggat

SEQ ID NO: 5629610 - DNA, 14 bp, Homo sapiens
gtaatgaaatgttt

SEQ ID NO: 5629611 - DNA, 15 bp, Homo sapiens
gtaatgaagaatcac

SEQ ID NO: 5629612 - DNA, 13 bp, Homo sapiens
gtaatgaagtaaa

SEQ ID NO: 5629613 - DNA, 21 bp, Homo sapiens
gtaatgaatttttatgatatt

SEQ ID NO: 5629614 - DNA, 21 bp, Homo sapiens
gtaatgacaaaagatacaaaa

SEQ ID NO: 5629615 - DNA, 22 bp, Homo sapiens
gtaatgacagaacatgctgtta

SEQ ID NO: 5629616 - DNA, 13 bp, Homo sapiens
gtaatgacagatg

SEQ ID NO: 5629617 - DNA, 16 bp, Homo sapiens
gtaatgacgtgtgtgg

SEQ ID NO: 5629618 - DNA, 22 bp, Homo sapiens
gtaatgacgtgtgtggctggga

SEQ ID NO: 5629619 - DNA, 18 bp, Homo sapiens
gtaatgacttagaaactg

SEQ ID NO: 5629620 - DNA, 23 bp, Homo sapiens
gtaatgaggtggtactatgatta

SEQ ID NO: 5629621 - DNA, 22 bp, Homo sapiens
gtaatgatactgattatgaaat

SEQ ID NO: 5629622 - DNA, 14 bp, Homo sapiens
gtaatgatactgtg

SEQ ID NO: 5629623 - DNA, 20 bp, Homo sapiens
gtaatgatatagccagaaaa

SEQ ID NO: 5629624 - DNA, 16 bp, Homo sapiens
gtaatgatgttgataa

SEQ ID NO: 5629625 - DNA, 15 bp, Homo sapiens
gtaatgatttcttga

SEQ ID NO: 5629626 - DNA, 16 bp, Homo sapiens
gtaatgattttggaac

SEQ ID NO: 5629627 - DNA, 19 bp, Homo sapiens
gtaatgattttggaactgt

SEQ ID NO: 5629628 - DNA, 14 bp, Homo sapiens
gtaatgcacaattt

SEQ ID NO: 5629629 - DNA, 19 bp, Homo sapiens
gtaatgcacaatttagaaa

SEQ ID NO: 5629630 - DNA, 17 bp, Homo sapiens
gtaatgcactcctgccc

SEQ ID NO: 5629631 - DNA, 16 bp, Homo sapiens
gtaatgcactttggga

SEQ ID NO: 5629632 - DNA, 21 bp, Homo sapiens
gtaatgcagacatttacatgt

SEQ ID NO: 5629633 - DNA, 19 bp, Homo sapiens
gtaatgcatacagaaatat

SEQ ID NO: 5629634 - DNA, 16 bp, Homo sapiens
gtaatgcattaataaa

SEQ ID NO: 5629635 - DNA, 21 bp, Homo sapiens
gtaatgcattaataaaaatca

SEQ ID NO: 5629636 - DNA, 17 bp, Homo sapiens
gtaatgcgccaataaac

SEQ ID NO: 5629637 - DNA, 12 bp, Homo sapiens
gtaatgctgcct

SEQ ID NO: 5629638 - DNA, 21 bp, Homo sapiens
gtaatgctgcctcaggaccca

SEQ ID NO: 5629639 - DNA, 15 bp, Homo sapiens
gtaatgctgtacagc

SEQ ID NO: 5629640 - DNA, 18 bp, Homo sapiens
gtaatggactatgcacac

SEQ ID NO: 5629641 - DNA, 22 bp, Homo sapiens
gtaatggaggccaagcctgcag

SEQ ID NO: 5629642 - DNA, 18 bp, Homo sapiens
gtaatggaggtcccagcc

SEQ ID NO: 5629643 - DNA, 21 bp, Homo sapiens
gtaatggaggtcccagccctg

SEQ ID NO: 5629644 - DNA, 17 bp, Homo sapiens
gtaatggatatgaaaga

SEQ ID NO: 5629645 - DNA, 13 bp, Homo sapiens
gtaatggcagagc

SEQ ID NO: 5629646 - DNA, 23 bp, Homo sapiens
gtaatggcagttatattttgcag

SEQ ID NO: 5629647 - DNA, 16 bp, Homo sapiens
gtaatgggccaattaa

SEQ ID NO: 5629648 - DNA, 22 bp, Homo sapiens
gtaatgggccaattaaaatata

SEQ ID NO: 5629649 - DNA, 12 bp, Homo sapiens
gtaatgggcctg

SEQ ID NO: 5629650 - DNA, 16 bp, Homo sapiens
gtaatgggcctgccca

SEQ ID NO: 5629651 - DNA, 22 bp, Homo sapiens
gtaatggggcagaaatctgagg

SEQ ID NO: 5629652 - DNA, 23 bp, Homo sapiens
gtaatgggtacaatgaagaagtt

SEQ ID NO: 5629653 - DNA, 11 bp, Homo sapiens
gtaatggtgct

SEQ ID NO: 5629654 - DNA, 15 bp, Homo sapiens
gtaatggtgtagaac

SEQ ID NO: 5629655 - DNA, 16 bp, Homo sapiens
gtaatggtgtagaaca

SEQ ID NO: 5629656 - DNA, 16 bp, Homo sapiens
gtaatggttgggacca

SEQ ID NO: 5629657 - DNA, 21 bp, Homo sapiens
gtaatgtacaattttatataa

SEQ ID NO: 5629658 - DNA, 21 bp, Homo sapiens
gtaatgtagcgtgtttacatg

SEQ ID NO: 5629659 - DNA, 12 bp, Homo sapiens
gtaatgtatctt

SEQ ID NO: 5629660 - DNA, 19 bp, Homo sapiens
gtaatgtatcttatttata

SEQ ID NO: 5629661 - DNA, 20 bp, Homo sapiens
gtaatgtatcttatttatat

SEQ ID NO: 5629662 - DNA, 23 bp, Homo sapiens
gtaatgtattttacagtacatgt

SEQ ID NO: 5629663 - DNA, 19 bp, Homo sapiens
gtaatgtcaccaccttccc

SEQ ID NO: 5629664 - DNA, 16 bp, Homo sapiens
gtaatgtcactgtttt

SEQ ID NO: 5629665 - DNA, 12 bp, Homo sapiens
gtaatgtcagac

SEQ ID NO: 5629666 - DNA, 23 bp, Homo sapiens
gtaatgtcagactttgctgcatt

SEQ ID NO: 5629667 - DNA, 14 bp, Homo sapiens
gtaatgtcttcagt

SEQ ID NO: 5629668 - DNA, 16 bp, Homo sapiens
gtaatgtgaataaatt

SEQ ID NO: 5629669 - DNA, 17 bp, Homo sapiens
gtaatgtggaagaaaat

SEQ ID NO: 5629670 - DNA, 18 bp, Homo sapiens
gtaatgtgtggtggcctc

SEQ ID NO: 5629671 - DNA, 17 bp, Homo sapiens
gtaatgttaatattgat

SEQ ID NO: 5629672 - DNA, 20 bp, Homo sapiens
gtaatgttaatgttatatca

SEQ ID NO: 5629673 - DNA, 13 bp, Homo sapiens
gtaatgttactga

SEQ ID NO: 5629674 - DNA, 21 bp, Homo sapiens
gtaatgttactgatcatgcat

SEQ ID NO: 5629675 - DNA, 14 bp, Homo sapiens
gtaatgtttaagat

SEQ ID NO: 5629676 - DNA, 19 bp, Homo sapiens
gtaatgttttctttgcaaa

SEQ ID NO: 5629677 - DNA, 15 bp, Homo sapiens
gtaatgttttgtata

SEQ ID NO: 5629678 - DNA, 16 bp, Homo sapiens
gtaatgttttgtatat

SEQ ID NO: 5629679 - DNA, 20 bp, Homo sapiens
gtaatgtttttatttcaatt

SEQ ID NO: 5629680 - DNA, 23 bp, Homo sapiens
gtaatgtttttatttcaattgtt

SEQ ID NO: 5629681 - DNA, 21 bp, Homo sapiens
gtaattaaaaagacactttta

SEQ ID NO: 5629682 - DNA, 13 bp, Homo sapiens
gtaattaaaagac

SEQ ID NO: 5629683 - DNA, 19 bp, Homo sapiens
gtaattaaggtacatcatt

SEQ ID NO: 5629684 - DNA, 22 bp, Homo sapiens
gtaattaaggtacatcattatt

SEQ ID NO: 5629685 - DNA, 21 bp, Homo sapiens
gtaattaagtactatgtatca

SEQ ID NO: 5629686 - DNA, 16 bp, Homo sapiens
gtaattaataaacgaa

SEQ ID NO: 5629687 - DNA, 18 bp, Homo sapiens
gtaattaataaagaaaaa

SEQ ID NO: 5629688 - DNA, 16 bp, Homo sapiens
gtaattacctggagaa

SEQ ID NO: 5629689 - DNA, 14 bp, Homo sapiens
gtaattagctctgg

SEQ ID NO: 5629690 - DNA, 15 bp, Homo sapiens
gtaattagctctggg

SEQ ID NO: 5629691 - DNA, 19 bp, Homo sapiens
gtaattaggataactaaaa

SEQ ID NO: 5629692 - DNA, 15 bp, Homo sapiens
gtaattagtaacatg

SEQ ID NO: 5629693 - DNA, 23 bp, Homo sapiens
gtaattagtaacatgtgttaagt

SEQ ID NO: 5629694 - DNA, 20 bp, Homo sapiens
gtaattagtgccacttaatg

SEQ ID NO: 5629695 - DNA, 15 bp, Homo sapiens
gtaattataggaagt

SEQ ID NO: 5629696 - DNA, 16 bp, Homo sapiens
gtaattatatctgttt

SEQ ID NO: 5629697 - DNA, 13 bp, Homo sapiens
gtaattatcagtt

SEQ ID NO: 5629698 - DNA, 22 bp, Homo sapiens
gtaattatgaaaagaaataaag

SEQ ID NO: 5629699 - DNA, 13 bp, Homo sapiens
gtaattatggagt

SEQ ID NO: 5629700 - DNA, 19 bp, Homo sapiens
gtaattattatttaactct

SEQ ID NO: 5629701 - DNA, 19 bp, Homo sapiens
gtaattatttatgtatggt

SEQ ID NO: 5629702 - DNA, 13 bp, Homo sapiens
gtaattatttgaa

SEQ ID NO: 5629703 - DNA, 13 bp, Homo sapiens
gtatgaacttgag

SEQ ID NO: 5629704 - DNA, 23 bp, Homo sapiens
gtatgaacttgaggacacatgtc

SEQ ID NO: 5629705 - DNA, 14 bp, Homo sapiens
gtatgaagacactg

SEQ ID NO: 5629706 - DNA, 18 bp, Homo sapiens
gtatgaagagctgtcttc

SEQ ID NO: 5629707 - DNA, 13 bp, Homo sapiens
gtatgaagtatct

SEQ ID NO: 5629708 - DNA, 22 bp, Homo sapiens
gtatgaataaaaggctggaaac

SEQ ID NO: 5629709 - DNA, 23 bp, Homo sapiens
gtatgaataatgaaaataaaaca

SEQ ID NO: 5629710 - DNA, 16 bp, Homo sapiens
gtatgaataattgcat

SEQ ID NO: 5629711 - DNA, 15 bp, Homo sapiens
gtatgaatacagcag

SEQ ID NO: 5629712 - DNA, 20 bp, Homo sapiens
gtatgaatacagcagcaaga

SEQ ID NO: 5629713 - DNA, 16 bp, Homo sapiens
gtatgaatatttcatt

SEQ ID NO: 5629714 - DNA, 21 bp, Homo sapiens
gtatgaatctatgccaaagat

SEQ ID NO: 5629715 - DNA, 17 bp, Homo sapiens
gtatgaatgatatcttt

SEQ ID NO: 5629716 - DNA, 18 bp, Homo sapiens
gtatgaattattcaattt

SEQ ID NO: 5629717 - DNA, 14 bp, Homo sapiens
gtatgaatttgagc

SEQ ID NO: 5629718 - DNA, 18 bp, Homo sapiens
gtatgacccctggccaca

SEQ ID NO: 5629719 - DNA, 19 bp, Homo sapiens
gtatgacgctgatacataa

SEQ ID NO: 5629720 - DNA, 14 bp, Homo sapiens
gtatgactaaagag

SEQ ID NO: 5629721 - DNA, 23 bp, Homo sapiens
gtatgacttaattttagaaagaa

SEQ ID NO: 5629722 - DNA, 17 bp, Homo sapiens
gtatgacttctgctgaa

SEQ ID NO: 5629723 - DNA, 17 bp, Homo sapiens
gtatgagaaacctatat

SEQ ID NO: 5629724 - DNA, 21 bp, Homo sapiens
gtatgagaaatacagtgcttt

SEQ ID NO: 5629725 - DNA, 21 bp, Homo sapiens
gtatgagataggcacatgcat

SEQ ID NO: 5629726 - DNA, 14 bp, Homo sapiens
gtatgagatggtta

SEQ ID NO: 5629727 - DNA, 16 bp, Homo sapiens
gtatgagatggttaaa

SEQ ID NO: 5629728 - DNA, 14 bp, Homo sapiens
gtatgagctgaggg

SEQ ID NO: 5629729 - DNA, 15 bp, Homo sapiens
gtatgagctggagct

SEQ ID NO: 5629730 - DNA, 22 bp, Homo sapiens
gtatgaggtcctcaggtcagct

SEQ ID NO: 5629731 - DNA, 18 bp, Homo sapiens
gtatgataaacagttgaa

SEQ ID NO: 5629732 - DNA, 24 bp, Homo sapiens
gtatgataggttattttgatgtaa

SEQ ID NO: 5629733 - DNA, 13 bp, Homo sapiens
gtatgatcaaatg

SEQ ID NO: 5629734 - DNA, 16 bp, Homo sapiens
gtatgatcaaatgttt

SEQ ID NO: 5629735 - DNA, 23 bp, Homo sapiens
gtatgatctctctagctttgtca

SEQ ID NO: 5629736 - DNA, 20 bp, Homo sapiens
gtatgatgaaaataattttc

SEQ ID NO: 5629737 - DNA, 13 bp, Homo sapiens
gtatgatgtgttg

SEQ ID NO: 5629738 - DNA, 23 bp, Homo sapiens
gtatgatttataaacagacaata

SEQ ID NO: 5629739 - DNA, 16 bp, Homo sapiens
gtatgatttctgttgt

SEQ ID NO: 5629740 - DNA, 16 bp, Homo sapiens
gtatgatttgttcctt

SEQ ID NO: 5629741 - DNA, 18 bp, Homo sapiens
gtatgatttgttttgaat

SEQ ID NO: 5629742 - DNA, 19 bp, Homo sapiens
gtatgatttttacaataat

SEQ ID NO: 5629743 - DNA, 13 bp, Homo sapiens
gtatgcaaaataa

SEQ ID NO: 5629744 - DNA, 17 bp, Homo sapiens
gtatgcaagaagaatat

SEQ ID NO: 5629745 - DNA, 20 bp, Homo sapiens
gtatgcaagaagaatataaa

SEQ ID NO: 5629746 - DNA, 15 bp, Homo sapiens
gtatgcaagcagttt

SEQ ID NO: 5629747 - DNA, 18 bp, Homo sapiens
gtatgcaagcagtttcaa

SEQ ID NO: 5629748 - DNA, 15 bp, Homo sapiens
gtatgcaagtctgtg

SEQ ID NO: 5629749 - DNA, 18 bp, Homo sapiens
gtatgcaagtctgtgagt

SEQ ID NO: 5629750 - DNA, 22 bp, Homo sapiens
gtatgcaagtgggagatgaaaa

SEQ ID NO: 5629751 - DNA, 16 bp, Homo sapiens
gtatgcacaattccat

SEQ ID NO: 5629752 - DNA, 19 bp, Homo sapiens
gtatgcacatgaacttaga

SEQ ID NO: 5629753 - DNA, 21 bp, Homo sapiens
gtatgcagcatacaaaaatat

SEQ ID NO: 5629754 - DNA, 13 bp, Homo sapiens
gtatgcagggagc

SEQ ID NO: 5629755 - DNA, 18 bp, Homo sapiens
gtatgcagtattcttgca

SEQ ID NO: 5629756 - DNA, 19 bp, Homo sapiens
gtatgcagttgataagagg

SEQ ID NO: 5629757 - DNA, 20 bp, Homo sapiens
gtatgcagttgataagagga

SEQ ID NO: 5629758 - DNA, 17 bp, Homo sapiens
gtatgcatgtgaagaaa

SEQ ID NO: 5629759 - DNA, 12 bp, Homo sapiens
gtatgcatgttg

SEQ ID NO: 5629760 - DNA, 16 bp, Homo sapiens
gtatgcatgttgtcta

SEQ ID NO: 5629761 - DNA, 20 bp, Homo sapiens
gtatgccaccaacttacaaa

SEQ ID NO: 5629762 - DNA, 21 bp, Homo sapiens
gtatgccttctgtattttaat

SEQ ID NO: 5629763 - DNA, 23 bp, Homo sapiens
gtatgctgtatgaatattttata

SEQ ID NO: 5629764 - DNA, 21 bp, Homo sapiens
gtatgctgtggagtcccaacc

SEQ ID NO: 5629765 - DNA, 13 bp, Homo sapiens
gtatgcttcatac

SEQ ID NO: 5629766 - DNA, 21 bp, Homo sapiens
gtatgcttcatacagggatgg

SEQ ID NO: 5629767 - DNA, 16 bp, Homo sapiens
gtatgctttccctgag

SEQ ID NO: 5629768 - DNA, 16 bp, Homo sapiens
gtatgctttgaatgta

SEQ ID NO: 5629769 - DNA, 22 bp, Homo sapiens
gtatgcttttataggcctgtgt

SEQ ID NO: 5629770 - DNA, 22 bp, Homo sapiens
gtatggaagggaggggtcctga

SEQ ID NO: 5629771 - DNA, 15 bp, Homo sapiens
gtatggaatgcttct

SEQ ID NO: 5629772 - DNA, 16 bp, Homo sapiens
gtatggaatgcttctt

SEQ ID NO: 5629773 - DNA, 20 bp, Homo sapiens
gtatggacgtgtgtgaatgg

SEQ ID NO: 5629774 - DNA, 18 bp, Homo sapiens
gtatggagctcagagagg

SEQ ID NO: 5629775 - DNA, 21 bp, Homo sapiens
gtatggatatgtgtaaatgtt

SEQ ID NO: 5629776 - DNA, 16 bp, Homo sapiens
gtatggatttccagtt

SEQ ID NO: 5629777 - DNA, 22 bp, Homo sapiens
gtatggcactggcattgtccct

SEQ ID NO: 5629778 - DNA, 14 bp, Homo sapiens
gtatggcagaggtg

SEQ ID NO: 5629779 - DNA, 16 bp, Homo sapiens
gtatggcccaggcagc

SEQ ID NO: 5629780 - DNA, 17 bp, Homo sapiens
gtatggcccaggcagcc

SEQ ID NO: 5629781 - DNA, 23 bp, Homo sapiens
gtatggcccaggcagcctcaagg

SEQ ID NO: 5629782 - DNA, 14 bp, Homo sapiens
gtatggcctgtgtc

SEQ ID NO: 5629783 - DNA, 15 bp, Homo sapiens
gtatggcctgtgtca

SEQ ID NO: 5629784 - DNA, 20 bp, Homo sapiens
gtatggcgtaagtacagaga

SEQ ID NO: 5629785 - DNA, 21 bp, Homo sapiens
gtatggcgtaagtacagagaa

SEQ ID NO: 5629786 - DNA, 21 bp, Homo sapiens
gtatggctttatttttttgaa

SEQ ID NO: 5629787 - DNA, 22 bp, Homo sapiens
gtatggctttatttttttgaac

SEQ ID NO: 5629788 - DNA, 14 bp, Homo sapiens
gtatgggggaaggc

SEQ ID NO: 5629789 - DNA, 19 bp, Homo sapiens
gtatgggtagggtaaatca

SEQ ID NO: 5629790 - DNA, 14 bp, Homo sapiens
gtatggtacatcta

SEQ ID NO: 5629791 - DNA, 16 bp, Homo sapiens
gtatggtatctttaga

SEQ ID NO: 5629792 - DNA, 13 bp, Homo sapiens
gtatggtctaaca

SEQ ID NO: 5629793 - DNA, 21 bp, Homo sapiens
gtatggtgacctctccggcct

SEQ ID NO: 5629794 - DNA, 15 bp, Homo sapiens
gtatggtgcaatgtg

SEQ ID NO: 5629795 - DNA, 18 bp, Homo sapiens
gtatggtgctaatatttt

SEQ ID NO: 5629796 - DNA, 20 bp, Homo sapiens
gtatggtgctaatattttat

SEQ ID NO: 5629797 - DNA, 15 bp, Homo sapiens
gtatggtgctgggtc

SEQ ID NO: 5629798 - DNA, 14 bp, Homo sapiens
gtatggtggaagct

SEQ ID NO: 5629799 - DNA, 15 bp, Homo sapiens
gtatggtggctgggt

SEQ ID NO: 5629800 - DNA, 16 bp, Homo sapiens
gtatggtggctgggtt

SEQ ID NO: 5629801 - DNA, 13 bp, Homo sapiens
gtatggtgtgttc

SEQ ID NO: 5629802 - DNA, 17 bp, Homo sapiens
gtatggttcaagattgt

SEQ ID NO: 5629803 - DNA, 15 bp, Homo sapiens
gtatggttctcagat

SEQ ID NO: 5629804 - DNA, 14 bp, Homo sapiens
gtatgtaaacagga

SEQ ID NO: 5629805 - DNA, 20 bp, Homo sapiens
gtatgtaaacattcatattt

SEQ ID NO: 5629806 - DNA, 11 bp, Homo sapiens
gtatgtaaatg

SEQ ID NO: 5629807 - DNA, 15 bp, Homo sapiens
gtatgtaaatgtata

SEQ ID NO: 5629808 - DNA, 19 bp, Homo sapiens
gtatgtaaggaggtttgta

SEQ ID NO: 5629809 - DNA, 23 bp, Homo sapiens
gtatgtacaatacaatgtacaat

SEQ ID NO: 5629810 - DNA, 20 bp, Homo sapiens
gtatgtacataccggggctc

SEQ ID NO: 5629811 - DNA, 21 bp, Homo sapiens
gtatgtacgtacgtataagac

SEQ ID NO: 5629812 - DNA, 14 bp, Homo sapiens
gtatgtactgttat

SEQ ID NO: 5629813 - DNA, 23 bp, Homo sapiens
gtatgtacttagctgtactataa

SEQ ID NO: 5629814 - DNA, 18 bp, Homo sapiens
gtatgtacttcatgctgt

SEQ ID NO: 5629815 - DNA, 16 bp, Homo sapiens
gtatgtagaagcatga

SEQ ID NO: 5629816 - DNA, 23 bp, Homo sapiens
gtatgtagcagcatttacagaaa

SEQ ID NO: 5629817 - DNA, 19 bp, Homo sapiens
gtatgtagcccggccaggg

SEQ ID NO: 5629818 - DNA, 16 bp, Homo sapiens
gtatgtaggagctgca

SEQ ID NO: 5629819 - DNA, 23 bp, Homo sapiens
gtatgtatataatcatgctcatg

SEQ ID NO: 5629820 - DNA, 18 bp, Homo sapiens
gtatgtatggaaacacat

SEQ ID NO: 5629821 - DNA, 12 bp, Homo sapiens
gtatgtatgtgt

SEQ ID NO: 5629822 - DNA, 13 bp, Homo sapiens
gtatgtatgtgta

SEQ ID NO: 5629823 - DNA, 13 bp, Homo sapiens
gtatgtattattt

SEQ ID NO: 5629824 - DNA, 13 bp, Homo sapiens
gtatgtcactatt

SEQ ID NO: 5629825 - DNA, 23 bp, Homo sapiens
gtatgtcagtggtttctacttcc

SEQ ID NO: 5629826 - DNA, 11 bp, Homo sapiens
gtatgtcatgg

SEQ ID NO: 5629827 - DNA, 18 bp, Homo sapiens
gtatgtccccataagaca

SEQ ID NO: 5629828 - DNA, 16 bp, Homo sapiens
gtatgtccttcagctg

SEQ ID NO: 5629829 - DNA, 17 bp, Homo sapiens
gtatgtccttcagctga

SEQ ID NO: 5629830 - DNA, 14 bp, Homo sapiens
gtatgtctggttct

SEQ ID NO: 5629831 - DNA, 11 bp, Homo sapiens
gtatgtctgtg

SEQ ID NO: 5629832 - DNA, 13 bp, Homo sapiens
gtatgtctgtttt

SEQ ID NO: 5629833 - DNA, 20 bp, Homo sapiens
gtatgtcttcaaaatatatt

SEQ ID NO: 5629834 - DNA, 18 bp, Homo sapiens
gtatgtgaattgaagtca

SEQ ID NO: 5629835 - DNA, 13 bp, Homo sapiens
gtatgtgactttt

SEQ ID NO: 5629836 - DNA, 19 bp, Homo sapiens
gtatgtgacttttctgatt

SEQ ID NO: 5629837 - DNA, 22 bp, Homo sapiens
gtatgtgagctgtaaaaatgtt

SEQ ID NO: 5629838 - DNA, 17 bp, Homo sapiens
gtatgtgatatctgaac

SEQ ID NO: 5629839 - DNA, 12 bp, Homo sapiens
gtatgtgccagg

SEQ ID NO: 5629840 - DNA, 15 bp, Homo sapiens
gtatgtgccaggctt

SEQ ID NO: 5629841 - DNA, 19 bp, Homo sapiens
gtatgtgccaggcttgcct

SEQ ID NO: 5629842 - DNA, 22 bp, Homo sapiens
gtatgtgccaggcttgcctggg

SEQ ID NO: 5629843 - DNA, 14 bp, Homo sapiens
gtatgtgccattta

SEQ ID NO: 5629844 - DNA, 22 bp, Homo sapiens
gtatgtggaagtatacctggct

SEQ ID NO: 5629845 - DNA, 16 bp, Homo sapiens
gtatgtggaagtgtgg

SEQ ID NO: 5629846 - DNA, 17 bp, Homo sapiens
gtatgtggaagtgtggg

SEQ ID NO: 5629847 - DNA, 18 bp, Homo sapiens
gtatgtggaagtgtgggt

SEQ ID NO: 5629848 - DNA, 22 bp, Homo sapiens
gtatgtggcatggcagaatgaa

SEQ ID NO: 5629849 - DNA, 23 bp, Homo sapiens
gtatgtgggggcttcatctcttt

SEQ ID NO: 5629850 - DNA, 20 bp, Homo sapiens
gtatgtgggggtctgtgtgt

SEQ ID NO: 5629851 - DNA, 13 bp, Homo sapiens
gtatgtgggtgac

SEQ ID NO: 5629852 - DNA, 16 bp, Homo sapiens
gtatgtggttttgtaa

SEQ ID NO: 5629853 - DNA, 16 bp, Homo sapiens
gtatgtgtaatgattt

SEQ ID NO: 5629854 - DNA, 21 bp, Homo sapiens
gtatgtgtacgtgtgtgtgcg

SEQ ID NO: 5629855 - DNA, 13 bp, Homo sapiens
gtatgtgtagtgt

SEQ ID NO: 5629856 - DNA, 13 bp, Homo sapiens
gtatgtgtatgta

SEQ ID NO: 5629857 - DNA, 18 bp, Homo sapiens
gtatgtgtatgtgtgtga

SEQ ID NO: 5629858 - DNA, 16 bp, Homo sapiens
gtatgtgtcatttata

SEQ ID NO: 5629859 - DNA, 22 bp, Homo sapiens
gtatgtgtgcaggagcctccct

SEQ ID NO: 5629860 - DNA, 14 bp, Homo sapiens
gtatgtgtggctgt

SEQ ID NO: 5629861 - DNA, 12 bp, Homo sapiens
gtatgtgtgtgg

SEQ ID NO: 5629862 - DNA, 15 bp, Homo sapiens
gtatgtgtgtgtatg

SEQ ID NO: 5629863 - DNA, 13 bp, Homo sapiens
gtatgtgtgtgtg

SEQ ID NO: 5629864 - DNA, 15 bp, Homo sapiens
gtatgtgtgtgtgta

SEQ ID NO: 5629865 - DNA, 17 bp, Homo sapiens
gtatgtgtgtgtgtata

SEQ ID NO: 5629866 - DNA, 13 bp, Homo sapiens
gtatgtgtttaga

SEQ ID NO: 5629867 - DNA, 12 bp, Homo sapiens
gtatgttaacct

SEQ ID NO: 5629868 - DNA, 14 bp, Homo sapiens
gtatgttaatatgt

SEQ ID NO: 5629869 - DNA, 14 bp, Homo sapiens
gtatgttatacaac

SEQ ID NO: 5629870 - DNA, 13 bp, Homo sapiens
gtatgttatccac

SEQ ID NO: 5629871 - DNA, 15 bp, Homo sapiens
gtatgttatgaacat

SEQ ID NO: 5629872 - DNA, 21 bp, Homo sapiens
gtatgttatgatattgtttaa

SEQ ID NO: 5629873 - DNA, 22 bp, Homo sapiens
gtatgttcaactaggatcagaa

SEQ ID NO: 5629874 - DNA, 22 bp, Homo sapiens
gtatgttccaaaccctcctggg

SEQ ID NO: 5629875 - DNA, 17 bp, Homo sapiens
gtatgttgaagcctttg

SEQ ID NO: 5629876 - DNA, 14 bp, Homo sapiens
gtatgttgtacaat

SEQ ID NO: 5629877 - DNA, 18 bp, Homo sapiens
gtatgttgtacaatcaaa

SEQ ID NO: 5629878 - DNA, 13 bp, Homo sapiens
gtatgttgtcaaa

SEQ ID NO: 5629879 - DNA, 13 bp, Homo sapiens
gtatgttgtcata

SEQ ID NO: 5629880 - DNA, 21 bp, Homo sapiens
gtatgttgtgaagatgtttgc

SEQ ID NO: 5629881 - DNA, 19 bp, Homo sapiens
gtattttaactatttttgt

SEQ ID NO: 5629882 - DNA, 20 bp, Homo sapiens
gtattttaagtgatgtcatt

SEQ ID NO: 5629883 - DNA, 23 bp, Homo sapiens
gtattttaataaagattccatgg

SEQ ID NO: 5629884 - DNA, 24 bp, Homo sapiens
gtattttaatcctgtaccaaatct

SEQ ID NO: 5629885 - DNA, 14 bp, Homo sapiens
gtattttactaata

SEQ ID NO: 5629886 - DNA, 15 bp, Homo sapiens
gtattttagaataaa

SEQ ID NO: 5629887 - DNA, 15 bp, Homo sapiens
gtattttagtatatt

SEQ ID NO: 5629888 - DNA, 23 bp, Homo sapiens
gtattttagtggaccctgaaatg

SEQ ID NO: 5629889 - DNA, 18 bp, Homo sapiens
gtattttataaaattaaa

SEQ ID NO: 5629890 - DNA, 22 bp, Homo sapiens
gtattttataaaattaaagaaa

SEQ ID NO: 5629891 - DNA, 14 bp, Homo sapiens
gtattttataagca

SEQ ID NO: 5629892 - DNA, 23 bp, Homo sapiens
gtattttataagcacagacaatt

SEQ ID NO: 5629893 - DNA, 12 bp, Homo sapiens
gtattttatctg

SEQ ID NO: 5629894 - DNA, 15 bp, Homo sapiens
gtattttatgtatgt

SEQ ID NO: 5629895 - DNA, 23 bp, Homo sapiens
gtattttatgtatgtttacactg

SEQ ID NO: 5629896 - DNA, 13 bp, Homo sapiens
gtattttatgtta

SEQ ID NO: 5629897 - DNA, 17 bp, Homo sapiens
gtattttatgttatata

SEQ ID NO: 5629898 - DNA, 17 bp, Homo sapiens
gtattttattaaagcaa

SEQ ID NO: 5629899 - DNA, 22 bp, Homo sapiens
gtattttattaaagcaacattt

SEQ ID NO: 5629900 - DNA, 17 bp, Homo sapiens
gtattttattgtaacag

SEQ ID NO: 5629901 - DNA, 13 bp, Homo sapiens
gtattttcaatag

SEQ ID NO: 5629902 - DNA, 17 bp, Homo sapiens
gtattttcaatagccac

SEQ ID NO: 5629903 - DNA, 14 bp, Homo sapiens
gtattttcagagaa

SEQ ID NO: 5629904 - DNA, 15 bp, Homo sapiens
gtattttcaggaagg

SEQ ID NO: 5629905 - DNA, 11 bp, Homo sapiens
gtattttcata

SEQ ID NO: 5629906 - DNA, 14 bp, Homo sapiens
gtattttcatacaa

SEQ ID NO: 5629907 - DNA, 12 bp, Homo sapiens
gtattttcatag

SEQ ID NO: 5629908 - DNA, 19 bp, Homo sapiens
gtattttcatgaaaatacc

SEQ ID NO: 5629909 - DNA, 16 bp, Homo sapiens
gtattttcattttaat

SEQ ID NO: 5629910 - DNA, 16 bp, Homo sapiens
gtattttccaagtgtg

SEQ ID NO: 5629911 - DNA, 13 bp, Homo sapiens
gtattttccagcc

SEQ ID NO: 5629912 - DNA, 18 bp, Homo sapiens
gtattttcctggatttat

SEQ ID NO: 5629913 - DNA, 19 bp, Homo sapiens
gtattttcctggatttata

SEQ ID NO: 5629914 - DNA, 15 bp, Homo sapiens
gtattttcgtgcatt

SEQ ID NO: 5629915 - DNA, 19 bp, Homo sapiens
gtattttcttcccatttgt

SEQ ID NO: 5629916 - DNA, 21 bp, Homo sapiens
gtattttcttcccatttgtaa

SEQ ID NO: 5629917 - DNA, 22 bp, Homo sapiens
gtattttcttcccatttgtaat

SEQ ID NO: 5629918 - DNA, 15 bp, Homo sapiens
gtattttcttctctg

SEQ ID NO: 5629919 - DNA, 19 bp, Homo sapiens
gtattttcttctctgtgag

SEQ ID NO: 5629920 - DNA, 17 bp, Homo sapiens
gtattttgaaaacactt

SEQ ID NO: 5629921 - DNA, 17 bp, Homo sapiens
gtattttgaagaatatt

SEQ ID NO: 5629922 - DNA, 16 bp, Homo sapiens
gtattttgaataccat

SEQ ID NO: 5629923 - DNA, 16 bp, Homo sapiens
gtattttgagtttcag

SEQ ID NO: 5629924 - DNA, 18 bp, Homo sapiens
gtattttgagtttcagct

SEQ ID NO: 5629925 - DNA, 19 bp, Homo sapiens
gtattttgtacaaagtaaa

SEQ ID NO: 5629926 - DNA, 18 bp, Homo sapiens
gtattttgtattgtttca

SEQ ID NO: 5629927 - DNA, 12 bp, Homo sapiens
gtattttgtgtg

SEQ ID NO: 5629928 - DNA, 23 bp, Homo sapiens
gtattttgtgtgaccaactgtgt

SEQ ID NO: 5629929 - DNA, 17 bp, Homo sapiens
gtatttttaaaaaacaa

SEQ ID NO: 5629930 - DNA, 13 bp, Homo sapiens
gtatttttaaagg

SEQ ID NO: 5629931 - DNA, 22 bp, Homo sapiens
gtatttttaacacttaaatttc

SEQ ID NO: 5629932 - DNA, 22 bp, Homo sapiens
gtatttttaatgggggtagcag

SEQ ID NO: 5629933 - DNA, 17 bp, Homo sapiens
gtatttttactattgaa

SEQ ID NO: 5629934 - DNA, 22 bp, Homo sapiens
gtatttttagagattaatttgt

SEQ ID NO: 5629935 - DNA, 18 bp, Homo sapiens
gtatttttataatgactg

SEQ ID NO: 5629936 - DNA, 22 bp, Homo sapiens
gtatttttataattttatctgt

SEQ ID NO: 5629937 - DNA, 18 bp, Homo sapiens
gtatttttatacaaacct

SEQ ID NO: 5629938 - DNA, 16 bp, Homo sapiens
gtatttttatttaaat

SEQ ID NO: 5629939 - DNA, 19 bp, Homo sapiens
gtatttttatttttgcaca

SEQ ID NO: 5629940 - DNA, 22 bp, Homo sapiens
gtatttttatttttgcacaact

SEQ ID NO: 5629941 - DNA, 19 bp, Homo sapiens
gtatttttccaatcacagt

SEQ ID NO: 5629942 - DNA, 16 bp, Homo sapiens
gtatttttcttgctgt

SEQ ID NO: 5629943 - DNA, 20 bp, Homo sapiens
gtatttttgaaagaattcta

SEQ ID NO: 5629944 - DNA, 15 bp, Homo sapiens
gtatttttgacagaa

SEQ ID NO: 5629945 - DNA, 14 bp, Homo sapiens
gtatttttgattaa

SEQ ID NO: 5629946 - DNA, 16 bp, Homo sapiens
gtatttttgattaaca

SEQ ID NO: 5629947 - DNA, 21 bp, Homo sapiens
gtatttttgattaacaatgta

SEQ ID NO: 5629948 - DNA, 22 bp, Homo sapiens
gtatttttgattaacaatgtat

SEQ ID NO: 5629949 - DNA, 18 bp, Homo sapiens
gtatttttgtatgtggca

SEQ ID NO: 5629950 - DNA, 16 bp, Homo sapiens
gtattttttaaaaaat

SEQ ID NO: 5629951 - DNA, 22 bp, Homo sapiens
gtattttttaaaacactaaaag

SEQ ID NO: 5629952 - DNA, 18 bp, Homo sapiens
gtattttttaattgattt

SEQ ID NO: 5629953 - DNA, 15 bp, Homo sapiens
gtattttttatttac

SEQ ID NO: 5629954 - DNA, 23 bp, Homo sapiens
gtattttttatttacattttata

SEQ ID NO: 5629955 - DNA, 13 bp, Homo sapiens
gtattttttcctt

SEQ ID NO: 5629956 - DNA, 15 bp, Homo sapiens
gtattttttccttaa

SEQ ID NO: 5629957 - DNA, 19 bp, Homo sapiens
gtattttttcttgcattga

SEQ ID NO: 5629958 - DNA, 20 bp, Homo sapiens
gtattttttcttgcattgac

SEQ ID NO: 5629959 - DNA, 15 bp, Homo sapiens
gtattttttgtgaat

SEQ ID NO: 5629960 - DNA, 16 bp, Homo sapiens
gtattttttgtttgta

SEQ ID NO: 5629961 - DNA, 14 bp, Homo sapiens
gtatttttttaact

SEQ ID NO: 5629962 - DNA, 23 bp, Homo sapiens
gtatttttttattcgccatctga

SEQ ID NO: 5629963 - DNA, 15 bp, Homo sapiens
gtatttttttccaag

SEQ ID NO: 5629964 - DNA, 20 bp, Homo sapiens
gtatttttttccaagtgtat

SEQ ID NO: 5629965 - DNA, 17 bp, Homo sapiens
gtatttttttgcaagtg

SEQ ID NO: 5629966 - DNA, 17 bp, Homo sapiens
gtatttttttgtaattg

SEQ ID NO: 5629967 - DNA, 20 bp, Homo sapiens
gtcaaaaaattatttgctat

SEQ ID NO: 5629968 - DNA, 12 bp, Homo sapiens
gtcaaaaacaaa

SEQ ID NO: 5629969 - DNA, 14 bp, Homo sapiens
gtcaaaaagaacca

SEQ ID NO: 5629970 - DNA, 20 bp, Homo sapiens
gtcaaaaagtttggttctgt

SEQ ID NO: 5629971 - DNA, 23 bp, Homo sapiens
gtcaaaaagtttggttctgtgtc

SEQ ID NO: 5629972 - DNA, 11 bp, Homo sapiens
gtcaaaaatat

SEQ ID NO: 5629973 - DNA, 12 bp, Homo sapiens
gtcaaaaatatt

SEQ ID NO: 5629974 - DNA, 23 bp, Homo sapiens
gtcaaaaattaaaccggaccatc

SEQ ID NO: 5629975 - DNA, 12 bp, Homo sapiens
gtcaaaacaaag

SEQ ID NO: 5629976 - DNA, 12 bp, Homo sapiens
gtcaaaacactg

SEQ ID NO: 5629977 - DNA, 20 bp, Homo sapiens
gtcaaaacagattgtttgca

SEQ ID NO: 5629978 - DNA, 16 bp, Homo sapiens
gtcaaaactcaaatgc

SEQ ID NO: 5629979 - DNA, 16 bp, Homo sapiens
gtcaaaactccactca

SEQ ID NO: 5629980 - DNA, 20 bp, Homo sapiens
gtcaaaactccactcagcac

SEQ ID NO: 5629981 - DNA, 15 bp, Homo sapiens
gtcaaaagctggatt

SEQ ID NO: 5629982 - DNA, 18 bp, Homo sapiens
gtcaaaatagtgccacta

SEQ ID NO: 5629983 - DNA, 12 bp, Homo sapiens
gtcaaacaaata

SEQ ID NO: 5629984 - DNA, 18 bp, Homo sapiens
gtcaaacaggctgtaatt

SEQ ID NO: 5629985 - DNA, 17 bp, Homo sapiens
gtcaaacagtgccaaat

SEQ ID NO: 5629986 - DNA, 16 bp, Homo sapiens
gtcaaacagtgtggct

SEQ ID NO: 5629987 - DNA, 22 bp, Homo sapiens
gtcaaacagtgtggcttaaaca

SEQ ID NO: 5629988 - DNA, 11 bp, Homo sapiens
gtcaaacatta

SEQ ID NO: 5629989 - DNA, 20 bp, Homo sapiens
gtcaaacattcgtgagctgg

SEQ ID NO: 5629990 - DNA, 13 bp, Homo sapiens
gtcaaaccgcact

SEQ ID NO: 5629991 - DNA, 15 bp, Homo sapiens
gtcaaacgtgaaaat

SEQ ID NO: 5629992 - DNA, 22 bp, Homo sapiens
gtcaaacgtgccccccagttcc

SEQ ID NO: 5629993 - DNA, 18 bp, Homo sapiens
gtcaaactaattctcaca

SEQ ID NO: 5629994 - DNA, 13 bp, Homo sapiens
gtcaaacttggat

SEQ ID NO: 5629995 - DNA, 16 bp, Homo sapiens
gtcaaactttttccag

SEQ ID NO: 5629996 - DNA, 16 bp, Homo sapiens
gtcaaagaaatgctga

SEQ ID NO: 5629997 - DNA, 12 bp, Homo sapiens
gtcaaagaagct

SEQ ID NO: 5629998 - DNA, 22 bp, Homo sapiens
gtcaaagaagcttccacaaaat

SEQ ID NO: 5629999 - DNA, 19 bp, Homo sapiens
gtcaaagacagaatggtgg

SEQ ID NO: 5630000 - DNA, 20 bp, Homo sapiens
gtcaaagacagaatggtgga

SEQ ID NO: 5630001 - DNA, 22 bp, Homo sapiens
gtcaaagacgctgagtgggagc

SEQ ID NO: 5630002 - DNA, 18 bp, Homo sapiens
gtcaaagcggatgctggc

SEQ ID NO: 5630003 - DNA, 18 bp, Homo sapiens
gtcaaaggcatctccctt

SEQ ID NO: 5630004 - DNA, 16 bp, Homo sapiens
gtcaaagtacagaata

SEQ ID NO: 5630005 - DNA, 19 bp, Homo sapiens
gtcaaagtgaaagacattt

SEQ ID NO: 5630006 - DNA, 18 bp, Homo sapiens
gtcaaagtggtgagaggc

SEQ ID NO: 5630007 - DNA, 15 bp, Homo sapiens
gtcaaagttgaaaat

SEQ ID NO: 5630008 - DNA, 13 bp, Homo sapiens
gtcaaataaacac

SEQ ID NO: 5630009 - DNA, 17 bp, Homo sapiens
gtcaaataaatgtttcc

SEQ ID NO: 5630010 - DNA, 16 bp, Homo sapiens
gtcaaatacagcattt

SEQ ID NO: 5630011 - DNA, 13 bp, Homo sapiens
gtcaaatccagtg

SEQ ID NO: 5630012 - DNA, 15 bp, Homo sapiens
gtcaaatccagtggt

SEQ ID NO: 5630013 - DNA, 13 bp, Homo sapiens
gtcaaatccatgt

SEQ ID NO: 5630014 - DNA, 13 bp, Homo sapiens
gtcaaatgaactt

SEQ ID NO: 5630015 - DNA, 16 bp, Homo sapiens
gtcaaatgatgtgcaa

SEQ ID NO: 5630016 - DNA, 17 bp, Homo sapiens
gtcaaatgatgtgcaaa

SEQ ID NO: 5630017 - DNA, 21 bp, Homo sapiens
gtcaaatgccaaacactagct

SEQ ID NO: 5630018 - DNA, 19 bp, Homo sapiens
gtcaaatgggaaaaaaaca

SEQ ID NO: 5630019 - DNA, 16 bp, Homo sapiens
gtcaaatggtattttt

SEQ ID NO: 5630020 - DNA, 22 bp, Homo sapiens
gtcaaatggtattttttgtgaa

SEQ ID NO: 5630021 - DNA, 19 bp, Homo sapiens
gtcaaatgtcattatgtag

SEQ ID NO: 5630022 - DNA, 11 bp, Homo sapiens
gtcaaatgtgt

SEQ ID NO: 5630023 - DNA, 16 bp, Homo sapiens
gtcaaattgtgtgaaa

SEQ ID NO: 5630024 - DNA, 17 bp, Homo sapiens
gtcaaatttactttaaa

SEQ ID NO: 5630025 - DNA, 18 bp, Homo sapiens
gtcaacaaaaagacatgg

SEQ ID NO: 5630026 - DNA, 18 bp, Homo sapiens
gtcaacaaactatttctt

SEQ ID NO: 5630027 - DNA, 16 bp, Homo sapiens
gtcaacaaagtgcttt

SEQ ID NO: 5630028 - DNA, 17 bp, Homo sapiens
gtcaacaataaaaacca

SEQ ID NO: 5630029 - DNA, 15 bp, Homo sapiens
gtcaacagaatgaaa

SEQ ID NO: 5630030 - DNA, 18 bp, Homo sapiens
gtcaacagagaaggcagg

SEQ ID NO: 5630031 - DNA, 13 bp, Homo sapiens
gtcaacagattca

SEQ ID NO: 5630032 - DNA, 21 bp, Homo sapiens
gtcaacagattcagaatgaga

SEQ ID NO: 5630033 - DNA, 18 bp, Homo sapiens
gtcaacagcaaagcttgg

SEQ ID NO: 5630034 - DNA, 13 bp, Homo sapiens
gtcaacagtaaac

SEQ ID NO: 5630035 - DNA, 16 bp, Homo sapiens
gtcaacatcttctctc

SEQ ID NO: 5630036 - DNA, 12 bp, Homo sapiens
gtcaacatttct

SEQ ID NO: 5630037 - DNA, 13 bp, Homo sapiens
gtcaacatttctc

SEQ ID NO: 5630038 - DNA, 22 bp, Homo sapiens
gtcaacatttgttagaaccagt

SEQ ID NO: 5630039 - DNA, 23 bp, Homo sapiens
gtcaacatttgttagaaccagtc

SEQ ID NO: 5630040 - DNA, 15 bp, Homo sapiens
gtcaaccactaaagt

SEQ ID NO: 5630041 - DNA, 15 bp, Homo sapiens
gtcaaccagacagag

SEQ ID NO: 5630042 - DNA, 18 bp, Homo sapiens
gtcaacccaagctctggg

SEQ ID NO: 5630043 - DNA, 23 bp, Homo sapiens
gtcaaccccacaagcaccactct

SEQ ID NO: 5630044 - DNA, 15 bp, Homo sapiens
gtcaacccgctgctt

SEQ ID NO: 5630045 - DNA, 17 bp, Homo sapiens
gtcaacccttctggaaa

SEQ ID NO: 5630046 - DNA, 15 bp, Homo sapiens
gtcaacctcctggac

SEQ ID NO: 5630047 - DNA, 21 bp, Homo sapiens
gtcaacctgcttttttctgtt

SEQ ID NO: 5630048 - DNA, 23 bp, Homo sapiens
gtcaacctgcttttttctgtttt

SEQ ID NO: 5630049 - DNA, 17 bp, Homo sapiens
gtcaaccttgtgtgagt

SEQ ID NO: 5630050 - DNA, 21 bp, Homo sapiens
gtcaaccttgtgtgagtgtga

SEQ ID NO: 5630051 - DNA, 21 bp, Homo sapiens
gtcaacctttgtgtggctcct

SEQ ID NO: 5630052 - DNA, 19 bp, Homo sapiens
gtcaacggggggctcctgc

SEQ ID NO: 5630053 - DNA, 23 bp, Homo sapiens
gtcaacggggggctcctgcccag

SEQ ID NO: 5630054 - DNA, 14 bp, Homo sapiens
gtcaactccaaggc

SEQ ID NO: 5630055 - DNA, 20 bp, Homo sapiens
gtcaactccaaggcaaatgt

SEQ ID NO: 5630056 - DNA, 21 bp, Homo sapiens
gtcaactccaaggcaaatgtc

SEQ ID NO: 5630057 - DNA, 22 bp, Homo sapiens
gtcaactccaaggcaaatgtcc

SEQ ID NO: 5630058 - DNA, 15 bp, Homo sapiens
gtcaactgctgtttt

SEQ ID NO: 5630059 - DNA, 21 bp, Homo sapiens
gtcagatctgcctaaggactt

SEQ ID NO: 5630060 - DNA, 22 bp, Homo sapiens
gtcagatgagaacaaagctgtt

SEQ ID NO: 5630061 - DNA, 20 bp, Homo sapiens
gtcagatgagcaaggacatt

SEQ ID NO: 5630062 - DNA, 15 bp, Homo sapiens
gtcagatgaggccct

SEQ ID NO: 5630063 - DNA, 21 bp, Homo sapiens
gtcagatgaggccctgcacct

SEQ ID NO: 5630064 - DNA, 22 bp, Homo sapiens
gtcagatgctgtgcaaatgtta

SEQ ID NO: 5630065 - DNA, 18 bp, Homo sapiens
gtcagatggatgtagata

SEQ ID NO: 5630066 - DNA, 19 bp, Homo sapiens
gtcagatggatgtagatac

SEQ ID NO: 5630067 - DNA, 12 bp, Homo sapiens
gtcagatgtttg

SEQ ID NO: 5630068 - DNA, 14 bp, Homo sapiens
gtcagattaaatta

SEQ ID NO: 5630069 - DNA, 16 bp, Homo sapiens
gtcagattcttgcatc

SEQ ID NO: 5630070 - DNA, 18 bp, Homo sapiens
gtcagatttttaaagttt

SEQ ID NO: 5630071 - DNA, 21 bp, Homo sapiens
gtcagatttttaaagttttgt

SEQ ID NO: 5630072 - DNA, 20 bp, Homo sapiens
gtcagcaaaaagcaaaatca

SEQ ID NO: 5630073 - DNA, 22 bp, Homo sapiens
gtcagcaaaaagcaaaatcatt

SEQ ID NO: 5630074 - DNA, 14 bp, Homo sapiens
gtcagcaaatgtaa

SEQ ID NO: 5630075 - DNA, 22 bp, Homo sapiens
gtcagcaaattaattggcagca

SEQ ID NO: 5630076 - DNA, 21 bp, Homo sapiens
gtcagcaagtcctaagcctgt

SEQ ID NO: 5630077 - DNA, 12 bp, Homo sapiens
gtcagcaccttg

SEQ ID NO: 5630078 - DNA, 22 bp, Homo sapiens
gtcagcaccttggcccaggagc

SEQ ID NO: 5630079 - DNA, 13 bp, Homo sapiens
gtcagcactcagg

SEQ ID NO: 5630080 - DNA, 14 bp, Homo sapiens
gtcagcagaaaccc

SEQ ID NO: 5630081 - DNA, 20 bp, Homo sapiens
gtcagcagaaacccccagga

SEQ ID NO: 5630082 - DNA, 23 bp, Homo sapiens
gtcagcagaaacccccaggagga

SEQ ID NO: 5630083 - DNA, 12 bp, Homo sapiens
gtcagcagacac

SEQ ID NO: 5630084 - DNA, 20 bp, Homo sapiens
gtcagcagatgccagtgaag

SEQ ID NO: 5630085 - DNA, 16 bp, Homo sapiens
gtcagcagatgctgtt

SEQ ID NO: 5630086 - DNA, 21 bp, Homo sapiens
gtcagcagcagctctgagcca

SEQ ID NO: 5630087 - DNA, 13 bp, Homo sapiens
gtcagcaggaagc

SEQ ID NO: 5630088 - DNA, 13 bp, Homo sapiens
gtcagcaggcagg

SEQ ID NO: 5630089 - DNA, 13 bp, Homo sapiens
gtcagcaggccca

SEQ ID NO: 5630090 - DNA, 14 bp, Homo sapiens
gtcagcaggcccag

SEQ ID NO: 5630091 - DNA, 15 bp, Homo sapiens
gtcagcaggcccagg

SEQ ID NO: 5630092 - DNA, 16 bp, Homo sapiens
gtcagcagtcctagcc

SEQ ID NO: 5630093 - DNA, 14 bp, Homo sapiens
gtcagcagtggagt

SEQ ID NO: 5630094 - DNA, 23 bp, Homo sapiens
gtcagcagttgctggtaaaatga

SEQ ID NO: 5630095 - DNA, 9 bp, Homo sapiens
gtcagcatc

SEQ ID NO: 5630096 - DNA, 16 bp, Homo sapiens
gtcagcatcactgatg

SEQ ID NO: 5630097 - DNA, 17 bp, Homo sapiens
gtcagcatcactgatgg

SEQ ID NO: 5630098 - DNA, 19 bp, Homo sapiens
gtcagcatcactgatggga

SEQ ID NO: 5630099 - DNA, 22 bp, Homo sapiens
gtcagcatcactgatgggaata

SEQ ID NO: 5630100 - DNA, 18 bp, Homo sapiens
gtcagcatctgaccatct

SEQ ID NO: 5630101 - DNA, 20 bp, Homo sapiens
gtcagcatctgaccatctgt

SEQ ID NO: 5630102 - DNA, 22 bp, Homo sapiens
gtcagcatctgaccatctgtga

SEQ ID NO: 5630103 - DNA, 18 bp, Homo sapiens
gtcagcatctggctgtct

SEQ ID NO: 5630104 - DNA, 16 bp, Homo sapiens
gtcagcatgcttccca

SEQ ID NO: 5630105 - DNA, 15 bp, Homo sapiens
gtcagccacactggg

SEQ ID NO: 5630106 - DNA, 17 bp, Homo sapiens
gtcagccacactgggcc

SEQ ID NO: 5630107 - DNA, 13 bp, Homo sapiens
gtcagccacatgg

SEQ ID NO: 5630108 - DNA, 12 bp, Homo sapiens
gtcagccacctc

SEQ ID NO: 5630109 - DNA, 14 bp, Homo sapiens
gtcagccacctccc

SEQ ID NO: 5630110 - DNA, 15 bp, Homo sapiens
gtcagccacctggga

SEQ ID NO: 5630111 - DNA, 21 bp, Homo sapiens
gtcagccactgtgatagaggc

SEQ ID NO: 5630112 - DNA, 18 bp, Homo sapiens
gtcagccagccgccctgg

SEQ ID NO: 5630113 - DNA, 15 bp, Homo sapiens
gtcagccagcttggt

SEQ ID NO: 5630114 - DNA, 10 bp, Homo sapiens
gtcagccagg

SEQ ID NO: 5630115 - DNA, 12 bp, Homo sapiens
gtcagccaggct

SEQ ID NO: 5630116 - DNA, 11 bp, Homo sapiens
gtcagccaggg

SEQ ID NO: 5630117 - DNA, 14 bp, Homo sapiens
gtcagccagggcca

SEQ ID NO: 5630118 - DNA, 15 bp, Homo sapiens
gtcagccagggccag

SEQ ID NO: 5630119 - DNA, 16 bp, Homo sapiens
gtcagccagggcctgc

SEQ ID NO: 5630120 - DNA, 20 bp, Homo sapiens
gtcagccatcgtcctgggac

SEQ ID NO: 5630121 - DNA, 23 bp, Homo sapiens
gtcagccatgggaaatgagccag

SEQ ID NO: 5630122 - DNA, 20 bp, Homo sapiens
gtcagccatgtctgtgctgt

SEQ ID NO: 5630123 - DNA, 23 bp, Homo sapiens
gtcagccattgcacccagcccag

SEQ ID NO: 5630124 - DNA, 17 bp, Homo sapiens
gtcagcccaagattctt

SEQ ID NO: 5630125 - DNA, 14 bp, Homo sapiens
gtcagcccagcacc

SEQ ID NO: 5630126 - DNA, 16 bp, Homo sapiens
gtcagcccagcacctg

SEQ ID NO: 5630127 - DNA, 17 bp, Homo sapiens
gtcagcccagcacctgc

SEQ ID NO: 5630128 - DNA, 13 bp, Homo sapiens
gtcagcccagtgg

SEQ ID NO: 5630129 - DNA, 14 bp, Homo sapiens
gtcagcccagtggg

SEQ ID NO: 5630130 - DNA, 23 bp, Homo sapiens
gtcagcccctcatcagccttttc

SEQ ID NO: 5630131 - DNA, 18 bp, Homo sapiens
gtcagcccgaatgcctgt

SEQ ID NO: 5630132 - DNA, 16 bp, Homo sapiens
gtcagcccgtttcaga

SEQ ID NO: 5630133 - DNA, 17 bp, Homo sapiens
gtcagcccgtttcagaa

SEQ ID NO: 5630134 - DNA, 23 bp, Homo sapiens
gtcagccctcactgtcagtccca

SEQ ID NO: 5630135 - DNA, 12 bp, Homo sapiens
gtcagccctgtg

SEQ ID NO: 5630136 - DNA, 20 bp, Homo sapiens
gtcagcccttggcttctgct

SEQ ID NO: 5630137 - DNA, 16 bp, Homo sapiens
gtcagccgggccctga

SEQ ID NO: 5630138 - DNA, 12 bp, Homo sapiens
gtcagcctccag

SEQ ID NO: 5630139 - DNA, 14 bp, Homo sapiens
gtcagcctccagcc

SEQ ID NO: 5630140 - DNA, 21 bp, Homo sapiens
gtcagcctccctgacgtctgc

SEQ ID NO: 5630141 - DNA, 20 bp, Homo sapiens
gtcagcctctctcccagtct

SEQ ID NO: 5630142 - DNA, 14 bp, Homo sapiens
gtcagcctggaagg

SEQ ID NO: 5630143 - DNA, 21 bp, Homo sapiens
gtcagcctggctgggctctgg

SEQ ID NO: 5630144 - DNA, 12 bp, Homo sapiens
gtcagcctgtgc

SEQ ID NO: 5630145 - DNA, 19 bp, Homo sapiens
gtcagcctgtgctgtggca

SEQ ID NO: 5630146 - DNA, 22 bp, Homo sapiens
gtcagccttccccctcccaggg

SEQ ID NO: 5630147 - DNA, 17 bp, Homo sapiens
gtcagcgacagcctggg

SEQ ID NO: 5630148 - DNA, 18 bp, Homo sapiens
gtcagcgacagcctgggc

SEQ ID NO: 5630149 - DNA, 16 bp, Homo sapiens
gtcagcgagaaggagt

SEQ ID NO: 5630150 - DNA, 18 bp, Homo sapiens
gtcagcgattcctgccaa

SEQ ID NO: 5630151 - DNA, 17 bp, Homo sapiens
gtcagcggagaggaccc

SEQ ID NO: 5630152 - DNA, 19 bp, Homo sapiens
gtcagcgggcccaggccta

SEQ ID NO: 5630153 - DNA, 23 bp, Homo sapiens
gtcagcggggcagcggggctggc

SEQ ID NO: 5630154 - DNA, 21 bp, Homo sapiens
gtcagcgtggtttttatgtgt

SEQ ID NO: 5630155 - DNA, 17 bp, Homo sapiens
gtcagctactaatgatg

SEQ ID NO: 5630156 - DNA, 21 bp, Homo sapiens
gtcagctcacaccctaataag

SEQ ID NO: 5630157 - DNA, 20 bp, Homo sapiens
gtcagctcaggcagctcgag

SEQ ID NO: 5630158 - DNA, 12 bp, Homo sapiens
gtcagctccagc

SEQ ID NO: 5630159 - DNA, 13 bp, Homo sapiens
gtcagctccagct

SEQ ID NO: 5630160 - DNA, 21 bp, Homo sapiens
gtcagctcccctcggagaaga

SEQ ID NO: 5630161 - DNA, 16 bp, Homo sapiens
gtcagctctcatctga

SEQ ID NO: 5630162 - DNA, 14 bp, Homo sapiens
gtcagctctctgcc

SEQ ID NO: 5630163 - DNA, 16 bp, Homo sapiens
gtcagctctctgccct

SEQ ID NO: 5630164 - DNA, 18 bp, Homo sapiens
gtcagctctctgccctgt

SEQ ID NO: 5630165 - DNA, 15 bp, Homo sapiens
gtcagctctggccac

SEQ ID NO: 5630166 - DNA, 19 bp, Homo sapiens
gtcagctgaccccctcccc

SEQ ID NO: 5630167 - DNA, 12 bp, Homo sapiens
gtcagctgaggc

SEQ ID NO: 5630168 - DNA, 23 bp, Homo sapiens
gtcagctgaggctgggggagagc

SEQ ID NO: 5630169 - DNA, 17 bp, Homo sapiens
gtcagctgctccctggc

SEQ ID NO: 5630170 - DNA, 20 bp, Homo sapiens
gtcagctgctccctggcatt

SEQ ID NO: 5630171 - DNA, 17 bp, Homo sapiens
gtcagctgctgttgaac

SEQ ID NO: 5630172 - DNA, 15 bp, Homo sapiens
gtcagctgcttctgc

SEQ ID NO: 5630173 - DNA, 21 bp, Homo sapiens
gtcagctggccagatttcctc

SEQ ID NO: 5630174 - DNA, 22 bp, Homo sapiens
gtcagctggccagatttcctca

SEQ ID NO: 5630175 - DNA, 22 bp, Homo sapiens
gtcagctgggacaccccgactt

SEQ ID NO: 5630176 - DNA, 18 bp, Homo sapiens
gtcagctgttactttctt

SEQ ID NO: 5630177 - DNA, 12 bp, Homo sapiens
gtcagcttatcc

SEQ ID NO: 5630178 - DNA, 23 bp, Homo sapiens
gtcagcttcccagccatgcccag

SEQ ID NO: 5630179 - DNA, 23 bp, Homo sapiens
gtcagcttccccaggagctctct

SEQ ID NO: 5630180 - DNA, 14 bp, Homo sapiens
gtcagcttgaatgt

SEQ ID NO: 5630181 - DNA, 16 bp, Homo sapiens
gtcagctttgccttcc

SEQ ID NO: 5630182 - DNA, 16 bp, Homo sapiens
gtcagcttttttcctg

SEQ ID NO: 5630183 - DNA, 17 bp, Homo sapiens
gtcagcttttttcctgt

SEQ ID NO: 5630184 - DNA, 17 bp, Homo sapiens
gtcaggaaacccagtcg

SEQ ID NO: 5630185 - DNA, 17 bp, Homo sapiens
gtcaggaaagacaggct

SEQ ID NO: 5630186 - DNA, 14 bp, Homo sapiens
gtcaggaaagagaa

SEQ ID NO: 5630187 - DNA, 20 bp, Homo sapiens
gtcaggaagtaaaataaata

SEQ ID NO: 5630188 - DNA, 18 bp, Homo sapiens
gtcaggacaccagcctgg

SEQ ID NO: 5630189 - DNA, 13 bp, Homo sapiens
gtcaggacagctt

SEQ ID NO: 5630190 - DNA, 18 bp, Homo sapiens
gtcaggaccaggacccag

SEQ ID NO: 5630191 - DNA, 13 bp, Homo sapiens
gtcaggacccagg

SEQ ID NO: 5630192 - DNA, 23 bp, Homo sapiens
gtcaggacccaggccgcctgcca

SEQ ID NO: 5630193 - DNA, 13 bp, Homo sapiens
gtcaggagccagc

SEQ ID NO: 5630194 - DNA, 15 bp, Homo sapiens
gtcaggagccagcag

SEQ ID NO: 5630195 - DNA, 15 bp, Homo sapiens
gtcaggaggcagaag

SEQ ID NO: 5630196 - DNA, 13 bp, Homo sapiens
gtcaggaggtgcc

SEQ ID NO: 5630197 - DNA, 20 bp, Homo sapiens
gtcaggagtgtgtgtgagtg

SEQ ID NO: 5630198 - DNA, 23 bp, Homo sapiens
gtcaggagttcaagaccagcctg

SEQ ID NO: 5630199 - DNA, 23 bp, Homo sapiens
gtcaggagttcgagaccagcctg

SEQ ID NO: 5630200 - DNA, 23 bp, Homo sapiens
gtcaggagttcgagagcagcctg

SEQ ID NO: 5630201 - DNA, 22 bp, Homo sapiens
gtcaggagttgtttctgaccca

SEQ ID NO: 5630202 - DNA, 16 bp, Homo sapiens
gtcaggatgaggcccc

SEQ ID NO: 5630203 - DNA, 22 bp, Homo sapiens
gtcaggattgcgagagatgtgt

SEQ ID NO: 5630204 - DNA, 22 bp, Homo sapiens
gtcaggcacgtctcctgctgcg

SEQ ID NO: 5630205 - DNA, 17 bp, Homo sapiens
gtcaggcactggctgaa

SEQ ID NO: 5630206 - DNA, 14 bp, Homo sapiens
gtcaggcagaggca

SEQ ID NO: 5630207 - DNA, 20 bp, Homo sapiens
gtcaggcagccagtgagatg

SEQ ID NO: 5630208 - DNA, 13 bp, Homo sapiens
gtcaggcagggtg

SEQ ID NO: 5630209 - DNA, 13 bp, Homo sapiens
gtcaggcaggttt

SEQ ID NO: 5630210 - DNA, 16 bp, Homo sapiens
gtcaggccagcctgtc

SEQ ID NO: 5630211 - DNA, 19 bp, Homo sapiens
gtcaggccagcctgtccct

SEQ ID NO: 5630212 - DNA, 16 bp, Homo sapiens
gtcaggccaggtgggc

SEQ ID NO: 5630213 - DNA, 20 bp, Homo sapiens
gtcaggccattcagtctatg

SEQ ID NO: 5630214 - DNA, 21 bp, Homo sapiens
gtcaggcccagcctctctggc

SEQ ID NO: 5630215 - DNA, 17 bp, Homo sapiens
gtcaggcccgtcggagc

SEQ ID NO: 5630216 - DNA, 19 bp, Homo sapiens
gtcaggcccgtcggagctg

SEQ ID NO: 5630217 - DNA, 13 bp, Homo sapiens
gtcaggccctctg

SEQ ID NO: 5630218 - DNA, 17 bp, Homo sapiens
gtcaggccctctgcctg

SEQ ID NO: 5630219 - DNA, 19 bp, Homo sapiens
gtcaggccctctgcctgca

SEQ ID NO: 5630220 - DNA, 17 bp, Homo sapiens
gtcaggccctgactcct

SEQ ID NO: 5630221 - DNA, 13 bp, Homo sapiens
gtcaggccctggt

SEQ ID NO: 5630222 - DNA, 22 bp, Homo sapiens
gtcaggcctctgagcccaagct

SEQ ID NO: 5630223 - DNA, 18 bp, Homo sapiens
gtcaggcctggcctcatc

SEQ ID NO: 5630224 - DNA, 13 bp, Homo sapiens
gtcaggcctgtgt

SEQ ID NO: 5630225 - DNA, 21 bp, Homo sapiens
gtcaggcggggtgctgtggtg

SEQ ID NO: 5630226 - DNA, 19 bp, Homo sapiens
gtcaggcgtagatcaccag

SEQ ID NO: 5630227 - DNA, 14 bp, Homo sapiens
gtcaggctagctgt

SEQ ID NO: 5630228 - DNA, 17 bp, Homo sapiens
gtcaggctagctgtgct

SEQ ID NO: 5630229 - DNA, 18 bp, Homo sapiens
gtcaggctagctgtgctg

SEQ ID NO: 5630230 - DNA, 12 bp, Homo sapiens
gtcaggctccat

SEQ ID NO: 5630231 - DNA, 19 bp, Homo sapiens
gtcaggctctctgggctga

SEQ ID NO: 5630232 - DNA, 16 bp, Homo sapiens
gtcaggctgaaaacaa

SEQ ID NO: 5630233 - DNA, 15 bp, Homo sapiens
gtcaggctgctggcg

SEQ ID NO: 5630234 - DNA, 19 bp, Homo sapiens
gtcaggctgggcagcccca

SEQ ID NO: 5630235 - DNA, 20 bp, Homo sapiens
gtcaggctgggcagccccag

SEQ ID NO: 5630236 - DNA, 12 bp, Homo sapiens
gtcaggcttctc

SEQ ID NO: 5630237 - DNA, 18 bp, Homo sapiens
gtccacttctgacagcct

SEQ ID NO: 5630238 - DNA, 18 bp, Homo sapiens
gtccacttgccagggctc

SEQ ID NO: 5630239 - DNA, 15 bp, Homo sapiens
gtccacttgtgggtc

SEQ ID NO: 5630240 - DNA, 15 bp, Homo sapiens
gtccactttcccttc

SEQ ID NO: 5630241 - DNA, 16 bp, Homo sapiens
gtccactttcccttcc

SEQ ID NO: 5630242 - DNA, 19 bp, Homo sapiens
gtccactttcctctctctc

SEQ ID NO: 5630243 - DNA, 15 bp, Homo sapiens
gtccacttttccagt

SEQ ID NO: 5630244 - DNA, 18 bp, Homo sapiens
gtccacttttccagtatt

SEQ ID NO: 5630245 - DNA, 20 bp, Homo sapiens
gtccacttttccagtatttt

SEQ ID NO: 5630246 - DNA, 21 bp, Homo sapiens
gtccagaagaatattcaggac

SEQ ID NO: 5630247 - DNA, 17 bp, Homo sapiens
gtccagaagaccccact

SEQ ID NO: 5630248 - DNA, 18 bp, Homo sapiens
gtccagaagaccccactt

SEQ ID NO: 5630249 - DNA, 19 bp, Homo sapiens
gtccagaagcctcctgttg

SEQ ID NO: 5630250 - DNA, 17 bp, Homo sapiens
gtccagaaggagggggt

SEQ ID NO: 5630251 - DNA, 19 bp, Homo sapiens
gtccagaataagtgctgtt

SEQ ID NO: 5630252 - DNA, 18 bp, Homo sapiens
gtccagacaagccctgct

SEQ ID NO: 5630253 - DNA, 17 bp, Homo sapiens
gtccagacaccatcacc

SEQ ID NO: 5630254 - DNA, 11 bp, Homo sapiens
gtccagacagc

SEQ ID NO: 5630255 - DNA, 14 bp, Homo sapiens
gtccagacagcctg

SEQ ID NO: 5630256 - DNA, 23 bp, Homo sapiens
gtccagacagcttgactgctttt

SEQ ID NO: 5630257 - DNA, 19 bp, Homo sapiens
gtccagaccattgtcttcc

SEQ ID NO: 5630258 - DNA, 20 bp, Homo sapiens
gtccagaccattgtcttcca

SEQ ID NO: 5630259 - DNA, 14 bp, Homo sapiens
gtccagacccaagt

SEQ ID NO: 5630260 - DNA, 16 bp, Homo sapiens
gtccagaccccccagc

SEQ ID NO: 5630261 - DNA, 16 bp, Homo sapiens
gtccagacctgggccc

SEQ ID NO: 5630262 - DNA, 19 bp, Homo sapiens
gtccagagaccacaccact

SEQ ID NO: 5630263 - DNA, 22 bp, Homo sapiens
gtccagagagagaagtgcccct

SEQ ID NO: 5630264 - DNA, 17 bp, Homo sapiens
gtccagagctgcttccc

SEQ ID NO: 5630265 - DNA, 13 bp, Homo sapiens
gtccagagctggc

SEQ ID NO: 5630266 - DNA, 19 bp, Homo sapiens
gtccagagcttcagggctg

SEQ ID NO: 5630267 - DNA, 12 bp, Homo sapiens
gtccagagcttg

SEQ ID NO: 5630268 - DNA, 22 bp, Homo sapiens
gtccagagcttgtgctcctctt

SEQ ID NO: 5630269 - DNA, 13 bp, Homo sapiens
gtccagaggaggt

SEQ ID NO: 5630270 - DNA, 15 bp, Homo sapiens
gtccagagggactgg

SEQ ID NO: 5630271 - DNA, 19 bp, Homo sapiens
gtccagagggactggacag

SEQ ID NO: 5630272 - DNA, 22 bp, Homo sapiens
gtccagagtagtttctttctgt

SEQ ID NO: 5630273 - DNA, 13 bp, Homo sapiens
gtccagagtctct

SEQ ID NO: 5630274 - DNA, 16 bp, Homo sapiens
gtccagatgccttcct

SEQ ID NO: 5630275 - DNA, 20 bp, Homo sapiens
gtccagatgccttcctgtct

SEQ ID NO: 5630276 - DNA, 22 bp, Homo sapiens
gtccagatttacactgggagag

SEQ ID NO: 5630277 - DNA, 12 bp, Homo sapiens
gtccagcacagc

SEQ ID NO: 5630278 - DNA, 12 bp, Homo sapiens
gtccagcagctg

SEQ ID NO: 5630279 - DNA, 20 bp, Homo sapiens
gtccagcagctgcgggtctg

SEQ ID NO: 5630280 - DNA, 14 bp, Homo sapiens
gtccagcagtcact

SEQ ID NO: 5630281 - DNA, 12 bp, Homo sapiens
gtccagccaccc

SEQ ID NO: 5630282 - DNA, 13 bp, Homo sapiens
gtccagccacccc

SEQ ID NO: 5630283 - DNA, 18 bp, Homo sapiens
gtccagccacccccaggc

SEQ ID NO: 5630284 - DNA, 14 bp, Homo sapiens
gtccagccagctcc

SEQ ID NO: 5630285 - DNA, 15 bp, Homo sapiens
gtccagccccccagg

SEQ ID NO: 5630286 - DNA, 16 bp, Homo sapiens
gtccagccccccaggc

SEQ ID NO: 5630287 - DNA, 18 bp, Homo sapiens
gtccagccccccaggctg

SEQ ID NO: 5630288 - DNA, 20 bp, Homo sapiens
gtccagcccctcctccctca

SEQ ID NO: 5630289 - DNA, 23 bp, Homo sapiens
gtccagcccctcctccctcagac

SEQ ID NO: 5630290 - DNA, 12 bp, Homo sapiens
gtccagccctcc

SEQ ID NO: 5630291 - DNA, 15 bp, Homo sapiens
gtccagccgtgtgtg

SEQ ID NO: 5630292 - DNA, 11 bp, Homo sapiens
gtccagcctta

SEQ ID NO: 5630293 - DNA, 20 bp, Homo sapiens
gtccagcgtcactccagtgc

SEQ ID NO: 5630294 - DNA, 21 bp, Homo sapiens
gtccagcgtcactccagtgct

SEQ ID NO: 5630295 - DNA, 17 bp, Homo sapiens
gtccagctcagccctgg

SEQ ID NO: 5630296 - DNA, 22 bp, Homo sapiens
gtccagctcagccctggcctgg

SEQ ID NO: 5630297 - DNA, 24 bp, Homo sapiens
gtccagctcccgctgtggccgcac

SEQ ID NO: 5630298 - DNA, 19 bp, Homo sapiens
gtccagctccttaaactga

SEQ ID NO: 5630299 - DNA, 10 bp, Homo sapiens
gtccagctct

SEQ ID NO: 5630300 - DNA, 16 bp, Homo sapiens
gtccagctctcccctg

SEQ ID NO: 5630301 - DNA, 18 bp, Homo sapiens
gtccagctctcccctgcg

SEQ ID NO: 5630302 - DNA, 20 bp, Homo sapiens
gtccagctctgacatccctt

SEQ ID NO: 5630303 - DNA, 18 bp, Homo sapiens
gtccagctctgtgggccc

SEQ ID NO: 5630304 - DNA, 14 bp, Homo sapiens
gtccagctcttggc

SEQ ID NO: 5630305 - DNA, 19 bp, Homo sapiens
gtccagctgcccttccgca

SEQ ID NO: 5630306 - DNA, 12 bp, Homo sapiens
gtccagctggcc

SEQ ID NO: 5630307 - DNA, 14 bp, Homo sapiens
gtccagctggcctg

SEQ ID NO: 5630308 - DNA, 19 bp, Homo sapiens
gtccagctggcctggacag

SEQ ID NO: 5630309 - DNA, 19 bp, Homo sapiens
gtccagctgggaagccctt

SEQ ID NO: 5630310 - DNA, 22 bp, Homo sapiens
gtccagctgggcctcctgcctc

SEQ ID NO: 5630311 - DNA, 17 bp, Homo sapiens
gtccagctggggccaga

SEQ ID NO: 5630312 - DNA, 17 bp, Homo sapiens
gtccagcttatagtctt

SEQ ID NO: 5630313 - DNA, 21 bp, Homo sapiens
gtccagcttctcttgaaaact

SEQ ID NO: 5630314 - DNA, 14 bp, Homo sapiens
gtccaggaaggcag

SEQ ID NO: 5630315 - DNA, 18 bp, Homo sapiens
gtccaggaaggcagctgc

SEQ ID NO: 5630316 - DNA, 21 bp, Homo sapiens
gtccaggaaggcagctgctct

SEQ ID NO: 5630317 - DNA, 22 bp, Homo sapiens
gtccaggaaggcagctgctctt

SEQ ID NO: 5630318 - DNA, 17 bp, Homo sapiens
gtccaggaatggtgctt

SEQ ID NO: 5630319 - DNA, 19 bp, Homo sapiens
gtccaggagagcctggggg

SEQ ID NO: 5630320 - DNA, 18 bp, Homo sapiens
gtccaggagccccagcca

SEQ ID NO: 5630321 - DNA, 20 bp, Homo sapiens
gtccaggagccccagccagc

SEQ ID NO: 5630322 - DNA, 13 bp, Homo sapiens
gtccaggagctca

SEQ ID NO: 5630323 - DNA, 23 bp, Homo sapiens
gtccaggagctcaggaagaagag

SEQ ID NO: 5630324 - DNA, 19 bp, Homo sapiens
gtccaggcagctccctcct

SEQ ID NO: 5630325 - DNA, 21 bp, Homo sapiens
gtccaggcagctccctcctgc

SEQ ID NO: 5630326 - DNA, 21 bp, Homo sapiens
gtccaggcatgttggactctg

SEQ ID NO: 5630327 - DNA, 11 bp, Homo sapiens
gtccaggccac

SEQ ID NO: 5630328 - DNA, 14 bp, Homo sapiens
gtccaggccactgt

SEQ ID NO: 5630329 - DNA, 17 bp, Homo sapiens
gtccaggccactgtggc

SEQ ID NO: 5630330 - DNA, 23 bp, Homo sapiens
gtccaggccactgtggccagagc

SEQ ID NO: 5630331 - DNA, 14 bp, Homo sapiens
gtccaggccaggcc

SEQ ID NO: 5630332 - DNA, 24 bp, Homo sapiens
gtccaggccaggcctcatcctcct

SEQ ID NO: 5630333 - DNA, 22 bp, Homo sapiens
gtccaggccccaccggccaggc

SEQ ID NO: 5630334 - DNA, 23 bp, Homo sapiens
gtccaggccccaccggccaggcc

SEQ ID NO: 5630335 - DNA, 15 bp, Homo sapiens
gtccaggcccccagc

SEQ ID NO: 5630336 - DNA, 16 bp, Homo sapiens
gtccaggcccccagcc

SEQ ID NO: 5630337 - DNA, 17 bp, Homo sapiens
gtccaggcccccagccc

SEQ ID NO: 5630338 - DNA, 19 bp, Homo sapiens
gtccaggcccgtgggcgca

SEQ ID NO: 5630339 - DNA, 12 bp, Homo sapiens
gtccaggccctt

SEQ ID NO: 5630340 - DNA, 13 bp, Homo sapiens
gtccaggccctta

SEQ ID NO: 5630341 - DNA, 19 bp, Homo sapiens
gtccaggcctactcctgtc

SEQ ID NO: 5630342 - DNA, 19 bp, Homo sapiens
gtccaggcctctctctgct

SEQ ID NO: 5630343 - DNA, 13 bp, Homo sapiens
gtccaggcctggg

SEQ ID NO: 5630344 - DNA, 16 bp, Homo sapiens
gtccaggcctgggtca

SEQ ID NO: 5630345 - DNA, 18 bp, Homo sapiens
gtccaggctctgggcaca

SEQ ID NO: 5630346 - DNA, 20 bp, Homo sapiens
gtccaggctctgggcacagt

SEQ ID NO: 5630347 - DNA, 14 bp, Homo sapiens
gtccaggctgccgt

SEQ ID NO: 5630348 - DNA, 20 bp, Homo sapiens
gtccaggctgccgtggggcc

SEQ ID NO: 5630349 - DNA, 16 bp, Homo sapiens
gtccaggcttgcctca

SEQ ID NO: 5630350 - DNA, 22 bp, Homo sapiens
gtccagggaaacagcctctctc

SEQ ID NO: 5630351 - DNA, 23 bp, Homo sapiens
gtccagggaaacagcctctctct

SEQ ID NO: 5630352 - DNA, 19 bp, Homo sapiens
gtccagggagggagctgag

SEQ ID NO: 5630353 - DNA, 13 bp, Homo sapiens
gtccagggcccca

SEQ ID NO: 5630354 - DNA, 15 bp, Homo sapiens
gtccagggccctgag

SEQ ID NO: 5630355 - DNA, 16 bp, Homo sapiens
gtccagggccctgagc

SEQ ID NO: 5630356 - DNA, 17 bp, Homo sapiens
gtccagggccctgagct

SEQ ID NO: 5630357 - DNA, 20 bp, Homo sapiens
gtccagggccctgagctcgg

SEQ ID NO: 5630358 - DNA, 21 bp, Homo sapiens
gtccagggcctgacaccccct

SEQ ID NO: 5630359 - DNA, 16 bp, Homo sapiens
gtccagggcctgggaa

SEQ ID NO: 5630360 - DNA, 22 bp, Homo sapiens
gtccagggctgttggaggaccc

SEQ ID NO: 5630361 - DNA, 19 bp, Homo sapiens
gtccaggggagatggggag

SEQ ID NO: 5630362 - DNA, 18 bp, Homo sapiens
gtccaggggaggccttcc

SEQ ID NO: 5630363 - DNA, 19 bp, Homo sapiens
gtccaggggcccctccagc

SEQ ID NO: 5630364 - DNA, 22 bp, Homo sapiens
gtccaggggtctgtctgctttg

SEQ ID NO: 5630365 - DNA, 18 bp, Homo sapiens
gtccagggtccagccctc

SEQ ID NO: 5630366 - DNA, 13 bp, Homo sapiens
gtccaggtagaaa

SEQ ID NO: 5630367 - DNA, 15 bp, Homo sapiens
gtccaggtagaaaag

SEQ ID NO: 5630368 - DNA, 14 bp, Homo sapiens
gtccaggtcacagg

SEQ ID NO: 5630369 - DNA, 18 bp, Homo sapiens
gtccaggtcaccagcctg

SEQ ID NO: 5630370 - DNA, 14 bp, Homo sapiens
gtccaggtcccagc

SEQ ID NO: 5630371 - DNA, 15 bp, Homo sapiens
gtccaggtccgtagc

SEQ ID NO: 5630372 - DNA, 20 bp, Homo sapiens
gtccaggtccgtagctcccc

SEQ ID NO: 5630373 - DNA, 22 bp, Homo sapiens
gtccaggtccgtagctcccctg

SEQ ID NO: 5630374 - DNA, 17 bp, Homo sapiens
gtccaggtcctggtggg

SEQ ID NO: 5630375 - DNA, 17 bp, Homo sapiens
gtccaggtcgggctcag

SEQ ID NO: 5630376 - DNA, 21 bp, Homo sapiens
gtccaggtctagaaggccagg

SEQ ID NO: 5630377 - DNA, 21 bp, Homo sapiens
gtccaggtgaggcccaagagc

SEQ ID NO: 5630378 - DNA, 22 bp, Homo sapiens
gtccaggtggaggtggcatccc

SEQ ID NO: 5630379 - DNA, 23 bp, Homo sapiens
gtccaggttgatcttgaactcct

SEQ ID NO: 5630380 - DNA, 23 bp, Homo sapiens
gtccagtaagatcactgtttaga

SEQ ID NO: 5630381 - DNA, 23 bp, Homo sapiens
gtccagtcctatctgggcttcct

SEQ ID NO: 5630382 - DNA, 23 bp, Homo sapiens
gtccagtcctttgttgctgttgc

SEQ ID NO: 5630383 - DNA, 19 bp, Homo sapiens
gtccagtgaccctggagct

SEQ ID NO: 5630384 - DNA, 19 bp, Homo sapiens
gtccagtgagcagtgttgc

SEQ ID NO: 5630385 - DNA, 21 bp, Homo sapiens
gtccagtgcattttgtttctg

SEQ ID NO: 5630386 - DNA, 22 bp, Homo sapiens
gtccagtgcattttgtttctgt

SEQ ID NO: 5630387 - DNA, 12 bp, Homo sapiens
gtccagtgccca

SEQ ID NO: 5630388 - DNA, 11 bp, Homo sapiens
gtccagtgcct

SEQ ID NO: 5630389 - DNA, 12 bp, Homo sapiens
gtccagtgctct

SEQ ID NO: 5630390 - DNA, 17 bp, Homo sapiens
gtccagtgctctgcctc

SEQ ID NO: 5630391 - DNA, 18 bp, Homo sapiens
gtccagtgtcacctctct

SEQ ID NO: 5630392 - DNA, 21 bp, Homo sapiens
gtccagtgtcacctctctcag

SEQ ID NO: 5630393 - DNA, 15 bp, Homo sapiens
gtccagtgtttcttt

SEQ ID NO: 5630394 - DNA, 13 bp, Homo sapiens
gtccagttttgtg

SEQ ID NO: 5630395 - DNA, 11 bp, Homo sapiens
gtccataaagt

SEQ ID NO: 5630396 - DNA, 12 bp, Homo sapiens
gtccataaagta

SEQ ID NO: 5630397 - DNA, 15 bp, Homo sapiens
gtccatacactttgt

SEQ ID NO: 5630398 - DNA, 15 bp, Homo sapiens
gtccatagctcctct

SEQ ID NO: 5630399 - DNA, 13 bp, Homo sapiens
gtccatagctgtg

SEQ ID NO: 5630400 - DNA, 16 bp, Homo sapiens
gtccatagctgtggtg

SEQ ID NO: 5630401 - DNA, 16 bp, Homo sapiens
gtccatatcacacaca

SEQ ID NO: 5630402 - DNA, 17 bp, Homo sapiens
gtccatatcacacacat

SEQ ID NO: 5630403 - DNA, 21 bp, Homo sapiens
gtccatatcagaactgtgcca

SEQ ID NO: 5630404 - DNA, 18 bp, Homo sapiens
gtccatatcagacctctg

SEQ ID NO: 5630405 - DNA, 15 bp, Homo sapiens
gtccatatgcatcta

SEQ ID NO: 5630406 - DNA, 13 bp, Homo sapiens
gtccatatttaca

SEQ ID NO: 5630407 - DNA, 21 bp, Homo sapiens
gtccatatttacattctagtt

SEQ ID NO: 5630408 - DNA, 14 bp, Homo sapiens
gtccatcactattc

SEQ ID NO: 5630409 - DNA, 23 bp, Homo sapiens
gtccatcagggatctcagaggct

SEQ ID NO: 5630410 - DNA, 13 bp, Homo sapiens
gtccatcccctga

SEQ ID NO: 5630411 - DNA, 17 bp, Homo sapiens
gtccatcccttttcctg

SEQ ID NO: 5630412 - DNA, 22 bp, Homo sapiens
gtccatcccttttcctgtcagt

SEQ ID NO: 5630413 - DNA, 12 bp, Homo sapiens
gtccatcctgac

SEQ ID NO: 5630414 - DNA, 13 bp, Homo sapiens
gtccatctctgaa

SEQ ID NO: 5630415 - DNA, 15 bp, Homo sapiens
gtcccctctgtgctt

SEQ ID NO: 5630416 - DNA, 16 bp, Homo sapiens
gtcccctctgtgcttc

SEQ ID NO: 5630417 - DNA, 11 bp, Homo sapiens
gtcccctgagg

SEQ ID NO: 5630418 - DNA, 14 bp, Homo sapiens
gtcccctgcagcct

SEQ ID NO: 5630419 - DNA, 16 bp, Homo sapiens
gtcccctgcagcctgg

SEQ ID NO: 5630420 - DNA, 13 bp, Homo sapiens
gtcccctgcccca

SEQ ID NO: 5630421 - DNA, 14 bp, Homo sapiens
gtcccctgccccag

SEQ ID NO: 5630422 - DNA, 16 bp, Homo sapiens
gtcccctgccccagag

SEQ ID NO: 5630423 - DNA, 15 bp, Homo sapiens
gtcccctgcctggaa

SEQ ID NO: 5630424 - DNA, 21 bp, Homo sapiens
gtcccctggagtgtgtcagag

SEQ ID NO: 5630425 - DNA, 23 bp, Homo sapiens
gtcccctggagtgtgtcagagcc

SEQ ID NO: 5630426 - DNA, 13 bp, Homo sapiens
gtcccctggcagt

SEQ ID NO: 5630427 - DNA, 15 bp, Homo sapiens
gtcccctgggccacc

SEQ ID NO: 5630428 - DNA, 16 bp, Homo sapiens
gtcccctgggccaccc

SEQ ID NO: 5630429 - DNA, 17 bp, Homo sapiens
gtcccctgggccaccct

SEQ ID NO: 5630430 - DNA, 12 bp, Homo sapiens
gtcccctggggc

SEQ ID NO: 5630431 - DNA, 19 bp, Homo sapiens
gtcccctggggctggtgga

SEQ ID NO: 5630432 - DNA, 17 bp, Homo sapiens
gtcccctggtgcccctc

SEQ ID NO: 5630433 - DNA, 13 bp, Homo sapiens
gtcccctgtccca

SEQ ID NO: 5630434 - DNA, 21 bp, Homo sapiens
gtcccctgtggtgatgtgcct

SEQ ID NO: 5630435 - DNA, 23 bp, Homo sapiens
gtcccctgtggtgatgtgcctgt

SEQ ID NO: 5630436 - DNA, 23 bp, Homo sapiens
gtcccctgtttgtttctgaaagg

SEQ ID NO: 5630437 - DNA, 13 bp, Homo sapiens
gtccccttccagg

SEQ ID NO: 5630438 - DNA, 13 bp, Homo sapiens
gtccccttcccct

SEQ ID NO: 5630439 - DNA, 18 bp, Homo sapiens
gtccccttcccctgctga

SEQ ID NO: 5630440 - DNA, 12 bp, Homo sapiens
gtccccttcctg

SEQ ID NO: 5630441 - DNA, 21 bp, Homo sapiens
gtccccttcctgttcttcctt

SEQ ID NO: 5630442 - DNA, 22 bp, Homo sapiens
gtccccttcctgttcttccttc

SEQ ID NO: 5630443 - DNA, 19 bp, Homo sapiens
gtccccttctctcatctct

SEQ ID NO: 5630444 - DNA, 20 bp, Homo sapiens
gtccccttctctcatctctt

SEQ ID NO: 5630445 - DNA, 22 bp, Homo sapiens
gtccccttctgtgtttctggag

SEQ ID NO: 5630446 - DNA, 22 bp, Homo sapiens
gtcccctttcatcggtgcctgg

SEQ ID NO: 5630447 - DNA, 20 bp, Homo sapiens
gtcccgaatggagtccagac

SEQ ID NO: 5630448 - DNA, 23 bp, Homo sapiens
gtcccgaatggagtccagacctg

SEQ ID NO: 5630449 - DNA, 17 bp, Homo sapiens
gtcccgagccccctgtc

SEQ ID NO: 5630450 - DNA, 19 bp, Homo sapiens
gtcccgagccccctgtcct

SEQ ID NO: 5630451 - DNA, 23 bp, Homo sapiens
gtcccgaggaagggccagagcct

SEQ ID NO: 5630452 - DNA, 19 bp, Homo sapiens
gtcccgaggatgctgtcag

SEQ ID NO: 5630453 - DNA, 16 bp, Homo sapiens
gtcccgcacagtggac

SEQ ID NO: 5630454 - DNA, 19 bp, Homo sapiens
gtcccgccttcctcctcca

SEQ ID NO: 5630455 - DNA, 21 bp, Homo sapiens
gtcccgcgcttcgaactccag

SEQ ID NO: 5630456 - DNA, 14 bp, Homo sapiens
gtcccgcggtgctg

SEQ ID NO: 5630457 - DNA, 17 bp, Homo sapiens
gtcccgcggtgctgact

SEQ ID NO: 5630458 - DNA, 13 bp, Homo sapiens
gtcccgctgcctc

SEQ ID NO: 5630459 - DNA, 17 bp, Homo sapiens
gtcccgctgctgtgctc

SEQ ID NO: 5630460 - DNA, 15 bp, Homo sapiens
gtcccggagctcagg

SEQ ID NO: 5630461 - DNA, 14 bp, Homo sapiens
gtcccggccagctc

SEQ ID NO: 5630462 - DNA, 17 bp, Homo sapiens
gtcccggccagctctgg

SEQ ID NO: 5630463 - DNA, 18 bp, Homo sapiens
gtcccggccagctctgga

SEQ ID NO: 5630464 - DNA, 19 bp, Homo sapiens
gtcccggccagctctggag

SEQ ID NO: 5630465 - DNA, 17 bp, Homo sapiens
gtcccggctctgtgggt

SEQ ID NO: 5630466 - DNA, 15 bp, Homo sapiens
gtcccggcttccacc

SEQ ID NO: 5630467 - DNA, 16 bp, Homo sapiens
gtcccgggcactgtca

SEQ ID NO: 5630468 - DNA, 15 bp, Homo sapiens
gtcccggggccagca

SEQ ID NO: 5630469 - DNA, 21 bp, Homo sapiens
gtcccggggccagcacttcca

SEQ ID NO: 5630470 - DNA, 22 bp, Homo sapiens
gtcccggggccagcacttccat

SEQ ID NO: 5630471 - DNA, 14 bp, Homo sapiens
gtcccggggtcctg

SEQ ID NO: 5630472 - DNA, 23 bp, Homo sapiens
gtcccggggtcctgtggcaggca

SEQ ID NO: 5630473 - DNA, 16 bp, Homo sapiens
gtcccgggttagcctg

SEQ ID NO: 5630474 - DNA, 20 bp, Homo sapiens
gtcccgtctggacctgggga

SEQ ID NO: 5630475 - DNA, 18 bp, Homo sapiens
gtcccgtgccctgtttcc

SEQ ID NO: 5630476 - DNA, 13 bp, Homo sapiens
gtcccgtggaggg

SEQ ID NO: 5630477 - DNA, 23 bp, Homo sapiens
gtccctaagtaagtttcttcctg

SEQ ID NO: 5630478 - DNA, 21 bp, Homo sapiens
gtccctaattctcttcgctgt

SEQ ID NO: 5630479 - DNA, 22 bp, Homo sapiens
gtccctaccactgagcccttgc

SEQ ID NO: 5630480 - DNA, 23 bp, Homo sapiens
gtccctaccactgagcccttgca

SEQ ID NO: 5630481 - DNA, 14 bp, Homo sapiens
gtccctacccactc

SEQ ID NO: 5630482 - DNA, 15 bp, Homo sapiens
gtccctacccactct

SEQ ID NO: 5630483 - DNA, 21 bp, Homo sapiens
gtccctaccgagtctcttctc

SEQ ID NO: 5630484 - DNA, 22 bp, Homo sapiens
gtccctaccgagtctcttctcc

SEQ ID NO: 5630485 - DNA, 23 bp, Homo sapiens
gtccctaccgagtctcttctcca

SEQ ID NO: 5630486 - DNA, 16 bp, Homo sapiens
gtccctacctgcttca

SEQ ID NO: 5630487 - DNA, 15 bp, Homo sapiens
gtccctagcagccca

SEQ ID NO: 5630488 - DNA, 14 bp, Homo sapiens
gtccctagctcaca

SEQ ID NO: 5630489 - DNA, 16 bp, Homo sapiens
gtccctagctcacact

SEQ ID NO: 5630490 - DNA, 16 bp, Homo sapiens
gtccctagggctctcc

SEQ ID NO: 5630491 - DNA, 16 bp, Homo sapiens
gtccctaggtgggtca

SEQ ID NO: 5630492 - DNA, 19 bp, Homo sapiens
gtccctatagtttcaccac

SEQ ID NO: 5630493 - DNA, 18 bp, Homo sapiens
gtccctatatcagggcct

SEQ ID NO: 5630494 - DNA, 19 bp, Homo sapiens
gtccctatatcagggcctg

SEQ ID NO: 5630495 - DNA, 20 bp, Homo sapiens
gtccctatatcagggcctga

SEQ ID NO: 5630496 - DNA, 23 bp, Homo sapiens
gtccctcaaatgacccaaagacc

SEQ ID NO: 5630497 - DNA, 13 bp, Homo sapiens
gtccctcacctcc

SEQ ID NO: 5630498 - DNA, 20 bp, Homo sapiens
gtccctcacgtttcttcccc

SEQ ID NO: 5630499 - DNA, 19 bp, Homo sapiens
gtccctcactccacagagt

SEQ ID NO: 5630500 - DNA, 16 bp, Homo sapiens
gtccctcactgccttc

SEQ ID NO: 5630501 - DNA, 15 bp, Homo sapiens
gtccctccaaggctg

SEQ ID NO: 5630502 - DNA, 18 bp, Homo sapiens
gtccctccaaggctgtct

SEQ ID NO: 5630503 - DNA, 12 bp, Homo sapiens
gtccctccaggg

SEQ ID NO: 5630504 - DNA, 13 bp, Homo sapiens
gtccctcccacct

SEQ ID NO: 5630505 - DNA, 21 bp, Homo sapiens
gtccctcccatctctacccca

SEQ ID NO: 5630506 - DNA, 19 bp, Homo sapiens
gtccctcccccgcttcctc

SEQ ID NO: 5630507 - DNA, 18 bp, Homo sapiens
gtccctccctgcctgagg

SEQ ID NO: 5630508 - DNA, 14 bp, Homo sapiens
gtccctccctttcc

SEQ ID NO: 5630509 - DNA, 16 bp, Homo sapiens
gtccctccctttcctc

SEQ ID NO: 5630510 - DNA, 13 bp, Homo sapiens
gtccctcctggga

SEQ ID NO: 5630511 - DNA, 14 bp, Homo sapiens
gtccctcgagctct

SEQ ID NO: 5630512 - DNA, 20 bp, Homo sapiens
gtccctcgagctctgtagcc

SEQ ID NO: 5630513 - DNA, 12 bp, Homo sapiens
gtccctctagct

SEQ ID NO: 5630514 - DNA, 18 bp, Homo sapiens
gtccctctcactccccag

SEQ ID NO: 5630515 - DNA, 16 bp, Homo sapiens
gtccctctcagtgcct

SEQ ID NO: 5630516 - DNA, 19 bp, Homo sapiens
gtccctctcagtgccttct

SEQ ID NO: 5630517 - DNA, 21 bp, Homo sapiens
gtccctctcagtgccttctct

SEQ ID NO: 5630518 - DNA, 22 bp, Homo sapiens
gtccctctcagtgccttctctc

SEQ ID NO: 5630519 - DNA, 14 bp, Homo sapiens
gtccctctctcagc

SEQ ID NO: 5630520 - DNA, 12 bp, Homo sapiens
gtccctctcttg

SEQ ID NO: 5630521 - DNA, 13 bp, Homo sapiens
gtccctctgtcca

SEQ ID NO: 5630522 - DNA, 20 bp, Homo sapiens
gtccctctgtccacttgtgg

SEQ ID NO: 5630523 - DNA, 11 bp, Homo sapiens
gtccctctgtg

SEQ ID NO: 5630524 - DNA, 22 bp, Homo sapiens
gtccctctgtgtatttgctttt

SEQ ID NO: 5630525 - DNA, 12 bp, Homo sapiens
gtccctcttctc

SEQ ID NO: 5630526 - DNA, 18 bp, Homo sapiens
gtccctcttctctcctca

SEQ ID NO: 5630527 - DNA, 16 bp, Homo sapiens
gtccctgaaagagaag

SEQ ID NO: 5630528 - DNA, 18 bp, Homo sapiens
gtccctgaagtcttgcat

SEQ ID NO: 5630529 - DNA, 20 bp, Homo sapiens
gtccctgactctctgtgacc

SEQ ID NO: 5630530 - DNA, 16 bp, Homo sapiens
gtccctgacttcccag

SEQ ID NO: 5630531 - DNA, 18 bp, Homo sapiens
gtccctgacttcccagct

SEQ ID NO: 5630532 - DNA, 22 bp, Homo sapiens
gtccctgagatttaacccctcc

SEQ ID NO: 5630533 - DNA, 23 bp, Homo sapiens
gtccctgagctcttgctatctct

SEQ ID NO: 5630534 - DNA, 23 bp, Homo sapiens
gtccctgcacagtgacttctgag

SEQ ID NO: 5630535 - DNA, 19 bp, Homo sapiens
gtccctgcacttgcagact

SEQ ID NO: 5630536 - DNA, 15 bp, Homo sapiens
gtccctgcagaagcc

SEQ ID NO: 5630537 - DNA, 22 bp, Homo sapiens
gtccctgcagaagccagaaggt

SEQ ID NO: 5630538 - DNA, 15 bp, Homo sapiens
gtccctgcagggcca

SEQ ID NO: 5630539 - DNA, 16 bp, Homo sapiens
gtccctgcagggccat

SEQ ID NO: 5630540 - DNA, 18 bp, Homo sapiens
gtccctgcagggccatct

SEQ ID NO: 5630541 - DNA, 11 bp, Homo sapiens
gtccctgccaa

SEQ ID NO: 5630542 - DNA, 15 bp, Homo sapiens
gtccctgccaatgga

SEQ ID NO: 5630543 - DNA, 17 bp, Homo sapiens
gtccctgccacactcag

SEQ ID NO: 5630544 - DNA, 22 bp, Homo sapiens
gtccctgccacgaatttctgtg

SEQ ID NO: 5630545 - DNA, 15 bp, Homo sapiens
gtccctgccagtgtt

SEQ ID NO: 5630546 - DNA, 21 bp, Homo sapiens
gtccctgccccgccccccaga

SEQ ID NO: 5630547 - DNA, 14 bp, Homo sapiens
gtccctgccctccc

SEQ ID NO: 5630548 - DNA, 17 bp, Homo sapiens
gtccctgccctcccctg

SEQ ID NO: 5630549 - DNA, 21 bp, Homo sapiens
gtccctgccctcccctgctcc

SEQ ID NO: 5630550 - DNA, 16 bp, Homo sapiens
gtccctgcccttcttc

SEQ ID NO: 5630551 - DNA, 12 bp, Homo sapiens
gtccctgcctgg

SEQ ID NO: 5630552 - DNA, 21 bp, Homo sapiens
gtccctgcctggaccagcctc

SEQ ID NO: 5630553 - DNA, 23 bp, Homo sapiens
gtccctgcctggaccagcctctc

SEQ ID NO: 5630554 - DNA, 13 bp, Homo sapiens
gtccctgcctggc

SEQ ID NO: 5630555 - DNA, 12 bp, Homo sapiens
gtccctgccttc

SEQ ID NO: 5630556 - DNA, 13 bp, Homo sapiens
gtccctgccttca

SEQ ID NO: 5630557 - DNA, 20 bp, Homo sapiens
gtccctgcggaagccacagg

SEQ ID NO: 5630558 - DNA, 10 bp, Homo sapiens
gtccctgctc

SEQ ID NO: 5630559 - DNA, 19 bp, Homo sapiens
gtccctgctcagcccatcc

SEQ ID NO: 5630560 - DNA, 13 bp, Homo sapiens
gtccctgctcccc

SEQ ID NO: 5630561 - DNA, 14 bp, Homo sapiens
gtccctgctcccct

SEQ ID NO: 5630562 - DNA, 12 bp, Homo sapiens
gtccctgctcct

SEQ ID NO: 5630563 - DNA, 13 bp, Homo sapiens
gtccctgctcctc

SEQ ID NO: 5630564 - DNA, 16 bp, Homo sapiens
gtccctgctcctccca

SEQ ID NO: 5630565 - DNA, 12 bp, Homo sapiens
gtccctgctggg

SEQ ID NO: 5630566 - DNA, 20 bp, Homo sapiens
gtccctgctttctggtataa

SEQ ID NO: 5630567 - DNA, 14 bp, Homo sapiens
gtccctggaaaagg

SEQ ID NO: 5630568 - DNA, 11 bp, Homo sapiens
gtccctggaca

SEQ ID NO: 5630569 - DNA, 23 bp, Homo sapiens
gtccctggacacagctcttcatt

SEQ ID NO: 5630570 - DNA, 18 bp, Homo sapiens
gtccctggaccagcctcc

SEQ ID NO: 5630571 - DNA, 19 bp, Homo sapiens
gtccctggaccagcctcct

SEQ ID NO: 5630572 - DNA, 22 bp, Homo sapiens
gtccctggagatcatcctaaca

SEQ ID NO: 5630573 - DNA, 13 bp, Homo sapiens
gtccctggagctg

SEQ ID NO: 5630574 - DNA, 14 bp, Homo sapiens
gtccctggagctgt

SEQ ID NO: 5630575 - DNA, 17 bp, Homo sapiens
gtccctggagctgtcct

SEQ ID NO: 5630576 - DNA, 16 bp, Homo sapiens
gtccctggagggcaag

SEQ ID NO: 5630577 - DNA, 21 bp, Homo sapiens
gtccctggagggcaagccctg

SEQ ID NO: 5630578 - DNA, 23 bp, Homo sapiens
gtccctggagggcaagccctgcc

SEQ ID NO: 5630579 - DNA, 15 bp, Homo sapiens
gtccctggccatctc

SEQ ID NO: 5630580 - DNA, 16 bp, Homo sapiens
gtccctggcttcctta

SEQ ID NO: 5630581 - DNA, 18 bp, Homo sapiens
gtccctgggccagggtct

SEQ ID NO: 5630582 - DNA, 17 bp, Homo sapiens
gtccctggggcactccc

SEQ ID NO: 5630583 - DNA, 21 bp, Homo sapiens
gtccctggggcactcccccag

SEQ ID NO: 5630584 - DNA, 21 bp, Homo sapiens
gtccctgggggaagccctgga

SEQ ID NO: 5630585 - DNA, 13 bp, Homo sapiens
gtccctggtccct

SEQ ID NO: 5630586 - DNA, 24 bp, Homo sapiens
gtccctggtccctcgtccacaggg

SEQ ID NO: 5630587 - DNA, 13 bp, Homo sapiens
gtccctggtcctt

SEQ ID NO: 5630588 - DNA, 20 bp, Homo sapiens
gtccctggtccttcactggc

SEQ ID NO: 5630589 - DNA, 17 bp, Homo sapiens
gtccctggtggcagctc

SEQ ID NO: 5630590 - DNA, 16 bp, Homo sapiens
gtccctggttttcagt

SEQ ID NO: 5630591 - DNA, 20 bp, Homo sapiens
gtccctgtcaggacacatgg

SEQ ID NO: 5630592 - DNA, 18 bp, Homo sapiens
gtccctgtcatttgaacc

SEQ ID NO: 5630593 - DNA, 20 bp, Homo sapiens
gtcctggtggtattttcaat

SEQ ID NO: 5630594 - DNA, 11 bp, Homo sapiens
gtcctggtgtc

SEQ ID NO: 5630595 - DNA, 17 bp, Homo sapiens
gtcctggttcagtggga

SEQ ID NO: 5630596 - DNA, 17 bp, Homo sapiens
gtcctggtttcctggca

SEQ ID NO: 5630597 - DNA, 22 bp, Homo sapiens
gtcctggtttcctggcagcctg

SEQ ID NO: 5630598 - DNA, 16 bp, Homo sapiens
gtcctgtaaacactca

SEQ ID NO: 5630599 - DNA, 15 bp, Homo sapiens
gtcctgtacattgtg

SEQ ID NO: 5630600 - DNA, 18 bp, Homo sapiens
gtcctgtcaccctggccc

SEQ ID NO: 5630601 - DNA, 19 bp, Homo sapiens
gtcctgtcaccctggcccc

SEQ ID NO: 5630602 - DNA, 20 bp, Homo sapiens
gtcctgtcaccctggcccca

SEQ ID NO: 5630603 - DNA, 17 bp, Homo sapiens
gtcctgtcactgagcac

SEQ ID NO: 5630604 - DNA, 19 bp, Homo sapiens
gtcctgtcagtgccgccgc

SEQ ID NO: 5630605 - DNA, 19 bp, Homo sapiens
gtcctgtcatcatcatggc

SEQ ID NO: 5630606 - DNA, 21 bp, Homo sapiens
gtcctgtcatcatcatggcca

SEQ ID NO: 5630607 - DNA, 18 bp, Homo sapiens
gtcctgtccacacccagc

SEQ ID NO: 5630608 - DNA, 11 bp, Homo sapiens
gtcctgtccca

SEQ ID NO: 5630609 - DNA, 12 bp, Homo sapiens
gtcctgtcccag

SEQ ID NO: 5630610 - DNA, 13 bp, Homo sapiens
gtcctgtccccca

SEQ ID NO: 5630611 - DNA, 19 bp, Homo sapiens
gtcctgtccggagcgaccc

SEQ ID NO: 5630612 - DNA, 17 bp, Homo sapiens
gtcctgtcctggctccc

SEQ ID NO: 5630613 - DNA, 21 bp, Homo sapiens
gtcctgtcggagccctgtctc

SEQ ID NO: 5630614 - DNA, 15 bp, Homo sapiens
gtcctgtctctgcct

SEQ ID NO: 5630615 - DNA, 23 bp, Homo sapiens
gtcctgtgatctgtgtacaattt

SEQ ID NO: 5630616 - DNA, 17 bp, Homo sapiens
gtcctgtggcaggcagc

SEQ ID NO: 5630617 - DNA, 19 bp, Homo sapiens
gtcctgtggtgacaggccc

SEQ ID NO: 5630618 - DNA, 12 bp, Homo sapiens
gtcctgtgtcat

SEQ ID NO: 5630619 - DNA, 16 bp, Homo sapiens
gtcctgtgtcatctgt

SEQ ID NO: 5630620 - DNA, 21 bp, Homo sapiens
gtcctgttaaccctccacctc

SEQ ID NO: 5630621 - DNA, 22 bp, Homo sapiens
gtcctgttaacgtcatctcagg

SEQ ID NO: 5630622 - DNA, 16 bp, Homo sapiens
gtcctgttaatttata

SEQ ID NO: 5630623 - DNA, 23 bp, Homo sapiens
gtcctgttaatttataggcgttt

SEQ ID NO: 5630624 - DNA, 15 bp, Homo sapiens
gtcctgttaggccaa

SEQ ID NO: 5630625 - DNA, 18 bp, Homo sapiens
gtcctgttcaaatttttt

SEQ ID NO: 5630626 - DNA, 22 bp, Homo sapiens
gtcctgttcagaaaggggctct

SEQ ID NO: 5630627 - DNA, 14 bp, Homo sapiens
gtcctgttctcaga

SEQ ID NO: 5630628 - DNA, 17 bp, Homo sapiens
gtcctgttctcagagct

SEQ ID NO: 5630629 - DNA, 15 bp, Homo sapiens
gtcctgttgaagact

SEQ ID NO: 5630630 - DNA, 16 bp, Homo sapiens
gtcctgttgaagactt

SEQ ID NO: 5630631 - DNA, 18 bp, Homo sapiens
gtcctgtttctgtcaagc

SEQ ID NO: 5630632 - DNA, 21 bp, Homo sapiens
gtccttaaaaaatatgctctc

SEQ ID NO: 5630633 - DNA, 22 bp, Homo sapiens
gtccttaaaaatcacactgtaa

SEQ ID NO: 5630634 - DNA, 14 bp, Homo sapiens
gtccttaaaatgtg

SEQ ID NO: 5630635 - DNA, 23 bp, Homo sapiens
gtccttaacccacctctcctgcc

SEQ ID NO: 5630636 - DNA, 16 bp, Homo sapiens
gtccttaccagagacg

SEQ ID NO: 5630637 - DNA, 18 bp, Homo sapiens
gtccttaccagcagagca

SEQ ID NO: 5630638 - DNA, 15 bp, Homo sapiens
gtccttactcagagc

SEQ ID NO: 5630639 - DNA, 20 bp, Homo sapiens
gtccttactcagagctgcgg

SEQ ID NO: 5630640 - DNA, 22 bp, Homo sapiens
gtccttactcagagctgcgggc

SEQ ID NO: 5630641 - DNA, 14 bp, Homo sapiens
gtccttactccccc

SEQ ID NO: 5630642 - DNA, 18 bp, Homo sapiens
gtccttactcccccacca

SEQ ID NO: 5630643 - DNA, 20 bp, Homo sapiens
gtccttactcccccaccact

SEQ ID NO: 5630644 - DNA, 17 bp, Homo sapiens
gtccttactcctgtggg

SEQ ID NO: 5630645 - DNA, 16 bp, Homo sapiens
gtccttagcctggacc

SEQ ID NO: 5630646 - DNA, 19 bp, Homo sapiens
gtccttagcctggacctct

SEQ ID NO: 5630647 - DNA, 17 bp, Homo sapiens
gtccttaggcctctgag

SEQ ID NO: 5630648 - DNA, 15 bp, Homo sapiens
gtccttagtggaggg

SEQ ID NO: 5630649 - DNA, 17 bp, Homo sapiens
gtccttatctagctgca

SEQ ID NO: 5630650 - DNA, 18 bp, Homo sapiens
gtccttattcttctcata

SEQ ID NO: 5630651 - DNA, 19 bp, Homo sapiens
gtccttcaagattccattt

SEQ ID NO: 5630652 - DNA, 21 bp, Homo sapiens
gtccttcacatttactagctg

SEQ ID NO: 5630653 - DNA, 17 bp, Homo sapiens
gtccttcacctttccca

SEQ ID NO: 5630654 - DNA, 13 bp, Homo sapiens
gtccttcagagct

SEQ ID NO: 5630655 - DNA, 20 bp, Homo sapiens
gtccttcagtcttctagaaa

SEQ ID NO: 5630656 - DNA, 22 bp, Homo sapiens
gtccttcagtgagcccctcccc

SEQ ID NO: 5630657 - DNA, 12 bp, Homo sapiens
gtccttcagttt

SEQ ID NO: 5630658 - DNA, 15 bp, Homo sapiens
gtccttcagtttaga

SEQ ID NO: 5630659 - DNA, 14 bp, Homo sapiens
gtccttccacctcg

SEQ ID NO: 5630660 - DNA, 16 bp, Homo sapiens
gtccttcccacggcca

SEQ ID NO: 5630661 - DNA, 20 bp, Homo sapiens
gtccttcccacggccactgc

SEQ ID NO: 5630662 - DNA, 15 bp, Homo sapiens
gtccttcccccagca

SEQ ID NO: 5630663 - DNA, 13 bp, Homo sapiens
gtccttccccttc

SEQ ID NO: 5630664 - DNA, 17 bp, Homo sapiens
gtccttccccttccccg

SEQ ID NO: 5630665 - DNA, 22 bp, Homo sapiens
gtccttccctcaaagaggcctt

SEQ ID NO: 5630666 - DNA, 18 bp, Homo sapiens
gtccttccctgatggcct

SEQ ID NO: 5630667 - DNA, 16 bp, Homo sapiens
gtccttcctctcaagc

SEQ ID NO: 5630668 - DNA, 16 bp, Homo sapiens
gtccttcctctgtcct

SEQ ID NO: 5630669 - DNA, 17 bp, Homo sapiens
gtccttcctgtgccctg

SEQ ID NO: 5630670 - DNA, 15 bp, Homo sapiens
gtccttccttgactg

SEQ ID NO: 5630671 - DNA, 14 bp, Homo sapiens
gtccttctaatgaa

SEQ ID NO: 5630672 - DNA, 21 bp, Homo sapiens
gtccttctaatgaagacaatg

SEQ ID NO: 5630673 - DNA, 22 bp, Homo sapiens
gtccttctacagaacctgaggg

SEQ ID NO: 5630674 - DNA, 21 bp, Homo sapiens
gtccttctcctcttgtagcca

SEQ ID NO: 5630675 - DNA, 17 bp, Homo sapiens
gtccttctctcacctcc

SEQ ID NO: 5630676 - DNA, 15 bp, Homo sapiens
gtccttctgacccca

SEQ ID NO: 5630677 - DNA, 16 bp, Homo sapiens
gtccttgaaaaacaaa

SEQ ID NO: 5630678 - DNA, 16 bp, Homo sapiens
gtccttgaacccaaca

SEQ ID NO: 5630679 - DNA, 19 bp, Homo sapiens
gtccttgaacccaacagtc

SEQ ID NO: 5630680 - DNA, 19 bp, Homo sapiens
gtccttgaactgaggccct

SEQ ID NO: 5630681 - DNA, 15 bp, Homo sapiens
gtccttgaagcttgt

SEQ ID NO: 5630682 - DNA, 20 bp, Homo sapiens
gtccttgatgccagagggcc

SEQ ID NO: 5630683 - DNA, 17 bp, Homo sapiens
gtccttgcaagaatgga

SEQ ID NO: 5630684 - DNA, 19 bp, Homo sapiens
gtccttgcacccctcactc

SEQ ID NO: 5630685 - DNA, 17 bp, Homo sapiens
gtccttgcacctgagcc

SEQ ID NO: 5630686 - DNA, 15 bp, Homo sapiens
gtccttgcacctgca

SEQ ID NO: 5630687 - DNA, 17 bp, Homo sapiens
gtccttgccccactcct

SEQ ID NO: 5630688 - DNA, 14 bp, Homo sapiens
gtccttgcctcctg

SEQ ID NO: 5630689 - DNA, 23 bp, Homo sapiens
gtccttgctcctggaacctggca

SEQ ID NO: 5630690 - DNA, 14 bp, Homo sapiens
gtccttgcttggct

SEQ ID NO: 5630691 - DNA, 18 bp, Homo sapiens
gtccttggagtgctgcag

SEQ ID NO: 5630692 - DNA, 17 bp, Homo sapiens
gtccttggcaactttct

SEQ ID NO: 5630693 - DNA, 20 bp, Homo sapiens
gtccttggcaggctgatttc

SEQ ID NO: 5630694 - DNA, 13 bp, Homo sapiens
gtccttggccccc

SEQ ID NO: 5630695 - DNA, 15 bp, Homo sapiens
gtccttggccccctt

SEQ ID NO: 5630696 - DNA, 14 bp, Homo sapiens
gtccttggcctgct

SEQ ID NO: 5630697 - DNA, 14 bp, Homo sapiens
gtccttggctcccg

SEQ ID NO: 5630698 - DNA, 21 bp, Homo sapiens
gtccttggctgtatccatgta

SEQ ID NO: 5630699 - DNA, 14 bp, Homo sapiens
gtccttgggcctgg

SEQ ID NO: 5630700 - DNA, 15 bp, Homo sapiens
gtccttgggcctggc

SEQ ID NO: 5630701 - DNA, 18 bp, Homo sapiens
gtccttgggcctggccag

SEQ ID NO: 5630702 - DNA, 15 bp, Homo sapiens
gtccttggggcacag

SEQ ID NO: 5630703 - DNA, 16 bp, Homo sapiens
gtccttggggcacagt

SEQ ID NO: 5630704 - DNA, 15 bp, Homo sapiens
gtccttgggtccatt

SEQ ID NO: 5630705 - DNA, 14 bp, Homo sapiens
gtccttggtgtgac

SEQ ID NO: 5630706 - DNA, 22 bp, Homo sapiens
gtccttggtgtgaccctctgaa

SEQ ID NO: 5630707 - DNA, 22 bp, Homo sapiens
gtccttggttgggtcaaggaca

SEQ ID NO: 5630708 - DNA, 23 bp, Homo sapiens
gtccttggttgggtcaaggacag

SEQ ID NO: 5630709 - DNA, 21 bp, Homo sapiens
gtccttgtctctgggccactt

SEQ ID NO: 5630710 - DNA, 21 bp, Homo sapiens
gtcctttaactcgttgcagtc

SEQ ID NO: 5630711 - DNA, 18 bp, Homo sapiens
gtcctttaggcagcctgc

SEQ ID NO: 5630712 - DNA, 19 bp, Homo sapiens
gtcctttaggcagcctgcc

SEQ ID NO: 5630713 - DNA, 21 bp, Homo sapiens
gtcctttaggcagcctgccgc

SEQ ID NO: 5630714 - DNA, 13 bp, Homo sapiens
gtcctttatgtgg

SEQ ID NO: 5630715 - DNA, 21 bp, Homo sapiens
gtcctttatgtggaaaacaga

SEQ ID NO: 5630716 - DNA, 22 bp, Homo sapiens
gtcctttcaattccaccagggc

SEQ ID NO: 5630717 - DNA, 22 bp, Homo sapiens
gtcctttccaaggcttctccaa

SEQ ID NO: 5630718 - DNA, 22 bp, Homo sapiens
gtcctttccagtggcctggctc

SEQ ID NO: 5630719 - DNA, 15 bp, Homo sapiens
gtcctttccatctgt

SEQ ID NO: 5630720 - DNA, 16 bp, Homo sapiens
gtcctttcccctctct

SEQ ID NO: 5630721 - DNA, 17 bp, Homo sapiens
gtcctttcccctctctg

SEQ ID NO: 5630722 - DNA, 22 bp, Homo sapiens
gtcctttcccctctctgcccct

SEQ ID NO: 5630723 - DNA, 23 bp, Homo sapiens
gtcctttcccctctctgcccctg

SEQ ID NO: 5630724 - DNA, 11 bp, Homo sapiens
gtcctttccct

SEQ ID NO: 5630725 - DNA, 18 bp, Homo sapiens
gtcctttccctggagtca

SEQ ID NO: 5630726 - DNA, 19 bp, Homo sapiens
gtcctttcctctcctctct

SEQ ID NO: 5630727 - DNA, 13 bp, Homo sapiens
gtcctttctgaac

SEQ ID NO: 5630728 - DNA, 14 bp, Homo sapiens
gtcctttctgcctt

SEQ ID NO: 5630729 - DNA, 15 bp, Homo sapiens
gtcctttctggaagt

SEQ ID NO: 5630730 - DNA, 13 bp, Homo sapiens
gtcctttcttttg

SEQ ID NO: 5630731 - DNA, 22 bp, Homo sapiens
gtcctttgacaaaagtaaatgg

SEQ ID NO: 5630732 - DNA, 18 bp, Homo sapiens
gtcctttgcgcctgtgac

SEQ ID NO: 5630733 - DNA, 14 bp, Homo sapiens
gtcctttgtctttc

SEQ ID NO: 5630734 - DNA, 16 bp, Homo sapiens
gtcctttgttgctgtt

SEQ ID NO: 5630735 - DNA, 23 bp, Homo sapiens
gtccttttagcacatcactgaga

SEQ ID NO: 5630736 - DNA, 17 bp, Homo sapiens
gtccttttatctccttg

SEQ ID NO: 5630737 - DNA, 15 bp, Homo sapiens
gtccttttcactaca

SEQ ID NO: 5630738 - DNA, 18 bp, Homo sapiens
gtccttttcactacacca

SEQ ID NO: 5630739 - DNA, 22 bp, Homo sapiens
gtccttttcagaagtgagcttt

SEQ ID NO: 5630740 - DNA, 20 bp, Homo sapiens
gtccttttcccccagcacct

SEQ ID NO: 5630741 - DNA, 15 bp, Homo sapiens
gtccttttctaggaa

SEQ ID NO: 5630742 - DNA, 15 bp, Homo sapiens
gtccttttgacactg

SEQ ID NO: 5630743 - DNA, 16 bp, Homo sapiens
gtccttttgacactgc

SEQ ID NO: 5630744 - DNA, 20 bp, Homo sapiens
gtccttttgacactgctcta

SEQ ID NO: 5630745 - DNA, 21 bp, Homo sapiens
gtccttttgacactgctctaa

SEQ ID NO: 5630746 - DNA, 21 bp, Homo sapiens
gtccttttgggaagaatccag

SEQ ID NO: 5630747 - DNA, 17 bp, Homo sapiens
gtccttttgtaccatgg

SEQ ID NO: 5630748 - DNA, 13 bp, Homo sapiens
gtccttttgtctt

SEQ ID NO: 5630749 - DNA, 15 bp, Homo sapiens
gtccttttgtcttct

SEQ ID NO: 5630750 - DNA, 20 bp, Homo sapiens
gtcctttttcctctccacac

SEQ ID NO: 5630751 - DNA, 21 bp, Homo sapiens
gtcgaaggatgctctttccct

SEQ ID NO: 5630752 - DNA, 18 bp, Homo sapiens
gtcgaaggggaggcacac

SEQ ID NO: 5630753 - DNA, 14 bp, Homo sapiens
gtcgacaagaatgt

SEQ ID NO: 5630754 - DNA, 16 bp, Homo sapiens
gtcgaccaggaaagcc

SEQ ID NO: 5630755 - DNA, 18 bp, Homo sapiens
gtcgaccccaaaggaaca

SEQ ID NO: 5630756 - DNA, 18 bp, Homo sapiens
gtcgacttcgggctggcc

SEQ ID NO: 5630757 - DNA, 14 bp, Homo sapiens
gtcgagagggctgt

SEQ ID NO: 5630758 - DNA, 21 bp, Homo sapiens
gtcgagcctgggggctggagc

SEQ ID NO: 5630759 - DNA, 23 bp, Homo sapiens
gtcgagctggatgtcccacctct

SEQ ID NO: 5630760 - DNA, 20 bp, Homo sapiens
gtcgaggccacattgctggc

SEQ ID NO: 5630761 - DNA, 15 bp, Homo sapiens
gtcgaggggctctca

SEQ ID NO: 5630762 - DNA, 19 bp, Homo sapiens
gtcgaggggctctcagctc

SEQ ID NO: 5630763 - DNA, 19 bp, Homo sapiens
gtcgagggtcgtgagccca

SEQ ID NO: 5630764 - DNA, 13 bp, Homo sapiens
gtcgcaactgaga

SEQ ID NO: 5630765 - DNA, 17 bp, Homo sapiens
gtcgcacccacagcgaa

SEQ ID NO: 5630766 - DNA, 14 bp, Homo sapiens
gtcgcagctaccct

SEQ ID NO: 5630767 - DNA, 17 bp, Homo sapiens
gtcgcagctaccctcag

SEQ ID NO: 5630768 - DNA, 19 bp, Homo sapiens
gtcgcaggatccgctgcca

SEQ ID NO: 5630769 - DNA, 22 bp, Homo sapiens
gtcgcaggatccgctgccacca

SEQ ID NO: 5630770 - DNA, 15 bp, Homo sapiens
gtctcctcaagcctg

SEQ ID NO: 5630771 - DNA, 23 bp, Homo sapiens
gtctcctcaagcctgtgggcagc

SEQ ID NO: 5630772 - DNA, 15 bp, Homo sapiens
gtctcctcactccct

SEQ ID NO: 5630773 - DNA, 21 bp, Homo sapiens
gtctcctcactcccttctacc

SEQ ID NO: 5630774 - DNA, 18 bp, Homo sapiens
gtctcctcactctgtccc

SEQ ID NO: 5630775 - DNA, 21 bp, Homo sapiens
gtctcctcactctgtccctgt

SEQ ID NO: 5630776 - DNA, 16 bp, Homo sapiens
gtctcctcactgccac

SEQ ID NO: 5630777 - DNA, 13 bp, Homo sapiens
gtctcctcagcct

SEQ ID NO: 5630778 - DNA, 19 bp, Homo sapiens
gtctcctcagggtgggggg

SEQ ID NO: 5630779 - DNA, 22 bp, Homo sapiens
gtctcctccccgtagccactct

SEQ ID NO: 5630780 - DNA, 14 bp, Homo sapiens
gtctcctccctggg

SEQ ID NO: 5630781 - DNA, 18 bp, Homo sapiens
gtctcctctccagcccta

SEQ ID NO: 5630782 - DNA, 13 bp, Homo sapiens
gtctcctctctga

SEQ ID NO: 5630783 - DNA, 14 bp, Homo sapiens
gtctcctctctgag

SEQ ID NO: 5630784 - DNA, 21 bp, Homo sapiens
gtctcctctctggtggctggg

SEQ ID NO: 5630785 - DNA, 23 bp, Homo sapiens
gtctcctctctggtggctgggct

SEQ ID NO: 5630786 - DNA, 17 bp, Homo sapiens
gtctcctctcttggcat

SEQ ID NO: 5630787 - DNA, 17 bp, Homo sapiens
gtctcctctgtcagttt

SEQ ID NO: 5630788 - DNA, 13 bp, Homo sapiens
gtctcctcttcca

SEQ ID NO: 5630789 - DNA, 23 bp, Homo sapiens
gtctcctgcccactctgaccggg

SEQ ID NO: 5630790 - DNA, 13 bp, Homo sapiens
gtctcctgccccc

SEQ ID NO: 5630791 - DNA, 14 bp, Homo sapiens
gtctcctgccccca

SEQ ID NO: 5630792 - DNA, 22 bp, Homo sapiens
gtctcctgcccccacacctggc

SEQ ID NO: 5630793 - DNA, 23 bp, Homo sapiens
gtctcctggaccttgacagagca

SEQ ID NO: 5630794 - DNA, 13 bp, Homo sapiens
gtctcctggcggt

SEQ ID NO: 5630795 - DNA, 13 bp, Homo sapiens
gtctcctgggaaa

SEQ ID NO: 5630796 - DNA, 19 bp, Homo sapiens
gtctcctgggcatctggcc

SEQ ID NO: 5630797 - DNA, 18 bp, Homo sapiens
gtctcctgtatcatttct

SEQ ID NO: 5630798 - DNA, 17 bp, Homo sapiens
gtctcctgtccccggcg

SEQ ID NO: 5630799 - DNA, 19 bp, Homo sapiens
gtctccttaaactaccacc

SEQ ID NO: 5630800 - DNA, 20 bp, Homo sapiens
gtctccttaaactaccaccc

SEQ ID NO: 5630801 - DNA, 16 bp, Homo sapiens
gtctccttacctgtgg

SEQ ID NO: 5630802 - DNA, 17 bp, Homo sapiens
gtctccttactctgagc

SEQ ID NO: 5630803 - DNA, 22 bp, Homo sapiens
gtctccttactctgagcccagg

SEQ ID NO: 5630804 - DNA, 18 bp, Homo sapiens
gtctccttcagcacggcg

SEQ ID NO: 5630805 - DNA, 20 bp, Homo sapiens
gtctccttcagcacggcgtg

SEQ ID NO: 5630806 - DNA, 16 bp, Homo sapiens
gtctccttcccactgt

SEQ ID NO: 5630807 - DNA, 18 bp, Homo sapiens
gtctccttcccactgtcc

SEQ ID NO: 5630808 - DNA, 16 bp, Homo sapiens
gtctccttccttccca

SEQ ID NO: 5630809 - DNA, 18 bp, Homo sapiens
gtctccttctcttctctt

SEQ ID NO: 5630810 - DNA, 17 bp, Homo sapiens
gtctccttggctgtctg

SEQ ID NO: 5630811 - DNA, 20 bp, Homo sapiens
gtctcctttctgactgtccc

SEQ ID NO: 5630812 - DNA, 16 bp, Homo sapiens
gtctcctttgcactga

SEQ ID NO: 5630813 - DNA, 18 bp, Homo sapiens
gtctcctttgcactgagg

SEQ ID NO: 5630814 - DNA, 15 bp, Homo sapiens
gtctcctttgctctt

SEQ ID NO: 5630815 - DNA, 19 bp, Homo sapiens
gtctcgaactcctgacctc

SEQ ID NO: 5630816 - DNA, 15 bp, Homo sapiens
gtctcgagcgccctg

SEQ ID NO: 5630817 - DNA, 23 bp, Homo sapiens
gtctcgatgccataatcagaaca

SEQ ID NO: 5630818 - DNA, 14 bp, Homo sapiens
gtctcgatgctgct

SEQ ID NO: 5630819 - DNA, 23 bp, Homo sapiens
gtctcgatgctgctggcctccct

SEQ ID NO: 5630820 - DNA, 15 bp, Homo sapiens
gtctcgcagcctgaa

SEQ ID NO: 5630821 - DNA, 16 bp, Homo sapiens
gtctcgcagcctgaag

SEQ ID NO: 5630822 - DNA, 13 bp, Homo sapiens
gtctcgctctgct

SEQ ID NO: 5630823 - DNA, 22 bp, Homo sapiens
gtctcgctctgttgcccaggct

SEQ ID NO: 5630824 - DNA, 17 bp, Homo sapiens
gtctcgctgatgctggg

SEQ ID NO: 5630825 - DNA, 19 bp, Homo sapiens
gtctcgctgatgctgggct

SEQ ID NO: 5630826 - DNA, 14 bp, Homo sapiens
gtctcgctgcatca

SEQ ID NO: 5630827 - DNA, 20 bp, Homo sapiens
gtctcgctgcatcacccagg

SEQ ID NO: 5630828 - DNA, 19 bp, Homo sapiens
gtctcgctttgttgcccag

SEQ ID NO: 5630829 - DNA, 16 bp, Homo sapiens
gtctcggactaagcct

SEQ ID NO: 5630830 - DNA, 12 bp, Homo sapiens
gtctcggcagag

SEQ ID NO: 5630831 - DNA, 14 bp, Homo sapiens
gtctcggcagaggt

SEQ ID NO: 5630832 - DNA, 16 bp, Homo sapiens
gtctcggcccctctga

SEQ ID NO: 5630833 - DNA, 13 bp, Homo sapiens
gtctcggccctga

SEQ ID NO: 5630834 - DNA, 13 bp, Homo sapiens
gtctcggctctgc

SEQ ID NO: 5630835 - DNA, 19 bp, Homo sapiens
gtctcgggctgaccctttt

SEQ ID NO: 5630836 - DNA, 15 bp, Homo sapiens
gtctcgggggtgggc

SEQ ID NO: 5630837 - DNA, 23 bp, Homo sapiens
gtctcgtgtacagctcccttccc

SEQ ID NO: 5630838 - DNA, 17 bp, Homo sapiens
gtctcgtgtcagtaatt

SEQ ID NO: 5630839 - DNA, 13 bp, Homo sapiens
gtctctaaagcac

SEQ ID NO: 5630840 - DNA, 22 bp, Homo sapiens
gtctctaagtgtaaaagtagta

SEQ ID NO: 5630841 - DNA, 21 bp, Homo sapiens
gtctctaatgtgactgttgag

SEQ ID NO: 5630842 - DNA, 15 bp, Homo sapiens
gtctctaatttaact

SEQ ID NO: 5630843 - DNA, 20 bp, Homo sapiens
gtctctacaaaaaaaatcaa

SEQ ID NO: 5630844 - DNA, 18 bp, Homo sapiens
gtctctacccctttctgt

SEQ ID NO: 5630845 - DNA, 16 bp, Homo sapiens
gtctctactaaaaata

SEQ ID NO: 5630846 - DNA, 17 bp, Homo sapiens
gtctctactaaaaatac

SEQ ID NO: 5630847 - DNA, 16 bp, Homo sapiens
gtctctagaagtgcca

SEQ ID NO: 5630848 - DNA, 21 bp, Homo sapiens
gtctctagaagtgccatctca

SEQ ID NO: 5630849 - DNA, 22 bp, Homo sapiens
gtctctagaagtgccatctcaa

SEQ ID NO: 5630850 - DNA, 13 bp, Homo sapiens
gtctctagcagtg

SEQ ID NO: 5630851 - DNA, 20 bp, Homo sapiens
gtctctagccgggccatgct

SEQ ID NO: 5630852 - DNA, 14 bp, Homo sapiens
gtctctaggctggg

SEQ ID NO: 5630853 - DNA, 17 bp, Homo sapiens
gtctctaggctggggaa

SEQ ID NO: 5630854 - DNA, 16 bp, Homo sapiens
gtctctagtgctgtga

SEQ ID NO: 5630855 - DNA, 17 bp, Homo sapiens
gtctctagtgctgtgaa

SEQ ID NO: 5630856 - DNA, 20 bp, Homo sapiens
gtctctatattatgtcttct

SEQ ID NO: 5630857 - DNA, 23 bp, Homo sapiens
gtctctatattgcttagtaagta

SEQ ID NO: 5630858 - DNA, 19 bp, Homo sapiens
gtctctatcattaaagttc

SEQ ID NO: 5630859 - DNA, 18 bp, Homo sapiens
gtctctatcttgcatcta

SEQ ID NO: 5630860 - DNA, 17 bp, Homo sapiens
gtctctatttaaattct

SEQ ID NO: 5630861 - DNA, 16 bp, Homo sapiens
gtctctatttatgaga

SEQ ID NO: 5630862 - DNA, 16 bp, Homo sapiens
gtctctatttcatttt

SEQ ID NO: 5630863 - DNA, 20 bp, Homo sapiens
gtctctcagggatggaggga

SEQ ID NO: 5630864 - DNA, 18 bp, Homo sapiens
gtctctcagggccaggcc

SEQ ID NO: 5630865 - DNA, 15 bp, Homo sapiens
gtctctcatgaacct

SEQ ID NO: 5630866 - DNA, 16 bp, Homo sapiens
gtctctcatgaacctc

SEQ ID NO: 5630867 - DNA, 13 bp, Homo sapiens
gtctctcatttct

SEQ ID NO: 5630868 - DNA, 20 bp, Homo sapiens
gtctctccactgctctcagc

SEQ ID NO: 5630869 - DNA, 23 bp, Homo sapiens
gtctctccactgctctcagcctc

SEQ ID NO: 5630870 - DNA, 19 bp, Homo sapiens
gtctctccagcctcacaga

SEQ ID NO: 5630871 - DNA, 16 bp, Homo sapiens
gtctctccagtgaaat

SEQ ID NO: 5630872 - DNA, 14 bp, Homo sapiens
gtctctcccacccc

SEQ ID NO: 5630873 - DNA, 16 bp, Homo sapiens
gtctctcccaccccgg

SEQ ID NO: 5630874 - DNA, 22 bp, Homo sapiens
gtctctcccaccccggcctcca

SEQ ID NO: 5630875 - DNA, 17 bp, Homo sapiens
gtctctccccctctgtc

SEQ ID NO: 5630876 - DNA, 18 bp, Homo sapiens
gtctctccccctctgtct

SEQ ID NO: 5630877 - DNA, 19 bp, Homo sapiens
gtctctccccctctgtctt

SEQ ID NO: 5630878 - DNA, 15 bp, Homo sapiens
gtctctccctcaggt

SEQ ID NO: 5630879 - DNA, 21 bp, Homo sapiens
gtctctccctcccccagagcc

SEQ ID NO: 5630880 - DNA, 22 bp, Homo sapiens
gtctctccctcccccagagccc

SEQ ID NO: 5630881 - DNA, 18 bp, Homo sapiens
gtctctcctagcccctct

SEQ ID NO: 5630882 - DNA, 19 bp, Homo sapiens
gtctctcctagcccctctc

SEQ ID NO: 5630883 - DNA, 14 bp, Homo sapiens
gtctctcctggctg

SEQ ID NO: 5630884 - DNA, 16 bp, Homo sapiens
gtctctcctggctggg

SEQ ID NO: 5630885 - DNA, 17 bp, Homo sapiens
gtctctcctggctgggc

SEQ ID NO: 5630886 - DNA, 18 bp, Homo sapiens
gtctctccttcctcttgg

SEQ ID NO: 5630887 - DNA, 20 bp, Homo sapiens
gtctctccttttcttttgtt

SEQ ID NO: 5630888 - DNA, 22 bp, Homo sapiens
gtctctctatgcctctctacag

SEQ ID NO: 5630889 - DNA, 23 bp, Homo sapiens
gtctctctattaccactgaagat

SEQ ID NO: 5630890 - DNA, 13 bp, Homo sapiens
gtctctctcccat

SEQ ID NO: 5630891 - DNA, 16 bp, Homo sapiens
gtctctctcccatgga

SEQ ID NO: 5630892 - DNA, 17 bp, Homo sapiens
gtctctctcccatggag

SEQ ID NO: 5630893 - DNA, 16 bp, Homo sapiens
gtctctctccctacct

SEQ ID NO: 5630894 - DNA, 14 bp, Homo sapiens
gtctctctccctct

SEQ ID NO: 5630895 - DNA, 16 bp, Homo sapiens
gtctctctccctctgt

SEQ ID NO: 5630896 - DNA, 18 bp, Homo sapiens
gtctctctccctctgtct

SEQ ID NO: 5630897 - DNA, 19 bp, Homo sapiens
gtctctctccctctgtctt

SEQ ID NO: 5630898 - DNA, 23 bp, Homo sapiens
gtctctctccctctgtcttttct

SEQ ID NO: 5630899 - DNA, 15 bp, Homo sapiens
gtctctctctctttt

SEQ ID NO: 5630900 - DNA, 22 bp, Homo sapiens
gtctctctgccaagatccatct

SEQ ID NO: 5630901 - DNA, 13 bp, Homo sapiens
gtctctctgcctg

SEQ ID NO: 5630902 - DNA, 16 bp, Homo sapiens
gtctctctgcctgctg

SEQ ID NO: 5630903 - DNA, 17 bp, Homo sapiens
gtctctctgcctgctgg

SEQ ID NO: 5630904 - DNA, 21 bp, Homo sapiens
gtctctctggggccacacaga

SEQ ID NO: 5630905 - DNA, 14 bp, Homo sapiens
gtctctctgtgaat

SEQ ID NO: 5630906 - DNA, 20 bp, Homo sapiens
gtctctcttcagactctcag

SEQ ID NO: 5630907 - DNA, 18 bp, Homo sapiens
gtctctcttctcagagtg

SEQ ID NO: 5630908 - DNA, 19 bp, Homo sapiens
gtctctcttctcagagtgg

SEQ ID NO: 5630909 - DNA, 20 bp, Homo sapiens
gtctctcttctctccagctg

SEQ ID NO: 5630910 - DNA, 12 bp, Homo sapiens
gtctctcttgct

SEQ ID NO: 5630911 - DNA, 20 bp, Homo sapiens
gtctctcttggacccacctg

SEQ ID NO: 5630912 - DNA, 17 bp, Homo sapiens
gtctctcttgtcacatg

SEQ ID NO: 5630913 - DNA, 17 bp, Homo sapiens
gtctctctttctccctc

SEQ ID NO: 5630914 - DNA, 19 bp, Homo sapiens
gtctctctttctccctcac

SEQ ID NO: 5630915 - DNA, 15 bp, Homo sapiens
gtctctgaagcgtga

SEQ ID NO: 5630916 - DNA, 12 bp, Homo sapiens
gtctctgaaggg

SEQ ID NO: 5630917 - DNA, 19 bp, Homo sapiens
gtctctgaagtactaacac

SEQ ID NO: 5630918 - DNA, 21 bp, Homo sapiens
gtctctgaagtgaaactgctt

SEQ ID NO: 5630919 - DNA, 16 bp, Homo sapiens
gtctctgactcttgcc

SEQ ID NO: 5630920 - DNA, 13 bp, Homo sapiens
gtctctgagcatt

SEQ ID NO: 5630921 - DNA, 13 bp, Homo sapiens
gtctctgagcccc

SEQ ID NO: 5630922 - DNA, 17 bp, Homo sapiens
gtctctgagccccctgt

SEQ ID NO: 5630923 - DNA, 21 bp, Homo sapiens
gtctctgagccccctgtgccc

SEQ ID NO: 5630924 - DNA, 17 bp, Homo sapiens
gtctctgaggctctcca

SEQ ID NO: 5630925 - DNA, 21 bp, Homo sapiens
gtctctgattagttgacagta

SEQ ID NO: 5630926 - DNA, 22 bp, Homo sapiens
gtctctgattagttgacagtat

SEQ ID NO: 5630927 - DNA, 12 bp, Homo sapiens
gtctctgcaaac

SEQ ID NO: 5630928 - DNA, 14 bp, Homo sapiens
gtctctgcagtgtc

SEQ ID NO: 5630929 - DNA, 12 bp, Homo sapiens
gtctctgcatct

SEQ ID NO: 5630930 - DNA, 16 bp, Homo sapiens
gtctctgcatcttcag

SEQ ID NO: 5630931 - DNA, 21 bp, Homo sapiens
gtctctgcatttttctgcaga

SEQ ID NO: 5630932 - DNA, 16 bp, Homo sapiens
gtctctgccatgtggc

SEQ ID NO: 5630933 - DNA, 18 bp, Homo sapiens
gtctctgccatgtggcag

SEQ ID NO: 5630934 - DNA, 18 bp, Homo sapiens
gtctctgccctgggctcc

SEQ ID NO: 5630935 - DNA, 20 bp, Homo sapiens
gtctctgcctggagcagggg

SEQ ID NO: 5630936 - DNA, 14 bp, Homo sapiens
gtctctgctccagc

SEQ ID NO: 5630937 - DNA, 20 bp, Homo sapiens
gtctctgctcctacatccag

SEQ ID NO: 5630938 - DNA, 15 bp, Homo sapiens
gtctctgctcgccct

SEQ ID NO: 5630939 - DNA, 22 bp, Homo sapiens
gtctctgctcgccctcctttct

SEQ ID NO: 5630940 - DNA, 16 bp, Homo sapiens
gtctctgctctgctca

SEQ ID NO: 5630941 - DNA, 17 bp, Homo sapiens
gtctctgctcttgcctg

SEQ ID NO: 5630942 - DNA, 14 bp, Homo sapiens
gtctctgcttccat

SEQ ID NO: 5630943 - DNA, 15 bp, Homo sapiens
gtctctgcttccatg

SEQ ID NO: 5630944 - DNA, 23 bp, Homo sapiens
gtctctgcttggcttcccctcca

SEQ ID NO: 5630945 - DNA, 19 bp, Homo sapiens
gtctctgctttccttttct

SEQ ID NO: 5630946 - DNA, 11 bp, Homo sapiens
gtctctggagt

SEQ ID NO: 5630947 - DNA, 14 bp, Homo sapiens
gtctggctgtggcc

SEQ ID NO: 5630948 - DNA, 15 bp, Homo sapiens
gtctggctgtggccc

SEQ ID NO: 5630949 - DNA, 18 bp, Homo sapiens
gtctggctgtggcccctc

SEQ ID NO: 5630950 - DNA, 22 bp, Homo sapiens
gtctggctgtggcccctccttc

SEQ ID NO: 5630951 - DNA, 19 bp, Homo sapiens
gtctggctgtgtggccaag

SEQ ID NO: 5630952 - DNA, 16 bp, Homo sapiens
gtctggctttaccttt

SEQ ID NO: 5630953 - DNA, 18 bp, Homo sapiens
gtctggctttggcactct

SEQ ID NO: 5630954 - DNA, 22 bp, Homo sapiens
gtctggctttggcactctctgc

SEQ ID NO: 5630955 - DNA, 19 bp, Homo sapiens
gtctggctttttcctctga

SEQ ID NO: 5630956 - DNA, 20 bp, Homo sapiens
gtctggctttttcctctgag

SEQ ID NO: 5630957 - DNA, 23 bp, Homo sapiens
gtctggctttttcctctgagccc

SEQ ID NO: 5630958 - DNA, 22 bp, Homo sapiens
gtctgggaaagcagagtggtgg

SEQ ID NO: 5630959 - DNA, 17 bp, Homo sapiens
gtctgggaaattctata

SEQ ID NO: 5630960 - DNA, 23 bp, Homo sapiens
gtctgggaacttgcgagtccaag

SEQ ID NO: 5630961 - DNA, 23 bp, Homo sapiens
gtctgggaaggggcgtgtccctc

SEQ ID NO: 5630962 - DNA, 24 bp, Homo sapiens
gtctgggacttccttgctctccct

SEQ ID NO: 5630963 - DNA, 17 bp, Homo sapiens
gtctgggagagcctggc

SEQ ID NO: 5630964 - DNA, 21 bp, Homo sapiens
gtctgggagagcctggcaagg

SEQ ID NO: 5630965 - DNA, 16 bp, Homo sapiens
gtctgggagaggcaga

SEQ ID NO: 5630966 - DNA, 17 bp, Homo sapiens
gtctgggagaggcagag

SEQ ID NO: 5630967 - DNA, 21 bp, Homo sapiens
gtctgggagccagagcctctg

SEQ ID NO: 5630968 - DNA, 13 bp, Homo sapiens
gtctgggaggcag

SEQ ID NO: 5630969 - DNA, 13 bp, Homo sapiens
gtctgggaggggg

SEQ ID NO: 5630970 - DNA, 16 bp, Homo sapiens
gtctgggagggggtga

SEQ ID NO: 5630971 - DNA, 16 bp, Homo sapiens
gtctgggagtcaggcc

SEQ ID NO: 5630972 - DNA, 18 bp, Homo sapiens
gtctgggagtcaggcccg

SEQ ID NO: 5630973 - DNA, 22 bp, Homo sapiens
gtctgggatatggctgcccagg

SEQ ID NO: 5630974 - DNA, 17 bp, Homo sapiens
gtctgggcaagaggaaa

SEQ ID NO: 5630975 - DNA, 18 bp, Homo sapiens
gtctgggcactggatgca

SEQ ID NO: 5630976 - DNA, 19 bp, Homo sapiens
gtctgggcagtgccacagc

SEQ ID NO: 5630977 - DNA, 20 bp, Homo sapiens
gtctgggcagtgccacagcc

SEQ ID NO: 5630978 - DNA, 12 bp, Homo sapiens
gtctgggcctct

SEQ ID NO: 5630979 - DNA, 14 bp, Homo sapiens
gtctgggcctctga

SEQ ID NO: 5630980 - DNA, 21 bp, Homo sapiens
gtctgggcgtccagctcagcc

SEQ ID NO: 5630981 - DNA, 18 bp, Homo sapiens
gtctgggctcctcttggg

SEQ ID NO: 5630982 - DNA, 14 bp, Homo sapiens
gtctgggctgggca

SEQ ID NO: 5630983 - DNA, 21 bp, Homo sapiens
gtctggggacgttgctgagcc

SEQ ID NO: 5630984 - DNA, 22 bp, Homo sapiens
gtctggggacgttgctgagcca

SEQ ID NO: 5630985 - DNA, 23 bp, Homo sapiens
gtctggggacgttgctgagccag

SEQ ID NO: 5630986 - DNA, 14 bp, Homo sapiens
gtctggggagggag

SEQ ID NO: 5630987 - DNA, 14 bp, Homo sapiens
gtctggggccccat

SEQ ID NO: 5630988 - DNA, 15 bp, Homo sapiens
gtctgggggcagctg

SEQ ID NO: 5630989 - DNA, 21 bp, Homo sapiens
gtctgggggcagctgtcctga

SEQ ID NO: 5630990 - DNA, 14 bp, Homo sapiens
gtctgggggtcagg

SEQ ID NO: 5630991 - DNA, 17 bp, Homo sapiens
gtctggggttcagcccc

SEQ ID NO: 5630992 - DNA, 16 bp, Homo sapiens
gtctgggtcagaccca

SEQ ID NO: 5630993 - DNA, 19 bp, Homo sapiens
gtctgggtcagacccatct

SEQ ID NO: 5630994 - DNA, 16 bp, Homo sapiens
gtctgggtccatcctg

SEQ ID NO: 5630995 - DNA, 19 bp, Homo sapiens
gtctgggtctaccaggaac

SEQ ID NO: 5630996 - DNA, 18 bp, Homo sapiens
gtctgggtggggcccagg

SEQ ID NO: 5630997 - DNA, 19 bp, Homo sapiens
gtctgggtggggcccaggc

SEQ ID NO: 5630998 - DNA, 20 bp, Homo sapiens
gtctgggtggggcccaggcc

SEQ ID NO: 5630999 - DNA, 17 bp, Homo sapiens
gtctgggtttggcaggc

SEQ ID NO: 5631000 - DNA, 17 bp, Homo sapiens
gtctgggtttggcccaa

SEQ ID NO: 5631001 - DNA, 19 bp, Homo sapiens
gtctgggtttggcccaaga

SEQ ID NO: 5631002 - DNA, 20 bp, Homo sapiens
gtctgggtttggcccaagac

SEQ ID NO: 5631003 - DNA, 19 bp, Homo sapiens
gtctgggtttttcttgtgg

SEQ ID NO: 5631004 - DNA, 14 bp, Homo sapiens
gtctggtccacaca

SEQ ID NO: 5631005 - DNA, 22 bp, Homo sapiens
gtctggtgaggtggcccaggcc

SEQ ID NO: 5631006 - DNA, 23 bp, Homo sapiens
gtctggtgaggtggcccaggccc

SEQ ID NO: 5631007 - DNA, 13 bp, Homo sapiens
gtctggtgcagaa

SEQ ID NO: 5631008 - DNA, 19 bp, Homo sapiens
gtctggtgccctggtggcc

SEQ ID NO: 5631009 - DNA, 15 bp, Homo sapiens
gtctggtggaggagc

SEQ ID NO: 5631010 - DNA, 13 bp, Homo sapiens
gtctggtggcccc

SEQ ID NO: 5631011 - DNA, 13 bp, Homo sapiens
gtctggtgggagg

SEQ ID NO: 5631012 - DNA, 19 bp, Homo sapiens
gtctggtgtagctcctctg

SEQ ID NO: 5631013 - DNA, 13 bp, Homo sapiens
gtctggtgttctg

SEQ ID NO: 5631014 - DNA, 16 bp, Homo sapiens
gtctggtgtttgtcat

SEQ ID NO: 5631015 - DNA, 15 bp, Homo sapiens
gtctggttaaatagt

SEQ ID NO: 5631016 - DNA, 15 bp, Homo sapiens
gtctggttcctgtgt

SEQ ID NO: 5631017 - DNA, 23 bp, Homo sapiens
gtctggttcctgtgtgaccctgg

SEQ ID NO: 5631018 - DNA, 18 bp, Homo sapiens
gtctggttgggcagccag

SEQ ID NO: 5631019 - DNA, 13 bp, Homo sapiens
gtctggtttctag

SEQ ID NO: 5631020 - DNA, 20 bp, Homo sapiens
gtctgtaaaaaatggagctc

SEQ ID NO: 5631021 - DNA, 11 bp, Homo sapiens
gtctgtaaaat

SEQ ID NO: 5631022 - DNA, 18 bp, Homo sapiens
gtctgtaaaatctttctt

SEQ ID NO: 5631023 - DNA, 21 bp, Homo sapiens
gtctgtaactgcccagcccct

SEQ ID NO: 5631024 - DNA, 22 bp, Homo sapiens
gtctgtaactttccactcttcc

SEQ ID NO: 5631025 - DNA, 19 bp, Homo sapiens
gtctgtaaggactcagtgt

SEQ ID NO: 5631026 - DNA, 14 bp, Homo sapiens
gtctgtaatacact

SEQ ID NO: 5631027 - DNA, 20 bp, Homo sapiens
gtctgtacacgtgtcctgta

SEQ ID NO: 5631028 - DNA, 15 bp, Homo sapiens
gtctgtacatactgg

SEQ ID NO: 5631029 - DNA, 20 bp, Homo sapiens
gtctgtacatactggcctct

SEQ ID NO: 5631030 - DNA, 15 bp, Homo sapiens
gtctgtactaaaaat

SEQ ID NO: 5631031 - DNA, 18 bp, Homo sapiens
gtctgtagagggccctgg

SEQ ID NO: 5631032 - DNA, 16 bp, Homo sapiens
gtctgtaggtgaaaga

SEQ ID NO: 5631033 - DNA, 20 bp, Homo sapiens
gtctgtaggttgcacacttt

SEQ ID NO: 5631034 - DNA, 17 bp, Homo sapiens
gtctgtagttgctttgc

SEQ ID NO: 5631035 - DNA, 22 bp, Homo sapiens
gtctgtatactcctgtcaccta

SEQ ID NO: 5631036 - DNA, 17 bp, Homo sapiens
gtctgtatatacatttc

SEQ ID NO: 5631037 - DNA, 16 bp, Homo sapiens
gtctgtatcactctgt

SEQ ID NO: 5631038 - DNA, 15 bp, Homo sapiens
gtctgtatcagtgga

SEQ ID NO: 5631039 - DNA, 23 bp, Homo sapiens
gtctgtatcagtggatttcccat

SEQ ID NO: 5631040 - DNA, 19 bp, Homo sapiens
gtctgtatccaaataatga

SEQ ID NO: 5631041 - DNA, 15 bp, Homo sapiens
gtctgtatccccagt

SEQ ID NO: 5631042 - DNA, 16 bp, Homo sapiens
gtctgtatccccagtg

SEQ ID NO: 5631043 - DNA, 16 bp, Homo sapiens
gtctgtattcatacag

SEQ ID NO: 5631044 - DNA, 21 bp, Homo sapiens
gtctgtattcatacagcacta

SEQ ID NO: 5631045 - DNA, 14 bp, Homo sapiens
gtctgtatttcatg

SEQ ID NO: 5631046 - DNA, 18 bp, Homo sapiens
gtctgtcacaggctgggt

SEQ ID NO: 5631047 - DNA, 16 bp, Homo sapiens
gtctgtcaccacatct

SEQ ID NO: 5631048 - DNA, 23 bp, Homo sapiens
gtctgtcagaagacactaattcc

SEQ ID NO: 5631049 - DNA, 16 bp, Homo sapiens
gtctgtcaggggcttg

SEQ ID NO: 5631050 - DNA, 14 bp, Homo sapiens
gtctgtcatctgct

SEQ ID NO: 5631051 - DNA, 19 bp, Homo sapiens
gtctgtcatttctctttca

SEQ ID NO: 5631052 - DNA, 20 bp, Homo sapiens
gtctgtccaacccctccccc

SEQ ID NO: 5631053 - DNA, 18 bp, Homo sapiens
gtctgtccagataagtta

SEQ ID NO: 5631054 - DNA, 21 bp, Homo sapiens
gtctgtccagataagttattt

SEQ ID NO: 5631055 - DNA, 15 bp, Homo sapiens
gtctgtccaggccct

SEQ ID NO: 5631056 - DNA, 13 bp, Homo sapiens
gtctgtccatctg

SEQ ID NO: 5631057 - DNA, 21 bp, Homo sapiens
gtctgtcccaagtcctgctcc

SEQ ID NO: 5631058 - DNA, 19 bp, Homo sapiens
gtctgtcccggggtcctgt

SEQ ID NO: 5631059 - DNA, 20 bp, Homo sapiens
gtctgtcccggggtcctgtg

SEQ ID NO: 5631060 - DNA, 24 bp, Homo sapiens
gtctgtcccggggtcctgtggcag

SEQ ID NO: 5631061 - DNA, 18 bp, Homo sapiens
gtctgtccctaaacatag

SEQ ID NO: 5631062 - DNA, 15 bp, Homo sapiens
gtctgtcccttttct

SEQ ID NO: 5631063 - DNA, 21 bp, Homo sapiens
gtctgtcccttttctttgacc

SEQ ID NO: 5631064 - DNA, 23 bp, Homo sapiens
gtctgtcctatggagcctctgca

SEQ ID NO: 5631065 - DNA, 17 bp, Homo sapiens
gtctgtcctcagagcag

SEQ ID NO: 5631066 - DNA, 19 bp, Homo sapiens
gtctgtcctgatttctaca

SEQ ID NO: 5631067 - DNA, 12 bp, Homo sapiens
gtctgtcctgcg

SEQ ID NO: 5631068 - DNA, 17 bp, Homo sapiens
gtctgtcctgcgcctgc

SEQ ID NO: 5631069 - DNA, 13 bp, Homo sapiens
gtctgtcctggaa

SEQ ID NO: 5631070 - DNA, 14 bp, Homo sapiens
gtctgtcctggagg

SEQ ID NO: 5631071 - DNA, 18 bp, Homo sapiens
gtctgtcctggaggtggg

SEQ ID NO: 5631072 - DNA, 16 bp, Homo sapiens
gtctgtctcaggagca

SEQ ID NO: 5631073 - DNA, 23 bp, Homo sapiens
gtctgtctccatcgtctcatcct

SEQ ID NO: 5631074 - DNA, 11 bp, Homo sapiens
gtctgtctctc

SEQ ID NO: 5631075 - DNA, 22 bp, Homo sapiens
gtctgtctctccatctgtttgg

SEQ ID NO: 5631076 - DNA, 14 bp, Homo sapiens
gtctgtctctcccc

SEQ ID NO: 5631077 - DNA, 24 bp, Homo sapiens
gtctgtctctcttttgctctctca

SEQ ID NO: 5631078 - DNA, 15 bp, Homo sapiens
gtctgtctcttggct

SEQ ID NO: 5631079 - DNA, 21 bp, Homo sapiens
gtctgtctgaatgatcttgtg

SEQ ID NO: 5631080 - DNA, 15 bp, Homo sapiens
gtctgtctgctctta

SEQ ID NO: 5631081 - DNA, 15 bp, Homo sapiens
gtctgtcttcacagc

SEQ ID NO: 5631082 - DNA, 16 bp, Homo sapiens
gtctgtcttcacagct

SEQ ID NO: 5631083 - DNA, 22 bp, Homo sapiens
gtctgtcttcacagctctgtgt

SEQ ID NO: 5631084 - DNA, 14 bp, Homo sapiens
gtctgtcttccttt

SEQ ID NO: 5631085 - DNA, 12 bp, Homo sapiens
gtctgtcttctg

SEQ ID NO: 5631086 - DNA, 21 bp, Homo sapiens
gtctgtcttgagatctgattt

SEQ ID NO: 5631087 - DNA, 20 bp, Homo sapiens
gtctgtctttcctgaaccat

SEQ ID NO: 5631088 - DNA, 18 bp, Homo sapiens
gtctgtgaacagagagac

SEQ ID NO: 5631089 - DNA, 22 bp, Homo sapiens
gtctgtgaacttgatgttcctg

SEQ ID NO: 5631090 - DNA, 13 bp, Homo sapiens
gtctgtgaagagc

SEQ ID NO: 5631091 - DNA, 22 bp, Homo sapiens
gtctgtgaagtgagaccttcct

SEQ ID NO: 5631092 - DNA, 18 bp, Homo sapiens
gtctgtgaataaagccac

SEQ ID NO: 5631093 - DNA, 11 bp, Homo sapiens
gtctgtgaatg

SEQ ID NO: 5631094 - DNA, 13 bp, Homo sapiens
gtctgtgaatgct

SEQ ID NO: 5631095 - DNA, 15 bp, Homo sapiens
gtctgtgaatgctaa

SEQ ID NO: 5631096 - DNA, 11 bp, Homo sapiens
gtctgtgactg

SEQ ID NO: 5631097 - DNA, 13 bp, Homo sapiens
gtctgtgactgga

SEQ ID NO: 5631098 - DNA, 17 bp, Homo sapiens
gtctgtgagatgctaga

SEQ ID NO: 5631099 - DNA, 23 bp, Homo sapiens
gtctgtgagatgctagaactccc

SEQ ID NO: 5631100 - DNA, 20 bp, Homo sapiens
gtctgtgagtacctggtcat

SEQ ID NO: 5631101 - DNA, 21 bp, Homo sapiens
gtctgtgatctctgctgggga

SEQ ID NO: 5631102 - DNA, 16 bp, Homo sapiens
gtctgtgatgctccca

SEQ ID NO: 5631103 - DNA, 19 bp, Homo sapiens
gtctgtgcacatgcctctg

SEQ ID NO: 5631104 - DNA, 11 bp, Homo sapiens
gtctgtgcaga

SEQ ID NO: 5631105 - DNA, 20 bp, Homo sapiens
gtctgtgcattgtggctgtc

SEQ ID NO: 5631106 - DNA, 13 bp, Homo sapiens
gtctgtgccatgg

SEQ ID NO: 5631107 - DNA, 15 bp, Homo sapiens
gtctgtgccatggat

SEQ ID NO: 5631108 - DNA, 15 bp, Homo sapiens
gtctgtgccatttct

SEQ ID NO: 5631109 - DNA, 16 bp, Homo sapiens
gtctgtgccatttctc

SEQ ID NO: 5631110 - DNA, 18 bp, Homo sapiens
gtctgtgccattttgtat

SEQ ID NO: 5631111 - DNA, 14 bp, Homo sapiens
gtctgtgcccgagg

SEQ ID NO: 5631112 - DNA, 21 bp, Homo sapiens
gtctgtgcccgaggttcctgt

SEQ ID NO: 5631113 - DNA, 18 bp, Homo sapiens
gtctgtgccctccaaaga

SEQ ID NO: 5631114 - DNA, 17 bp, Homo sapiens
gtctgtgcctggagctc

SEQ ID NO: 5631115 - DNA, 12 bp, Homo sapiens
gtctgtgctctt

SEQ ID NO: 5631116 - DNA, 12 bp, Homo sapiens
gtctgtgctgag

SEQ ID NO: 5631117 - DNA, 14 bp, Homo sapiens
gtctgtgctgaggc

SEQ ID NO: 5631118 - DNA, 16 bp, Homo sapiens
gtctgtgctgtgcctg

SEQ ID NO: 5631119 - DNA, 20 bp, Homo sapiens
gtctgtggagatggactcag

SEQ ID NO: 5631120 - DNA, 13 bp, Homo sapiens
gtctgtggatttt

SEQ ID NO: 5631121 - DNA, 16 bp, Homo sapiens
gtctgtggccctctct

SEQ ID NO: 5631122 - DNA, 16 bp, Homo sapiens
gtctgtgggcttcagc

SEQ ID NO: 5631123 - DNA, 13 bp, Homo sapiens
gtctgtggtgcag

SEQ ID NO: 5631124 - DNA, 22 bp, Homo sapiens
gtctgtggttgcagtctttccc

SEQ ID NO: 5631125 - DNA, 20 bp, Homo sapiens
gtctttatttttatcccagg

SEQ ID NO: 5631126 - DNA, 18 bp, Homo sapiens
gtctttatttttttccca

SEQ ID NO: 5631127 - DNA, 16 bp, Homo sapiens
gtctttcacagctcct

SEQ ID NO: 5631128 - DNA, 16 bp, Homo sapiens
gtctttcacatttaaa

SEQ ID NO: 5631129 - DNA, 20 bp, Homo sapiens
gtctttcactggaatgaaga

SEQ ID NO: 5631130 - DNA, 14 bp, Homo sapiens
gtctttcagcattc

SEQ ID NO: 5631131 - DNA, 16 bp, Homo sapiens
gtctttcagcattcag

SEQ ID NO: 5631132 - DNA, 11 bp, Homo sapiens
gtctttcagta

SEQ ID NO: 5631133 - DNA, 22 bp, Homo sapiens
gtctttcagtacttttttaaat

SEQ ID NO: 5631134 - DNA, 14 bp, Homo sapiens
gtctttccactctg

SEQ ID NO: 5631135 - DNA, 17 bp, Homo sapiens
gtctttccacttctctg

SEQ ID NO: 5631136 - DNA, 16 bp, Homo sapiens
gtctttccactttcat

SEQ ID NO: 5631137 - DNA, 19 bp, Homo sapiens
gtctttcccatggggaggg

SEQ ID NO: 5631138 - DNA, 12 bp, Homo sapiens
gtctttcctaga

SEQ ID NO: 5631139 - DNA, 19 bp, Homo sapiens
gtctttcctgctacaagtg

SEQ ID NO: 5631140 - DNA, 19 bp, Homo sapiens
gtctttctaagaaatcaag

SEQ ID NO: 5631141 - DNA, 21 bp, Homo sapiens
gtctttctaatgtagctattt

SEQ ID NO: 5631142 - DNA, 20 bp, Homo sapiens
gtctttctagccataataaa

SEQ ID NO: 5631143 - DNA, 22 bp, Homo sapiens
gtctttctattcataataaact

SEQ ID NO: 5631144 - DNA, 18 bp, Homo sapiens
gtctttctcactgccttt

SEQ ID NO: 5631145 - DNA, 14 bp, Homo sapiens
gtctttctccaaag

SEQ ID NO: 5631146 - DNA, 15 bp, Homo sapiens
gtctttctcctctgg

SEQ ID NO: 5631147 - DNA, 14 bp, Homo sapiens
gtctttctctcagt

SEQ ID NO: 5631148 - DNA, 16 bp, Homo sapiens
gtctttctctcagtga

SEQ ID NO: 5631149 - DNA, 18 bp, Homo sapiens
gtctttctgcagaaaatt

SEQ ID NO: 5631150 - DNA, 13 bp, Homo sapiens
gtctttctggaga

SEQ ID NO: 5631151 - DNA, 14 bp, Homo sapiens
gtctttcttgaaat

SEQ ID NO: 5631152 - DNA, 16 bp, Homo sapiens
gtctttcttgctccct

SEQ ID NO: 5631153 - DNA, 22 bp, Homo sapiens
gtctttcttgtaaggcatactg

SEQ ID NO: 5631154 - DNA, 12 bp, Homo sapiens
gtctttctttgc

SEQ ID NO: 5631155 - DNA, 22 bp, Homo sapiens
gtctttctttgctgctgtggaa

SEQ ID NO: 5631156 - DNA, 15 bp, Homo sapiens
gtctttctttggtgc

SEQ ID NO: 5631157 - DNA, 18 bp, Homo sapiens
gtctttctttgtcattca

SEQ ID NO: 5631158 - DNA, 17 bp, Homo sapiens
gtctttctttttggaca

SEQ ID NO: 5631159 - DNA, 15 bp, Homo sapiens
gtctttgaataaagt

SEQ ID NO: 5631160 - DNA, 17 bp, Homo sapiens
gtctttgaataaagtct

SEQ ID NO: 5631161 - DNA, 23 bp, Homo sapiens
gtctttgaataaagtctgagtgg

SEQ ID NO: 5631162 - DNA, 16 bp, Homo sapiens
gtctttgagctcccac

SEQ ID NO: 5631163 - DNA, 15 bp, Homo sapiens
gtctttgatcatcat

SEQ ID NO: 5631164 - DNA, 13 bp, Homo sapiens
gtctttgcacatg

SEQ ID NO: 5631165 - DNA, 14 bp, Homo sapiens
gtctttgcagggca

SEQ ID NO: 5631166 - DNA, 18 bp, Homo sapiens
gtctttgcggggcctgtc

SEQ ID NO: 5631167 - DNA, 20 bp, Homo sapiens
gtctttgcggggcctgtctc

SEQ ID NO: 5631168 - DNA, 13 bp, Homo sapiens
gtctttgctcagt

SEQ ID NO: 5631169 - DNA, 18 bp, Homo sapiens
gtctttggaaaaatgttt

SEQ ID NO: 5631170 - DNA, 20 bp, Homo sapiens
gtctttggaaaaatgtttgt

SEQ ID NO: 5631171 - DNA, 14 bp, Homo sapiens
gtctttggaccctg

SEQ ID NO: 5631172 - DNA, 15 bp, Homo sapiens
gtctttggaccctga

SEQ ID NO: 5631173 - DNA, 23 bp, Homo sapiens
gtctttggagagctcagtacagg

SEQ ID NO: 5631174 - DNA, 20 bp, Homo sapiens
gtctttggataataggaatt

SEQ ID NO: 5631175 - DNA, 23 bp, Homo sapiens
gtctttggttcctcatggctgtt

SEQ ID NO: 5631176 - DNA, 13 bp, Homo sapiens
gtctttgtaagag

SEQ ID NO: 5631177 - DNA, 23 bp, Homo sapiens
gtctttgtaagtcagtgttgaga

SEQ ID NO: 5631178 - DNA, 16 bp, Homo sapiens
gtctttgtaatgcttg

SEQ ID NO: 5631179 - DNA, 18 bp, Homo sapiens
gtctttgtaatgcttgta

SEQ ID NO: 5631180 - DNA, 13 bp, Homo sapiens
gtctttgtgtatg

SEQ ID NO: 5631181 - DNA, 15 bp, Homo sapiens
gtctttgtgtgctgt

SEQ ID NO: 5631182 - DNA, 18 bp, Homo sapiens
gtctttgtgttttgtcca

SEQ ID NO: 5631183 - DNA, 16 bp, Homo sapiens
gtctttgttgcaccat

SEQ ID NO: 5631184 - DNA, 16 bp, Homo sapiens
gtctttgttgtctccc

SEQ ID NO: 5631185 - DNA, 17 bp, Homo sapiens
gtctttgttgtctccct

SEQ ID NO: 5631186 - DNA, 10 bp, Homo sapiens
gtcttttaaa

SEQ ID NO: 5631187 - DNA, 20 bp, Homo sapiens
gtcttttaaaaactcctgtt

SEQ ID NO: 5631188 - DNA, 17 bp, Homo sapiens
gtcttttaaaaagtatt

SEQ ID NO: 5631189 - DNA, 13 bp, Homo sapiens
gtcttttaaaatg

SEQ ID NO: 5631190 - DNA, 14 bp, Homo sapiens
gtcttttaaactgg

SEQ ID NO: 5631191 - DNA, 17 bp, Homo sapiens
gtcttttaatgcttcat

SEQ ID NO: 5631192 - DNA, 16 bp, Homo sapiens
gtcttttacatacagt

SEQ ID NO: 5631193 - DNA, 16 bp, Homo sapiens
gtcttttaccctgtgt

SEQ ID NO: 5631194 - DNA, 23 bp, Homo sapiens
gtcttttatagtggaaaaacaca

SEQ ID NO: 5631195 - DNA, 11 bp, Homo sapiens
gtcttttcatc

SEQ ID NO: 5631196 - DNA, 17 bp, Homo sapiens
gtcttttcctcgcttct

SEQ ID NO: 5631197 - DNA, 17 bp, Homo sapiens
gtcttttctcctccgcc

SEQ ID NO: 5631198 - DNA, 17 bp, Homo sapiens
gtcttttctctgaaaag

SEQ ID NO: 5631199 - DNA, 16 bp, Homo sapiens
gtcttttctgctgagg

SEQ ID NO: 5631200 - DNA, 23 bp, Homo sapiens
gtcttttctgtcaccaaatttgt

SEQ ID NO: 5631201 - DNA, 14 bp, Homo sapiens
gtcttttcttgcat

SEQ ID NO: 5631202 - DNA, 17 bp, Homo sapiens
gtcttttgaagaagttc

SEQ ID NO: 5631203 - DNA, 19 bp, Homo sapiens
gtcttttgaatattcccaa

SEQ ID NO: 5631204 - DNA, 14 bp, Homo sapiens
gtcttttgacatgt

SEQ ID NO: 5631205 - DNA, 19 bp, Homo sapiens
gtcttttgacatgtggaaa

SEQ ID NO: 5631206 - DNA, 12 bp, Homo sapiens
gtcttttgcttt

SEQ ID NO: 5631207 - DNA, 14 bp, Homo sapiens
gtcttttgcttttg

SEQ ID NO: 5631208 - DNA, 21 bp, Homo sapiens
gtcttttgggagtggcccctg

SEQ ID NO: 5631209 - DNA, 16 bp, Homo sapiens
gtcttttggttatgaa

SEQ ID NO: 5631210 - DNA, 14 bp, Homo sapiens
gtcttttgttctct

SEQ ID NO: 5631211 - DNA, 15 bp, Homo sapiens
gtctttttaaaaata

SEQ ID NO: 5631212 - DNA, 20 bp, Homo sapiens
gtctttttaagcttatttaa

SEQ ID NO: 5631213 - DNA, 16 bp, Homo sapiens
gtctttttagatgccc

SEQ ID NO: 5631214 - DNA, 13 bp, Homo sapiens
gtctttttcctac

SEQ ID NO: 5631215 - DNA, 16 bp, Homo sapiens
gtctttttcctactcc

SEQ ID NO: 5631216 - DNA, 16 bp, Homo sapiens
gtctttttccttcctg

SEQ ID NO: 5631217 - DNA, 17 bp, Homo sapiens
gtctttttccttcctga

SEQ ID NO: 5631218 - DNA, 21 bp, Homo sapiens
gtctttttctagggtccctga

SEQ ID NO: 5631219 - DNA, 15 bp, Homo sapiens
gtctttttctcttct

SEQ ID NO: 5631220 - DNA, 17 bp, Homo sapiens
gtctttttctgttgtaa

SEQ ID NO: 5631221 - DNA, 23 bp, Homo sapiens
gtctttttctttttttggtaaat

SEQ ID NO: 5631222 - DNA, 13 bp, Homo sapiens
gtctttttgaagt

SEQ ID NO: 5631223 - DNA, 14 bp, Homo sapiens
gtctttttgtaagt

SEQ ID NO: 5631224 - DNA, 18 bp, Homo sapiens
gtctttttgtataaatga

SEQ ID NO: 5631225 - DNA, 14 bp, Homo sapiens
gtctttttgtttgt

SEQ ID NO: 5631226 - DNA, 16 bp, Homo sapiens
gtctttttgtttgttt

SEQ ID NO: 5631227 - DNA, 16 bp, Homo sapiens
gtcttttttcactaca

SEQ ID NO: 5631228 - DNA, 23 bp, Homo sapiens
gtctttttttggtgattcaaatg

SEQ ID NO: 5631229 - DNA, 21 bp, Homo sapiens
gtctttttttgtattataaaa

SEQ ID NO: 5631230 - DNA, 18 bp, Homo sapiens
gtcttttttttaatgtgc

SEQ ID NO: 5631231 - DNA, 14 bp, Homo sapiens
gtcttttttttcct

SEQ ID NO: 5631232 - DNA, 21 bp, Homo sapiens
gtcttttttttttaagtgaaa

SEQ ID NO: 5631233 - DNA, 18 bp, Homo sapiens
gtcttttttttttccaaa

SEQ ID NO: 5631234 - DNA, 20 bp, Homo sapiens
gtcttttttttttttgtcta

SEQ ID NO: 5631235 - DNA, 19 bp, Homo sapiens
gtgaaaaaaaaaagtaatt

SEQ ID NO: 5631236 - DNA, 14 bp, Homo sapiens
gtgaaaaaaaaaat

SEQ ID NO: 5631237 - DNA, 13 bp, Homo sapiens
gtgaaaaaaagaa

SEQ ID NO: 5631238 - DNA, 14 bp, Homo sapiens
gtgaaaaaaagaaa

SEQ ID NO: 5631239 - DNA, 20 bp, Homo sapiens
gtgaaaaaagcttttatgag

SEQ ID NO: 5631240 - DNA, 21 bp, Homo sapiens
gtgaaaaatgagcttgtaaat

SEQ ID NO: 5631241 - DNA, 21 bp, Homo sapiens
gtgaaaaatggtaatataaca

SEQ ID NO: 5631242 - DNA, 15 bp, Homo sapiens
gtgaaaacaagtgct

SEQ ID NO: 5631243 - DNA, 22 bp, Homo sapiens
gtgaaaaccaaccctgtgggct

SEQ ID NO: 5631244 - DNA, 15 bp, Homo sapiens
gtgaaaacggagctg

SEQ ID NO: 5631245 - DNA, 18 bp, Homo sapiens
gtgaaaacgtcttccttc

SEQ ID NO: 5631246 - DNA, 23 bp, Homo sapiens
gtgaaaagaaaaatgagcctggc

SEQ ID NO: 5631247 - DNA, 12 bp, Homo sapiens
gtgaaaagatcc

SEQ ID NO: 5631248 - DNA, 16 bp, Homo sapiens
gtgaaaagattttatt

SEQ ID NO: 5631249 - DNA, 21 bp, Homo sapiens
gtgaaaagcacagctgtatat

SEQ ID NO: 5631250 - DNA, 16 bp, Homo sapiens
gtgaaaagggcagagg

SEQ ID NO: 5631251 - DNA, 17 bp, Homo sapiens
gtgaaaagggcagaggc

SEQ ID NO: 5631252 - DNA, 22 bp, Homo sapiens
gtgaaaataagccatgagaatg

SEQ ID NO: 5631253 - DNA, 16 bp, Homo sapiens
gtgaaaatatacttga

SEQ ID NO: 5631254 - DNA, 16 bp, Homo sapiens
gtgaaaatatttaaag

SEQ ID NO: 5631255 - DNA, 13 bp, Homo sapiens
gtgaaaatgaaga

SEQ ID NO: 5631256 - DNA, 16 bp, Homo sapiens
gtgaaaatgaggagga

SEQ ID NO: 5631257 - DNA, 20 bp, Homo sapiens
gtgaaacaattattgtacac

SEQ ID NO: 5631258 - DNA, 14 bp, Homo sapiens
gtgaaacacaatat

SEQ ID NO: 5631259 - DNA, 20 bp, Homo sapiens
gtgaaacacaccaggctgtg

SEQ ID NO: 5631260 - DNA, 15 bp, Homo sapiens
gtgaaacacagctgt

SEQ ID NO: 5631261 - DNA, 13 bp, Homo sapiens
gtgaaacagagaa

SEQ ID NO: 5631262 - DNA, 14 bp, Homo sapiens
gtgaaacagagaaa

SEQ ID NO: 5631263 - DNA, 17 bp, Homo sapiens
gtgaaacagagaaagaa

SEQ ID NO: 5631264 - DNA, 17 bp, Homo sapiens
gtgaaacagtgtggatg

SEQ ID NO: 5631265 - DNA, 19 bp, Homo sapiens
gtgaaacattttctccctg

SEQ ID NO: 5631266 - DNA, 14 bp, Homo sapiens
gtgaaaccacaggc

SEQ ID NO: 5631267 - DNA, 21 bp, Homo sapiens
gtgaaacccagatcgctgtgt

SEQ ID NO: 5631268 - DNA, 17 bp, Homo sapiens
gtgaaaccctgtctcta

SEQ ID NO: 5631269 - DNA, 17 bp, Homo sapiens
gtgaaacctacagcata

SEQ ID NO: 5631270 - DNA, 20 bp, Homo sapiens
gtgaaacctgacacctagat

SEQ ID NO: 5631271 - DNA, 20 bp, Homo sapiens
gtgaaacctttagggcagct

SEQ ID NO: 5631272 - DNA, 17 bp, Homo sapiens
gtgaaaccttttttaag

SEQ ID NO: 5631273 - DNA, 21 bp, Homo sapiens
gtgaaaccttttttaagattt

SEQ ID NO: 5631274 - DNA, 15 bp, Homo sapiens
gtgaaacgactcaaa

SEQ ID NO: 5631275 - DNA, 21 bp, Homo sapiens
gtgaaacgactcaaaatgaca

SEQ ID NO: 5631276 - DNA, 19 bp, Homo sapiens
gtgaaacgtaattgtacaa

SEQ ID NO: 5631277 - DNA, 17 bp, Homo sapiens
gtgaaacgtctggactg

SEQ ID NO: 5631278 - DNA, 14 bp, Homo sapiens
gtgaaactcccacc

SEQ ID NO: 5631279 - DNA, 16 bp, Homo sapiens
gtgaaactcccaccct

SEQ ID NO: 5631280 - DNA, 20 bp, Homo sapiens
gtgaaactcgttaatttgta

SEQ ID NO: 5631281 - DNA, 18 bp, Homo sapiens
gtgaaactgcattatttg

SEQ ID NO: 5631282 - DNA, 12 bp, Homo sapiens
gtgaaactttta

SEQ ID NO: 5631283 - DNA, 20 bp, Homo sapiens
gtgaaagaaagctgagaaga

SEQ ID NO: 5631284 - DNA, 21 bp, Homo sapiens
gtgaaagaaagggacccacct

SEQ ID NO: 5631285 - DNA, 13 bp, Homo sapiens
gtgaaagaaatca

SEQ ID NO: 5631286 - DNA, 16 bp, Homo sapiens
gtgaaagaaatcatgt

SEQ ID NO: 5631287 - DNA, 20 bp, Homo sapiens
gtgaaagaaatcatgttatg

SEQ ID NO: 5631288 - DNA, 21 bp, Homo sapiens
gtgaaagaaatcatgttatga

SEQ ID NO: 5631289 - DNA, 20 bp, Homo sapiens
gtgaaagccttaagaagata

SEQ ID NO: 5631290 - DNA, 21 bp, Homo sapiens
gtgaaagccttaagaagataa

SEQ ID NO: 5631291 - DNA, 20 bp, Homo sapiens
gtgaaagctgagaactcctg

SEQ ID NO: 5631292 - DNA, 11 bp, Homo sapiens
gtgaaagcttt

SEQ ID NO: 5631293 - DNA, 19 bp, Homo sapiens
gtgaaaggaaagagggagg

SEQ ID NO: 5631294 - DNA, 13 bp, Homo sapiens
gtgaaaggaaagt

SEQ ID NO: 5631295 - DNA, 15 bp, Homo sapiens
gtgaaaggcagggcc

SEQ ID NO: 5631296 - DNA, 22 bp, Homo sapiens
gtgaaagtgcatttttgtaaat

SEQ ID NO: 5631297 - DNA, 16 bp, Homo sapiens
gtgaaagtggcaagct

SEQ ID NO: 5631298 - DNA, 13 bp, Homo sapiens
gtgaaagtgtaaa

SEQ ID NO: 5631299 - DNA, 18 bp, Homo sapiens
gtgaaagtgtaaaataga

SEQ ID NO: 5631300 - DNA, 15 bp, Homo sapiens
gtgaaagtgtaatac

SEQ ID NO: 5631301 - DNA, 15 bp, Homo sapiens
gtgaaagtgtcgtct

SEQ ID NO: 5631302 - DNA, 20 bp, Homo sapiens
gtgaaagttgccattattct

SEQ ID NO: 5631303 - DNA, 14 bp, Homo sapiens
gtgaaagtttttct

SEQ ID NO: 5631304 - DNA, 15 bp, Homo sapiens
gtgacatgcggctgc

SEQ ID NO: 5631305 - DNA, 20 bp, Homo sapiens
gtgacatggggaaggcagag

SEQ ID NO: 5631306 - DNA, 15 bp, Homo sapiens
gtgacatggtgcctg

SEQ ID NO: 5631307 - DNA, 19 bp, Homo sapiens
gtgacatggtgcctgagag

SEQ ID NO: 5631308 - DNA, 23 bp, Homo sapiens
gtgacatggtgcctgagaggcag

SEQ ID NO: 5631309 - DNA, 13 bp, Homo sapiens
gtgacatgtaaca

SEQ ID NO: 5631310 - DNA, 17 bp, Homo sapiens
gtgacatgtcctctctg

SEQ ID NO: 5631311 - DNA, 19 bp, Homo sapiens
gtgacatgtcttttcttgc

SEQ ID NO: 5631312 - DNA, 14 bp, Homo sapiens
gtgacatgtgaaac

SEQ ID NO: 5631313 - DNA, 15 bp, Homo sapiens
gtgacatgtgaaacc

SEQ ID NO: 5631314 - DNA, 16 bp, Homo sapiens
gtgacatgtgaaacct

SEQ ID NO: 5631315 - DNA, 18 bp, Homo sapiens
gtgacatgtgaaaccttt

SEQ ID NO: 5631316 - DNA, 19 bp, Homo sapiens
gtgacatgtgaaacctttt

SEQ ID NO: 5631317 - DNA, 20 bp, Homo sapiens
gtgacatgtgaaaccttttt

SEQ ID NO: 5631318 - DNA, 22 bp, Homo sapiens
gtgacatgtgaaacctttttta

SEQ ID NO: 5631319 - DNA, 22 bp, Homo sapiens
gtgacatgtgttggcagcctct

SEQ ID NO: 5631320 - DNA, 17 bp, Homo sapiens
gtgacatttcccaagtc

SEQ ID NO: 5631321 - DNA, 17 bp, Homo sapiens
gtgacatttgtcatttt

SEQ ID NO: 5631322 - DNA, 20 bp, Homo sapiens
gtgacattttacattaaatt

SEQ ID NO: 5631323 - DNA, 17 bp, Homo sapiens
gtgaccaaaagttacat

SEQ ID NO: 5631324 - DNA, 16 bp, Homo sapiens
gtgaccaaaatcccct

SEQ ID NO: 5631325 - DNA, 22 bp, Homo sapiens
gtgaccaactagacattctgtc

SEQ ID NO: 5631326 - DNA, 23 bp, Homo sapiens
gtgaccaactagacattctgtcg

SEQ ID NO: 5631327 - DNA, 19 bp, Homo sapiens
gtgaccaactgtgttgtat

SEQ ID NO: 5631328 - DNA, 19 bp, Homo sapiens
gtgaccaagttataaatca

SEQ ID NO: 5631329 - DNA, 18 bp, Homo sapiens
gtgaccaatacatttgta

SEQ ID NO: 5631330 - DNA, 17 bp, Homo sapiens
gtgaccaatcgggagta

SEQ ID NO: 5631331 - DNA, 17 bp, Homo sapiens
gtgaccaatgatggtca

SEQ ID NO: 5631332 - DNA, 16 bp, Homo sapiens
gtgaccaatgtcttga

SEQ ID NO: 5631333 - DNA, 16 bp, Homo sapiens
gtgaccaattgccctg

SEQ ID NO: 5631334 - DNA, 17 bp, Homo sapiens
gtgaccaattgccctgc

SEQ ID NO: 5631335 - DNA, 19 bp, Homo sapiens
gtgaccaattgccctgcca

SEQ ID NO: 5631336 - DNA, 20 bp, Homo sapiens
gtgaccaattgccctgccag

SEQ ID NO: 5631337 - DNA, 16 bp, Homo sapiens
gtgaccacaaaagagg

SEQ ID NO: 5631338 - DNA, 15 bp, Homo sapiens
gtgaccaccccctgt

SEQ ID NO: 5631339 - DNA, 15 bp, Homo sapiens
gtgaccaccttctgt

SEQ ID NO: 5631340 - DNA, 15 bp, Homo sapiens
gtgaccagaaagctt

SEQ ID NO: 5631341 - DNA, 16 bp, Homo sapiens
gtgaccagaccaaggc

SEQ ID NO: 5631342 - DNA, 18 bp, Homo sapiens
gtgaccagcaccatctct

SEQ ID NO: 5631343 - DNA, 19 bp, Homo sapiens
gtgaccagcataccagttc

SEQ ID NO: 5631344 - DNA, 18 bp, Homo sapiens
gtgaccagcctgtcaccc

SEQ ID NO: 5631345 - DNA, 17 bp, Homo sapiens
gtgaccagcggaaacag

SEQ ID NO: 5631346 - DNA, 17 bp, Homo sapiens
gtgaccaggcatcctcc

SEQ ID NO: 5631347 - DNA, 13 bp, Homo sapiens
gtgaccaggcttt

SEQ ID NO: 5631348 - DNA, 22 bp, Homo sapiens
gtgaccatcttcataatttgct

SEQ ID NO: 5631349 - DNA, 13 bp, Homo sapiens
gtgaccatgttca

SEQ ID NO: 5631350 - DNA, 15 bp, Homo sapiens
gtgaccatttataat

SEQ ID NO: 5631351 - DNA, 14 bp, Homo sapiens
gtgacccaatgatt

SEQ ID NO: 5631352 - DNA, 12 bp, Homo sapiens
gtgacccacagc

SEQ ID NO: 5631353 - DNA, 18 bp, Homo sapiens
gtgacccacagctctggg

SEQ ID NO: 5631354 - DNA, 14 bp, Homo sapiens
gtgacccacatgcc

SEQ ID NO: 5631355 - DNA, 22 bp, Homo sapiens
gtgacccacccgccttggcctc

SEQ ID NO: 5631356 - DNA, 13 bp, Homo sapiens
gtgacccagtggc

SEQ ID NO: 5631357 - DNA, 13 bp, Homo sapiens
gtgaccccactgc

SEQ ID NO: 5631358 - DNA, 15 bp, Homo sapiens
gtgaccccagctcca

SEQ ID NO: 5631359 - DNA, 19 bp, Homo sapiens
gtgaccccagctccaggca

SEQ ID NO: 5631360 - DNA, 20 bp, Homo sapiens
gtgaccccagctccaggcag

SEQ ID NO: 5631361 - DNA, 21 bp, Homo sapiens
gtgaccccatcactcgcagga

SEQ ID NO: 5631362 - DNA, 23 bp, Homo sapiens
gtgaccccatcactcgcaggacc

SEQ ID NO: 5631363 - DNA, 16 bp, Homo sapiens
gtgacccccagctccg

SEQ ID NO: 5631364 - DNA, 20 bp, Homo sapiens
gtgacccccatgtccttgga

SEQ ID NO: 5631365 - DNA, 23 bp, Homo sapiens
gtgacccccttgattcccaccgt

SEQ ID NO: 5631366 - DNA, 14 bp, Homo sapiens
gtgacccctcctgg

SEQ ID NO: 5631367 - DNA, 17 bp, Homo sapiens
gtgacccctcctggggc

SEQ ID NO: 5631368 - DNA, 20 bp, Homo sapiens
gtgacccctcctggggccag

SEQ ID NO: 5631369 - DNA, 12 bp, Homo sapiens
gtgacccctgct

SEQ ID NO: 5631370 - DNA, 18 bp, Homo sapiens
gtgacccctgctttgccc

SEQ ID NO: 5631371 - DNA, 16 bp, Homo sapiens
gtgacccgacctggcc

SEQ ID NO: 5631372 - DNA, 23 bp, Homo sapiens
gtgacccggcaccccctgcagct

SEQ ID NO: 5631373 - DNA, 15 bp, Homo sapiens
gtgacccgtgaatgt

SEQ ID NO: 5631374 - DNA, 14 bp, Homo sapiens
gtgaccctctcact

SEQ ID NO: 5631375 - DNA, 13 bp, Homo sapiens
gtgaccctctgaa

SEQ ID NO: 5631376 - DNA, 15 bp, Homo sapiens
gtgaccctctttgct

SEQ ID NO: 5631377 - DNA, 19 bp, Homo sapiens
gtgaccctctttgctgaag

SEQ ID NO: 5631378 - DNA, 18 bp, Homo sapiens
gtgaccctgagggctcct

SEQ ID NO: 5631379 - DNA, 14 bp, Homo sapiens
gtgaccctggagct

SEQ ID NO: 5631380 - DNA, 15 bp, Homo sapiens
gtgaccctggagcta

SEQ ID NO: 5631381 - DNA, 17 bp, Homo sapiens
gtgaccctggagctagg

SEQ ID NO: 5631382 - DNA, 17 bp, Homo sapiens
gtgacccttcagggcca

SEQ ID NO: 5631383 - DNA, 18 bp, Homo sapiens
gtgacccttcagggccag

SEQ ID NO: 5631384 - DNA, 12 bp, Homo sapiens
gtgacccttccc

SEQ ID NO: 5631385 - DNA, 22 bp, Homo sapiens
gtgaccgactaccccagtccca

SEQ ID NO: 5631386 - DNA, 19 bp, Homo sapiens
gtgaccgcccagctctccc

SEQ ID NO: 5631387 - DNA, 18 bp, Homo sapiens
gtgaccgcctcctgctct

SEQ ID NO: 5631388 - DNA, 15 bp, Homo sapiens
gtgaccggacttttc

SEQ ID NO: 5631389 - DNA, 14 bp, Homo sapiens
gtgaccggcccgcc

SEQ ID NO: 5631390 - DNA, 16 bp, Homo sapiens
gtgaccggcccgccac

SEQ ID NO: 5631391 - DNA, 19 bp, Homo sapiens
gtgaccgggcactggcact

SEQ ID NO: 5631392 - DNA, 21 bp, Homo sapiens
gtgaccgggggaagctgagcc

SEQ ID NO: 5631393 - DNA, 17 bp, Homo sapiens
gtgaccgggggctgctg

SEQ ID NO: 5631394 - DNA, 21 bp, Homo sapiens
gtgaccgggggctgctgggcg

SEQ ID NO: 5631395 - DNA, 22 bp, Homo sapiens
gtgaccgggggctgctgggcgt

SEQ ID NO: 5631396 - DNA, 15 bp, Homo sapiens
gtgaccggggtcctg

SEQ ID NO: 5631397 - DNA, 20 bp, Homo sapiens
gtgacctatcagttattaat

SEQ ID NO: 5631398 - DNA, 20 bp, Homo sapiens
gtgacctattcaccctccac

SEQ ID NO: 5631399 - DNA, 20 bp, Homo sapiens
gtgacctcacacacctctgc

SEQ ID NO: 5631400 - DNA, 21 bp, Homo sapiens
gtgacctcacacacctctgcc

SEQ ID NO: 5631401 - DNA, 22 bp, Homo sapiens
gtgacctcacacacctctgccc

SEQ ID NO: 5631402 - DNA, 17 bp, Homo sapiens
gtgacctcactggcctg

SEQ ID NO: 5631403 - DNA, 19 bp, Homo sapiens
gtgacctccagagctgtcc

SEQ ID NO: 5631404 - DNA, 19 bp, Homo sapiens
gtgacctccatactgggct

SEQ ID NO: 5631405 - DNA, 15 bp, Homo sapiens
gtgacctcctgtcac

SEQ ID NO: 5631406 - DNA, 19 bp, Homo sapiens
gtgacctcggacagagccc

SEQ ID NO: 5631407 - DNA, 15 bp, Homo sapiens
gtgacctctccggcc

SEQ ID NO: 5631408 - DNA, 22 bp, Homo sapiens
gtgacctctccggcctggcctt

SEQ ID NO: 5631409 - DNA, 22 bp, Homo sapiens
gtgacctctctaggtgtgtcca

SEQ ID NO: 5631410 - DNA, 14 bp, Homo sapiens
gtgacctcttgcct

SEQ ID NO: 5631411 - DNA, 15 bp, Homo sapiens
gtgacctgacacctg

SEQ ID NO: 5631412 - DNA, 16 bp, Homo sapiens
gtgacctgacacctgc

SEQ ID NO: 5631413 - DNA, 14 bp, Homo sapiens
gtgacctgaggaag

SEQ ID NO: 5631414 - DNA, 17 bp, Homo sapiens
gtgacctgatttcagaa

SEQ ID NO: 5631415 - DNA, 18 bp, Homo sapiens
gtgacctgctaggccaga

SEQ ID NO: 5631416 - DNA, 14 bp, Homo sapiens
gtgacctgctgagc

SEQ ID NO: 5631417 - DNA, 15 bp, Homo sapiens
gtgacctgctgagct

SEQ ID NO: 5631418 - DNA, 19 bp, Homo sapiens
gtgacctgctgagctctga

SEQ ID NO: 5631419 - DNA, 23 bp, Homo sapiens
gtgacctgggtatcccctgcctc

SEQ ID NO: 5631420 - DNA, 19 bp, Homo sapiens
gtgacctggtctggtcagg

SEQ ID NO: 5631421 - DNA, 20 bp, Homo sapiens
gtgacctggtctggtcaggc

SEQ ID NO: 5631422 - DNA, 23 bp, Homo sapiens
gtgacctggtctggtcaggcaat

SEQ ID NO: 5631423 - DNA, 17 bp, Homo sapiens
gtgacctgtcagaataa

SEQ ID NO: 5631424 - DNA, 17 bp, Homo sapiens
gtgaccttacagccatt

SEQ ID NO: 5631425 - DNA, 20 bp, Homo sapiens
gtgaccttagtgtttctgtg

SEQ ID NO: 5631426 - DNA, 18 bp, Homo sapiens
gtgaccttgggaccaaag

SEQ ID NO: 5631427 - DNA, 20 bp, Homo sapiens
gtgacctttaagaaaaatga

SEQ ID NO: 5631428 - DNA, 13 bp, Homo sapiens
gtgacctttgtct

SEQ ID NO: 5631429 - DNA, 19 bp, Homo sapiens
gtgaccttttcttcatttt

SEQ ID NO: 5631430 - DNA, 14 bp, Homo sapiens
gtgacgaaaacatt

SEQ ID NO: 5631431 - DNA, 15 bp, Homo sapiens
gtgacgcccagctcc

SEQ ID NO: 5631432 - DNA, 17 bp, Homo sapiens
gtgacgctgaataaatg

SEQ ID NO: 5631433 - DNA, 13 bp, Homo sapiens
gtgacgctgctga

SEQ ID NO: 5631434 - DNA, 16 bp, Homo sapiens
gtgacgggagcctcct

SEQ ID NO: 5631435 - DNA, 19 bp, Homo sapiens
gtgacgggggttggggtgg

SEQ ID NO: 5631436 - DNA, 21 bp, Homo sapiens
gtgacgggggttggggtgggg

SEQ ID NO: 5631437 - DNA, 23 bp, Homo sapiens
gtgacggggtgtgtggcccgagg

SEQ ID NO: 5631438 - DNA, 14 bp, Homo sapiens
gtgacgtcacagac

SEQ ID NO: 5631439 - DNA, 17 bp, Homo sapiens
gtgacgtgagtggggag

SEQ ID NO: 5631440 - DNA, 23 bp, Homo sapiens
gtgactaactagacaccaaagtt

SEQ ID NO: 5631441 - DNA, 23 bp, Homo sapiens
gtgactaattgtataacaggtta

SEQ ID NO: 5631442 - DNA, 22 bp, Homo sapiens
gtgactaccacttatttctaaa

SEQ ID NO: 5631443 - DNA, 20 bp, Homo sapiens
gtgactaccgtgccagcagc

SEQ ID NO: 5631444 - DNA, 11 bp, Homo sapiens
gtgactagtgc

SEQ ID NO: 5631445 - DNA, 12 bp, Homo sapiens
gtgactataaag

SEQ ID NO: 5631446 - DNA, 17 bp, Homo sapiens
gtgactataaagctgtt

SEQ ID NO: 5631447 - DNA, 17 bp, Homo sapiens
gtgactatatagagatg

SEQ ID NO: 5631448 - DNA, 13 bp, Homo sapiens
gtgactatctccc

SEQ ID NO: 5631449 - DNA, 14 bp, Homo sapiens
gtgactatgaactt

SEQ ID NO: 5631450 - DNA, 12 bp, Homo sapiens
gtgactattaaa

SEQ ID NO: 5631451 - DNA, 22 bp, Homo sapiens
gtgactattctcatctctgttt

SEQ ID NO: 5631452 - DNA, 16 bp, Homo sapiens
gtgactcagcagaggc

SEQ ID NO: 5631453 - DNA, 17 bp, Homo sapiens
gtgactcagtgtatttt

SEQ ID NO: 5631454 - DNA, 19 bp, Homo sapiens
gtgactccaggagaggagc

SEQ ID NO: 5631455 - DNA, 22 bp, Homo sapiens
gtgactcctgaaacctcttcct

SEQ ID NO: 5631456 - DNA, 14 bp, Homo sapiens
gtgactcctgctgg

SEQ ID NO: 5631457 - DNA, 16 bp, Homo sapiens
gtgactcctgctggta

SEQ ID NO: 5631458 - DNA, 20 bp, Homo sapiens
gtgactcctgctggtacctg

SEQ ID NO: 5631459 - DNA, 22 bp, Homo sapiens
gtgactcctgctggtacctgcc

SEQ ID NO: 5631460 - DNA, 17 bp, Homo sapiens
gtgactcgagtgtttaa

SEQ ID NO: 5631461 - DNA, 14 bp, Homo sapiens
gtgactcgggagct

SEQ ID NO: 5631462 - DNA, 19 bp, Homo sapiens
gtgactcgggggctgtctc

SEQ ID NO: 5631463 - DNA, 20 bp, Homo sapiens
gtgactcggtgtaaaaccat

SEQ ID NO: 5631464 - DNA, 19 bp, Homo sapiens
gtgactctaagctcagtgc

SEQ ID NO: 5631465 - DNA, 16 bp, Homo sapiens
gtgactctggctgcca

SEQ ID NO: 5631466 - DNA, 14 bp, Homo sapiens
gtgactctgggcag

SEQ ID NO: 5631467 - DNA, 12 bp, Homo sapiens
gtgactctttcc

SEQ ID NO: 5631468 - DNA, 19 bp, Homo sapiens
gtgactgaaacaaaatgtt

SEQ ID NO: 5631469 - DNA, 14 bp, Homo sapiens
gtgactgaaaccat

SEQ ID NO: 5631470 - DNA, 15 bp, Homo sapiens
gtgactgaagaagat

SEQ ID NO: 5631471 - DNA, 15 bp, Homo sapiens
gtgactgaatttctt

SEQ ID NO: 5631472 - DNA, 16 bp, Homo sapiens
gtgactgacggctgtg

SEQ ID NO: 5631473 - DNA, 14 bp, Homo sapiens
gtgactgagggcct

SEQ ID NO: 5631474 - DNA, 22 bp, Homo sapiens
gtgactgcaagcatttttccat

SEQ ID NO: 5631475 - DNA, 18 bp, Homo sapiens
gtgactgcatcatatatt

SEQ ID NO: 5631476 - DNA, 16 bp, Homo sapiens
gtgactgccaccgtgc

SEQ ID NO: 5631477 - DNA, 16 bp, Homo sapiens
gtgactgccaggataa

SEQ ID NO: 5631478 - DNA, 20 bp, Homo sapiens
gtgactgccccaactcctgg

SEQ ID NO: 5631479 - DNA, 17 bp, Homo sapiens
gtgactgcgatcttcag

SEQ ID NO: 5631480 - DNA, 23 bp, Homo sapiens
gtgactgctgccatttttgcaaa

SEQ ID NO: 5631481 - DNA, 12 bp, Homo sapiens
gtgatgtatttt

SEQ ID NO: 5631482 - DNA, 16 bp, Homo sapiens
gtgatgtcatacagag

SEQ ID NO: 5631483 - DNA, 18 bp, Homo sapiens
gtgatgtcatacagagaa

SEQ ID NO: 5631484 - DNA, 20 bp, Homo sapiens
gtgatgtcatacagagaagt

SEQ ID NO: 5631485 - DNA, 14 bp, Homo sapiens
gtgatgtcatctgt

SEQ ID NO: 5631486 - DNA, 12 bp, Homo sapiens
gtgatgtcatga

SEQ ID NO: 5631487 - DNA, 15 bp, Homo sapiens
gtgatgtcatgaaac

SEQ ID NO: 5631488 - DNA, 14 bp, Homo sapiens
gtgatgtcatttga

SEQ ID NO: 5631489 - DNA, 15 bp, Homo sapiens
gtgatgtcctgtaaa

SEQ ID NO: 5631490 - DNA, 20 bp, Homo sapiens
gtgatgtccttaaaatgtgg

SEQ ID NO: 5631491 - DNA, 13 bp, Homo sapiens
gtgatgtgacatt

SEQ ID NO: 5631492 - DNA, 21 bp, Homo sapiens
gtgatgtgcaaggaaaataat

SEQ ID NO: 5631493 - DNA, 12 bp, Homo sapiens
gtgatgtgccac

SEQ ID NO: 5631494 - DNA, 10 bp, Homo sapiens
gtgatgtgga

SEQ ID NO: 5631495 - DNA, 14 bp, Homo sapiens
gtgatgtggaggaa

SEQ ID NO: 5631496 - DNA, 12 bp, Homo sapiens
gtgatgtgttcg

SEQ ID NO: 5631497 - DNA, 22 bp, Homo sapiens
gtgatgttctaaggctctgaga

SEQ ID NO: 5631498 - DNA, 16 bp, Homo sapiens
gtgatgtttccagctg

SEQ ID NO: 5631499 - DNA, 14 bp, Homo sapiens
gtgattaaacgtgc

SEQ ID NO: 5631500 - DNA, 13 bp, Homo sapiens
gtgattaaatctc

SEQ ID NO: 5631501 - DNA, 13 bp, Homo sapiens
gtgattaatatgc

SEQ ID NO: 5631502 - DNA, 14 bp, Homo sapiens
gtgattaatgtttt

SEQ ID NO: 5631503 - DNA, 17 bp, Homo sapiens
gtgattaccggcatttt

SEQ ID NO: 5631504 - DNA, 14 bp, Homo sapiens
gtgattagatcaca

SEQ ID NO: 5631505 - DNA, 18 bp, Homo sapiens
gtgattatttttctcctg

SEQ ID NO: 5631506 - DNA, 18 bp, Homo sapiens
gtgattcaaatgcaaaat

SEQ ID NO: 5631507 - DNA, 21 bp, Homo sapiens
gtgattcaatctgtaaactgt

SEQ ID NO: 5631508 - DNA, 16 bp, Homo sapiens
gtgattcactgtgctt

SEQ ID NO: 5631509 - DNA, 21 bp, Homo sapiens
gtgattcagaaaatgttctgt

SEQ ID NO: 5631510 - DNA, 15 bp, Homo sapiens
gtgattcattgtttg

SEQ ID NO: 5631511 - DNA, 20 bp, Homo sapiens
gtgattcccaactcctttct

SEQ ID NO: 5631512 - DNA, 17 bp, Homo sapiens
gtgattccccggagctg

SEQ ID NO: 5631513 - DNA, 15 bp, Homo sapiens
gtgattccgcagtga

SEQ ID NO: 5631514 - DNA, 22 bp, Homo sapiens
gtgattccttcttgctcagtcc

SEQ ID NO: 5631515 - DNA, 22 bp, Homo sapiens
gtgattccttttgatggggaga

SEQ ID NO: 5631516 - DNA, 16 bp, Homo sapiens
gtgattctcagggctg

SEQ ID NO: 5631517 - DNA, 14 bp, Homo sapiens
gtgattctcctgcc

SEQ ID NO: 5631518 - DNA, 15 bp, Homo sapiens
gtgattctctcttct

SEQ ID NO: 5631519 - DNA, 18 bp, Homo sapiens
gtgattctctcttctctc

SEQ ID NO: 5631520 - DNA, 13 bp, Homo sapiens
gtgattctgcctt

SEQ ID NO: 5631521 - DNA, 22 bp, Homo sapiens
gtgattctggaagcaaatggca

SEQ ID NO: 5631522 - DNA, 13 bp, Homo sapiens
gtgattctgggat

SEQ ID NO: 5631523 - DNA, 13 bp, Homo sapiens
gtgattctgtccc

SEQ ID NO: 5631524 - DNA, 18 bp, Homo sapiens
gtgattgacacacagcac

SEQ ID NO: 5631525 - DNA, 20 bp, Homo sapiens
gtgattgacattttgtagct

SEQ ID NO: 5631526 - DNA, 13 bp, Homo sapiens
gtgattgaccctt

SEQ ID NO: 5631527 - DNA, 19 bp, Homo sapiens
gtgattgattcagtatctt

SEQ ID NO: 5631528 - DNA, 22 bp, Homo sapiens
gtgattgcagctttatgttcat

SEQ ID NO: 5631529 - DNA, 22 bp, Homo sapiens
gtgattgccatttcttcccaag

SEQ ID NO: 5631530 - DNA, 16 bp, Homo sapiens
gtgattgcctcaataa

SEQ ID NO: 5631531 - DNA, 20 bp, Homo sapiens
gtgattgcctcaataaagct

SEQ ID NO: 5631532 - DNA, 15 bp, Homo sapiens
gtgattgctgccagg

SEQ ID NO: 5631533 - DNA, 17 bp, Homo sapiens
gtgattgggaataaata

SEQ ID NO: 5631534 - DNA, 12 bp, Homo sapiens
gtgattgtgaag

SEQ ID NO: 5631535 - DNA, 13 bp, Homo sapiens
gtgattgtgtctg

SEQ ID NO: 5631536 - DNA, 19 bp, Homo sapiens
gtgattgttccataataaa

SEQ ID NO: 5631537 - DNA, 20 bp, Homo sapiens
gtgatttaatagtgttaatc

SEQ ID NO: 5631538 - DNA, 16 bp, Homo sapiens
gtgatttaatccagtt

SEQ ID NO: 5631539 - DNA, 18 bp, Homo sapiens
gtgatttacgctcattgt

SEQ ID NO: 5631540 - DNA, 18 bp, Homo sapiens
gtgatttagaactgtatg

SEQ ID NO: 5631541 - DNA, 17 bp, Homo sapiens
gtgatttatgcatttat

SEQ ID NO: 5631542 - DNA, 14 bp, Homo sapiens
gtgatttatttgga

SEQ ID NO: 5631543 - DNA, 15 bp, Homo sapiens
gtgatttatttggag

SEQ ID NO: 5631544 - DNA, 20 bp, Homo sapiens
gtgatttcccgtggccccag

SEQ ID NO: 5631545 - DNA, 12 bp, Homo sapiens
gtgatttctgag

SEQ ID NO: 5631546 - DNA, 12 bp, Homo sapiens
gtgatttctggc

SEQ ID NO: 5631547 - DNA, 22 bp, Homo sapiens
gtgatttgaaaaatataaaatt

SEQ ID NO: 5631548 - DNA, 15 bp, Homo sapiens
gtgatttgaaggtct

SEQ ID NO: 5631549 - DNA, 14 bp, Homo sapiens
gtgatttgaattct

SEQ ID NO: 5631550 - DNA, 16 bp, Homo sapiens
gtgatttgaattctgt

SEQ ID NO: 5631551 - DNA, 16 bp, Homo sapiens
gtgatttgcctgcctg

SEQ ID NO: 5631552 - DNA, 23 bp, Homo sapiens
gtgatttggaagagaggcacctg

SEQ ID NO: 5631553 - DNA, 14 bp, Homo sapiens
gtgatttggttgca

SEQ ID NO: 5631554 - DNA, 20 bp, Homo sapiens
gtgatttgtcttcccttctt

SEQ ID NO: 5631555 - DNA, 14 bp, Homo sapiens
gtgattttaactct

SEQ ID NO: 5631556 - DNA, 16 bp, Homo sapiens
gtgattttaactctgt

SEQ ID NO: 5631557 - DNA, 16 bp, Homo sapiens
gtgattttgccctcct

SEQ ID NO: 5631558 - DNA, 20 bp, Homo sapiens
gtgattttgccctcctgccc

SEQ ID NO: 5631559 - DNA, 16 bp, Homo sapiens
gtgattttgtacagaa

SEQ ID NO: 5631560 - DNA, 17 bp, Homo sapiens
gtgattttgtacagaat

SEQ ID NO: 5631561 - DNA, 19 bp, Homo sapiens
gtgatttttaaattaaata

SEQ ID NO: 5631562 - DNA, 16 bp, Homo sapiens
gtgatttttatcacaa

SEQ ID NO: 5631563 - DNA, 19 bp, Homo sapiens
gtgatttttatgccacctg

SEQ ID NO: 5631564 - DNA, 21 bp, Homo sapiens
gtgatttttatgccacctgaa

SEQ ID NO: 5631565 - DNA, 14 bp, Homo sapiens
gtgatttttgtaat

SEQ ID NO: 5631566 - DNA, 21 bp, Homo sapiens
gtgattttttgttcttgttgt

SEQ ID NO: 5631567 - DNA, 17 bp, Homo sapiens
gtgatttttttatataa

SEQ ID NO: 5631568 - DNA, 14 bp, Homo sapiens
gtgatttttttctt

SEQ ID NO: 5631569 - DNA, 16 bp, Homo sapiens
gtgcaaaaactgtaaa

SEQ ID NO: 5631570 - DNA, 20 bp, Homo sapiens
gtgcaaaaataaaatggaca

SEQ ID NO: 5631571 - DNA, 14 bp, Homo sapiens
gtgcaaaaattttt

SEQ ID NO: 5631572 - DNA, 17 bp, Homo sapiens
gtgcaaaaccttttact

SEQ ID NO: 5631573 - DNA, 21 bp, Homo sapiens
gtgcaaaactgtgtcacagtt

SEQ ID NO: 5631574 - DNA, 19 bp, Homo sapiens
gtgcaaaagcttcaaatta

SEQ ID NO: 5631575 - DNA, 16 bp, Homo sapiens
gtgcaaaataaaatga

SEQ ID NO: 5631576 - DNA, 12 bp, Homo sapiens
gtgcaaaatatt

SEQ ID NO: 5631577 - DNA, 14 bp, Homo sapiens
gtgcaaaatggtca

SEQ ID NO: 5631578 - DNA, 13 bp, Homo sapiens
gtgcaaaatgtct

SEQ ID NO: 5631579 - DNA, 18 bp, Homo sapiens
gtgcaaacaacctgaatc

SEQ ID NO: 5631580 - DNA, 19 bp, Homo sapiens
gtgcaaacaacctgaatct

SEQ ID NO: 5631581 - DNA, 14 bp, Homo sapiens
gtgcaaacacagca

SEQ ID NO: 5631582 - DNA, 17 bp, Homo sapiens
gtgcaaacagaagtgca

SEQ ID NO: 5631583 - DNA, 21 bp, Homo sapiens
gtgcaaaccacttctccatgc

SEQ ID NO: 5631584 - DNA, 19 bp, Homo sapiens
gtgcaaacccactcagaga

SEQ ID NO: 5631585 - DNA, 14 bp, Homo sapiens
gtgcaaagactctg

SEQ ID NO: 5631586 - DNA, 19 bp, Homo sapiens
gtgcaaagactctgagcca

SEQ ID NO: 5631587 - DNA, 10 bp, Homo sapiens
gtgcaaagct

SEQ ID NO: 5631588 - DNA, 16 bp, Homo sapiens
gtgcaaagctgcttga

SEQ ID NO: 5631589 - DNA, 11 bp, Homo sapiens
gtgcaaagtga

SEQ ID NO: 5631590 - DNA, 13 bp, Homo sapiens
gtgcaaagtgact

SEQ ID NO: 5631591 - DNA, 22 bp, Homo sapiens
gtgcaaagttccctacttcctg

SEQ ID NO: 5631592 - DNA, 22 bp, Homo sapiens
gtgcaaatactccaagcttcaa

SEQ ID NO: 5631593 - DNA, 23 bp, Homo sapiens
gtgcaaatgtcagatacaatgta

SEQ ID NO: 5631594 - DNA, 16 bp, Homo sapiens
gtgcaaattcattttt

SEQ ID NO: 5631595 - DNA, 12 bp, Homo sapiens
gtgcaaattgta

SEQ ID NO: 5631596 - DNA, 18 bp, Homo sapiens
gtgcaaattgtcacagga

SEQ ID NO: 5631597 - DNA, 13 bp, Homo sapiens
gtgcaacagacaa

SEQ ID NO: 5631598 - DNA, 12 bp, Homo sapiens
gtgcaacagcac

SEQ ID NO: 5631599 - DNA, 20 bp, Homo sapiens
gtgcaacagcactggctctc

SEQ ID NO: 5631600 - DNA, 16 bp, Homo sapiens
gtgcaacatctctgaa

SEQ ID NO: 5631601 - DNA, 17 bp, Homo sapiens
gtgcaacatctctgaat

SEQ ID NO: 5631602 - DNA, 22 bp, Homo sapiens
gtgcaacatttctgtatactgt

SEQ ID NO: 5631603 - DNA, 13 bp, Homo sapiens
gtgcaaccaggga

SEQ ID NO: 5631604 - DNA, 23 bp, Homo sapiens
gtgcaacccttaccccttagcct

SEQ ID NO: 5631605 - DNA, 17 bp, Homo sapiens
gtgcaacctctgcttcc

SEQ ID NO: 5631606 - DNA, 21 bp, Homo sapiens
gtgcaacctctgcttcccagg

SEQ ID NO: 5631607 - DNA, 24 bp, Homo sapiens
gtgcaacctgtggctcaggggagc

SEQ ID NO: 5631608 - DNA, 16 bp, Homo sapiens
gtgcaacgccgtgggc

SEQ ID NO: 5631609 - DNA, 18 bp, Homo sapiens
gtgcaacggccagggttg

SEQ ID NO: 5631610 - DNA, 14 bp, Homo sapiens
gtgcaactcttgta

SEQ ID NO: 5631611 - DNA, 15 bp, Homo sapiens
gtgcaactcttgtat

SEQ ID NO: 5631612 - DNA, 14 bp, Homo sapiens
gtgcaactggccag

SEQ ID NO: 5631613 - DNA, 17 bp, Homo sapiens
gtgcaagacctagtccc

SEQ ID NO: 5631614 - DNA, 19 bp, Homo sapiens
gtgcaagactgaattaatg

SEQ ID NO: 5631615 - DNA, 14 bp, Homo sapiens
gtgcaagagacaga

SEQ ID NO: 5631616 - DNA, 17 bp, Homo sapiens
gtgcaagagacagagcc

SEQ ID NO: 5631617 - DNA, 22 bp, Homo sapiens
gtgcaagagactctggcctcca

SEQ ID NO: 5631618 - DNA, 12 bp, Homo sapiens
gtgcaagagagg

SEQ ID NO: 5631619 - DNA, 15 bp, Homo sapiens
gtgcaagagcctgag

SEQ ID NO: 5631620 - DNA, 15 bp, Homo sapiens
gtgcaagcaaagaac

SEQ ID NO: 5631621 - DNA, 15 bp, Homo sapiens
gtgcaagcccctgct

SEQ ID NO: 5631622 - DNA, 14 bp, Homo sapiens
gtgcaaggcagccg

SEQ ID NO: 5631623 - DNA, 16 bp, Homo sapiens
gtgcaaggtggccttt

SEQ ID NO: 5631624 - DNA, 16 bp, Homo sapiens
gtgcaataaaataaca

SEQ ID NO: 5631625 - DNA, 21 bp, Homo sapiens
gtgcaataaatctgacccagt

SEQ ID NO: 5631626 - DNA, 15 bp, Homo sapiens
gtgcaataatttgta

SEQ ID NO: 5631627 - DNA, 23 bp, Homo sapiens
gtgcaataatttgtacaatggtt

SEQ ID NO: 5631628 - DNA, 14 bp, Homo sapiens
gtgcaatacatttt

SEQ ID NO: 5631629 - DNA, 12 bp, Homo sapiens
gtgcaatagaag

SEQ ID NO: 5631630 - DNA, 21 bp, Homo sapiens
gtgcaataggtgagagaatgt

SEQ ID NO: 5631631 - DNA, 15 bp, Homo sapiens
gtgcaatatattttg

SEQ ID NO: 5631632 - DNA, 16 bp, Homo sapiens
gtgcaatatattttgt

SEQ ID NO: 5631633 - DNA, 23 bp, Homo sapiens
gtgcaatatattttgtatgcaag

SEQ ID NO: 5631634 - DNA, 16 bp, Homo sapiens
gtgcaatatgagggga

SEQ ID NO: 5631635 - DNA, 22 bp, Homo sapiens
gtgcaatgccccctcccctcct

SEQ ID NO: 5631636 - DNA, 23 bp, Homo sapiens
gtgcaatgcttgtagaagtagga

SEQ ID NO: 5631637 - DNA, 19 bp, Homo sapiens
gtgcaatgggggagggagg

SEQ ID NO: 5631638 - DNA, 17 bp, Homo sapiens
gtgcaatgggtaaggga

SEQ ID NO: 5631639 - DNA, 17 bp, Homo sapiens
gtgcaatgtaaatattt

SEQ ID NO: 5631640 - DNA, 22 bp, Homo sapiens
gtgcaatgtaaatattttaaag

SEQ ID NO: 5631641 - DNA, 16 bp, Homo sapiens
gtgcaattaacatatg

SEQ ID NO: 5631642 - DNA, 15 bp, Homo sapiens
gtgcaattatttctt

SEQ ID NO: 5631643 - DNA, 20 bp, Homo sapiens
gtgcaatttcaaggttctaa

SEQ ID NO: 5631644 - DNA, 16 bp, Homo sapiens
gtgcaatttcccctct

SEQ ID NO: 5631645 - DNA, 22 bp, Homo sapiens
gtgcaatttcccctctgtgtcc

SEQ ID NO: 5631646 - DNA, 23 bp, Homo sapiens
gtgcaatttcccctctgtgtcct

SEQ ID NO: 5631647 - DNA, 15 bp, Homo sapiens
gtgcaatttcttctg

SEQ ID NO: 5631648 - DNA, 16 bp, Homo sapiens
gtgcaatttcttctgt

SEQ ID NO: 5631649 - DNA, 20 bp, Homo sapiens
gtgcaatttgtttgtgcttc

SEQ ID NO: 5631650 - DNA, 23 bp, Homo sapiens
gtgcaatttgtttgtgcttctaa

SEQ ID NO: 5631651 - DNA, 17 bp, Homo sapiens
gtgcacaaaccttcttt

SEQ ID NO: 5631652 - DNA, 20 bp, Homo sapiens
gtgcacaaatatttattttc

SEQ ID NO: 5631653 - DNA, 12 bp, Homo sapiens
gtgcacacacca

SEQ ID NO: 5631654 - DNA, 14 bp, Homo sapiens
gtgcacacaccaga

SEQ ID NO: 5631655 - DNA, 15 bp, Homo sapiens
gtgcacacacctgca

SEQ ID NO: 5631656 - DNA, 20 bp, Homo sapiens
gtgcacacacctgcacaccc

SEQ ID NO: 5631657 - DNA, 21 bp, Homo sapiens
gtgcacacagaaatatatata

SEQ ID NO: 5631658 - DNA, 22 bp, Homo sapiens
gtgcacacagaaatatatatac

SEQ ID NO: 5631659 - DNA, 23 bp, Homo sapiens
gtgcacacagaaatatatataca

SEQ ID NO: 5631660 - DNA, 18 bp, Homo sapiens
gtgcacacatcaccaggt

SEQ ID NO: 5631661 - DNA, 12 bp, Homo sapiens
gtgccctcacca

SEQ ID NO: 5631662 - DNA, 23 bp, Homo sapiens
gtgccctcaccccaatccctgcc

SEQ ID NO: 5631663 - DNA, 18 bp, Homo sapiens
gtgccctccactgccctc

SEQ ID NO: 5631664 - DNA, 23 bp, Homo sapiens
gtgccctcctgagggaggacctg

SEQ ID NO: 5631665 - DNA, 15 bp, Homo sapiens
gtgccctctcactga

SEQ ID NO: 5631666 - DNA, 17 bp, Homo sapiens
gtgccctctcccaccct

SEQ ID NO: 5631667 - DNA, 18 bp, Homo sapiens
gtgccctctcccaccctc

SEQ ID NO: 5631668 - DNA, 20 bp, Homo sapiens
gtgccctctcccaccctctt

SEQ ID NO: 5631669 - DNA, 21 bp, Homo sapiens
gtgccctctcccaccctcttc

SEQ ID NO: 5631670 - DNA, 20 bp, Homo sapiens
gtgccctctggacagcttga

SEQ ID NO: 5631671 - DNA, 19 bp, Homo sapiens
gtgccctctggatcctgct

SEQ ID NO: 5631672 - DNA, 15 bp, Homo sapiens
gtgccctctgggctc

SEQ ID NO: 5631673 - DNA, 16 bp, Homo sapiens
gtgccctctgggctct

SEQ ID NO: 5631674 - DNA, 18 bp, Homo sapiens
gtgccctgaaagggccct

SEQ ID NO: 5631675 - DNA, 15 bp, Homo sapiens
gtgccctgcaggcac

SEQ ID NO: 5631676 - DNA, 21 bp, Homo sapiens
gtgccctgcaggcacagagga

SEQ ID NO: 5631677 - DNA, 12 bp, Homo sapiens
gtgccctgcccc

SEQ ID NO: 5631678 - DNA, 14 bp, Homo sapiens
gtgccctgccccca

SEQ ID NO: 5631679 - DNA, 19 bp, Homo sapiens
gtgccctgccccctggctg

SEQ ID NO: 5631680 - DNA, 20 bp, Homo sapiens
gtgccctgccccctggctga

SEQ ID NO: 5631681 - DNA, 10 bp, Homo sapiens
gtgccctggc

SEQ ID NO: 5631682 - DNA, 12 bp, Homo sapiens
gtgccctggctc

SEQ ID NO: 5631683 - DNA, 17 bp, Homo sapiens
gtgccctggctccttgc

SEQ ID NO: 5631684 - DNA, 12 bp, Homo sapiens
gtgccctgggcc

SEQ ID NO: 5631685 - DNA, 17 bp, Homo sapiens
gtgccctgggccaggca

SEQ ID NO: 5631686 - DNA, 20 bp, Homo sapiens
gtgccctgggccaggcaggc

SEQ ID NO: 5631687 - DNA, 22 bp, Homo sapiens
gtgccctggtgaatcacctggc

SEQ ID NO: 5631688 - DNA, 13 bp, Homo sapiens
gtgccctgtagct

SEQ ID NO: 5631689 - DNA, 17 bp, Homo sapiens
gtgccctgtagctcctt

SEQ ID NO: 5631690 - DNA, 23 bp, Homo sapiens
gtgccctgtggtagttggaaaca

SEQ ID NO: 5631691 - DNA, 22 bp, Homo sapiens
gtgccctgttgacctaccctgg

SEQ ID NO: 5631692 - DNA, 15 bp, Homo sapiens
gtgcccttccctgga

SEQ ID NO: 5631693 - DNA, 18 bp, Homo sapiens
gtgccctttcctggcagt

SEQ ID NO: 5631694 - DNA, 20 bp, Homo sapiens
gtgccctttctcttaccact

SEQ ID NO: 5631695 - DNA, 21 bp, Homo sapiens
gtgccctttggggttgcccag

SEQ ID NO: 5631696 - DNA, 17 bp, Homo sapiens
gtgccgaatgactatgt

SEQ ID NO: 5631697 - DNA, 19 bp, Homo sapiens
gtgccgaatgactatgtcc

SEQ ID NO: 5631698 - DNA, 22 bp, Homo sapiens
gtgccgagaaggaagcctccca

SEQ ID NO: 5631699 - DNA, 13 bp, Homo sapiens
gtgccgagccctt

SEQ ID NO: 5631700 - DNA, 19 bp, Homo sapiens
gtgccgaggcttgggctcc

SEQ ID NO: 5631701 - DNA, 18 bp, Homo sapiens
gtgccgccgcctcgccca

SEQ ID NO: 5631702 - DNA, 13 bp, Homo sapiens
gtgccgcctgccc

SEQ ID NO: 5631703 - DNA, 23 bp, Homo sapiens
gtgccgcctgcccgtctctctcc

SEQ ID NO: 5631704 - DNA, 16 bp, Homo sapiens
gtgccgcctgctcctc

SEQ ID NO: 5631705 - DNA, 21 bp, Homo sapiens
gtgccgcctgctcctcactgg

SEQ ID NO: 5631706 - DNA, 13 bp, Homo sapiens
gtgccgcgctccg

SEQ ID NO: 5631707 - DNA, 19 bp, Homo sapiens
gtgccggaaagagagctgg

SEQ ID NO: 5631708 - DNA, 15 bp, Homo sapiens
gtgccggcatctccc

SEQ ID NO: 5631709 - DNA, 20 bp, Homo sapiens
gtgccggcatctcccctagc

SEQ ID NO: 5631710 - DNA, 14 bp, Homo sapiens
gtgccggctgtgga

SEQ ID NO: 5631711 - DNA, 20 bp, Homo sapiens
gtgccgggaggcagccacag

SEQ ID NO: 5631712 - DNA, 22 bp, Homo sapiens
gtgccgtggagcttggagcccc

SEQ ID NO: 5631713 - DNA, 23 bp, Homo sapiens
gtgccgtgtcccctgacagggcc

SEQ ID NO: 5631714 - DNA, 13 bp, Homo sapiens
gtgccgtgtgagt

SEQ ID NO: 5631715 - DNA, 21 bp, Homo sapiens
gtgccgtgtgagtgtgacagg

SEQ ID NO: 5631716 - DNA, 20 bp, Homo sapiens
gtgccgtgtgttgcatgcag

SEQ ID NO: 5631717 - DNA, 12 bp, Homo sapiens
gtgcctaaaata

SEQ ID NO: 5631718 - DNA, 17 bp, Homo sapiens
gtgcctaacctgggacc

SEQ ID NO: 5631719 - DNA, 20 bp, Homo sapiens
gtgcctaactccttacagaa

SEQ ID NO: 5631720 - DNA, 22 bp, Homo sapiens
gtgcctaagaagttattttctt

SEQ ID NO: 5631721 - DNA, 17 bp, Homo sapiens
gtgcctaatggagaaga

SEQ ID NO: 5631722 - DNA, 15 bp, Homo sapiens
gtgcctaatgtgttt

SEQ ID NO: 5631723 - DNA, 14 bp, Homo sapiens
gtgcctagaaagca

SEQ ID NO: 5631724 - DNA, 16 bp, Homo sapiens
gtgcctagaaagcaat

SEQ ID NO: 5631725 - DNA, 18 bp, Homo sapiens
gtgcctagactgttactt

SEQ ID NO: 5631726 - DNA, 15 bp, Homo sapiens
gtgcctaggcctggg

SEQ ID NO: 5631727 - DNA, 18 bp, Homo sapiens
gtgcctaggcctgggcag

SEQ ID NO: 5631728 - DNA, 22 bp, Homo sapiens
gtgcctaggttggtttcccctg

SEQ ID NO: 5631729 - DNA, 20 bp, Homo sapiens
gtgcctagtattgacaaaat

SEQ ID NO: 5631730 - DNA, 18 bp, Homo sapiens
gtgcctatatctgagaga

SEQ ID NO: 5631731 - DNA, 23 bp, Homo sapiens
gtgcctatattaaaggtatacaa

SEQ ID NO: 5631732 - DNA, 20 bp, Homo sapiens
gtgcctattgctagagctcc

SEQ ID NO: 5631733 - DNA, 21 bp, Homo sapiens
gtgcctattgctagagctcct

SEQ ID NO: 5631734 - DNA, 16 bp, Homo sapiens
gtgcctatttattcat

SEQ ID NO: 5631735 - DNA, 16 bp, Homo sapiens
gtgcctcactgggggc

SEQ ID NO: 5631736 - DNA, 13 bp, Homo sapiens
gtgcctcagactc

SEQ ID NO: 5631737 - DNA, 20 bp, Homo sapiens
gtgcctcagagaccagggct

SEQ ID NO: 5631738 - DNA, 20 bp, Homo sapiens
gtgcctcagagcaggctcag

SEQ ID NO: 5631739 - DNA, 19 bp, Homo sapiens
gtgcctcagcctcctaagc

SEQ ID NO: 5631740 - DNA, 20 bp, Homo sapiens
gtgcctcagcgctgcccaca

SEQ ID NO: 5631741 - DNA, 21 bp, Homo sapiens
gtgcctcagcgctgcccacac

SEQ ID NO: 5631742 - DNA, 19 bp, Homo sapiens
gtgcctcagttttccttct

SEQ ID NO: 5631743 - DNA, 20 bp, Homo sapiens
gtgcctccaagcggccctgt

SEQ ID NO: 5631744 - DNA, 23 bp, Homo sapiens
gtgcctccacatgctgcctggca

SEQ ID NO: 5631745 - DNA, 15 bp, Homo sapiens
gtgcctccaccacca

SEQ ID NO: 5631746 - DNA, 23 bp, Homo sapiens
gtgcctccaccaccactggccac

SEQ ID NO: 5631747 - DNA, 15 bp, Homo sapiens
gtgcctccaggacca

SEQ ID NO: 5631748 - DNA, 16 bp, Homo sapiens
gtgcctccaggaccag

SEQ ID NO: 5631749 - DNA, 20 bp, Homo sapiens
gtgcctcccacacttgctgg

SEQ ID NO: 5631750 - DNA, 13 bp, Homo sapiens
gtgcctcccagct

SEQ ID NO: 5631751 - DNA, 24 bp, Homo sapiens
gtgcctcccagtggcctggcttgt

SEQ ID NO: 5631752 - DNA, 16 bp, Homo sapiens
gtgcctccccccagac

SEQ ID NO: 5631753 - DNA, 21 bp, Homo sapiens
gtgcctccccccagaccccgc

SEQ ID NO: 5631754 - DNA, 12 bp, Homo sapiens
gtgcctcccccg

SEQ ID NO: 5631755 - DNA, 17 bp, Homo sapiens
gtgcctcccgagaaatt

SEQ ID NO: 5631756 - DNA, 17 bp, Homo sapiens
gtgcctccctctcctcg

SEQ ID NO: 5631757 - DNA, 14 bp, Homo sapiens
gtgcctcccttccc

SEQ ID NO: 5631758 - DNA, 17 bp, Homo sapiens
gtgcctcccttcccagt

SEQ ID NO: 5631759 - DNA, 20 bp, Homo sapiens
gtgcctcctcagaggacagt

SEQ ID NO: 5631760 - DNA, 14 bp, Homo sapiens
gtgcctcctgtctt

SEQ ID NO: 5631761 - DNA, 14 bp, Homo sapiens
gtgcctcctgtgtg

SEQ ID NO: 5631762 - DNA, 21 bp, Homo sapiens
gtgcctccttggtaaatacaa

SEQ ID NO: 5631763 - DNA, 15 bp, Homo sapiens
gtgcctcgaggcacc

SEQ ID NO: 5631764 - DNA, 15 bp, Homo sapiens
gtgcctcgcatccta

SEQ ID NO: 5631765 - DNA, 19 bp, Homo sapiens
gtgcctcgctccccactct

SEQ ID NO: 5631766 - DNA, 20 bp, Homo sapiens
gtgcctcgctccccactctg

SEQ ID NO: 5631767 - DNA, 21 bp, Homo sapiens
gtgcctcgctccccactctgc

SEQ ID NO: 5631768 - DNA, 15 bp, Homo sapiens
gtgcctctagctgaa

SEQ ID NO: 5631769 - DNA, 16 bp, Homo sapiens
gtgcctctcccatggc

SEQ ID NO: 5631770 - DNA, 23 bp, Homo sapiens
gtgcctctccctgctgctcctag

SEQ ID NO: 5631771 - DNA, 23 bp, Homo sapiens
gtgcctctctctcccaactgctg

SEQ ID NO: 5631772 - DNA, 16 bp, Homo sapiens
gtgcctctgcagtact

SEQ ID NO: 5631773 - DNA, 20 bp, Homo sapiens
gtgcctctgtcctagactcc

SEQ ID NO: 5631774 - DNA, 14 bp, Homo sapiens
gtgcctctgtgcac

SEQ ID NO: 5631775 - DNA, 21 bp, Homo sapiens
gtgcctctgtgcacagtggct

SEQ ID NO: 5631776 - DNA, 20 bp, Homo sapiens
gtgcctcttctttttcttct

SEQ ID NO: 5631777 - DNA, 15 bp, Homo sapiens
gtgcctcttgggaga

SEQ ID NO: 5631778 - DNA, 15 bp, Homo sapiens
gtgcctgaagacccc

SEQ ID NO: 5631779 - DNA, 18 bp, Homo sapiens
gtgcctgactctgtgctg

SEQ ID NO: 5631780 - DNA, 16 bp, Homo sapiens
gtgcctgactgcccag

SEQ ID NO: 5631781 - DNA, 17 bp, Homo sapiens
gtgcctgagaccagggt

SEQ ID NO: 5631782 - DNA, 15 bp, Homo sapiens
gtgcctgagaggcag

SEQ ID NO: 5631783 - DNA, 21 bp, Homo sapiens
gtgcctgagcccgaatttctc

SEQ ID NO: 5631784 - DNA, 13 bp, Homo sapiens
gtgcctgagctgg

SEQ ID NO: 5631785 - DNA, 16 bp, Homo sapiens
gtgcctgaggctggct

SEQ ID NO: 5631786 - DNA, 21 bp, Homo sapiens
gtgcctgatgggagtaggctc

SEQ ID NO: 5631787 - DNA, 17 bp, Homo sapiens
gtgcctgcacatcatga

SEQ ID NO: 5631788 - DNA, 14 bp, Homo sapiens
gtgcctgcaccagg

SEQ ID NO: 5631789 - DNA, 15 bp, Homo sapiens
gtgcctgcaccagga

SEQ ID NO: 5631790 - DNA, 18 bp, Homo sapiens
gtgcctgcaccaggagac

SEQ ID NO: 5631791 - DNA, 15 bp, Homo sapiens
gtgcctgcagcgcct

SEQ ID NO: 5631792 - DNA, 20 bp, Homo sapiens
gtgcctgccatagccaggag

SEQ ID NO: 5631793 - DNA, 14 bp, Homo sapiens
gtgcctgctagagc

SEQ ID NO: 5631794 - DNA, 19 bp, Homo sapiens
gtgcctgctagagcaaccc

SEQ ID NO: 5631795 - DNA, 16 bp, Homo sapiens
gtgcctgctatccagc

SEQ ID NO: 5631796 - DNA, 17 bp, Homo sapiens
gtgcctgctatccagcc

SEQ ID NO: 5631797 - DNA, 20 bp, Homo sapiens
gtgcctgctatccagccgca

SEQ ID NO: 5631798 - DNA, 14 bp, Homo sapiens
gtgcctgctcagca

SEQ ID NO: 5631799 - DNA, 17 bp, Homo sapiens
gtgcctgctcagcagcc

SEQ ID NO: 5631800 - DNA, 18 bp, Homo sapiens
gtgcctgctcagcagcca

SEQ ID NO: 5631801 - DNA, 15 bp, Homo sapiens
gtgcctgctcaggtg

SEQ ID NO: 5631802 - DNA, 17 bp, Homo sapiens
gtgcctgctcaggtgct

SEQ ID NO: 5631803 - DNA, 14 bp, Homo sapiens
gtgcctgctgggca

SEQ ID NO: 5631804 - DNA, 15 bp, Homo sapiens
gtgcctgctgggcac

SEQ ID NO: 5631805 - DNA, 17 bp, Homo sapiens
gtgcctgctgggcactg

SEQ ID NO: 5631806 - DNA, 20 bp, Homo sapiens
gtgcctgctgggcactgggc

SEQ ID NO: 5631807 - DNA, 18 bp, Homo sapiens
gtgcctgctgggtgccag

SEQ ID NO: 5631808 - DNA, 19 bp, Homo sapiens
gtgcctgctgggtgccagg

SEQ ID NO: 5631809 - DNA, 12 bp, Homo sapiens
gtgcctgcttca

SEQ ID NO: 5631810 - DNA, 21 bp, Homo sapiens
gtgcctgcttcagcctcccac

SEQ ID NO: 5631811 - DNA, 23 bp, Homo sapiens
gtgcctgcttcagcctcccacag

SEQ ID NO: 5631812 - DNA, 22 bp, Homo sapiens
gtgcctgctttgacgggccagg

SEQ ID NO: 5631813 - DNA, 23 bp, Homo sapiens
gtgcctgctttgacgggccaggc

SEQ ID NO: 5631814 - DNA, 12 bp, Homo sapiens
gtgcctggagct

SEQ ID NO: 5631815 - DNA, 19 bp, Homo sapiens
gtgcctggagctcctggga

SEQ ID NO: 5631816 - DNA, 15 bp, Homo sapiens
gtgcctggcacagcc

SEQ ID NO: 5631817 - DNA, 21 bp, Homo sapiens
gtgcctggcccattcttgagt

SEQ ID NO: 5631818 - DNA, 16 bp, Homo sapiens
gtgcctggccccagcc

SEQ ID NO: 5631819 - DNA, 17 bp, Homo sapiens
gtgcctggccccagcct

SEQ ID NO: 5631820 - DNA, 15 bp, Homo sapiens
gtgcctggcctggca

SEQ ID NO: 5631821 - DNA, 14 bp, Homo sapiens
gtgcctggctccct

SEQ ID NO: 5631822 - DNA, 14 bp, Homo sapiens
gtgcctggctgggc

SEQ ID NO: 5631823 - DNA, 15 bp, Homo sapiens
gtgcctggctgggct

SEQ ID NO: 5631824 - DNA, 13 bp, Homo sapiens
gtgcctggcttgc

SEQ ID NO: 5631825 - DNA, 18 bp, Homo sapiens
gtgcctgggaagcccacc

SEQ ID NO: 5631826 - DNA, 16 bp, Homo sapiens
gtgcctgggaatgtat

SEQ ID NO: 5631827 - DNA, 17 bp, Homo sapiens
gtgcctgggaatgtatt

SEQ ID NO: 5631828 - DNA, 11 bp, Homo sapiens
gtgcctgggag

SEQ ID NO: 5631829 - DNA, 12 bp, Homo sapiens
gtgcctgggaga

SEQ ID NO: 5631830 - DNA, 23 bp, Homo sapiens
gtgcctgggaggagtggccctga

SEQ ID NO: 5631831 - DNA, 19 bp, Homo sapiens
gtgcctgggatcagtgggg

SEQ ID NO: 5631832 - DNA, 21 bp, Homo sapiens
gtgcctgggatcgtgcatttg

SEQ ID NO: 5631833 - DNA, 15 bp, Homo sapiens
gtgcctgggattcta

SEQ ID NO: 5631834 - DNA, 19 bp, Homo sapiens
gtgcctgggtggccatcct

SEQ ID NO: 5631835 - DNA, 17 bp, Homo sapiens
gtgcctgggtggggctg

SEQ ID NO: 5631836 - DNA, 21 bp, Homo sapiens
gtgcctgggtggggctgctcc

SEQ ID NO: 5631837 - DNA, 23 bp, Homo sapiens
gtgcctgggtggggctgctcctc

SEQ ID NO: 5631838 - DNA, 13 bp, Homo sapiens
gtgcttgctgtgt

SEQ ID NO: 5631839 - DNA, 14 bp, Homo sapiens
gtgcttgctgtgtg

SEQ ID NO: 5631840 - DNA, 21 bp, Homo sapiens
gtgcttgcttagagtgcccag

SEQ ID NO: 5631841 - DNA, 23 bp, Homo sapiens
gtgcttgcttagagtgcccagca

SEQ ID NO: 5631842 - DNA, 12 bp, Homo sapiens
gtgcttggagga

SEQ ID NO: 5631843 - DNA, 17 bp, Homo sapiens
gtgcttggaggcctcag

SEQ ID NO: 5631844 - DNA, 11 bp, Homo sapiens
gtgcttggatt

SEQ ID NO: 5631845 - DNA, 14 bp, Homo sapiens
gtgcttggccagga

SEQ ID NO: 5631846 - DNA, 24 bp, Homo sapiens
gtgcttggcccaggagtttggcca

SEQ ID NO: 5631847 - DNA, 15 bp, Homo sapiens
gtgcttggctgcccc

SEQ ID NO: 5631848 - DNA, 16 bp, Homo sapiens
gtgcttgggctccacg

SEQ ID NO: 5631849 - DNA, 18 bp, Homo sapiens
gtgcttggttgaaaagat

SEQ ID NO: 5631850 - DNA, 19 bp, Homo sapiens
gtgcttgtgtgtatgtcta

SEQ ID NO: 5631851 - DNA, 17 bp, Homo sapiens
gtgcttgttagagagaa

SEQ ID NO: 5631852 - DNA, 20 bp, Homo sapiens
gtgcttgttagagagaaaga

SEQ ID NO: 5631853 - DNA, 21 bp, Homo sapiens
gtgcttgttagagagaaagag

SEQ ID NO: 5631854 - DNA, 20 bp, Homo sapiens
gtgcttgttatgtctagaaa

SEQ ID NO: 5631855 - DNA, 20 bp, Homo sapiens
gtgcttgttccctctccctg

SEQ ID NO: 5631856 - DNA, 22 bp, Homo sapiens
gtgcttgtttgctcacctgggg

SEQ ID NO: 5631857 - DNA, 13 bp, Homo sapiens
gtgctttatattt

SEQ ID NO: 5631858 - DNA, 14 bp, Homo sapiens
gtgctttatgctga

SEQ ID NO: 5631859 - DNA, 11 bp, Homo sapiens
gtgctttattt

SEQ ID NO: 5631860 - DNA, 13 bp, Homo sapiens
gtgctttcatgtt

SEQ ID NO: 5631861 - DNA, 23 bp, Homo sapiens
gtgctttcatgtttaagaaatga

SEQ ID NO: 5631862 - DNA, 20 bp, Homo sapiens
gtgctttccagctcaccccc

SEQ ID NO: 5631863 - DNA, 20 bp, Homo sapiens
gtgctttccattcgtgaaaa

SEQ ID NO: 5631864 - DNA, 19 bp, Homo sapiens
gtgctttccttttttaaaa

SEQ ID NO: 5631865 - DNA, 20 bp, Homo sapiens
gtgctttccttttttaaaaa

SEQ ID NO: 5631866 - DNA, 19 bp, Homo sapiens
gtgctttctatctaatttt

SEQ ID NO: 5631867 - DNA, 20 bp, Homo sapiens
gtgctttctatctaattttt

SEQ ID NO: 5631868 - DNA, 12 bp, Homo sapiens
gtgctttctatt

SEQ ID NO: 5631869 - DNA, 13 bp, Homo sapiens
gtgctttctattg

SEQ ID NO: 5631870 - DNA, 19 bp, Homo sapiens
gtgctttctattgtacaga

SEQ ID NO: 5631871 - DNA, 20 bp, Homo sapiens
gtgctttctattgtacagaa

SEQ ID NO: 5631872 - DNA, 22 bp, Homo sapiens
gtgctttctattgtacagaagc

SEQ ID NO: 5631873 - DNA, 12 bp, Homo sapiens
gtgctttctcaa

SEQ ID NO: 5631874 - DNA, 12 bp, Homo sapiens
gtgctttctgca

SEQ ID NO: 5631875 - DNA, 14 bp, Homo sapiens
gtgctttgagaaaa

SEQ ID NO: 5631876 - DNA, 17 bp, Homo sapiens
gtgctttgagagagaaa

SEQ ID NO: 5631877 - DNA, 13 bp, Homo sapiens
gtgctttgcattt

SEQ ID NO: 5631878 - DNA, 11 bp, Homo sapiens
gtgctttgccc

SEQ ID NO: 5631879 - DNA, 12 bp, Homo sapiens
gtgctttggaac

SEQ ID NO: 5631880 - DNA, 21 bp, Homo sapiens
gtgctttggaacaatcacagg

SEQ ID NO: 5631881 - DNA, 16 bp, Homo sapiens
gtgctttgtggcttct

SEQ ID NO: 5631882 - DNA, 12 bp, Homo sapiens
gtgctttgtgtc

SEQ ID NO: 5631883 - DNA, 19 bp, Homo sapiens
gtgcttttaaaaattttgt

SEQ ID NO: 5631884 - DNA, 15 bp, Homo sapiens
gtgcttttaaatgca

SEQ ID NO: 5631885 - DNA, 15 bp, Homo sapiens
gtgcttttagtaaaa

SEQ ID NO: 5631886 - DNA, 14 bp, Homo sapiens
gtgcttttatttag

SEQ ID NO: 5631887 - DNA, 16 bp, Homo sapiens
gtgcttttgcaaaaga

SEQ ID NO: 5631888 - DNA, 15 bp, Homo sapiens
gtgcttttggcagag

SEQ ID NO: 5631889 - DNA, 23 bp, Homo sapiens
gtgcttttggcggggaggaggaa

SEQ ID NO: 5631890 - DNA, 13 bp, Homo sapiens
gtgctttttcctt

SEQ ID NO: 5631891 - DNA, 14 bp, Homo sapiens
gtgctttttgtcat

SEQ ID NO: 5631892 - DNA, 15 bp, Homo sapiens
gtggaaaaaagagaa

SEQ ID NO: 5631893 - DNA, 17 bp, Homo sapiens
gtggaaaaaagagaaaa

SEQ ID NO: 5631894 - DNA, 17 bp, Homo sapiens
gtggaaaaagaaattct

SEQ ID NO: 5631895 - DNA, 23 bp, Homo sapiens
gtggaaaaatgcccatttttgct

SEQ ID NO: 5631896 - DNA, 22 bp, Homo sapiens
gtggaaaacaatttgcataata

SEQ ID NO: 5631897 - DNA, 14 bp, Homo sapiens
gtggaaaataactc

SEQ ID NO: 5631898 - DNA, 12 bp, Homo sapiens
gtggaaactgtc

SEQ ID NO: 5631899 - DNA, 22 bp, Homo sapiens
gtggaaagataataaattgatt

SEQ ID NO: 5631900 - DNA, 18 bp, Homo sapiens
gtggaaagattgtgtctg

SEQ ID NO: 5631901 - DNA, 14 bp, Homo sapiens
gtggaaagcacttt

SEQ ID NO: 5631902 - DNA, 17 bp, Homo sapiens
gtggaaagtagctgcta

SEQ ID NO: 5631903 - DNA, 21 bp, Homo sapiens
gtggaaagtgtaaagcattcc

SEQ ID NO: 5631904 - DNA, 16 bp, Homo sapiens
gtggaaagtgttcatt

SEQ ID NO: 5631905 - DNA, 16 bp, Homo sapiens
gtggaaataatttgaa

SEQ ID NO: 5631906 - DNA, 22 bp, Homo sapiens
gtggaaatatgcaacctgtgca

SEQ ID NO: 5631907 - DNA, 11 bp, Homo sapiens
gtggaaatcct

SEQ ID NO: 5631908 - DNA, 23 bp, Homo sapiens
gtggaaatggcccatttaatgat

SEQ ID NO: 5631909 - DNA, 16 bp, Homo sapiens
gtggaaatggggaact

SEQ ID NO: 5631910 - DNA, 17 bp, Homo sapiens
gtggaaattaagaagaa

SEQ ID NO: 5631911 - DNA, 20 bp, Homo sapiens
gtggaaattaagactttatg

SEQ ID NO: 5631912 - DNA, 17 bp, Homo sapiens
gtggaaattcatgagag

SEQ ID NO: 5631913 - DNA, 20 bp, Homo sapiens
gtggaacaggaggaactggt

SEQ ID NO: 5631914 - DNA, 22 bp, Homo sapiens
gtggaacagtcacccttctggg

SEQ ID NO: 5631915 - DNA, 19 bp, Homo sapiens
gtggaacataaaaaggaca

SEQ ID NO: 5631916 - DNA, 20 bp, Homo sapiens
gtggaacataaaaaggacat

SEQ ID NO: 5631917 - DNA, 18 bp, Homo sapiens
gtggaagaagggagaaga

SEQ ID NO: 5631918 - DNA, 20 bp, Homo sapiens
gtggaagaagggagaagaaa

SEQ ID NO: 5631919 - DNA, 20 bp, Homo sapiens
gtggaagaagggccaccctg

SEQ ID NO: 5631920 - DNA, 20 bp, Homo sapiens
gtggaagacaatactccctt

SEQ ID NO: 5631921 - DNA, 21 bp, Homo sapiens
gtggaagacagagatggcaga

SEQ ID NO: 5631922 - DNA, 19 bp, Homo sapiens
gtggaagagagattgggac

SEQ ID NO: 5631923 - DNA, 14 bp, Homo sapiens
gtggaagagcagcc

SEQ ID NO: 5631924 - DNA, 15 bp, Homo sapiens
gtggaagaggggaca

SEQ ID NO: 5631925 - DNA, 13 bp, Homo sapiens
gtggaagcaacca

SEQ ID NO: 5631926 - DNA, 13 bp, Homo sapiens
gtggaagcagagg

SEQ ID NO: 5631927 - DNA, 22 bp, Homo sapiens
gtggaagcagaggccctgcccc

SEQ ID NO: 5631928 - DNA, 24 bp, Homo sapiens
gtggaagcagaggccctgccccca

SEQ ID NO: 5631929 - DNA, 15 bp, Homo sapiens
gtggaagccactgga

SEQ ID NO: 5631930 - DNA, 17 bp, Homo sapiens
gtggaagccctccttcc

SEQ ID NO: 5631931 - DNA, 14 bp, Homo sapiens
gtggaagcttgggg

SEQ ID NO: 5631932 - DNA, 16 bp, Homo sapiens
gtggaagcttggggaa

SEQ ID NO: 5631933 - DNA, 13 bp, Homo sapiens
gtggaaggagaaa

SEQ ID NO: 5631934 - DNA, 12 bp, Homo sapiens
gtggaaggagcc

SEQ ID NO: 5631935 - DNA, 14 bp, Homo sapiens
gtggaaggcctccc

SEQ ID NO: 5631936 - DNA, 17 bp, Homo sapiens
gtggaagggcaggagct

SEQ ID NO: 5631937 - DNA, 14 bp, Homo sapiens
gtggaagggctggg

SEQ ID NO: 5631938 - DNA, 16 bp, Homo sapiens
gtggaagggctgggtg

SEQ ID NO: 5631939 - DNA, 14 bp, Homo sapiens
gtggaagggggagg

SEQ ID NO: 5631940 - DNA, 16 bp, Homo sapiens
gtggaagggggtgtgc

SEQ ID NO: 5631941 - DNA, 19 bp, Homo sapiens
gtggaaggtgtcaatttgg

SEQ ID NO: 5631942 - DNA, 15 bp, Homo sapiens
gtggaagtcagtacg

SEQ ID NO: 5631943 - DNA, 15 bp, Homo sapiens
gtggaagtgtgggtc

SEQ ID NO: 5631944 - DNA, 22 bp, Homo sapiens
gtggaagtgtgggtctgtgtgt

SEQ ID NO: 5631945 - DNA, 15 bp, Homo sapiens
gtggaagttcttcaa

SEQ ID NO: 5631946 - DNA, 23 bp, Homo sapiens
gtggaataaacattaattttgtg

SEQ ID NO: 5631947 - DNA, 14 bp, Homo sapiens
gtggaataaagatg

SEQ ID NO: 5631948 - DNA, 21 bp, Homo sapiens
gtggaatagtatcctccaggt

SEQ ID NO: 5631949 - DNA, 18 bp, Homo sapiens
gtggaatgcagtcctcat

SEQ ID NO: 5631950 - DNA, 18 bp, Homo sapiens
gtggaatgcgggggagca

SEQ ID NO: 5631951 - DNA, 19 bp, Homo sapiens
gtggaatgcgggggagcag

SEQ ID NO: 5631952 - DNA, 22 bp, Homo sapiens
gtggaatgcgggggagcaggca

SEQ ID NO: 5631953 - DNA, 23 bp, Homo sapiens
gtggaatgtcgcagactcctcca

SEQ ID NO: 5631954 - DNA, 16 bp, Homo sapiens
gtggaatgttggataa

SEQ ID NO: 5631955 - DNA, 20 bp, Homo sapiens
gtggaatgttggataaggaa

SEQ ID NO: 5631956 - DNA, 23 bp, Homo sapiens
gtggaattacctgataagggaga

SEQ ID NO: 5631957 - DNA, 12 bp, Homo sapiens
gtggaattagag

SEQ ID NO: 5631958 - DNA, 16 bp, Homo sapiens
gtggaattattttaaa

SEQ ID NO: 5631959 - DNA, 18 bp, Homo sapiens
gtggaattccaacttgaa

SEQ ID NO: 5631960 - DNA, 21 bp, Homo sapiens
gtggacaagtcatggacattc

SEQ ID NO: 5631961 - DNA, 22 bp, Homo sapiens
gtggacacagatcccactggaa

SEQ ID NO: 5631962 - DNA, 15 bp, Homo sapiens
gtggacacagctctt

SEQ ID NO: 5631963 - DNA, 17 bp, Homo sapiens
gtggacacagctcttct

SEQ ID NO: 5631964 - DNA, 23 bp, Homo sapiens
gtggacacagctcttctccaggc

SEQ ID NO: 5631965 - DNA, 24 bp, Homo sapiens
gtggacacagctcttctccaggct

SEQ ID NO: 5631966 - DNA, 21 bp, Homo sapiens
gtggacaccactgagctctgc

SEQ ID NO: 5631967 - DNA, 13 bp, Homo sapiens
gtggacacctgcc

SEQ ID NO: 5631968 - DNA, 14 bp, Homo sapiens
gtggacacctgccc

SEQ ID NO: 5631969 - DNA, 16 bp, Homo sapiens
gtggacacctgccctg

SEQ ID NO: 5631970 - DNA, 17 bp, Homo sapiens
gtggacacctgccctgc

SEQ ID NO: 5631971 - DNA, 19 bp, Homo sapiens
gtggacagacccagggtgg

SEQ ID NO: 5631972 - DNA, 19 bp, Homo sapiens
gtggacagcccgggagctt

SEQ ID NO: 5631973 - DNA, 17 bp, Homo sapiens
gtggacagccggagcag

SEQ ID NO: 5631974 - DNA, 18 bp, Homo sapiens
gtggacaggatgaggaca

SEQ ID NO: 5631975 - DNA, 12 bp, Homo sapiens
gtggacaggccc

SEQ ID NO: 5631976 - DNA, 23 bp, Homo sapiens
gtggacaggcccagcgcggccag

SEQ ID NO: 5631977 - DNA, 13 bp, Homo sapiens
gtggacagggccc

SEQ ID NO: 5631978 - DNA, 13 bp, Homo sapiens
gtggacagtcctg

SEQ ID NO: 5631979 - DNA, 16 bp, Homo sapiens
gtggacagtcctggga

SEQ ID NO: 5631980 - DNA, 21 bp, Homo sapiens
gtggacagtgctgttgaagat

SEQ ID NO: 5631981 - DNA, 17 bp, Homo sapiens
gtggacatatgtatact

SEQ ID NO: 5631982 - DNA, 18 bp, Homo sapiens
gtggacatcgtaggcagc

SEQ ID NO: 5631983 - DNA, 17 bp, Homo sapiens
gtggacatgcataaaaa

SEQ ID NO: 5631984 - DNA, 17 bp, Homo sapiens
gtggaccaatgcatctc

SEQ ID NO: 5631985 - DNA, 19 bp, Homo sapiens
gtggaccaatgcatctctt

SEQ ID NO: 5631986 - DNA, 13 bp, Homo sapiens
gtggaccacgacc

SEQ ID NO: 5631987 - DNA, 15 bp, Homo sapiens
gtggaccacgacctc

SEQ ID NO: 5631988 - DNA, 21 bp, Homo sapiens
gtggaccacgccgccctccat

SEQ ID NO: 5631989 - DNA, 18 bp, Homo sapiens
gtggaccaggacaggacc

SEQ ID NO: 5631990 - DNA, 16 bp, Homo sapiens
gtggaccatggagtgg

SEQ ID NO: 5631991 - DNA, 21 bp, Homo sapiens
gtggaccatggagtggcagcc

SEQ ID NO: 5631992 - DNA, 13 bp, Homo sapiens
gtggacccagctg

SEQ ID NO: 5631993 - DNA, 22 bp, Homo sapiens
gtggacccagggatgacatgtc

SEQ ID NO: 5631994 - DNA, 17 bp, Homo sapiens
gtggaccccgcctgccc

SEQ ID NO: 5631995 - DNA, 19 bp, Homo sapiens
gtggacccgcccgcggccc

SEQ ID NO: 5631996 - DNA, 20 bp, Homo sapiens
gtggacccgcccgcggccct

SEQ ID NO: 5631997 - DNA, 22 bp, Homo sapiens
gtggaccctggaccattccagg

SEQ ID NO: 5631998 - DNA, 22 bp, Homo sapiens
gtggaccctgtcttctgggcac

SEQ ID NO: 5631999 - DNA, 14 bp, Homo sapiens
gtggaccctgtggc

SEQ ID NO: 5632000 - DNA, 17 bp, Homo sapiens
gtggaccctgtggccag

SEQ ID NO: 5632001 - DNA, 17 bp, Homo sapiens
gtggaccggccgcagcc

SEQ ID NO: 5632002 - DNA, 18 bp, Homo sapiens
gtggaccggccgcagccc

SEQ ID NO: 5632003 - DNA, 16 bp, Homo sapiens
gtggacctagcctgga

SEQ ID NO: 5632004 - DNA, 22 bp, Homo sapiens
gtggacctagcctggatggccc

SEQ ID NO: 5632005 - DNA, 19 bp, Homo sapiens
gtggacctctactttccag

SEQ ID NO: 5632006 - DNA, 14 bp, Homo sapiens
gtggacctgaagga

SEQ ID NO: 5632007 - DNA, 13 bp, Homo sapiens
gtggacctggcag

SEQ ID NO: 5632008 - DNA, 17 bp, Homo sapiens
gtggaccttaggccttc

SEQ ID NO: 5632009 - DNA, 18 bp, Homo sapiens
gtggaccttaggccttcc

SEQ ID NO: 5632010 - DNA, 13 bp, Homo sapiens
gtggaccttcctg

SEQ ID NO: 5632011 - DNA, 14 bp, Homo sapiens
gtggacgagagggc

SEQ ID NO: 5632012 - DNA, 17 bp, Homo sapiens
gtggacgctgcagaccc

SEQ ID NO: 5632013 - DNA, 14 bp, Homo sapiens
gtggacgctgtcca

SEQ ID NO: 5632014 - DNA, 18 bp, Homo sapiens
gtggacggggaggctctc

SEQ ID NO: 5632015 - DNA, 15 bp, Homo sapiens
gtggacgtagagttg

SEQ ID NO: 5632016 - DNA, 17 bp, Homo sapiens
gtggccacagcgccagc

SEQ ID NO: 5632017 - DNA, 18 bp, Homo sapiens
gtggccacagcgtgctgg

SEQ ID NO: 5632018 - DNA, 22 bp, Homo sapiens
gtggccaccgggggtggctctg

SEQ ID NO: 5632019 - DNA, 14 bp, Homo sapiens
gtggccacggccac

SEQ ID NO: 5632020 - DNA, 22 bp, Homo sapiens
gtggccacgggggcagtgtgag

SEQ ID NO: 5632021 - DNA, 21 bp, Homo sapiens
gtggccactccagacccctgg

SEQ ID NO: 5632022 - DNA, 17 bp, Homo sapiens
gtggccactcctgggcc

SEQ ID NO: 5632023 - DNA, 20 bp, Homo sapiens
gtggccactgagctggctga

SEQ ID NO: 5632024 - DNA, 23 bp, Homo sapiens
gtggccactggcacttgcctgct

SEQ ID NO: 5632025 - DNA, 17 bp, Homo sapiens
gtggccacttcattcca

SEQ ID NO: 5632026 - DNA, 21 bp, Homo sapiens
gtggccacttcattccagcag

SEQ ID NO: 5632027 - DNA, 22 bp, Homo sapiens
gtggccacttcattccagcagc

SEQ ID NO: 5632028 - DNA, 18 bp, Homo sapiens
gtggccagaccagagctc

SEQ ID NO: 5632029 - DNA, 15 bp, Homo sapiens
gtggccagagctgga

SEQ ID NO: 5632030 - DNA, 22 bp, Homo sapiens
gtggccagagctggaaggcagg

SEQ ID NO: 5632031 - DNA, 23 bp, Homo sapiens
gtggccagagctgggaggcatgg

SEQ ID NO: 5632032 - DNA, 18 bp, Homo sapiens
gtggccagcagcctctga

SEQ ID NO: 5632033 - DNA, 11 bp, Homo sapiens
gtggccagccc

SEQ ID NO: 5632034 - DNA, 15 bp, Homo sapiens
gtggccagcccggct

SEQ ID NO: 5632035 - DNA, 18 bp, Homo sapiens
gtggccagcctggcatca

SEQ ID NO: 5632036 - DNA, 21 bp, Homo sapiens
gtggccagcctggcatcagtt

SEQ ID NO: 5632037 - DNA, 18 bp, Homo sapiens
gtggccagcgccagggcc

SEQ ID NO: 5632038 - DNA, 19 bp, Homo sapiens
gtggccagcgccagggccc

SEQ ID NO: 5632039 - DNA, 15 bp, Homo sapiens
gtggccaggagccct

SEQ ID NO: 5632040 - DNA, 16 bp, Homo sapiens
gtggccaggagccctg

SEQ ID NO: 5632041 - DNA, 23 bp, Homo sapiens
gtggccaggccgggaaaaagccc

SEQ ID NO: 5632042 - DNA, 13 bp, Homo sapiens
gtggccaggcctt

SEQ ID NO: 5632043 - DNA, 21 bp, Homo sapiens
gtggccaggctgcctggcctt

SEQ ID NO: 5632044 - DNA, 15 bp, Homo sapiens
gtggccaggctggta

SEQ ID NO: 5632045 - DNA, 19 bp, Homo sapiens
gtggccagggcttccccat

SEQ ID NO: 5632046 - DNA, 13 bp, Homo sapiens
gtggccaggggtg

SEQ ID NO: 5632047 - DNA, 19 bp, Homo sapiens
gtggccaggggtgctcctg

SEQ ID NO: 5632048 - DNA, 20 bp, Homo sapiens
gtggccaggggtgctcctgt

SEQ ID NO: 5632049 - DNA, 21 bp, Homo sapiens
gtggccatatatgctgtattt

SEQ ID NO: 5632050 - DNA, 20 bp, Homo sapiens
gtggccatcactcagcccct

SEQ ID NO: 5632051 - DNA, 18 bp, Homo sapiens
gtggccatcagggtgggc

SEQ ID NO: 5632052 - DNA, 20 bp, Homo sapiens
gtggccatcatcctcccgcc

SEQ ID NO: 5632053 - DNA, 16 bp, Homo sapiens
gtggccatcatttctg

SEQ ID NO: 5632054 - DNA, 14 bp, Homo sapiens
gtggccatccctgg

SEQ ID NO: 5632055 - DNA, 21 bp, Homo sapiens
gtggccatccctgggcccctc

SEQ ID NO: 5632056 - DNA, 18 bp, Homo sapiens
gtggccatgaccctgcct

SEQ ID NO: 5632057 - DNA, 13 bp, Homo sapiens
gtggccatgctcc

SEQ ID NO: 5632058 - DNA, 18 bp, Homo sapiens
gtggccatgctcctcttc

SEQ ID NO: 5632059 - DNA, 17 bp, Homo sapiens
gtggccatgcttcttgc

SEQ ID NO: 5632060 - DNA, 19 bp, Homo sapiens
gtggccatgttatgctggt

SEQ ID NO: 5632061 - DNA, 13 bp, Homo sapiens
gtggcccagagcc

SEQ ID NO: 5632062 - DNA, 20 bp, Homo sapiens
gtggcccagcacgagcctgg

SEQ ID NO: 5632063 - DNA, 14 bp, Homo sapiens
gtggcccaggcccc

SEQ ID NO: 5632064 - DNA, 21 bp, Homo sapiens
gtggcccatcccccctcacca

SEQ ID NO: 5632065 - DNA, 18 bp, Homo sapiens
gtggccccaccctgggcc

SEQ ID NO: 5632066 - DNA, 22 bp, Homo sapiens
gtggccccacctggccctctct

SEQ ID NO: 5632067 - DNA, 16 bp, Homo sapiens
gtggccccagcctggc

SEQ ID NO: 5632068 - DNA, 18 bp, Homo sapiens
gtggccccagcctggccc

SEQ ID NO: 5632069 - DNA, 19 bp, Homo sapiens
gtggccccagcctggccca

SEQ ID NO: 5632070 - DNA, 21 bp, Homo sapiens
gtggccccagcctggcccagc

SEQ ID NO: 5632071 - DNA, 16 bp, Homo sapiens
gtggccccaggtgcca

SEQ ID NO: 5632072 - DNA, 20 bp, Homo sapiens
gtggccccatattaacaaat

SEQ ID NO: 5632073 - DNA, 19 bp, Homo sapiens
gtggcccccgggcctgcac

SEQ ID NO: 5632074 - DNA, 14 bp, Homo sapiens
gtggccccctgtcc

SEQ ID NO: 5632075 - DNA, 16 bp, Homo sapiens
gtggccccctgtgcca

SEQ ID NO: 5632076 - DNA, 19 bp, Homo sapiens
gtggccccctgtgccagct

SEQ ID NO: 5632077 - DNA, 21 bp, Homo sapiens
gtggccccgcccgagcccctg

SEQ ID NO: 5632078 - DNA, 12 bp, Homo sapiens
gtggcccctcct

SEQ ID NO: 5632079 - DNA, 17 bp, Homo sapiens
gtggcccctccttctcc

SEQ ID NO: 5632080 - DNA, 20 bp, Homo sapiens
gtggccccttctatgcccag

SEQ ID NO: 5632081 - DNA, 22 bp, Homo sapiens
gtggccccttctatgcccagct

SEQ ID NO: 5632082 - DNA, 17 bp, Homo sapiens
gtggcccgacagcctgg

SEQ ID NO: 5632083 - DNA, 18 bp, Homo sapiens
gtggcccgacagcctggc

SEQ ID NO: 5632084 - DNA, 19 bp, Homo sapiens
gtggcccgacagcctggca

SEQ ID NO: 5632085 - DNA, 15 bp, Homo sapiens
gtggcccgtggcctg

SEQ ID NO: 5632086 - DNA, 17 bp, Homo sapiens
gtggccctcaggcccac

SEQ ID NO: 5632087 - DNA, 15 bp, Homo sapiens
gtggccctcccaggc

SEQ ID NO: 5632088 - DNA, 14 bp, Homo sapiens
gtggccctccctca

SEQ ID NO: 5632089 - DNA, 16 bp, Homo sapiens
gtggccctccctcagc

SEQ ID NO: 5632090 - DNA, 22 bp, Homo sapiens
gtggccctgaacctcattctgg

SEQ ID NO: 5632091 - DNA, 17 bp, Homo sapiens
gtggccctgatccagga

SEQ ID NO: 5632092 - DNA, 16 bp, Homo sapiens
gtggccctgcaagggc

SEQ ID NO: 5632093 - DNA, 22 bp, Homo sapiens
gtggccctgccatcttcccagc

SEQ ID NO: 5632094 - DNA, 17 bp, Homo sapiens
gtggccctgccctctcc

SEQ ID NO: 5632095 - DNA, 21 bp, Homo sapiens
gtggccctgcccttggcacca

SEQ ID NO: 5632096 - DNA, 15 bp, Homo sapiens
gtggccctggacaag

SEQ ID NO: 5632097 - DNA, 18 bp, Homo sapiens
gtggccctggacacagcc

SEQ ID NO: 5632098 - DNA, 13 bp, Homo sapiens
gtggccctggcat

SEQ ID NO: 5632099 - DNA, 16 bp, Homo sapiens
gtggccctggcctgct

SEQ ID NO: 5632100 - DNA, 12 bp, Homo sapiens
gtggccctgggg

SEQ ID NO: 5632101 - DNA, 23 bp, Homo sapiens
gtggccctggggaagaggccttg

SEQ ID NO: 5632102 - DNA, 17 bp, Homo sapiens
gtggccctgtccctccc

SEQ ID NO: 5632103 - DNA, 13 bp, Homo sapiens
gtggccctgtggg

SEQ ID NO: 5632104 - DNA, 16 bp, Homo sapiens
gtggcccttcctggac

SEQ ID NO: 5632105 - DNA, 18 bp, Homo sapiens
gtggcccttcctggacag

SEQ ID NO: 5632106 - DNA, 20 bp, Homo sapiens
gtggcccttgtttacagtga

SEQ ID NO: 5632107 - DNA, 18 bp, Homo sapiens
gtggccgaaccagaacca

SEQ ID NO: 5632108 - DNA, 19 bp, Homo sapiens
gtggccgcaagcgcaggga

SEQ ID NO: 5632109 - DNA, 20 bp, Homo sapiens
gtggccgcaagcgcagggag

SEQ ID NO: 5632110 - DNA, 21 bp, Homo sapiens
gtggccgcaagcgcagggagg

SEQ ID NO: 5632111 - DNA, 14 bp, Homo sapiens
gtggccgccatctg

SEQ ID NO: 5632112 - DNA, 14 bp, Homo sapiens
gtggccgccatgct

SEQ ID NO: 5632113 - DNA, 14 bp, Homo sapiens
gtggccgctcctcc

SEQ ID NO: 5632114 - DNA, 15 bp, Homo sapiens
gtggccgctcctccc

SEQ ID NO: 5632115 - DNA, 12 bp, Homo sapiens
gtggccggccct

SEQ ID NO: 5632116 - DNA, 13 bp, Homo sapiens
gtggccggccctg

SEQ ID NO: 5632117 - DNA, 14 bp, Homo sapiens
gtggccggggaagc

SEQ ID NO: 5632118 - DNA, 13 bp, Homo sapiens
gtggccggggctg

SEQ ID NO: 5632119 - DNA, 16 bp, Homo sapiens
gtggccggggctgaag

SEQ ID NO: 5632120 - DNA, 18 bp, Homo sapiens
gtggccggggctgaagcc

SEQ ID NO: 5632121 - DNA, 23 bp, Homo sapiens
gtggccggggctgaagccacaca

SEQ ID NO: 5632122 - DNA, 15 bp, Homo sapiens
gtggccggtgccagc

SEQ ID NO: 5632123 - DNA, 21 bp, Homo sapiens
gtggccggtgccagctgccct

SEQ ID NO: 5632124 - DNA, 23 bp, Homo sapiens
gtggccggtggttttgtgcttta

SEQ ID NO: 5632125 - DNA, 18 bp, Homo sapiens
gtggccgtcacgctttca

SEQ ID NO: 5632126 - DNA, 13 bp, Homo sapiens
gtggccgtctcct

SEQ ID NO: 5632127 - DNA, 21 bp, Homo sapiens
gtggcctaacctgccgagagt

SEQ ID NO: 5632128 - DNA, 22 bp, Homo sapiens
gtggcctaacctgccgagagtc

SEQ ID NO: 5632129 - DNA, 19 bp, Homo sapiens
gtggcctaccttgtgaggg

SEQ ID NO: 5632130 - DNA, 20 bp, Homo sapiens
gtggcctaccttgtgaggga

SEQ ID NO: 5632131 - DNA, 22 bp, Homo sapiens
gtggcctatttcagctgctttg

SEQ ID NO: 5632132 - DNA, 20 bp, Homo sapiens
gtggcctcaaccctccctca

SEQ ID NO: 5632133 - DNA, 19 bp, Homo sapiens
gtggcctcacttccctggg

SEQ ID NO: 5632134 - DNA, 11 bp, Homo sapiens
gtggcctcagc

SEQ ID NO: 5632135 - DNA, 12 bp, Homo sapiens
gtggcctcagca

SEQ ID NO: 5632136 - DNA, 13 bp, Homo sapiens
gtggcctcagccc

SEQ ID NO: 5632137 - DNA, 14 bp, Homo sapiens
gtggcctcagccct

SEQ ID NO: 5632138 - DNA, 14 bp, Homo sapiens
gtggcctcccaact

SEQ ID NO: 5632139 - DNA, 15 bp, Homo sapiens
gtggcctcccaactc

SEQ ID NO: 5632140 - DNA, 21 bp, Homo sapiens
gtggcctcccaactcacccca

SEQ ID NO: 5632141 - DNA, 22 bp, Homo sapiens
gtggcctcccaactcaccccag

SEQ ID NO: 5632142 - DNA, 14 bp, Homo sapiens
gtggcctccctgct

SEQ ID NO: 5632143 - DNA, 19 bp, Homo sapiens
gtggcctccctgctgtgcc

SEQ ID NO: 5632144 - DNA, 21 bp, Homo sapiens
gtggcctccctggctcctccg

SEQ ID NO: 5632145 - DNA, 18 bp, Homo sapiens
gtggcctccgcagtgtct

SEQ ID NO: 5632146 - DNA, 14 bp, Homo sapiens
gtggcctcctggcc

SEQ ID NO: 5632147 - DNA, 12 bp, Homo sapiens
gtggcctctcag

SEQ ID NO: 5632148 - DNA, 13 bp, Homo sapiens
gtggcctctcagt

SEQ ID NO: 5632149 - DNA, 20 bp, Homo sapiens
gtggcctctctctctctcct

SEQ ID NO: 5632150 - DNA, 16 bp, Homo sapiens
gtggcctctgcctggg

SEQ ID NO: 5632151 - DNA, 21 bp, Homo sapiens
gtggcctcttgagcagtggct

SEQ ID NO: 5632152 - DNA, 22 bp, Homo sapiens
gtggcctcttggataccagctc

SEQ ID NO: 5632153 - DNA, 17 bp, Homo sapiens
gtggcctgcccagcctc

SEQ ID NO: 5632154 - DNA, 19 bp, Homo sapiens
gtggcctggatccatcctg

SEQ ID NO: 5632155 - DNA, 18 bp, Homo sapiens
gtggcctggcatctgtgc

SEQ ID NO: 5632156 - DNA, 19 bp, Homo sapiens
gtggcctggcatctgtgtg

SEQ ID NO: 5632157 - DNA, 13 bp, Homo sapiens
gtggcctggccag

SEQ ID NO: 5632158 - DNA, 18 bp, Homo sapiens
gtggcctggccaggagct

SEQ ID NO: 5632159 - DNA, 17 bp, Homo sapiens
gtggcctggccctcctg

SEQ ID NO: 5632160 - DNA, 13 bp, Homo sapiens
gtggcctggctcc

SEQ ID NO: 5632161 - DNA, 23 bp, Homo sapiens
gtggcctggcttctgggacaggc

SEQ ID NO: 5632162 - DNA, 16 bp, Homo sapiens
gtggcctggcttgtct

SEQ ID NO: 5632163 - DNA, 15 bp, Homo sapiens
gtggcctgggcctcc

SEQ ID NO: 5632164 - DNA, 15 bp, Homo sapiens
gtggcctgggcttgg

SEQ ID NO: 5632165 - DNA, 16 bp, Homo sapiens
gtggcctgggcttggc

SEQ ID NO: 5632166 - DNA, 17 bp, Homo sapiens
gtggcctgggcttggcc

SEQ ID NO: 5632167 - DNA, 18 bp, Homo sapiens
gtggcctgggtcccaggg

SEQ ID NO: 5632168 - DNA, 23 bp, Homo sapiens
gtggcctgggtcccagggctggc

SEQ ID NO: 5632169 - DNA, 15 bp, Homo sapiens
gtggcctgggtcctc

SEQ ID NO: 5632170 - DNA, 22 bp, Homo sapiens
gtggcctgggtcctcggccctg

SEQ ID NO: 5632171 - DNA, 15 bp, Homo sapiens
gtggcctggtccctg

SEQ ID NO: 5632172 - DNA, 20 bp, Homo sapiens
gtggcctgtgagcaagagcc

SEQ ID NO: 5632173 - DNA, 21 bp, Homo sapiens
gtggcctgtgaggggcccctg

SEQ ID NO: 5632174 - DNA, 13 bp, Homo sapiens
gtggcctgtgctt

SEQ ID NO: 5632175 - DNA, 22 bp, Homo sapiens
gtggcctgtgtccagcagctgc

SEQ ID NO: 5632176 - DNA, 17 bp, Homo sapiens
gtggcctgttccctaga

SEQ ID NO: 5632177 - DNA, 17 bp, Homo sapiens
gtggccttaactgttca

SEQ ID NO: 5632178 - DNA, 21 bp, Homo sapiens
gtggccttccccagcatgcac

SEQ ID NO: 5632179 - DNA, 16 bp, Homo sapiens
gtggccttctgctgcc

SEQ ID NO: 5632180 - DNA, 17 bp, Homo sapiens
gtggccttctgctgccc

SEQ ID NO: 5632181 - DNA, 20 bp, Homo sapiens
gtggccttctgctgcccagg

SEQ ID NO: 5632182 - DNA, 19 bp, Homo sapiens
gtggccttgagtctctgaa

SEQ ID NO: 5632183 - DNA, 15 bp, Homo sapiens
gtggccttggccctg

SEQ ID NO: 5632184 - DNA, 14 bp, Homo sapiens
gtggccttgggcct

SEQ ID NO: 5632185 - DNA, 16 bp, Homo sapiens
gtggccttgggccttg

SEQ ID NO: 5632186 - DNA, 17 bp, Homo sapiens
gtggcctttgcgctcct

SEQ ID NO: 5632187 - DNA, 20 bp, Homo sapiens
gtggcctttgcgctcctggc

SEQ ID NO: 5632188 - DNA, 23 bp, Homo sapiens
gtggcctttttctgagatgctca

SEQ ID NO: 5632189 - DNA, 17 bp, Homo sapiens
gtggccttttttataac

SEQ ID NO: 5632190 - DNA, 17 bp, Homo sapiens
gtggcgaaatccctgct

SEQ ID NO: 5632191 - DNA, 20 bp, Homo sapiens
gtggcgactctatagactct

SEQ ID NO: 5632192 - DNA, 23 bp, Homo sapiens
gtggcgcagcatattcaggaagc

SEQ ID NO: 5632193 - DNA, 16 bp, Homo sapiens
gtggggtttcctggca

SEQ ID NO: 5632194 - DNA, 22 bp, Homo sapiens
gtggggtttcgcagcctgagtc

SEQ ID NO: 5632195 - DNA, 18 bp, Homo sapiens
gtggggttttcacttcct

SEQ ID NO: 5632196 - DNA, 22 bp, Homo sapiens
gtgggtaatccaggcacagctg

SEQ ID NO: 5632197 - DNA, 19 bp, Homo sapiens
gtgggtaattgtacaataa

SEQ ID NO: 5632198 - DNA, 15 bp, Homo sapiens
gtgggtacatcaagt

SEQ ID NO: 5632199 - DNA, 18 bp, Homo sapiens
gtgggtactttctgaaaa

SEQ ID NO: 5632200 - DNA, 15 bp, Homo sapiens
gtgggtagatgtgca

SEQ ID NO: 5632201 - DNA, 15 bp, Homo sapiens
gtgggtatcccacct

SEQ ID NO: 5632202 - DNA, 20 bp, Homo sapiens
gtgggtatcccacctccagc

SEQ ID NO: 5632203 - DNA, 17 bp, Homo sapiens
gtgggtatgcgagacca

SEQ ID NO: 5632204 - DNA, 21 bp, Homo sapiens
gtgggtatttcttatttgaaa

SEQ ID NO: 5632205 - DNA, 16 bp, Homo sapiens
gtgggtcaactccaag

SEQ ID NO: 5632206 - DNA, 22 bp, Homo sapiens
gtgggtcacacacacgcactgc

SEQ ID NO: 5632207 - DNA, 18 bp, Homo sapiens
gtgggtcagaacatgtta

SEQ ID NO: 5632208 - DNA, 14 bp, Homo sapiens
gtgggtcagaaccc

SEQ ID NO: 5632209 - DNA, 16 bp, Homo sapiens
gtgggtcagcccagca

SEQ ID NO: 5632210 - DNA, 20 bp, Homo sapiens
gtgggtccaggaaggcagct

SEQ ID NO: 5632211 - DNA, 22 bp, Homo sapiens
gtgggtccaggaaggcagctgc

SEQ ID NO: 5632212 - DNA, 20 bp, Homo sapiens
gtgggtcccacttcccctcc

SEQ ID NO: 5632213 - DNA, 18 bp, Homo sapiens
gtgggtcccgcactctgc

SEQ ID NO: 5632214 - DNA, 16 bp, Homo sapiens
gtgggtccctctgccc

SEQ ID NO: 5632215 - DNA, 17 bp, Homo sapiens
gtgggtccgcatccctg

SEQ ID NO: 5632216 - DNA, 23 bp, Homo sapiens
gtgggtcgcccacgggtgtggct

SEQ ID NO: 5632217 - DNA, 13 bp, Homo sapiens
gtgggtctctggg

SEQ ID NO: 5632218 - DNA, 19 bp, Homo sapiens
gtgggtctctgggcacagt

SEQ ID NO: 5632219 - DNA, 16 bp, Homo sapiens
gtgggtctctggggac

SEQ ID NO: 5632220 - DNA, 17 bp, Homo sapiens
gtgggtctctggggacc

SEQ ID NO: 5632221 - DNA, 17 bp, Homo sapiens
gtgggtctctgtgtgtg

SEQ ID NO: 5632222 - DNA, 20 bp, Homo sapiens
gtgggtctgcagctggtgtg

SEQ ID NO: 5632223 - DNA, 20 bp, Homo sapiens
gtgggtctggactaaccctg

SEQ ID NO: 5632224 - DNA, 13 bp, Homo sapiens
gtgggtctgggag

SEQ ID NO: 5632225 - DNA, 13 bp, Homo sapiens
gtgggtcttcagg

SEQ ID NO: 5632226 - DNA, 17 bp, Homo sapiens
gtgggtcttcagggggc

SEQ ID NO: 5632227 - DNA, 16 bp, Homo sapiens
gtgggtctttaataaa

SEQ ID NO: 5632228 - DNA, 20 bp, Homo sapiens
gtgggtctttttctcttctg

SEQ ID NO: 5632229 - DNA, 18 bp, Homo sapiens
gtgggtgaaagaaatcat

SEQ ID NO: 5632230 - DNA, 16 bp, Homo sapiens
gtgggtgaaggcctgg

SEQ ID NO: 5632231 - DNA, 16 bp, Homo sapiens
gtgggtgaccaggtcc

SEQ ID NO: 5632232 - DNA, 13 bp, Homo sapiens
gtgggtgagagag

SEQ ID NO: 5632233 - DNA, 12 bp, Homo sapiens
gtgggtgagcca

SEQ ID NO: 5632234 - DNA, 17 bp, Homo sapiens
gtgggtgagctctcagg

SEQ ID NO: 5632235 - DNA, 22 bp, Homo sapiens
gtgggtgagctctcaggccgag

SEQ ID NO: 5632236 - DNA, 21 bp, Homo sapiens
gtgggtgattcctcccaggag

SEQ ID NO: 5632237 - DNA, 15 bp, Homo sapiens
gtgggtgatttgata

SEQ ID NO: 5632238 - DNA, 22 bp, Homo sapiens
gtgggtgatttgataacaagtt

SEQ ID NO: 5632239 - DNA, 12 bp, Homo sapiens
gtgggtgcagtc

SEQ ID NO: 5632240 - DNA, 13 bp, Homo sapiens
gtgggtgcctagg

SEQ ID NO: 5632241 - DNA, 14 bp, Homo sapiens
gtgggtgctgccct

SEQ ID NO: 5632242 - DNA, 16 bp, Homo sapiens
gtgggtgctgccctgt

SEQ ID NO: 5632243 - DNA, 15 bp, Homo sapiens
gtgggtggagtcagg

SEQ ID NO: 5632244 - DNA, 19 bp, Homo sapiens
gtgggtggagtcaggcttc

SEQ ID NO: 5632245 - DNA, 21 bp, Homo sapiens
gtgggtggatataaatatata

SEQ ID NO: 5632246 - DNA, 13 bp, Homo sapiens
gtgggtgggcctg

SEQ ID NO: 5632247 - DNA, 14 bp, Homo sapiens
gtgggtggggaggc

SEQ ID NO: 5632248 - DNA, 15 bp, Homo sapiens
gtgggtggggcagtg

SEQ ID NO: 5632249 - DNA, 15 bp, Homo sapiens
gtgggtggggctgta

SEQ ID NO: 5632250 - DNA, 21 bp, Homo sapiens
gtgggtggggctgtacacacc

SEQ ID NO: 5632251 - DNA, 14 bp, Homo sapiens
gtgggtggggcttc

SEQ ID NO: 5632252 - DNA, 16 bp, Homo sapiens
gtgggtggtggatctg

SEQ ID NO: 5632253 - DNA, 14 bp, Homo sapiens
gtgggtggtgggga

SEQ ID NO: 5632254 - DNA, 14 bp, Homo sapiens
gtgggtgtagccag

SEQ ID NO: 5632255 - DNA, 18 bp, Homo sapiens
gtgggtgtcctgcctgtc

SEQ ID NO: 5632256 - DNA, 22 bp, Homo sapiens
gtgggtgtgggacacctgggag

SEQ ID NO: 5632257 - DNA, 12 bp, Homo sapiens
gtgggtgtgtga

SEQ ID NO: 5632258 - DNA, 23 bp, Homo sapiens
gtgggtgtgtgcgcctgagtgag

SEQ ID NO: 5632259 - DNA, 17 bp, Homo sapiens
gtgggtgttctttcctg

SEQ ID NO: 5632260 - DNA, 20 bp, Homo sapiens
gtgggtgttctttcctgccc

SEQ ID NO: 5632261 - DNA, 20 bp, Homo sapiens
gtgggttagtcgggtgccag

SEQ ID NO: 5632262 - DNA, 15 bp, Homo sapiens
gtgggttcagaacca

SEQ ID NO: 5632263 - DNA, 16 bp, Homo sapiens
gtgggttccagggact

SEQ ID NO: 5632264 - DNA, 20 bp, Homo sapiens
gtgggttgaatatagcctgc

SEQ ID NO: 5632265 - DNA, 21 bp, Homo sapiens
gtgggttgaatatagcctgcc

SEQ ID NO: 5632266 - DNA, 21 bp, Homo sapiens
gtgggtttttgtatccagagc

SEQ ID NO: 5632267 - DNA, 15 bp, Homo sapiens
gtggtaaaaaagaaa

SEQ ID NO: 5632268 - DNA, 12 bp, Homo sapiens
gtggtaaaaagg

SEQ ID NO: 5632269 - DNA, 20 bp, Homo sapiens
gtggtaaagtagttgattca

SEQ ID NO: 5632270 - DNA, 16 bp, Homo sapiens
gtggtaaatactgtga

SEQ ID NO: 5632271 - DNA, 22 bp, Homo sapiens
gtggtaaatgccacacaccttt

SEQ ID NO: 5632272 - DNA, 20 bp, Homo sapiens
gtggtaacagctctcttctt

SEQ ID NO: 5632273 - DNA, 23 bp, Homo sapiens
gtggtaaccagccctgcacgacc

SEQ ID NO: 5632274 - DNA, 12 bp, Homo sapiens
gtggtaaccctg

SEQ ID NO: 5632275 - DNA, 20 bp, Homo sapiens
gtggtaacttgagattcaag

SEQ ID NO: 5632276 - DNA, 22 bp, Homo sapiens
gtggtaactttatttaaaatga

SEQ ID NO: 5632277 - DNA, 16 bp, Homo sapiens
gtggtaactttgcagg

SEQ ID NO: 5632278 - DNA, 22 bp, Homo sapiens
gtggtaagagggaaactctgga

SEQ ID NO: 5632279 - DNA, 16 bp, Homo sapiens
gtggtaagctctggct

SEQ ID NO: 5632280 - DNA, 19 bp, Homo sapiens
gtggtaaggtgtgtactca

SEQ ID NO: 5632281 - DNA, 15 bp, Homo sapiens
gtggtaatctacacc

SEQ ID NO: 5632282 - DNA, 14 bp, Homo sapiens
gtggtaatttttgt

SEQ ID NO: 5632283 - DNA, 15 bp, Homo sapiens
gtggtaatttttgta

SEQ ID NO: 5632284 - DNA, 12 bp, Homo sapiens
gtggtacagaga

SEQ ID NO: 5632285 - DNA, 22 bp, Homo sapiens
gtggtacagagaagccagcttg

SEQ ID NO: 5632286 - DNA, 18 bp, Homo sapiens
gtggtacatacacaccag

SEQ ID NO: 5632287 - DNA, 16 bp, Homo sapiens
gtggtaccttcagccc

SEQ ID NO: 5632288 - DNA, 22 bp, Homo sapiens
gtggtaccttcagccctggcca

SEQ ID NO: 5632289 - DNA, 23 bp, Homo sapiens
gtggtacttaagctcccctgcct

SEQ ID NO: 5632290 - DNA, 14 bp, Homo sapiens
gtggtacttgatca

SEQ ID NO: 5632291 - DNA, 11 bp, Homo sapiens
gtggtacttgg

SEQ ID NO: 5632292 - DNA, 14 bp, Homo sapiens
gtggtacttggcac

SEQ ID NO: 5632293 - DNA, 19 bp, Homo sapiens
gtggtagaaccacttggct

SEQ ID NO: 5632294 - DNA, 14 bp, Homo sapiens
gtggtagaagccag

SEQ ID NO: 5632295 - DNA, 14 bp, Homo sapiens
gtggtagctccagc

SEQ ID NO: 5632296 - DNA, 15 bp, Homo sapiens
gtggtagctccagcg

SEQ ID NO: 5632297 - DNA, 19 bp, Homo sapiens
gtggtaggccttttaacat

SEQ ID NO: 5632298 - DNA, 22 bp, Homo sapiens
gtggtaggccttttaacatttt

SEQ ID NO: 5632299 - DNA, 21 bp, Homo sapiens
gtggtaggtactttttgtgaa

SEQ ID NO: 5632300 - DNA, 19 bp, Homo sapiens
gtggtagtaaaacacagag

SEQ ID NO: 5632301 - DNA, 20 bp, Homo sapiens
gtggtagtaaaacacagagg

SEQ ID NO: 5632302 - DNA, 15 bp, Homo sapiens
gtggtagtacccagg

SEQ ID NO: 5632303 - DNA, 16 bp, Homo sapiens
gtggtagtatctcgta

SEQ ID NO: 5632304 - DNA, 23 bp, Homo sapiens
gtggtagtcctcccaagctgtgc

SEQ ID NO: 5632305 - DNA, 15 bp, Homo sapiens
gtggtatgagggggt

SEQ ID NO: 5632306 - DNA, 21 bp, Homo sapiens
gtggtatgtaatttatgcaag

SEQ ID NO: 5632307 - DNA, 15 bp, Homo sapiens
gtggtatgtcactca

SEQ ID NO: 5632308 - DNA, 14 bp, Homo sapiens
gtggtatgtctctt

SEQ ID NO: 5632309 - DNA, 14 bp, Homo sapiens
gtggtatgtctgcc

SEQ ID NO: 5632310 - DNA, 15 bp, Homo sapiens
gtggtatgtctgcca

SEQ ID NO: 5632311 - DNA, 16 bp, Homo sapiens
gtggtattctggtagg

SEQ ID NO: 5632312 - DNA, 15 bp, Homo sapiens
gtggtattctgtcat

SEQ ID NO: 5632313 - DNA, 23 bp, Homo sapiens
gtggtattttattttggcttcat

SEQ ID NO: 5632314 - DNA, 21 bp, Homo sapiens
gtggtattttcaatagccact

SEQ ID NO: 5632315 - DNA, 23 bp, Homo sapiens
gtggtattttcaatagccactaa

SEQ ID NO: 5632316 - DNA, 22 bp, Homo sapiens
gtggtcaaaccgcactcaccca

SEQ ID NO: 5632317 - DNA, 22 bp, Homo sapiens
gtggtcacaacttgatggctgc

SEQ ID NO: 5632318 - DNA, 18 bp, Homo sapiens
gtggtcacagcggaggtg

SEQ ID NO: 5632319 - DNA, 22 bp, Homo sapiens
gtggtcacagcggaggtgtgga

SEQ ID NO: 5632320 - DNA, 15 bp, Homo sapiens
gtggtcacaggctgt

SEQ ID NO: 5632321 - DNA, 20 bp, Homo sapiens
gtggtcacaggctgtgcctt

SEQ ID NO: 5632322 - DNA, 14 bp, Homo sapiens
gtggtcactgctgt

SEQ ID NO: 5632323 - DNA, 18 bp, Homo sapiens
gtggtcactggtcagggc

SEQ ID NO: 5632324 - DNA, 14 bp, Homo sapiens
gtggtcagatgcag

SEQ ID NO: 5632325 - DNA, 17 bp, Homo sapiens
gtggtcagcaggtgtct

SEQ ID NO: 5632326 - DNA, 16 bp, Homo sapiens
gtggtcagcggcctgg

SEQ ID NO: 5632327 - DNA, 13 bp, Homo sapiens
gtggtcaggccca

SEQ ID NO: 5632328 - DNA, 15 bp, Homo sapiens
gtggtcagggcaggg

SEQ ID NO: 5632329 - DNA, 22 bp, Homo sapiens
gtggtcataaaatagaataatt

SEQ ID NO: 5632330 - DNA, 22 bp, Homo sapiens
gtggtcatattattattaattt

SEQ ID NO: 5632331 - DNA, 21 bp, Homo sapiens
gtggtcatgaattcatactct

SEQ ID NO: 5632332 - DNA, 23 bp, Homo sapiens
gtggtcatgaattcatactctgt

SEQ ID NO: 5632333 - DNA, 19 bp, Homo sapiens
gtggtcatgctcagccttg

SEQ ID NO: 5632334 - DNA, 16 bp, Homo sapiens
gtggtcatgtgagtct

SEQ ID NO: 5632335 - DNA, 20 bp, Homo sapiens
gtggtccacaagcttctgtc

SEQ ID NO: 5632336 - DNA, 19 bp, Homo sapiens
gtggtccacattctgctgc

SEQ ID NO: 5632337 - DNA, 22 bp, Homo sapiens
gtggtccacattctgctgcccc

SEQ ID NO: 5632338 - DNA, 20 bp, Homo sapiens
gtggtccagggtccagccct

SEQ ID NO: 5632339 - DNA, 17 bp, Homo sapiens
gtggtccatctctgaaa

SEQ ID NO: 5632340 - DNA, 18 bp, Homo sapiens
gtggtccatctctgaaaa

SEQ ID NO: 5632341 - DNA, 13 bp, Homo sapiens
gtggtccatgccc

SEQ ID NO: 5632342 - DNA, 21 bp, Homo sapiens
gtggtccatgcccactgctgg

SEQ ID NO: 5632343 - DNA, 18 bp, Homo sapiens
gtggtccatggaatgctt

SEQ ID NO: 5632344 - DNA, 18 bp, Homo sapiens
gtggtcccacccaggaag

SEQ ID NO: 5632345 - DNA, 14 bp, Homo sapiens
gtggtcccacccca

SEQ ID NO: 5632346 - DNA, 16 bp, Homo sapiens
gtggtcccaccccaca

SEQ ID NO: 5632347 - DNA, 21 bp, Homo sapiens
gtggtcccataggtcttgtga

SEQ ID NO: 5632348 - DNA, 16 bp, Homo sapiens
gtggtccccaaaacac

SEQ ID NO: 5632349 - DNA, 13 bp, Homo sapiens
gtggtccccaaca

SEQ ID NO: 5632350 - DNA, 14 bp, Homo sapiens
gtggtccttaggct

SEQ ID NO: 5632351 - DNA, 19 bp, Homo sapiens
gtggtcgtcaactttcctc

SEQ ID NO: 5632352 - DNA, 22 bp, Homo sapiens
gtggtcgtcaactttcctcaaa

SEQ ID NO: 5632353 - DNA, 18 bp, Homo sapiens
gtggtctagaccagggct

SEQ ID NO: 5632354 - DNA, 21 bp, Homo sapiens
gtggtctataaaataaacttc

SEQ ID NO: 5632355 - DNA, 22 bp, Homo sapiens
gtggtctataaaataaacttct

SEQ ID NO: 5632356 - DNA, 23 bp, Homo sapiens
gtggtctataaaataaacttctt

SEQ ID NO: 5632357 - DNA, 12 bp, Homo sapiens
gtggtctccagc

SEQ ID NO: 5632358 - DNA, 15 bp, Homo sapiens
gtggtctccagctcc

SEQ ID NO: 5632359 - DNA, 21 bp, Homo sapiens
gtggtctccagctcctctcca

SEQ ID NO: 5632360 - DNA, 22 bp, Homo sapiens
gtggtctccagctcctctccag

SEQ ID NO: 5632361 - DNA, 15 bp, Homo sapiens
gtggtctcctctcag

SEQ ID NO: 5632362 - DNA, 20 bp, Homo sapiens
gtggtctcctctcagcttct

SEQ ID NO: 5632363 - DNA, 18 bp, Homo sapiens
gtggtctcgatgctgctg

SEQ ID NO: 5632364 - DNA, 21 bp, Homo sapiens
gtggtctcgatgctgctggcc

SEQ ID NO: 5632365 - DNA, 21 bp, Homo sapiens
gtggtctctgccccagcctgt

SEQ ID NO: 5632366 - DNA, 21 bp, Homo sapiens
gtggtctcttcttggggccca

SEQ ID NO: 5632367 - DNA, 24 bp, Homo sapiens
gtggtctgaatgttctgacattaa

SEQ ID NO: 5632368 - DNA, 19 bp, Homo sapiens
gtggtctgagctgtcccaa

SEQ ID NO: 5632369 - DNA, 20 bp, Homo sapiens
gtgtccccccaggtgctgga

SEQ ID NO: 5632370 - DNA, 20 bp, Homo sapiens
gtgtcccccccaggccttgt

SEQ ID NO: 5632371 - DNA, 14 bp, Homo sapiens
gtgtcccccctgtg

SEQ ID NO: 5632372 - DNA, 18 bp, Homo sapiens
gtgtcccccctgtggtct

SEQ ID NO: 5632373 - DNA, 20 bp, Homo sapiens
gtgtccccccttgaagcaat

SEQ ID NO: 5632374 - DNA, 19 bp, Homo sapiens
gtgtccccgatgctgacct

SEQ ID NO: 5632375 - DNA, 17 bp, Homo sapiens
gtgtccccggggcccag

SEQ ID NO: 5632376 - DNA, 15 bp, Homo sapiens
gtgtcccctatcctc

SEQ ID NO: 5632377 - DNA, 23 bp, Homo sapiens
gtgtcccctcacgcaagtgccag

SEQ ID NO: 5632378 - DNA, 19 bp, Homo sapiens
gtgtcccctgacctgtcca

SEQ ID NO: 5632379 - DNA, 12 bp, Homo sapiens
gtgtcccctgcc

SEQ ID NO: 5632380 - DNA, 15 bp, Homo sapiens
gtgtcccctgcccca

SEQ ID NO: 5632381 - DNA, 21 bp, Homo sapiens
gtgtcccctgccccagaggtc

SEQ ID NO: 5632382 - DNA, 13 bp, Homo sapiens
gtgtccctgcact

SEQ ID NO: 5632383 - DNA, 14 bp, Homo sapiens
gtgtccctgcctgg

SEQ ID NO: 5632384 - DNA, 18 bp, Homo sapiens
gtgtccctgcctggccct

SEQ ID NO: 5632385 - DNA, 13 bp, Homo sapiens
gtgtccctgctgg

SEQ ID NO: 5632386 - DNA, 13 bp, Homo sapiens
gtgtccctggaca

SEQ ID NO: 5632387 - DNA, 16 bp, Homo sapiens
gtgtccctggacacag

SEQ ID NO: 5632388 - DNA, 18 bp, Homo sapiens
gtgtccctgtggtaccct

SEQ ID NO: 5632389 - DNA, 21 bp, Homo sapiens
gtgtccctgtggtaccctggc

SEQ ID NO: 5632390 - DNA, 20 bp, Homo sapiens
gtgtccctttttgcagggga

SEQ ID NO: 5632391 - DNA, 12 bp, Homo sapiens
gtgtccgagagg

SEQ ID NO: 5632392 - DNA, 15 bp, Homo sapiens
gtgtccgatgctgga

SEQ ID NO: 5632393 - DNA, 19 bp, Homo sapiens
gtgtccgcataagaaaaag

SEQ ID NO: 5632394 - DNA, 18 bp, Homo sapiens
gtgtccgccatccagggt

SEQ ID NO: 5632395 - DNA, 21 bp, Homo sapiens
gtgtccgccatccagggtctg

SEQ ID NO: 5632396 - DNA, 17 bp, Homo sapiens
gtgtccgctctctcatg

SEQ ID NO: 5632397 - DNA, 21 bp, Homo sapiens
gtgtccgctgctgctttcctt

SEQ ID NO: 5632398 - DNA, 16 bp, Homo sapiens
gtgtccgggggtctag

SEQ ID NO: 5632399 - DNA, 15 bp, Homo sapiens
gtgtcctaaatgcaa

SEQ ID NO: 5632400 - DNA, 14 bp, Homo sapiens
gtgtcctacagcct

SEQ ID NO: 5632401 - DNA, 14 bp, Homo sapiens
gtgtcctccctccc

SEQ ID NO: 5632402 - DNA, 12 bp, Homo sapiens
gtgtcctcctct

SEQ ID NO: 5632403 - DNA, 21 bp, Homo sapiens
gtgtcctcctctgaggaagca

SEQ ID NO: 5632404 - DNA, 16 bp, Homo sapiens
gtgtcctcctgctctg

SEQ ID NO: 5632405 - DNA, 22 bp, Homo sapiens
gtgtcctcctgctctgcttcct

SEQ ID NO: 5632406 - DNA, 15 bp, Homo sapiens
gtgtcctctccctgc

SEQ ID NO: 5632407 - DNA, 17 bp, Homo sapiens
gtgtcctctccctgcca

SEQ ID NO: 5632408 - DNA, 19 bp, Homo sapiens
gtgtcctctccctgccaag

SEQ ID NO: 5632409 - DNA, 21 bp, Homo sapiens
gtgtcctctctgtgtccctgc

SEQ ID NO: 5632410 - DNA, 17 bp, Homo sapiens
gtgtcctctgcctgggc

SEQ ID NO: 5632411 - DNA, 13 bp, Homo sapiens
gtgtcctctgtcc

SEQ ID NO: 5632412 - DNA, 16 bp, Homo sapiens
gtgtcctctgtgccca

SEQ ID NO: 5632413 - DNA, 17 bp, Homo sapiens
gtgtcctctgtgcccac

SEQ ID NO: 5632414 - DNA, 18 bp, Homo sapiens
gtgtcctcttccctctct

SEQ ID NO: 5632415 - DNA, 19 bp, Homo sapiens
gtgtcctgaagctgctgga

SEQ ID NO: 5632416 - DNA, 23 bp, Homo sapiens
gtgtcctgagccccagggagagg

SEQ ID NO: 5632417 - DNA, 14 bp, Homo sapiens
gtgtcctgcatgta

SEQ ID NO: 5632418 - DNA, 20 bp, Homo sapiens
gtgtcctgcctgtctgcccc

SEQ ID NO: 5632419 - DNA, 13 bp, Homo sapiens
gtgtcctgccttg

SEQ ID NO: 5632420 - DNA, 22 bp, Homo sapiens
gtgtcctgctagctgtctctct

SEQ ID NO: 5632421 - DNA, 23 bp, Homo sapiens
gtgtcctgctagctgtctctctt

SEQ ID NO: 5632422 - DNA, 20 bp, Homo sapiens
gtgtcctggtaattcctctc

SEQ ID NO: 5632423 - DNA, 16 bp, Homo sapiens
gtgtcctggtgctctc

SEQ ID NO: 5632424 - DNA, 16 bp, Homo sapiens
gtgtcctgtctgctgg

SEQ ID NO: 5632425 - DNA, 17 bp, Homo sapiens
gtgtcctgtctgctggg

SEQ ID NO: 5632426 - DNA, 20 bp, Homo sapiens
gtgtcctgtctgctgggcta

SEQ ID NO: 5632427 - DNA, 22 bp, Homo sapiens
gtgtcctgtgctttctgcatgc

SEQ ID NO: 5632428 - DNA, 23 bp, Homo sapiens
gtgtccttcacggcactggatcc

SEQ ID NO: 5632429 - DNA, 13 bp, Homo sapiens
gtgtccttccctg

SEQ ID NO: 5632430 - DNA, 15 bp, Homo sapiens
gtgtccttccctgca

SEQ ID NO: 5632431 - DNA, 14 bp, Homo sapiens
gtgtccttcttcct

SEQ ID NO: 5632432 - DNA, 13 bp, Homo sapiens
gtgtccttgaact

SEQ ID NO: 5632433 - DNA, 17 bp, Homo sapiens
gtgtccttgaactgagg

SEQ ID NO: 5632434 - DNA, 20 bp, Homo sapiens
gtgtccttgaactgaggccc

SEQ ID NO: 5632435 - DNA, 17 bp, Homo sapiens
gtgtccttggggcacag

SEQ ID NO: 5632436 - DNA, 14 bp, Homo sapiens
gtgtcctttcccct

SEQ ID NO: 5632437 - DNA, 17 bp, Homo sapiens
gtgtcgagtccagtcct

SEQ ID NO: 5632438 - DNA, 17 bp, Homo sapiens
gtgtcgccgtccctctg

SEQ ID NO: 5632439 - DNA, 16 bp, Homo sapiens
gtgtcggatcctgtga

SEQ ID NO: 5632440 - DNA, 20 bp, Homo sapiens
gtgtcggggggcgagggagg

SEQ ID NO: 5632441 - DNA, 21 bp, Homo sapiens
gtgtcggggggcgagggaggg

SEQ ID NO: 5632442 - DNA, 14 bp, Homo sapiens
gtgtcgtctgtgaa

SEQ ID NO: 5632443 - DNA, 22 bp, Homo sapiens
gtgtcgtcttgaacgagcagcc

SEQ ID NO: 5632444 - DNA, 20 bp, Homo sapiens
gtgtctaaaatacttgagaa

SEQ ID NO: 5632445 - DNA, 22 bp, Homo sapiens
gtgtctaaaatacttgagaaat

SEQ ID NO: 5632446 - DNA, 18 bp, Homo sapiens
gtgtctaagattctagat

SEQ ID NO: 5632447 - DNA, 17 bp, Homo sapiens
gtgtctaagttttgtca

SEQ ID NO: 5632448 - DNA, 16 bp, Homo sapiens
gtgtctaatgcattaa

SEQ ID NO: 5632449 - DNA, 18 bp, Homo sapiens
gtgtctactctaggactg

SEQ ID NO: 5632450 - DNA, 15 bp, Homo sapiens
gtgtctagcaaagcc

SEQ ID NO: 5632451 - DNA, 21 bp, Homo sapiens
gtgtctaggctggaagagcca

SEQ ID NO: 5632452 - DNA, 16 bp, Homo sapiens
gtgtctatgaactaga

SEQ ID NO: 5632453 - DNA, 20 bp, Homo sapiens
gtgtctatgaactagagact

SEQ ID NO: 5632454 - DNA, 16 bp, Homo sapiens
gtgtctatggagcagc

SEQ ID NO: 5632455 - DNA, 19 bp, Homo sapiens
gtgtctcaggaaaacagct

SEQ ID NO: 5632456 - DNA, 12 bp, Homo sapiens
gtgtctcaggct

SEQ ID NO: 5632457 - DNA, 16 bp, Homo sapiens
gtgtctcaggctgcct

SEQ ID NO: 5632458 - DNA, 20 bp, Homo sapiens
gtgtctcaggctgcctgagt

SEQ ID NO: 5632459 - DNA, 23 bp, Homo sapiens
gtgtctcagggtgcagaggtcag

SEQ ID NO: 5632460 - DNA, 13 bp, Homo sapiens
gtgtctcccaaca

SEQ ID NO: 5632461 - DNA, 16 bp, Homo sapiens
gtgtctcccaggtgca

SEQ ID NO: 5632462 - DNA, 15 bp, Homo sapiens
gtgtctcctgcatgc

SEQ ID NO: 5632463 - DNA, 16 bp, Homo sapiens
gtgtctcctgcatgca

SEQ ID NO: 5632464 - DNA, 14 bp, Homo sapiens
gtgtctcgctgcat

SEQ ID NO: 5632465 - DNA, 15 bp, Homo sapiens
gtgtctctatgtgaa

SEQ ID NO: 5632466 - DNA, 15 bp, Homo sapiens
gtgtctctatttatg

SEQ ID NO: 5632467 - DNA, 20 bp, Homo sapiens
gtgtctctcccaccccggcc

SEQ ID NO: 5632468 - DNA, 12 bp, Homo sapiens
gtgtctctgcct

SEQ ID NO: 5632469 - DNA, 15 bp, Homo sapiens
gtgtctctgcctgga

SEQ ID NO: 5632470 - DNA, 18 bp, Homo sapiens
gtgtctctgcctggagca

SEQ ID NO: 5632471 - DNA, 22 bp, Homo sapiens
gtgtctctgctttccttttctc

SEQ ID NO: 5632472 - DNA, 18 bp, Homo sapiens
gtgtctctgggcctgtgt

SEQ ID NO: 5632473 - DNA, 14 bp, Homo sapiens
gtgtctctgtctct

SEQ ID NO: 5632474 - DNA, 14 bp, Homo sapiens
gtgtctcttggtcc

SEQ ID NO: 5632475 - DNA, 20 bp, Homo sapiens
gtgtctcttggtcctgctgc

SEQ ID NO: 5632476 - DNA, 22 bp, Homo sapiens
gtgtctcttggtcctgctgcag

SEQ ID NO: 5632477 - DNA, 22 bp, Homo sapiens
gtgtctcttttatgttcagctt

SEQ ID NO: 5632478 - DNA, 18 bp, Homo sapiens
gtgtctcttttctctttc

SEQ ID NO: 5632479 - DNA, 13 bp, Homo sapiens
gtgtctgaatcat

SEQ ID NO: 5632480 - DNA, 13 bp, Homo sapiens
gtgtctgagccca

SEQ ID NO: 5632481 - DNA, 17 bp, Homo sapiens
gtgtctgagtggcttca

SEQ ID NO: 5632482 - DNA, 16 bp, Homo sapiens
gtgtctgatgtgtgcc

SEQ ID NO: 5632483 - DNA, 14 bp, Homo sapiens
gtgtctgcaacatg

SEQ ID NO: 5632484 - DNA, 12 bp, Homo sapiens
gtgtctgcacct

SEQ ID NO: 5632485 - DNA, 14 bp, Homo sapiens
gtgtctgcagctcc

SEQ ID NO: 5632486 - DNA, 18 bp, Homo sapiens
gtgtctgcagctcctgga

SEQ ID NO: 5632487 - DNA, 17 bp, Homo sapiens
gtgtctgcagtcctggt

SEQ ID NO: 5632488 - DNA, 23 bp, Homo sapiens
gtgtctgcattgttattgtggaa

SEQ ID NO: 5632489 - DNA, 20 bp, Homo sapiens
gtgtctgccaaacacattta

SEQ ID NO: 5632490 - DNA, 19 bp, Homo sapiens
gtgtctggaagaagcagcg

SEQ ID NO: 5632491 - DNA, 20 bp, Homo sapiens
gtgtctggaagctgagcagg

SEQ ID NO: 5632492 - DNA, 22 bp, Homo sapiens
gtgtctggagacctggatttga

SEQ ID NO: 5632493 - DNA, 12 bp, Homo sapiens
gtgtctggagcc

SEQ ID NO: 5632494 - DNA, 17 bp, Homo sapiens
gtgtctggcacagcctg

SEQ ID NO: 5632495 - DNA, 21 bp, Homo sapiens
gtgtctggcccagccatggct

SEQ ID NO: 5632496 - DNA, 14 bp, Homo sapiens
gtgtctggctgcag

SEQ ID NO: 5632497 - DNA, 13 bp, Homo sapiens
gtgtctgggagag

SEQ ID NO: 5632498 - DNA, 16 bp, Homo sapiens
gtgtctgggagagcct

SEQ ID NO: 5632499 - DNA, 17 bp, Homo sapiens
gtgtctgggagagcctg

SEQ ID NO: 5632500 - DNA, 19 bp, Homo sapiens
gtgtctgggagagcctggc

SEQ ID NO: 5632501 - DNA, 20 bp, Homo sapiens
gtgtctgggagagcctggca

SEQ ID NO: 5632502 - DNA, 22 bp, Homo sapiens
gtgtctgggagagcctggcaag

SEQ ID NO: 5632503 - DNA, 21 bp, Homo sapiens
gtgtctgggctcaagctttcc

SEQ ID NO: 5632504 - DNA, 23 bp, Homo sapiens
gtgtctgggctcaagctttcccg

SEQ ID NO: 5632505 - DNA, 12 bp, Homo sapiens
gtgtctggtggg

SEQ ID NO: 5632506 - DNA, 13 bp, Homo sapiens
gtgtctgtaaatc

SEQ ID NO: 5632507 - DNA, 13 bp, Homo sapiens
gtgtctgtacacg

SEQ ID NO: 5632508 - DNA, 20 bp, Homo sapiens
gtgtctgtattcatacagca

SEQ ID NO: 5632509 - DNA, 19 bp, Homo sapiens
gtgtctgtcacaggctggg

SEQ ID NO: 5632510 - DNA, 22 bp, Homo sapiens
gtgtctgtcacaggctgggtca

SEQ ID NO: 5632511 - DNA, 18 bp, Homo sapiens
gtgtctgtcatttctctt

SEQ ID NO: 5632512 - DNA, 20 bp, Homo sapiens
gtgtctgtccatctgtctgt

SEQ ID NO: 5632513 - DNA, 21 bp, Homo sapiens
gtgtctgtgccctccaaagag

SEQ ID NO: 5632514 - DNA, 11 bp, Homo sapiens
gtgtctgtgtg

SEQ ID NO: 5632515 - DNA, 13 bp, Homo sapiens
gtgtctgtgtggt

SEQ ID NO: 5632516 - DNA, 18 bp, Homo sapiens
gtgtctgttcttcatttc

SEQ ID NO: 5632517 - DNA, 15 bp, Homo sapiens
gtgtctgttgcttgt

SEQ ID NO: 5632518 - DNA, 16 bp, Homo sapiens
gtgtctgttttgagct

SEQ ID NO: 5632519 - DNA, 22 bp, Homo sapiens
gtgtcttacaaggcaggccttt

SEQ ID NO: 5632520 - DNA, 14 bp, Homo sapiens
gtgtcttcctccca

SEQ ID NO: 5632521 - DNA, 13 bp, Homo sapiens
gtgtcttcctgtg

SEQ ID NO: 5632522 - DNA, 18 bp, Homo sapiens
gtgtcttgcaatggcagc

SEQ ID NO: 5632523 - DNA, 23 bp, Homo sapiens
gtgtcttgggcagagctggctct

SEQ ID NO: 5632524 - DNA, 20 bp, Homo sapiens
gtgtcttgttcactgcagca

SEQ ID NO: 5632525 - DNA, 15 bp, Homo sapiens
gtgtctttctaagaa

SEQ ID NO: 5632526 - DNA, 21 bp, Homo sapiens
gtgtctttctaagaaatcaag

SEQ ID NO: 5632527 - DNA, 16 bp, Homo sapiens
gtgtctttctctctct

SEQ ID NO: 5632528 - DNA, 15 bp, Homo sapiens
gtgtctttctctttt

SEQ ID NO: 5632529 - DNA, 21 bp, Homo sapiens
gtgtctttctttggtgccttt

SEQ ID NO: 5632530 - DNA, 21 bp, Homo sapiens
gtgtctttgtgattttgagta

SEQ ID NO: 5632531 - DNA, 21 bp, Homo sapiens
gtgtcttttctgtagagcata

SEQ ID NO: 5632532 - DNA, 14 bp, Homo sapiens
gtgtcttttgacat

SEQ ID NO: 5632533 - DNA, 15 bp, Homo sapiens
gtgtcttttgcatga

SEQ ID NO: 5632534 - DNA, 20 bp, Homo sapiens
gtgtcttttgttctctcttg

SEQ ID NO: 5632535 - DNA, 21 bp, Homo sapiens
gtgtcttttgttctctcttgg

SEQ ID NO: 5632536 - DNA, 18 bp, Homo sapiens
gtgtcttttttcactaca

SEQ ID NO: 5632537 - DNA, 16 bp, Homo sapiens
gtgtctttttttgtat

SEQ ID NO: 5632538 - DNA, 15 bp, Homo sapiens
gtgtgaaacctgaca

SEQ ID NO: 5632539 - DNA, 19 bp, Homo sapiens
gtgtgaaatagttctgcca

SEQ ID NO: 5632540 - DNA, 17 bp, Homo sapiens
gtgtgaaatctgtcttt

SEQ ID NO: 5632541 - DNA, 18 bp, Homo sapiens
gtgtgaaatctgtctttg

SEQ ID NO: 5632542 - DNA, 21 bp, Homo sapiens
gtgtgaacacataaggacgtg

SEQ ID NO: 5632543 - DNA, 16 bp, Homo sapiens
gtgtgaactaagttat

SEQ ID NO: 5632544 - DNA, 19 bp, Homo sapiens
gtgtgaactaagttattgc

SEQ ID NO: 5632545 - DNA, 22 bp, Homo sapiens
gtgtgaactcaccctgggagcc

SEQ ID NO: 5632546 - DNA, 17 bp, Homo sapiens
gtgtgaactggaccctg

SEQ ID NO: 5632547 - DNA, 15 bp, Homo sapiens
gtgtgtgatgtgaca

SEQ ID NO: 5632548 - DNA, 13 bp, Homo sapiens
gtgtgtgcaatgt

SEQ ID NO: 5632549 - DNA, 14 bp, Homo sapiens
gtgtgtgcagagct

SEQ ID NO: 5632550 - DNA, 19 bp, Homo sapiens
gtgtgtgcagagtccattt

SEQ ID NO: 5632551 - DNA, 19 bp, Homo sapiens
gtgtgtgcatgtgccgagg

SEQ ID NO: 5632552 - DNA, 15 bp, Homo sapiens
gtgtgtgccaagagc

SEQ ID NO: 5632553 - DNA, 20 bp, Homo sapiens
gtgtgtgccaagccctggcc

SEQ ID NO: 5632554 - DNA, 23 bp, Homo sapiens
gtgtgtgccctctgggctctgag

SEQ ID NO: 5632555 - DNA, 16 bp, Homo sapiens
gtgtgtgccctgggcc

SEQ ID NO: 5632556 - DNA, 17 bp, Homo sapiens
gtgtgtgctctgcttca

SEQ ID NO: 5632557 - DNA, 17 bp, Homo sapiens
gtgtgtgcttacagtaa

SEQ ID NO: 5632558 - DNA, 20 bp, Homo sapiens
gtgtgtggaaggcacccgcc

SEQ ID NO: 5632559 - DNA, 14 bp, Homo sapiens
gtgtgtggacagcc

SEQ ID NO: 5632560 - DNA, 14 bp, Homo sapiens
gtgtgtggcagggg

SEQ ID NO: 5632561 - DNA, 21 bp, Homo sapiens
gtgtgtggccggcctcctcct

SEQ ID NO: 5632562 - DNA, 13 bp, Homo sapiens
gtgtgtggctggg

SEQ ID NO: 5632563 - DNA, 21 bp, Homo sapiens
gtgtgtgggccaccgtgcctg

SEQ ID NO: 5632564 - DNA, 14 bp, Homo sapiens
gtgtgtgggtgtgt

SEQ ID NO: 5632565 - DNA, 17 bp, Homo sapiens
gtgtgtgggtgtgtgcg

SEQ ID NO: 5632566 - DNA, 17 bp, Homo sapiens
gtgtgtggtagaaacaa

SEQ ID NO: 5632567 - DNA, 16 bp, Homo sapiens
gtgtgtggttggaaaa

SEQ ID NO: 5632568 - DNA, 14 bp, Homo sapiens
gtgtgtgtatgtgt

SEQ ID NO: 5632569 - DNA, 16 bp, Homo sapiens
gtgtgtgtatgtgtga

SEQ ID NO: 5632570 - DNA, 15 bp, Homo sapiens
gtgtgtgtctgtgcg

SEQ ID NO: 5632571 - DNA, 13 bp, Homo sapiens
gtgtgtgtgcaca

SEQ ID NO: 5632572 - DNA, 13 bp, Homo sapiens
gtgtgtgtgcatg

SEQ ID NO: 5632573 - DNA, 13 bp, Homo sapiens
gtgtgtgtgcccg

SEQ ID NO: 5632574 - DNA, 14 bp, Homo sapiens
gtgtgtgtggacag

SEQ ID NO: 5632575 - DNA, 14 bp, Homo sapiens
gtgtgtgtggaccc

SEQ ID NO: 5632576 - DNA, 15 bp, Homo sapiens
gtgtgtgtgtcagct

SEQ ID NO: 5632577 - DNA, 14 bp, Homo sapiens
gtgtgtgtgtcctt

SEQ ID NO: 5632578 - DNA, 13 bp, Homo sapiens
gtgtgtgtgtgca

SEQ ID NO: 5632579 - DNA, 15 bp, Homo sapiens
gtgtgtgtgtgtatg

SEQ ID NO: 5632580 - DNA, 15 bp, Homo sapiens
gtgtgtgtgtgtgtc

SEQ ID NO: 5632581 - DNA, 13 bp, Homo sapiens
gtgtgtgtgttgc

SEQ ID NO: 5632582 - DNA, 17 bp, Homo sapiens
gtgtgtgttgtgtgtgg

SEQ ID NO: 5632583 - DNA, 17 bp, Homo sapiens
gtgtgttaagctctgct

SEQ ID NO: 5632584 - DNA, 15 bp, Homo sapiens
gtgtgttacaatgta

SEQ ID NO: 5632585 - DNA, 19 bp, Homo sapiens
gtgtgttacaatgtaactt

SEQ ID NO: 5632586 - DNA, 21 bp, Homo sapiens
gtgtgttataaaataatgtac

SEQ ID NO: 5632587 - DNA, 18 bp, Homo sapiens
gtgtgttatattccaagg

SEQ ID NO: 5632588 - DNA, 15 bp, Homo sapiens
gtgtgttccaactgc

SEQ ID NO: 5632589 - DNA, 12 bp, Homo sapiens
gtgtgttcctgg

SEQ ID NO: 5632590 - DNA, 13 bp, Homo sapiens
gtgtgttctgtag

SEQ ID NO: 5632591 - DNA, 20 bp, Homo sapiens
gtgtgttcttcaagccagct

SEQ ID NO: 5632592 - DNA, 19 bp, Homo sapiens
gtgtgttcttttgatacat

SEQ ID NO: 5632593 - DNA, 16 bp, Homo sapiens
gtgtgttgatactgtt

SEQ ID NO: 5632594 - DNA, 20 bp, Homo sapiens
gtgtgttgatactgttgcac

SEQ ID NO: 5632595 - DNA, 13 bp, Homo sapiens
gtgtgttggacag

SEQ ID NO: 5632596 - DNA, 14 bp, Homo sapiens
gtgtgttgtctctt

SEQ ID NO: 5632597 - DNA, 19 bp, Homo sapiens
gtgtgttgtgtccattttg

SEQ ID NO: 5632598 - DNA, 13 bp, Homo sapiens
gtgtgttgtgtga

SEQ ID NO: 5632599 - DNA, 16 bp, Homo sapiens
gtgtgtttagaagcct

SEQ ID NO: 5632600 - DNA, 21 bp, Homo sapiens
gtgtgtttaggcctcatttct

SEQ ID NO: 5632601 - DNA, 23 bp, Homo sapiens
gtgtgtttattttttattatttt

SEQ ID NO: 5632602 - DNA, 18 bp, Homo sapiens
gtgtgtttcatccttccc

SEQ ID NO: 5632603 - DNA, 13 bp, Homo sapiens
gtgtgtttgtaat

SEQ ID NO: 5632604 - DNA, 16 bp, Homo sapiens
gtgtgtttgtgtgtgt

SEQ ID NO: 5632605 - DNA, 16 bp, Homo sapiens
gtgtgttttaaaatga

SEQ ID NO: 5632606 - DNA, 17 bp, Homo sapiens
gtgtgttttcagcaaat

SEQ ID NO: 5632607 - DNA, 14 bp, Homo sapiens
gtgtgttttggtat

SEQ ID NO: 5632608 - DNA, 20 bp, Homo sapiens
gtgtgtttttctattaaaag

SEQ ID NO: 5632609 - DNA, 12 bp, Homo sapiens
gtgttaaaacat

SEQ ID NO: 5632610 - DNA, 20 bp, Homo sapiens
gtgttaaaattttttgagtg

SEQ ID NO: 5632611 - DNA, 20 bp, Homo sapiens
gtgttaaagttgttttgatt

SEQ ID NO: 5632612 - DNA, 22 bp, Homo sapiens
gtgttaacagaagggagggcag

SEQ ID NO: 5632613 - DNA, 17 bp, Homo sapiens
gtgttaacattccaaga

SEQ ID NO: 5632614 - DNA, 20 bp, Homo sapiens
gtgttaacttgcctccatct

SEQ ID NO: 5632615 - DNA, 21 bp, Homo sapiens
gtgttaacttgcctccatctt

SEQ ID NO: 5632616 - DNA, 14 bp, Homo sapiens
gtgttaagattgca

SEQ ID NO: 5632617 - DNA, 20 bp, Homo sapiens
gtgttaatacatcacatctt

SEQ ID NO: 5632618 - DNA, 23 bp, Homo sapiens
gtgttaatacatcacatcttatt

SEQ ID NO: 5632619 - DNA, 16 bp, Homo sapiens
gtgttaatcatttcat

SEQ ID NO: 5632620 - DNA, 15 bp, Homo sapiens
gtgttaatccagaga

SEQ ID NO: 5632621 - DNA, 17 bp, Homo sapiens
gtgttaatgagtatatg

SEQ ID NO: 5632622 - DNA, 20 bp, Homo sapiens
gtgttaattgcgtagaggct

SEQ ID NO: 5632623 - DNA, 13 bp, Homo sapiens
gtgttaatttaag

SEQ ID NO: 5632624 - DNA, 16 bp, Homo sapiens
gtgttaattttgctaa

SEQ ID NO: 5632625 - DNA, 17 bp, Homo sapiens
gtgttaattttgctaac

SEQ ID NO: 5632626 - DNA, 20 bp, Homo sapiens
gtgttaattttgctaactgg

SEQ ID NO: 5632627 - DNA, 21 bp, Homo sapiens
gtgttacaatcagtgtgaatg

SEQ ID NO: 5632628 - DNA, 23 bp, Homo sapiens
gtgttacaatcgttctgtgtttg

SEQ ID NO: 5632629 - DNA, 21 bp, Homo sapiens
gtgttacacagcccaagagga

SEQ ID NO: 5632630 - DNA, 13 bp, Homo sapiens
gtgttacatgtat

SEQ ID NO: 5632631 - DNA, 23 bp, Homo sapiens
gtgttacccagtaactcatctgt

SEQ ID NO: 5632632 - DNA, 16 bp, Homo sapiens
gtgttacctgaaaaca

SEQ ID NO: 5632633 - DNA, 12 bp, Homo sapiens
gtgttacctgta

SEQ ID NO: 5632634 - DNA, 15 bp, Homo sapiens
gtgttacctgtgtgc

SEQ ID NO: 5632635 - DNA, 16 bp, Homo sapiens
gtgttacctgtgtgct

SEQ ID NO: 5632636 - DNA, 17 bp, Homo sapiens
gtgttaccttttaaaat

SEQ ID NO: 5632637 - DNA, 15 bp, Homo sapiens
gtgttactcatgtac

SEQ ID NO: 5632638 - DNA, 15 bp, Homo sapiens
gtgttactgcagtga

SEQ ID NO: 5632639 - DNA, 16 bp, Homo sapiens
gtgttactgcagttga

SEQ ID NO: 5632640 - DNA, 21 bp, Homo sapiens
gtgttactgcagttgaaaggg

SEQ ID NO: 5632641 - DNA, 19 bp, Homo sapiens
gtgttacttcaagtaatac

SEQ ID NO: 5632642 - DNA, 12 bp, Homo sapiens
gtgttacttgaa

SEQ ID NO: 5632643 - DNA, 13 bp, Homo sapiens
gtgttagaaaagt

SEQ ID NO: 5632644 - DNA, 13 bp, Homo sapiens
gtgttagagaaat

SEQ ID NO: 5632645 - DNA, 13 bp, Homo sapiens
gtgttagccagga

SEQ ID NO: 5632646 - DNA, 16 bp, Homo sapiens
gtgttaggaggctgca

SEQ ID NO: 5632647 - DNA, 21 bp, Homo sapiens
gtgttaggaggctgcatgctc

SEQ ID NO: 5632648 - DNA, 14 bp, Homo sapiens
gtgttaggcctggc

SEQ ID NO: 5632649 - DNA, 15 bp, Homo sapiens
gtgttaggcctggca

SEQ ID NO: 5632650 - DNA, 21 bp, Homo sapiens
gtgttaggcctggcacagtgt

SEQ ID NO: 5632651 - DNA, 24 bp, Homo sapiens
gtgttaggcctggcacagtgtctg

SEQ ID NO: 5632652 - DNA, 14 bp, Homo sapiens
gtgttagttaagaa

SEQ ID NO: 5632653 - DNA, 12 bp, Homo sapiens
gtgttagttccc

SEQ ID NO: 5632654 - DNA, 22 bp, Homo sapiens
gtgttataatacgctgctgatc

SEQ ID NO: 5632655 - DNA, 15 bp, Homo sapiens
gtgttataccaacta

SEQ ID NO: 5632656 - DNA, 14 bp, Homo sapiens
gtgttatatgaaca

SEQ ID NO: 5632657 - DNA, 17 bp, Homo sapiens
gtgttatatgaacatac

SEQ ID NO: 5632658 - DNA, 13 bp, Homo sapiens
gtgttatattcca

SEQ ID NO: 5632659 - DNA, 19 bp, Homo sapiens
gtgttatattccaaggaaa

SEQ ID NO: 5632660 - DNA, 22 bp, Homo sapiens
gtgttatgaacatccaagtctt

SEQ ID NO: 5632661 - DNA, 21 bp, Homo sapiens
gtgttatgggtgctgaactct

SEQ ID NO: 5632662 - DNA, 14 bp, Homo sapiens
gtgttatgtatttc

SEQ ID NO: 5632663 - DNA, 19 bp, Homo sapiens
gtgttatgtgaatttgagt

SEQ ID NO: 5632664 - DNA, 15 bp, Homo sapiens
gtgttattatttggc

SEQ ID NO: 5632665 - DNA, 13 bp, Homo sapiens
gtgttattatttt

SEQ ID NO: 5632666 - DNA, 17 bp, Homo sapiens
gtgttatttaaagaaga

SEQ ID NO: 5632667 - DNA, 17 bp, Homo sapiens
gtgttatttccccagcc

SEQ ID NO: 5632668 - DNA, 22 bp, Homo sapiens
gtgttatttccccagccacagg

SEQ ID NO: 5632669 - DNA, 20 bp, Homo sapiens
gtgttattttaatctcagaa

SEQ ID NO: 5632670 - DNA, 18 bp, Homo sapiens
gtgttattttctttgaaa

SEQ ID NO: 5632671 - DNA, 13 bp, Homo sapiens
gtgttatttttca

SEQ ID NO: 5632672 - DNA, 20 bp, Homo sapiens
gtgttcaaactactgtacat

SEQ ID NO: 5632673 - DNA, 14 bp, Homo sapiens
gtgttcaatatttt

SEQ ID NO: 5632674 - DNA, 18 bp, Homo sapiens
gtgttcacaaactgtgaa

SEQ ID NO: 5632675 - DNA, 14 bp, Homo sapiens
gtgttcacacacac

SEQ ID NO: 5632676 - DNA, 21 bp, Homo sapiens
gtgttcacacttttcagcaaa

SEQ ID NO: 5632677 - DNA, 22 bp, Homo sapiens
gtgttcacagacctcagcaggg

SEQ ID NO: 5632678 - DNA, 24 bp, Homo sapiens
gtgttcaccttcaaaatgttctat

SEQ ID NO: 5632679 - DNA, 22 bp, Homo sapiens
gtgttcactgtactctgtgggc

SEQ ID NO: 5632680 - DNA, 14 bp, Homo sapiens
gtgttcagaggcag

SEQ ID NO: 5632681 - DNA, 18 bp, Homo sapiens
gtgttcagagttccacag

SEQ ID NO: 5632682 - DNA, 20 bp, Homo sapiens
gtgttcagctctttccaaat

SEQ ID NO: 5632683 - DNA, 17 bp, Homo sapiens
gtgttcagtgccttgga

SEQ ID NO: 5632684 - DNA, 22 bp, Homo sapiens
gtgttcagtgttgacatagcct

SEQ ID NO: 5632685 - DNA, 22 bp, Homo sapiens
gtgttcagttccagcttttgta

SEQ ID NO: 5632686 - DNA, 17 bp, Homo sapiens
gtgttcatacatttgag

SEQ ID NO: 5632687 - DNA, 14 bp, Homo sapiens
gtgttcatttcatt

SEQ ID NO: 5632688 - DNA, 15 bp, Homo sapiens
gtgttcattttaagt

SEQ ID NO: 5632689 - DNA, 20 bp, Homo sapiens
gtgttccaagtctctgtgta

SEQ ID NO: 5632690 - DNA, 17 bp, Homo sapiens
gtgttccagctgcctgg

SEQ ID NO: 5632691 - DNA, 18 bp, Homo sapiens
gtgttccagctgcctggg

SEQ ID NO: 5632692 - DNA, 17 bp, Homo sapiens
gtgttccattgcctctt

SEQ ID NO: 5632693 - DNA, 18 bp, Homo sapiens
gtgttcccaatgctttgt

SEQ ID NO: 5632694 - DNA, 22 bp, Homo sapiens
gtgttcccattaagtggtagta

SEQ ID NO: 5632695 - DNA, 16 bp, Homo sapiens
gtgttccccagctgat

SEQ ID NO: 5632696 - DNA, 19 bp, Homo sapiens
gtgttccccatctgggtcc

SEQ ID NO: 5632697 - DNA, 18 bp, Homo sapiens
gtgttcccctcttgtctc

SEQ ID NO: 5632698 - DNA, 15 bp, Homo sapiens
gtgttccgtgggacc

SEQ ID NO: 5632699 - DNA, 17 bp, Homo sapiens
gtgttcctatggaaaca

SEQ ID NO: 5632700 - DNA, 19 bp, Homo sapiens
gtgttcctcaccaataact

SEQ ID NO: 5632701 - DNA, 19 bp, Homo sapiens
gtgttcctcctcccctctc

SEQ ID NO: 5632702 - DNA, 16 bp, Homo sapiens
gtgttcctcctgctgt

SEQ ID NO: 5632703 - DNA, 12 bp, Homo sapiens
gtgttcctcttt

SEQ ID NO: 5632704 - DNA, 14 bp, Homo sapiens
gtgttcctggaagc

SEQ ID NO: 5632705 - DNA, 19 bp, Homo sapiens
gtgttcctggcagtttaaa

SEQ ID NO: 5632706 - DNA, 14 bp, Homo sapiens
gtgttcctggctga

SEQ ID NO: 5632707 - DNA, 19 bp, Homo sapiens
gtgttcctgtctcaatagc

SEQ ID NO: 5632708 - DNA, 14 bp, Homo sapiens
gtgttccttccgct

SEQ ID NO: 5632709 - DNA, 13 bp, Homo sapiens
gtgttccttctgt

SEQ ID NO: 5632710 - DNA, 15 bp, Homo sapiens
gtgttcgctggctga

SEQ ID NO: 5632711 - DNA, 14 bp, Homo sapiens
gtgttcgcttggct

SEQ ID NO: 5632712 - DNA, 12 bp, Homo sapiens
gtgttcggagct

SEQ ID NO: 5632713 - DNA, 22 bp, Homo sapiens
gtgttcgggggagcagagagag

SEQ ID NO: 5632714 - DNA, 23 bp, Homo sapiens
gtgttcgggggagcagagagagc

SEQ ID NO: 5632715 - DNA, 23 bp, Homo sapiens
gtgttcgtggagccacaggcaga

SEQ ID NO: 5632716 - DNA, 20 bp, Homo sapiens
gtgttcgtttccatcatgtc

SEQ ID NO: 5632717 - DNA, 14 bp, Homo sapiens
gtgttctagttcct

SEQ ID NO: 5632718 - DNA, 20 bp, Homo sapiens
gtgttctatagagcctggcg

SEQ ID NO: 5632719 - DNA, 17 bp, Homo sapiens
gtgttctcaatgctttt

SEQ ID NO: 5632720 - DNA, 18 bp, Homo sapiens
gtgttctcacagtgacac

SEQ ID NO: 5632721 - DNA, 21 bp, Homo sapiens
gtgttctcacagtgacaccat

SEQ ID NO: 5632722 - DNA, 13 bp, Homo sapiens
gtgttctcagagg

SEQ ID NO: 5632723 - DNA, 20 bp, Homo sapiens
gtgttctcatgaagcaggag

SEQ ID NO: 5632724 - DNA, 12 bp, Homo sapiens
gtgttctcctcc

SEQ ID NO: 5632725 - DNA, 15 bp, Homo sapiens
gtgttctcctgctgc

SEQ ID NO: 5632726 - DNA, 23 bp, Homo sapiens
gttaaggacccttttaagcatgt

SEQ ID NO: 5632727 - DNA, 14 bp, Homo sapiens
gttaaggccagggc

SEQ ID NO: 5632728 - DNA, 16 bp, Homo sapiens
gttaagggaagctgat

SEQ ID NO: 5632729 - DNA, 17 bp, Homo sapiens
gttaagggcatttttat

SEQ ID NO: 5632730 - DNA, 16 bp, Homo sapiens
gttaagtacccgaggc

SEQ ID NO: 5632731 - DNA, 21 bp, Homo sapiens
gttaagtatcagctacaattg

SEQ ID NO: 5632732 - DNA, 14 bp, Homo sapiens
gttaagtcatccac

SEQ ID NO: 5632733 - DNA, 21 bp, Homo sapiens
gttaagtcccattcagtggca

SEQ ID NO: 5632734 - DNA, 22 bp, Homo sapiens
gttaagtctaaatatttcctta

SEQ ID NO: 5632735 - DNA, 15 bp, Homo sapiens
gttaagtctgtttta

SEQ ID NO: 5632736 - DNA, 18 bp, Homo sapiens
gttaagtgactgagaaga

SEQ ID NO: 5632737 - DNA, 23 bp, Homo sapiens
gttaagtgccattactactgtac

SEQ ID NO: 5632738 - DNA, 14 bp, Homo sapiens
gttaagtggtttca

SEQ ID NO: 5632739 - DNA, 14 bp, Homo sapiens
gttaagttctattg

SEQ ID NO: 5632740 - DNA, 23 bp, Homo sapiens
gttaagttggcttctgtttctag

SEQ ID NO: 5632741 - DNA, 14 bp, Homo sapiens
gttaagttttcttg

SEQ ID NO: 5632742 - DNA, 22 bp, Homo sapiens
gttaagtttttcccttcatctg

SEQ ID NO: 5632743 - DNA, 12 bp, Homo sapiens
gttaataaaagt

SEQ ID NO: 5632744 - DNA, 18 bp, Homo sapiens
gttaataaaataattatg

SEQ ID NO: 5632745 - DNA, 23 bp, Homo sapiens
gttaataaaataattatgatcta

SEQ ID NO: 5632746 - DNA, 17 bp, Homo sapiens
gttaataaactgcaaat

SEQ ID NO: 5632747 - DNA, 13 bp, Homo sapiens
gttaataaatgga

SEQ ID NO: 5632748 - DNA, 17 bp, Homo sapiens
gttaataacagctcctt

SEQ ID NO: 5632749 - DNA, 14 bp, Homo sapiens
gttaataagtctct

SEQ ID NO: 5632750 - DNA, 18 bp, Homo sapiens
gttaataagttgatgttt

SEQ ID NO: 5632751 - DNA, 21 bp, Homo sapiens
gttaataagttgatgttttct

SEQ ID NO: 5632752 - DNA, 16 bp, Homo sapiens
gttaatacaaggtata

SEQ ID NO: 5632753 - DNA, 18 bp, Homo sapiens
gttaatacgcaggcatct

SEQ ID NO: 5632754 - DNA, 14 bp, Homo sapiens
gttaatagacagta

SEQ ID NO: 5632755 - DNA, 18 bp, Homo sapiens
gttaatatctgatactgt

SEQ ID NO: 5632756 - DNA, 14 bp, Homo sapiens
gttaatatggctga

SEQ ID NO: 5632757 - DNA, 21 bp, Homo sapiens
gttaatattaaaaagtctgta

SEQ ID NO: 5632758 - DNA, 18 bp, Homo sapiens
gttaatattgatttatta

SEQ ID NO: 5632759 - DNA, 14 bp, Homo sapiens
gttaatatttcttc

SEQ ID NO: 5632760 - DNA, 22 bp, Homo sapiens
gttaatatttgaattgccttgc

SEQ ID NO: 5632761 - DNA, 20 bp, Homo sapiens
gttaatattttacttttaca

SEQ ID NO: 5632762 - DNA, 17 bp, Homo sapiens
gttaatcaactgaaagt

SEQ ID NO: 5632763 - DNA, 14 bp, Homo sapiens
gttaatcaatttaa

SEQ ID NO: 5632764 - DNA, 18 bp, Homo sapiens
gttaatcagagtatctga

SEQ ID NO: 5632765 - DNA, 13 bp, Homo sapiens
gttaatcagtgtt

SEQ ID NO: 5632766 - DNA, 16 bp, Homo sapiens
gttaatcatcttctct

SEQ ID NO: 5632767 - DNA, 19 bp, Homo sapiens
gttaatctcccagcccacc

SEQ ID NO: 5632768 - DNA, 18 bp, Homo sapiens
gttaatctctgttatgta

SEQ ID NO: 5632769 - DNA, 19 bp, Homo sapiens
gttaatcttaatgtatatc

SEQ ID NO: 5632770 - DNA, 17 bp, Homo sapiens
gttaatcttgctgctta

SEQ ID NO: 5632771 - DNA, 13 bp, Homo sapiens
gttaatcttgctt

SEQ ID NO: 5632772 - DNA, 12 bp, Homo sapiens
gttaatgaaaaa

SEQ ID NO: 5632773 - DNA, 21 bp, Homo sapiens
gttaatgaaaaatctgaattt

SEQ ID NO: 5632774 - DNA, 20 bp, Homo sapiens
gttaatgaaggtgtgctaca

SEQ ID NO: 5632775 - DNA, 23 bp, Homo sapiens
gttaatgatggttgatgggttct

SEQ ID NO: 5632776 - DNA, 19 bp, Homo sapiens
gttaatgcattgttgtaaa

SEQ ID NO: 5632777 - DNA, 21 bp, Homo sapiens
gttaatgcattgttgtaaagt

SEQ ID NO: 5632778 - DNA, 17 bp, Homo sapiens
gttaatgctctatgttt

SEQ ID NO: 5632779 - DNA, 20 bp, Homo sapiens
gttaatgctctatgtttgta

SEQ ID NO: 5632780 - DNA, 22 bp, Homo sapiens
gttaatgctgaaacatcattac

SEQ ID NO: 5632781 - DNA, 15 bp, Homo sapiens
gttaatgctttctga

SEQ ID NO: 5632782 - DNA, 22 bp, Homo sapiens
gttaatggctagtactgtattg

SEQ ID NO: 5632783 - DNA, 15 bp, Homo sapiens
gttaatggtagcatt

SEQ ID NO: 5632784 - DNA, 19 bp, Homo sapiens
gttaatgtactctttggct

SEQ ID NO: 5632785 - DNA, 23 bp, Homo sapiens
gttaatgtatttgttcatgtttg

SEQ ID NO: 5632786 - DNA, 22 bp, Homo sapiens
gttaatgtcaaggaaaggatgc

SEQ ID NO: 5632787 - DNA, 17 bp, Homo sapiens
gttaatgtcattgctaa

SEQ ID NO: 5632788 - DNA, 23 bp, Homo sapiens
gttaatgttgggatttatatcta

SEQ ID NO: 5632789 - DNA, 13 bp, Homo sapiens
gttaattaaacaa

SEQ ID NO: 5632790 - DNA, 18 bp, Homo sapiens
gttaattaatgtcatgtt

SEQ ID NO: 5632791 - DNA, 20 bp, Homo sapiens
gttaattaatgtcatgttgc

SEQ ID NO: 5632792 - DNA, 17 bp, Homo sapiens
gttaattataaacagca

SEQ ID NO: 5632793 - DNA, 16 bp, Homo sapiens
gttaattatgtacaac

SEQ ID NO: 5632794 - DNA, 21 bp, Homo sapiens
gttaattcagcactgatttca

SEQ ID NO: 5632795 - DNA, 14 bp, Homo sapiens
gttaattcatttgg

SEQ ID NO: 5632796 - DNA, 20 bp, Homo sapiens
gttaattctcagaagtgaaa

SEQ ID NO: 5632797 - DNA, 17 bp, Homo sapiens
gttaattgatagaataa

SEQ ID NO: 5632798 - DNA, 21 bp, Homo sapiens
gttaattgattaaactgtatg

SEQ ID NO: 5632799 - DNA, 13 bp, Homo sapiens
gttaatttaagtt

SEQ ID NO: 5632800 - DNA, 19 bp, Homo sapiens
gttaatttaagttttgaca

SEQ ID NO: 5632801 - DNA, 21 bp, Homo sapiens
gttaatttatctaaattaaag

SEQ ID NO: 5632802 - DNA, 16 bp, Homo sapiens
gttaatttattttgct

SEQ ID NO: 5632803 - DNA, 12 bp, Homo sapiens
gttaatttcatt

SEQ ID NO: 5632804 - DNA, 23 bp, Homo sapiens
gttaatttctccctatgtttatt

SEQ ID NO: 5632805 - DNA, 12 bp, Homo sapiens
gttaatttggac

SEQ ID NO: 5632806 - DNA, 17 bp, Homo sapiens
gttaatttggaccattt

SEQ ID NO: 5632807 - DNA, 12 bp, Homo sapiens
gttaattttacc

SEQ ID NO: 5632808 - DNA, 16 bp, Homo sapiens
gttaattttaccttgt

SEQ ID NO: 5632809 - DNA, 18 bp, Homo sapiens
gttaattttattcaagaa

SEQ ID NO: 5632810 - DNA, 16 bp, Homo sapiens
gttaattttcctcatt

SEQ ID NO: 5632811 - DNA, 17 bp, Homo sapiens
gttaattttgctaactg

SEQ ID NO: 5632812 - DNA, 18 bp, Homo sapiens
gttaattttgctaactgg

SEQ ID NO: 5632813 - DNA, 21 bp, Homo sapiens
gttaatttttcctgcatgttc

SEQ ID NO: 5632814 - DNA, 18 bp, Homo sapiens
gttaatttttccttcctc

SEQ ID NO: 5632815 - DNA, 21 bp, Homo sapiens
gttaatttttcttagtgttgt

SEQ ID NO: 5632816 - DNA, 14 bp, Homo sapiens
gttaatttttgata

SEQ ID NO: 5632817 - DNA, 21 bp, Homo sapiens
gttacaaaatgtaactgttac

SEQ ID NO: 5632818 - DNA, 14 bp, Homo sapiens
gttacaaactgcaa

SEQ ID NO: 5632819 - DNA, 16 bp, Homo sapiens
gttacaaactgcaata

SEQ ID NO: 5632820 - DNA, 15 bp, Homo sapiens
gttacaaattataat

SEQ ID NO: 5632821 - DNA, 17 bp, Homo sapiens
gttacaaattataatgt

SEQ ID NO: 5632822 - DNA, 13 bp, Homo sapiens
gttacaacagatt

SEQ ID NO: 5632823 - DNA, 14 bp, Homo sapiens
gttacaacagattt

SEQ ID NO: 5632824 - DNA, 22 bp, Homo sapiens
gttacaagtatacttatatttc

SEQ ID NO: 5632825 - DNA, 23 bp, Homo sapiens
gttacaagtttgctaaaagaaga

SEQ ID NO: 5632826 - DNA, 12 bp, Homo sapiens
gttacaataaag

SEQ ID NO: 5632827 - DNA, 19 bp, Homo sapiens
gttacaatcagtgtgaatg

SEQ ID NO: 5632828 - DNA, 14 bp, Homo sapiens
gttacacaaagaac

SEQ ID NO: 5632829 - DNA, 20 bp, Homo sapiens
gttacacagaaatgctgctg

SEQ ID NO: 5632830 - DNA, 21 bp, Homo sapiens
gttacacagaaatgctgctgg

SEQ ID NO: 5632831 - DNA, 17 bp, Homo sapiens
gttacacagtgtgaata

SEQ ID NO: 5632832 - DNA, 16 bp, Homo sapiens
gttacacattaaacag

SEQ ID NO: 5632833 - DNA, 19 bp, Homo sapiens
gttacacattaaacaggat

SEQ ID NO: 5632834 - DNA, 17 bp, Homo sapiens
gttacacatttttcaga

SEQ ID NO: 5632835 - DNA, 24 bp, Homo sapiens
gttacacctccactcagcactctg

SEQ ID NO: 5632836 - DNA, 22 bp, Homo sapiens
gttacactggaggagagaagaa

SEQ ID NO: 5632837 - DNA, 13 bp, Homo sapiens
gttacacttttat

SEQ ID NO: 5632838 - DNA, 12 bp, Homo sapiens
gttacagaaagt

SEQ ID NO: 5632839 - DNA, 13 bp, Homo sapiens
gttacagaaagtg

SEQ ID NO: 5632840 - DNA, 15 bp, Homo sapiens
gttacagactgaaag

SEQ ID NO: 5632841 - DNA, 23 bp, Homo sapiens
gttacagagaatttctaaagtaa

SEQ ID NO: 5632842 - DNA, 22 bp, Homo sapiens
gttacagagacctatgtaagaa

SEQ ID NO: 5632843 - DNA, 21 bp, Homo sapiens
gttacagcacaaaatgatggc

SEQ ID NO: 5632844 - DNA, 18 bp, Homo sapiens
gttacagcctgttagtaa

SEQ ID NO: 5632845 - DNA, 21 bp, Homo sapiens
gttacagcctgttagtaacat

SEQ ID NO: 5632846 - DNA, 21 bp, Homo sapiens
gttacagcgagaggcagagaa

SEQ ID NO: 5632847 - DNA, 12 bp, Homo sapiens
gttacagctgaa

SEQ ID NO: 5632848 - DNA, 22 bp, Homo sapiens
gttacaggcaccgagaatgttg

SEQ ID NO: 5632849 - DNA, 14 bp, Homo sapiens
gttacagggcccag

SEQ ID NO: 5632850 - DNA, 19 bp, Homo sapiens
gttacaggtaccagttctt

SEQ ID NO: 5632851 - DNA, 19 bp, Homo sapiens
gttacagtaaatacactgt

SEQ ID NO: 5632852 - DNA, 22 bp, Homo sapiens
gttacagtaatgtcataaagtg

SEQ ID NO: 5632853 - DNA, 17 bp, Homo sapiens
gttacagtatgcttgct

SEQ ID NO: 5632854 - DNA, 22 bp, Homo sapiens
gttacagtccagttttgtgtgc

SEQ ID NO: 5632855 - DNA, 15 bp, Homo sapiens
gttacagtgcagaca

SEQ ID NO: 5632856 - DNA, 18 bp, Homo sapiens
gttacagtggcagtattg

SEQ ID NO: 5632857 - DNA, 14 bp, Homo sapiens
gttacagttctgtg

SEQ ID NO: 5632858 - DNA, 16 bp, Homo sapiens
gttacagtttgcacaa

SEQ ID NO: 5632859 - DNA, 18 bp, Homo sapiens
gttacataagataaatgt

SEQ ID NO: 5632860 - DNA, 18 bp, Homo sapiens
gttacataaggatgactt

SEQ ID NO: 5632861 - DNA, 19 bp, Homo sapiens
gttacataaggatgacttt

SEQ ID NO: 5632862 - DNA, 23 bp, Homo sapiens
gttacataatcagtatatttggt

SEQ ID NO: 5632863 - DNA, 14 bp, Homo sapiens
gttacatacattta

SEQ ID NO: 5632864 - DNA, 17 bp, Homo sapiens
gttacatacatttaaaa

SEQ ID NO: 5632865 - DNA, 15 bp, Homo sapiens
gttacatctgtgcag

SEQ ID NO: 5632866 - DNA, 22 bp, Homo sapiens
gttacatgaagatgttaaaatc

SEQ ID NO: 5632867 - DNA, 17 bp, Homo sapiens
gttacatgtaatatatt

SEQ ID NO: 5632868 - DNA, 14 bp, Homo sapiens
gttacattaaaata

SEQ ID NO: 5632869 - DNA, 21 bp, Homo sapiens
gttacattaaagccctgtgtt

SEQ ID NO: 5632870 - DNA, 18 bp, Homo sapiens
gttacattaatgcccagc

SEQ ID NO: 5632871 - DNA, 13 bp, Homo sapiens
gttacatttatgt

SEQ ID NO: 5632872 - DNA, 21 bp, Homo sapiens
gttacatttctatcagtactt

SEQ ID NO: 5632873 - DNA, 18 bp, Homo sapiens
gttaccaaagcaatattt

SEQ ID NO: 5632874 - DNA, 19 bp, Homo sapiens
gttaccaaagcaatatttc

SEQ ID NO: 5632875 - DNA, 12 bp, Homo sapiens
gttaccacagca

SEQ ID NO: 5632876 - DNA, 13 bp, Homo sapiens
gttaccatgaaga

SEQ ID NO: 5632877 - DNA, 15 bp, Homo sapiens
gttaccatgtcactg

SEQ ID NO: 5632878 - DNA, 23 bp, Homo sapiens
gttaccattaaaccatctccctg

SEQ ID NO: 5632879 - DNA, 19 bp, Homo sapiens
gttaccattggaaatttca

SEQ ID NO: 5632880 - DNA, 16 bp, Homo sapiens
gttaccatttacatgt

SEQ ID NO: 5632881 - DNA, 21 bp, Homo sapiens
gttaccattttaacgctgcct

SEQ ID NO: 5632882 - DNA, 23 bp, Homo sapiens
gttacccaaaatctgattagaag

SEQ ID NO: 5632883 - DNA, 19 bp, Homo sapiens
gttacccaaagggcttatt

SEQ ID NO: 5632884 - DNA, 16 bp, Homo sapiens
gttacccaaattaaga

SEQ ID NO: 5632885 - DNA, 13 bp, Homo sapiens
gttacccacccta

SEQ ID NO: 5632886 - DNA, 20 bp, Homo sapiens
gttacccagtaactcatctg

SEQ ID NO: 5632887 - DNA, 14 bp, Homo sapiens
gttacccatgaaaa

SEQ ID NO: 5632888 - DNA, 16 bp, Homo sapiens
gttaccccaccctgcc

SEQ ID NO: 5632889 - DNA, 17 bp, Homo sapiens
gttaccctcctgtaaat

SEQ ID NO: 5632890 - DNA, 18 bp, Homo sapiens
gttaccgagtatctgtaa

SEQ ID NO: 5632891 - DNA, 16 bp, Homo sapiens
gttaccgcctgtctct

SEQ ID NO: 5632892 - DNA, 16 bp, Homo sapiens
gttacctaaagtattt

SEQ ID NO: 5632893 - DNA, 20 bp, Homo sapiens
gttacctaaagtatttttat

SEQ ID NO: 5632894 - DNA, 17 bp, Homo sapiens
gttacctaggttaacaa

SEQ ID NO: 5632895 - DNA, 22 bp, Homo sapiens
gttacctccaacagaactaaat

SEQ ID NO: 5632896 - DNA, 22 bp, Homo sapiens
gttacctccctcgccccaaggt

SEQ ID NO: 5632897 - DNA, 14 bp, Homo sapiens
gttacctgtgtgct

SEQ ID NO: 5632898 - DNA, 14 bp, Homo sapiens
gttaccttactgaa

SEQ ID NO: 5632899 - DNA, 15 bp, Homo sapiens
gttaccttatagtta

SEQ ID NO: 5632900 - DNA, 22 bp, Homo sapiens
gttaccttggcgtgtgtccctg

SEQ ID NO: 5632901 - DNA, 23 bp, Homo sapiens
gttacctttctaggtcaaggcct

SEQ ID NO: 5632902 - DNA, 18 bp, Homo sapiens
gttcacagcttttcttga

SEQ ID NO: 5632903 - DNA, 17 bp, Homo sapiens
gttcacagtagagtagg

SEQ ID NO: 5632904 - DNA, 18 bp, Homo sapiens
gttcacagtagagtaggg

SEQ ID NO: 5632905 - DNA, 16 bp, Homo sapiens
gttcacagtgtttctt

SEQ ID NO: 5632906 - DNA, 19 bp, Homo sapiens
gttcacatatgattctctt

SEQ ID NO: 5632907 - DNA, 19 bp, Homo sapiens
gttcacatgattctcctgc

SEQ ID NO: 5632908 - DNA, 19 bp, Homo sapiens
gttcacatgtgccctgcct

SEQ ID NO: 5632909 - DNA, 18 bp, Homo sapiens
gttcacattaactcaggc

SEQ ID NO: 5632910 - DNA, 16 bp, Homo sapiens
gttcacattagaatta

SEQ ID NO: 5632911 - DNA, 12 bp, Homo sapiens
gttcacattttt

SEQ ID NO: 5632912 - DNA, 22 bp, Homo sapiens
gttcaccagagaaagcttgagg

SEQ ID NO: 5632913 - DNA, 16 bp, Homo sapiens
gttcaccagccctgag

SEQ ID NO: 5632914 - DNA, 17 bp, Homo sapiens
gttcaccagccctgagc

SEQ ID NO: 5632915 - DNA, 12 bp, Homo sapiens
gttcaccagcct

SEQ ID NO: 5632916 - DNA, 19 bp, Homo sapiens
gttcacccatcttatcaag

SEQ ID NO: 5632917 - DNA, 22 bp, Homo sapiens
gttcacctatttcaaaaatttg

SEQ ID NO: 5632918 - DNA, 21 bp, Homo sapiens
gttcacctccaagcatttcat

SEQ ID NO: 5632919 - DNA, 18 bp, Homo sapiens
gttcacctccctgctcag

SEQ ID NO: 5632920 - DNA, 13 bp, Homo sapiens
gttcaccttatgt

SEQ ID NO: 5632921 - DNA, 19 bp, Homo sapiens
gttcaccttcaaaatgttc

SEQ ID NO: 5632922 - DNA, 16 bp, Homo sapiens
gttcaccttctgtgca

SEQ ID NO: 5632923 - DNA, 15 bp, Homo sapiens
gttcaccttggaagg

SEQ ID NO: 5632924 - DNA, 14 bp, Homo sapiens
gttcacctttgtag

SEQ ID NO: 5632925 - DNA, 17 bp, Homo sapiens
gttcacgccattctcct

SEQ ID NO: 5632926 - DNA, 15 bp, Homo sapiens
gttcacgctcaccca

SEQ ID NO: 5632927 - DNA, 18 bp, Homo sapiens
gttcacgctcacccagtc

SEQ ID NO: 5632928 - DNA, 20 bp, Homo sapiens
gttcacggtgacacaggtca

SEQ ID NO: 5632929 - DNA, 21 bp, Homo sapiens
gttcacgtaagatacaagttt

SEQ ID NO: 5632930 - DNA, 22 bp, Homo sapiens
gttcacgtacaaaactctgtat

SEQ ID NO: 5632931 - DNA, 16 bp, Homo sapiens
gttcacgtcactgcca

SEQ ID NO: 5632932 - DNA, 21 bp, Homo sapiens
gttcactactacacccagcta

SEQ ID NO: 5632933 - DNA, 14 bp, Homo sapiens
gttcactagagctg

SEQ ID NO: 5632934 - DNA, 16 bp, Homo sapiens
gttcactagagctggg

SEQ ID NO: 5632935 - DNA, 19 bp, Homo sapiens
gttcactccccgcctcccc

SEQ ID NO: 5632936 - DNA, 20 bp, Homo sapiens
gttcactccgggtcaagttg

SEQ ID NO: 5632937 - DNA, 13 bp, Homo sapiens
gttcactcttctc

SEQ ID NO: 5632938 - DNA, 19 bp, Homo sapiens
gttcactcttggagcctgc

SEQ ID NO: 5632939 - DNA, 22 bp, Homo sapiens
gttcactgagctccccagatct

SEQ ID NO: 5632940 - DNA, 13 bp, Homo sapiens
gttcactgcactg

SEQ ID NO: 5632941 - DNA, 13 bp, Homo sapiens
gttcactggagtc

SEQ ID NO: 5632942 - DNA, 17 bp, Homo sapiens
gttcacttaaattcttt

SEQ ID NO: 5632943 - DNA, 16 bp, Homo sapiens
gttcacttcatcttct

SEQ ID NO: 5632944 - DNA, 13 bp, Homo sapiens
gttcacttcctag

SEQ ID NO: 5632945 - DNA, 20 bp, Homo sapiens
gttcacttgggctctctcta

SEQ ID NO: 5632946 - DNA, 20 bp, Homo sapiens
gttcacttttgacaaaggca

SEQ ID NO: 5632947 - DNA, 19 bp, Homo sapiens
gttcagaaaaaatgtgaag

SEQ ID NO: 5632948 - DNA, 17 bp, Homo sapiens
gttcagaaatgctgcct

SEQ ID NO: 5632949 - DNA, 15 bp, Homo sapiens
gttcagaaatttaaa

SEQ ID NO: 5632950 - DNA, 20 bp, Homo sapiens
gttcagaaatttaaaagcag

SEQ ID NO: 5632951 - DNA, 22 bp, Homo sapiens
gttcagaaatttggcattgatc

SEQ ID NO: 5632952 - DNA, 18 bp, Homo sapiens
gttcagaacttcatctgc

SEQ ID NO: 5632953 - DNA, 19 bp, Homo sapiens
gttcagaagaatcttcctg

SEQ ID NO: 5632954 - DNA, 16 bp, Homo sapiens
gttcagaatggcagtc

SEQ ID NO: 5632955 - DNA, 18 bp, Homo sapiens
gttcagaattaagcagaa

SEQ ID NO: 5632956 - DNA, 22 bp, Homo sapiens
gttcagaattttggaaaaatgt

SEQ ID NO: 5632957 - DNA, 15 bp, Homo sapiens
gttcagacaagacag

SEQ ID NO: 5632958 - DNA, 23 bp, Homo sapiens
gttcagacaagacagaggggagc

SEQ ID NO: 5632959 - DNA, 18 bp, Homo sapiens
gttcagagactggcagcc

SEQ ID NO: 5632960 - DNA, 22 bp, Homo sapiens
gttcagagactggcagccaggg

SEQ ID NO: 5632961 - DNA, 18 bp, Homo sapiens
gttcagagatcaggatca

SEQ ID NO: 5632962 - DNA, 18 bp, Homo sapiens
gttcagagccaagcctta

SEQ ID NO: 5632963 - DNA, 17 bp, Homo sapiens
gttcagaggaagcacat

SEQ ID NO: 5632964 - DNA, 17 bp, Homo sapiens
gttcagaggcagcacca

SEQ ID NO: 5632965 - DNA, 16 bp, Homo sapiens
gttcagagtggctcac

SEQ ID NO: 5632966 - DNA, 20 bp, Homo sapiens
gttcagagtggctcactggc

SEQ ID NO: 5632967 - DNA, 19 bp, Homo sapiens
gttcagataattgaataag

SEQ ID NO: 5632968 - DNA, 14 bp, Homo sapiens
gttcagatctcata

SEQ ID NO: 5632969 - DNA, 21 bp, Homo sapiens
gttcagatctcatagatgacc

SEQ ID NO: 5632970 - DNA, 14 bp, Homo sapiens
gttcagattaaaaa

SEQ ID NO: 5632971 - DNA, 16 bp, Homo sapiens
gttcagattgctttga

SEQ ID NO: 5632972 - DNA, 16 bp, Homo sapiens
gttcagattttactgt

SEQ ID NO: 5632973 - DNA, 22 bp, Homo sapiens
gttcagcaaactaaccagcatt

SEQ ID NO: 5632974 - DNA, 24 bp, Homo sapiens
gttcagcaaactaaccagcattcc

SEQ ID NO: 5632975 - DNA, 17 bp, Homo sapiens
gttcagcaccaccctag

SEQ ID NO: 5632976 - DNA, 16 bp, Homo sapiens
gttcagcactgtccct

SEQ ID NO: 5632977 - DNA, 22 bp, Homo sapiens
gttcagcactgtcccttgcctc

SEQ ID NO: 5632978 - DNA, 14 bp, Homo sapiens
gttcagcagtacag

SEQ ID NO: 5632979 - DNA, 13 bp, Homo sapiens
gttcagcatagag

SEQ ID NO: 5632980 - DNA, 22 bp, Homo sapiens
gttcagccattgtggaagacag

SEQ ID NO: 5632981 - DNA, 17 bp, Homo sapiens
gttcagcccctcctctg

SEQ ID NO: 5632982 - DNA, 22 bp, Homo sapiens
gttcagcccctcctctgccacc

SEQ ID NO: 5632983 - DNA, 19 bp, Homo sapiens
gttcagcccctgatctctg

SEQ ID NO: 5632984 - DNA, 12 bp, Homo sapiens
gttcagcctggc

SEQ ID NO: 5632985 - DNA, 12 bp, Homo sapiens
gttcagcctgtc

SEQ ID NO: 5632986 - DNA, 15 bp, Homo sapiens
gttcagcctgtctcc

SEQ ID NO: 5632987 - DNA, 22 bp, Homo sapiens
gttcagcgctgtcaggattgcg

SEQ ID NO: 5632988 - DNA, 22 bp, Homo sapiens
gttcagctaagctaggaatgaa

SEQ ID NO: 5632989 - DNA, 16 bp, Homo sapiens
gttcagctccagctca

SEQ ID NO: 5632990 - DNA, 15 bp, Homo sapiens
gttcagctgcttctc

SEQ ID NO: 5632991 - DNA, 21 bp, Homo sapiens
gttcagctgtcctccctccac

SEQ ID NO: 5632992 - DNA, 12 bp, Homo sapiens
gttcagcttggg

SEQ ID NO: 5632993 - DNA, 13 bp, Homo sapiens
gttcaggagactt

SEQ ID NO: 5632994 - DNA, 20 bp, Homo sapiens
gttcaggagtcccaaggaaa

SEQ ID NO: 5632995 - DNA, 21 bp, Homo sapiens
gttcaggagtcccaaggaaag

SEQ ID NO: 5632996 - DNA, 16 bp, Homo sapiens
gttcaggcattccagg

SEQ ID NO: 5632997 - DNA, 17 bp, Homo sapiens
gttcagggaactgcttg

SEQ ID NO: 5632998 - DNA, 17 bp, Homo sapiens
gttcagggaccgtccag

SEQ ID NO: 5632999 - DNA, 17 bp, Homo sapiens
gttcagggaggggctga

SEQ ID NO: 5633000 - DNA, 17 bp, Homo sapiens
gttcagggcatcggcag

SEQ ID NO: 5633001 - DNA, 15 bp, Homo sapiens
gttcaggggactcag

SEQ ID NO: 5633002 - DNA, 20 bp, Homo sapiens
gttcaggggactcagccctg

SEQ ID NO: 5633003 - DNA, 21 bp, Homo sapiens
gttcagggttggcccctgccc

SEQ ID NO: 5633004 - DNA, 18 bp, Homo sapiens
gttcaggtaacaggcaga

SEQ ID NO: 5633005 - DNA, 22 bp, Homo sapiens
gttcaggtgaataataaaatca

SEQ ID NO: 5633006 - DNA, 17 bp, Homo sapiens
gttcagtacctggagga

SEQ ID NO: 5633007 - DNA, 15 bp, Homo sapiens
gttcagtagaattac

SEQ ID NO: 5633008 - DNA, 18 bp, Homo sapiens
gttcagtagcttatctca

SEQ ID NO: 5633009 - DNA, 17 bp, Homo sapiens
gttcagtagttccagga

SEQ ID NO: 5633010 - DNA, 16 bp, Homo sapiens
gttcagtattgcaata

SEQ ID NO: 5633011 - DNA, 14 bp, Homo sapiens
gttcagtcctctgc

SEQ ID NO: 5633012 - DNA, 15 bp, Homo sapiens
gttcagtcctctgca

SEQ ID NO: 5633013 - DNA, 20 bp, Homo sapiens
gttcagtcttgtctttgata

SEQ ID NO: 5633014 - DNA, 17 bp, Homo sapiens
gttcagtggcagggctc

SEQ ID NO: 5633015 - DNA, 16 bp, Homo sapiens
gttcagtgtaatttct

SEQ ID NO: 5633016 - DNA, 19 bp, Homo sapiens
gttcagtgtaatttctttg

SEQ ID NO: 5633017 - DNA, 15 bp, Homo sapiens
gttcagtgttgacat

SEQ ID NO: 5633018 - DNA, 16 bp, Homo sapiens
gttcagtgttgacata

SEQ ID NO: 5633019 - DNA, 19 bp, Homo sapiens
gttcagtgttgacatagcc

SEQ ID NO: 5633020 - DNA, 23 bp, Homo sapiens
gttcagtgttgacatagcctttg

SEQ ID NO: 5633021 - DNA, 15 bp, Homo sapiens
gttcagtgtttctgg

SEQ ID NO: 5633022 - DNA, 14 bp, Homo sapiens
gttcagttacagaa

SEQ ID NO: 5633023 - DNA, 18 bp, Homo sapiens
gttcagttccagcttttg

SEQ ID NO: 5633024 - DNA, 18 bp, Homo sapiens
gttcagtttcttctgcgc

SEQ ID NO: 5633025 - DNA, 20 bp, Homo sapiens
gttcagtttgtctctttgca

SEQ ID NO: 5633026 - DNA, 15 bp, Homo sapiens
gttcataaaaaataa

SEQ ID NO: 5633027 - DNA, 20 bp, Homo sapiens
gttcataaaacggtgctttc

SEQ ID NO: 5633028 - DNA, 21 bp, Homo sapiens
gttcataaaggtttacagtga

SEQ ID NO: 5633029 - DNA, 12 bp, Homo sapiens
gttcataaatga

SEQ ID NO: 5633030 - DNA, 20 bp, Homo sapiens
gttcataacagtgccattgt

SEQ ID NO: 5633031 - DNA, 19 bp, Homo sapiens
gttcataaccaacaatata

SEQ ID NO: 5633032 - DNA, 19 bp, Homo sapiens
gttcataactgctacttgc

SEQ ID NO: 5633033 - DNA, 18 bp, Homo sapiens
gttcataataaaagtgaa

SEQ ID NO: 5633034 - DNA, 14 bp, Homo sapiens
gttcataatttcag

SEQ ID NO: 5633035 - DNA, 22 bp, Homo sapiens
gttcatacactaaccaaatctc

SEQ ID NO: 5633036 - DNA, 14 bp, Homo sapiens
gttcatacattgta

SEQ ID NO: 5633037 - DNA, 19 bp, Homo sapiens
gttcatacctaagtactgt

SEQ ID NO: 5633038 - DNA, 17 bp, Homo sapiens
gttcatacgcatcccat

SEQ ID NO: 5633039 - DNA, 22 bp, Homo sapiens
gttcatacgcatcccatctctc

SEQ ID NO: 5633040 - DNA, 19 bp, Homo sapiens
gttcatagatattggaaga

SEQ ID NO: 5633041 - DNA, 19 bp, Homo sapiens
gttcatagttggaaatatt

SEQ ID NO: 5633042 - DNA, 20 bp, Homo sapiens
gttcatagtttctgtaattg

SEQ ID NO: 5633043 - DNA, 14 bp, Homo sapiens
gttcatataattta

SEQ ID NO: 5633044 - DNA, 16 bp, Homo sapiens
gttcatatagccaggg

SEQ ID NO: 5633045 - DNA, 20 bp, Homo sapiens
gttcatatatcaagaagtct

SEQ ID NO: 5633046 - DNA, 19 bp, Homo sapiens
gttcatatgctctgctttt

SEQ ID NO: 5633047 - DNA, 18 bp, Homo sapiens
gttcatattaagaatgat

SEQ ID NO: 5633048 - DNA, 15 bp, Homo sapiens
gttcatattggattg

SEQ ID NO: 5633049 - DNA, 17 bp, Homo sapiens
gttcatatttattgatt

SEQ ID NO: 5633050 - DNA, 17 bp, Homo sapiens
gttcatcacctgctaga

SEQ ID NO: 5633051 - DNA, 13 bp, Homo sapiens
gttcatcagtgtt

SEQ ID NO: 5633052 - DNA, 14 bp, Homo sapiens
gttcatcatccaga

SEQ ID NO: 5633053 - DNA, 21 bp, Homo sapiens
gttcatcatccagatgtggct

SEQ ID NO: 5633054 - DNA, 14 bp, Homo sapiens
gttcatcatccctc

SEQ ID NO: 5633055 - DNA, 19 bp, Homo sapiens
gttcatcatccctccctgc

SEQ ID NO: 5633056 - DNA, 17 bp, Homo sapiens
gttcatcatcctaagct

SEQ ID NO: 5633057 - DNA, 22 bp, Homo sapiens
gttcatcatgagccgttgctaa

SEQ ID NO: 5633058 - DNA, 21 bp, Homo sapiens
gttcatccatcatctgctgca

SEQ ID NO: 5633059 - DNA, 16 bp, Homo sapiens
gttcatccattctatt

SEQ ID NO: 5633060 - DNA, 16 bp, Homo sapiens
gttcatcccagcccca

SEQ ID NO: 5633061 - DNA, 19 bp, Homo sapiens
gttcatcccttctcttcca

SEQ ID NO: 5633062 - DNA, 19 bp, Homo sapiens
gttcatccgcactgtaaat

SEQ ID NO: 5633063 - DNA, 17 bp, Homo sapiens
gttcatcctattgttga

SEQ ID NO: 5633064 - DNA, 18 bp, Homo sapiens
gttcatcctattgttgat

SEQ ID NO: 5633065 - DNA, 22 bp, Homo sapiens
gttcatcctcattgcctcctgt

SEQ ID NO: 5633066 - DNA, 18 bp, Homo sapiens
gttcatctctgctgaaca

SEQ ID NO: 5633067 - DNA, 21 bp, Homo sapiens
gttcatctctttgtcctgaat

SEQ ID NO: 5633068 - DNA, 13 bp, Homo sapiens
gttcatctgtcca

SEQ ID NO: 5633069 - DNA, 12 bp, Homo sapiens
gttcatcttgca

SEQ ID NO: 5633070 - DNA, 22 bp, Homo sapiens
gttcatcttgtacaaactttgt

SEQ ID NO: 5633071 - DNA, 22 bp, Homo sapiens
gttcatgaaggtcctagcttta

SEQ ID NO: 5633072 - DNA, 12 bp, Homo sapiens
gttcatgagaat

SEQ ID NO: 5633073 - DNA, 14 bp, Homo sapiens
gttcatgagaatct

SEQ ID NO: 5633074 - DNA, 14 bp, Homo sapiens
gttcatgagtggat

SEQ ID NO: 5633075 - DNA, 16 bp, Homo sapiens
gttcatgagtggatgg

SEQ ID NO: 5633076 - DNA, 17 bp, Homo sapiens
gttcatgagtggatgga

SEQ ID NO: 5633077 - DNA, 20 bp, Homo sapiens
gttcatgatagtgtgatttt

SEQ ID NO: 5633078 - DNA, 18 bp, Homo sapiens
gttcatgatttcaagatg

SEQ ID NO: 5633079 - DNA, 12 bp, Homo sapiens
gttctctgggag

SEQ ID NO: 5633080 - DNA, 13 bp, Homo sapiens
gttctctgggaga

SEQ ID NO: 5633081 - DNA, 14 bp, Homo sapiens
gttctctgggagaa

SEQ ID NO: 5633082 - DNA, 15 bp, Homo sapiens
gttctctgggagaaa

SEQ ID NO: 5633083 - DNA, 13 bp, Homo sapiens
gttctctgtccta

SEQ ID NO: 5633084 - DNA, 16 bp, Homo sapiens
gttctcttaaaaggta

SEQ ID NO: 5633085 - DNA, 15 bp, Homo sapiens
gttctcttaaatatt

SEQ ID NO: 5633086 - DNA, 17 bp, Homo sapiens
gttctcttcccaggcct

SEQ ID NO: 5633087 - DNA, 15 bp, Homo sapiens
gttctcttctctctt

SEQ ID NO: 5633088 - DNA, 15 bp, Homo sapiens
gttctcttgctttaa

SEQ ID NO: 5633089 - DNA, 12 bp, Homo sapiens
gttctcttgtat

SEQ ID NO: 5633090 - DNA, 15 bp, Homo sapiens
gttctcttgtatagc

SEQ ID NO: 5633091 - DNA, 16 bp, Homo sapiens
gttctcttttgtcctc

SEQ ID NO: 5633092 - DNA, 15 bp, Homo sapiens
gttctgaaaactgtt

SEQ ID NO: 5633093 - DNA, 13 bp, Homo sapiens
gttctgaaatgtt

SEQ ID NO: 5633094 - DNA, 21 bp, Homo sapiens
gttctgaaattaaagtatgca

SEQ ID NO: 5633095 - DNA, 13 bp, Homo sapiens
gttctgaaattta

SEQ ID NO: 5633096 - DNA, 12 bp, Homo sapiens
gttctgaagaag

SEQ ID NO: 5633097 - DNA, 15 bp, Homo sapiens
gttctgaagaagatg

SEQ ID NO: 5633098 - DNA, 20 bp, Homo sapiens
gttctgaagccatgtagcca

SEQ ID NO: 5633099 - DNA, 23 bp, Homo sapiens
gttctgaagccatgtagccaccc

SEQ ID NO: 5633100 - DNA, 19 bp, Homo sapiens
gttctgaaggtgcccagga

SEQ ID NO: 5633101 - DNA, 14 bp, Homo sapiens
gttctgacagtgtt

SEQ ID NO: 5633102 - DNA, 17 bp, Homo sapiens
gttctgacattaacagt

SEQ ID NO: 5633103 - DNA, 14 bp, Homo sapiens
gttctgacattcat

SEQ ID NO: 5633104 - DNA, 15 bp, Homo sapiens
gttctgactctggac

SEQ ID NO: 5633105 - DNA, 14 bp, Homo sapiens
gttctgactttgaa

SEQ ID NO: 5633106 - DNA, 17 bp, Homo sapiens
gttctgactttgaattt

SEQ ID NO: 5633107 - DNA, 19 bp, Homo sapiens
gttctgactttgaatttat

SEQ ID NO: 5633108 - DNA, 22 bp, Homo sapiens
gttctgactttttgtttctttg

SEQ ID NO: 5633109 - DNA, 20 bp, Homo sapiens
gttctgagaactgactttct

SEQ ID NO: 5633110 - DNA, 22 bp, Homo sapiens
gttctgagaagcgctgccctgt

SEQ ID NO: 5633111 - DNA, 21 bp, Homo sapiens
gttctgagatggctcccaggg

SEQ ID NO: 5633112 - DNA, 19 bp, Homo sapiens
gttctgagccgggcaagtc

SEQ ID NO: 5633113 - DNA, 17 bp, Homo sapiens
gttctgagctataacat

SEQ ID NO: 5633114 - DNA, 13 bp, Homo sapiens
gttctgaggccag

SEQ ID NO: 5633115 - DNA, 14 bp, Homo sapiens
gttctgaggggtgt

SEQ ID NO: 5633116 - DNA, 19 bp, Homo sapiens
gttctgatcctagttccac

SEQ ID NO: 5633117 - DNA, 19 bp, Homo sapiens
gttctgatgcttacatctg

SEQ ID NO: 5633118 - DNA, 14 bp, Homo sapiens
gttctgcaaataga

SEQ ID NO: 5633119 - DNA, 21 bp, Homo sapiens
gttctgcaaatagaaaacagg

SEQ ID NO: 5633120 - DNA, 20 bp, Homo sapiens
gttctgcaagaattaaaact

SEQ ID NO: 5633121 - DNA, 20 bp, Homo sapiens
gttctgcaataacagtttta

SEQ ID NO: 5633122 - DNA, 15 bp, Homo sapiens
gttctgcacacagca

SEQ ID NO: 5633123 - DNA, 16 bp, Homo sapiens
gttctgcacacagcac

SEQ ID NO: 5633124 - DNA, 15 bp, Homo sapiens
gttctgcactcttgt

SEQ ID NO: 5633125 - DNA, 16 bp, Homo sapiens
gttctgcactcttgta

SEQ ID NO: 5633126 - DNA, 17 bp, Homo sapiens
gttctgcactcttgtac

SEQ ID NO: 5633127 - DNA, 23 bp, Homo sapiens
gttctgcactcttgtacaaaaga

SEQ ID NO: 5633128 - DNA, 13 bp, Homo sapiens
gttctgcactgaa

SEQ ID NO: 5633129 - DNA, 14 bp, Homo sapiens
gttctgcactgaaa

SEQ ID NO: 5633130 - DNA, 15 bp, Homo sapiens
gttctgcactgaaaa

SEQ ID NO: 5633131 - DNA, 15 bp, Homo sapiens
gttctgcagagactt

SEQ ID NO: 5633132 - DNA, 10 bp, Homo sapiens
gttctgcagc

SEQ ID NO: 5633133 - DNA, 18 bp, Homo sapiens
gttctgcagcggcagagc

SEQ ID NO: 5633134 - DNA, 19 bp, Homo sapiens
gttctgcagcggcagagca

SEQ ID NO: 5633135 - DNA, 22 bp, Homo sapiens
gttctgcatcacccgcccctgg

SEQ ID NO: 5633136 - DNA, 12 bp, Homo sapiens
gttctgccagga

SEQ ID NO: 5633137 - DNA, 13 bp, Homo sapiens
gttctgccaggag

SEQ ID NO: 5633138 - DNA, 20 bp, Homo sapiens
gttctgcccacgatcccctc

SEQ ID NO: 5633139 - DNA, 15 bp, Homo sapiens
gttctgccctgcctg

SEQ ID NO: 5633140 - DNA, 19 bp, Homo sapiens
gttctgccctgcctgagga

SEQ ID NO: 5633141 - DNA, 19 bp, Homo sapiens
gttctgcctctccctgggt

SEQ ID NO: 5633142 - DNA, 20 bp, Homo sapiens
gttctgcctctgatgtattt

SEQ ID NO: 5633143 - DNA, 17 bp, Homo sapiens
gttctgcctgccagctg

SEQ ID NO: 5633144 - DNA, 22 bp, Homo sapiens
gttctgcctgccagctgcactg

SEQ ID NO: 5633145 - DNA, 19 bp, Homo sapiens
gttctgcgctgtgtacaat

SEQ ID NO: 5633146 - DNA, 18 bp, Homo sapiens
gttctgctagagcagaca

SEQ ID NO: 5633147 - DNA, 15 bp, Homo sapiens
gttctgctcatcatt

SEQ ID NO: 5633148 - DNA, 20 bp, Homo sapiens
gttctgctccagacagggaa

SEQ ID NO: 5633149 - DNA, 21 bp, Homo sapiens
gttctgctccataccttttct

SEQ ID NO: 5633150 - DNA, 19 bp, Homo sapiens
gttctgctcctctccaggc

SEQ ID NO: 5633151 - DNA, 14 bp, Homo sapiens
gttctgctcctgct

SEQ ID NO: 5633152 - DNA, 22 bp, Homo sapiens
gttctgctcctgcttttctgtc

SEQ ID NO: 5633153 - DNA, 18 bp, Homo sapiens
gttctgctgaccaaatgg

SEQ ID NO: 5633154 - DNA, 17 bp, Homo sapiens
gttctgctgcccctgca

SEQ ID NO: 5633155 - DNA, 16 bp, Homo sapiens
gttctgctggccaaga

SEQ ID NO: 5633156 - DNA, 13 bp, Homo sapiens
gttctgctggcct

SEQ ID NO: 5633157 - DNA, 19 bp, Homo sapiens
gttctgctggcctggatct

SEQ ID NO: 5633158 - DNA, 20 bp, Homo sapiens
gttctgctgggagttctaga

SEQ ID NO: 5633159 - DNA, 19 bp, Homo sapiens
gttctgctgtctgggactc

SEQ ID NO: 5633160 - DNA, 23 bp, Homo sapiens
gttctgcttcaaggcttccactg

SEQ ID NO: 5633161 - DNA, 21 bp, Homo sapiens
gttctgctttctgcctctcct

SEQ ID NO: 5633162 - DNA, 16 bp, Homo sapiens
gttctgcttttaagtt

SEQ ID NO: 5633163 - DNA, 17 bp, Homo sapiens
gttctggacctccccct

SEQ ID NO: 5633164 - DNA, 21 bp, Homo sapiens
gttctggcactattataagtg

SEQ ID NO: 5633165 - DNA, 11 bp, Homo sapiens
gttctggcagg

SEQ ID NO: 5633166 - DNA, 13 bp, Homo sapiens
gttctggcaggac

SEQ ID NO: 5633167 - DNA, 19 bp, Homo sapiens
gttctggccaccccagagt

SEQ ID NO: 5633168 - DNA, 12 bp, Homo sapiens
gttctggccaga

SEQ ID NO: 5633169 - DNA, 13 bp, Homo sapiens
gttctggccagaa

SEQ ID NO: 5633170 - DNA, 21 bp, Homo sapiens
gttctggccctcacccctgcc

SEQ ID NO: 5633171 - DNA, 14 bp, Homo sapiens
gttctggcctctgg

SEQ ID NO: 5633172 - DNA, 20 bp, Homo sapiens
gttctggcctctggcctggg

SEQ ID NO: 5633173 - DNA, 22 bp, Homo sapiens
gttctggctgccccaacctgct

SEQ ID NO: 5633174 - DNA, 14 bp, Homo sapiens
gttctgggacacag

SEQ ID NO: 5633175 - DNA, 15 bp, Homo sapiens
gttctgggactccag

SEQ ID NO: 5633176 - DNA, 16 bp, Homo sapiens
gttctgggcatggcag

SEQ ID NO: 5633177 - DNA, 12 bp, Homo sapiens
gttctgggctgg

SEQ ID NO: 5633178 - DNA, 13 bp, Homo sapiens
gttctgggctggg

SEQ ID NO: 5633179 - DNA, 18 bp, Homo sapiens
gttctggggaggaagggc

SEQ ID NO: 5633180 - DNA, 23 bp, Homo sapiens
gttctggggcatcagccagctac

SEQ ID NO: 5633181 - DNA, 19 bp, Homo sapiens
gttctggggcccgcctgcc

SEQ ID NO: 5633182 - DNA, 14 bp, Homo sapiens
gttctggggctgag

SEQ ID NO: 5633183 - DNA, 20 bp, Homo sapiens
gttctgggttaacagtaaat

SEQ ID NO: 5633184 - DNA, 17 bp, Homo sapiens
gttctggtcctttttgg

SEQ ID NO: 5633185 - DNA, 16 bp, Homo sapiens
gttctggtgaggcctt

SEQ ID NO: 5633186 - DNA, 20 bp, Homo sapiens
gttctggtgaggccttgctc

SEQ ID NO: 5633187 - DNA, 16 bp, Homo sapiens
gttctggtggccccag

SEQ ID NO: 5633188 - DNA, 15 bp, Homo sapiens
gttctggtggcccct

SEQ ID NO: 5633189 - DNA, 16 bp, Homo sapiens
gttctggtggtttgat

SEQ ID NO: 5633190 - DNA, 15 bp, Homo sapiens
gttctggtgtgaact

SEQ ID NO: 5633191 - DNA, 17 bp, Homo sapiens
gttctggttagctcagc

SEQ ID NO: 5633192 - DNA, 23 bp, Homo sapiens
gttctggtttagtgttctgtatt

SEQ ID NO: 5633193 - DNA, 21 bp, Homo sapiens
gttctgtaatggaactgaccc

SEQ ID NO: 5633194 - DNA, 16 bp, Homo sapiens
gttctgtacttagaaa

SEQ ID NO: 5633195 - DNA, 21 bp, Homo sapiens
gttctgtagattcatgcaagt

SEQ ID NO: 5633196 - DNA, 14 bp, Homo sapiens
gttctgtaggagag

SEQ ID NO: 5633197 - DNA, 19 bp, Homo sapiens
gttctgtaggagagactgg

SEQ ID NO: 5633198 - DNA, 14 bp, Homo sapiens
gttctgtatatttt

SEQ ID NO: 5633199 - DNA, 21 bp, Homo sapiens
gttctgtatattttgttacct

SEQ ID NO: 5633200 - DNA, 15 bp, Homo sapiens
gttctgtattttaag

SEQ ID NO: 5633201 - DNA, 17 bp, Homo sapiens
gttctgtccccatctag

SEQ ID NO: 5633202 - DNA, 11 bp, Homo sapiens
gttctgtccct

SEQ ID NO: 5633203 - DNA, 13 bp, Homo sapiens
gttctgtcccttc

SEQ ID NO: 5633204 - DNA, 22 bp, Homo sapiens
gttctgtcccttccacttctaa

SEQ ID NO: 5633205 - DNA, 16 bp, Homo sapiens
gttctgtcccttgccc

SEQ ID NO: 5633206 - DNA, 15 bp, Homo sapiens
gttctgtgaagagga

SEQ ID NO: 5633207 - DNA, 21 bp, Homo sapiens
gttctgtgacccatctgtagt

SEQ ID NO: 5633208 - DNA, 22 bp, Homo sapiens
gttctgtgactgaagaagatga

SEQ ID NO: 5633209 - DNA, 11 bp, Homo sapiens
gttctgtgcac

SEQ ID NO: 5633210 - DNA, 19 bp, Homo sapiens
gttctgtgcagtttggtat

SEQ ID NO: 5633211 - DNA, 18 bp, Homo sapiens
gttctgtgcctcccccca

SEQ ID NO: 5633212 - DNA, 23 bp, Homo sapiens
gttctgtggcgccgcgtggacag

SEQ ID NO: 5633213 - DNA, 16 bp, Homo sapiens
gttctgtggttccagt

SEQ ID NO: 5633214 - DNA, 21 bp, Homo sapiens
gttctgtggtttcatgttagt

SEQ ID NO: 5633215 - DNA, 17 bp, Homo sapiens
gttctgtgtacatttta

SEQ ID NO: 5633216 - DNA, 17 bp, Homo sapiens
gttctgtgtagagaatg

SEQ ID NO: 5633217 - DNA, 19 bp, Homo sapiens
gttctgtgtatttaattgt

SEQ ID NO: 5633218 - DNA, 20 bp, Homo sapiens
gttctgtgtcacgtgaccct

SEQ ID NO: 5633219 - DNA, 22 bp, Homo sapiens
gttctgtgtcacgtgaccctgt

SEQ ID NO: 5633220 - DNA, 12 bp, Homo sapiens
gttctgtgtcct

SEQ ID NO: 5633221 - DNA, 22 bp, Homo sapiens
gttctgtgtcctctgcctgggc

SEQ ID NO: 5633222 - DNA, 21 bp, Homo sapiens
gttctgtgtgccctgaaaatg

SEQ ID NO: 5633223 - DNA, 20 bp, Homo sapiens
gttctgtgtgggtctgggga

SEQ ID NO: 5633224 - DNA, 15 bp, Homo sapiens
gttctgtgtgtctgg

SEQ ID NO: 5633225 - DNA, 21 bp, Homo sapiens
gttctgtgtttaatttcttca

SEQ ID NO: 5633226 - DNA, 13 bp, Homo sapiens
gttctgttaaata

SEQ ID NO: 5633227 - DNA, 21 bp, Homo sapiens
gttctgttaactgaataccac

SEQ ID NO: 5633228 - DNA, 14 bp, Homo sapiens
gttctgttacaaaa

SEQ ID NO: 5633229 - DNA, 18 bp, Homo sapiens
gttctgttacaaaatgta

SEQ ID NO: 5633230 - DNA, 21 bp, Homo sapiens
gttctgttatatcccctgcta

SEQ ID NO: 5633231 - DNA, 15 bp, Homo sapiens
gttctgttctgctgg

SEQ ID NO: 5633232 - DNA, 18 bp, Homo sapiens
gttctgttgacctgtgca

SEQ ID NO: 5633233 - DNA, 18 bp, Homo sapiens
gttctgttgtaaagagtg

SEQ ID NO: 5633234 - DNA, 19 bp, Homo sapiens
gttctgtttacatcagttt

SEQ ID NO: 5633235 - DNA, 15 bp, Homo sapiens
gttctgtttggcact

SEQ ID NO: 5633236 - DNA, 17 bp, Homo sapiens
gttctgtttgttaaaac

SEQ ID NO: 5633237 - DNA, 18 bp, Homo sapiens
gttctgtttgttattgtt

SEQ ID NO: 5633238 - DNA, 22 bp, Homo sapiens
gttctgtttgttattgttttgt

SEQ ID NO: 5633239 - DNA, 23 bp, Homo sapiens
gttctgtttgttattgttttgtt

SEQ ID NO: 5633240 - DNA, 14 bp, Homo sapiens
gttctgttttcgta

SEQ ID NO: 5633241 - DNA, 22 bp, Homo sapiens
gttctgttttcgtaccttccca

SEQ ID NO: 5633242 - DNA, 23 bp, Homo sapiens
gttctgttttcgtaccttcccac

SEQ ID NO: 5633243 - DNA, 16 bp, Homo sapiens
gttctgttttgtttcg

SEQ ID NO: 5633244 - DNA, 17 bp, Homo sapiens
gttctgttttgttttgt

SEQ ID NO: 5633245 - DNA, 16 bp, Homo sapiens
gttcttaaaaaaataa

SEQ ID NO: 5633246 - DNA, 22 bp, Homo sapiens
gttcttaaaaaaataaaatatt

SEQ ID NO: 5633247 - DNA, 21 bp, Homo sapiens
gttcttaaaaaatttatactt

SEQ ID NO: 5633248 - DNA, 15 bp, Homo sapiens
gttcttaaaaaggaa

SEQ ID NO: 5633249 - DNA, 21 bp, Homo sapiens
gttcttaaaaatgcatttaag

SEQ ID NO: 5633250 - DNA, 23 bp, Homo sapiens
gttcttaaaaatgcatttaagtt

SEQ ID NO: 5633251 - DNA, 12 bp, Homo sapiens
gttcttaaaatt

SEQ ID NO: 5633252 - DNA, 23 bp, Homo sapiens
gttcttaaagtttaaagttgcac

SEQ ID NO: 5633253 - DNA, 21 bp, Homo sapiens
gttcttaaatgtttatactgt

SEQ ID NO: 5633254 - DNA, 21 bp, Homo sapiens
gttcttaaccagatggttgtg

SEQ ID NO: 5633255 - DNA, 17 bp, Homo sapiens
gttcttaattcttagct

SEQ ID NO: 5633256 - DNA, 13 bp, Homo sapiens
gttcttacacata

SEQ ID NO: 5633257 - DNA, 15 bp, Homo sapiens
gttgccaagctccaa

SEQ ID NO: 5633258 - DNA, 13 bp, Homo sapiens
gttgccaagctgg

SEQ ID NO: 5633259 - DNA, 12 bp, Homo sapiens
gttgccacaggc

SEQ ID NO: 5633260 - DNA, 21 bp, Homo sapiens
gttgccacatttagtcctgta

SEQ ID NO: 5633261 - DNA, 17 bp, Homo sapiens
gttgccaccacctctgt

SEQ ID NO: 5633262 - DNA, 15 bp, Homo sapiens
gttgccactctcctc

SEQ ID NO: 5633263 - DNA, 17 bp, Homo sapiens
gttgccagagatggagg

SEQ ID NO: 5633264 - DNA, 13 bp, Homo sapiens
gttgccagaggcc

SEQ ID NO: 5633265 - DNA, 17 bp, Homo sapiens
gttgccagaggccctgg

SEQ ID NO: 5633266 - DNA, 21 bp, Homo sapiens
gttgccagaggccctggaggg

SEQ ID NO: 5633267 - DNA, 13 bp, Homo sapiens
gttgccagtcacc

SEQ ID NO: 5633268 - DNA, 14 bp, Homo sapiens
gttgccagtcaccc

SEQ ID NO: 5633269 - DNA, 17 bp, Homo sapiens
gttgccagtcaccccgg

SEQ ID NO: 5633270 - DNA, 16 bp, Homo sapiens
gttgccagttgtcctc

SEQ ID NO: 5633271 - DNA, 19 bp, Homo sapiens
gttgccatgaggcctttcc

SEQ ID NO: 5633272 - DNA, 15 bp, Homo sapiens
gttgccatggattca

SEQ ID NO: 5633273 - DNA, 22 bp, Homo sapiens
gttgccatggtaaccagccaca

SEQ ID NO: 5633274 - DNA, 16 bp, Homo sapiens
gttgccattttgtctg

SEQ ID NO: 5633275 - DNA, 13 bp, Homo sapiens
gttgcccagagca

SEQ ID NO: 5633276 - DNA, 22 bp, Homo sapiens
gttgcccagcctctttcccttc

SEQ ID NO: 5633277 - DNA, 13 bp, Homo sapiens
gttgcccagcctg

SEQ ID NO: 5633278 - DNA, 14 bp, Homo sapiens
gttgcccagcctgg

SEQ ID NO: 5633279 - DNA, 14 bp, Homo sapiens
gttgcccaggcagg

SEQ ID NO: 5633280 - DNA, 19 bp, Homo sapiens
gttgcccaggcaggtcttg

SEQ ID NO: 5633281 - DNA, 15 bp, Homo sapiens
gttgcccaggctgga

SEQ ID NO: 5633282 - DNA, 15 bp, Homo sapiens
gttgcccaggctggc

SEQ ID NO: 5633283 - DNA, 16 bp, Homo sapiens
gttgcccaggctggcg

SEQ ID NO: 5633284 - DNA, 20 bp, Homo sapiens
gttgcccaggctggtcttga

SEQ ID NO: 5633285 - DNA, 21 bp, Homo sapiens
gttgcccccattcccagcctg

SEQ ID NO: 5633286 - DNA, 15 bp, Homo sapiens
gttgccccccagggt

SEQ ID NO: 5633287 - DNA, 21 bp, Homo sapiens
gttgccccccatcaccagagt

SEQ ID NO: 5633288 - DNA, 21 bp, Homo sapiens
gttgcccctcctccgcatgcc

SEQ ID NO: 5633289 - DNA, 20 bp, Homo sapiens
gttgcccgaaactaagccag

SEQ ID NO: 5633290 - DNA, 21 bp, Homo sapiens
gttgcccgccctccacccact

SEQ ID NO: 5633291 - DNA, 19 bp, Homo sapiens
gttgccctaattcatcttt

SEQ ID NO: 5633292 - DNA, 20 bp, Homo sapiens
gttgccctagcccagactct

SEQ ID NO: 5633293 - DNA, 21 bp, Homo sapiens
gttgccctgtttcctgctgct

SEQ ID NO: 5633294 - DNA, 17 bp, Homo sapiens
gttgcccttctgtccaa

SEQ ID NO: 5633295 - DNA, 16 bp, Homo sapiens
gttgccgagcccagct

SEQ ID NO: 5633296 - DNA, 23 bp, Homo sapiens
gttgccgcagcggtgggaaggaa

SEQ ID NO: 5633297 - DNA, 22 bp, Homo sapiens
gttgccgggcctggactgtcct

SEQ ID NO: 5633298 - DNA, 15 bp, Homo sapiens
gttgccgtctctggc

SEQ ID NO: 5633299 - DNA, 13 bp, Homo sapiens
gttgccgtgctcc

SEQ ID NO: 5633300 - DNA, 16 bp, Homo sapiens
gttgcctaaatccatt

SEQ ID NO: 5633301 - DNA, 17 bp, Homo sapiens
gttgcctaaatccattt

SEQ ID NO: 5633302 - DNA, 18 bp, Homo sapiens
gttgcctaagtattaaaa

SEQ ID NO: 5633303 - DNA, 22 bp, Homo sapiens
gttgcctaattggaaagtgcca

SEQ ID NO: 5633304 - DNA, 23 bp, Homo sapiens
gttgcctataagccaaaattaag

SEQ ID NO: 5633305 - DNA, 17 bp, Homo sapiens
gttgcctcaacagcagg

SEQ ID NO: 5633306 - DNA, 20 bp, Homo sapiens
gttgcctcaacagcaggagg

SEQ ID NO: 5633307 - DNA, 20 bp, Homo sapiens
gttgcctcatggccagcgcc

SEQ ID NO: 5633308 - DNA, 21 bp, Homo sapiens
gttgcctcatggccagcgccc

SEQ ID NO: 5633309 - DNA, 21 bp, Homo sapiens
gttgcctcccccgcctccagt

SEQ ID NO: 5633310 - DNA, 13 bp, Homo sapiens
gttgcctcctctc

SEQ ID NO: 5633311 - DNA, 19 bp, Homo sapiens
gttgcctcctctctccctg

SEQ ID NO: 5633312 - DNA, 23 bp, Homo sapiens
gttgcctcctctctccctgcctc

SEQ ID NO: 5633313 - DNA, 18 bp, Homo sapiens
gttgcctcgagtcccccc

SEQ ID NO: 5633314 - DNA, 15 bp, Homo sapiens
gttgcctctctgcca

SEQ ID NO: 5633315 - DNA, 17 bp, Homo sapiens
gttgcctctctgccagc

SEQ ID NO: 5633316 - DNA, 15 bp, Homo sapiens
gttgcctctcttgcc

SEQ ID NO: 5633317 - DNA, 18 bp, Homo sapiens
gttgcctcttgcaatgcc

SEQ ID NO: 5633318 - DNA, 20 bp, Homo sapiens
gttgcctgcacccttccctc

SEQ ID NO: 5633319 - DNA, 21 bp, Homo sapiens
gttgcctgctgagctgtgccc

SEQ ID NO: 5633320 - DNA, 22 bp, Homo sapiens
gttgcctggattgggagccatt

SEQ ID NO: 5633321 - DNA, 21 bp, Homo sapiens
gttgccttgaaccacttccct

SEQ ID NO: 5633322 - DNA, 15 bp, Homo sapiens
gttgcctttatttgc

SEQ ID NO: 5633323 - DNA, 19 bp, Homo sapiens
gttgccttttcttcccctc

SEQ ID NO: 5633324 - DNA, 19 bp, Homo sapiens
gttgcctttttacagccaa

SEQ ID NO: 5633325 - DNA, 23 bp, Homo sapiens
gttgccttttttatcatttctac

SEQ ID NO: 5633326 - DNA, 21 bp, Homo sapiens
gttgcgccatctgtgcacact

SEQ ID NO: 5633327 - DNA, 20 bp, Homo sapiens
gttgcggatggatggaaggt

SEQ ID NO: 5633328 - DNA, 17 bp, Homo sapiens
gttgcgggggagctgga

SEQ ID NO: 5633329 - DNA, 18 bp, Homo sapiens
gttgcgggggagctggaa

SEQ ID NO: 5633330 - DNA, 21 bp, Homo sapiens
gttgcgggggagctggaaata

SEQ ID NO: 5633331 - DNA, 13 bp, Homo sapiens
gttgcggggggag

SEQ ID NO: 5633332 - DNA, 15 bp, Homo sapiens
gttgcggggggaggg

SEQ ID NO: 5633333 - DNA, 18 bp, Homo sapiens
gttgcgtgacactctcct

SEQ ID NO: 5633334 - DNA, 22 bp, Homo sapiens
gttgcgtgtctgtttccttctc

SEQ ID NO: 5633335 - DNA, 13 bp, Homo sapiens
gttgcgtttttcc

SEQ ID NO: 5633336 - DNA, 22 bp, Homo sapiens
gttgctaaattataaaattgaa

SEQ ID NO: 5633337 - DNA, 23 bp, Homo sapiens
gttgctaacagcaacacaaagct

SEQ ID NO: 5633338 - DNA, 22 bp, Homo sapiens
gttgctaactgaactttgaaga

SEQ ID NO: 5633339 - DNA, 15 bp, Homo sapiens
gttgctaatgacagc

SEQ ID NO: 5633340 - DNA, 17 bp, Homo sapiens
gttgctacatcagagtg

SEQ ID NO: 5633341 - DNA, 22 bp, Homo sapiens
gttgctagcaaacaaatggctt

SEQ ID NO: 5633342 - DNA, 15 bp, Homo sapiens
gttgctagggagagg

SEQ ID NO: 5633343 - DNA, 18 bp, Homo sapiens
gttgctagttttttgctt

SEQ ID NO: 5633344 - DNA, 22 bp, Homo sapiens
gttgctagttttttgcttctct

SEQ ID NO: 5633345 - DNA, 13 bp, Homo sapiens
gttgctataagaa

SEQ ID NO: 5633346 - DNA, 17 bp, Homo sapiens
gttgctataagaaaagt

SEQ ID NO: 5633347 - DNA, 20 bp, Homo sapiens
gttgctatagtgacatgcag

SEQ ID NO: 5633348 - DNA, 21 bp, Homo sapiens
gttgctattgtaaggtctttg

SEQ ID NO: 5633349 - DNA, 22 bp, Homo sapiens
gttgctattgtaaggtctttgt

SEQ ID NO: 5633350 - DNA, 12 bp, Homo sapiens
gttgctcagctc

SEQ ID NO: 5633351 - DNA, 14 bp, Homo sapiens
gttgctcagctcct

SEQ ID NO: 5633352 - DNA, 19 bp, Homo sapiens
gttgctccaactgaattgc

SEQ ID NO: 5633353 - DNA, 18 bp, Homo sapiens
gttgctccgcctctgctg

SEQ ID NO: 5633354 - DNA, 22 bp, Homo sapiens
gttgctccgcctctgctggcac

SEQ ID NO: 5633355 - DNA, 15 bp, Homo sapiens
gttgctcgcttttcc

SEQ ID NO: 5633356 - DNA, 20 bp, Homo sapiens
gttgctctaggaagacattt

SEQ ID NO: 5633357 - DNA, 11 bp, Homo sapiens
gttgctctgta

SEQ ID NO: 5633358 - DNA, 19 bp, Homo sapiens
gttgctcttggaaagctga

SEQ ID NO: 5633359 - DNA, 15 bp, Homo sapiens
gttgctgaagatgcc

SEQ ID NO: 5633360 - DNA, 13 bp, Homo sapiens
gttgctgaatagg

SEQ ID NO: 5633361 - DNA, 21 bp, Homo sapiens
gttgctgactactactctgcc

SEQ ID NO: 5633362 - DNA, 15 bp, Homo sapiens
gttgctgagaaatgg

SEQ ID NO: 5633363 - DNA, 17 bp, Homo sapiens
gttgctgagccagctgc

SEQ ID NO: 5633364 - DNA, 16 bp, Homo sapiens
gttgctgatgtttata

SEQ ID NO: 5633365 - DNA, 22 bp, Homo sapiens
gttgctgattcaagaaacagaa

SEQ ID NO: 5633366 - DNA, 14 bp, Homo sapiens
gttgctgattgtca

SEQ ID NO: 5633367 - DNA, 17 bp, Homo sapiens
gttgctgctgctgctca

SEQ ID NO: 5633368 - DNA, 13 bp, Homo sapiens
gttgctgctgtga

SEQ ID NO: 5633369 - DNA, 16 bp, Homo sapiens
gttgctggactgagga

SEQ ID NO: 5633370 - DNA, 21 bp, Homo sapiens
gttgctggaggggctgtcctc

SEQ ID NO: 5633371 - DNA, 18 bp, Homo sapiens
gttgctggatcaggaagc

SEQ ID NO: 5633372 - DNA, 23 bp, Homo sapiens
gttgctggcttgttgtaaagcaa

SEQ ID NO: 5633373 - DNA, 18 bp, Homo sapiens
gttgctgggcctcattct

SEQ ID NO: 5633374 - DNA, 22 bp, Homo sapiens
gttgctgggcctcattctagca

SEQ ID NO: 5633375 - DNA, 12 bp, Homo sapiens
gttgctggtaaa

SEQ ID NO: 5633376 - DNA, 14 bp, Homo sapiens
gttgctggtacaca

SEQ ID NO: 5633377 - DNA, 15 bp, Homo sapiens
gttgctggtacacac

SEQ ID NO: 5633378 - DNA, 16 bp, Homo sapiens
gttgctggtcctgcac

SEQ ID NO: 5633379 - DNA, 17 bp, Homo sapiens
gttgctggttgctgtgt

SEQ ID NO: 5633380 - DNA, 14 bp, Homo sapiens
gttgctggttggat

SEQ ID NO: 5633381 - DNA, 16 bp, Homo sapiens
gttgctgtacaggaaa

SEQ ID NO: 5633382 - DNA, 14 bp, Homo sapiens
gttgctgtcactgt

SEQ ID NO: 5633383 - DNA, 20 bp, Homo sapiens
gttgctgtcctccagggcga

SEQ ID NO: 5633384 - DNA, 21 bp, Homo sapiens
gttgctgtgccccatcagcag

SEQ ID NO: 5633385 - DNA, 23 bp, Homo sapiens
gttgctgtggaccaatgcatctc

SEQ ID NO: 5633386 - DNA, 12 bp, Homo sapiens
gttgctgtggct

SEQ ID NO: 5633387 - DNA, 15 bp, Homo sapiens
gttgctgtggctcca

SEQ ID NO: 5633388 - DNA, 19 bp, Homo sapiens
gttgctgtgtttaatttga

SEQ ID NO: 5633389 - DNA, 23 bp, Homo sapiens
gttgctgttattatatttgacat

SEQ ID NO: 5633390 - DNA, 18 bp, Homo sapiens
gttgctgttgctgttgct

SEQ ID NO: 5633391 - DNA, 12 bp, Homo sapiens
gttgctgtttag

SEQ ID NO: 5633392 - DNA, 19 bp, Homo sapiens
gttgctgttttcctccctt

SEQ ID NO: 5633393 - DNA, 17 bp, Homo sapiens
gttgctgtttttcttgt

SEQ ID NO: 5633394 - DNA, 14 bp, Homo sapiens
gttgcttacaattt

SEQ ID NO: 5633395 - DNA, 15 bp, Homo sapiens
gttgcttacaatttt

SEQ ID NO: 5633396 - DNA, 23 bp, Homo sapiens
gttgcttaggatgtgtgcatgtg

SEQ ID NO: 5633397 - DNA, 13 bp, Homo sapiens
gttgcttctgaat

SEQ ID NO: 5633398 - DNA, 16 bp, Homo sapiens
gttgcttctgaatcac

SEQ ID NO: 5633399 - DNA, 16 bp, Homo sapiens
gttgcttcttgtgaag

SEQ ID NO: 5633400 - DNA, 20 bp, Homo sapiens
gttgcttcttgtgaaggcca

SEQ ID NO: 5633401 - DNA, 21 bp, Homo sapiens
gttgcttgcctgatataaatg

SEQ ID NO: 5633402 - DNA, 15 bp, Homo sapiens
gttgctttcactctc

SEQ ID NO: 5633403 - DNA, 23 bp, Homo sapiens
gttgctttgaaaaatctcattat

SEQ ID NO: 5633404 - DNA, 19 bp, Homo sapiens
gttgctttggatacacaca

SEQ ID NO: 5633405 - DNA, 22 bp, Homo sapiens
gttgctttgttacaataaaact

SEQ ID NO: 5633406 - DNA, 21 bp, Homo sapiens
gttgcttttgaaggaatacaa

SEQ ID NO: 5633407 - DNA, 16 bp, Homo sapiens
gttggaaaacatatga

SEQ ID NO: 5633408 - DNA, 15 bp, Homo sapiens
gttggaaaagaatac

SEQ ID NO: 5633409 - DNA, 20 bp, Homo sapiens
gttggaaaagaatacagaaa

SEQ ID NO: 5633410 - DNA, 16 bp, Homo sapiens
gttggaaaatgtgtct

SEQ ID NO: 5633411 - DNA, 22 bp, Homo sapiens
gttggaaaatgtgtctctgctt

SEQ ID NO: 5633412 - DNA, 11 bp, Homo sapiens
gttggaaaatt

SEQ ID NO: 5633413 - DNA, 20 bp, Homo sapiens
gttggaaacactaaatgtta

SEQ ID NO: 5633414 - DNA, 12 bp, Homo sapiens
gttggaaagaac

SEQ ID NO: 5633415 - DNA, 18 bp, Homo sapiens
gttggaaatattcatgct

SEQ ID NO: 5633416 - DNA, 14 bp, Homo sapiens
gttggaaatatttg

SEQ ID NO: 5633417 - DNA, 15 bp, Homo sapiens
gttggaaatgtgttt

SEQ ID NO: 5633418 - DNA, 14 bp, Homo sapiens
gttggaaccgtgtc

SEQ ID NO: 5633419 - DNA, 18 bp, Homo sapiens
gttggaactatgcagtgt

SEQ ID NO: 5633420 - DNA, 16 bp, Homo sapiens
gttggaactctgtgca

SEQ ID NO: 5633421 - DNA, 22 bp, Homo sapiens
gttggaactctgtgcaggtgct

SEQ ID NO: 5633422 - DNA, 14 bp, Homo sapiens
gttggaactgctgc

SEQ ID NO: 5633423 - DNA, 14 bp, Homo sapiens
gttggaactttagg

SEQ ID NO: 5633424 - DNA, 15 bp, Homo sapiens
gttggaagaaaagaa

SEQ ID NO: 5633425 - DNA, 13 bp, Homo sapiens
gttggaagaaata

SEQ ID NO: 5633426 - DNA, 19 bp, Homo sapiens
gttggaaggatctgctgag

SEQ ID NO: 5633427 - DNA, 18 bp, Homo sapiens
gttggaaggggccttgct

SEQ ID NO: 5633428 - DNA, 20 bp, Homo sapiens
gttggaatcacctggagggc

SEQ ID NO: 5633429 - DNA, 22 bp, Homo sapiens
gttggaatgaattaaataaacc

SEQ ID NO: 5633430 - DNA, 22 bp, Homo sapiens
gttggaatggatttttctttaa

SEQ ID NO: 5633431 - DNA, 16 bp, Homo sapiens
gttggaattaaaacaa

SEQ ID NO: 5633432 - DNA, 16 bp, Homo sapiens
gttggaattccacgcc

SEQ ID NO: 5633433 - DNA, 17 bp, Homo sapiens
gttggacaagcttctga

SEQ ID NO: 5633434 - DNA, 12 bp, Homo sapiens
gtttactgtaaa

SEQ ID NO: 5633435 - DNA, 14 bp, Homo sapiens
gtttacttaaagat

SEQ ID NO: 5633436 - DNA, 18 bp, Homo sapiens
gtttacttatcttatgcc

SEQ ID NO: 5633437 - DNA, 16 bp, Homo sapiens
gtttacttattttcca

SEQ ID NO: 5633438 - DNA, 19 bp, Homo sapiens
gtttacttggtgaggagga

SEQ ID NO: 5633439 - DNA, 23 bp, Homo sapiens
gtttacttgtctgtcaaatgttt

SEQ ID NO: 5633440 - DNA, 13 bp, Homo sapiens
gtttactttcaaa

SEQ ID NO: 5633441 - DNA, 14 bp, Homo sapiens
gtttactttttaac

SEQ ID NO: 5633442 - DNA, 18 bp, Homo sapiens
gtttactttttggctgga

SEQ ID NO: 5633443 - DNA, 22 bp, Homo sapiens
gtttagaaaaaaaactgaagat

SEQ ID NO: 5633444 - DNA, 16 bp, Homo sapiens
gtttagaaaaaacaat

SEQ ID NO: 5633445 - DNA, 14 bp, Homo sapiens
gtttagaaataaat

SEQ ID NO: 5633446 - DNA, 17 bp, Homo sapiens
gtttagaaattacaagt

SEQ ID NO: 5633447 - DNA, 22 bp, Homo sapiens
gtttagaaattacaagtttcag

SEQ ID NO: 5633448 - DNA, 19 bp, Homo sapiens
gtttagaagagcctgactg

SEQ ID NO: 5633449 - DNA, 12 bp, Homo sapiens
gtttagaagcct

SEQ ID NO: 5633450 - DNA, 17 bp, Homo sapiens
gtttagaatcagaataa

SEQ ID NO: 5633451 - DNA, 22 bp, Homo sapiens
gtttagaatggaggaagaacaa

SEQ ID NO: 5633452 - DNA, 12 bp, Homo sapiens
gtttagaccaag

SEQ ID NO: 5633453 - DNA, 15 bp, Homo sapiens
gtttagaccaaggaa

SEQ ID NO: 5633454 - DNA, 20 bp, Homo sapiens
gtttagaccaaggaacaaaa

SEQ ID NO: 5633455 - DNA, 16 bp, Homo sapiens
gtttagagaattatgg

SEQ ID NO: 5633456 - DNA, 15 bp, Homo sapiens
gtttagagagcctgt

SEQ ID NO: 5633457 - DNA, 20 bp, Homo sapiens
gtttagagtaaataaactgt

SEQ ID NO: 5633458 - DNA, 21 bp, Homo sapiens
gtttagataaaggaaacatat

SEQ ID NO: 5633459 - DNA, 14 bp, Homo sapiens
gtttagatgaatgc

SEQ ID NO: 5633460 - DNA, 17 bp, Homo sapiens
gtttagatgaatgtcag

SEQ ID NO: 5633461 - DNA, 20 bp, Homo sapiens
gtttagattgtattaactat

SEQ ID NO: 5633462 - DNA, 20 bp, Homo sapiens
gtttagatttatggttgtta

SEQ ID NO: 5633463 - DNA, 12 bp, Homo sapiens
gtttagatttgc

SEQ ID NO: 5633464 - DNA, 14 bp, Homo sapiens
gtttagattttatg

SEQ ID NO: 5633465 - DNA, 12 bp, Homo sapiens
gtttagcaaata

SEQ ID NO: 5633466 - DNA, 16 bp, Homo sapiens
gtttagcagatttaag

SEQ ID NO: 5633467 - DNA, 14 bp, Homo sapiens
gtttagcaggctgc

SEQ ID NO: 5633468 - DNA, 19 bp, Homo sapiens
gtttagcccttccctgcct

SEQ ID NO: 5633469 - DNA, 13 bp, Homo sapiens
gtttagctctgag

SEQ ID NO: 5633470 - DNA, 15 bp, Homo sapiens
gtttagctctgagaa

SEQ ID NO: 5633471 - DNA, 15 bp, Homo sapiens
gtttagctgacaaaa

SEQ ID NO: 5633472 - DNA, 20 bp, Homo sapiens
gtttagctggaaaagtatgt

SEQ ID NO: 5633473 - DNA, 15 bp, Homo sapiens
gtttagcttcctcca

SEQ ID NO: 5633474 - DNA, 20 bp, Homo sapiens
gtttagcttcctccagagga

SEQ ID NO: 5633475 - DNA, 13 bp, Homo sapiens
gtttagctttgga

SEQ ID NO: 5633476 - DNA, 22 bp, Homo sapiens
gtttagctttggaaagttactg

SEQ ID NO: 5633477 - DNA, 19 bp, Homo sapiens
gtttaggatcatctctgca

SEQ ID NO: 5633478 - DNA, 21 bp, Homo sapiens
gtttaggccttgccagttttc

SEQ ID NO: 5633479 - DNA, 16 bp, Homo sapiens
gtttagggttctggtg

SEQ ID NO: 5633480 - DNA, 18 bp, Homo sapiens
gtttagtaaggctgtgta

SEQ ID NO: 5633481 - DNA, 22 bp, Homo sapiens
gtttagtagaaacggggtttca

SEQ ID NO: 5633482 - DNA, 14 bp, Homo sapiens
gtttagtcttgtct

SEQ ID NO: 5633483 - DNA, 18 bp, Homo sapiens
gtttagtcttgtctcaga

SEQ ID NO: 5633484 - DNA, 15 bp, Homo sapiens
gtttagtgccaatgt

SEQ ID NO: 5633485 - DNA, 22 bp, Homo sapiens
gtttagtgtttctttatctact

SEQ ID NO: 5633486 - DNA, 15 bp, Homo sapiens
gtttagttaaatgag

SEQ ID NO: 5633487 - DNA, 15 bp, Homo sapiens
gtttagtttgcattt

SEQ ID NO: 5633488 - DNA, 15 bp, Homo sapiens
gtttagttttacact

SEQ ID NO: 5633489 - DNA, 16 bp, Homo sapiens
gtttagttttacacta

SEQ ID NO: 5633490 - DNA, 15 bp, Homo sapiens
gtttataaagccaag

SEQ ID NO: 5633491 - DNA, 18 bp, Homo sapiens
gtttataaagccaagaat

SEQ ID NO: 5633492 - DNA, 17 bp, Homo sapiens
gtttataagcccaaatg

SEQ ID NO: 5633493 - DNA, 13 bp, Homo sapiens
gtttataataaaa

SEQ ID NO: 5633494 - DNA, 15 bp, Homo sapiens
gtttataataaaaat

SEQ ID NO: 5633495 - DNA, 13 bp, Homo sapiens
gtttataatctga

SEQ ID NO: 5633496 - DNA, 23 bp, Homo sapiens
gtttataatctgacaaagtcatg

SEQ ID NO: 5633497 - DNA, 15 bp, Homo sapiens
gtttataatgaagaa

SEQ ID NO: 5633498 - DNA, 21 bp, Homo sapiens
gtttataattgttatacattt

SEQ ID NO: 5633499 - DNA, 17 bp, Homo sapiens
gtttataattgtttata

SEQ ID NO: 5633500 - DNA, 16 bp, Homo sapiens
gtttatacacaacttt

SEQ ID NO: 5633501 - DNA, 18 bp, Homo sapiens
gtttatacacaactttgc

SEQ ID NO: 5633502 - DNA, 19 bp, Homo sapiens
gtttatacacaactttgca

SEQ ID NO: 5633503 - DNA, 19 bp, Homo sapiens
gtttatacgtggaaacaca

SEQ ID NO: 5633504 - DNA, 16 bp, Homo sapiens
gtttatactaattcag

SEQ ID NO: 5633505 - DNA, 20 bp, Homo sapiens
gtttatagagggccaagact

SEQ ID NO: 5633506 - DNA, 20 bp, Homo sapiens
gtttatagcaaacttggaat

SEQ ID NO: 5633507 - DNA, 18 bp, Homo sapiens
gtttatagttaatctata

SEQ ID NO: 5633508 - DNA, 12 bp, Homo sapiens
gtttatatactg

SEQ ID NO: 5633509 - DNA, 19 bp, Homo sapiens
gtttatatctcctttgtat

SEQ ID NO: 5633510 - DNA, 13 bp, Homo sapiens
gtttatatggata

SEQ ID NO: 5633511 - DNA, 19 bp, Homo sapiens
gtttatatggataatctga

SEQ ID NO: 5633512 - DNA, 22 bp, Homo sapiens
gtttatatggataatctgagca

SEQ ID NO: 5633513 - DNA, 23 bp, Homo sapiens
gtttatatggcgttttgtctgtg

SEQ ID NO: 5633514 - DNA, 18 bp, Homo sapiens
gtttatatgtgttgaaaa

SEQ ID NO: 5633515 - DNA, 17 bp, Homo sapiens
gtttatattgggaagct

SEQ ID NO: 5633516 - DNA, 14 bp, Homo sapiens
gtttatattgtgga

SEQ ID NO: 5633517 - DNA, 21 bp, Homo sapiens
gtttatattgtttttatatat

SEQ ID NO: 5633518 - DNA, 18 bp, Homo sapiens
gtttatatttattatata

SEQ ID NO: 5633519 - DNA, 11 bp, Homo sapiens
gtttatatttt

SEQ ID NO: 5633520 - DNA, 21 bp, Homo sapiens
gtttatcagaaagggcagaag

SEQ ID NO: 5633521 - DNA, 21 bp, Homo sapiens
gtttatcagatacatcactgc

SEQ ID NO: 5633522 - DNA, 15 bp, Homo sapiens
gtttatcatgaagcc

SEQ ID NO: 5633523 - DNA, 17 bp, Homo sapiens
gtttatcatgaagcctg

SEQ ID NO: 5633524 - DNA, 18 bp, Homo sapiens
gtttatcattgggagaag

SEQ ID NO: 5633525 - DNA, 15 bp, Homo sapiens
gtttatccaaatctt

SEQ ID NO: 5633526 - DNA, 16 bp, Homo sapiens
gtttatccaaatcttg

SEQ ID NO: 5633527 - DNA, 17 bp, Homo sapiens
gtttatcccttaagaat

SEQ ID NO: 5633528 - DNA, 22 bp, Homo sapiens
gtttatcccttaagaatgagtt

SEQ ID NO: 5633529 - DNA, 21 bp, Homo sapiens
gtttatcctcttggtgtctgg

SEQ ID NO: 5633530 - DNA, 17 bp, Homo sapiens
gtttatctagatgtaaa

SEQ ID NO: 5633531 - DNA, 12 bp, Homo sapiens
gtttatgaaaat

SEQ ID NO: 5633532 - DNA, 16 bp, Homo sapiens
gtttatgagaaactgg

SEQ ID NO: 5633533 - DNA, 13 bp, Homo sapiens
gtttatgagccag

SEQ ID NO: 5633534 - DNA, 17 bp, Homo sapiens
gtttatgatatttcttg

SEQ ID NO: 5633535 - DNA, 12 bp, Homo sapiens
gtttatgattaa

SEQ ID NO: 5633536 - DNA, 13 bp, Homo sapiens
gtttatgcatgta

SEQ ID NO: 5633537 - DNA, 16 bp, Homo sapiens
gtttatgcatgtatat

SEQ ID NO: 5633538 - DNA, 20 bp, Homo sapiens
gtttatggaaataccaggac

SEQ ID NO: 5633539 - DNA, 15 bp, Homo sapiens
gtttatggaaatatt

SEQ ID NO: 5633540 - DNA, 22 bp, Homo sapiens
gtttatggaaatattaagaaca

SEQ ID NO: 5633541 - DNA, 15 bp, Homo sapiens
gtttatggcctcagc

SEQ ID NO: 5633542 - DNA, 18 bp, Homo sapiens
gtttatggcctcagctgc

SEQ ID NO: 5633543 - DNA, 19 bp, Homo sapiens
gtttatgtaaacaaatctt

SEQ ID NO: 5633544 - DNA, 23 bp, Homo sapiens
gtttatgtaactatcaaatggtt

SEQ ID NO: 5633545 - DNA, 15 bp, Homo sapiens
gtttatgtaatttca

SEQ ID NO: 5633546 - DNA, 16 bp, Homo sapiens
gtttatgtactgtaaa

SEQ ID NO: 5633547 - DNA, 19 bp, Homo sapiens
gtttatgtatcagctctct

SEQ ID NO: 5633548 - DNA, 13 bp, Homo sapiens
gtttatgtctaaa

SEQ ID NO: 5633549 - DNA, 19 bp, Homo sapiens
gtttatgtgaacattccta

SEQ ID NO: 5633550 - DNA, 13 bp, Homo sapiens
gtttatgtgtgtg

SEQ ID NO: 5633551 - DNA, 17 bp, Homo sapiens
gtttatgtgttatgaac

SEQ ID NO: 5633552 - DNA, 13 bp, Homo sapiens
gtttattaaatct

SEQ ID NO: 5633553 - DNA, 18 bp, Homo sapiens
gtttattaactactgaat

SEQ ID NO: 5633554 - DNA, 18 bp, Homo sapiens
gtttattaatcttagtgt

SEQ ID NO: 5633555 - DNA, 20 bp, Homo sapiens
gtttattaatcttagtgtat

SEQ ID NO: 5633556 - DNA, 23 bp, Homo sapiens
gtttattacgtatgtctggttct

SEQ ID NO: 5633557 - DNA, 17 bp, Homo sapiens
gtttattacttccatga

SEQ ID NO: 5633558 - DNA, 20 bp, Homo sapiens
gtttattacttccatgaatt

SEQ ID NO: 5633559 - DNA, 19 bp, Homo sapiens
gtttattataaagcttaaa

SEQ ID NO: 5633560 - DNA, 14 bp, Homo sapiens
gtttattatacagt

SEQ ID NO: 5633561 - DNA, 13 bp, Homo sapiens
gtttattattgta

SEQ ID NO: 5633562 - DNA, 14 bp, Homo sapiens
gtttattcaaactg

SEQ ID NO: 5633563 - DNA, 22 bp, Homo sapiens
gtttattcagtaaacaacttgt

SEQ ID NO: 5633564 - DNA, 17 bp, Homo sapiens
gtttattcatatgcata

SEQ ID NO: 5633565 - DNA, 16 bp, Homo sapiens
gtttattccaaagagt

SEQ ID NO: 5633566 - DNA, 20 bp, Homo sapiens
gtttattccagagctgccag

SEQ ID NO: 5633567 - DNA, 13 bp, Homo sapiens
gtttattcccaag

SEQ ID NO: 5633568 - DNA, 18 bp, Homo sapiens
gtttattcccaagtatgc

SEQ ID NO: 5633569 - DNA, 20 bp, Homo sapiens
gtttattcccaagtatgcct

SEQ ID NO: 5633570 - DNA, 22 bp, Homo sapiens
gtttattccttctgtagtgtat

SEQ ID NO: 5633571 - DNA, 20 bp, Homo sapiens
gtttattcttccaacacatt

SEQ ID NO: 5633572 - DNA, 16 bp, Homo sapiens
gtttattcttccagaa

SEQ ID NO: 5633573 - DNA, 15 bp, Homo sapiens
gtttattcttctaga

SEQ ID NO: 5633574 - DNA, 18 bp, Homo sapiens
gtttattgatattcaata

SEQ ID NO: 5633575 - DNA, 20 bp, Homo sapiens
gtttattggaagtgttcaag

SEQ ID NO: 5633576 - DNA, 17 bp, Homo sapiens
gtttattgggcaataaa

SEQ ID NO: 5633577 - DNA, 21 bp, Homo sapiens
gtttattggtgagttaggaac

SEQ ID NO: 5633578 - DNA, 14 bp, Homo sapiens
gtttattgtttgat

SEQ ID NO: 5633579 - DNA, 16 bp, Homo sapiens
gtttatttaaggatgg

SEQ ID NO: 5633580 - DNA, 18 bp, Homo sapiens
gtttatttaaggatggat

SEQ ID NO: 5633581 - DNA, 19 bp, Homo sapiens
gtttatttaaggatggatg

SEQ ID NO: 5633582 - DNA, 14 bp, Homo sapiens
gtttatttagaaac

SEQ ID NO: 5633583 - DNA, 16 bp, Homo sapiens
gtttatttagaaactg

SEQ ID NO: 5633584 - DNA, 17 bp, Homo sapiens
gtttatttagctctgaa

SEQ ID NO: 5633585 - DNA, 15 bp, Homo sapiens
gtttatttattcact

SEQ ID NO: 5633586 - DNA, 21 bp, Homo sapiens
gtttatttccactattttcaa

SEQ ID NO: 5633587 - DNA, 13 bp, Homo sapiens
gtttatttctgtg

SEQ ID NO: 5633588 - DNA, 15 bp, Homo sapiens
gtttatttgcaattt

SEQ ID NO: 5633589 - DNA, 17 bp, Homo sapiens
gtttatttgcaatttga

SEQ ID NO: 5633590 - DNA, 18 bp, Homo sapiens
gtttatttgcaatttgag

SEQ ID NO: 5633591 - DNA, 18 bp, Homo sapiens
gtttatttgttgttttct

SEQ ID NO: 5633592 - DNA, 19 bp, Homo sapiens
gtttattttcaagaataat

SEQ ID NO: 5633593 - DNA, 18 bp, Homo sapiens
gtttattttcattctgcc

SEQ ID NO: 5633594 - DNA, 22 bp, Homo sapiens
gtttattttcattctgccaaag

SEQ ID NO: 5633595 - DNA, 18 bp, Homo sapiens
gtttatttttatatagct

SEQ ID NO: 5633596 - DNA, 17 bp, Homo sapiens
gtttatttttcatattg

SEQ ID NO: 5633597 - DNA, 18 bp, Homo sapiens
gtttatttttcatattgt

SEQ ID NO: 5633598 - DNA, 17 bp, Homo sapiens
gtttatttttgtaatgt

SEQ ID NO: 5633599 - DNA, 19 bp, Homo sapiens
gtttattttttaactttta

SEQ ID NO: 5633600 - DNA, 18 bp, Homo sapiens
gtttattttttttggcct

SEQ ID NO: 5633601 - DNA, 19 bp, Homo sapiens
gtttcaaaaacacagtgtt

SEQ ID NO: 5633602 - DNA, 19 bp, Homo sapiens
gtttcaaaagcaaaacatc

SEQ ID NO: 5633603 - DNA, 14 bp, Homo sapiens
gtttcaaaatagac

SEQ ID NO: 5633604 - DNA, 13 bp, Homo sapiens
gtttcaaacctgc

SEQ ID NO: 5633605 - DNA, 14 bp, Homo sapiens
gtttcaaactttac

SEQ ID NO: 5633606 - DNA, 20 bp, Homo sapiens
gtttcaaagatgctgtgagt

SEQ ID NO: 5633607 - DNA, 22 bp, Homo sapiens
gtttcaaagcacaataactagt

SEQ ID NO: 5633608 - DNA, 22 bp, Homo sapiens
gtttcaaagtaaaggcctcctc

SEQ ID NO: 5633609 - DNA, 23 bp, Homo sapiens
gtttcaaagtgtctcattctcag

SEQ ID NO: 5633610 - DNA, 20 bp, Homo sapiens
gtttcaacaatttttgatca

SEQ ID NO: 5633611 - DNA, 17 bp, Homo sapiens
gtttcaacccaactgac

SEQ ID NO: 5633612 - DNA, 23 bp, Homo sapiens
gtttgggggaaaaaaaagaaaaa

SEQ ID NO: 5633613 - DNA, 22 bp, Homo sapiens
gtttgggggcgccctctctgct

SEQ ID NO: 5633614 - DNA, 18 bp, Homo sapiens
gtttgggggcttccctgg

SEQ ID NO: 5633615 - DNA, 21 bp, Homo sapiens
gtttgggggttaccaaaaata

SEQ ID NO: 5633616 - DNA, 19 bp, Homo sapiens
gtttggggtgccaagatgg

SEQ ID NO: 5633617 - DNA, 20 bp, Homo sapiens
gtttgggtattgtgtgagtg

SEQ ID NO: 5633618 - DNA, 17 bp, Homo sapiens
gtttgggtgattcctaa

SEQ ID NO: 5633619 - DNA, 22 bp, Homo sapiens
gtttgggttctctgctgtccta

SEQ ID NO: 5633620 - DNA, 23 bp, Homo sapiens
gtttggtaacgaatttaaaatgt

SEQ ID NO: 5633621 - DNA, 17 bp, Homo sapiens
gtttggtattgtattta

SEQ ID NO: 5633622 - DNA, 15 bp, Homo sapiens
gtttggtctggactg

SEQ ID NO: 5633623 - DNA, 17 bp, Homo sapiens
gtttggtctggactgac

SEQ ID NO: 5633624 - DNA, 15 bp, Homo sapiens
gtttggtgaggacct

SEQ ID NO: 5633625 - DNA, 22 bp, Homo sapiens
gtttggtgggggtagagctgat

SEQ ID NO: 5633626 - DNA, 15 bp, Homo sapiens
gtttggtgtgtccca

SEQ ID NO: 5633627 - DNA, 15 bp, Homo sapiens
gtttggtgtgttccc

SEQ ID NO: 5633628 - DNA, 22 bp, Homo sapiens
gtttggttcaaatgtgttttgg

SEQ ID NO: 5633629 - DNA, 22 bp, Homo sapiens
gtttggttcacttacagatagt

SEQ ID NO: 5633630 - DNA, 13 bp, Homo sapiens
gtttggtttacat

SEQ ID NO: 5633631 - DNA, 21 bp, Homo sapiens
gtttggtttcccattggttca

SEQ ID NO: 5633632 - DNA, 16 bp, Homo sapiens
gtttggttttaaaata

SEQ ID NO: 5633633 - DNA, 11 bp, Homo sapiens
gtttggttttg

SEQ ID NO: 5633634 - DNA, 22 bp, Homo sapiens
gtttggtttttatttctccttt

SEQ ID NO: 5633635 - DNA, 13 bp, Homo sapiens
gtttgtaaaacta

SEQ ID NO: 5633636 - DNA, 16 bp, Homo sapiens
gtttgtaaaagagctg

SEQ ID NO: 5633637 - DNA, 22 bp, Homo sapiens
gtttgtaaaagagctgttcttt

SEQ ID NO: 5633638 - DNA, 20 bp, Homo sapiens
gtttgtaaaattgttcctga

SEQ ID NO: 5633639 - DNA, 15 bp, Homo sapiens
gtttgtaaataagag

SEQ ID NO: 5633640 - DNA, 18 bp, Homo sapiens
gtttgtaaataagagatt

SEQ ID NO: 5633641 - DNA, 14 bp, Homo sapiens
gtttgtaaatgact

SEQ ID NO: 5633642 - DNA, 20 bp, Homo sapiens
gtttgtaaattaacttttat

SEQ ID NO: 5633643 - DNA, 15 bp, Homo sapiens
gtttgtaacttttta

SEQ ID NO: 5633644 - DNA, 20 bp, Homo sapiens
gtttgtaagcaattctaagt

SEQ ID NO: 5633645 - DNA, 21 bp, Homo sapiens
gtttgtaaggatgattttaat

SEQ ID NO: 5633646 - DNA, 23 bp, Homo sapiens
gtttgtaatatacagtttttgta

SEQ ID NO: 5633647 - DNA, 14 bp, Homo sapiens
gtttgtaatctgta

SEQ ID NO: 5633648 - DNA, 16 bp, Homo sapiens
gtttgtaatggtgctt

SEQ ID NO: 5633649 - DNA, 22 bp, Homo sapiens
gtttgtacaaactatttcagaa

SEQ ID NO: 5633650 - DNA, 19 bp, Homo sapiens
gtttgtacatatcaaatag

SEQ ID NO: 5633651 - DNA, 21 bp, Homo sapiens
gtttgtagcatttttctaata

SEQ ID NO: 5633652 - DNA, 20 bp, Homo sapiens
gtttgtagctttcctggaag

SEQ ID NO: 5633653 - DNA, 14 bp, Homo sapiens
gtttgtaggtaaaa

SEQ ID NO: 5633654 - DNA, 16 bp, Homo sapiens
gtttgtataacttctt

SEQ ID NO: 5633655 - DNA, 15 bp, Homo sapiens
gtttgtatataaatg

SEQ ID NO: 5633656 - DNA, 14 bp, Homo sapiens
gtttgtatatttgc

SEQ ID NO: 5633657 - DNA, 15 bp, Homo sapiens
gtttgtatatttgca

SEQ ID NO: 5633658 - DNA, 13 bp, Homo sapiens
gtttgtatgaaac

SEQ ID NO: 5633659 - DNA, 15 bp, Homo sapiens
gtttgtatgtctgtg

SEQ ID NO: 5633660 - DNA, 19 bp, Homo sapiens
gtttgtattgtaaaaaatt

SEQ ID NO: 5633661 - DNA, 14 bp, Homo sapiens
gtttgtattttaaa

SEQ ID NO: 5633662 - DNA, 16 bp, Homo sapiens
gtttgtatttttagta

SEQ ID NO: 5633663 - DNA, 11 bp, Homo sapiens
gtttgtcaaca

SEQ ID NO: 5633664 - DNA, 15 bp, Homo sapiens
gtttgtcaacaaaaa

SEQ ID NO: 5633665 - DNA, 21 bp, Homo sapiens
gtttgtcaacaaaaagacatg

SEQ ID NO: 5633666 - DNA, 17 bp, Homo sapiens
gtttgtcacatgaaaca

SEQ ID NO: 5633667 - DNA, 16 bp, Homo sapiens
gtttgtcactgccaaa

SEQ ID NO: 5633668 - DNA, 12 bp, Homo sapiens
gtttgtcagcat

SEQ ID NO: 5633669 - DNA, 16 bp, Homo sapiens
gtttgtcagcatctga

SEQ ID NO: 5633670 - DNA, 21 bp, Homo sapiens
gtttgtcattagcctgagtag

SEQ ID NO: 5633671 - DNA, 22 bp, Homo sapiens
gtttgtcctgatgcttttgtct

SEQ ID NO: 5633672 - DNA, 13 bp, Homo sapiens
gtttgtccttgca

SEQ ID NO: 5633673 - DNA, 20 bp, Homo sapiens
gtttgtccttgcacctgagc

SEQ ID NO: 5633674 - DNA, 20 bp, Homo sapiens
gtttgtcctttttcactttg

SEQ ID NO: 5633675 - DNA, 16 bp, Homo sapiens
gtttgtctattttaaa

SEQ ID NO: 5633676 - DNA, 19 bp, Homo sapiens
gtttgtctattttaaaata

SEQ ID NO: 5633677 - DNA, 15 bp, Homo sapiens
gtttgtctcactttt

SEQ ID NO: 5633678 - DNA, 18 bp, Homo sapiens
gtttgtctcagttggaaa

SEQ ID NO: 5633679 - DNA, 19 bp, Homo sapiens
gtttgtctcagttggaaat

SEQ ID NO: 5633680 - DNA, 17 bp, Homo sapiens
gtttgtctctccttttc

SEQ ID NO: 5633681 - DNA, 18 bp, Homo sapiens
gtttgtctctccttttct

SEQ ID NO: 5633682 - DNA, 18 bp, Homo sapiens
gtttgtctgtttgtttca

SEQ ID NO: 5633683 - DNA, 21 bp, Homo sapiens
gtttgtcttccattccattgt

SEQ ID NO: 5633684 - DNA, 15 bp, Homo sapiens
gtttgtcttctcccc

SEQ ID NO: 5633685 - DNA, 20 bp, Homo sapiens
gtttgtcttggatatatagg

SEQ ID NO: 5633686 - DNA, 17 bp, Homo sapiens
gtttgtgaagtgattga

SEQ ID NO: 5633687 - DNA, 17 bp, Homo sapiens
gtttgtgacagggcggg

SEQ ID NO: 5633688 - DNA, 22 bp, Homo sapiens
gtttgtgagccttgctgccaag

SEQ ID NO: 5633689 - DNA, 23 bp, Homo sapiens
gtttgtgattcttccagatgtga

SEQ ID NO: 5633690 - DNA, 14 bp, Homo sapiens
gtttgtgcatcctg

SEQ ID NO: 5633691 - DNA, 22 bp, Homo sapiens
gtttgtgccttaaaaggagaga

SEQ ID NO: 5633692 - DNA, 23 bp, Homo sapiens
gtttgtgcctttttatttttgtt

SEQ ID NO: 5633693 - DNA, 23 bp, Homo sapiens
gtttgtgctggtgtatgtgtgaa

SEQ ID NO: 5633694 - DNA, 13 bp, Homo sapiens
gtttgtggcctca

SEQ ID NO: 5633695 - DNA, 14 bp, Homo sapiens
gtttgtggcctcag

SEQ ID NO: 5633696 - DNA, 17 bp, Homo sapiens
gtttgtggcgtctccct

SEQ ID NO: 5633697 - DNA, 17 bp, Homo sapiens
gtttgtgggacacaaca

SEQ ID NO: 5633698 - DNA, 13 bp, Homo sapiens
gtttgtgggactg

SEQ ID NO: 5633699 - DNA, 14 bp, Homo sapiens
gtttgtgtgcatga

SEQ ID NO: 5633700 - DNA, 15 bp, Homo sapiens
gtttgtgtgctgttg

SEQ ID NO: 5633701 - DNA, 13 bp, Homo sapiens
gtttgtgtgtctt

SEQ ID NO: 5633702 - DNA, 14 bp, Homo sapiens
gtttgtgtgtctta

SEQ ID NO: 5633703 - DNA, 15 bp, Homo sapiens
gtttgtgtgtcttaa

SEQ ID NO: 5633704 - DNA, 15 bp, Homo sapiens
gtttgtgtgttgtct

SEQ ID NO: 5633705 - DNA, 14 bp, Homo sapiens
gtttgtgtgtttca

SEQ ID NO: 5633706 - DNA, 16 bp, Homo sapiens
gtttgtgttagaaaag

SEQ ID NO: 5633707 - DNA, 17 bp, Homo sapiens
gtttgtgttagaaaagt

SEQ ID NO: 5633708 - DNA, 16 bp, Homo sapiens
gtttgtgttattattt

SEQ ID NO: 5633709 - DNA, 14 bp, Homo sapiens
gtttgttaaaactg

SEQ ID NO: 5633710 - DNA, 13 bp, Homo sapiens
gtttgttactgtc

SEQ ID NO: 5633711 - DNA, 12 bp, Homo sapiens
gtttgttacttt

SEQ ID NO: 5633712 - DNA, 13 bp, Homo sapiens
gtttgttactttg

SEQ ID NO: 5633713 - DNA, 14 bp, Homo sapiens
gtttgttactttga

SEQ ID NO: 5633714 - DNA, 19 bp, Homo sapiens
gtttgttatcagtacaatt

SEQ ID NO: 5633715 - DNA, 21 bp, Homo sapiens
gtttgttatgtgtctggaaga

SEQ ID NO: 5633716 - DNA, 17 bp, Homo sapiens
gtttgttcctttgaaga

SEQ ID NO: 5633717 - DNA, 12 bp, Homo sapiens
gtttgttctccg

SEQ ID NO: 5633718 - DNA, 19 bp, Homo sapiens
gtttgttgagctggtaaca

SEQ ID NO: 5633719 - DNA, 13 bp, Homo sapiens
gtttgttggaaag

SEQ ID NO: 5633720 - DNA, 23 bp, Homo sapiens
gtttgttggatccgtttgaccaa

SEQ ID NO: 5633721 - DNA, 16 bp, Homo sapiens
gtttgttgtgaggatt

SEQ ID NO: 5633722 - DNA, 18 bp, Homo sapiens
gtttgtttacaaaatcag

SEQ ID NO: 5633723 - DNA, 16 bp, Homo sapiens
gtttgtttacataaga

SEQ ID NO: 5633724 - DNA, 15 bp, Homo sapiens
gtttgtttataatgt

SEQ ID NO: 5633725 - DNA, 18 bp, Homo sapiens
gtttgtttattagatgaa

SEQ ID NO: 5633726 - DNA, 18 bp, Homo sapiens
gtttgtttcaagaacctg

SEQ ID NO: 5633727 - DNA, 21 bp, Homo sapiens
gtttgtttctccccctgggct

SEQ ID NO: 5633728 - DNA, 20 bp, Homo sapiens
gtttgtttctgttgttcact

SEQ ID NO: 5633729 - DNA, 21 bp, Homo sapiens
gtttgtttcttcttttccttt

SEQ ID NO: 5633730 - DNA, 14 bp, Homo sapiens
gtttgtttgcttaa

SEQ ID NO: 5633731 - DNA, 15 bp, Homo sapiens
gtttgtttggcactg

SEQ ID NO: 5633732 - DNA, 12 bp, Homo sapiens
gtttgtttggct

SEQ ID NO: 5633733 - DNA, 14 bp, Homo sapiens
gtttgtttgtttca

SEQ ID NO: 5633734 - DNA, 20 bp, Homo sapiens
gtttgttttagaaccagccg

SEQ ID NO: 5633735 - DNA, 18 bp, Homo sapiens
gtttgttttccttttatt

SEQ ID NO: 5633736 - DNA, 21 bp, Homo sapiens
gtttgtttttaaaaagcaaat

SEQ ID NO: 5633737 - DNA, 14 bp, Homo sapiens
gtttgtttttgcgt

SEQ ID NO: 5633738 - DNA, 12 bp, Homo sapiens
gtttgtttttgg

SEQ ID NO: 5633739 - DNA, 23 bp, Homo sapiens
gtttgttttttcaagaaaatttt

SEQ ID NO: 5633740 - DNA, 14 bp, Homo sapiens
gtttgttttttcat

SEQ ID NO: 5633741 - DNA, 15 bp, Homo sapiens
gtttgttttttcatg

SEQ ID NO: 5633742 - DNA, 23 bp, Homo sapiens
gtttgttttttgtttttctgctt

SEQ ID NO: 5633743 - DNA, 15 bp, Homo sapiens
gttttaaaaaaactg

SEQ ID NO: 5633744 - DNA, 16 bp, Homo sapiens
gttttaaaaaaactga

SEQ ID NO: 5633745 - DNA, 21 bp, Homo sapiens
gttttaaaaaaataaaacatt

SEQ ID NO: 5633746 - DNA, 17 bp, Homo sapiens
gttttaaaaacctgttc

SEQ ID NO: 5633747 - DNA, 15 bp, Homo sapiens
gttttaaaaagcatc

SEQ ID NO: 5633748 - DNA, 16 bp, Homo sapiens
gttttaaaaagccagt

SEQ ID NO: 5633749 - DNA, 19 bp, Homo sapiens
gttttaaaacgtgtaaatg

SEQ ID NO: 5633750 - DNA, 20 bp, Homo sapiens
gttttaaaacgtgtaaatga

SEQ ID NO: 5633751 - DNA, 21 bp, Homo sapiens
gttttaaaataaaaattctga

SEQ ID NO: 5633752 - DNA, 24 bp, Homo sapiens
gttttaaaataaaaattctgaatg

SEQ ID NO: 5633753 - DNA, 13 bp, Homo sapiens
gttttaaaataag

SEQ ID NO: 5633754 - DNA, 22 bp, Homo sapiens
gttttaaaataagttaaaggca

SEQ ID NO: 5633755 - DNA, 13 bp, Homo sapiens
gttttaaaataat

SEQ ID NO: 5633756 - DNA, 19 bp, Homo sapiens
gttttaaaatactgtagat

SEQ ID NO: 5633757 - DNA, 21 bp, Homo sapiens
gttttaaaatactgtagataa

SEQ ID NO: 5633758 - DNA, 11 bp, Homo sapiens
gttttaaaatt

SEQ ID NO: 5633759 - DNA, 16 bp, Homo sapiens
gttttaaaattatata

SEQ ID NO: 5633760 - DNA, 22 bp, Homo sapiens
gttttaaacacatgccttaaat

SEQ ID NO: 5633761 - DNA, 14 bp, Homo sapiens
gttttaaactcatt

SEQ ID NO: 5633762 - DNA, 16 bp, Homo sapiens
gttttaaactttcaat

SEQ ID NO: 5633763 - DNA, 13 bp, Homo sapiens
gttttaaagaagt

SEQ ID NO: 5633764 - DNA, 22 bp, Homo sapiens
gttttaaatacgcactacatgt

SEQ ID NO: 5633765 - DNA, 15 bp, Homo sapiens
gttttaaatgtgttg

SEQ ID NO: 5633766 - DNA, 21 bp, Homo sapiens
gttttaaattatgtataaaca

SEQ ID NO: 5633767 - DNA, 20 bp, Homo sapiens
gttttaaattgcatttctat

SEQ ID NO: 5633768 - DNA, 19 bp, Homo sapiens
gttttaaatttatttcaaa

SEQ ID NO: 5633769 - DNA, 17 bp, Homo sapiens
gttttaacaagaagcaa

SEQ ID NO: 5633770 - DNA, 18 bp, Homo sapiens
gttttaacagaaccagag

SEQ ID NO: 5633771 - DNA, 17 bp, Homo sapiens
gttttaacggcctgcat

SEQ ID NO: 5633772 - DNA, 19 bp, Homo sapiens
gttttaactagaatttatt

SEQ ID NO: 5633773 - DNA, 22 bp, Homo sapiens
gttttaactgtggatattgtta

SEQ ID NO: 5633774 - DNA, 16 bp, Homo sapiens
gttttaacttatttat

SEQ ID NO: 5633775 - DNA, 23 bp, Homo sapiens
gttttaacttatttatatgaagc

SEQ ID NO: 5633776 - DNA, 19 bp, Homo sapiens
gttttaactttaatacagc

SEQ ID NO: 5633777 - DNA, 16 bp, Homo sapiens
gttttaagaaatgtag

SEQ ID NO: 5633778 - DNA, 14 bp, Homo sapiens
gttttaagaggcag

SEQ ID NO: 5633779 - DNA, 15 bp, Homo sapiens
gttttaagattgtaa

SEQ ID NO: 5633780 - DNA, 20 bp, Homo sapiens
gttttaagcaaatgcattct

SEQ ID NO: 5633781 - DNA, 22 bp, Homo sapiens
gttttaagcaaatgcattctat

SEQ ID NO: 5633782 - DNA, 18 bp, Homo sapiens
gttttaagctaaaatgtt

SEQ ID NO: 5633783 - DNA, 19 bp, Homo sapiens
gttttaagctaaaatgtta

SEQ ID NO: 5633784 - DNA, 17 bp, Homo sapiens
gttttaaggacattaaa

SEQ ID NO: 5633785 - DNA, 16 bp, Homo sapiens
gttttaagtactacac

SEQ ID NO: 5633786 - DNA, 17 bp, Homo sapiens
gttttaagttgtttgca

SEQ ID NO: 5633787 - DNA, 14 bp, Homo sapiens
gttttaataaaaga

SEQ ID NO: 5633788 - DNA, 19 bp, Homo sapiens
gttttaatctgaaattcta

SEQ ID NO: 5633789 - DNA, 12 bp, Homo sapiens
gttttaatgtat

SEQ ID NO: 5633790 - DNA, 14 bp, Homo sapiens
gttttgttttttag

SEQ ID NO: 5633791 - DNA, 13 bp, Homo sapiens
gttttgttttttt

SEQ ID NO: 5633792 - DNA, 17 bp, Homo sapiens
gttttgtttttttgaga

SEQ ID NO: 5633793 - DNA, 22 bp, Homo sapiens
gtttttaaaaaaaaaaaatcat

SEQ ID NO: 5633794 - DNA, 19 bp, Homo sapiens
gtttttaaaaagagtaatt

SEQ ID NO: 5633795 - DNA, 21 bp, Homo sapiens
gtttttaaaaaggcctttggg

SEQ ID NO: 5633796 - DNA, 14 bp, Homo sapiens
gtttttaaaaatta

SEQ ID NO: 5633797 - DNA, 14 bp, Homo sapiens
gtttttaaactgta

SEQ ID NO: 5633798 - DNA, 19 bp, Homo sapiens
gtttttaaataaagaacaa

SEQ ID NO: 5633799 - DNA, 18 bp, Homo sapiens
gtttttaaatagagtttg

SEQ ID NO: 5633800 - DNA, 18 bp, Homo sapiens
gtttttaaatgaggatta

SEQ ID NO: 5633801 - DNA, 15 bp, Homo sapiens
gtttttaaattttgt

SEQ ID NO: 5633802 - DNA, 14 bp, Homo sapiens
gtttttaacatgtg

SEQ ID NO: 5633803 - DNA, 22 bp, Homo sapiens
gtttttaacctgttttgttaat

SEQ ID NO: 5633804 - DNA, 12 bp, Homo sapiens
gtttttaactca

SEQ ID NO: 5633805 - DNA, 19 bp, Homo sapiens
gtttttaactcaatatttt

SEQ ID NO: 5633806 - DNA, 13 bp, Homo sapiens
gtttttaactcat

SEQ ID NO: 5633807 - DNA, 22 bp, Homo sapiens
gtttttaacttttaatttaaaa

SEQ ID NO: 5633808 - DNA, 13 bp, Homo sapiens
gtttttaagctgt

SEQ ID NO: 5633809 - DNA, 15 bp, Homo sapiens
gtttttaagctgttt

SEQ ID NO: 5633810 - DNA, 19 bp, Homo sapiens
gtttttaagctgtttccat

SEQ ID NO: 5633811 - DNA, 13 bp, Homo sapiens
gtttttaagtgct

SEQ ID NO: 5633812 - DNA, 17 bp, Homo sapiens
gtttttaagtttgcact

SEQ ID NO: 5633813 - DNA, 17 bp, Homo sapiens
gtttttaataaagacag

SEQ ID NO: 5633814 - DNA, 20 bp, Homo sapiens
gtttttaatagctatggaat

SEQ ID NO: 5633815 - DNA, 17 bp, Homo sapiens
gtttttaatctcctgtt

SEQ ID NO: 5633816 - DNA, 15 bp, Homo sapiens
gtttttaatctcttg

SEQ ID NO: 5633817 - DNA, 16 bp, Homo sapiens
gtttttaatggcataa

SEQ ID NO: 5633818 - DNA, 21 bp, Homo sapiens
gtttttaatttaaactgtgtt

SEQ ID NO: 5633819 - DNA, 19 bp, Homo sapiens
gtttttaatttgaatcaga

SEQ ID NO: 5633820 - DNA, 14 bp, Homo sapiens
gtttttaatttgat

SEQ ID NO: 5633821 - DNA, 21 bp, Homo sapiens
gtttttacaaatgttaaaatg

SEQ ID NO: 5633822 - DNA, 13 bp, Homo sapiens
gtttttacagtgt

SEQ ID NO: 5633823 - DNA, 20 bp, Homo sapiens
gtttttacatacttttgcaa

SEQ ID NO: 5633824 - DNA, 13 bp, Homo sapiens
gtttttacccata

SEQ ID NO: 5633825 - DNA, 14 bp, Homo sapiens
gtttttacccatat

SEQ ID NO: 5633826 - DNA, 20 bp, Homo sapiens
gtttttacccatatcccctc

SEQ ID NO: 5633827 - DNA, 22 bp, Homo sapiens
gtttttacctaccacagtgtct

SEQ ID NO: 5633828 - DNA, 17 bp, Homo sapiens
gtttttacctctgtctt

SEQ ID NO: 5633829 - DNA, 16 bp, Homo sapiens
gtttttactacagttg

SEQ ID NO: 5633830 - DNA, 13 bp, Homo sapiens
gtttttactgaat

SEQ ID NO: 5633831 - DNA, 17 bp, Homo sapiens
gtttttactttctgttg

SEQ ID NO: 5633832 - DNA, 23 bp, Homo sapiens
gtttttagagaatgtgtttcaaa

SEQ ID NO: 5633833 - DNA, 16 bp, Homo sapiens
gtttttagagacaggg

SEQ ID NO: 5633834 - DNA, 19 bp, Homo sapiens
gtttttagagcttccaaat

SEQ ID NO: 5633835 - DNA, 22 bp, Homo sapiens
gtttttagaggggcaaaaatat

SEQ ID NO: 5633836 - DNA, 20 bp, Homo sapiens
gtttttagcatgttcctcct

SEQ ID NO: 5633837 - DNA, 18 bp, Homo sapiens
gtttttaggctgttcctt

SEQ ID NO: 5633838 - DNA, 23 bp, Homo sapiens
gtttttataaaaaatggtgcctg

SEQ ID NO: 5633839 - DNA, 15 bp, Homo sapiens
gtttttataataaaa

SEQ ID NO: 5633840 - DNA, 22 bp, Homo sapiens
gtttttatacctgtacacacac

SEQ ID NO: 5633841 - DNA, 21 bp, Homo sapiens
gtttttatatagtctacagtt

SEQ ID NO: 5633842 - DNA, 16 bp, Homo sapiens
gtttttatattacttt

SEQ ID NO: 5633843 - DNA, 15 bp, Homo sapiens
gtttttatattttca

SEQ ID NO: 5633844 - DNA, 19 bp, Homo sapiens
gtttttatctttgaccaac

SEQ ID NO: 5633845 - DNA, 21 bp, Homo sapiens
gtttttatgaagaaaaaatac

SEQ ID NO: 5633846 - DNA, 15 bp, Homo sapiens
gtttttatgagaaac

SEQ ID NO: 5633847 - DNA, 19 bp, Homo sapiens
gtttttatgatatccctga

SEQ ID NO: 5633848 - DNA, 18 bp, Homo sapiens
gtttttatgcctttctct

SEQ ID NO: 5633849 - DNA, 21 bp, Homo sapiens
gtttttatggttccaatgaaa

SEQ ID NO: 5633850 - DNA, 19 bp, Homo sapiens
gtttttatgtgtattagga

SEQ ID NO: 5633851 - DNA, 21 bp, Homo sapiens
gtttttattaatctactgtat

SEQ ID NO: 5633852 - DNA, 13 bp, Homo sapiens
gtttttattacaa

SEQ ID NO: 5633853 - DNA, 23 bp, Homo sapiens
gtttttattacaaattttcactg

SEQ ID NO: 5633854 - DNA, 18 bp, Homo sapiens
gtttttattattaacaaa

SEQ ID NO: 5633855 - DNA, 22 bp, Homo sapiens
gtttttattgcatttgctgttg

SEQ ID NO: 5633856 - DNA, 18 bp, Homo sapiens
gtttttattgtaaaacaa

SEQ ID NO: 5633857 - DNA, 16 bp, Homo sapiens
gtttttatttcctatg

SEQ ID NO: 5633858 - DNA, 20 bp, Homo sapiens
gtttttatttcctatgatgt

SEQ ID NO: 5633859 - DNA, 18 bp, Homo sapiens
gtttttattttaaacatt

SEQ ID NO: 5633860 - DNA, 20 bp, Homo sapiens
gtttttattttaaacatttt

SEQ ID NO: 5633861 - DNA, 16 bp, Homo sapiens
gtttttattttcaaga

SEQ ID NO: 5633862 - DNA, 14 bp, Homo sapiens
gtttttatttttgt

SEQ ID NO: 5633863 - DNA, 12 bp, Homo sapiens
gtttttcaatta

SEQ ID NO: 5633864 - DNA, 13 bp, Homo sapiens
gtttttcaattaa

SEQ ID NO: 5633865 - DNA, 21 bp, Homo sapiens
gtttttcaattaaacggatta

SEQ ID NO: 5633866 - DNA, 12 bp, Homo sapiens
gtttttcacatt

SEQ ID NO: 5633867 - DNA, 17 bp, Homo sapiens
gtttttcactttagcaa

SEQ ID NO: 5633868 - DNA, 14 bp, Homo sapiens
gtttttcagctccc

SEQ ID NO: 5633869 - DNA, 23 bp, Homo sapiens
gtttttcaggtatatacctccat

SEQ ID NO: 5633870 - DNA, 12 bp, Homo sapiens
gtttttcagttc

SEQ ID NO: 5633871 - DNA, 15 bp, Homo sapiens
gtttttcataaagca

SEQ ID NO: 5633872 - DNA, 16 bp, Homo sapiens
gtttttcatactgaat

SEQ ID NO: 5633873 - DNA, 15 bp, Homo sapiens
gtttttcatactgta

SEQ ID NO: 5633874 - DNA, 20 bp, Homo sapiens
gtttttcatactgtacacat

SEQ ID NO: 5633875 - DNA, 14 bp, Homo sapiens
gtttttcatctttt

SEQ ID NO: 5633876 - DNA, 18 bp, Homo sapiens
gtttttcatttgttttgc

SEQ ID NO: 5633877 - DNA, 21 bp, Homo sapiens
gtttttccaaaacttgaactt

SEQ ID NO: 5633878 - DNA, 18 bp, Homo sapiens
gtttttccactactgcta

SEQ ID NO: 5633879 - DNA, 16 bp, Homo sapiens
gtttttcccctgctcc

SEQ ID NO: 5633880 - DNA, 12 bp, Homo sapiens
gtttttccctaa

SEQ ID NO: 5633881 - DNA, 13 bp, Homo sapiens
gtttttccctccc

SEQ ID NO: 5633882 - DNA, 17 bp, Homo sapiens
gtttttccctccccaga

SEQ ID NO: 5633883 - DNA, 18 bp, Homo sapiens
gtttttccctccccagaa

SEQ ID NO: 5633884 - DNA, 19 bp, Homo sapiens
gtttttccctccccagaat

SEQ ID NO: 5633885 - DNA, 18 bp, Homo sapiens
gtttttcctatcatgtta

SEQ ID NO: 5633886 - DNA, 20 bp, Homo sapiens
gtttttcctatcatgttaac

SEQ ID NO: 5633887 - DNA, 18 bp, Homo sapiens
gtttttcctttttttgta

SEQ ID NO: 5633888 - DNA, 13 bp, Homo sapiens
gtttttctaaagg

SEQ ID NO: 5633889 - DNA, 15 bp, Homo sapiens
gtttttctattaaaa

SEQ ID NO: 5633890 - DNA, 16 bp, Homo sapiens
gtttttctattaaaag

SEQ ID NO: 5633891 - DNA, 17 bp, Homo sapiens
gtttttctattaaaaga

SEQ ID NO: 5633892 - DNA, 19 bp, Homo sapiens
gtttttctattaaaagact

SEQ ID NO: 5633893 - DNA, 20 bp, Homo sapiens
gtttttctcaaaaagctgct

SEQ ID NO: 5633894 - DNA, 11 bp, Homo sapiens
gtttttctcac

SEQ ID NO: 5633895 - DNA, 15 bp, Homo sapiens
gtttttctcatgtat

SEQ ID NO: 5633896 - DNA, 21 bp, Homo sapiens
gtttttctcgtccccctccct

SEQ ID NO: 5633897 - DNA, 23 bp, Homo sapiens
gtttttctctataaagggtcagg

SEQ ID NO: 5633898 - DNA, 17 bp, Homo sapiens
gtttttctgccagggag

SEQ ID NO: 5633899 - DNA, 19 bp, Homo sapiens
gtttttctgctttagactt

SEQ ID NO: 5633900 - DNA, 22 bp, Homo sapiens
gtttttctgctttagacttgaa

SEQ ID NO: 5633901 - DNA, 17 bp, Homo sapiens
gtttttctgcttttgaa

SEQ ID NO: 5633902 - DNA, 15 bp, Homo sapiens
gtttttctggaagta

SEQ ID NO: 5633903 - DNA, 16 bp, Homo sapiens
gtttttctgggtggcc

SEQ ID NO: 5633904 - DNA, 23 bp, Homo sapiens
gtttttcttcaacatcaatgttc

SEQ ID NO: 5633905 - DNA, 15 bp, Homo sapiens
gtttttcttcagcat

SEQ ID NO: 5633906 - DNA, 15 bp, Homo sapiens
gtttttcttctccct

SEQ ID NO: 5633907 - DNA, 13 bp, Homo sapiens
gtttttcttgcta

SEQ ID NO: 5633908 - DNA, 12 bp, Homo sapiens
gtttttctttaa

SEQ ID NO: 5633909 - DNA, 17 bp, Homo sapiens
gtttttgaaacccacag

SEQ ID NO: 5633910 - DNA, 20 bp, Homo sapiens
gtttttgaaacccacagttt

SEQ ID NO: 5633911 - DNA, 19 bp, Homo sapiens
gtttttgaaggcagaaagc

SEQ ID NO: 5633912 - DNA, 15 bp, Homo sapiens
gtttttgacagcctt

SEQ ID NO: 5633913 - DNA, 14 bp, Homo sapiens
gtttttgacattta

SEQ ID NO: 5633914 - DNA, 15 bp, Homo sapiens
gtttttgacatttat

SEQ ID NO: 5633915 - DNA, 14 bp, Homo sapiens
gtttttgactcttt

SEQ ID NO: 5633916 - DNA, 13 bp, Homo sapiens
gtttttgagatat

SEQ ID NO: 5633917 - DNA, 19 bp, Homo sapiens
gtttttgatagcattgtaa

SEQ ID NO: 5633918 - DNA, 12 bp, Homo sapiens
gtttttgcccat

SEQ ID NO: 5633919 - DNA, 17 bp, Homo sapiens
gtttttgctctacttta

SEQ ID NO: 5633920 - DNA, 13 bp, Homo sapiens
gtttttgctgaag

SEQ ID NO: 5633921 - DNA, 11 bp, Homo sapiens
gtttttgcttt

SEQ ID NO: 5633922 - DNA, 15 bp, Homo sapiens
gtttttgctttctga

SEQ ID NO: 5633923 - DNA, 13 bp, Homo sapiens
gtttttggctctt

SEQ ID NO: 5633924 - DNA, 19 bp, Homo sapiens
gtttttgggtgcaagaggg

SEQ ID NO: 5633925 - DNA, 20 bp, Homo sapiens
gtttttggtcttttataatt

SEQ ID NO: 5633926 - DNA, 15 bp, Homo sapiens
gtttttggtgtttct

SEQ ID NO: 5633927 - DNA, 15 bp, Homo sapiens
gtttttgtaaagatt

SEQ ID NO: 5633928 - DNA, 13 bp, Homo sapiens
gtttttgtatctt

SEQ ID NO: 5633929 - DNA, 19 bp, Homo sapiens
gtttttgtatctttaaaga

SEQ ID NO: 5633930 - DNA, 19 bp, Homo sapiens
gtttttgtatctttatgct

SEQ ID NO: 5633931 - DNA, 15 bp, Homo sapiens
gtttttgtcttgcat

SEQ ID NO: 5633932 - DNA, 15 bp, Homo sapiens
gtttttgttaacttt

SEQ ID NO: 5633933 - DNA, 18 bp, Homo sapiens
gtttttgttcttaaaaat

SEQ ID NO: 5633934 - DNA, 23 bp, Homo sapiens
gtttttgttcttaattgcactct

SEQ ID NO: 5633935 - DNA, 19 bp, Homo sapiens
gtttttgttgcttttttag

SEQ ID NO: 5633936 - DNA, 16 bp, Homo sapiens
gtttttgttttaagga

SEQ ID NO: 5633937 - DNA, 12 bp, Homo sapiens
gtttttgttttg

SEQ ID NO: 5633938 - DNA, 15 bp, Homo sapiens
gttttttaaagcaag

SEQ ID NO: 5633939 - DNA, 21 bp, Homo sapiens
gttttttaaagtcttgctgtg

SEQ ID NO: 5633940 - DNA, 15 bp, Homo sapiens
gttttttaaatgact

SEQ ID NO: 5633941 - DNA, 18 bp, Homo sapiens
gttttttaagatagtgta

SEQ ID NO: 5633942 - DNA, 12 bp, Homo sapiens
gttttttaagtc

SEQ ID NO: 5633943 - DNA, 17 bp, Homo sapiens
gttttttaataaaagtt

SEQ ID NO: 5633944 - DNA, 16 bp, Homo sapiens
gttttttatacttcaa

SEQ ID NO: 5633945 - DNA, 17 bp, Homo sapiens
gttttttatacttcaaa

SEQ ID NO: 5633946 - DNA, 16 bp, Homo sapiens
gttttttatatatgaa

SEQ ID NO: 5633947 - DNA, 21 bp, Homo sapiens
gttttttatatatgaatatta

SEQ ID NO: 5633948 - DNA, 19 bp, Homo sapiens
gttttttatcttttctaca

SEQ ID NO: 5633949 - DNA, 15 bp, Homo sapiens
gttttttatgctaat

SEQ ID NO: 5633950 - DNA, 16 bp, Homo sapiens
gttttttattattgtg

SEQ ID NO: 5633951 - DNA, 13 bp, Homo sapiens
gttttttcatagt

SEQ ID NO: 5633952 - DNA, 15 bp, Homo sapiens
gttttttcatctgta

SEQ ID NO: 5633953 - DNA, 19 bp, Homo sapiens
gttttttcctaaggaaact

SEQ ID NO: 5633954 - DNA, 14 bp, Homo sapiens
gttttttcctttat

SEQ ID NO: 5633955 - DNA, 14 bp, Homo sapiens
gttttttcgtgttt

SEQ ID NO: 5633956 - DNA, 13 bp, Homo sapiens
gttttttctgcaa

SEQ ID NO: 5633957 - DNA, 18 bp, Homo sapiens
gttttttctgtaatgtaa

SEQ ID NO: 5633958 - DNA, 14 bp, Homo sapiens
gttttttctgtaca

SEQ ID NO: 5633959 - DNA, 14 bp, Homo sapiens
gttttttctttata

SEQ ID NO: 5633960 - DNA, 19 bp, Homo sapiens
gttttttctttcccatgta

SEQ ID NO: 5633961 - DNA, 14 bp, Homo sapiens
gttttttgccacag

SEQ ID NO: 5633962 - DNA, 19 bp, Homo sapiens
gttttttggcttgcttatg

SEQ ID NO: 5633963 - DNA, 14 bp, Homo sapiens
gttttttgtaacta

SEQ ID NO: 5633964 - DNA, 18 bp, Homo sapiens
gttttttgtaactacaaa

SEQ ID NO: 5633965 - DNA, 14 bp, Homo sapiens
gttttttgtaagat

SEQ ID NO: 5633966 - DNA, 14 bp, Homo sapiens
gttttttgttactg

SEQ ID NO: 5633967 - DNA, 21 bp, Homo sapiens
gttttttgttcaatgttccat

SEQ ID NO: 5633968 - DNA, 13 bp, Homo sapiens
gttttttgtttct

SEQ ID NO: 5633969 - DNA, 18 bp, Homo sapiens
gttttttgttttcattaa

SEQ ID NO: 5633970 - DNA, 21 bp, Homo sapiens
taaaaccatgcagcttcatca

SEQ ID NO: 5633971 - DNA, 22 bp, Homo sapiens
taaaaccattatttaataagag

SEQ ID NO: 5633972 - DNA, 21 bp, Homo sapiens
taaaacccaaaggtggcagct

SEQ ID NO: 5633973 - DNA, 13 bp, Homo sapiens
taaaacccaagtg

SEQ ID NO: 5633974 - DNA, 19 bp, Homo sapiens
taaaacccatttaaatttt

SEQ ID NO: 5633975 - DNA, 21 bp, Homo sapiens
taaaacccctaggtcatttgt

SEQ ID NO: 5633976 - DNA, 21 bp, Homo sapiens
taaaaccgaaggtgaaaaaaa

SEQ ID NO: 5633977 - DNA, 23 bp, Homo sapiens
taaaacctaaaattaagaagtac

SEQ ID NO: 5633978 - DNA, 22 bp, Homo sapiens
taaaacctaaaggttatagtag

SEQ ID NO: 5633979 - DNA, 18 bp, Homo sapiens
taaaacctagaacttcaa

SEQ ID NO: 5633980 - DNA, 23 bp, Homo sapiens
taaaacctcagggacaacatttt

SEQ ID NO: 5633981 - DNA, 23 bp, Homo sapiens
taaaacctgggtatgttcctaag

SEQ ID NO: 5633982 - DNA, 22 bp, Homo sapiens
taaaaccttccatgtcaagatt

SEQ ID NO: 5633983 - DNA, 15 bp, Homo sapiens
taaaaccttgaaggt

SEQ ID NO: 5633984 - DNA, 14 bp, Homo sapiens
taaaaccttgattt

SEQ ID NO: 5633985 - DNA, 21 bp, Homo sapiens
taaaaccttgttctatttttc

SEQ ID NO: 5633986 - DNA, 14 bp, Homo sapiens
taaaacgataaaaa

SEQ ID NO: 5633987 - DNA, 16 bp, Homo sapiens
taaaacgatctaaagg

SEQ ID NO: 5633988 - DNA, 18 bp, Homo sapiens
taaaacgcagttgcaaac

SEQ ID NO: 5633989 - DNA, 17 bp, Homo sapiens
taaaacgtgtaaatgaa

SEQ ID NO: 5633990 - DNA, 17 bp, Homo sapiens
taaaacgttttctcttc

SEQ ID NO: 5633991 - DNA, 17 bp, Homo sapiens
taaaactaaacatacat

SEQ ID NO: 5633992 - DNA, 21 bp, Homo sapiens
taaaactaaggcttttatttc

SEQ ID NO: 5633993 - DNA, 22 bp, Homo sapiens
taaaactaaggcttttatttct

SEQ ID NO: 5633994 - DNA, 17 bp, Homo sapiens
taaaactagataactta

SEQ ID NO: 5633995 - DNA, 15 bp, Homo sapiens
taaaactagcaactc

SEQ ID NO: 5633996 - DNA, 19 bp, Homo sapiens
taaaactaggcatttgtaa

SEQ ID NO: 5633997 - DNA, 21 bp, Homo sapiens
taaaactagggggtgtatatt

SEQ ID NO: 5633998 - DNA, 21 bp, Homo sapiens
taaaactaggtgctgcagccc

SEQ ID NO: 5633999 - DNA, 21 bp, Homo sapiens
taaaactataacattatataa

SEQ ID NO: 5634000 - DNA, 23 bp, Homo sapiens
taaaactataacattatataaca

SEQ ID NO: 5634001 - DNA, 21 bp, Homo sapiens
taaaactatggttcccaataa

SEQ ID NO: 5634002 - DNA, 21 bp, Homo sapiens
taaaactatttaaaattggca

SEQ ID NO: 5634003 - DNA, 21 bp, Homo sapiens
taaaactcactcactgtttat

SEQ ID NO: 5634004 - DNA, 23 bp, Homo sapiens
taaaactcactgaatctaaccat

SEQ ID NO: 5634005 - DNA, 17 bp, Homo sapiens
taaaactcagatttaaa

SEQ ID NO: 5634006 - DNA, 19 bp, Homo sapiens
taaaactcatcacataaag

SEQ ID NO: 5634007 - DNA, 16 bp, Homo sapiens
taaaactcatttagga

SEQ ID NO: 5634008 - DNA, 21 bp, Homo sapiens
taaaactctcattatttgtgt

SEQ ID NO: 5634009 - DNA, 13 bp, Homo sapiens
taaaactctcctt

SEQ ID NO: 5634010 - DNA, 15 bp, Homo sapiens
taaaactctgggtct

SEQ ID NO: 5634011 - DNA, 14 bp, Homo sapiens
taaaactcttttaa

SEQ ID NO: 5634012 - DNA, 15 bp, Homo sapiens
taaaactgaaataaa

SEQ ID NO: 5634013 - DNA, 17 bp, Homo sapiens
taaaactgaaataaacc

SEQ ID NO: 5634014 - DNA, 22 bp, Homo sapiens
taaaactgaaggcctcacttaa

SEQ ID NO: 5634015 - DNA, 18 bp, Homo sapiens
taaaactgaagtctgaaa

SEQ ID NO: 5634016 - DNA, 19 bp, Homo sapiens
taaaactgaagtctgaaat

SEQ ID NO: 5634017 - DNA, 16 bp, Homo sapiens
taaaactgatgtgaaa

SEQ ID NO: 5634018 - DNA, 20 bp, Homo sapiens
taaaactgcgaggacatcaa

SEQ ID NO: 5634019 - DNA, 21 bp, Homo sapiens
taaaactgcgaggacatcaaa

SEQ ID NO: 5634020 - DNA, 13 bp, Homo sapiens
taaaactgctttt

SEQ ID NO: 5634021 - DNA, 16 bp, Homo sapiens
taaaactggcatctga

SEQ ID NO: 5634022 - DNA, 17 bp, Homo sapiens
taaaactggctttggct

SEQ ID NO: 5634023 - DNA, 19 bp, Homo sapiens
taaaactgggtcatcattt

SEQ ID NO: 5634024 - DNA, 20 bp, Homo sapiens
taaaactgggtcatcatttg

SEQ ID NO: 5634025 - DNA, 13 bp, Homo sapiens
taaaactgtacct

SEQ ID NO: 5634026 - DNA, 14 bp, Homo sapiens
taaaactgtacctt

SEQ ID NO: 5634027 - DNA, 13 bp, Homo sapiens
taaaactgtactt

SEQ ID NO: 5634028 - DNA, 15 bp, Homo sapiens
taaaactgtactttg

SEQ ID NO: 5634029 - DNA, 19 bp, Homo sapiens
taaaactgtactttgattc

SEQ ID NO: 5634030 - DNA, 22 bp, Homo sapiens
taaaactgtgacattccacaga

SEQ ID NO: 5634031 - DNA, 12 bp, Homo sapiens
taaaactgtgta

SEQ ID NO: 5634032 - DNA, 15 bp, Homo sapiens
taaaacttaaaaaca

SEQ ID NO: 5634033 - DNA, 14 bp, Homo sapiens
taaaacttaaaact

SEQ ID NO: 5634034 - DNA, 20 bp, Homo sapiens
taaaacttacctaagtgaca

SEQ ID NO: 5634035 - DNA, 18 bp, Homo sapiens
taaaacttataaatttca

SEQ ID NO: 5634036 - DNA, 22 bp, Homo sapiens
taaaacttcagtttcacagaaa

SEQ ID NO: 5634037 - DNA, 13 bp, Homo sapiens
taaaacttcttaa

SEQ ID NO: 5634038 - DNA, 19 bp, Homo sapiens
taaaacttcttaaatatct

SEQ ID NO: 5634039 - DNA, 20 bp, Homo sapiens
taaaacttgatgtgttatct

SEQ ID NO: 5634040 - DNA, 18 bp, Homo sapiens
taaaacttggatggactt

SEQ ID NO: 5634041 - DNA, 19 bp, Homo sapiens
taaaactttaaaaggcaac

SEQ ID NO: 5634042 - DNA, 15 bp, Homo sapiens
taaaactttaagaaa

SEQ ID NO: 5634043 - DNA, 17 bp, Homo sapiens
taaaactttatgtactg

SEQ ID NO: 5634044 - DNA, 13 bp, Homo sapiens
taaaactttattt

SEQ ID NO: 5634045 - DNA, 17 bp, Homo sapiens
taaaactttcctcgcct

SEQ ID NO: 5634046 - DNA, 15 bp, Homo sapiens
taaaactttgctgcc

SEQ ID NO: 5634047 - DNA, 14 bp, Homo sapiens
taaaactttgtaga

SEQ ID NO: 5634048 - DNA, 12 bp, Homo sapiens
taaaacttttta

SEQ ID NO: 5634049 - DNA, 15 bp, Homo sapiens
taaaactttttaaaa

SEQ ID NO: 5634050 - DNA, 14 bp, Homo sapiens
taaaagaaaataaa

SEQ ID NO: 5634051 - DNA, 16 bp, Homo sapiens
taaaagaaaccctgca

SEQ ID NO: 5634052 - DNA, 15 bp, Homo sapiens
taaaagaaactatga

SEQ ID NO: 5634053 - DNA, 19 bp, Homo sapiens
taaaagaaagaaagaaaaa

SEQ ID NO: 5634054 - DNA, 22 bp, Homo sapiens
taaaagaaagcctcagagaatt

SEQ ID NO: 5634055 - DNA, 23 bp, Homo sapiens
taaaagaaagttaggttataaga

SEQ ID NO: 5634056 - DNA, 14 bp, Homo sapiens
taaaagaaataaac

SEQ ID NO: 5634057 - DNA, 19 bp, Homo sapiens
taaaagaaatatacagttt

SEQ ID NO: 5634058 - DNA, 15 bp, Homo sapiens
taaaagaaatctcta

SEQ ID NO: 5634059 - DNA, 22 bp, Homo sapiens
taaaagaaatctctagctcaga

SEQ ID NO: 5634060 - DNA, 14 bp, Homo sapiens
taaaagaaatcttg

SEQ ID NO: 5634061 - DNA, 19 bp, Homo sapiens
taaaagaaatcttgcttca

SEQ ID NO: 5634062 - DNA, 21 bp, Homo sapiens
taaaagaaatgcacaatgtct

SEQ ID NO: 5634063 - DNA, 23 bp, Homo sapiens
taaaagaaatgcacaatgtcttg

SEQ ID NO: 5634064 - DNA, 22 bp, Homo sapiens
taaaagaagaaatagttctgtg

SEQ ID NO: 5634065 - DNA, 18 bp, Homo sapiens
taaaagaagagaggggaa

SEQ ID NO: 5634066 - DNA, 13 bp, Homo sapiens
taaaagaagcttt

SEQ ID NO: 5634067 - DNA, 23 bp, Homo sapiens
taaaagaatattttaacttcctt

SEQ ID NO: 5634068 - DNA, 18 bp, Homo sapiens
taaaagaatctgatactt

SEQ ID NO: 5634069 - DNA, 12 bp, Homo sapiens
taaaagaatgat

SEQ ID NO: 5634070 - DNA, 12 bp, Homo sapiens
taaaagaattgt

SEQ ID NO: 5634071 - DNA, 14 bp, Homo sapiens
taaaagaatttaaa

SEQ ID NO: 5634072 - DNA, 18 bp, Homo sapiens
taaaagaattttaccatt

SEQ ID NO: 5634073 - DNA, 11 bp, Homo sapiens
taaaagacaaa

SEQ ID NO: 5634074 - DNA, 14 bp, Homo sapiens
taaaagacaaacac

SEQ ID NO: 5634075 - DNA, 19 bp, Homo sapiens
taaaagacaagcactttgg

SEQ ID NO: 5634076 - DNA, 21 bp, Homo sapiens
taaaagacagtgtatgtagaa

SEQ ID NO: 5634077 - DNA, 12 bp, Homo sapiens
taaaagactcat

SEQ ID NO: 5634078 - DNA, 16 bp, Homo sapiens
taaaagactcatccgt

SEQ ID NO: 5634079 - DNA, 13 bp, Homo sapiens
taaaagactttga

SEQ ID NO: 5634080 - DNA, 22 bp, Homo sapiens
taaaagagccaagttcaaagaa

SEQ ID NO: 5634081 - DNA, 12 bp, Homo sapiens
taaaagagcttt

SEQ ID NO: 5634082 - DNA, 21 bp, Homo sapiens
taaaagaggaaattaaataat

SEQ ID NO: 5634083 - DNA, 18 bp, Homo sapiens
taaaagaggtttttctta

SEQ ID NO: 5634084 - DNA, 21 bp, Homo sapiens
taaaagaggtttttcttaaat

SEQ ID NO: 5634085 - DNA, 22 bp, Homo sapiens
taaaagataaatttgttgaata

SEQ ID NO: 5634086 - DNA, 17 bp, Homo sapiens
taaaagataagtgcagt

SEQ ID NO: 5634087 - DNA, 17 bp, Homo sapiens
taaaagataagtttgtt

SEQ ID NO: 5634088 - DNA, 17 bp, Homo sapiens
taaaagatacagttact

SEQ ID NO: 5634089 - DNA, 16 bp, Homo sapiens
taaaagatataagtgc

SEQ ID NO: 5634090 - DNA, 18 bp, Homo sapiens
taaaagatataagtgctg

SEQ ID NO: 5634091 - DNA, 13 bp, Homo sapiens
taaaagatatata

SEQ ID NO: 5634092 - DNA, 13 bp, Homo sapiens
taaaagatatgtt

SEQ ID NO: 5634093 - DNA, 16 bp, Homo sapiens
taaaagatcttgcaga

SEQ ID NO: 5634094 - DNA, 14 bp, Homo sapiens
taaaagatgaaaat

SEQ ID NO: 5634095 - DNA, 13 bp, Homo sapiens
taaaagatgaaag

SEQ ID NO: 5634096 - DNA, 13 bp, Homo sapiens
taaaagatgcaga

SEQ ID NO: 5634097 - DNA, 18 bp, Homo sapiens
taaaagatggggtctgta

SEQ ID NO: 5634098 - DNA, 23 bp, Homo sapiens
taaaagatggtgaactgtgagta

SEQ ID NO: 5634099 - DNA, 20 bp, Homo sapiens
taaaagatgtctctgcaaac

SEQ ID NO: 5634100 - DNA, 12 bp, Homo sapiens
taaaagattcat

SEQ ID NO: 5634101 - DNA, 20 bp, Homo sapiens
taaaagattcatttttaatc

SEQ ID NO: 5634102 - DNA, 15 bp, Homo sapiens
taaaagattctttaa

SEQ ID NO: 5634103 - DNA, 23 bp, Homo sapiens
taaaagattctttaaactactga

SEQ ID NO: 5634104 - DNA, 14 bp, Homo sapiens
taaaagattttatg

SEQ ID NO: 5634105 - DNA, 17 bp, Homo sapiens
taaaagattttgtgaaa

SEQ ID NO: 5634106 - DNA, 17 bp, Homo sapiens
taaaagcaaaaaagaaa

SEQ ID NO: 5634107 - DNA, 22 bp, Homo sapiens
taaaagcaaaaaagaaaacctt

SEQ ID NO: 5634108 - DNA, 18 bp, Homo sapiens
taaaagcaaaaagatgta

SEQ ID NO: 5634109 - DNA, 15 bp, Homo sapiens
taaaagcaaaagaga

SEQ ID NO: 5634110 - DNA, 15 bp, Homo sapiens
taaaagcaaatcatt

SEQ ID NO: 5634111 - DNA, 18 bp, Homo sapiens
taaaagcaaatctacaga

SEQ ID NO: 5634112 - DNA, 20 bp, Homo sapiens
taaaagcaacatcagcttga

SEQ ID NO: 5634113 - DNA, 19 bp, Homo sapiens
taaaagcaattatattgtc

SEQ ID NO: 5634114 - DNA, 16 bp, Homo sapiens
taaaagcaattctgac

SEQ ID NO: 5634115 - DNA, 11 bp, Homo sapiens
taaaagcacac

SEQ ID NO: 5634116 - DNA, 18 bp, Homo sapiens
taaaagcaccactgttct

SEQ ID NO: 5634117 - DNA, 22 bp, Homo sapiens
taaaagcagaaaataaaggaag

SEQ ID NO: 5634118 - DNA, 21 bp, Homo sapiens
taaaagcagcataaagaattt

SEQ ID NO: 5634119 - DNA, 21 bp, Homo sapiens
taaaagcaggcttctatgaaa

SEQ ID NO: 5634120 - DNA, 15 bp, Homo sapiens
taaaagcataaatgc

SEQ ID NO: 5634121 - DNA, 17 bp, Homo sapiens
taaaagcataaatgcaa

SEQ ID NO: 5634122 - DNA, 20 bp, Homo sapiens
taaaagcatactctatgtga

SEQ ID NO: 5634123 - DNA, 22 bp, Homo sapiens
taaaagcatactctatgtgatt

SEQ ID NO: 5634124 - DNA, 16 bp, Homo sapiens
taaaagcatatataaa

SEQ ID NO: 5634125 - DNA, 20 bp, Homo sapiens
taaaagcatatataaaacaa

SEQ ID NO: 5634126 - DNA, 20 bp, Homo sapiens
taaaagcatgaattggaact

SEQ ID NO: 5634127 - DNA, 16 bp, Homo sapiens
taaaagcatgtatagt

SEQ ID NO: 5634128 - DNA, 14 bp, Homo sapiens
taaaagcattgtct

SEQ ID NO: 5634129 - DNA, 15 bp, Homo sapiens
taaaagccacataga

SEQ ID NO: 5634130 - DNA, 20 bp, Homo sapiens
taaaagccactgttacattt

SEQ ID NO: 5634131 - DNA, 16 bp, Homo sapiens
taaaagccagatgcta

SEQ ID NO: 5634132 - DNA, 18 bp, Homo sapiens
taaaagccataatccagt

SEQ ID NO: 5634133 - DNA, 17 bp, Homo sapiens
taaaagcccaggagccc

SEQ ID NO: 5634134 - DNA, 16 bp, Homo sapiens
taaaagccttattcta

SEQ ID NO: 5634135 - DNA, 14 bp, Homo sapiens
taaaagccttccag

SEQ ID NO: 5634136 - DNA, 18 bp, Homo sapiens
taaaagctagatactgga

SEQ ID NO: 5634137 - DNA, 14 bp, Homo sapiens
taaaagctataaag

SEQ ID NO: 5634138 - DNA, 19 bp, Homo sapiens
taaaagctataaagtatat

SEQ ID NO: 5634139 - DNA, 22 bp, Homo sapiens
taaaagctatcttcatgtaaat

SEQ ID NO: 5634140 - DNA, 12 bp, Homo sapiens
taaaagctatga

SEQ ID NO: 5634141 - DNA, 22 bp, Homo sapiens
taaaagctcagatgacatttcg

SEQ ID NO: 5634142 - DNA, 21 bp, Homo sapiens
taaaagctctagataaaactt

SEQ ID NO: 5634143 - DNA, 14 bp, Homo sapiens
taaaagctgtggaa

SEQ ID NO: 5634144 - DNA, 15 bp, Homo sapiens
taaaagctttagatt

SEQ ID NO: 5634145 - DNA, 20 bp, Homo sapiens
taaaagctttagattgaaat

SEQ ID NO: 5634146 - DNA, 11 bp, Homo sapiens
taaaaggaaaa

SEQ ID NO: 5634147 - DNA, 20 bp, Homo sapiens
taaaatgctaggttctacct

SEQ ID NO: 5634148 - DNA, 22 bp, Homo sapiens
taaaatgctcctagaagtctta

SEQ ID NO: 5634149 - DNA, 18 bp, Homo sapiens
taaaatgctgttctcaat

SEQ ID NO: 5634150 - DNA, 19 bp, Homo sapiens
taaaatgctgttctcaatc

SEQ ID NO: 5634151 - DNA, 23 bp, Homo sapiens
taaaatgcttacatttgaacttg

SEQ ID NO: 5634152 - DNA, 13 bp, Homo sapiens
taaaatgctttaa

SEQ ID NO: 5634153 - DNA, 16 bp, Homo sapiens
taaaatgctttaaaaa

SEQ ID NO: 5634154 - DNA, 12 bp, Homo sapiens
taaaatggaaaa

SEQ ID NO: 5634155 - DNA, 13 bp, Homo sapiens
taaaatggaaaat

SEQ ID NO: 5634156 - DNA, 15 bp, Homo sapiens
taaaatggaagcaat

SEQ ID NO: 5634157 - DNA, 14 bp, Homo sapiens
taaaatggaataac

SEQ ID NO: 5634158 - DNA, 16 bp, Homo sapiens
taaaatggaataacat

SEQ ID NO: 5634159 - DNA, 13 bp, Homo sapiens
taaaatggaattg

SEQ ID NO: 5634160 - DNA, 23 bp, Homo sapiens
taaaatggaattgaaaaactctt

SEQ ID NO: 5634161 - DNA, 23 bp, Homo sapiens
taaaatggacacaaattttcaag

SEQ ID NO: 5634162 - DNA, 21 bp, Homo sapiens
taaaatggacctatctgtaag

SEQ ID NO: 5634163 - DNA, 23 bp, Homo sapiens
taaaatggacctatctgtaagag

SEQ ID NO: 5634164 - DNA, 18 bp, Homo sapiens
taaaatggatgccttgaa

SEQ ID NO: 5634165 - DNA, 15 bp, Homo sapiens
taaaatggatttaat

SEQ ID NO: 5634166 - DNA, 18 bp, Homo sapiens
taaaatggcaacaaactg

SEQ ID NO: 5634167 - DNA, 20 bp, Homo sapiens
taaaatggcaacaaactgca

SEQ ID NO: 5634168 - DNA, 19 bp, Homo sapiens
taaaatggcaagttttcca

SEQ ID NO: 5634169 - DNA, 18 bp, Homo sapiens
taaaatggcatttagcac

SEQ ID NO: 5634170 - DNA, 17 bp, Homo sapiens
taaaatggcgaacatgt

SEQ ID NO: 5634171 - DNA, 17 bp, Homo sapiens
taaaatgggttttactg

SEQ ID NO: 5634172 - DNA, 16 bp, Homo sapiens
taaaatggtgttttca

SEQ ID NO: 5634173 - DNA, 22 bp, Homo sapiens
taaaatggttcatattttatag

SEQ ID NO: 5634174 - DNA, 14 bp, Homo sapiens
taaaatgtaaaaac

SEQ ID NO: 5634175 - DNA, 17 bp, Homo sapiens
taaaatgtaacactgat

SEQ ID NO: 5634176 - DNA, 17 bp, Homo sapiens
taaaatgtaatttaaat

SEQ ID NO: 5634177 - DNA, 20 bp, Homo sapiens
taaaatgtaatttaaatgaa

SEQ ID NO: 5634178 - DNA, 14 bp, Homo sapiens
taaaatgtacatgt

SEQ ID NO: 5634179 - DNA, 15 bp, Homo sapiens
taaaatgtacatgta

SEQ ID NO: 5634180 - DNA, 18 bp, Homo sapiens
taaaatgtacatgtatta

SEQ ID NO: 5634181 - DNA, 16 bp, Homo sapiens
taaaatgtagaaattc

SEQ ID NO: 5634182 - DNA, 16 bp, Homo sapiens
taaaatgtagaagaaa

SEQ ID NO: 5634183 - DNA, 15 bp, Homo sapiens
taaaatgtagtttta

SEQ ID NO: 5634184 - DNA, 20 bp, Homo sapiens
taaaatgtagttttaaataa

SEQ ID NO: 5634185 - DNA, 14 bp, Homo sapiens
taaaatgtataaat

SEQ ID NO: 5634186 - DNA, 15 bp, Homo sapiens
taaaatgtataaatt

SEQ ID NO: 5634187 - DNA, 16 bp, Homo sapiens
taaaatgtataagttg

SEQ ID NO: 5634188 - DNA, 22 bp, Homo sapiens
taaaatgtatctaagaataata

SEQ ID NO: 5634189 - DNA, 16 bp, Homo sapiens
taaaatgtatcttcca

SEQ ID NO: 5634190 - DNA, 16 bp, Homo sapiens
taaaatgtatgcatgt

SEQ ID NO: 5634191 - DNA, 14 bp, Homo sapiens
taaaatgtattttt

SEQ ID NO: 5634192 - DNA, 19 bp, Homo sapiens
taaaatgtccagtaagatc

SEQ ID NO: 5634193 - DNA, 15 bp, Homo sapiens
taaaatgtctttcca

SEQ ID NO: 5634194 - DNA, 22 bp, Homo sapiens
taaaatgtctttccaaattatt

SEQ ID NO: 5634195 - DNA, 11 bp, Homo sapiens
taaaatgtgaa

SEQ ID NO: 5634196 - DNA, 14 bp, Homo sapiens
taaaatgtgaaaaa

SEQ ID NO: 5634197 - DNA, 19 bp, Homo sapiens
taaaatgtgaaaaactaat

SEQ ID NO: 5634198 - DNA, 13 bp, Homo sapiens
taaaatgtgaagt

SEQ ID NO: 5634199 - DNA, 17 bp, Homo sapiens
taaaatgtgatgttcta

SEQ ID NO: 5634200 - DNA, 19 bp, Homo sapiens
taaaatgtgatgttctaag

SEQ ID NO: 5634201 - DNA, 21 bp, Homo sapiens
taaaatgtgatgttctaaggc

SEQ ID NO: 5634202 - DNA, 18 bp, Homo sapiens
taaaatgtgatttttctt

SEQ ID NO: 5634203 - DNA, 20 bp, Homo sapiens
taaaatgtgggattatgggt

SEQ ID NO: 5634204 - DNA, 14 bp, Homo sapiens
taaaatgtgtacag

SEQ ID NO: 5634205 - DNA, 17 bp, Homo sapiens
taaaatgtgtatttttc

SEQ ID NO: 5634206 - DNA, 21 bp, Homo sapiens
taaaatgtgtatttttcaagg

SEQ ID NO: 5634207 - DNA, 17 bp, Homo sapiens
taaaatgtgtgccatat

SEQ ID NO: 5634208 - DNA, 18 bp, Homo sapiens
taaaatgtgttgaaactg

SEQ ID NO: 5634209 - DNA, 12 bp, Homo sapiens
taaaatgttctc

SEQ ID NO: 5634210 - DNA, 14 bp, Homo sapiens
taaaatgttctcct

SEQ ID NO: 5634211 - DNA, 23 bp, Homo sapiens
taaaatgttctccttagatgtga

SEQ ID NO: 5634212 - DNA, 14 bp, Homo sapiens
taaaatgttgaaaa

SEQ ID NO: 5634213 - DNA, 19 bp, Homo sapiens
taaaatgttgaaaagtcaa

SEQ ID NO: 5634214 - DNA, 20 bp, Homo sapiens
taaaatgttgaaaagtcaaa

SEQ ID NO: 5634215 - DNA, 19 bp, Homo sapiens
taaaatgtttaatggtgaa

SEQ ID NO: 5634216 - DNA, 18 bp, Homo sapiens
taaaatgtttacattttc

SEQ ID NO: 5634217 - DNA, 14 bp, Homo sapiens
taaaatgtttactg

SEQ ID NO: 5634218 - DNA, 17 bp, Homo sapiens
taaaatgtttactgtaa

SEQ ID NO: 5634219 - DNA, 18 bp, Homo sapiens
taaaatgtttactgtaaa

SEQ ID NO: 5634220 - DNA, 20 bp, Homo sapiens
taaaatgtttactgtaaatt

SEQ ID NO: 5634221 - DNA, 21 bp, Homo sapiens
taaaatgtttactgtaaattt

SEQ ID NO: 5634222 - DNA, 13 bp, Homo sapiens
taaaatgtttatt

SEQ ID NO: 5634223 - DNA, 22 bp, Homo sapiens
taaaatgtttattccttctgta

SEQ ID NO: 5634224 - DNA, 17 bp, Homo sapiens
taaaatgtttcattatg

SEQ ID NO: 5634225 - DNA, 23 bp, Homo sapiens
taaaatgtttcattatgcacttt

SEQ ID NO: 5634226 - DNA, 16 bp, Homo sapiens
taaaatgttttcagct

SEQ ID NO: 5634227 - DNA, 23 bp, Homo sapiens
taaaatgttttcagctaggaaca

SEQ ID NO: 5634228 - DNA, 16 bp, Homo sapiens
taaaatgttttcattt

SEQ ID NO: 5634229 - DNA, 21 bp, Homo sapiens
taaaatgttttcattttactg

SEQ ID NO: 5634230 - DNA, 15 bp, Homo sapiens
taaaattaaaattta

SEQ ID NO: 5634231 - DNA, 16 bp, Homo sapiens
taaaattaaaatttaa

SEQ ID NO: 5634232 - DNA, 18 bp, Homo sapiens
taaaattaaaatttaaca

SEQ ID NO: 5634233 - DNA, 19 bp, Homo sapiens
taaaattaaaatttaacat

SEQ ID NO: 5634234 - DNA, 19 bp, Homo sapiens
taaaattaaagctgaaaac

SEQ ID NO: 5634235 - DNA, 14 bp, Homo sapiens
taaaattaaataaa

SEQ ID NO: 5634236 - DNA, 15 bp, Homo sapiens
taaaattaaataaat

SEQ ID NO: 5634237 - DNA, 18 bp, Homo sapiens
taaaattaagaatgttct

SEQ ID NO: 5634238 - DNA, 15 bp, Homo sapiens
taaaattaagtagaa

SEQ ID NO: 5634239 - DNA, 11 bp, Homo sapiens
taaaattaatg

SEQ ID NO: 5634240 - DNA, 18 bp, Homo sapiens
taaaattaatgtaataaa

SEQ ID NO: 5634241 - DNA, 16 bp, Homo sapiens
taaaattacaaaagag

SEQ ID NO: 5634242 - DNA, 17 bp, Homo sapiens
taaaattacaaaagaga

SEQ ID NO: 5634243 - DNA, 15 bp, Homo sapiens
taaaattacaactaa

SEQ ID NO: 5634244 - DNA, 19 bp, Homo sapiens
taaaattacaactaagtga

SEQ ID NO: 5634245 - DNA, 16 bp, Homo sapiens
taaaattacactttga

SEQ ID NO: 5634246 - DNA, 13 bp, Homo sapiens
taaaattacagaa

SEQ ID NO: 5634247 - DNA, 14 bp, Homo sapiens
taaaattacagaag

SEQ ID NO: 5634248 - DNA, 18 bp, Homo sapiens
taaaattacagatgtgaa

SEQ ID NO: 5634249 - DNA, 19 bp, Homo sapiens
taaaattacagatgtgaaa

SEQ ID NO: 5634250 - DNA, 20 bp, Homo sapiens
taaaattacagatgtgaaaa

SEQ ID NO: 5634251 - DNA, 16 bp, Homo sapiens
taaaattacgtttgtt

SEQ ID NO: 5634252 - DNA, 12 bp, Homo sapiens
taaaattactat

SEQ ID NO: 5634253 - DNA, 15 bp, Homo sapiens
taaaattactattct

SEQ ID NO: 5634254 - DNA, 18 bp, Homo sapiens
taaaattacttggctttt

SEQ ID NO: 5634255 - DNA, 14 bp, Homo sapiens
taaaattagaaaaa

SEQ ID NO: 5634256 - DNA, 11 bp, Homo sapiens
taaaattagat

SEQ ID NO: 5634257 - DNA, 16 bp, Homo sapiens
taaaattagatgcatg

SEQ ID NO: 5634258 - DNA, 18 bp, Homo sapiens
taaaattaggactgtata

SEQ ID NO: 5634259 - DNA, 17 bp, Homo sapiens
taaaattaggttaaacg

SEQ ID NO: 5634260 - DNA, 21 bp, Homo sapiens
taaaattagtcttttgtaata

SEQ ID NO: 5634261 - DNA, 16 bp, Homo sapiens
taaaattagttttaaa

SEQ ID NO: 5634262 - DNA, 21 bp, Homo sapiens
taaaattagttttaaaatact

SEQ ID NO: 5634263 - DNA, 17 bp, Homo sapiens
taaaattataaactttt

SEQ ID NO: 5634264 - DNA, 19 bp, Homo sapiens
taaaattatagatgggaat

SEQ ID NO: 5634265 - DNA, 12 bp, Homo sapiens
taaaattatata

SEQ ID NO: 5634266 - DNA, 19 bp, Homo sapiens
taaaattatatagcaaaga

SEQ ID NO: 5634267 - DNA, 22 bp, Homo sapiens
taaaattatcaatatctaatat

SEQ ID NO: 5634268 - DNA, 20 bp, Homo sapiens
taaaattatcctctttgtaa

SEQ ID NO: 5634269 - DNA, 22 bp, Homo sapiens
taaaattatctgttctatggac

SEQ ID NO: 5634270 - DNA, 17 bp, Homo sapiens
taaaattatgaatctga

SEQ ID NO: 5634271 - DNA, 20 bp, Homo sapiens
taaaattatgaatctgattt

SEQ ID NO: 5634272 - DNA, 15 bp, Homo sapiens
taaaattatgagatt

SEQ ID NO: 5634273 - DNA, 13 bp, Homo sapiens
taaaattatgagt

SEQ ID NO: 5634274 - DNA, 22 bp, Homo sapiens
taaaattattaaaaattataga

SEQ ID NO: 5634275 - DNA, 13 bp, Homo sapiens
taaaattattcaa

SEQ ID NO: 5634276 - DNA, 19 bp, Homo sapiens
taaaattattccctgaatt

SEQ ID NO: 5634277 - DNA, 14 bp, Homo sapiens
taaaattatttgca

SEQ ID NO: 5634278 - DNA, 22 bp, Homo sapiens
taaaattcaaaaacaaaattag

SEQ ID NO: 5634279 - DNA, 15 bp, Homo sapiens
taaaattcaacaaat

SEQ ID NO: 5634280 - DNA, 21 bp, Homo sapiens
taaaattcaaggccacaaaaa

SEQ ID NO: 5634281 - DNA, 21 bp, Homo sapiens
taaaattcagtttttgtatct

SEQ ID NO: 5634282 - DNA, 16 bp, Homo sapiens
taaaattcatggaact

SEQ ID NO: 5634283 - DNA, 12 bp, Homo sapiens
taaaattccact

SEQ ID NO: 5634284 - DNA, 17 bp, Homo sapiens
taaaattcgctttctaa

SEQ ID NO: 5634285 - DNA, 20 bp, Homo sapiens
taaaattcggaatggttttc

SEQ ID NO: 5634286 - DNA, 22 bp, Homo sapiens
taaaattcgttgaaacgatttc

SEQ ID NO: 5634287 - DNA, 12 bp, Homo sapiens
taaaattctagt

SEQ ID NO: 5634288 - DNA, 15 bp, Homo sapiens
taaaattctcttcca

SEQ ID NO: 5634289 - DNA, 17 bp, Homo sapiens
taaaattctgatgtttc

SEQ ID NO: 5634290 - DNA, 18 bp, Homo sapiens
taaaattctgatgtttct

SEQ ID NO: 5634291 - DNA, 22 bp, Homo sapiens
taaaattctgatgtttctgtga

SEQ ID NO: 5634292 - DNA, 13 bp, Homo sapiens
taaaattctgtaa

SEQ ID NO: 5634293 - DNA, 13 bp, Homo sapiens
taaaattgaaagg

SEQ ID NO: 5634294 - DNA, 22 bp, Homo sapiens
taaaattgaatagtttatttct

SEQ ID NO: 5634295 - DNA, 22 bp, Homo sapiens
taaaattgacaacattttatta

SEQ ID NO: 5634296 - DNA, 18 bp, Homo sapiens
taaaattgagtgcactaa

SEQ ID NO: 5634297 - DNA, 12 bp, Homo sapiens
taaaattgatat

SEQ ID NO: 5634298 - DNA, 13 bp, Homo sapiens
taaaattgatttt

SEQ ID NO: 5634299 - DNA, 22 bp, Homo sapiens
taaaattgcagtttcatgtatg

SEQ ID NO: 5634300 - DNA, 23 bp, Homo sapiens
taaaattgcagtttcatgtatgt

SEQ ID NO: 5634301 - DNA, 12 bp, Homo sapiens
taaaattgcatg

SEQ ID NO: 5634302 - DNA, 13 bp, Homo sapiens
taaaattgcatgg

SEQ ID NO: 5634303 - DNA, 12 bp, Homo sapiens
taaaattgccat

SEQ ID NO: 5634304 - DNA, 15 bp, Homo sapiens
taaaattgccatatt

SEQ ID NO: 5634305 - DNA, 22 bp, Homo sapiens
taaaattgctagtgatttcatt

SEQ ID NO: 5634306 - DNA, 14 bp, Homo sapiens
taaaattggcacca

SEQ ID NO: 5634307 - DNA, 17 bp, Homo sapiens
taaaattggtaattgaa

SEQ ID NO: 5634308 - DNA, 19 bp, Homo sapiens
taaaattgtacatgaacat

SEQ ID NO: 5634309 - DNA, 15 bp, Homo sapiens
taaaattgtgatgtg

SEQ ID NO: 5634310 - DNA, 17 bp, Homo sapiens
taaaattgtgatgtttt

SEQ ID NO: 5634311 - DNA, 18 bp, Homo sapiens
taaaattgtgatgttttg

SEQ ID NO: 5634312 - DNA, 16 bp, Homo sapiens
taaaattgttagtaaa

SEQ ID NO: 5634313 - DNA, 15 bp, Homo sapiens
taaaattgttatcaa

SEQ ID NO: 5634314 - DNA, 15 bp, Homo sapiens
taaaattgttctact

SEQ ID NO: 5634315 - DNA, 16 bp, Homo sapiens
taaaatttaaaaactt

SEQ ID NO: 5634316 - DNA, 15 bp, Homo sapiens
taaaatttaaaatta

SEQ ID NO: 5634317 - DNA, 14 bp, Homo sapiens
taaaatttaaatca

SEQ ID NO: 5634318 - DNA, 23 bp, Homo sapiens
taaaatttaaatcagactagaga

SEQ ID NO: 5634319 - DNA, 21 bp, Homo sapiens
taaaatttaacttcttcataa

SEQ ID NO: 5634320 - DNA, 22 bp, Homo sapiens
taaaatttacatttaatacaga

SEQ ID NO: 5634321 - DNA, 17 bp, Homo sapiens
taaaatttatattgtaa

SEQ ID NO: 5634322 - DNA, 17 bp, Homo sapiens
taaaatttatcttaagt

SEQ ID NO: 5634323 - DNA, 23 bp, Homo sapiens
taaaatttattctacttttaaat

SEQ ID NO: 5634324 - DNA, 15 bp, Homo sapiens
taaaatttcataatt

SEQ ID NO: 5634325 - DNA, 17 bp, Homo sapiens
taaactccatgatattt

SEQ ID NO: 5634326 - DNA, 23 bp, Homo sapiens
taaactcctactgcttcctctga

SEQ ID NO: 5634327 - DNA, 16 bp, Homo sapiens
taaactccttcctggc

SEQ ID NO: 5634328 - DNA, 12 bp, Homo sapiens
taaactctcccc

SEQ ID NO: 5634329 - DNA, 20 bp, Homo sapiens
taaactctcgagacttctct

SEQ ID NO: 5634330 - DNA, 13 bp, Homo sapiens
taaactctctagc

SEQ ID NO: 5634331 - DNA, 15 bp, Homo sapiens
taaactctcttctct

SEQ ID NO: 5634332 - DNA, 16 bp, Homo sapiens
taaactctcttctctt

SEQ ID NO: 5634333 - DNA, 21 bp, Homo sapiens
taaactctctttgggaatgtt

SEQ ID NO: 5634334 - DNA, 14 bp, Homo sapiens
taaactctgaaatc

SEQ ID NO: 5634335 - DNA, 22 bp, Homo sapiens
taaactctgaataagcactttt

SEQ ID NO: 5634336 - DNA, 17 bp, Homo sapiens
taaactctgaatttatc

SEQ ID NO: 5634337 - DNA, 21 bp, Homo sapiens
taaactctgaatttatctttg

SEQ ID NO: 5634338 - DNA, 18 bp, Homo sapiens
taaactctgcatccagag

SEQ ID NO: 5634339 - DNA, 22 bp, Homo sapiens
taaactctggacactctatatg

SEQ ID NO: 5634340 - DNA, 12 bp, Homo sapiens
taaactctgggg

SEQ ID NO: 5634341 - DNA, 14 bp, Homo sapiens
taaactctggggct

SEQ ID NO: 5634342 - DNA, 15 bp, Homo sapiens
taaactcttcaaggc

SEQ ID NO: 5634343 - DNA, 18 bp, Homo sapiens
taaactcttcaaggccaa

SEQ ID NO: 5634344 - DNA, 12 bp, Homo sapiens
taaactcttcac

SEQ ID NO: 5634345 - DNA, 16 bp, Homo sapiens
taaactgaaaaatgtc

SEQ ID NO: 5634346 - DNA, 11 bp, Homo sapiens
taaactgaagc

SEQ ID NO: 5634347 - DNA, 20 bp, Homo sapiens
taaactgaatattttggaaa

SEQ ID NO: 5634348 - DNA, 22 bp, Homo sapiens
taaactgaatattttggaaact

SEQ ID NO: 5634349 - DNA, 20 bp, Homo sapiens
taaactgactttttcccccc

SEQ ID NO: 5634350 - DNA, 19 bp, Homo sapiens
taaactgagagtaattcat

SEQ ID NO: 5634351 - DNA, 17 bp, Homo sapiens
taaactgagcctctttt

SEQ ID NO: 5634352 - DNA, 20 bp, Homo sapiens
taaactgagcctcttttcaa

SEQ ID NO: 5634353 - DNA, 16 bp, Homo sapiens
taaactgcaaacagaa

SEQ ID NO: 5634354 - DNA, 17 bp, Homo sapiens
taaactgcaaacagaaa

SEQ ID NO: 5634355 - DNA, 12 bp, Homo sapiens
taaactgcaaat

SEQ ID NO: 5634356 - DNA, 12 bp, Homo sapiens
taaactgcaagt

SEQ ID NO: 5634357 - DNA, 10 bp, Homo sapiens
taaactgcag

SEQ ID NO: 5634358 - DNA, 20 bp, Homo sapiens
taaactgcagcctctctggc

SEQ ID NO: 5634359 - DNA, 19 bp, Homo sapiens
taaactgcaggagcagttt

SEQ ID NO: 5634360 - DNA, 16 bp, Homo sapiens
taaactgcagttttaa

SEQ ID NO: 5634361 - DNA, 10 bp, Homo sapiens
taaactgcat

SEQ ID NO: 5634362 - DNA, 16 bp, Homo sapiens
taaactgcattagaaa

SEQ ID NO: 5634363 - DNA, 15 bp, Homo sapiens
taaactgccctgtct

SEQ ID NO: 5634364 - DNA, 19 bp, Homo sapiens
taaactgcggtcagatgtg

SEQ ID NO: 5634365 - DNA, 17 bp, Homo sapiens
taaactgctattacttt

SEQ ID NO: 5634366 - DNA, 11 bp, Homo sapiens
taaactgctgt

SEQ ID NO: 5634367 - DNA, 12 bp, Homo sapiens
taaactggctta

SEQ ID NO: 5634368 - DNA, 16 bp, Homo sapiens
taaactggcttaactt

SEQ ID NO: 5634369 - DNA, 18 bp, Homo sapiens
taaactggcttaacttag

SEQ ID NO: 5634370 - DNA, 23 bp, Homo sapiens
taaactggggagttataaaaata

SEQ ID NO: 5634371 - DNA, 20 bp, Homo sapiens
taaactggtattttatcttt

SEQ ID NO: 5634372 - DNA, 11 bp, Homo sapiens
taaactgtaaa

SEQ ID NO: 5634373 - DNA, 12 bp, Homo sapiens
taaactgtaaac

SEQ ID NO: 5634374 - DNA, 13 bp, Homo sapiens
taaactgtaaact

SEQ ID NO: 5634375 - DNA, 14 bp, Homo sapiens
taaactgtaaacta

SEQ ID NO: 5634376 - DNA, 18 bp, Homo sapiens
taaactgtacaaatgaaa

SEQ ID NO: 5634377 - DNA, 13 bp, Homo sapiens
taaactgtacagt

SEQ ID NO: 5634378 - DNA, 15 bp, Homo sapiens
taaactgtacagtgt

SEQ ID NO: 5634379 - DNA, 18 bp, Homo sapiens
taaactgtacagtgtctt

SEQ ID NO: 5634380 - DNA, 19 bp, Homo sapiens
taaactgtactagtctgtg

SEQ ID NO: 5634381 - DNA, 18 bp, Homo sapiens
taaactgtatgtcttata

SEQ ID NO: 5634382 - DNA, 17 bp, Homo sapiens
taaactgtcctctttca

SEQ ID NO: 5634383 - DNA, 23 bp, Homo sapiens
taaactgtcctctttcagaaaac

SEQ ID NO: 5634384 - DNA, 10 bp, Homo sapiens
taaactgtga

SEQ ID NO: 5634385 - DNA, 12 bp, Homo sapiens
taaactgtgaaa

SEQ ID NO: 5634386 - DNA, 12 bp, Homo sapiens
taaactgtgaga

SEQ ID NO: 5634387 - DNA, 19 bp, Homo sapiens
taaactgtgagataaatat

SEQ ID NO: 5634388 - DNA, 14 bp, Homo sapiens
taaactgtgcacca

SEQ ID NO: 5634389 - DNA, 22 bp, Homo sapiens
taaactgtgtattccaagacat

SEQ ID NO: 5634390 - DNA, 22 bp, Homo sapiens
taaactgtgtggactgtgatgc

SEQ ID NO: 5634391 - DNA, 12 bp, Homo sapiens
taaactgtgttt

SEQ ID NO: 5634392 - DNA, 18 bp, Homo sapiens
taaactgttaaacaactc

SEQ ID NO: 5634393 - DNA, 14 bp, Homo sapiens
taaactgttaactt

SEQ ID NO: 5634394 - DNA, 18 bp, Homo sapiens
taaactgttagcactgtt

SEQ ID NO: 5634395 - DNA, 20 bp, Homo sapiens
taaactgttagcactgttga

SEQ ID NO: 5634396 - DNA, 22 bp, Homo sapiens
taaactgttagcactgttgatg

SEQ ID NO: 5634397 - DNA, 14 bp, Homo sapiens
taaactgtttatat

SEQ ID NO: 5634398 - DNA, 13 bp, Homo sapiens
taaactgttttca

SEQ ID NO: 5634399 - DNA, 14 bp, Homo sapiens
taaactgttttcaa

SEQ ID NO: 5634400 - DNA, 15 bp, Homo sapiens
taaactgttttcaag

SEQ ID NO: 5634401 - DNA, 18 bp, Homo sapiens
taaactgttttcatgtgt

SEQ ID NO: 5634402 - DNA, 22 bp, Homo sapiens
taaacttaaaataaaattatat

SEQ ID NO: 5634403 - DNA, 14 bp, Homo sapiens
taaacttacattta

SEQ ID NO: 5634404 - DNA, 19 bp, Homo sapiens
taaacttagaataaaattg

SEQ ID NO: 5634405 - DNA, 20 bp, Homo sapiens
taaacttagaataaaattgt

SEQ ID NO: 5634406 - DNA, 14 bp, Homo sapiens
taaacttatgaatg

SEQ ID NO: 5634407 - DNA, 19 bp, Homo sapiens
taaacttatgaatgtttcc

SEQ ID NO: 5634408 - DNA, 20 bp, Homo sapiens
taaacttcagagttctctgt

SEQ ID NO: 5634409 - DNA, 17 bp, Homo sapiens
taaacttcagcaaccct

SEQ ID NO: 5634410 - DNA, 14 bp, Homo sapiens
taaacttcagtttt

SEQ ID NO: 5634411 - DNA, 19 bp, Homo sapiens
taaacttcagttttactgc

SEQ ID NO: 5634412 - DNA, 18 bp, Homo sapiens
taaacttcatatgtaatc

SEQ ID NO: 5634413 - DNA, 17 bp, Homo sapiens
taaacttccaaagaaag

SEQ ID NO: 5634414 - DNA, 16 bp, Homo sapiens
taaacttccaaagctt

SEQ ID NO: 5634415 - DNA, 20 bp, Homo sapiens
taaacttcctattttcttga

SEQ ID NO: 5634416 - DNA, 18 bp, Homo sapiens
taaacttctactgagcaa

SEQ ID NO: 5634417 - DNA, 22 bp, Homo sapiens
taaacttctgcaacaagcatgc

SEQ ID NO: 5634418 - DNA, 21 bp, Homo sapiens
taaacttgaaatatataatat

SEQ ID NO: 5634419 - DNA, 16 bp, Homo sapiens
taaacttgaagcagtc

SEQ ID NO: 5634420 - DNA, 21 bp, Homo sapiens
taaacttgattatattgtttt

SEQ ID NO: 5634421 - DNA, 23 bp, Homo sapiens
taaacttgcaatgaaaagaaaat

SEQ ID NO: 5634422 - DNA, 17 bp, Homo sapiens
taaacttgcacatttga

SEQ ID NO: 5634423 - DNA, 23 bp, Homo sapiens
taaacttggaagggggagacagg

SEQ ID NO: 5634424 - DNA, 15 bp, Homo sapiens
taaacttggaatcaa

SEQ ID NO: 5634425 - DNA, 17 bp, Homo sapiens
taaacttgtacatggaa

SEQ ID NO: 5634426 - DNA, 16 bp, Homo sapiens
taaacttgtgcctcca

SEQ ID NO: 5634427 - DNA, 13 bp, Homo sapiens
taaacttgtgtat

SEQ ID NO: 5634428 - DNA, 20 bp, Homo sapiens
taaacttgtgtatgatccaa

SEQ ID NO: 5634429 - DNA, 14 bp, Homo sapiens
taaacttgtgtatt

SEQ ID NO: 5634430 - DNA, 16 bp, Homo sapiens
taaactttatttgtaa

SEQ ID NO: 5634431 - DNA, 17 bp, Homo sapiens
taaactttatttgtaaa

SEQ ID NO: 5634432 - DNA, 21 bp, Homo sapiens
taaactttcaatatctttatt

SEQ ID NO: 5634433 - DNA, 16 bp, Homo sapiens
taaactttcagaactg

SEQ ID NO: 5634434 - DNA, 19 bp, Homo sapiens
taaactttcagaactgcta

SEQ ID NO: 5634435 - DNA, 17 bp, Homo sapiens
taaactttcccttggct

SEQ ID NO: 5634436 - DNA, 14 bp, Homo sapiens
taaactttcctgta

SEQ ID NO: 5634437 - DNA, 18 bp, Homo sapiens
taaactttctccatttaa

SEQ ID NO: 5634438 - DNA, 18 bp, Homo sapiens
taaactttcttaatattt

SEQ ID NO: 5634439 - DNA, 11 bp, Homo sapiens
taaactttgaa

SEQ ID NO: 5634440 - DNA, 14 bp, Homo sapiens
taaactttgaaata

SEQ ID NO: 5634441 - DNA, 17 bp, Homo sapiens
taaactttgaaatatat

SEQ ID NO: 5634442 - DNA, 21 bp, Homo sapiens
taaactttgaagcaactgtga

SEQ ID NO: 5634443 - DNA, 18 bp, Homo sapiens
taaactttgaataaaaga

SEQ ID NO: 5634444 - DNA, 15 bp, Homo sapiens
taaactttgtgcctt

SEQ ID NO: 5634445 - DNA, 17 bp, Homo sapiens
taaactttgtgcctttg

SEQ ID NO: 5634446 - DNA, 17 bp, Homo sapiens
taaacttttataccaag

SEQ ID NO: 5634447 - DNA, 19 bp, Homo sapiens
taaacttttatacttgggt

SEQ ID NO: 5634448 - DNA, 14 bp, Homo sapiens
taaacttttctgat

SEQ ID NO: 5634449 - DNA, 16 bp, Homo sapiens
taaactttttaaaata

SEQ ID NO: 5634450 - DNA, 17 bp, Homo sapiens
taaactttttaaaatac

SEQ ID NO: 5634451 - DNA, 22 bp, Homo sapiens
taaactttttaccaagtacaaa

SEQ ID NO: 5634452 - DNA, 15 bp, Homo sapiens
taaactttttcaatg

SEQ ID NO: 5634453 - DNA, 18 bp, Homo sapiens
taaactttttttcaatgt

SEQ ID NO: 5634454 - DNA, 19 bp, Homo sapiens
taaactttttttcaatgtg

SEQ ID NO: 5634455 - DNA, 20 bp, Homo sapiens
taaactttttttctgtacca

SEQ ID NO: 5634456 - DNA, 18 bp, Homo sapiens
taaacttttttttgagaa

SEQ ID NO: 5634457 - DNA, 11 bp, Homo sapiens
taaagaaaaaa

SEQ ID NO: 5634458 - DNA, 17 bp, Homo sapiens
taaagaaaaaaattgaa

SEQ ID NO: 5634459 - DNA, 20 bp, Homo sapiens
taaagaaaaaaattgaaatg

SEQ ID NO: 5634460 - DNA, 21 bp, Homo sapiens
taaagaaaaaaattgaaatgt

SEQ ID NO: 5634461 - DNA, 14 bp, Homo sapiens
taaagaaaaacaaa

SEQ ID NO: 5634462 - DNA, 17 bp, Homo sapiens
taaagaaaaagtcatcc

SEQ ID NO: 5634463 - DNA, 20 bp, Homo sapiens
taaagaaaaatatcttggcc

SEQ ID NO: 5634464 - DNA, 16 bp, Homo sapiens
taaagaaaaatatgat

SEQ ID NO: 5634465 - DNA, 20 bp, Homo sapiens
taaagaaaaatatttaatgt

SEQ ID NO: 5634466 - DNA, 21 bp, Homo sapiens
taaagaaaaatatttaatgtt

SEQ ID NO: 5634467 - DNA, 22 bp, Homo sapiens
taaagaaaaatgcacctaaaat

SEQ ID NO: 5634468 - DNA, 16 bp, Homo sapiens
taaagaaaaatgcctg

SEQ ID NO: 5634469 - DNA, 13 bp, Homo sapiens
taaagaaaaccat

SEQ ID NO: 5634470 - DNA, 15 bp, Homo sapiens
taaagaaaagatgaa

SEQ ID NO: 5634471 - DNA, 18 bp, Homo sapiens
taaagaaaagatgcactt

SEQ ID NO: 5634472 - DNA, 18 bp, Homo sapiens
taaagaaaagcctcagct

SEQ ID NO: 5634473 - DNA, 19 bp, Homo sapiens
taaagaaaagcctcagctc

SEQ ID NO: 5634474 - DNA, 23 bp, Homo sapiens
taaagaaaagttcttaaaacact

SEQ ID NO: 5634475 - DNA, 13 bp, Homo sapiens
taaagaaaataaa

SEQ ID NO: 5634476 - DNA, 20 bp, Homo sapiens
taaagaaaatgaactgccca

SEQ ID NO: 5634477 - DNA, 21 bp, Homo sapiens
taaagaaaatgaactgcccac

SEQ ID NO: 5634478 - DNA, 15 bp, Homo sapiens
taaagaaaattgcat

SEQ ID NO: 5634479 - DNA, 18 bp, Homo sapiens
taaagaaaattgccaaaa

SEQ ID NO: 5634480 - DNA, 22 bp, Homo sapiens
taaagaaaattgccaaaatata

SEQ ID NO: 5634481 - DNA, 14 bp, Homo sapiens
taaagaaacactaa

SEQ ID NO: 5634482 - DNA, 16 bp, Homo sapiens
taaagaaacactaaat

SEQ ID NO: 5634483 - DNA, 17 bp, Homo sapiens
taaagaaacactaaatt

SEQ ID NO: 5634484 - DNA, 13 bp, Homo sapiens
taaagaaacactt

SEQ ID NO: 5634485 - DNA, 14 bp, Homo sapiens
taaagaaacacttt

SEQ ID NO: 5634486 - DNA, 17 bp, Homo sapiens
taaagaaacactttctt

SEQ ID NO: 5634487 - DNA, 15 bp, Homo sapiens
taaagaaacagcttt

SEQ ID NO: 5634488 - DNA, 19 bp, Homo sapiens
taaagaaacagctttcaag

SEQ ID NO: 5634489 - DNA, 14 bp, Homo sapiens
taaagaaacatttc

SEQ ID NO: 5634490 - DNA, 17 bp, Homo sapiens
taaagaaaccttttaaa

SEQ ID NO: 5634491 - DNA, 20 bp, Homo sapiens
taaagaaactgaggcccacg

SEQ ID NO: 5634492 - DNA, 15 bp, Homo sapiens
taaagaaactgctta

SEQ ID NO: 5634493 - DNA, 17 bp, Homo sapiens
taaagaaactgcttaca

SEQ ID NO: 5634494 - DNA, 22 bp, Homo sapiens
taaagaaactgcttacagttta

SEQ ID NO: 5634495 - DNA, 21 bp, Homo sapiens
taaagaaacttggctggaatt

SEQ ID NO: 5634496 - DNA, 13 bp, Homo sapiens
taaagaaactttt

SEQ ID NO: 5634497 - DNA, 12 bp, Homo sapiens
taaagaaagaga

SEQ ID NO: 5634498 - DNA, 13 bp, Homo sapiens
taaagaaagattg

SEQ ID NO: 5634499 - DNA, 19 bp, Homo sapiens
taaagaaagattgtaaact

SEQ ID NO: 5634500 - DNA, 21 bp, Homo sapiens
taaagaaagattgtaaactaa

SEQ ID NO: 5634501 - DNA, 22 bp, Homo sapiens
taaagaaaggaaaagaaaacaa

SEQ ID NO: 5634502 - DNA, 15 bp, Homo sapiens
taaagaaaggcagag

SEQ ID NO: 5634503 - DNA, 17 bp, Homo sapiens
taaagaaaggcagagat

SEQ ID NO: 5634504 - DNA, 16 bp, Homo sapiens
taaagttacactttta

SEQ ID NO: 5634505 - DNA, 15 bp, Homo sapiens
taaagttacattgct

SEQ ID NO: 5634506 - DNA, 14 bp, Homo sapiens
taaagttactactg

SEQ ID NO: 5634507 - DNA, 16 bp, Homo sapiens
taaagttactttgtca

SEQ ID NO: 5634508 - DNA, 19 bp, Homo sapiens
taaagttagaatctatttt

SEQ ID NO: 5634509 - DNA, 20 bp, Homo sapiens
taaagttagaatctattttc

SEQ ID NO: 5634510 - DNA, 20 bp, Homo sapiens
taaagttagggcatttttct

SEQ ID NO: 5634511 - DNA, 20 bp, Homo sapiens
taaagttagtatcttttgat

SEQ ID NO: 5634512 - DNA, 15 bp, Homo sapiens
taaagttagtctact

SEQ ID NO: 5634513 - DNA, 13 bp, Homo sapiens
taaagttatattt

SEQ ID NO: 5634514 - DNA, 16 bp, Homo sapiens
taaagttatatttcag

SEQ ID NO: 5634515 - DNA, 15 bp, Homo sapiens
taaagttatatttgt

SEQ ID NO: 5634516 - DNA, 21 bp, Homo sapiens
taaagttattcttgtcatttt

SEQ ID NO: 5634517 - DNA, 15 bp, Homo sapiens
taaagttcaacatgt

SEQ ID NO: 5634518 - DNA, 17 bp, Homo sapiens
taaagttcattgcaatt

SEQ ID NO: 5634519 - DNA, 20 bp, Homo sapiens
taaagttccatgaagacaaa

SEQ ID NO: 5634520 - DNA, 13 bp, Homo sapiens
taaagttccttaa

SEQ ID NO: 5634521 - DNA, 15 bp, Homo sapiens
taaagttctaagatt

SEQ ID NO: 5634522 - DNA, 18 bp, Homo sapiens
taaagttctaagattctg

SEQ ID NO: 5634523 - DNA, 22 bp, Homo sapiens
taaagttctaagattctgattt

SEQ ID NO: 5634524 - DNA, 19 bp, Homo sapiens
taaagttctctgtaattac

SEQ ID NO: 5634525 - DNA, 23 bp, Homo sapiens
taaagttctgtactcaaatgtag

SEQ ID NO: 5634526 - DNA, 13 bp, Homo sapiens
taaagttctgtgt

SEQ ID NO: 5634527 - DNA, 15 bp, Homo sapiens
taaagttgaaaatac

SEQ ID NO: 5634528 - DNA, 18 bp, Homo sapiens
taaagttgaaaatacatt

SEQ ID NO: 5634529 - DNA, 14 bp, Homo sapiens
taaagttgaattta

SEQ ID NO: 5634530 - DNA, 17 bp, Homo sapiens
taaagttgaatttattg

SEQ ID NO: 5634531 - DNA, 19 bp, Homo sapiens
taaagttgagcttagtttt

SEQ ID NO: 5634532 - DNA, 16 bp, Homo sapiens
taaagttgataaagat

SEQ ID NO: 5634533 - DNA, 21 bp, Homo sapiens
taaagttgattttgaactttt

SEQ ID NO: 5634534 - DNA, 13 bp, Homo sapiens
taaagttggaaag

SEQ ID NO: 5634535 - DNA, 14 bp, Homo sapiens
taaagttggaattt

SEQ ID NO: 5634536 - DNA, 18 bp, Homo sapiens
taaagttggaatttacca

SEQ ID NO: 5634537 - DNA, 20 bp, Homo sapiens
taaagttggttcacttcaaa

SEQ ID NO: 5634538 - DNA, 18 bp, Homo sapiens
taaagttggttggataag

SEQ ID NO: 5634539 - DNA, 22 bp, Homo sapiens
taaagttgtaaataattttcta

SEQ ID NO: 5634540 - DNA, 13 bp, Homo sapiens
taaagttgtactt

SEQ ID NO: 5634541 - DNA, 16 bp, Homo sapiens
taaagttgtactttaa

SEQ ID NO: 5634542 - DNA, 20 bp, Homo sapiens
taaagttgtgccaaactata

SEQ ID NO: 5634543 - DNA, 21 bp, Homo sapiens
taaagttgttcacatatatgt

SEQ ID NO: 5634544 - DNA, 22 bp, Homo sapiens
taaagttgttcgccgcgtggaa

SEQ ID NO: 5634545 - DNA, 15 bp, Homo sapiens
taaagttgttgcatt

SEQ ID NO: 5634546 - DNA, 14 bp, Homo sapiens
taaagttgttttat

SEQ ID NO: 5634547 - DNA, 14 bp, Homo sapiens
taaagtttaaaaaa

SEQ ID NO: 5634548 - DNA, 21 bp, Homo sapiens
taaagtttaagtgtgcagcca

SEQ ID NO: 5634549 - DNA, 16 bp, Homo sapiens
taaagtttaatgccta

SEQ ID NO: 5634550 - DNA, 14 bp, Homo sapiens
taaagtttacagta

SEQ ID NO: 5634551 - DNA, 19 bp, Homo sapiens
taaagtttacagtctttct

SEQ ID NO: 5634552 - DNA, 21 bp, Homo sapiens
taaagtttatcagatattttc

SEQ ID NO: 5634553 - DNA, 20 bp, Homo sapiens
taaagtttatttcatggatt

SEQ ID NO: 5634554 - DNA, 13 bp, Homo sapiens
taaagtttcaaaa

SEQ ID NO: 5634555 - DNA, 15 bp, Homo sapiens
taaagtttgatcttc

SEQ ID NO: 5634556 - DNA, 18 bp, Homo sapiens
taaagtttgcttgtttct

SEQ ID NO: 5634557 - DNA, 18 bp, Homo sapiens
taaagtttgctttcagat

SEQ ID NO: 5634558 - DNA, 21 bp, Homo sapiens
taaagtttggacttatctata

SEQ ID NO: 5634559 - DNA, 22 bp, Homo sapiens
taaagtttggtattgtaaaaca

SEQ ID NO: 5634560 - DNA, 15 bp, Homo sapiens
taaagtttgttcact

SEQ ID NO: 5634561 - DNA, 19 bp, Homo sapiens
taaagtttgttcacttaaa

SEQ ID NO: 5634562 - DNA, 12 bp, Homo sapiens
taaagtttgttg

SEQ ID NO: 5634563 - DNA, 14 bp, Homo sapiens
taaagtttgttgaa

SEQ ID NO: 5634564 - DNA, 15 bp, Homo sapiens
taaagtttgttgaaa

SEQ ID NO: 5634565 - DNA, 14 bp, Homo sapiens
taaagttttatata

SEQ ID NO: 5634566 - DNA, 18 bp, Homo sapiens
taaagttttatatattat

SEQ ID NO: 5634567 - DNA, 19 bp, Homo sapiens
taaagttttatatattata

SEQ ID NO: 5634568 - DNA, 20 bp, Homo sapiens
taaagttttattgatgtgaa

SEQ ID NO: 5634569 - DNA, 17 bp, Homo sapiens
taaagttttcaaattat

SEQ ID NO: 5634570 - DNA, 19 bp, Homo sapiens
taaagttttcaaattattt

SEQ ID NO: 5634571 - DNA, 14 bp, Homo sapiens
taaagttttgcaac

SEQ ID NO: 5634572 - DNA, 17 bp, Homo sapiens
taaagttttgcaacaat

SEQ ID NO: 5634573 - DNA, 22 bp, Homo sapiens
taaagttttgccccatgataaa

SEQ ID NO: 5634574 - DNA, 20 bp, Homo sapiens
taaagttttgtcagaaaaga

SEQ ID NO: 5634575 - DNA, 19 bp, Homo sapiens
taaagttttttatatatga

SEQ ID NO: 5634576 - DNA, 21 bp, Homo sapiens
taaagtttttttccttaaaaa

SEQ ID NO: 5634577 - DNA, 23 bp, Homo sapiens
taaataaaaaataataatacaag

SEQ ID NO: 5634578 - DNA, 19 bp, Homo sapiens
taaataaaaactaattaag

SEQ ID NO: 5634579 - DNA, 23 bp, Homo sapiens
taaataaaaagtacaaagggcac

SEQ ID NO: 5634580 - DNA, 11 bp, Homo sapiens
taaataaaaat

SEQ ID NO: 5634581 - DNA, 19 bp, Homo sapiens
taaataaaaataagtcatt

SEQ ID NO: 5634582 - DNA, 14 bp, Homo sapiens
taaataaaaataat

SEQ ID NO: 5634583 - DNA, 17 bp, Homo sapiens
taaataaaaataataga

SEQ ID NO: 5634584 - DNA, 16 bp, Homo sapiens
taaataaaaataattg

SEQ ID NO: 5634585 - DNA, 15 bp, Homo sapiens
taaataaaaatgcat

SEQ ID NO: 5634586 - DNA, 14 bp, Homo sapiens
taaataaaaatgga

SEQ ID NO: 5634587 - DNA, 13 bp, Homo sapiens
taaataaaaatta

SEQ ID NO: 5634588 - DNA, 14 bp, Homo sapiens
taaataaaaattca

SEQ ID NO: 5634589 - DNA, 17 bp, Homo sapiens
taaataaaacaatgtaa

SEQ ID NO: 5634590 - DNA, 14 bp, Homo sapiens
taaataaaaccctt

SEQ ID NO: 5634591 - DNA, 16 bp, Homo sapiens
taaataaaactattta

SEQ ID NO: 5634592 - DNA, 13 bp, Homo sapiens
taaataaaactga

SEQ ID NO: 5634593 - DNA, 14 bp, Homo sapiens
taaataaaactgaa

SEQ ID NO: 5634594 - DNA, 21 bp, Homo sapiens
taaataaaacttaaatctcac

SEQ ID NO: 5634595 - DNA, 22 bp, Homo sapiens
taaataaaagaaaaatatgcat

SEQ ID NO: 5634596 - DNA, 20 bp, Homo sapiens
taaataaaagaaatgcacaa

SEQ ID NO: 5634597 - DNA, 22 bp, Homo sapiens
taaataaaagaggtccattaat

SEQ ID NO: 5634598 - DNA, 16 bp, Homo sapiens
taaataaaagatagca

SEQ ID NO: 5634599 - DNA, 19 bp, Homo sapiens
taaataaaagtgatcaata

SEQ ID NO: 5634600 - DNA, 22 bp, Homo sapiens
taaataaaagttttacaaaggg

SEQ ID NO: 5634601 - DNA, 15 bp, Homo sapiens
taaataaaataaaag

SEQ ID NO: 5634602 - DNA, 14 bp, Homo sapiens
taaataaaatactg

SEQ ID NO: 5634603 - DNA, 22 bp, Homo sapiens
taaataaaatagagtctggaat

SEQ ID NO: 5634604 - DNA, 15 bp, Homo sapiens
taaataaaatcaatt

SEQ ID NO: 5634605 - DNA, 13 bp, Homo sapiens
taaataaaatgac

SEQ ID NO: 5634606 - DNA, 22 bp, Homo sapiens
taaataaaatgcacaaaacttt

SEQ ID NO: 5634607 - DNA, 17 bp, Homo sapiens
taaataaaatgctaggt

SEQ ID NO: 5634608 - DNA, 13 bp, Homo sapiens
taaataaaatgga

SEQ ID NO: 5634609 - DNA, 15 bp, Homo sapiens
taaataaaatgtgta

SEQ ID NO: 5634610 - DNA, 21 bp, Homo sapiens
taaataaaatgtgtacagtga

SEQ ID NO: 5634611 - DNA, 17 bp, Homo sapiens
taaataaaattcatttc

SEQ ID NO: 5634612 - DNA, 20 bp, Homo sapiens
taaataaacacatagattca

SEQ ID NO: 5634613 - DNA, 15 bp, Homo sapiens
taaataaacagatgt

SEQ ID NO: 5634614 - DNA, 22 bp, Homo sapiens
taaataaacatctgatctgtat

SEQ ID NO: 5634615 - DNA, 14 bp, Homo sapiens
taaataaaccactg

SEQ ID NO: 5634616 - DNA, 22 bp, Homo sapiens
taaataaacctcaaaatgtcta

SEQ ID NO: 5634617 - DNA, 14 bp, Homo sapiens
taaataaactagta

SEQ ID NO: 5634618 - DNA, 12 bp, Homo sapiens
taaataaactat

SEQ ID NO: 5634619 - DNA, 16 bp, Homo sapiens
taaataaactatttat

SEQ ID NO: 5634620 - DNA, 22 bp, Homo sapiens
taaataaactcttcaaggccaa

SEQ ID NO: 5634621 - DNA, 11 bp, Homo sapiens
taaataaactg

SEQ ID NO: 5634622 - DNA, 17 bp, Homo sapiens
taaataaactgtttata

SEQ ID NO: 5634623 - DNA, 21 bp, Homo sapiens
taaataaactgttttcaagtc

SEQ ID NO: 5634624 - DNA, 13 bp, Homo sapiens
taaataaactttg

SEQ ID NO: 5634625 - DNA, 13 bp, Homo sapiens
taaataaactttt

SEQ ID NO: 5634626 - DNA, 19 bp, Homo sapiens
taaataaactttttttcaa

SEQ ID NO: 5634627 - DNA, 23 bp, Homo sapiens
taaataaactttttttcaatgtg

SEQ ID NO: 5634628 - DNA, 21 bp, Homo sapiens
taaataaagaagaaaataacc

SEQ ID NO: 5634629 - DNA, 13 bp, Homo sapiens
taaataaagagga

SEQ ID NO: 5634630 - DNA, 12 bp, Homo sapiens
taaataaagctc

SEQ ID NO: 5634631 - DNA, 14 bp, Homo sapiens
taaataaagctcaa

SEQ ID NO: 5634632 - DNA, 15 bp, Homo sapiens
taaataaagctcaag

SEQ ID NO: 5634633 - DNA, 15 bp, Homo sapiens
taaataaagtatcat

SEQ ID NO: 5634634 - DNA, 15 bp, Homo sapiens
taaataaagtttgga

SEQ ID NO: 5634635 - DNA, 16 bp, Homo sapiens
taaataaagtttggac

SEQ ID NO: 5634636 - DNA, 12 bp, Homo sapiens
taaataaataca

SEQ ID NO: 5634637 - DNA, 13 bp, Homo sapiens
taaataaatagaa

SEQ ID NO: 5634638 - DNA, 16 bp, Homo sapiens
taaataaatagaaaga

SEQ ID NO: 5634639 - DNA, 14 bp, Homo sapiens
taaataaatatata

SEQ ID NO: 5634640 - DNA, 22 bp, Homo sapiens
taaataaatgaagtatttctca

SEQ ID NO: 5634641 - DNA, 13 bp, Homo sapiens
taaataaatgctg

SEQ ID NO: 5634642 - DNA, 22 bp, Homo sapiens
taaataaatgctgctttgggga

SEQ ID NO: 5634643 - DNA, 16 bp, Homo sapiens
taaataaatgggtgta

SEQ ID NO: 5634644 - DNA, 18 bp, Homo sapiens
taaataaatgtcattaaa

SEQ ID NO: 5634645 - DNA, 17 bp, Homo sapiens
taaataaattcaaacca

SEQ ID NO: 5634646 - DNA, 18 bp, Homo sapiens
taaataaattcaaaccat

SEQ ID NO: 5634647 - DNA, 22 bp, Homo sapiens
taaataaattgcctcccttcct

SEQ ID NO: 5634648 - DNA, 13 bp, Homo sapiens
taaataaatttga

SEQ ID NO: 5634649 - DNA, 18 bp, Homo sapiens
taaataaattttgtgcaa

SEQ ID NO: 5634650 - DNA, 18 bp, Homo sapiens
taaataacaaaactgtgc

SEQ ID NO: 5634651 - DNA, 13 bp, Homo sapiens
taaataacacaga

SEQ ID NO: 5634652 - DNA, 19 bp, Homo sapiens
taaataaccaggaagcatt

SEQ ID NO: 5634653 - DNA, 15 bp, Homo sapiens
taaataacctctggc

SEQ ID NO: 5634654 - DNA, 19 bp, Homo sapiens
taaataacctctggccctt

SEQ ID NO: 5634655 - DNA, 10 bp, Homo sapiens
taaataacta

SEQ ID NO: 5634656 - DNA, 15 bp, Homo sapiens
taaataactggaaaa

SEQ ID NO: 5634657 - DNA, 22 bp, Homo sapiens
taaataactggaggaattttct

SEQ ID NO: 5634658 - DNA, 21 bp, Homo sapiens
taaataacttgccatttcttt

SEQ ID NO: 5634659 - DNA, 13 bp, Homo sapiens
taaataacttttt

SEQ ID NO: 5634660 - DNA, 21 bp, Homo sapiens
taaataagaaacaactctttg

SEQ ID NO: 5634661 - DNA, 13 bp, Homo sapiens
taaataagaaact

SEQ ID NO: 5634662 - DNA, 18 bp, Homo sapiens
taaataagcaaataaaca

SEQ ID NO: 5634663 - DNA, 13 bp, Homo sapiens
taaataagcacta

SEQ ID NO: 5634664 - DNA, 18 bp, Homo sapiens
taaataaggaatttcctc

SEQ ID NO: 5634665 - DNA, 20 bp, Homo sapiens
taaataagtttgcaatttgg

SEQ ID NO: 5634666 - DNA, 21 bp, Homo sapiens
taaataataaaggttctatga

SEQ ID NO: 5634667 - DNA, 17 bp, Homo sapiens
taaataatagatgtgaa

SEQ ID NO: 5634668 - DNA, 15 bp, Homo sapiens
taaataatattatat

SEQ ID NO: 5634669 - DNA, 20 bp, Homo sapiens
taaataatattatattgtat

SEQ ID NO: 5634670 - DNA, 15 bp, Homo sapiens
taaataatcatacac

SEQ ID NO: 5634671 - DNA, 21 bp, Homo sapiens
taaataatcatccctccttgc

SEQ ID NO: 5634672 - DNA, 13 bp, Homo sapiens
taaataatctcat

SEQ ID NO: 5634673 - DNA, 17 bp, Homo sapiens
taaataatgatcttcca

SEQ ID NO: 5634674 - DNA, 17 bp, Homo sapiens
taaataatgcttcagat

SEQ ID NO: 5634675 - DNA, 18 bp, Homo sapiens
taaataatgcttcagata

SEQ ID NO: 5634676 - DNA, 13 bp, Homo sapiens
taaataatgtagt

SEQ ID NO: 5634677 - DNA, 15 bp, Homo sapiens
taaataatgtattta

SEQ ID NO: 5634678 - DNA, 17 bp, Homo sapiens
taaataatgtatttact

SEQ ID NO: 5634679 - DNA, 13 bp, Homo sapiens
taaataattcttt

SEQ ID NO: 5634680 - DNA, 20 bp, Homo sapiens
taaataattgcatcagttca

SEQ ID NO: 5634681 - DNA, 16 bp, Homo sapiens
taaataatttaactac

SEQ ID NO: 5634682 - DNA, 17 bp, Homo sapiens
taaataatttaactacc

SEQ ID NO: 5634683 - DNA, 22 bp, Homo sapiens
taaatgtgcaatagaaggtgat

SEQ ID NO: 5634684 - DNA, 18 bp, Homo sapiens
taaatgtgcttcattgtt

SEQ ID NO: 5634685 - DNA, 23 bp, Homo sapiens
taaatgtggaatgatgtatataa

SEQ ID NO: 5634686 - DNA, 20 bp, Homo sapiens
taaatgtggattttgtagat

SEQ ID NO: 5634687 - DNA, 14 bp, Homo sapiens
taaatgtggttttt

SEQ ID NO: 5634688 - DNA, 20 bp, Homo sapiens
taaatgtgtaataatgtaac

SEQ ID NO: 5634689 - DNA, 12 bp, Homo sapiens
taaatgtgtaca

SEQ ID NO: 5634690 - DNA, 14 bp, Homo sapiens
taaatgtgtacaat

SEQ ID NO: 5634691 - DNA, 15 bp, Homo sapiens
taaatgtgtatttct

SEQ ID NO: 5634692 - DNA, 14 bp, Homo sapiens
taaatgtgtgtatg

SEQ ID NO: 5634693 - DNA, 14 bp, Homo sapiens
taaatgtgttagca

SEQ ID NO: 5634694 - DNA, 22 bp, Homo sapiens
taaatgtgttggacaaatgtga

SEQ ID NO: 5634695 - DNA, 18 bp, Homo sapiens
taaatgttaaagatgtag

SEQ ID NO: 5634696 - DNA, 17 bp, Homo sapiens
taaatgttaccaaaaat

SEQ ID NO: 5634697 - DNA, 12 bp, Homo sapiens
taaatgttacct

SEQ ID NO: 5634698 - DNA, 20 bp, Homo sapiens
taaatgttacctaattatta

SEQ ID NO: 5634699 - DNA, 17 bp, Homo sapiens
taaatgttacctctgaa

SEQ ID NO: 5634700 - DNA, 22 bp, Homo sapiens
taaatgttagtttcttggtaaa

SEQ ID NO: 5634701 - DNA, 18 bp, Homo sapiens
taaatgttatagctgcat

SEQ ID NO: 5634702 - DNA, 13 bp, Homo sapiens
taaatgttatgac

SEQ ID NO: 5634703 - DNA, 19 bp, Homo sapiens
taaatgttatgactatgta

SEQ ID NO: 5634704 - DNA, 21 bp, Homo sapiens
taaatgttatgactatgtaaa

SEQ ID NO: 5634705 - DNA, 22 bp, Homo sapiens
taaatgttatgactatgtaaac

SEQ ID NO: 5634706 - DNA, 23 bp, Homo sapiens
taaatgttatgactatgtaaact

SEQ ID NO: 5634707 - DNA, 20 bp, Homo sapiens
taaatgttatgactccttga

SEQ ID NO: 5634708 - DNA, 14 bp, Homo sapiens
taaatgttatgtat

SEQ ID NO: 5634709 - DNA, 19 bp, Homo sapiens
taaatgttatgtatatggt

SEQ ID NO: 5634710 - DNA, 12 bp, Homo sapiens
taaatgttcaaa

SEQ ID NO: 5634711 - DNA, 11 bp, Homo sapiens
taaatgttcac

SEQ ID NO: 5634712 - DNA, 14 bp, Homo sapiens
taaatgttcatgtc

SEQ ID NO: 5634713 - DNA, 14 bp, Homo sapiens
taaatgttgaaaag

SEQ ID NO: 5634714 - DNA, 20 bp, Homo sapiens
taaatgttgaaagatcaaaa

SEQ ID NO: 5634715 - DNA, 15 bp, Homo sapiens
taaatgttgaaatct

SEQ ID NO: 5634716 - DNA, 13 bp, Homo sapiens
taaatgttgcaca

SEQ ID NO: 5634717 - DNA, 21 bp, Homo sapiens
taaatgttgcacatcattcat

SEQ ID NO: 5634718 - DNA, 22 bp, Homo sapiens
taaatgttgcacatcattcatt

SEQ ID NO: 5634719 - DNA, 23 bp, Homo sapiens
taaatgttgcacatcattcattc

SEQ ID NO: 5634720 - DNA, 19 bp, Homo sapiens
taaatgttggaattttcaa

SEQ ID NO: 5634721 - DNA, 20 bp, Homo sapiens
taaatgtttaatatctgact

SEQ ID NO: 5634722 - DNA, 14 bp, Homo sapiens
taaatgtttcaaaa

SEQ ID NO: 5634723 - DNA, 18 bp, Homo sapiens
taaatgtttcatgaagaa

SEQ ID NO: 5634724 - DNA, 17 bp, Homo sapiens
taaatgtttcccccact

SEQ ID NO: 5634725 - DNA, 11 bp, Homo sapiens
taaatgtttct

SEQ ID NO: 5634726 - DNA, 12 bp, Homo sapiens
taaatgtttctt

SEQ ID NO: 5634727 - DNA, 19 bp, Homo sapiens
taaatgtttcttttgtttg

SEQ ID NO: 5634728 - DNA, 17 bp, Homo sapiens
taaatgtttctttttct

SEQ ID NO: 5634729 - DNA, 20 bp, Homo sapiens
taaatgtttggcatgtaaat

SEQ ID NO: 5634730 - DNA, 13 bp, Homo sapiens
taaatgtttgtta

SEQ ID NO: 5634731 - DNA, 20 bp, Homo sapiens
taaatgtttgttatttacac

SEQ ID NO: 5634732 - DNA, 13 bp, Homo sapiens
taaatgttttagt

SEQ ID NO: 5634733 - DNA, 22 bp, Homo sapiens
taaatgttttataagttcacaa

SEQ ID NO: 5634734 - DNA, 16 bp, Homo sapiens
taaatgttttcattgg

SEQ ID NO: 5634735 - DNA, 14 bp, Homo sapiens
taaatgttttggaa

SEQ ID NO: 5634736 - DNA, 12 bp, Homo sapiens
taaatgttttgt

SEQ ID NO: 5634737 - DNA, 15 bp, Homo sapiens
taaatgttttgtaaa

SEQ ID NO: 5634738 - DNA, 16 bp, Homo sapiens
taaatgttttgtaaac

SEQ ID NO: 5634739 - DNA, 18 bp, Homo sapiens
taaatgtttttctatgta

SEQ ID NO: 5634740 - DNA, 20 bp, Homo sapiens
taaatgtttttctatgtagt

SEQ ID NO: 5634741 - DNA, 24 bp, Homo sapiens
taaatgtttttttttaaagacttt

SEQ ID NO: 5634742 - DNA, 16 bp, Homo sapiens
taaattaaaaaagaaa

SEQ ID NO: 5634743 - DNA, 13 bp, Homo sapiens
taaattaaaattt

SEQ ID NO: 5634744 - DNA, 15 bp, Homo sapiens
taaattaaacaattt

SEQ ID NO: 5634745 - DNA, 15 bp, Homo sapiens
taaattaaacatttt

SEQ ID NO: 5634746 - DNA, 20 bp, Homo sapiens
taaattaaacatttttcaca

SEQ ID NO: 5634747 - DNA, 19 bp, Homo sapiens
taaattaaagcctttagta

SEQ ID NO: 5634748 - DNA, 20 bp, Homo sapiens
taaattaaagcctttagtat

SEQ ID NO: 5634749 - DNA, 13 bp, Homo sapiens
taaattaaataaa

SEQ ID NO: 5634750 - DNA, 18 bp, Homo sapiens
taaattaacaaattcagt

SEQ ID NO: 5634751 - DNA, 14 bp, Homo sapiens
taaattaacattat

SEQ ID NO: 5634752 - DNA, 15 bp, Homo sapiens
taaattaacttctat

SEQ ID NO: 5634753 - DNA, 19 bp, Homo sapiens
taaattaacttttataaac

SEQ ID NO: 5634754 - DNA, 15 bp, Homo sapiens
taaattaagacatgc

SEQ ID NO: 5634755 - DNA, 13 bp, Homo sapiens
taaattaagactt

SEQ ID NO: 5634756 - DNA, 21 bp, Homo sapiens
taaattaagatcctaaactct

SEQ ID NO: 5634757 - DNA, 15 bp, Homo sapiens
taaattaagttactg

SEQ ID NO: 5634758 - DNA, 16 bp, Homo sapiens
taaattaatacagagt

SEQ ID NO: 5634759 - DNA, 22 bp, Homo sapiens
taaattaatacataagttaata

SEQ ID NO: 5634760 - DNA, 22 bp, Homo sapiens
taaattaatattgtattgctgc

SEQ ID NO: 5634761 - DNA, 17 bp, Homo sapiens
taaattaattgaatcta

SEQ ID NO: 5634762 - DNA, 22 bp, Homo sapiens
taaattaatttgttaattaaat

SEQ ID NO: 5634763 - DNA, 13 bp, Homo sapiens
taaattacaaagg

SEQ ID NO: 5634764 - DNA, 16 bp, Homo sapiens
taaattacaaatgtgg

SEQ ID NO: 5634765 - DNA, 13 bp, Homo sapiens
taaattacaattt

SEQ ID NO: 5634766 - DNA, 16 bp, Homo sapiens
taaattacaattttat

SEQ ID NO: 5634767 - DNA, 17 bp, Homo sapiens
taaattacaattttatc

SEQ ID NO: 5634768 - DNA, 19 bp, Homo sapiens
taaattacactttattctt

SEQ ID NO: 5634769 - DNA, 13 bp, Homo sapiens
taaattacagctt

SEQ ID NO: 5634770 - DNA, 14 bp, Homo sapiens
taaattacagcttt

SEQ ID NO: 5634771 - DNA, 16 bp, Homo sapiens
taaattacagctttta

SEQ ID NO: 5634772 - DNA, 21 bp, Homo sapiens
taaattacagcttttatggat

SEQ ID NO: 5634773 - DNA, 21 bp, Homo sapiens
taaattacagtaatcccattt

SEQ ID NO: 5634774 - DNA, 13 bp, Homo sapiens
taaattacatgca

SEQ ID NO: 5634775 - DNA, 16 bp, Homo sapiens
taaattacatgcatga

SEQ ID NO: 5634776 - DNA, 17 bp, Homo sapiens
taaattacatttgtaat

SEQ ID NO: 5634777 - DNA, 15 bp, Homo sapiens
taaattacattttta

SEQ ID NO: 5634778 - DNA, 16 bp, Homo sapiens
taaattacatttttaa

SEQ ID NO: 5634779 - DNA, 22 bp, Homo sapiens
taaattaccagtaaagtgtaac

SEQ ID NO: 5634780 - DNA, 17 bp, Homo sapiens
taaattacctttacata

SEQ ID NO: 5634781 - DNA, 15 bp, Homo sapiens
taaattactaattat

SEQ ID NO: 5634782 - DNA, 16 bp, Homo sapiens
taaattactaattatc

SEQ ID NO: 5634783 - DNA, 17 bp, Homo sapiens
taaattactaattatct

SEQ ID NO: 5634784 - DNA, 16 bp, Homo sapiens
taaattactatagcaa

SEQ ID NO: 5634785 - DNA, 12 bp, Homo sapiens
taaattagaaaa

SEQ ID NO: 5634786 - DNA, 16 bp, Homo sapiens
taaattagaaaatatt

SEQ ID NO: 5634787 - DNA, 20 bp, Homo sapiens
taaattagaaaatattctct

SEQ ID NO: 5634788 - DNA, 11 bp, Homo sapiens
taaattagaat

SEQ ID NO: 5634789 - DNA, 20 bp, Homo sapiens
taaattagaatgaatttatc

SEQ ID NO: 5634790 - DNA, 20 bp, Homo sapiens
taaattagctatttctgctc

SEQ ID NO: 5634791 - DNA, 22 bp, Homo sapiens
taaattaggaataaataaaaat

SEQ ID NO: 5634792 - DNA, 23 bp, Homo sapiens
taaattaggaggctcaacaataa

SEQ ID NO: 5634793 - DNA, 13 bp, Homo sapiens
taaattaggcagt

SEQ ID NO: 5634794 - DNA, 23 bp, Homo sapiens
taaattagtgtacctattaaaag

SEQ ID NO: 5634795 - DNA, 13 bp, Homo sapiens
taaattagtttga

SEQ ID NO: 5634796 - DNA, 15 bp, Homo sapiens
taaattagtttgaca

SEQ ID NO: 5634797 - DNA, 18 bp, Homo sapiens
taaattagtttgacactg

SEQ ID NO: 5634798 - DNA, 21 bp, Homo sapiens
taaattataaaattgaaaaca

SEQ ID NO: 5634799 - DNA, 23 bp, Homo sapiens
taaattataaaattgaaaacact

SEQ ID NO: 5634800 - DNA, 17 bp, Homo sapiens
taaattataacttaaaa

SEQ ID NO: 5634801 - DNA, 13 bp, Homo sapiens
taaattataagga

SEQ ID NO: 5634802 - DNA, 17 bp, Homo sapiens
taaattataaggactgc

SEQ ID NO: 5634803 - DNA, 21 bp, Homo sapiens
taaattataatgcatctaaac

SEQ ID NO: 5634804 - DNA, 12 bp, Homo sapiens
taaattatagag

SEQ ID NO: 5634805 - DNA, 21 bp, Homo sapiens
taaattatagagcctcaattt

SEQ ID NO: 5634806 - DNA, 22 bp, Homo sapiens
taaattatagagcctcaatttt

SEQ ID NO: 5634807 - DNA, 13 bp, Homo sapiens
taaattatatatt

SEQ ID NO: 5634808 - DNA, 16 bp, Homo sapiens
taaattatatgatatg

SEQ ID NO: 5634809 - DNA, 19 bp, Homo sapiens
taaattatatgatatgcat

SEQ ID NO: 5634810 - DNA, 15 bp, Homo sapiens
taaattatcattgtt

SEQ ID NO: 5634811 - DNA, 12 bp, Homo sapiens
taaattatctga

SEQ ID NO: 5634812 - DNA, 21 bp, Homo sapiens
taaattatgggaatcaagatt

SEQ ID NO: 5634813 - DNA, 13 bp, Homo sapiens
taaattatgtata

SEQ ID NO: 5634814 - DNA, 22 bp, Homo sapiens
taaattatgtgaccataatgta

SEQ ID NO: 5634815 - DNA, 18 bp, Homo sapiens
taaattatgttttaaaca

SEQ ID NO: 5634816 - DNA, 23 bp, Homo sapiens
taaattattaagcagactggaaa

SEQ ID NO: 5634817 - DNA, 13 bp, Homo sapiens
taaattattacat

SEQ ID NO: 5634818 - DNA, 17 bp, Homo sapiens
taaattattactttaaa

SEQ ID NO: 5634819 - DNA, 19 bp, Homo sapiens
taaattattagagattttc

SEQ ID NO: 5634820 - DNA, 23 bp, Homo sapiens
taaattattcagaactatttaaa

SEQ ID NO: 5634821 - DNA, 21 bp, Homo sapiens
taaattattcagttaagaaaa

SEQ ID NO: 5634822 - DNA, 10 bp, Homo sapiens
taaattattt

SEQ ID NO: 5634823 - DNA, 13 bp, Homo sapiens
taaattatttcat

SEQ ID NO: 5634824 - DNA, 16 bp, Homo sapiens
taaattatttctaaaa

SEQ ID NO: 5634825 - DNA, 22 bp, Homo sapiens
taaattatttgattatttaaga

SEQ ID NO: 5634826 - DNA, 22 bp, Homo sapiens
taaattattttatatcatacag

SEQ ID NO: 5634827 - DNA, 19 bp, Homo sapiens
taaattattttatgtcata

SEQ ID NO: 5634828 - DNA, 19 bp, Homo sapiens
taaattatttttaagaaat

SEQ ID NO: 5634829 - DNA, 15 bp, Homo sapiens
taaattcaaacctaa

SEQ ID NO: 5634830 - DNA, 23 bp, Homo sapiens
taaattcaacacttattttctga

SEQ ID NO: 5634831 - DNA, 15 bp, Homo sapiens
taaattcaactttgt

SEQ ID NO: 5634832 - DNA, 16 bp, Homo sapiens
taaattcaactttgta

SEQ ID NO: 5634833 - DNA, 18 bp, Homo sapiens
taaattcaactttgtaaa

SEQ ID NO: 5634834 - DNA, 16 bp, Homo sapiens
taaattcacaaacttt

SEQ ID NO: 5634835 - DNA, 18 bp, Homo sapiens
taaattcactttcatttt

SEQ ID NO: 5634836 - DNA, 10 bp, Homo sapiens
taaattcaga

SEQ ID NO: 5634837 - DNA, 15 bp, Homo sapiens
taaattcagacaaca

SEQ ID NO: 5634838 - DNA, 17 bp, Homo sapiens
taaattcagacaacatt

SEQ ID NO: 5634839 - DNA, 20 bp, Homo sapiens
taaattcagatatatttttc

SEQ ID NO: 5634840 - DNA, 14 bp, Homo sapiens
taaattcagtccta

SEQ ID NO: 5634841 - DNA, 23 bp, Homo sapiens
taaattcatggttttaaagctaa

SEQ ID NO: 5634842 - DNA, 16 bp, Homo sapiens
taaattcatttctaga

SEQ ID NO: 5634843 - DNA, 17 bp, Homo sapiens
taaattcatttctagac

SEQ ID NO: 5634844 - DNA, 17 bp, Homo sapiens
taaattcattttattct

SEQ ID NO: 5634845 - DNA, 20 bp, Homo sapiens
taaattccacagattatcaa

SEQ ID NO: 5634846 - DNA, 20 bp, Homo sapiens
taaattccactgaaaattta

SEQ ID NO: 5634847 - DNA, 22 bp, Homo sapiens
taaattccactgaaaatttaac

SEQ ID NO: 5634848 - DNA, 23 bp, Homo sapiens
taaattccactgaaaatttaaca

SEQ ID NO: 5634849 - DNA, 14 bp, Homo sapiens
taaattccactgga

SEQ ID NO: 5634850 - DNA, 12 bp, Homo sapiens
taaattccagag

SEQ ID NO: 5634851 - DNA, 18 bp, Homo sapiens
taaattccagaggactct

SEQ ID NO: 5634852 - DNA, 19 bp, Homo sapiens
taaattccccatatttgtg

SEQ ID NO: 5634853 - DNA, 22 bp, Homo sapiens
taaattccccatatttgtgttc

SEQ ID NO: 5634854 - DNA, 20 bp, Homo sapiens
taaattcctcaacagtgttt

SEQ ID NO: 5634855 - DNA, 12 bp, Homo sapiens
taaattcctctt

SEQ ID NO: 5634856 - DNA, 17 bp, Homo sapiens
taaattcctctttgctt

SEQ ID NO: 5634857 - DNA, 19 bp, Homo sapiens
taaattcctctttgctttg

SEQ ID NO: 5634858 - DNA, 15 bp, Homo sapiens
taaattctaaattac

SEQ ID NO: 5634859 - DNA, 14 bp, Homo sapiens
taaattctactaag

SEQ ID NO: 5634860 - DNA, 16 bp, Homo sapiens
taaattctactaagtt

SEQ ID NO: 5634861 - DNA, 17 bp, Homo sapiens
taacatgtaattaagta

SEQ ID NO: 5634862 - DNA, 15 bp, Homo sapiens
taacatgtaggaagt

SEQ ID NO: 5634863 - DNA, 19 bp, Homo sapiens
taacatgtgaaaagaatag

SEQ ID NO: 5634864 - DNA, 16 bp, Homo sapiens
taacatgttaaaatgt

SEQ ID NO: 5634865 - DNA, 15 bp, Homo sapiens
taacatgttaaacca

SEQ ID NO: 5634866 - DNA, 16 bp, Homo sapiens
taacatgttaaaccat

SEQ ID NO: 5634867 - DNA, 18 bp, Homo sapiens
taacatgttaaaccatgg

SEQ ID NO: 5634868 - DNA, 23 bp, Homo sapiens
taacattaaagcaatctgttgaa

SEQ ID NO: 5634869 - DNA, 24 bp, Homo sapiens
taacattaaagcaatctgttgaaa

SEQ ID NO: 5634870 - DNA, 13 bp, Homo sapiens
taacattaagaaa

SEQ ID NO: 5634871 - DNA, 22 bp, Homo sapiens
taacattaagaaaaacaataaa

SEQ ID NO: 5634872 - DNA, 13 bp, Homo sapiens
taacattacctta

SEQ ID NO: 5634873 - DNA, 18 bp, Homo sapiens
taacattagatgtcatga

SEQ ID NO: 5634874 - DNA, 22 bp, Homo sapiens
taacattaggaccttagaattt

SEQ ID NO: 5634875 - DNA, 16 bp, Homo sapiens
taacattatataacaa

SEQ ID NO: 5634876 - DNA, 16 bp, Homo sapiens
taacattatttatatg

SEQ ID NO: 5634877 - DNA, 14 bp, Homo sapiens
taacattcacagcc

SEQ ID NO: 5634878 - DNA, 21 bp, Homo sapiens
taacattcagtactttatgaa

SEQ ID NO: 5634879 - DNA, 17 bp, Homo sapiens
taacattcatgagattg

SEQ ID NO: 5634880 - DNA, 12 bp, Homo sapiens
taacattccaag

SEQ ID NO: 5634881 - DNA, 16 bp, Homo sapiens
taacattcccactgcc

SEQ ID NO: 5634882 - DNA, 21 bp, Homo sapiens
taacattcctcatgaatgtaa

SEQ ID NO: 5634883 - DNA, 16 bp, Homo sapiens
taacattctacttgct

SEQ ID NO: 5634884 - DNA, 23 bp, Homo sapiens
taacattctcaatcatgggaatt

SEQ ID NO: 5634885 - DNA, 22 bp, Homo sapiens
taacattctgtaaaatgtctgt

SEQ ID NO: 5634886 - DNA, 15 bp, Homo sapiens
taacattgaaagtga

SEQ ID NO: 5634887 - DNA, 16 bp, Homo sapiens
taacattgaccaagaa

SEQ ID NO: 5634888 - DNA, 19 bp, Homo sapiens
taacattgaccaagaactg

SEQ ID NO: 5634889 - DNA, 21 bp, Homo sapiens
taacattgaccaagaactgca

SEQ ID NO: 5634890 - DNA, 22 bp, Homo sapiens
taacattgattggataaatgct

SEQ ID NO: 5634891 - DNA, 23 bp, Homo sapiens
taacattgcactttataaacact

SEQ ID NO: 5634892 - DNA, 13 bp, Homo sapiens
taacattggtgaa

SEQ ID NO: 5634893 - DNA, 14 bp, Homo sapiens
taacattgtaaagt

SEQ ID NO: 5634894 - DNA, 16 bp, Homo sapiens
taacattgtaaagtat

SEQ ID NO: 5634895 - DNA, 20 bp, Homo sapiens
taacattgtaaagtatgtga

SEQ ID NO: 5634896 - DNA, 14 bp, Homo sapiens
taacattgtatgtt

SEQ ID NO: 5634897 - DNA, 22 bp, Homo sapiens
taacattgtgactttgctttga

SEQ ID NO: 5634898 - DNA, 15 bp, Homo sapiens
taacatttaaagaga

SEQ ID NO: 5634899 - DNA, 14 bp, Homo sapiens
taacatttaaattc

SEQ ID NO: 5634900 - DNA, 19 bp, Homo sapiens
taacatttacgaattattt

SEQ ID NO: 5634901 - DNA, 17 bp, Homo sapiens
taacatttagactaaat

SEQ ID NO: 5634902 - DNA, 23 bp, Homo sapiens
taacatttcattaaccaaagaaa

SEQ ID NO: 5634903 - DNA, 18 bp, Homo sapiens
taacatttctaactctga

SEQ ID NO: 5634904 - DNA, 18 bp, Homo sapiens
taacatttgcaaaatgga

SEQ ID NO: 5634905 - DNA, 14 bp, Homo sapiens
taacatttgctgtt

SEQ ID NO: 5634906 - DNA, 22 bp, Homo sapiens
taacatttgctgttttaaacat

SEQ ID NO: 5634907 - DNA, 14 bp, Homo sapiens
taacattttacagt

SEQ ID NO: 5634908 - DNA, 16 bp, Homo sapiens
taacattttacagtaa

SEQ ID NO: 5634909 - DNA, 14 bp, Homo sapiens
taacattttggaaa

SEQ ID NO: 5634910 - DNA, 15 bp, Homo sapiens
taacattttggaaat

SEQ ID NO: 5634911 - DNA, 17 bp, Homo sapiens
taacattttggaaattg

SEQ ID NO: 5634912 - DNA, 22 bp, Homo sapiens
taacattttggtgacagtttcc

SEQ ID NO: 5634913 - DNA, 12 bp, Homo sapiens
taacattttgtt

SEQ ID NO: 5634914 - DNA, 21 bp, Homo sapiens
taacattttgttcttacacat

SEQ ID NO: 5634915 - DNA, 22 bp, Homo sapiens
taacattttgttcttacacata

SEQ ID NO: 5634916 - DNA, 18 bp, Homo sapiens
taacattttgtttccaaa

SEQ ID NO: 5634917 - DNA, 17 bp, Homo sapiens
taaccaaaaagaccaga

SEQ ID NO: 5634918 - DNA, 15 bp, Homo sapiens
taaccaaagaacgta

SEQ ID NO: 5634919 - DNA, 22 bp, Homo sapiens
taaccaaatattaaagattctc

SEQ ID NO: 5634920 - DNA, 20 bp, Homo sapiens
taaccaacattaaaactcat

SEQ ID NO: 5634921 - DNA, 21 bp, Homo sapiens
taaccaacattttaaaaataa

SEQ ID NO: 5634922 - DNA, 16 bp, Homo sapiens
taaccaactgaacgac

SEQ ID NO: 5634923 - DNA, 17 bp, Homo sapiens
taaccaagaaatactaa

SEQ ID NO: 5634924 - DNA, 22 bp, Homo sapiens
taaccaagaaatactaatgtaa

SEQ ID NO: 5634925 - DNA, 14 bp, Homo sapiens
taaccaagaggctg

SEQ ID NO: 5634926 - DNA, 20 bp, Homo sapiens
taaccaaggaaatatatttt

SEQ ID NO: 5634927 - DNA, 16 bp, Homo sapiens
taaccaaggaggggcc

SEQ ID NO: 5634928 - DNA, 15 bp, Homo sapiens
taaccaaggccctgt

SEQ ID NO: 5634929 - DNA, 18 bp, Homo sapiens
taaccaaggctccaataa

SEQ ID NO: 5634930 - DNA, 16 bp, Homo sapiens
taaccaagttgtttat

SEQ ID NO: 5634931 - DNA, 22 bp, Homo sapiens
taaccaagttgtttattccaaa

SEQ ID NO: 5634932 - DNA, 19 bp, Homo sapiens
taaccaatcctactaataa

SEQ ID NO: 5634933 - DNA, 22 bp, Homo sapiens
taaccaatctacaatctccctt

SEQ ID NO: 5634934 - DNA, 14 bp, Homo sapiens
taaccaatgtttaa

SEQ ID NO: 5634935 - DNA, 17 bp, Homo sapiens
taaccaattcctcattt

SEQ ID NO: 5634936 - DNA, 22 bp, Homo sapiens
taaccacaaggtccactccctg

SEQ ID NO: 5634937 - DNA, 13 bp, Homo sapiens
taaccacagctcc

SEQ ID NO: 5634938 - DNA, 21 bp, Homo sapiens
taaccacagctccttttccag

SEQ ID NO: 5634939 - DNA, 16 bp, Homo sapiens
taaccacattttagga

SEQ ID NO: 5634940 - DNA, 11 bp, Homo sapiens
taaccacccca

SEQ ID NO: 5634941 - DNA, 23 bp, Homo sapiens
taaccaccgcatatgcatgccag

SEQ ID NO: 5634942 - DNA, 17 bp, Homo sapiens
taaccactaacattgtg

SEQ ID NO: 5634943 - DNA, 20 bp, Homo sapiens
taaccactcctcaggaacag

SEQ ID NO: 5634944 - DNA, 20 bp, Homo sapiens
taaccactgcaagtcctttt

SEQ ID NO: 5634945 - DNA, 13 bp, Homo sapiens
taaccactgcttc

SEQ ID NO: 5634946 - DNA, 20 bp, Homo sapiens
taaccacttaaaaaatgtcc

SEQ ID NO: 5634947 - DNA, 22 bp, Homo sapiens
taaccacttatcagtgtattga

SEQ ID NO: 5634948 - DNA, 16 bp, Homo sapiens
taaccacttcagctga

SEQ ID NO: 5634949 - DNA, 22 bp, Homo sapiens
taaccacttcgcacacacccat

SEQ ID NO: 5634950 - DNA, 16 bp, Homo sapiens
taaccagacacaaact

SEQ ID NO: 5634951 - DNA, 21 bp, Homo sapiens
taaccagagcaagctttttta

SEQ ID NO: 5634952 - DNA, 13 bp, Homo sapiens
taaccagatcatt

SEQ ID NO: 5634953 - DNA, 21 bp, Homo sapiens
taaccagatggttgtgtatgg

SEQ ID NO: 5634954 - DNA, 18 bp, Homo sapiens
taaccagcacatttctcc

SEQ ID NO: 5634955 - DNA, 14 bp, Homo sapiens
taaccagcagaaat

SEQ ID NO: 5634956 - DNA, 15 bp, Homo sapiens
taaccagcattccct

SEQ ID NO: 5634957 - DNA, 18 bp, Homo sapiens
taaccagccacagtacat

SEQ ID NO: 5634958 - DNA, 20 bp, Homo sapiens
taaccagccacagtacatat

SEQ ID NO: 5634959 - DNA, 21 bp, Homo sapiens
taaccagccacagtacatatg

SEQ ID NO: 5634960 - DNA, 23 bp, Homo sapiens
taaccagccacagtacatatgta

SEQ ID NO: 5634961 - DNA, 18 bp, Homo sapiens
taaccagctcagtgtttt

SEQ ID NO: 5634962 - DNA, 20 bp, Homo sapiens
taaccagctcagtgttttgg

SEQ ID NO: 5634963 - DNA, 13 bp, Homo sapiens
taaccaggcccag

SEQ ID NO: 5634964 - DNA, 14 bp, Homo sapiens
taaccaggcccagc

SEQ ID NO: 5634965 - DNA, 16 bp, Homo sapiens
taaccaggcccagcca

SEQ ID NO: 5634966 - DNA, 19 bp, Homo sapiens
taaccaggccccagcctcc

SEQ ID NO: 5634967 - DNA, 18 bp, Homo sapiens
taaccagtacttctaaga

SEQ ID NO: 5634968 - DNA, 21 bp, Homo sapiens
taaccagtacttctaagagca

SEQ ID NO: 5634969 - DNA, 15 bp, Homo sapiens
taaccagtgcagaaa

SEQ ID NO: 5634970 - DNA, 18 bp, Homo sapiens
taaccagttttttcacct

SEQ ID NO: 5634971 - DNA, 14 bp, Homo sapiens
taaccatccccaac

SEQ ID NO: 5634972 - DNA, 21 bp, Homo sapiens
taaccatgggctcagggccag

SEQ ID NO: 5634973 - DNA, 17 bp, Homo sapiens
taaccatggtgcttgtt

SEQ ID NO: 5634974 - DNA, 17 bp, Homo sapiens
taaccatgttgtgttct

SEQ ID NO: 5634975 - DNA, 19 bp, Homo sapiens
taaccatgttgtgttcttc

SEQ ID NO: 5634976 - DNA, 15 bp, Homo sapiens
taaccattaagaaat

SEQ ID NO: 5634977 - DNA, 16 bp, Homo sapiens
taaccattaagtcatg

SEQ ID NO: 5634978 - DNA, 16 bp, Homo sapiens
taaccattacatgttt

SEQ ID NO: 5634979 - DNA, 15 bp, Homo sapiens
taaccattctgtcca

SEQ ID NO: 5634980 - DNA, 23 bp, Homo sapiens
taaccattgtcttgttctgtgat

SEQ ID NO: 5634981 - DNA, 18 bp, Homo sapiens
taaccatttaaagaaaga

SEQ ID NO: 5634982 - DNA, 18 bp, Homo sapiens
taaccattttataaagtg

SEQ ID NO: 5634983 - DNA, 14 bp, Homo sapiens
taaccattttcctt

SEQ ID NO: 5634984 - DNA, 18 bp, Homo sapiens
taaccattttcctttgga

SEQ ID NO: 5634985 - DNA, 15 bp, Homo sapiens
taacccacctctcct

SEQ ID NO: 5634986 - DNA, 18 bp, Homo sapiens
taacccacctctcctgcc

SEQ ID NO: 5634987 - DNA, 21 bp, Homo sapiens
taacccacctctcctgccctg

SEQ ID NO: 5634988 - DNA, 14 bp, Homo sapiens
taacccacttgtca

SEQ ID NO: 5634989 - DNA, 13 bp, Homo sapiens
taacccagatttt

SEQ ID NO: 5634990 - DNA, 19 bp, Homo sapiens
taacccaggcctgtctgac

SEQ ID NO: 5634991 - DNA, 15 bp, Homo sapiens
taacccagtctttct

SEQ ID NO: 5634992 - DNA, 19 bp, Homo sapiens
taacccagtggctggaaga

SEQ ID NO: 5634993 - DNA, 14 bp, Homo sapiens
taacccagttactt

SEQ ID NO: 5634994 - DNA, 19 bp, Homo sapiens
taacccatctctgaactgg

SEQ ID NO: 5634995 - DNA, 15 bp, Homo sapiens
taaccccaaaatgaa

SEQ ID NO: 5634996 - DNA, 11 bp, Homo sapiens
taaccccaccc

SEQ ID NO: 5634997 - DNA, 13 bp, Homo sapiens
taaccccagcctg

SEQ ID NO: 5634998 - DNA, 15 bp, Homo sapiens
taaccccaggcactg

SEQ ID NO: 5634999 - DNA, 20 bp, Homo sapiens
taaccccaggcactgtttgg

SEQ ID NO: 5635000 - DNA, 21 bp, Homo sapiens
taaccccaggcatcccatccc

SEQ ID NO: 5635001 - DNA, 19 bp, Homo sapiens
taaccccagggcactgcca

SEQ ID NO: 5635002 - DNA, 16 bp, Homo sapiens
taaccccattctttgc

SEQ ID NO: 5635003 - DNA, 18 bp, Homo sapiens
taacccccactggactga

SEQ ID NO: 5635004 - DNA, 17 bp, Homo sapiens
taacccccctgtacaca

SEQ ID NO: 5635005 - DNA, 22 bp, Homo sapiens
taaccccctctgctctgtcctc

SEQ ID NO: 5635006 - DNA, 15 bp, Homo sapiens
taaccccgggcgggt

SEQ ID NO: 5635007 - DNA, 18 bp, Homo sapiens
taaccccgggcgggtggc

SEQ ID NO: 5635008 - DNA, 18 bp, Homo sapiens
taaccccgtcaacaaatc

SEQ ID NO: 5635009 - DNA, 19 bp, Homo sapiens
taacccctaagactgcctt

SEQ ID NO: 5635010 - DNA, 14 bp, Homo sapiens
taaccccttgaaac

SEQ ID NO: 5635011 - DNA, 23 bp, Homo sapiens
taacccgctcatcactggatgaa

SEQ ID NO: 5635012 - DNA, 15 bp, Homo sapiens
taaccctactttgct

SEQ ID NO: 5635013 - DNA, 17 bp, Homo sapiens
taaccctaggaatttag

SEQ ID NO: 5635014 - DNA, 22 bp, Homo sapiens
taaccctatcctaattgtccac

SEQ ID NO: 5635015 - DNA, 18 bp, Homo sapiens
taaccctcacactgctcc

SEQ ID NO: 5635016 - DNA, 21 bp, Homo sapiens
taaccctcattgctgtcttgc

SEQ ID NO: 5635017 - DNA, 18 bp, Homo sapiens
taaccctcccatggcacc

SEQ ID NO: 5635018 - DNA, 15 bp, Homo sapiens
taaccctcgccctgt

SEQ ID NO: 5635019 - DNA, 12 bp, Homo sapiens
taaccctgccag

SEQ ID NO: 5635020 - DNA, 15 bp, Homo sapiens
taaccctgccagtgc

SEQ ID NO: 5635021 - DNA, 17 bp, Homo sapiens
taaccctgccagtgcca

SEQ ID NO: 5635022 - DNA, 22 bp, Homo sapiens
taaccctgccagtgccagggtg

SEQ ID NO: 5635023 - DNA, 19 bp, Homo sapiens
taaccctgggctccctgga

SEQ ID NO: 5635024 - DNA, 18 bp, Homo sapiens
taaccctgggctgtccag

SEQ ID NO: 5635025 - DNA, 20 bp, Homo sapiens
taaccctggtggttgctgtt

SEQ ID NO: 5635026 - DNA, 18 bp, Homo sapiens
taaccctgtgctgtcaga

SEQ ID NO: 5635027 - DNA, 13 bp, Homo sapiens
taaccctgtggtt

SEQ ID NO: 5635028 - DNA, 23 bp, Homo sapiens
taacccttcaacgtttcttcact

SEQ ID NO: 5635029 - DNA, 18 bp, Homo sapiens
taacccttcatcttcctg

SEQ ID NO: 5635030 - DNA, 16 bp, Homo sapiens
taacccttgaatttct

SEQ ID NO: 5635031 - DNA, 22 bp, Homo sapiens
taaccctttctgggatgcaata

SEQ ID NO: 5635032 - DNA, 22 bp, Homo sapiens
taaccctttcttcaatacaaaa

SEQ ID NO: 5635033 - DNA, 17 bp, Homo sapiens
taaccgatgctttacca

SEQ ID NO: 5635034 - DNA, 14 bp, Homo sapiens
taaccgctccaggt

SEQ ID NO: 5635035 - DNA, 19 bp, Homo sapiens
taaccgcttctggggccac

SEQ ID NO: 5635036 - DNA, 15 bp, Homo sapiens
taacctaataattgt

SEQ ID NO: 5635037 - DNA, 13 bp, Homo sapiens
taacctacctgtg

SEQ ID NO: 5635038 - DNA, 22 bp, Homo sapiens
taactttgtggtctaaagtgtt

SEQ ID NO: 5635039 - DNA, 12 bp, Homo sapiens
taactttgtttt

SEQ ID NO: 5635040 - DNA, 17 bp, Homo sapiens
taacttttaaaagggaa

SEQ ID NO: 5635041 - DNA, 16 bp, Homo sapiens
taacttttaaatgttt

SEQ ID NO: 5635042 - DNA, 21 bp, Homo sapiens
taacttttaatccctatgttt

SEQ ID NO: 5635043 - DNA, 16 bp, Homo sapiens
taacttttaatttaaa

SEQ ID NO: 5635044 - DNA, 21 bp, Homo sapiens
taacttttataaactttacct

SEQ ID NO: 5635045 - DNA, 14 bp, Homo sapiens
taacttttatatta

SEQ ID NO: 5635046 - DNA, 20 bp, Homo sapiens
taacttttcaatgacatttt

SEQ ID NO: 5635047 - DNA, 15 bp, Homo sapiens
taacttttcaccaat

SEQ ID NO: 5635048 - DNA, 13 bp, Homo sapiens
taacttttccaag

SEQ ID NO: 5635049 - DNA, 22 bp, Homo sapiens
taacttttccttgtatgttctt

SEQ ID NO: 5635050 - DNA, 17 bp, Homo sapiens
taacttttcttgatatc

SEQ ID NO: 5635051 - DNA, 17 bp, Homo sapiens
taacttttggaatcata

SEQ ID NO: 5635052 - DNA, 15 bp, Homo sapiens
taacttttgtagtct

SEQ ID NO: 5635053 - DNA, 22 bp, Homo sapiens
taacttttgtgaattaggctgt

SEQ ID NO: 5635054 - DNA, 16 bp, Homo sapiens
taacttttgtgtgaaa

SEQ ID NO: 5635055 - DNA, 13 bp, Homo sapiens
taacttttgtttt

SEQ ID NO: 5635056 - DNA, 23 bp, Homo sapiens
taactttttaaaaaaataaaaca

SEQ ID NO: 5635057 - DNA, 16 bp, Homo sapiens
taactttttaatcatc

SEQ ID NO: 5635058 - DNA, 19 bp, Homo sapiens
taactttttaatcatctgg

SEQ ID NO: 5635059 - DNA, 15 bp, Homo sapiens
taactttttacatta

SEQ ID NO: 5635060 - DNA, 17 bp, Homo sapiens
taactttttacattaca

SEQ ID NO: 5635061 - DNA, 22 bp, Homo sapiens
taactttttacattacagaata

SEQ ID NO: 5635062 - DNA, 15 bp, Homo sapiens
taactttttatattc

SEQ ID NO: 5635063 - DNA, 16 bp, Homo sapiens
taactttttatttcta

SEQ ID NO: 5635064 - DNA, 17 bp, Homo sapiens
taactttttatttctaa

SEQ ID NO: 5635065 - DNA, 20 bp, Homo sapiens
taactttttctaagctgttt

SEQ ID NO: 5635066 - DNA, 17 bp, Homo sapiens
taactttttgtttttat

SEQ ID NO: 5635067 - DNA, 22 bp, Homo sapiens
taactttttgtttttatttctt

SEQ ID NO: 5635068 - DNA, 23 bp, Homo sapiens
taactttttgtttttatttcttt

SEQ ID NO: 5635069 - DNA, 21 bp, Homo sapiens
taactttttttcttctacttt

SEQ ID NO: 5635070 - DNA, 16 bp, Homo sapiens
taacttttttttttct

SEQ ID NO: 5635071 - DNA, 23 bp, Homo sapiens
taacttttttttttttaacatct

SEQ ID NO: 5635072 - DNA, 14 bp, Homo sapiens
taagaaaaaaaatg

SEQ ID NO: 5635073 - DNA, 17 bp, Homo sapiens
taagaaaaaaagcaaaa

SEQ ID NO: 5635074 - DNA, 21 bp, Homo sapiens
taagaaaaaaagctgcaaaaa

SEQ ID NO: 5635075 - DNA, 18 bp, Homo sapiens
taagaaaaaattactaaa

SEQ ID NO: 5635076 - DNA, 16 bp, Homo sapiens
taagaaaaaattcttt

SEQ ID NO: 5635077 - DNA, 22 bp, Homo sapiens
taagaaaaaattctttcacttg

SEQ ID NO: 5635078 - DNA, 23 bp, Homo sapiens
taagaaaaaattctttcacttga

SEQ ID NO: 5635079 - DNA, 15 bp, Homo sapiens
taagaaaaacatgtc

SEQ ID NO: 5635080 - DNA, 19 bp, Homo sapiens
taagaaaaacatgtcatgt

SEQ ID NO: 5635081 - DNA, 20 bp, Homo sapiens
taagaaaaacttttttggtt

SEQ ID NO: 5635082 - DNA, 18 bp, Homo sapiens
taagaaaaaggatgcaca

SEQ ID NO: 5635083 - DNA, 23 bp, Homo sapiens
taagaaaaaggatgcacagagtt

SEQ ID NO: 5635084 - DNA, 16 bp, Homo sapiens
taagaaaaattcacaa

SEQ ID NO: 5635085 - DNA, 17 bp, Homo sapiens
taagaaaaattcacaag

SEQ ID NO: 5635086 - DNA, 18 bp, Homo sapiens
taagaaaagagatatttt

SEQ ID NO: 5635087 - DNA, 15 bp, Homo sapiens
taagaaaagcacttt

SEQ ID NO: 5635088 - DNA, 20 bp, Homo sapiens
taagaaaagcacttttgtta

SEQ ID NO: 5635089 - DNA, 21 bp, Homo sapiens
taagaaaagcacttttgttat

SEQ ID NO: 5635090 - DNA, 19 bp, Homo sapiens
taagaaaagtattttgaag

SEQ ID NO: 5635091 - DNA, 14 bp, Homo sapiens
taagaaaatacaat

SEQ ID NO: 5635092 - DNA, 21 bp, Homo sapiens
taagaaaatatattctttcaa

SEQ ID NO: 5635093 - DNA, 20 bp, Homo sapiens
taagaaaatattctaacatt

SEQ ID NO: 5635094 - DNA, 21 bp, Homo sapiens
taagaaaatattctaacattt

SEQ ID NO: 5635095 - DNA, 17 bp, Homo sapiens
taagaaaatattttgtc

SEQ ID NO: 5635096 - DNA, 22 bp, Homo sapiens
taagaaaatattttgtctaaaa

SEQ ID NO: 5635097 - DNA, 12 bp, Homo sapiens
taagaaaattta

SEQ ID NO: 5635098 - DNA, 20 bp, Homo sapiens
taagaaacaactctttgaga

SEQ ID NO: 5635099 - DNA, 21 bp, Homo sapiens
taagaaacacagggttttgta

SEQ ID NO: 5635100 - DNA, 23 bp, Homo sapiens
taagaaacacagggttttgtatt

SEQ ID NO: 5635101 - DNA, 13 bp, Homo sapiens
taagaaacactca

SEQ ID NO: 5635102 - DNA, 19 bp, Homo sapiens
taagaaacatgatgtgaga

SEQ ID NO: 5635103 - DNA, 18 bp, Homo sapiens
taagaaacccagactgaa

SEQ ID NO: 5635104 - DNA, 23 bp, Homo sapiens
taagaaacctactgcccaggcac

SEQ ID NO: 5635105 - DNA, 20 bp, Homo sapiens
taagaaactatgaagatctg

SEQ ID NO: 5635106 - DNA, 14 bp, Homo sapiens
taagaaacttttgt

SEQ ID NO: 5635107 - DNA, 19 bp, Homo sapiens
taagaaacttttttattta

SEQ ID NO: 5635108 - DNA, 15 bp, Homo sapiens
taagaaagaaaggaa

SEQ ID NO: 5635109 - DNA, 16 bp, Homo sapiens
taagaaagaaaggaaa

SEQ ID NO: 5635110 - DNA, 21 bp, Homo sapiens
taagaaagaaaggaaagaagg

SEQ ID NO: 5635111 - DNA, 23 bp, Homo sapiens
taagaaagaaaggaaagaaggag

SEQ ID NO: 5635112 - DNA, 17 bp, Homo sapiens
taagaaagaattgcagt

SEQ ID NO: 5635113 - DNA, 12 bp, Homo sapiens
taagaaagacat

SEQ ID NO: 5635114 - DNA, 14 bp, Homo sapiens
taagaaagacatct

SEQ ID NO: 5635115 - DNA, 21 bp, Homo sapiens
taagaaagacatctttctctt

SEQ ID NO: 5635116 - DNA, 18 bp, Homo sapiens
taagaaagcacttaaaca

SEQ ID NO: 5635117 - DNA, 20 bp, Homo sapiens
taagaaagccaccttgttac

SEQ ID NO: 5635118 - DNA, 19 bp, Homo sapiens
taagaaagcctaaaattga

SEQ ID NO: 5635119 - DNA, 14 bp, Homo sapiens
taagaaagcctgag

SEQ ID NO: 5635120 - DNA, 17 bp, Homo sapiens
taagaaagcctgagtac

SEQ ID NO: 5635121 - DNA, 13 bp, Homo sapiens
taagaaagctata

SEQ ID NO: 5635122 - DNA, 15 bp, Homo sapiens
taagaaaggaagcaa

SEQ ID NO: 5635123 - DNA, 20 bp, Homo sapiens
taagaaaggaagcaacagat

SEQ ID NO: 5635124 - DNA, 13 bp, Homo sapiens
taagaaaggaagt

SEQ ID NO: 5635125 - DNA, 20 bp, Homo sapiens
taagaaaggcaaccaataaa

SEQ ID NO: 5635126 - DNA, 16 bp, Homo sapiens
taagaaagtagaggca

SEQ ID NO: 5635127 - DNA, 18 bp, Homo sapiens
taagaaagtataaagtca

SEQ ID NO: 5635128 - DNA, 18 bp, Homo sapiens
taagaaagtgaagcaaat

SEQ ID NO: 5635129 - DNA, 16 bp, Homo sapiens
taagaaataaaactgt

SEQ ID NO: 5635130 - DNA, 17 bp, Homo sapiens
taagaaataagaataaa

SEQ ID NO: 5635131 - DNA, 20 bp, Homo sapiens
taagaaataaggctaaccat

SEQ ID NO: 5635132 - DNA, 11 bp, Homo sapiens
taagaaatacc

SEQ ID NO: 5635133 - DNA, 18 bp, Homo sapiens
taagaaatactgtacaat

SEQ ID NO: 5635134 - DNA, 13 bp, Homo sapiens
taagaaatagaat

SEQ ID NO: 5635135 - DNA, 15 bp, Homo sapiens
taagaaatatctgtg

SEQ ID NO: 5635136 - DNA, 16 bp, Homo sapiens
taagaaatatgtgaga

SEQ ID NO: 5635137 - DNA, 19 bp, Homo sapiens
taagaaatcaaagagagaa

SEQ ID NO: 5635138 - DNA, 21 bp, Homo sapiens
taagaaatctcccatgtgcat

SEQ ID NO: 5635139 - DNA, 17 bp, Homo sapiens
taagaaatgaacaaaag

SEQ ID NO: 5635140 - DNA, 19 bp, Homo sapiens
taagaaatgaacaaaagat

SEQ ID NO: 5635141 - DNA, 17 bp, Homo sapiens
taagaaatgagaaattg

SEQ ID NO: 5635142 - DNA, 18 bp, Homo sapiens
taagaaatggtggaactg

SEQ ID NO: 5635143 - DNA, 18 bp, Homo sapiens
taagaaatgtagctgaag

SEQ ID NO: 5635144 - DNA, 22 bp, Homo sapiens
taagaaatgtagctgaagtaga

SEQ ID NO: 5635145 - DNA, 19 bp, Homo sapiens
taagaaattcctagtgtct

SEQ ID NO: 5635146 - DNA, 15 bp, Homo sapiens
taagaaattgaatac

SEQ ID NO: 5635147 - DNA, 21 bp, Homo sapiens
taagaaattgaatactttgaa

SEQ ID NO: 5635148 - DNA, 13 bp, Homo sapiens
taagaaattgttt

SEQ ID NO: 5635149 - DNA, 23 bp, Homo sapiens
taagaacaagttttggcagccat

SEQ ID NO: 5635150 - DNA, 17 bp, Homo sapiens
taagaacataaggcagg

SEQ ID NO: 5635151 - DNA, 22 bp, Homo sapiens
taagaacatgttacgtgtgcaa

SEQ ID NO: 5635152 - DNA, 23 bp, Homo sapiens
taagaaccaaaaaaaaaaaagga

SEQ ID NO: 5635153 - DNA, 22 bp, Homo sapiens
taagaaccaaactcctatttca

SEQ ID NO: 5635154 - DNA, 18 bp, Homo sapiens
taagaaccattgatttaa

SEQ ID NO: 5635155 - DNA, 14 bp, Homo sapiens
taagaacctggaac

SEQ ID NO: 5635156 - DNA, 15 bp, Homo sapiens
taagaaccttaatga

SEQ ID NO: 5635157 - DNA, 17 bp, Homo sapiens
taagaaccttaatgaca

SEQ ID NO: 5635158 - DNA, 18 bp, Homo sapiens
taagaaccttaatgacaa

SEQ ID NO: 5635159 - DNA, 22 bp, Homo sapiens
taagaaccttttgagtgcctta

SEQ ID NO: 5635160 - DNA, 15 bp, Homo sapiens
taagaacgaggattt

SEQ ID NO: 5635161 - DNA, 19 bp, Homo sapiens
taagaacgtactttctgtt

SEQ ID NO: 5635162 - DNA, 12 bp, Homo sapiens
taagaactgaat

SEQ ID NO: 5635163 - DNA, 18 bp, Homo sapiens
taagaactgaatccatat

SEQ ID NO: 5635164 - DNA, 22 bp, Homo sapiens
taagaactgctttctttcgttt

SEQ ID NO: 5635165 - DNA, 22 bp, Homo sapiens
taagaacttcatgggccttcca

SEQ ID NO: 5635166 - DNA, 18 bp, Homo sapiens
taagaagaaggccagaga

SEQ ID NO: 5635167 - DNA, 14 bp, Homo sapiens
taagaagacatgaa

SEQ ID NO: 5635168 - DNA, 14 bp, Homo sapiens
taagaagacatgac

SEQ ID NO: 5635169 - DNA, 15 bp, Homo sapiens
taagaagacatgaca

SEQ ID NO: 5635170 - DNA, 17 bp, Homo sapiens
taagaagacatgacaat

SEQ ID NO: 5635171 - DNA, 19 bp, Homo sapiens
taagaagagactgggaaga

SEQ ID NO: 5635172 - DNA, 15 bp, Homo sapiens
taagaagaggagcct

SEQ ID NO: 5635173 - DNA, 17 bp, Homo sapiens
taagaagaggagcctca

SEQ ID NO: 5635174 - DNA, 19 bp, Homo sapiens
taagaagaggagcctcaga

SEQ ID NO: 5635175 - DNA, 20 bp, Homo sapiens
taagaagaggagcctcagaa

SEQ ID NO: 5635176 - DNA, 21 bp, Homo sapiens
taagaagagtttttattacaa

SEQ ID NO: 5635177 - DNA, 17 bp, Homo sapiens
taagaagattctcgccc

SEQ ID NO: 5635178 - DNA, 20 bp, Homo sapiens
taagaagcaatctttgaaat

SEQ ID NO: 5635179 - DNA, 19 bp, Homo sapiens
taagaagccccttattttt

SEQ ID NO: 5635180 - DNA, 23 bp, Homo sapiens
taagaagccttaatttgcacagt

SEQ ID NO: 5635181 - DNA, 11 bp, Homo sapiens
taagaagctct

SEQ ID NO: 5635182 - DNA, 18 bp, Homo sapiens
taagaagctgttgtacat

SEQ ID NO: 5635183 - DNA, 21 bp, Homo sapiens
taagaagctgttgtacattta

SEQ ID NO: 5635184 - DNA, 22 bp, Homo sapiens
taagaagcttctaataaattat

SEQ ID NO: 5635185 - DNA, 18 bp, Homo sapiens
taagaaggcaaaaatgta

SEQ ID NO: 5635186 - DNA, 20 bp, Homo sapiens
taagaagggatggattccaa

SEQ ID NO: 5635187 - DNA, 12 bp, Homo sapiens
taagaagggtgg

SEQ ID NO: 5635188 - DNA, 16 bp, Homo sapiens
taagaagtacaataag

SEQ ID NO: 5635189 - DNA, 22 bp, Homo sapiens
taagaagtagagaacccagatg

SEQ ID NO: 5635190 - DNA, 18 bp, Homo sapiens
taagaagtgaaaatctac

SEQ ID NO: 5635191 - DNA, 15 bp, Homo sapiens
taagaagttactttt

SEQ ID NO: 5635192 - DNA, 21 bp, Homo sapiens
taagaagttcaccagccctga

SEQ ID NO: 5635193 - DNA, 18 bp, Homo sapiens
taagaagttgaactatga

SEQ ID NO: 5635194 - DNA, 13 bp, Homo sapiens
taagaagtttgtg

SEQ ID NO: 5635195 - DNA, 21 bp, Homo sapiens
taagaagtttgttatagattt

SEQ ID NO: 5635196 - DNA, 17 bp, Homo sapiens
taagaataaaatgttga

SEQ ID NO: 5635197 - DNA, 15 bp, Homo sapiens
taagaataaacattt

SEQ ID NO: 5635198 - DNA, 17 bp, Homo sapiens
taagaataataaaatca

SEQ ID NO: 5635199 - DNA, 14 bp, Homo sapiens
taagaatacagctt

SEQ ID NO: 5635200 - DNA, 23 bp, Homo sapiens
taagaataccacatcaaataaga

SEQ ID NO: 5635201 - DNA, 20 bp, Homo sapiens
taagaataggtcattttcta

SEQ ID NO: 5635202 - DNA, 20 bp, Homo sapiens
taagaatagtctctgggttt

SEQ ID NO: 5635203 - DNA, 14 bp, Homo sapiens
taagaatatttgaa

SEQ ID NO: 5635204 - DNA, 21 bp, Homo sapiens
taagaatcagagtagaaataa

SEQ ID NO: 5635205 - DNA, 12 bp, Homo sapiens
taagaatcatgg

SEQ ID NO: 5635206 - DNA, 13 bp, Homo sapiens
taagaatcatgga

SEQ ID NO: 5635207 - DNA, 19 bp, Homo sapiens
taagaatcatggatttatt

SEQ ID NO: 5635208 - DNA, 21 bp, Homo sapiens
taagaatcattgtaaacatta

SEQ ID NO: 5635209 - DNA, 14 bp, Homo sapiens
taagaatctttaga

SEQ ID NO: 5635210 - DNA, 15 bp, Homo sapiens
taagaatgaaatact

SEQ ID NO: 5635211 - DNA, 12 bp, Homo sapiens
taagaatgaaca

SEQ ID NO: 5635212 - DNA, 14 bp, Homo sapiens
taagaatgaacaca

SEQ ID NO: 5635213 - DNA, 15 bp, Homo sapiens
taagaatgagcctgt

SEQ ID NO: 5635214 - DNA, 22 bp, Homo sapiens
taagcaggtggatctatttcat

SEQ ID NO: 5635215 - DNA, 15 bp, Homo sapiens
taagcagtaatctgt

SEQ ID NO: 5635216 - DNA, 18 bp, Homo sapiens
taagcagtaatctgtcag

SEQ ID NO: 5635217 - DNA, 15 bp, Homo sapiens
taagcagtacatctt

SEQ ID NO: 5635218 - DNA, 15 bp, Homo sapiens
taagcagttcattct

SEQ ID NO: 5635219 - DNA, 21 bp, Homo sapiens
taagcagttcattctaccaag

SEQ ID NO: 5635220 - DNA, 21 bp, Homo sapiens
taagcataagcttatgcttaa

SEQ ID NO: 5635221 - DNA, 17 bp, Homo sapiens
taagcatactttgtaaa

SEQ ID NO: 5635222 - DNA, 19 bp, Homo sapiens
taagcatactttgtaaata

SEQ ID NO: 5635223 - DNA, 13 bp, Homo sapiens
taagcatatattt

SEQ ID NO: 5635224 - DNA, 16 bp, Homo sapiens
taagcatatattttta

SEQ ID NO: 5635225 - DNA, 19 bp, Homo sapiens
taagcatatatttttatat

SEQ ID NO: 5635226 - DNA, 22 bp, Homo sapiens
taagcatatcgtaaagctgttc

SEQ ID NO: 5635227 - DNA, 20 bp, Homo sapiens
taagcatatgtgttacttca

SEQ ID NO: 5635228 - DNA, 16 bp, Homo sapiens
taagcatcaaactctt

SEQ ID NO: 5635229 - DNA, 13 bp, Homo sapiens
taagcatcacaaa

SEQ ID NO: 5635230 - DNA, 14 bp, Homo sapiens
taagcatcattatt

SEQ ID NO: 5635231 - DNA, 22 bp, Homo sapiens
taagcatcattatttatgtatt

SEQ ID NO: 5635232 - DNA, 23 bp, Homo sapiens
taagcatcattatttatgtattg

SEQ ID NO: 5635233 - DNA, 23 bp, Homo sapiens
taagcatctaaggacaaggtaag

SEQ ID NO: 5635234 - DNA, 15 bp, Homo sapiens
taagcatctacttca

SEQ ID NO: 5635235 - DNA, 21 bp, Homo sapiens
taagcatcttgtcaagaaata

SEQ ID NO: 5635236 - DNA, 14 bp, Homo sapiens
taagcatgagtggc

SEQ ID NO: 5635237 - DNA, 16 bp, Homo sapiens
taagcatggcctggac

SEQ ID NO: 5635238 - DNA, 21 bp, Homo sapiens
taagcattaccactcaggcat

SEQ ID NO: 5635239 - DNA, 16 bp, Homo sapiens
taagcattactcttgt

SEQ ID NO: 5635240 - DNA, 20 bp, Homo sapiens
taagcattactcttgtaaga

SEQ ID NO: 5635241 - DNA, 22 bp, Homo sapiens
taagcattactcttgtaagatt

SEQ ID NO: 5635242 - DNA, 21 bp, Homo sapiens
taagcattagctttaattaag

SEQ ID NO: 5635243 - DNA, 16 bp, Homo sapiens
taagcattccaactat

SEQ ID NO: 5635244 - DNA, 18 bp, Homo sapiens
taagcattccaactatct

SEQ ID NO: 5635245 - DNA, 14 bp, Homo sapiens
taagcattgccatt

SEQ ID NO: 5635246 - DNA, 17 bp, Homo sapiens
taagcattgccattgaa

SEQ ID NO: 5635247 - DNA, 15 bp, Homo sapiens
taagcattgcctggc

SEQ ID NO: 5635248 - DNA, 16 bp, Homo sapiens
taagcatttgtatatt

SEQ ID NO: 5635249 - DNA, 19 bp, Homo sapiens
taagcattttctacacagc

SEQ ID NO: 5635250 - DNA, 16 bp, Homo sapiens
taagccaaaacaatgt

SEQ ID NO: 5635251 - DNA, 15 bp, Homo sapiens
taagccaaaactgag

SEQ ID NO: 5635252 - DNA, 13 bp, Homo sapiens
taagccaaaatgc

SEQ ID NO: 5635253 - DNA, 21 bp, Homo sapiens
taagccaaaattaaggtgttt

SEQ ID NO: 5635254 - DNA, 11 bp, Homo sapiens
taagccaaaga

SEQ ID NO: 5635255 - DNA, 23 bp, Homo sapiens
taagccaaagaaatgaacattcc

SEQ ID NO: 5635256 - DNA, 19 bp, Homo sapiens
taagccaacaaccacagtg

SEQ ID NO: 5635257 - DNA, 13 bp, Homo sapiens
taagccaagctgt

SEQ ID NO: 5635258 - DNA, 17 bp, Homo sapiens
taagccaagctgtgttc

SEQ ID NO: 5635259 - DNA, 18 bp, Homo sapiens
taagccaagctgtgttca

SEQ ID NO: 5635260 - DNA, 14 bp, Homo sapiens
taagccaagggcct

SEQ ID NO: 5635261 - DNA, 18 bp, Homo sapiens
taagccaataaataatat

SEQ ID NO: 5635262 - DNA, 18 bp, Homo sapiens
taagccaatttttctgca

SEQ ID NO: 5635263 - DNA, 22 bp, Homo sapiens
taagccacaagaaatttgattt

SEQ ID NO: 5635264 - DNA, 19 bp, Homo sapiens
taagccactgcctctccct

SEQ ID NO: 5635265 - DNA, 23 bp, Homo sapiens
taagccactgcctctccctctgg

SEQ ID NO: 5635266 - DNA, 17 bp, Homo sapiens
taagccactggtatctg

SEQ ID NO: 5635267 - DNA, 20 bp, Homo sapiens
taagccacttaaaatgttca

SEQ ID NO: 5635268 - DNA, 13 bp, Homo sapiens
taagccagacatc

SEQ ID NO: 5635269 - DNA, 20 bp, Homo sapiens
taagccagacatcaacagat

SEQ ID NO: 5635270 - DNA, 14 bp, Homo sapiens
taagccagagcctg

SEQ ID NO: 5635271 - DNA, 16 bp, Homo sapiens
taagccagagcctggg

SEQ ID NO: 5635272 - DNA, 17 bp, Homo sapiens
taagccagagtgtatta

SEQ ID NO: 5635273 - DNA, 13 bp, Homo sapiens
taagccagcctgg

SEQ ID NO: 5635274 - DNA, 15 bp, Homo sapiens
taagccagctgcccc

SEQ ID NO: 5635275 - DNA, 17 bp, Homo sapiens
taagccaggaaacatga

SEQ ID NO: 5635276 - DNA, 13 bp, Homo sapiens
taagccaggcctg

SEQ ID NO: 5635277 - DNA, 19 bp, Homo sapiens
taagccagtgttgcctaag

SEQ ID NO: 5635278 - DNA, 20 bp, Homo sapiens
taagccatatgacaatttca

SEQ ID NO: 5635279 - DNA, 17 bp, Homo sapiens
taagccatgagaatgtt

SEQ ID NO: 5635280 - DNA, 15 bp, Homo sapiens
taagccatgggagac

SEQ ID NO: 5635281 - DNA, 19 bp, Homo sapiens
taagccattctgactcata

SEQ ID NO: 5635282 - DNA, 20 bp, Homo sapiens
taagcccagtgctgctgtaa

SEQ ID NO: 5635283 - DNA, 17 bp, Homo sapiens
taagccccagcaagcaa

SEQ ID NO: 5635284 - DNA, 22 bp, Homo sapiens
taagccccagcaagcaatccta

SEQ ID NO: 5635285 - DNA, 23 bp, Homo sapiens
taagcccccagggcctccagggc

SEQ ID NO: 5635286 - DNA, 19 bp, Homo sapiens
taagccctcgaaccaaggc

SEQ ID NO: 5635287 - DNA, 22 bp, Homo sapiens
taagccctcgaaccaaggcagc

SEQ ID NO: 5635288 - DNA, 16 bp, Homo sapiens
taagccctgccccggg

SEQ ID NO: 5635289 - DNA, 14 bp, Homo sapiens
taagccctgctctt

SEQ ID NO: 5635290 - DNA, 13 bp, Homo sapiens
taagccctggcag

SEQ ID NO: 5635291 - DNA, 15 bp, Homo sapiens
taagccctggccccc

SEQ ID NO: 5635292 - DNA, 16 bp, Homo sapiens
taagccctgtcgagac

SEQ ID NO: 5635293 - DNA, 15 bp, Homo sapiens
taagcccttaataat

SEQ ID NO: 5635294 - DNA, 16 bp, Homo sapiens
taagcccttaataata

SEQ ID NO: 5635295 - DNA, 16 bp, Homo sapiens
taagccgcagacctgg

SEQ ID NO: 5635296 - DNA, 21 bp, Homo sapiens
taagccgcagacctggagctt

SEQ ID NO: 5635297 - DNA, 16 bp, Homo sapiens
taagcctaaaagtggg

SEQ ID NO: 5635298 - DNA, 17 bp, Homo sapiens
taagcctaatatttatg

SEQ ID NO: 5635299 - DNA, 18 bp, Homo sapiens
taagcctaccgtatttca

SEQ ID NO: 5635300 - DNA, 18 bp, Homo sapiens
taagcctatacgtttctg

SEQ ID NO: 5635301 - DNA, 22 bp, Homo sapiens
taagcctatatatatagtcaaa

SEQ ID NO: 5635302 - DNA, 18 bp, Homo sapiens
taagcctcaaatttgaac

SEQ ID NO: 5635303 - DNA, 12 bp, Homo sapiens
taagcctcaggc

SEQ ID NO: 5635304 - DNA, 20 bp, Homo sapiens
taagcctcaggcctggccct

SEQ ID NO: 5635305 - DNA, 21 bp, Homo sapiens
taagcctcaggcctggccctt

SEQ ID NO: 5635306 - DNA, 17 bp, Homo sapiens
taagcctcatatttaaa

SEQ ID NO: 5635307 - DNA, 17 bp, Homo sapiens
taagcctccatttagtt

SEQ ID NO: 5635308 - DNA, 21 bp, Homo sapiens
taagcctccatttagttcttt

SEQ ID NO: 5635309 - DNA, 11 bp, Homo sapiens
taagcctggac

SEQ ID NO: 5635310 - DNA, 10 bp, Homo sapiens
taagcctggc

SEQ ID NO: 5635311 - DNA, 13 bp, Homo sapiens
taagcctggctta

SEQ ID NO: 5635312 - DNA, 13 bp, Homo sapiens
taagcctgtggct

SEQ ID NO: 5635313 - DNA, 16 bp, Homo sapiens
taagccttataaacca

SEQ ID NO: 5635314 - DNA, 20 bp, Homo sapiens
taagccttataaaccaatct

SEQ ID NO: 5635315 - DNA, 20 bp, Homo sapiens
taagccttcgaaaagaaatt

SEQ ID NO: 5635316 - DNA, 21 bp, Homo sapiens
taagcctttgttgaactgtta

SEQ ID NO: 5635317 - DNA, 20 bp, Homo sapiens
taagccttttatactgatta

SEQ ID NO: 5635318 - DNA, 22 bp, Homo sapiens
taagcgctagaggaagcagcca

SEQ ID NO: 5635319 - DNA, 13 bp, Homo sapiens
taagcggaataaa

SEQ ID NO: 5635320 - DNA, 16 bp, Homo sapiens
taagcgggatcccagc

SEQ ID NO: 5635321 - DNA, 22 bp, Homo sapiens
taagcggtggaggaaggctctg

SEQ ID NO: 5635322 - DNA, 18 bp, Homo sapiens
taagcggtggtttgtaat

SEQ ID NO: 5635323 - DNA, 17 bp, Homo sapiens
taagcgttaagggcaga

SEQ ID NO: 5635324 - DNA, 18 bp, Homo sapiens
taagctaaagaaactgct

SEQ ID NO: 5635325 - DNA, 15 bp, Homo sapiens
taagctactagcaaa

SEQ ID NO: 5635326 - DNA, 14 bp, Homo sapiens
taagctactgccat

SEQ ID NO: 5635327 - DNA, 21 bp, Homo sapiens
taagctacttattcatagttt

SEQ ID NO: 5635328 - DNA, 18 bp, Homo sapiens
taagctagaagaagtgag

SEQ ID NO: 5635329 - DNA, 17 bp, Homo sapiens
taagctaggaaaagaaa

SEQ ID NO: 5635330 - DNA, 18 bp, Homo sapiens
taagctagttgaatactt

SEQ ID NO: 5635331 - DNA, 20 bp, Homo sapiens
taagctagttgaatacttga

SEQ ID NO: 5635332 - DNA, 21 bp, Homo sapiens
taagctagttgaatacttgaa

SEQ ID NO: 5635333 - DNA, 22 bp, Homo sapiens
taagctatcacctagcagcctc

SEQ ID NO: 5635334 - DNA, 21 bp, Homo sapiens
taagctatgagttgaaatgtt

SEQ ID NO: 5635335 - DNA, 22 bp, Homo sapiens
taagctatgagttgaaatgttc

SEQ ID NO: 5635336 - DNA, 17 bp, Homo sapiens
taagctatggcccatct

SEQ ID NO: 5635337 - DNA, 15 bp, Homo sapiens
taagctatttgatgt

SEQ ID NO: 5635338 - DNA, 23 bp, Homo sapiens
taagctatttgatgtaatacttc

SEQ ID NO: 5635339 - DNA, 21 bp, Homo sapiens
taagctatttttctaactaca

SEQ ID NO: 5635340 - DNA, 20 bp, Homo sapiens
taagctcaaggcgtgaggat

SEQ ID NO: 5635341 - DNA, 12 bp, Homo sapiens
taagctcagaat

SEQ ID NO: 5635342 - DNA, 20 bp, Homo sapiens
taagctcaggatatggctta

SEQ ID NO: 5635343 - DNA, 15 bp, Homo sapiens
taagctcagtgctct

SEQ ID NO: 5635344 - DNA, 13 bp, Homo sapiens
taagctccagctt

SEQ ID NO: 5635345 - DNA, 16 bp, Homo sapiens
taagctccatgtgcat

SEQ ID NO: 5635346 - DNA, 17 bp, Homo sapiens
taagctccatgtgcata

SEQ ID NO: 5635347 - DNA, 19 bp, Homo sapiens
taagctccatgtgcatata

SEQ ID NO: 5635348 - DNA, 22 bp, Homo sapiens
taagctcccagggcctgtctca

SEQ ID NO: 5635349 - DNA, 16 bp, Homo sapiens
taagctcccctgcctt

SEQ ID NO: 5635350 - DNA, 20 bp, Homo sapiens
taagctccttcagtttgaag

SEQ ID NO: 5635351 - DNA, 19 bp, Homo sapiens
taagctctatctgcaatgt

SEQ ID NO: 5635352 - DNA, 16 bp, Homo sapiens
taagctctctgggcct

SEQ ID NO: 5635353 - DNA, 16 bp, Homo sapiens
taagctctgagctgtc

SEQ ID NO: 5635354 - DNA, 15 bp, Homo sapiens
taagctctgcccctt

SEQ ID NO: 5635355 - DNA, 17 bp, Homo sapiens
taagctctttgagaact

SEQ ID NO: 5635356 - DNA, 13 bp, Homo sapiens
taagctgagccac

SEQ ID NO: 5635357 - DNA, 18 bp, Homo sapiens
taagctgatattatttct

SEQ ID NO: 5635358 - DNA, 10 bp, Homo sapiens
taagctgcaa

SEQ ID NO: 5635359 - DNA, 14 bp, Homo sapiens
taagctgcagcttc

SEQ ID NO: 5635360 - DNA, 14 bp, Homo sapiens
taagctgcaggcac

SEQ ID NO: 5635361 - DNA, 22 bp, Homo sapiens
taagctgcaggcacacacgcct

SEQ ID NO: 5635362 - DNA, 13 bp, Homo sapiens
taagctgctgaat

SEQ ID NO: 5635363 - DNA, 12 bp, Homo sapiens
taagctgctttt

SEQ ID NO: 5635364 - DNA, 16 bp, Homo sapiens
taagctggactagtgt

SEQ ID NO: 5635365 - DNA, 18 bp, Homo sapiens
taagctggagctcttgga

SEQ ID NO: 5635366 - DNA, 20 bp, Homo sapiens
taagctggctctgtttgatg

SEQ ID NO: 5635367 - DNA, 19 bp, Homo sapiens
taagctggtttacagatgt

SEQ ID NO: 5635368 - DNA, 21 bp, Homo sapiens
taagctggtttacagatgttt

SEQ ID NO: 5635369 - DNA, 22 bp, Homo sapiens
taagctgtgcaattactgcctg

SEQ ID NO: 5635370 - DNA, 13 bp, Homo sapiens
taagctgtgtctg

SEQ ID NO: 5635371 - DNA, 13 bp, Homo sapiens
taagctgtttatt

SEQ ID NO: 5635372 - DNA, 21 bp, Homo sapiens
taagctgtttattttatatta

SEQ ID NO: 5635373 - DNA, 16 bp, Homo sapiens
taagctgtttccatag

SEQ ID NO: 5635374 - DNA, 20 bp, Homo sapiens
taagctgtttgccaagctga

SEQ ID NO: 5635375 - DNA, 21 bp, Homo sapiens
taagctgtttgccaagctgaa

SEQ ID NO: 5635376 - DNA, 16 bp, Homo sapiens
taagcttaaaaaaaac

SEQ ID NO: 5635377 - DNA, 17 bp, Homo sapiens
taagcttaaaaaaaact

SEQ ID NO: 5635378 - DNA, 14 bp, Homo sapiens
taagcttaaaataa

SEQ ID NO: 5635379 - DNA, 19 bp, Homo sapiens
taagcttaaaataagtgaa

SEQ ID NO: 5635380 - DNA, 19 bp, Homo sapiens
taagcttaacatttcatgt

SEQ ID NO: 5635381 - DNA, 18 bp, Homo sapiens
taagcttatttaattaaa

SEQ ID NO: 5635382 - DNA, 17 bp, Homo sapiens
taagcttcagttgcttg

SEQ ID NO: 5635383 - DNA, 23 bp, Homo sapiens
taagcttccaggctgcatagaag

SEQ ID NO: 5635384 - DNA, 19 bp, Homo sapiens
taagcttctagacactcct

SEQ ID NO: 5635385 - DNA, 22 bp, Homo sapiens
taagctttatttatttctttgt

SEQ ID NO: 5635386 - DNA, 16 bp, Homo sapiens
taagctttctcctttg

SEQ ID NO: 5635387 - DNA, 18 bp, Homo sapiens
taagctttgccagctgct

SEQ ID NO: 5635388 - DNA, 17 bp, Homo sapiens
taagctttgtaattcag

SEQ ID NO: 5635389 - DNA, 15 bp, Homo sapiens
taagctttgttctgg

SEQ ID NO: 5635390 - DNA, 17 bp, Homo sapiens
taagcttttaagaaaaa

SEQ ID NO: 5635391 - DNA, 16 bp, Homo sapiens
taagtctgatgttctt

SEQ ID NO: 5635392 - DNA, 21 bp, Homo sapiens
taagtctgatttttaagattt

SEQ ID NO: 5635393 - DNA, 14 bp, Homo sapiens
taagtctgggcact

SEQ ID NO: 5635394 - DNA, 19 bp, Homo sapiens
taagtctgtcttgccttca

SEQ ID NO: 5635395 - DNA, 13 bp, Homo sapiens
taagtctgtttta

SEQ ID NO: 5635396 - DNA, 21 bp, Homo sapiens
taagtctgttttatgacttca

SEQ ID NO: 5635397 - DNA, 16 bp, Homo sapiens
taagtcttactgtttt

SEQ ID NO: 5635398 - DNA, 22 bp, Homo sapiens
taagtcttatcaagcagccaag

SEQ ID NO: 5635399 - DNA, 14 bp, Homo sapiens
taagtctttactct

SEQ ID NO: 5635400 - DNA, 16 bp, Homo sapiens
taagtctttttgaagt

SEQ ID NO: 5635401 - DNA, 22 bp, Homo sapiens
taagtcttttttttttccaaat

SEQ ID NO: 5635402 - DNA, 19 bp, Homo sapiens
taagtgaaaataatttgtt

SEQ ID NO: 5635403 - DNA, 15 bp, Homo sapiens
taagtgaaaatatag

SEQ ID NO: 5635404 - DNA, 15 bp, Homo sapiens
taagtgaaaatctta

SEQ ID NO: 5635405 - DNA, 11 bp, Homo sapiens
taagtgaaatt

SEQ ID NO: 5635406 - DNA, 12 bp, Homo sapiens
taagtgaaattt

SEQ ID NO: 5635407 - DNA, 15 bp, Homo sapiens
taagtgaaattttaa

SEQ ID NO: 5635408 - DNA, 23 bp, Homo sapiens
taagtgaactaccatgctttgtt

SEQ ID NO: 5635409 - DNA, 19 bp, Homo sapiens
taagtgaagaatacatcag

SEQ ID NO: 5635410 - DNA, 21 bp, Homo sapiens
taagtgaagcctaccagaaga

SEQ ID NO: 5635411 - DNA, 17 bp, Homo sapiens
taagtgaagtaaaactt

SEQ ID NO: 5635412 - DNA, 18 bp, Homo sapiens
taagtgaatctaataaaa

SEQ ID NO: 5635413 - DNA, 20 bp, Homo sapiens
taagtgaatctaataaaatg

SEQ ID NO: 5635414 - DNA, 14 bp, Homo sapiens
taagtgaatttata

SEQ ID NO: 5635415 - DNA, 15 bp, Homo sapiens
taagtgacacagaca

SEQ ID NO: 5635416 - DNA, 19 bp, Homo sapiens
taagtgacacagacatttt

SEQ ID NO: 5635417 - DNA, 21 bp, Homo sapiens
taagtgacacagacattttgt

SEQ ID NO: 5635418 - DNA, 23 bp, Homo sapiens
taagtgacatagataagaacttt

SEQ ID NO: 5635419 - DNA, 21 bp, Homo sapiens
taagtgaccttctgatcttgg

SEQ ID NO: 5635420 - DNA, 12 bp, Homo sapiens
taagtgactacc

SEQ ID NO: 5635421 - DNA, 17 bp, Homo sapiens
taagtgagtttttaatg

SEQ ID NO: 5635422 - DNA, 19 bp, Homo sapiens
taagtgatattcatttaaa

SEQ ID NO: 5635423 - DNA, 22 bp, Homo sapiens
taagtgatgtgctgaattttat

SEQ ID NO: 5635424 - DNA, 22 bp, Homo sapiens
taagtgattgctggttttagtt

SEQ ID NO: 5635425 - DNA, 18 bp, Homo sapiens
taagtgatttttttgtcc

SEQ ID NO: 5635426 - DNA, 18 bp, Homo sapiens
taagtgcaaacacagcat

SEQ ID NO: 5635427 - DNA, 19 bp, Homo sapiens
taagtgcaacatttctgta

SEQ ID NO: 5635428 - DNA, 14 bp, Homo sapiens
taagtgcacaacat

SEQ ID NO: 5635429 - DNA, 15 bp, Homo sapiens
taagtgcacacagaa

SEQ ID NO: 5635430 - DNA, 18 bp, Homo sapiens
taagtgcacacagaaata

SEQ ID NO: 5635431 - DNA, 12 bp, Homo sapiens
taagtgcacttt

SEQ ID NO: 5635432 - DNA, 16 bp, Homo sapiens
taagtgcactttttta

SEQ ID NO: 5635433 - DNA, 22 bp, Homo sapiens
taagtgcagcttgacattatgt

SEQ ID NO: 5635434 - DNA, 18 bp, Homo sapiens
taagtgcatttattgcct

SEQ ID NO: 5635435 - DNA, 22 bp, Homo sapiens
taagtgccaggatggaatgatg

SEQ ID NO: 5635436 - DNA, 14 bp, Homo sapiens
taagtgcccaaagt

SEQ ID NO: 5635437 - DNA, 21 bp, Homo sapiens
taagtgccctctcccaccctc

SEQ ID NO: 5635438 - DNA, 13 bp, Homo sapiens
taagtgccttcca

SEQ ID NO: 5635439 - DNA, 23 bp, Homo sapiens
taagtgcgaagactgagccagat

SEQ ID NO: 5635440 - DNA, 18 bp, Homo sapiens
taagtgcgtgtgtagagt

SEQ ID NO: 5635441 - DNA, 16 bp, Homo sapiens
taagtgctacataaat

SEQ ID NO: 5635442 - DNA, 20 bp, Homo sapiens
taagtgctgtataaaatcag

SEQ ID NO: 5635443 - DNA, 22 bp, Homo sapiens
taagtgctgtataaaatcagcc

SEQ ID NO: 5635444 - DNA, 22 bp, Homo sapiens
taagtgctgtttgagatgtgat

SEQ ID NO: 5635445 - DNA, 23 bp, Homo sapiens
taagtgcttcacaggttttatgt

SEQ ID NO: 5635446 - DNA, 16 bp, Homo sapiens
taagtgcttggttgaa

SEQ ID NO: 5635447 - DNA, 15 bp, Homo sapiens
taagtgctttgtaat

SEQ ID NO: 5635448 - DNA, 20 bp, Homo sapiens
taagtggaaaaaagagaaaa

SEQ ID NO: 5635449 - DNA, 22 bp, Homo sapiens
taagtggaaaaaagagaaaaac

SEQ ID NO: 5635450 - DNA, 16 bp, Homo sapiens
taagtggacccagctg

SEQ ID NO: 5635451 - DNA, 19 bp, Homo sapiens
taagtggactggtgtcata

SEQ ID NO: 5635452 - DNA, 17 bp, Homo sapiens
taagtggactgtatttc

SEQ ID NO: 5635453 - DNA, 16 bp, Homo sapiens
taagtggaggcacttt

SEQ ID NO: 5635454 - DNA, 19 bp, Homo sapiens
taagtggaggcactttagg

SEQ ID NO: 5635455 - DNA, 17 bp, Homo sapiens
taagtggcgtgtgcata

SEQ ID NO: 5635456 - DNA, 12 bp, Homo sapiens
taagtgggagac

SEQ ID NO: 5635457 - DNA, 22 bp, Homo sapiens
taagtgggcattttgacaacat

SEQ ID NO: 5635458 - DNA, 15 bp, Homo sapiens
taagtgggcccaccc

SEQ ID NO: 5635459 - DNA, 20 bp, Homo sapiens
taagtggtgcttagaaaatt

SEQ ID NO: 5635460 - DNA, 15 bp, Homo sapiens
taagtggttactttg

SEQ ID NO: 5635461 - DNA, 12 bp, Homo sapiens
taagtgtaaaaa

SEQ ID NO: 5635462 - DNA, 13 bp, Homo sapiens
taagtgtaaaaaa

SEQ ID NO: 5635463 - DNA, 19 bp, Homo sapiens
taagtgtaaaaaatgtctc

SEQ ID NO: 5635464 - DNA, 14 bp, Homo sapiens
taagtgtaaataga

SEQ ID NO: 5635465 - DNA, 16 bp, Homo sapiens
taagtgtaacctcagt

SEQ ID NO: 5635466 - DNA, 15 bp, Homo sapiens
taagtgtacatatgt

SEQ ID NO: 5635467 - DNA, 15 bp, Homo sapiens
taagtgtagctcaaa

SEQ ID NO: 5635468 - DNA, 16 bp, Homo sapiens
taagtgtcaagtcctg

SEQ ID NO: 5635469 - DNA, 16 bp, Homo sapiens
taagtgtcatttcttt

SEQ ID NO: 5635470 - DNA, 22 bp, Homo sapiens
taagtgtgaactggaccctgtt

SEQ ID NO: 5635471 - DNA, 18 bp, Homo sapiens
taagtgtgaccagttttg

SEQ ID NO: 5635472 - DNA, 19 bp, Homo sapiens
taagtgtgagtaagagctg

SEQ ID NO: 5635473 - DNA, 21 bp, Homo sapiens
taagtgtgagtaagagctggt

SEQ ID NO: 5635474 - DNA, 20 bp, Homo sapiens
taagtgtgcacagatacaca

SEQ ID NO: 5635475 - DNA, 14 bp, Homo sapiens
taagtgtggatgtt

SEQ ID NO: 5635476 - DNA, 15 bp, Homo sapiens
taagtgtggttttgt

SEQ ID NO: 5635477 - DNA, 14 bp, Homo sapiens
taagtgtgtgtgtg

SEQ ID NO: 5635478 - DNA, 14 bp, Homo sapiens
taagtgttcagtgt

SEQ ID NO: 5635479 - DNA, 12 bp, Homo sapiens
taagtgttcatt

SEQ ID NO: 5635480 - DNA, 14 bp, Homo sapiens
taagtgttgtaaat

SEQ ID NO: 5635481 - DNA, 21 bp, Homo sapiens
taagtgttgtacaattactgt

SEQ ID NO: 5635482 - DNA, 23 bp, Homo sapiens
taagtgttgtacaattactgtga

SEQ ID NO: 5635483 - DNA, 16 bp, Homo sapiens
taagtgttgtaccata

SEQ ID NO: 5635484 - DNA, 17 bp, Homo sapiens
taagtgttgtaccatat

SEQ ID NO: 5635485 - DNA, 15 bp, Homo sapiens
taagtgtttaaaagc

SEQ ID NO: 5635486 - DNA, 12 bp, Homo sapiens
taagtgtttctc

SEQ ID NO: 5635487 - DNA, 15 bp, Homo sapiens
taagttaaagagaca

SEQ ID NO: 5635488 - DNA, 17 bp, Homo sapiens
taagttaataatgtatt

SEQ ID NO: 5635489 - DNA, 19 bp, Homo sapiens
taagttaataatgtattgt

SEQ ID NO: 5635490 - DNA, 22 bp, Homo sapiens
taagttaatgaaataaaatttg

SEQ ID NO: 5635491 - DNA, 16 bp, Homo sapiens
taagttaatgtatata

SEQ ID NO: 5635492 - DNA, 20 bp, Homo sapiens
taagttaatgtatataaaaa

SEQ ID NO: 5635493 - DNA, 21 bp, Homo sapiens
taagttaatgtatataaaaat

SEQ ID NO: 5635494 - DNA, 19 bp, Homo sapiens
taagttactatcctggctt

SEQ ID NO: 5635495 - DNA, 17 bp, Homo sapiens
taagttacttgaaataa

SEQ ID NO: 5635496 - DNA, 18 bp, Homo sapiens
taagttacttgaaataag

SEQ ID NO: 5635497 - DNA, 19 bp, Homo sapiens
taagttagagaatatattt

SEQ ID NO: 5635498 - DNA, 20 bp, Homo sapiens
taagttagttccactgagac

SEQ ID NO: 5635499 - DNA, 19 bp, Homo sapiens
taagttataattggaatat

SEQ ID NO: 5635500 - DNA, 15 bp, Homo sapiens
taagttataccagca

SEQ ID NO: 5635501 - DNA, 19 bp, Homo sapiens
taagttataccagcaaaag

SEQ ID NO: 5635502 - DNA, 18 bp, Homo sapiens
taagttatagtgaatact

SEQ ID NO: 5635503 - DNA, 20 bp, Homo sapiens
taagttatgactgtgaaatg

SEQ ID NO: 5635504 - DNA, 23 bp, Homo sapiens
taagttatgcctctgacagtcca

SEQ ID NO: 5635505 - DNA, 15 bp, Homo sapiens
taagttatgtacgta

SEQ ID NO: 5635506 - DNA, 23 bp, Homo sapiens
taagttattaagaggtaagactt

SEQ ID NO: 5635507 - DNA, 18 bp, Homo sapiens
taagttattacctctcca

SEQ ID NO: 5635508 - DNA, 23 bp, Homo sapiens
taagttattacctctccagttcc

SEQ ID NO: 5635509 - DNA, 15 bp, Homo sapiens
taagttattgcagtt

SEQ ID NO: 5635510 - DNA, 15 bp, Homo sapiens
taagttattgctgca

SEQ ID NO: 5635511 - DNA, 17 bp, Homo sapiens
taagttatttcttgttt

SEQ ID NO: 5635512 - DNA, 15 bp, Homo sapiens
taagttattttacct

SEQ ID NO: 5635513 - DNA, 18 bp, Homo sapiens
taagttatttttgtacat

SEQ ID NO: 5635514 - DNA, 13 bp, Homo sapiens
taagttcacatta

SEQ ID NO: 5635515 - DNA, 14 bp, Homo sapiens
taagttcagcactt

SEQ ID NO: 5635516 - DNA, 17 bp, Homo sapiens
taagttcatgtttgtaa

SEQ ID NO: 5635517 - DNA, 13 bp, Homo sapiens
taagttcattaaa

SEQ ID NO: 5635518 - DNA, 14 bp, Homo sapiens
taagttccactgag

SEQ ID NO: 5635519 - DNA, 19 bp, Homo sapiens
taagttccactgagctcca

SEQ ID NO: 5635520 - DNA, 13 bp, Homo sapiens
taagttcctgctg

SEQ ID NO: 5635521 - DNA, 22 bp, Homo sapiens
taagttcctgctgcctgggtag

SEQ ID NO: 5635522 - DNA, 22 bp, Homo sapiens
taagttctcccaacaacatgaa

SEQ ID NO: 5635523 - DNA, 18 bp, Homo sapiens
taagttctgaaaactgtt

SEQ ID NO: 5635524 - DNA, 20 bp, Homo sapiens
taagttctggatgcatttct

SEQ ID NO: 5635525 - DNA, 23 bp, Homo sapiens
taagttctggatgcatttctctg

SEQ ID NO: 5635526 - DNA, 23 bp, Homo sapiens
taagttctgtgcagtttggtatg

SEQ ID NO: 5635527 - DNA, 19 bp, Homo sapiens
taagttcttagatatcttt

SEQ ID NO: 5635528 - DNA, 12 bp, Homo sapiens
taagttcttatg

SEQ ID NO: 5635529 - DNA, 19 bp, Homo sapiens
taagttctttgatttgtac

SEQ ID NO: 5635530 - DNA, 21 bp, Homo sapiens
taagttctttgatttgtacca

SEQ ID NO: 5635531 - DNA, 14 bp, Homo sapiens
taagttgaaaagta

SEQ ID NO: 5635532 - DNA, 14 bp, Homo sapiens
taagttgaaggaaa

SEQ ID NO: 5635533 - DNA, 19 bp, Homo sapiens
taagttgaagggaaatcaa

SEQ ID NO: 5635534 - DNA, 12 bp, Homo sapiens
taagttgaatga

SEQ ID NO: 5635535 - DNA, 15 bp, Homo sapiens
taagttgaatgataa

SEQ ID NO: 5635536 - DNA, 15 bp, Homo sapiens
taagttgacctttat

SEQ ID NO: 5635537 - DNA, 20 bp, Homo sapiens
taagttgagatagttttcat

SEQ ID NO: 5635538 - DNA, 14 bp, Homo sapiens
taagttgagcgtgc

SEQ ID NO: 5635539 - DNA, 12 bp, Homo sapiens
taagttgagtat

SEQ ID NO: 5635540 - DNA, 15 bp, Homo sapiens
taagttgattctgtc

SEQ ID NO: 5635541 - DNA, 18 bp, Homo sapiens
taagttgcaagatcttat

SEQ ID NO: 5635542 - DNA, 19 bp, Homo sapiens
taagttgcatttagaaatc

SEQ ID NO: 5635543 - DNA, 18 bp, Homo sapiens
taagttgctgtaaaattt

SEQ ID NO: 5635544 - DNA, 22 bp, Homo sapiens
taagttggaaacactaaatgtt

SEQ ID NO: 5635545 - DNA, 23 bp, Homo sapiens
taagttggtaaagtatttactga

SEQ ID NO: 5635546 - DNA, 18 bp, Homo sapiens
taagttgtacaaatgtat

SEQ ID NO: 5635547 - DNA, 21 bp, Homo sapiens
taagttgtattattagactct

SEQ ID NO: 5635548 - DNA, 22 bp, Homo sapiens
taagttgtattttaataaagat

SEQ ID NO: 5635549 - DNA, 24 bp, Homo sapiens
taagttgtattttaataaagattc

SEQ ID NO: 5635550 - DNA, 18 bp, Homo sapiens
taagttgtcaaagaagct

SEQ ID NO: 5635551 - DNA, 22 bp, Homo sapiens
taagttgtcaaagaagcttcca

SEQ ID NO: 5635552 - DNA, 12 bp, Homo sapiens
taagttgtctgt

SEQ ID NO: 5635553 - DNA, 15 bp, Homo sapiens
taagttgtcttacac

SEQ ID NO: 5635554 - DNA, 20 bp, Homo sapiens
taagttgttttcccatttaa

SEQ ID NO: 5635555 - DNA, 22 bp, Homo sapiens
taagttgttttcccatttaaaa

SEQ ID NO: 5635556 - DNA, 19 bp, Homo sapiens
taagtttacctatgtaaca

SEQ ID NO: 5635557 - DNA, 20 bp, Homo sapiens
taagtttagaaattacaagt

SEQ ID NO: 5635558 - DNA, 21 bp, Homo sapiens
taagtttagaaattacaagtt

SEQ ID NO: 5635559 - DNA, 18 bp, Homo sapiens
taagtttatccaaatctt

SEQ ID NO: 5635560 - DNA, 17 bp, Homo sapiens
taagtttatgtctaaag

SEQ ID NO: 5635561 - DNA, 20 bp, Homo sapiens
taagtttattgtaaaagtga

SEQ ID NO: 5635562 - DNA, 17 bp, Homo sapiens
taagtttatttcttaaa

SEQ ID NO: 5635563 - DNA, 21 bp, Homo sapiens
taagtttcactcacatagcca

SEQ ID NO: 5635564 - DNA, 18 bp, Homo sapiens
taagtttcaggtgacatg

SEQ ID NO: 5635565 - DNA, 20 bp, Homo sapiens
taagtttcaggtgacatgtg

SEQ ID NO: 5635566 - DNA, 20 bp, Homo sapiens
taagtttcattctaaaatca

SEQ ID NO: 5635567 - DNA, 22 bp, Homo sapiens
taatatttcttaatttggataa

SEQ ID NO: 5635568 - DNA, 14 bp, Homo sapiens
taatatttgaattg

SEQ ID NO: 5635569 - DNA, 14 bp, Homo sapiens
taatatttgaattt

SEQ ID NO: 5635570 - DNA, 15 bp, Homo sapiens
taatatttgaatttt

SEQ ID NO: 5635571 - DNA, 11 bp, Homo sapiens
taatatttgca

SEQ ID NO: 5635572 - DNA, 15 bp, Homo sapiens
taatatttgtctgtg

SEQ ID NO: 5635573 - DNA, 20 bp, Homo sapiens
taatatttgtctgtgtgcta

SEQ ID NO: 5635574 - DNA, 22 bp, Homo sapiens
taatatttgtctgtgtgctact

SEQ ID NO: 5635575 - DNA, 14 bp, Homo sapiens
taatattttaagat

SEQ ID NO: 5635576 - DNA, 14 bp, Homo sapiens
taatattttagaaa

SEQ ID NO: 5635577 - DNA, 18 bp, Homo sapiens
taatattttagaaaatgt

SEQ ID NO: 5635578 - DNA, 21 bp, Homo sapiens
taatattttcctcctgagtgc

SEQ ID NO: 5635579 - DNA, 22 bp, Homo sapiens
taatattttcctcctgagtgct

SEQ ID NO: 5635580 - DNA, 13 bp, Homo sapiens
taatattttgtat

SEQ ID NO: 5635581 - DNA, 15 bp, Homo sapiens
taatattttgtattt

SEQ ID NO: 5635582 - DNA, 19 bp, Homo sapiens
taatattttgtattttcaa

SEQ ID NO: 5635583 - DNA, 20 bp, Homo sapiens
taatatttttcaaaatcaaa

SEQ ID NO: 5635584 - DNA, 19 bp, Homo sapiens
taatatttttgtatttctc

SEQ ID NO: 5635585 - DNA, 21 bp, Homo sapiens
taatcaaaagggaaaagaaga

SEQ ID NO: 5635586 - DNA, 22 bp, Homo sapiens
taatcaaaagtccttagaatga

SEQ ID NO: 5635587 - DNA, 14 bp, Homo sapiens
taatcaaaattgtc

SEQ ID NO: 5635588 - DNA, 18 bp, Homo sapiens
taatcaaagccagggtct

SEQ ID NO: 5635589 - DNA, 20 bp, Homo sapiens
taatcaaagctcataatgga

SEQ ID NO: 5635590 - DNA, 11 bp, Homo sapiens
taatcaaatga

SEQ ID NO: 5635591 - DNA, 14 bp, Homo sapiens
taatcaaatgattt

SEQ ID NO: 5635592 - DNA, 21 bp, Homo sapiens
taatcaaattctgtctgggga

SEQ ID NO: 5635593 - DNA, 22 bp, Homo sapiens
taatcaaattctgtctggggac

SEQ ID NO: 5635594 - DNA, 23 bp, Homo sapiens
taatcaaatttgtagggtttcta

SEQ ID NO: 5635595 - DNA, 16 bp, Homo sapiens
taatcaagaatattca

SEQ ID NO: 5635596 - DNA, 22 bp, Homo sapiens
taatcaagagaaacttcaaagt

SEQ ID NO: 5635597 - DNA, 18 bp, Homo sapiens
taatcaagagccttaaaa

SEQ ID NO: 5635598 - DNA, 21 bp, Homo sapiens
taatcaagagtctctccagcc

SEQ ID NO: 5635599 - DNA, 22 bp, Homo sapiens
taatcaagagtctctccagcct

SEQ ID NO: 5635600 - DNA, 13 bp, Homo sapiens
taatcaagatttt

SEQ ID NO: 5635601 - DNA, 23 bp, Homo sapiens
taatcaagtacctatattgattt

SEQ ID NO: 5635602 - DNA, 14 bp, Homo sapiens
taatcaataaagaa

SEQ ID NO: 5635603 - DNA, 17 bp, Homo sapiens
taatcaatacccttggc

SEQ ID NO: 5635604 - DNA, 22 bp, Homo sapiens
taatcaatatcccaacattctg

SEQ ID NO: 5635605 - DNA, 23 bp, Homo sapiens
taatcaatatcccaacattctgc

SEQ ID NO: 5635606 - DNA, 13 bp, Homo sapiens
taatcaatttaaa

SEQ ID NO: 5635607 - DNA, 20 bp, Homo sapiens
taatcaatttaaacccattt

SEQ ID NO: 5635608 - DNA, 15 bp, Homo sapiens
taatcacaaaatcac

SEQ ID NO: 5635609 - DNA, 17 bp, Homo sapiens
taatcacagtcatcttt

SEQ ID NO: 5635610 - DNA, 18 bp, Homo sapiens
taatcacagtcatcttta

SEQ ID NO: 5635611 - DNA, 21 bp, Homo sapiens
taatcaccctaccaactttac

SEQ ID NO: 5635612 - DNA, 18 bp, Homo sapiens
taatcaccttctttgtaa

SEQ ID NO: 5635613 - DNA, 13 bp, Homo sapiens
taatcactaattt

SEQ ID NO: 5635614 - DNA, 13 bp, Homo sapiens
taatcactcccat

SEQ ID NO: 5635615 - DNA, 16 bp, Homo sapiens
taatcactgctgaaga

SEQ ID NO: 5635616 - DNA, 10 bp, Homo sapiens
taatcactgt

SEQ ID NO: 5635617 - DNA, 21 bp, Homo sapiens
taatcactgtgtatatttgat

SEQ ID NO: 5635618 - DNA, 12 bp, Homo sapiens
taatcacttaaa

SEQ ID NO: 5635619 - DNA, 16 bp, Homo sapiens
taatcacttttttcca

SEQ ID NO: 5635620 - DNA, 18 bp, Homo sapiens
taatcacttttttccaca

SEQ ID NO: 5635621 - DNA, 21 bp, Homo sapiens
taatcagaaaccccacttcca

SEQ ID NO: 5635622 - DNA, 13 bp, Homo sapiens
taatcagaaattt

SEQ ID NO: 5635623 - DNA, 18 bp, Homo sapiens
taatcagaaatttttatc

SEQ ID NO: 5635624 - DNA, 23 bp, Homo sapiens
taatcagaatgaaccctcctcct

SEQ ID NO: 5635625 - DNA, 17 bp, Homo sapiens
taatcagacaccagatt

SEQ ID NO: 5635626 - DNA, 15 bp, Homo sapiens
taatcagagcccagg

SEQ ID NO: 5635627 - DNA, 17 bp, Homo sapiens
taatcagagtatctgaa

SEQ ID NO: 5635628 - DNA, 18 bp, Homo sapiens
taatcagagtatctgaag

SEQ ID NO: 5635629 - DNA, 16 bp, Homo sapiens
taatcagatcttcttt

SEQ ID NO: 5635630 - DNA, 20 bp, Homo sapiens
taatcagcaagaatttgatc

SEQ ID NO: 5635631 - DNA, 15 bp, Homo sapiens
taatcagcaataaaa

SEQ ID NO: 5635632 - DNA, 17 bp, Homo sapiens
taatcagcaatattgcc

SEQ ID NO: 5635633 - DNA, 18 bp, Homo sapiens
taatcagcattattcttc

SEQ ID NO: 5635634 - DNA, 11 bp, Homo sapiens
taatcagcctc

SEQ ID NO: 5635635 - DNA, 12 bp, Homo sapiens
taatcagcctct

SEQ ID NO: 5635636 - DNA, 13 bp, Homo sapiens
taatcagcctctt

SEQ ID NO: 5635637 - DNA, 16 bp, Homo sapiens
taatcagctctcctgg

SEQ ID NO: 5635638 - DNA, 19 bp, Homo sapiens
taatcagctctcctggctc

SEQ ID NO: 5635639 - DNA, 21 bp, Homo sapiens
taatcagctgttgcaggcagt

SEQ ID NO: 5635640 - DNA, 20 bp, Homo sapiens
taatcaggcaaggaggagga

SEQ ID NO: 5635641 - DNA, 12 bp, Homo sapiens
taatcaggcagc

SEQ ID NO: 5635642 - DNA, 18 bp, Homo sapiens
taatcagggaaactaatt

SEQ ID NO: 5635643 - DNA, 21 bp, Homo sapiens
taatcagtagttcactttaat

SEQ ID NO: 5635644 - DNA, 18 bp, Homo sapiens
taatcagtgtagccccaa

SEQ ID NO: 5635645 - DNA, 17 bp, Homo sapiens
taatcagtgtgtctaaa

SEQ ID NO: 5635646 - DNA, 23 bp, Homo sapiens
taatcagttagataaaaataaaa

SEQ ID NO: 5635647 - DNA, 23 bp, Homo sapiens
taatcagttcattagaaatattt

SEQ ID NO: 5635648 - DNA, 20 bp, Homo sapiens
taatcagttttgtataactt

SEQ ID NO: 5635649 - DNA, 13 bp, Homo sapiens
taatcataacata

SEQ ID NO: 5635650 - DNA, 12 bp, Homo sapiens
taatcatataaa

SEQ ID NO: 5635651 - DNA, 15 bp, Homo sapiens
taatcatataataaa

SEQ ID NO: 5635652 - DNA, 13 bp, Homo sapiens
taatcatatgtgt

SEQ ID NO: 5635653 - DNA, 14 bp, Homo sapiens
taatcatattagac

SEQ ID NO: 5635654 - DNA, 17 bp, Homo sapiens
taatcatatttgaaaac

SEQ ID NO: 5635655 - DNA, 19 bp, Homo sapiens
taatcatcaggtttactca

SEQ ID NO: 5635656 - DNA, 21 bp, Homo sapiens
taatcatcagttcctttgatc

SEQ ID NO: 5635657 - DNA, 16 bp, Homo sapiens
taatcatctataaaga

SEQ ID NO: 5635658 - DNA, 23 bp, Homo sapiens
taatcatgagaaaaactgttctt

SEQ ID NO: 5635659 - DNA, 17 bp, Homo sapiens
taatcatgagcctgttt

SEQ ID NO: 5635660 - DNA, 18 bp, Homo sapiens
taatcatgagcctgttta

SEQ ID NO: 5635661 - DNA, 19 bp, Homo sapiens
taatcatgagcctgtttat

SEQ ID NO: 5635662 - DNA, 15 bp, Homo sapiens
taatcatgctcatgt

SEQ ID NO: 5635663 - DNA, 17 bp, Homo sapiens
taatcatgctcatgtat

SEQ ID NO: 5635664 - DNA, 18 bp, Homo sapiens
taatcatgctcatgtata

SEQ ID NO: 5635665 - DNA, 19 bp, Homo sapiens
taatcatgctcatgtatat

SEQ ID NO: 5635666 - DNA, 17 bp, Homo sapiens
taatcatggattatgtt

SEQ ID NO: 5635667 - DNA, 22 bp, Homo sapiens
taatcatggctcttagaaactc

SEQ ID NO: 5635668 - DNA, 14 bp, Homo sapiens
taatcatgtaaatg

SEQ ID NO: 5635669 - DNA, 17 bp, Homo sapiens
taatcatgttttaatgt

SEQ ID NO: 5635670 - DNA, 14 bp, Homo sapiens
taatcattatctca

SEQ ID NO: 5635671 - DNA, 16 bp, Homo sapiens
taatcattatttgaga

SEQ ID NO: 5635672 - DNA, 14 bp, Homo sapiens
taatcattgcctgg

SEQ ID NO: 5635673 - DNA, 19 bp, Homo sapiens
taatcatttatcttatcta

SEQ ID NO: 5635674 - DNA, 19 bp, Homo sapiens
taatcatttgtttacattt

SEQ ID NO: 5635675 - DNA, 19 bp, Homo sapiens
taatcattttaaattccac

SEQ ID NO: 5635676 - DNA, 17 bp, Homo sapiens
taatcattttcattcct

SEQ ID NO: 5635677 - DNA, 15 bp, Homo sapiens
taatcattttgagtt

SEQ ID NO: 5635678 - DNA, 20 bp, Homo sapiens
taatccaatattttgccttt

SEQ ID NO: 5635679 - DNA, 22 bp, Homo sapiens
taatccaatccactaacacttt

SEQ ID NO: 5635680 - DNA, 22 bp, Homo sapiens
taatccacatctttactcaggc

SEQ ID NO: 5635681 - DNA, 19 bp, Homo sapiens
taatccaggcagatccagg

SEQ ID NO: 5635682 - DNA, 22 bp, Homo sapiens
taatccaggcagatccaggact

SEQ ID NO: 5635683 - DNA, 20 bp, Homo sapiens
taatccaggtaactttgaag

SEQ ID NO: 5635684 - DNA, 18 bp, Homo sapiens
taatccagtattgctgat

SEQ ID NO: 5635685 - DNA, 16 bp, Homo sapiens
taatccatgtgctgct

SEQ ID NO: 5635686 - DNA, 22 bp, Homo sapiens
taatccatgtgctgctgtggca

SEQ ID NO: 5635687 - DNA, 13 bp, Homo sapiens
taatcccaccacc

SEQ ID NO: 5635688 - DNA, 14 bp, Homo sapiens
taatcccagcaatt

SEQ ID NO: 5635689 - DNA, 13 bp, Homo sapiens
taatcccagcact

SEQ ID NO: 5635690 - DNA, 14 bp, Homo sapiens
taatcccagcactt

SEQ ID NO: 5635691 - DNA, 19 bp, Homo sapiens
taatcccagcactttggga

SEQ ID NO: 5635692 - DNA, 18 bp, Homo sapiens
taatcccagctacacctg

SEQ ID NO: 5635693 - DNA, 14 bp, Homo sapiens
taatcccagctact

SEQ ID NO: 5635694 - DNA, 19 bp, Homo sapiens
taatcccagctacttggga

SEQ ID NO: 5635695 - DNA, 20 bp, Homo sapiens
taatccccagtaaaattgcc

SEQ ID NO: 5635696 - DNA, 15 bp, Homo sapiens
taatccccatcatta

SEQ ID NO: 5635697 - DNA, 16 bp, Homo sapiens
taatccccatcattac

SEQ ID NO: 5635698 - DNA, 14 bp, Homo sapiens
taatcccctgcact

SEQ ID NO: 5635699 - DNA, 17 bp, Homo sapiens
taatccccttctcccct

SEQ ID NO: 5635700 - DNA, 18 bp, Homo sapiens
taatccccttctcccctg

SEQ ID NO: 5635701 - DNA, 17 bp, Homo sapiens
taatcccgattcaccct

SEQ ID NO: 5635702 - DNA, 19 bp, Homo sapiens
taatcccggtttcagaagc

SEQ ID NO: 5635703 - DNA, 16 bp, Homo sapiens
taatccctatgtttgt

SEQ ID NO: 5635704 - DNA, 20 bp, Homo sapiens
taatccctgggcattgcttt

SEQ ID NO: 5635705 - DNA, 19 bp, Homo sapiens
taatcccttcctctcccat

SEQ ID NO: 5635706 - DNA, 19 bp, Homo sapiens
taatccgaatctctttttg

SEQ ID NO: 5635707 - DNA, 21 bp, Homo sapiens
taatcctagcactttgggagg

SEQ ID NO: 5635708 - DNA, 23 bp, Homo sapiens
taatcctatctggggagctcctg

SEQ ID NO: 5635709 - DNA, 17 bp, Homo sapiens
taatcctattgtacgct

SEQ ID NO: 5635710 - DNA, 20 bp, Homo sapiens
taatcctctaggaggtctct

SEQ ID NO: 5635711 - DNA, 23 bp, Homo sapiens
taatcctctcaaccacctttcag

SEQ ID NO: 5635712 - DNA, 20 bp, Homo sapiens
taatcctggagtctcactgt

SEQ ID NO: 5635713 - DNA, 14 bp, Homo sapiens
taatcctgtaccaa

SEQ ID NO: 5635714 - DNA, 18 bp, Homo sapiens
taatcctgtaccaaatct

SEQ ID NO: 5635715 - DNA, 19 bp, Homo sapiens
taatcctgtaccaaatctg

SEQ ID NO: 5635716 - DNA, 14 bp, Homo sapiens
taatcctgtaggaa

SEQ ID NO: 5635717 - DNA, 22 bp, Homo sapiens
taatccttaaatcttaatgttc

SEQ ID NO: 5635718 - DNA, 17 bp, Homo sapiens
taatcctttctgccgac

SEQ ID NO: 5635719 - DNA, 18 bp, Homo sapiens
taatcctttgttttctga

SEQ ID NO: 5635720 - DNA, 20 bp, Homo sapiens
taatcctttgttttctgact

SEQ ID NO: 5635721 - DNA, 14 bp, Homo sapiens
taatccttttcctt

SEQ ID NO: 5635722 - DNA, 23 bp, Homo sapiens
taatccttttccttatttgcctt

SEQ ID NO: 5635723 - DNA, 15 bp, Homo sapiens
taatcgaaatgaatt

SEQ ID NO: 5635724 - DNA, 21 bp, Homo sapiens
taatcgaaatgaatttatctg

SEQ ID NO: 5635725 - DNA, 21 bp, Homo sapiens
taatcgaacgcgtgtgtgcct

SEQ ID NO: 5635726 - DNA, 22 bp, Homo sapiens
taatcgaacgcgtgtgtgcctg

SEQ ID NO: 5635727 - DNA, 14 bp, Homo sapiens
taatcgacctgcct

SEQ ID NO: 5635728 - DNA, 15 bp, Homo sapiens
taatcgatgaatgta

SEQ ID NO: 5635729 - DNA, 16 bp, Homo sapiens
taatcggcccacagct

SEQ ID NO: 5635730 - DNA, 22 bp, Homo sapiens
taatcggcccacagctcccacc

SEQ ID NO: 5635731 - DNA, 17 bp, Homo sapiens
taatcggggtataatag

SEQ ID NO: 5635732 - DNA, 21 bp, Homo sapiens
taatcgtcttcaaattaaagt

SEQ ID NO: 5635733 - DNA, 15 bp, Homo sapiens
taatcgttatgtgtg

SEQ ID NO: 5635734 - DNA, 19 bp, Homo sapiens
taatcgttatgtgtgtata

SEQ ID NO: 5635735 - DNA, 15 bp, Homo sapiens
taatctaaaatgatt

SEQ ID NO: 5635736 - DNA, 14 bp, Homo sapiens
taatctaaatataa

SEQ ID NO: 5635737 - DNA, 11 bp, Homo sapiens
taatctaaatg

SEQ ID NO: 5635738 - DNA, 21 bp, Homo sapiens
taatctaaatttaattacctt

SEQ ID NO: 5635739 - DNA, 13 bp, Homo sapiens
taatctacaccaa

SEQ ID NO: 5635740 - DNA, 18 bp, Homo sapiens
taatctacaccaatgaaa

SEQ ID NO: 5635741 - DNA, 15 bp, Homo sapiens
taatctactgtaaag

SEQ ID NO: 5635742 - DNA, 17 bp, Homo sapiens
taatctactttttgtat

SEQ ID NO: 5635743 - DNA, 14 bp, Homo sapiens
taatctagaaaatg

SEQ ID NO: 5635744 - DNA, 13 bp, Homo sapiens
taatggagtgttt

SEQ ID NO: 5635745 - DNA, 22 bp, Homo sapiens
taatggagtgtttgaaaactga

SEQ ID NO: 5635746 - DNA, 18 bp, Homo sapiens
taatggatcatagaattg

SEQ ID NO: 5635747 - DNA, 12 bp, Homo sapiens
taatggatcctt

SEQ ID NO: 5635748 - DNA, 16 bp, Homo sapiens
taatggattgttaatt

SEQ ID NO: 5635749 - DNA, 13 bp, Homo sapiens
taatggcactgat

SEQ ID NO: 5635750 - DNA, 15 bp, Homo sapiens
taatggcagagcagt

SEQ ID NO: 5635751 - DNA, 19 bp, Homo sapiens
taatggcagctagtgcctt

SEQ ID NO: 5635752 - DNA, 17 bp, Homo sapiens
taatggcatgagaaata

SEQ ID NO: 5635753 - DNA, 14 bp, Homo sapiens
taatggcatttctc

SEQ ID NO: 5635754 - DNA, 15 bp, Homo sapiens
taatggcatttctct

SEQ ID NO: 5635755 - DNA, 23 bp, Homo sapiens
taatggccggctggaaatgctgg

SEQ ID NO: 5635756 - DNA, 18 bp, Homo sapiens
taatggccttaattaatt

SEQ ID NO: 5635757 - DNA, 20 bp, Homo sapiens
taatggccttaattaattct

SEQ ID NO: 5635758 - DNA, 13 bp, Homo sapiens
taatggctctggg

SEQ ID NO: 5635759 - DNA, 22 bp, Homo sapiens
taatggctctgggctatatgcc

SEQ ID NO: 5635760 - DNA, 23 bp, Homo sapiens
taatggctctgggctatatgcct

SEQ ID NO: 5635761 - DNA, 22 bp, Homo sapiens
taatggctgataattttaaatt

SEQ ID NO: 5635762 - DNA, 19 bp, Homo sapiens
taatggcttccctctttca

SEQ ID NO: 5635763 - DNA, 23 bp, Homo sapiens
taatggcttccctctttcatctc

SEQ ID NO: 5635764 - DNA, 13 bp, Homo sapiens
taatgggaaaaac

SEQ ID NO: 5635765 - DNA, 16 bp, Homo sapiens
taatgggaatcattcc

SEQ ID NO: 5635766 - DNA, 23 bp, Homo sapiens
taatgggatctatttttgcactg

SEQ ID NO: 5635767 - DNA, 17 bp, Homo sapiens
taatgggattagaaaca

SEQ ID NO: 5635768 - DNA, 15 bp, Homo sapiens
taatgggattttctt

SEQ ID NO: 5635769 - DNA, 17 bp, Homo sapiens
taatgggccaattaaaa

SEQ ID NO: 5635770 - DNA, 18 bp, Homo sapiens
taatgggccaattaaaat

SEQ ID NO: 5635771 - DNA, 22 bp, Homo sapiens
taatgggctgcaaaatgaagac

SEQ ID NO: 5635772 - DNA, 15 bp, Homo sapiens
taatgggggtagcag

SEQ ID NO: 5635773 - DNA, 14 bp, Homo sapiens
taatggtaaatctt

SEQ ID NO: 5635774 - DNA, 23 bp, Homo sapiens
taatggtactgactttgcttgct

SEQ ID NO: 5635775 - DNA, 16 bp, Homo sapiens
taatggtagttttaca

SEQ ID NO: 5635776 - DNA, 18 bp, Homo sapiens
taatggtattttctagac

SEQ ID NO: 5635777 - DNA, 18 bp, Homo sapiens
taatggtccacacccaat

SEQ ID NO: 5635778 - DNA, 16 bp, Homo sapiens
taatggtcccatccag

SEQ ID NO: 5635779 - DNA, 16 bp, Homo sapiens
taatggtcctgttatg

SEQ ID NO: 5635780 - DNA, 17 bp, Homo sapiens
taatggtctaaaaataa

SEQ ID NO: 5635781 - DNA, 17 bp, Homo sapiens
taatggtgaaaacgtct

SEQ ID NO: 5635782 - DNA, 22 bp, Homo sapiens
taatggtgaaaacgtcttcctt

SEQ ID NO: 5635783 - DNA, 14 bp, Homo sapiens
taatggtgaaagtt

SEQ ID NO: 5635784 - DNA, 17 bp, Homo sapiens
taatggtgaacatttta

SEQ ID NO: 5635785 - DNA, 16 bp, Homo sapiens
taatggtgccttcatt

SEQ ID NO: 5635786 - DNA, 18 bp, Homo sapiens
taatggtgccttcatttg

SEQ ID NO: 5635787 - DNA, 21 bp, Homo sapiens
taatggtgggttttttttctg

SEQ ID NO: 5635788 - DNA, 18 bp, Homo sapiens
taatggtgtaacctgaga

SEQ ID NO: 5635789 - DNA, 19 bp, Homo sapiens
taatggttaagttttcttg

SEQ ID NO: 5635790 - DNA, 15 bp, Homo sapiens
taatggttgtgaaat

SEQ ID NO: 5635791 - DNA, 16 bp, Homo sapiens
taatggttgtgaaatg

SEQ ID NO: 5635792 - DNA, 19 bp, Homo sapiens
taatggttgtgaaatgtaa

SEQ ID NO: 5635793 - DNA, 15 bp, Homo sapiens
taatggtttactgct

SEQ ID NO: 5635794 - DNA, 14 bp, Homo sapiens
taatgtaaaatgat

SEQ ID NO: 5635795 - DNA, 14 bp, Homo sapiens
taatgtaaaatgtt

SEQ ID NO: 5635796 - DNA, 18 bp, Homo sapiens
taatgtaaaccagaaaaa

SEQ ID NO: 5635797 - DNA, 23 bp, Homo sapiens
taatgtaaactttgtcatggttt

SEQ ID NO: 5635798 - DNA, 19 bp, Homo sapiens
taatgtaaagaacttaaat

SEQ ID NO: 5635799 - DNA, 20 bp, Homo sapiens
taatgtaaataaactattta

SEQ ID NO: 5635800 - DNA, 17 bp, Homo sapiens
taatgtaactgaagcat

SEQ ID NO: 5635801 - DNA, 20 bp, Homo sapiens
taatgtaactgaagcataaa

SEQ ID NO: 5635802 - DNA, 14 bp, Homo sapiens
taatgtaacttaat

SEQ ID NO: 5635803 - DNA, 15 bp, Homo sapiens
taatgtaagacaaat

SEQ ID NO: 5635804 - DNA, 16 bp, Homo sapiens
taatgtaagctctact

SEQ ID NO: 5635805 - DNA, 19 bp, Homo sapiens
taatgtaagggtctgttgt

SEQ ID NO: 5635806 - DNA, 13 bp, Homo sapiens
taatgtaataaag

SEQ ID NO: 5635807 - DNA, 17 bp, Homo sapiens
taatgtaataaagtgaa

SEQ ID NO: 5635808 - DNA, 21 bp, Homo sapiens
taatgtaatgtttttatttca

SEQ ID NO: 5635809 - DNA, 17 bp, Homo sapiens
taatgtaatttagtcta

SEQ ID NO: 5635810 - DNA, 20 bp, Homo sapiens
taatgtaatttagtctaaca

SEQ ID NO: 5635811 - DNA, 16 bp, Homo sapiens
taatgtacaagttttg

SEQ ID NO: 5635812 - DNA, 18 bp, Homo sapiens
taatgtacaagttttgta

SEQ ID NO: 5635813 - DNA, 20 bp, Homo sapiens
taatgtacagagtggcccct

SEQ ID NO: 5635814 - DNA, 15 bp, Homo sapiens
taatgtacatctggc

SEQ ID NO: 5635815 - DNA, 22 bp, Homo sapiens
taatgtacgctgctgcaggaca

SEQ ID NO: 5635816 - DNA, 23 bp, Homo sapiens
taatgtacgctgctgcaggacat

SEQ ID NO: 5635817 - DNA, 12 bp, Homo sapiens
taatgtactcac

SEQ ID NO: 5635818 - DNA, 15 bp, Homo sapiens
taatgtactcacata

SEQ ID NO: 5635819 - DNA, 20 bp, Homo sapiens
taatgtactcacatataaca

SEQ ID NO: 5635820 - DNA, 18 bp, Homo sapiens
taatgtactgaattcttt

SEQ ID NO: 5635821 - DNA, 14 bp, Homo sapiens
taatgtacttttta

SEQ ID NO: 5635822 - DNA, 21 bp, Homo sapiens
taatgtagacattatcttttg

SEQ ID NO: 5635823 - DNA, 22 bp, Homo sapiens
taatgtagcagctcataaatga

SEQ ID NO: 5635824 - DNA, 22 bp, Homo sapiens
taatgtagcgtgtttacatgtg

SEQ ID NO: 5635825 - DNA, 16 bp, Homo sapiens
taatgtaggactgtat

SEQ ID NO: 5635826 - DNA, 17 bp, Homo sapiens
taatgtaggactgtata

SEQ ID NO: 5635827 - DNA, 21 bp, Homo sapiens
taatgtagggcagaatagctg

SEQ ID NO: 5635828 - DNA, 22 bp, Homo sapiens
taatgtagggttatatttggga

SEQ ID NO: 5635829 - DNA, 20 bp, Homo sapiens
taatgtaggtttagatatat

SEQ ID NO: 5635830 - DNA, 19 bp, Homo sapiens
taatgtagttctttgttcc

SEQ ID NO: 5635831 - DNA, 22 bp, Homo sapiens
taatgtagttttgtgatgcatt

SEQ ID NO: 5635832 - DNA, 15 bp, Homo sapiens
taatgtatatttgct

SEQ ID NO: 5635833 - DNA, 18 bp, Homo sapiens
taatgtatcatgaagaaa

SEQ ID NO: 5635834 - DNA, 15 bp, Homo sapiens
taatgtatcttaaag

SEQ ID NO: 5635835 - DNA, 18 bp, Homo sapiens
taatgtatcttatttata

SEQ ID NO: 5635836 - DNA, 14 bp, Homo sapiens
taatgtatgaattt

SEQ ID NO: 5635837 - DNA, 23 bp, Homo sapiens
taatgtatgaattttgtaagtat

SEQ ID NO: 5635838 - DNA, 22 bp, Homo sapiens
taatgtatggctcatttgcttt

SEQ ID NO: 5635839 - DNA, 16 bp, Homo sapiens
taatgtatgttaccaa

SEQ ID NO: 5635840 - DNA, 17 bp, Homo sapiens
taatgtatgttaccaaa

SEQ ID NO: 5635841 - DNA, 16 bp, Homo sapiens
taatgtattcccttca

SEQ ID NO: 5635842 - DNA, 16 bp, Homo sapiens
taatgtattttcagct

SEQ ID NO: 5635843 - DNA, 19 bp, Homo sapiens
taatgtatttttgtaaata

SEQ ID NO: 5635844 - DNA, 18 bp, Homo sapiens
taatgtcaaacttgagtc

SEQ ID NO: 5635845 - DNA, 21 bp, Homo sapiens
taatgtcaatgttaatcagcc

SEQ ID NO: 5635846 - DNA, 15 bp, Homo sapiens
taatgtcacaggcag

SEQ ID NO: 5635847 - DNA, 11 bp, Homo sapiens
taatgtcagac

SEQ ID NO: 5635848 - DNA, 14 bp, Homo sapiens
taatgtcagcttat

SEQ ID NO: 5635849 - DNA, 16 bp, Homo sapiens
taatgtcatgttgctt

SEQ ID NO: 5635850 - DNA, 14 bp, Homo sapiens
taatgtcattgcta

SEQ ID NO: 5635851 - DNA, 18 bp, Homo sapiens
taatgtcattgctaaaaa

SEQ ID NO: 5635852 - DNA, 22 bp, Homo sapiens
taatgtccaaatactctgaaat

SEQ ID NO: 5635853 - DNA, 14 bp, Homo sapiens
taatgtccccactc

SEQ ID NO: 5635854 - DNA, 15 bp, Homo sapiens
taatgtccccactcc

SEQ ID NO: 5635855 - DNA, 20 bp, Homo sapiens
taatgtccctctcttggcta

SEQ ID NO: 5635856 - DNA, 17 bp, Homo sapiens
taatgtctagattttga

SEQ ID NO: 5635857 - DNA, 18 bp, Homo sapiens
taatgtctagattttgaa

SEQ ID NO: 5635858 - DNA, 17 bp, Homo sapiens
taatgtctcaaaataaa

SEQ ID NO: 5635859 - DNA, 17 bp, Homo sapiens
taatgtctcactgttct

SEQ ID NO: 5635860 - DNA, 16 bp, Homo sapiens
taatgtctcctttgct

SEQ ID NO: 5635861 - DNA, 19 bp, Homo sapiens
taatgtctctgtgagactc

SEQ ID NO: 5635862 - DNA, 22 bp, Homo sapiens
taatgtctggtgtttgtcatgg

SEQ ID NO: 5635863 - DNA, 21 bp, Homo sapiens
taatgtctgtcagaagacact

SEQ ID NO: 5635864 - DNA, 23 bp, Homo sapiens
taatgtctgtcagaagacactaa

SEQ ID NO: 5635865 - DNA, 14 bp, Homo sapiens
taatgtctttgagc

SEQ ID NO: 5635866 - DNA, 14 bp, Homo sapiens
taatgtgaaaagta

SEQ ID NO: 5635867 - DNA, 16 bp, Homo sapiens
taatgtgaaaagtatc

SEQ ID NO: 5635868 - DNA, 15 bp, Homo sapiens
taatgtgaaaatcat

SEQ ID NO: 5635869 - DNA, 20 bp, Homo sapiens
taatgtgaaactggattaaa

SEQ ID NO: 5635870 - DNA, 13 bp, Homo sapiens
taatgtgaaatgt

SEQ ID NO: 5635871 - DNA, 19 bp, Homo sapiens
taatgtgaaatgtaactgt

SEQ ID NO: 5635872 - DNA, 19 bp, Homo sapiens
taatgtgaactagctggaa

SEQ ID NO: 5635873 - DNA, 18 bp, Homo sapiens
taatgtgaactctcccct

SEQ ID NO: 5635874 - DNA, 18 bp, Homo sapiens
taatgtgaacttgtagct

SEQ ID NO: 5635875 - DNA, 15 bp, Homo sapiens
taatgtgaagacatt

SEQ ID NO: 5635876 - DNA, 13 bp, Homo sapiens
taatgtgaagtgt

SEQ ID NO: 5635877 - DNA, 11 bp, Homo sapiens
taatgtgaatt

SEQ ID NO: 5635878 - DNA, 16 bp, Homo sapiens
taatgtgacctagcaa

SEQ ID NO: 5635879 - DNA, 14 bp, Homo sapiens
taatgtgagacagc

SEQ ID NO: 5635880 - DNA, 22 bp, Homo sapiens
taatgtgaggaactcacatact

SEQ ID NO: 5635881 - DNA, 23 bp, Homo sapiens
taatgtgaggaactcacatactg

SEQ ID NO: 5635882 - DNA, 18 bp, Homo sapiens
taatgtgagggtttgtaa

SEQ ID NO: 5635883 - DNA, 19 bp, Homo sapiens
taatgtgagtagttactaa

SEQ ID NO: 5635884 - DNA, 20 bp, Homo sapiens
taatgtgatggatggcacaa

SEQ ID NO: 5635885 - DNA, 21 bp, Homo sapiens
taatgtgatggatggcacaat

SEQ ID NO: 5635886 - DNA, 23 bp, Homo sapiens
taatgtgatggatggcacaatga

SEQ ID NO: 5635887 - DNA, 19 bp, Homo sapiens
taatgtgattttttttaga

SEQ ID NO: 5635888 - DNA, 16 bp, Homo sapiens
taatgtgcaaattttg

SEQ ID NO: 5635889 - DNA, 18 bp, Homo sapiens
taatgtgcaaattttgca

SEQ ID NO: 5635890 - DNA, 18 bp, Homo sapiens
taatgtgcagaaaatatt

SEQ ID NO: 5635891 - DNA, 17 bp, Homo sapiens
taatgtgcctagttctt

SEQ ID NO: 5635892 - DNA, 12 bp, Homo sapiens
taatgtgcctgg

SEQ ID NO: 5635893 - DNA, 21 bp, Homo sapiens
taatgtgcctggctctgattc

SEQ ID NO: 5635894 - DNA, 18 bp, Homo sapiens
taatgtgctctgtacctg

SEQ ID NO: 5635895 - DNA, 14 bp, Homo sapiens
taatgtgctgtgta

SEQ ID NO: 5635896 - DNA, 16 bp, Homo sapiens
taatgtgctgtgtaaa

SEQ ID NO: 5635897 - DNA, 17 bp, Homo sapiens
taatgtgctgtgtaaag

SEQ ID NO: 5635898 - DNA, 19 bp, Homo sapiens
taatgtgctgtgtaaagtt

SEQ ID NO: 5635899 - DNA, 20 bp, Homo sapiens
taatgtgctgtgtaaagtta

SEQ ID NO: 5635900 - DNA, 21 bp, Homo sapiens
taatgtgctgtgtaaagttag

SEQ ID NO: 5635901 - DNA, 15 bp, Homo sapiens
taatgtgctttattt

SEQ ID NO: 5635902 - DNA, 13 bp, Homo sapiens
taatgtggactgg

SEQ ID NO: 5635903 - DNA, 17 bp, Homo sapiens
taatgtggatttcctat

SEQ ID NO: 5635904 - DNA, 13 bp, Homo sapiens
taatgtggcttct

SEQ ID NO: 5635905 - DNA, 20 bp, Homo sapiens
taatgtgtagttcatgtaaa

SEQ ID NO: 5635906 - DNA, 22 bp, Homo sapiens
taatgtgtagttcatgtaaata

SEQ ID NO: 5635907 - DNA, 15 bp, Homo sapiens
taatgtgtcccctga

SEQ ID NO: 5635908 - DNA, 15 bp, Homo sapiens
taatgtgtctgtgtt

SEQ ID NO: 5635909 - DNA, 12 bp, Homo sapiens
taatgtgtgtat

SEQ ID NO: 5635910 - DNA, 14 bp, Homo sapiens
taatgtgtgtatgt

SEQ ID NO: 5635911 - DNA, 17 bp, Homo sapiens
taatgtgtgtatgtgta

SEQ ID NO: 5635912 - DNA, 21 bp, Homo sapiens
taatgtgttatgagaaattag

SEQ ID NO: 5635913 - DNA, 23 bp, Homo sapiens
taatgtgttttagagtaagaaat

SEQ ID NO: 5635914 - DNA, 20 bp, Homo sapiens
taatgttaaatttgtaagtt

SEQ ID NO: 5635915 - DNA, 17 bp, Homo sapiens
taatgttaaccaaggaa

SEQ ID NO: 5635916 - DNA, 14 bp, Homo sapiens
taatgttaactttc

SEQ ID NO: 5635917 - DNA, 14 bp, Homo sapiens
taatgttaagcttt

SEQ ID NO: 5635918 - DNA, 17 bp, Homo sapiens
taatgttaagctttatt

SEQ ID NO: 5635919 - DNA, 13 bp, Homo sapiens
taatgttaatatt

SEQ ID NO: 5635920 - DNA, 18 bp, Homo sapiens
taatgttaattaaagtaa

SEQ ID NO: 5635921 - DNA, 21 bp, Homo sapiens
taatttattgtaccaaagctg

SEQ ID NO: 5635922 - DNA, 13 bp, Homo sapiens
taatttatttcaa

SEQ ID NO: 5635923 - DNA, 22 bp, Homo sapiens
taatttatttcaataaatcttt

SEQ ID NO: 5635924 - DNA, 15 bp, Homo sapiens
taatttatttcatcc

SEQ ID NO: 5635925 - DNA, 19 bp, Homo sapiens
taatttatttccactaaaa

SEQ ID NO: 5635926 - DNA, 16 bp, Homo sapiens
taatttatttgtttcc

SEQ ID NO: 5635927 - DNA, 21 bp, Homo sapiens
taatttattttaatgtaaata

SEQ ID NO: 5635928 - DNA, 13 bp, Homo sapiens
taatttattttgt

SEQ ID NO: 5635929 - DNA, 23 bp, Homo sapiens
taatttattttgtatttttgaat

SEQ ID NO: 5635930 - DNA, 15 bp, Homo sapiens
taatttattttttaa

SEQ ID NO: 5635931 - DNA, 20 bp, Homo sapiens
taatttcaaaaatataactt

SEQ ID NO: 5635932 - DNA, 21 bp, Homo sapiens
taatttcaaaaatataactta

SEQ ID NO: 5635933 - DNA, 14 bp, Homo sapiens
taatttcaaaatac

SEQ ID NO: 5635934 - DNA, 16 bp, Homo sapiens
taatttcaaaatacat

SEQ ID NO: 5635935 - DNA, 19 bp, Homo sapiens
taatttcaaaatacatttg

SEQ ID NO: 5635936 - DNA, 13 bp, Homo sapiens
taatttcaaatgt

SEQ ID NO: 5635937 - DNA, 16 bp, Homo sapiens
taatttcaagaatgtt

SEQ ID NO: 5635938 - DNA, 11 bp, Homo sapiens
taatttcaagc

SEQ ID NO: 5635939 - DNA, 19 bp, Homo sapiens
taatttcaatcaaccaaag

SEQ ID NO: 5635940 - DNA, 16 bp, Homo sapiens
taatttcactttagaa

SEQ ID NO: 5635941 - DNA, 21 bp, Homo sapiens
taatttcagcttctatatatt

SEQ ID NO: 5635942 - DNA, 12 bp, Homo sapiens
taatttcaggaa

SEQ ID NO: 5635943 - DNA, 21 bp, Homo sapiens
taatttcaggaggaatactga

SEQ ID NO: 5635944 - DNA, 19 bp, Homo sapiens
taatttcagggaaattaat

SEQ ID NO: 5635945 - DNA, 23 bp, Homo sapiens
taatttcagtcctgtagttttat

SEQ ID NO: 5635946 - DNA, 22 bp, Homo sapiens
taatttcagttctagttgattg

SEQ ID NO: 5635947 - DNA, 14 bp, Homo sapiens
taatttcataaatt

SEQ ID NO: 5635948 - DNA, 24 bp, Homo sapiens
taatttcatactatttagattttc

SEQ ID NO: 5635949 - DNA, 10 bp, Homo sapiens
taatttcatc

SEQ ID NO: 5635950 - DNA, 22 bp, Homo sapiens
taatttcattgtctctatctga

SEQ ID NO: 5635951 - DNA, 20 bp, Homo sapiens
taatttcattttagtatttt

SEQ ID NO: 5635952 - DNA, 22 bp, Homo sapiens
taatttccatttacttaagact

SEQ ID NO: 5635953 - DNA, 16 bp, Homo sapiens
taatttcctcactgcc

SEQ ID NO: 5635954 - DNA, 16 bp, Homo sapiens
taatttcctgctgaaa

SEQ ID NO: 5635955 - DNA, 15 bp, Homo sapiens
taatttcctgtgagg

SEQ ID NO: 5635956 - DNA, 11 bp, Homo sapiens
taatttccttt

SEQ ID NO: 5635957 - DNA, 19 bp, Homo sapiens
taatttcctttttgacact

SEQ ID NO: 5635958 - DNA, 17 bp, Homo sapiens
taatttcgagatttgta

SEQ ID NO: 5635959 - DNA, 13 bp, Homo sapiens
taatttcgcctta

SEQ ID NO: 5635960 - DNA, 18 bp, Homo sapiens
taatttcgccttaaactc

SEQ ID NO: 5635961 - DNA, 21 bp, Homo sapiens
taatttctaactccttatgtt

SEQ ID NO: 5635962 - DNA, 22 bp, Homo sapiens
taatttctactctgtcttaaat

SEQ ID NO: 5635963 - DNA, 12 bp, Homo sapiens
taatttctactt

SEQ ID NO: 5635964 - DNA, 13 bp, Homo sapiens
taatttctcctcc

SEQ ID NO: 5635965 - DNA, 19 bp, Homo sapiens
taatttctcctcccttcct

SEQ ID NO: 5635966 - DNA, 22 bp, Homo sapiens
taatttctgattataagacaat

SEQ ID NO: 5635967 - DNA, 15 bp, Homo sapiens
taatttctgttgttt

SEQ ID NO: 5635968 - DNA, 19 bp, Homo sapiens
taatttcttactaaacatt

SEQ ID NO: 5635969 - DNA, 17 bp, Homo sapiens
taatttcttcaaaatgt

SEQ ID NO: 5635970 - DNA, 16 bp, Homo sapiens
taatttcttctttaga

SEQ ID NO: 5635971 - DNA, 23 bp, Homo sapiens
taatttctttgcctgttcagtta

SEQ ID NO: 5635972 - DNA, 22 bp, Homo sapiens
taatttgaaaacataatctgca

SEQ ID NO: 5635973 - DNA, 14 bp, Homo sapiens
taatttgaacaggt

SEQ ID NO: 5635974 - DNA, 13 bp, Homo sapiens
taatttgaagatt

SEQ ID NO: 5635975 - DNA, 14 bp, Homo sapiens
taatttgaagattg

SEQ ID NO: 5635976 - DNA, 18 bp, Homo sapiens
taatttgaatcagagaaa

SEQ ID NO: 5635977 - DNA, 17 bp, Homo sapiens
taatttgaatgtatttg

SEQ ID NO: 5635978 - DNA, 19 bp, Homo sapiens
taatttgaatgtatttgat

SEQ ID NO: 5635979 - DNA, 20 bp, Homo sapiens
taatttgaatgtggttactt

SEQ ID NO: 5635980 - DNA, 12 bp, Homo sapiens
taatttgaattg

SEQ ID NO: 5635981 - DNA, 17 bp, Homo sapiens
taatttgaccagaaaat

SEQ ID NO: 5635982 - DNA, 17 bp, Homo sapiens
taatttgagaattattc

SEQ ID NO: 5635983 - DNA, 21 bp, Homo sapiens
taatttgagatcgtccactgt

SEQ ID NO: 5635984 - DNA, 14 bp, Homo sapiens
taatttgagtgtat

SEQ ID NO: 5635985 - DNA, 17 bp, Homo sapiens
taatttgagtgtatata

SEQ ID NO: 5635986 - DNA, 22 bp, Homo sapiens
taatttgatagatgtttgactt

SEQ ID NO: 5635987 - DNA, 12 bp, Homo sapiens
taatttgatatc

SEQ ID NO: 5635988 - DNA, 19 bp, Homo sapiens
taatttgatatcacagtct

SEQ ID NO: 5635989 - DNA, 19 bp, Homo sapiens
taatttgatgaaagctgat

SEQ ID NO: 5635990 - DNA, 24 bp, Homo sapiens
taatttgatgaaagctgattactg

SEQ ID NO: 5635991 - DNA, 14 bp, Homo sapiens
taatttgatgttta

SEQ ID NO: 5635992 - DNA, 20 bp, Homo sapiens
taatttgcattaaattcaca

SEQ ID NO: 5635993 - DNA, 17 bp, Homo sapiens
taatttgccaaaataat

SEQ ID NO: 5635994 - DNA, 22 bp, Homo sapiens
taatttgccattatctgtatta

SEQ ID NO: 5635995 - DNA, 21 bp, Homo sapiens
taatttgctctgtggtaagag

SEQ ID NO: 5635996 - DNA, 22 bp, Homo sapiens
taatttgctggaacacaaagac

SEQ ID NO: 5635997 - DNA, 20 bp, Homo sapiens
taatttggaaactaataaaa

SEQ ID NO: 5635998 - DNA, 21 bp, Homo sapiens
taatttggacattatttcgtg

SEQ ID NO: 5635999 - DNA, 21 bp, Homo sapiens
taatttggagcacaaaattca

SEQ ID NO: 5636000 - DNA, 15 bp, Homo sapiens
taatttggataataa

SEQ ID NO: 5636001 - DNA, 13 bp, Homo sapiens
taatttggatcta

SEQ ID NO: 5636002 - DNA, 23 bp, Homo sapiens
taatttggatctcttcttaatgt

SEQ ID NO: 5636003 - DNA, 19 bp, Homo sapiens
taatttgggaaaagaagct

SEQ ID NO: 5636004 - DNA, 20 bp, Homo sapiens
taatttggtagatgacaaat

SEQ ID NO: 5636005 - DNA, 21 bp, Homo sapiens
taatttggtagatgacaaata

SEQ ID NO: 5636006 - DNA, 15 bp, Homo sapiens
taatttggtcatttg

SEQ ID NO: 5636007 - DNA, 20 bp, Homo sapiens
taatttgtaaacttctgaag

SEQ ID NO: 5636008 - DNA, 15 bp, Homo sapiens
taatttgtaaattga

SEQ ID NO: 5636009 - DNA, 12 bp, Homo sapiens
taatttgtacaa

SEQ ID NO: 5636010 - DNA, 23 bp, Homo sapiens
taatttgtacaatggtttattcc

SEQ ID NO: 5636011 - DNA, 13 bp, Homo sapiens
taatttgtacagg

SEQ ID NO: 5636012 - DNA, 21 bp, Homo sapiens
taatttgtacatatgtaaaat

SEQ ID NO: 5636013 - DNA, 21 bp, Homo sapiens
taatttgtataagatgctgct

SEQ ID NO: 5636014 - DNA, 17 bp, Homo sapiens
taatttgtcttagttga

SEQ ID NO: 5636015 - DNA, 14 bp, Homo sapiens
taatttgtgaattt

SEQ ID NO: 5636016 - DNA, 15 bp, Homo sapiens
taatttgtgaatttg

SEQ ID NO: 5636017 - DNA, 17 bp, Homo sapiens
taatttgtgaatttgca

SEQ ID NO: 5636018 - DNA, 18 bp, Homo sapiens
taatttgtgatacaatgc

SEQ ID NO: 5636019 - DNA, 14 bp, Homo sapiens
taatttgtgtaata

SEQ ID NO: 5636020 - DNA, 21 bp, Homo sapiens
taatttgtgtaataaagtgtt

SEQ ID NO: 5636021 - DNA, 20 bp, Homo sapiens
taatttgtgtctgtgtttaa

SEQ ID NO: 5636022 - DNA, 15 bp, Homo sapiens
taatttgttatgtat

SEQ ID NO: 5636023 - DNA, 22 bp, Homo sapiens
taatttgttggggctttacata

SEQ ID NO: 5636024 - DNA, 16 bp, Homo sapiens
taatttgtttccagca

SEQ ID NO: 5636025 - DNA, 22 bp, Homo sapiens
taatttgttttcatttgtataa

SEQ ID NO: 5636026 - DNA, 17 bp, Homo sapiens
taattttaaaaatggtg

SEQ ID NO: 5636027 - DNA, 20 bp, Homo sapiens
taattttaaaagtctatttt

SEQ ID NO: 5636028 - DNA, 14 bp, Homo sapiens
taattttaaacaaa

SEQ ID NO: 5636029 - DNA, 16 bp, Homo sapiens
taattttaaagtaatt

SEQ ID NO: 5636030 - DNA, 21 bp, Homo sapiens
taattttaaagtaatttctaa

SEQ ID NO: 5636031 - DNA, 21 bp, Homo sapiens
taattttaaataacctctggc

SEQ ID NO: 5636032 - DNA, 23 bp, Homo sapiens
taattttaacaaacgcattaaga

SEQ ID NO: 5636033 - DNA, 22 bp, Homo sapiens
taattttaaccaaaacatgtct

SEQ ID NO: 5636034 - DNA, 14 bp, Homo sapiens
taattttaactgat

SEQ ID NO: 5636035 - DNA, 12 bp, Homo sapiens
taattttaagtt

SEQ ID NO: 5636036 - DNA, 14 bp, Homo sapiens
taattttacaaagt

SEQ ID NO: 5636037 - DNA, 15 bp, Homo sapiens
taattttacacatta

SEQ ID NO: 5636038 - DNA, 17 bp, Homo sapiens
taattttactcactcac

SEQ ID NO: 5636039 - DNA, 12 bp, Homo sapiens
taattttacttt

SEQ ID NO: 5636040 - DNA, 16 bp, Homo sapiens
taattttagaaagaaa

SEQ ID NO: 5636041 - DNA, 23 bp, Homo sapiens
taattttagtttttcattaaata

SEQ ID NO: 5636042 - DNA, 15 bp, Homo sapiens
taattttatctgtat

SEQ ID NO: 5636043 - DNA, 18 bp, Homo sapiens
taattttatgaatgtctt

SEQ ID NO: 5636044 - DNA, 23 bp, Homo sapiens
taattttatggtggaaaagaact

SEQ ID NO: 5636045 - DNA, 22 bp, Homo sapiens
taattttattagaataatttca

SEQ ID NO: 5636046 - DNA, 17 bp, Homo sapiens
taattttattgcaaagt

SEQ ID NO: 5636047 - DNA, 18 bp, Homo sapiens
taattttatttataaact

SEQ ID NO: 5636048 - DNA, 18 bp, Homo sapiens
taattttcacaaaatgtc

SEQ ID NO: 5636049 - DNA, 15 bp, Homo sapiens
taattttcaccgagc

SEQ ID NO: 5636050 - DNA, 16 bp, Homo sapiens
taattttcacttctgt

SEQ ID NO: 5636051 - DNA, 21 bp, Homo sapiens
taattttcaggatttttggta

SEQ ID NO: 5636052 - DNA, 15 bp, Homo sapiens
taattttcagttcta

SEQ ID NO: 5636053 - DNA, 21 bp, Homo sapiens
taattttccagtataaaacaa

SEQ ID NO: 5636054 - DNA, 20 bp, Homo sapiens
taattttcctcaatcacact

SEQ ID NO: 5636055 - DNA, 13 bp, Homo sapiens
taattttcctcct

SEQ ID NO: 5636056 - DNA, 22 bp, Homo sapiens
taattttcctctaattaaaatg

SEQ ID NO: 5636057 - DNA, 13 bp, Homo sapiens
taattttctaaga

SEQ ID NO: 5636058 - DNA, 19 bp, Homo sapiens
taattttctaagacagttt

SEQ ID NO: 5636059 - DNA, 21 bp, Homo sapiens
taattttctagattttctact

SEQ ID NO: 5636060 - DNA, 13 bp, Homo sapiens
taattttctatgt

SEQ ID NO: 5636061 - DNA, 13 bp, Homo sapiens
taattttctcaaa

SEQ ID NO: 5636062 - DNA, 19 bp, Homo sapiens
taattttctcaaaagcatt

SEQ ID NO: 5636063 - DNA, 16 bp, Homo sapiens
taattttctctttagg

SEQ ID NO: 5636064 - DNA, 15 bp, Homo sapiens
taattttcttctcat

SEQ ID NO: 5636065 - DNA, 13 bp, Homo sapiens
taattttcttgat

SEQ ID NO: 5636066 - DNA, 13 bp, Homo sapiens
taattttgaaaaa

SEQ ID NO: 5636067 - DNA, 22 bp, Homo sapiens
taattttgaagtgctgtttatt

SEQ ID NO: 5636068 - DNA, 11 bp, Homo sapiens
taattttgaat

SEQ ID NO: 5636069 - DNA, 21 bp, Homo sapiens
taattttgacactatatctgt

SEQ ID NO: 5636070 - DNA, 18 bp, Homo sapiens
taattttgatatacattg

SEQ ID NO: 5636071 - DNA, 13 bp, Homo sapiens
taattttgatttt

SEQ ID NO: 5636072 - DNA, 12 bp, Homo sapiens
taattttgcaaa

SEQ ID NO: 5636073 - DNA, 14 bp, Homo sapiens
taattttgcagcag

SEQ ID NO: 5636074 - DNA, 19 bp, Homo sapiens
taattttgcatactgaaaa

SEQ ID NO: 5636075 - DNA, 15 bp, Homo sapiens
taattttgcctttaa

SEQ ID NO: 5636076 - DNA, 12 bp, Homo sapiens
taattttgctaa

SEQ ID NO: 5636077 - DNA, 20 bp, Homo sapiens
taattttggaataatttcta

SEQ ID NO: 5636078 - DNA, 13 bp, Homo sapiens
taattttggaatt

SEQ ID NO: 5636079 - DNA, 13 bp, Homo sapiens
taattttggataa

SEQ ID NO: 5636080 - DNA, 13 bp, Homo sapiens
taattttggattt

SEQ ID NO: 5636081 - DNA, 21 bp, Homo sapiens
taattttggttgtattctttg

SEQ ID NO: 5636082 - DNA, 20 bp, Homo sapiens
taattttgtacgtatgaatg

SEQ ID NO: 5636083 - DNA, 15 bp, Homo sapiens
taattttgtattttc

SEQ ID NO: 5636084 - DNA, 17 bp, Homo sapiens
taattttgtatttttag

SEQ ID NO: 5636085 - DNA, 12 bp, Homo sapiens
taattttgtcag

SEQ ID NO: 5636086 - DNA, 11 bp, Homo sapiens
taattttgtct

SEQ ID NO: 5636087 - DNA, 13 bp, Homo sapiens
taattttgtcttt

SEQ ID NO: 5636088 - DNA, 13 bp, Homo sapiens
taattttgtgaag

SEQ ID NO: 5636089 - DNA, 20 bp, Homo sapiens
taattttgtgctctttcctg

SEQ ID NO: 5636090 - DNA, 19 bp, Homo sapiens
taattttgtgtaagaaata

SEQ ID NO: 5636091 - DNA, 15 bp, Homo sapiens
taattttgtgttgta

SEQ ID NO: 5636092 - DNA, 18 bp, Homo sapiens
taattttgtgttgtacaa

SEQ ID NO: 5636093 - DNA, 22 bp, Homo sapiens
taattttgttaagaatttcaat

SEQ ID NO: 5636094 - DNA, 16 bp, Homo sapiens
taattttgttcctgtt

SEQ ID NO: 5636095 - DNA, 18 bp, Homo sapiens
taattttgttcctgttta

SEQ ID NO: 5636096 - DNA, 13 bp, Homo sapiens
taattttgttgaa

SEQ ID NO: 5636097 - DNA, 19 bp, Homo sapiens
taattttgttgaaaatggt

SEQ ID NO: 5636098 - DNA, 16 bp, Homo sapiens
taattttgtttgtaat

SEQ ID NO: 5636099 - DNA, 21 bp, Homo sapiens
tacaagtttcagtaatagctg

SEQ ID NO: 5636100 - DNA, 14 bp, Homo sapiens
tacaagtttcatcc

SEQ ID NO: 5636101 - DNA, 18 bp, Homo sapiens
tacaagtttcatccagaa

SEQ ID NO: 5636102 - DNA, 14 bp, Homo sapiens
tacaagttttgtat

SEQ ID NO: 5636103 - DNA, 15 bp, Homo sapiens
tacaagttttgtata

SEQ ID NO: 5636104 - DNA, 23 bp, Homo sapiens
tacaagttttttaggattctttt

SEQ ID NO: 5636105 - DNA, 23 bp, Homo sapiens
tacaataaaacaaataaatatga

SEQ ID NO: 5636106 - DNA, 21 bp, Homo sapiens
tacaataaaactttgctgcca

SEQ ID NO: 5636107 - DNA, 13 bp, Homo sapiens
tacaataaaagag

SEQ ID NO: 5636108 - DNA, 17 bp, Homo sapiens
tacaataaaagagcttt

SEQ ID NO: 5636109 - DNA, 15 bp, Homo sapiens
tacaataaaattttg

SEQ ID NO: 5636110 - DNA, 11 bp, Homo sapiens
tacaataaact

SEQ ID NO: 5636111 - DNA, 13 bp, Homo sapiens
tacaataaactgg

SEQ ID NO: 5636112 - DNA, 15 bp, Homo sapiens
tacaataaataatct

SEQ ID NO: 5636113 - DNA, 18 bp, Homo sapiens
tacaataaatattctgca

SEQ ID NO: 5636114 - DNA, 20 bp, Homo sapiens
tacaataaatatttgaaccc

SEQ ID NO: 5636115 - DNA, 20 bp, Homo sapiens
tacaataaatcctttacttt

SEQ ID NO: 5636116 - DNA, 15 bp, Homo sapiens
tacaataaatgctga

SEQ ID NO: 5636117 - DNA, 17 bp, Homo sapiens
tacaataaatgctgaat

SEQ ID NO: 5636118 - DNA, 16 bp, Homo sapiens
tacaataaattgctaa

SEQ ID NO: 5636119 - DNA, 22 bp, Homo sapiens
tacaataaattgctaatgttgc

SEQ ID NO: 5636120 - DNA, 23 bp, Homo sapiens
tacaataaattgctaatgttgct

SEQ ID NO: 5636121 - DNA, 20 bp, Homo sapiens
tacaataacccagttacttt

SEQ ID NO: 5636122 - DNA, 13 bp, Homo sapiens
tacaataagcaga

SEQ ID NO: 5636123 - DNA, 13 bp, Homo sapiens
tacaataatgagt

SEQ ID NO: 5636124 - DNA, 12 bp, Homo sapiens
tacaataatgga

SEQ ID NO: 5636125 - DNA, 12 bp, Homo sapiens
tacaataatgta

SEQ ID NO: 5636126 - DNA, 20 bp, Homo sapiens
tacaataatgtaatttagtc

SEQ ID NO: 5636127 - DNA, 19 bp, Homo sapiens
tacaataatgtactcacat

SEQ ID NO: 5636128 - DNA, 23 bp, Homo sapiens
tacaatacaacacattgaaactg

SEQ ID NO: 5636129 - DNA, 16 bp, Homo sapiens
tacaatacaatgtaca

SEQ ID NO: 5636130 - DNA, 13 bp, Homo sapiens
tacaatacatata

SEQ ID NO: 5636131 - DNA, 14 bp, Homo sapiens
tacaatacatatat

SEQ ID NO: 5636132 - DNA, 21 bp, Homo sapiens
tacaataccgtaacaatgttt

SEQ ID NO: 5636133 - DNA, 14 bp, Homo sapiens
tacaatagtataca

SEQ ID NO: 5636134 - DNA, 19 bp, Homo sapiens
tacaatagtatacatttta

SEQ ID NO: 5636135 - DNA, 22 bp, Homo sapiens
tacaatagtatacattttataa

SEQ ID NO: 5636136 - DNA, 17 bp, Homo sapiens
tacaatatataaaaata

SEQ ID NO: 5636137 - DNA, 12 bp, Homo sapiens
tacaatatatat

SEQ ID NO: 5636138 - DNA, 15 bp, Homo sapiens
tacaatatatattct

SEQ ID NO: 5636139 - DNA, 19 bp, Homo sapiens
tacaatatggacatgtaaa

SEQ ID NO: 5636140 - DNA, 17 bp, Homo sapiens
tacaatatgtatttatg

SEQ ID NO: 5636141 - DNA, 19 bp, Homo sapiens
tacaatattatgaaatttc

SEQ ID NO: 5636142 - DNA, 18 bp, Homo sapiens
tacaatattatgtttcct

SEQ ID NO: 5636143 - DNA, 16 bp, Homo sapiens
tacaatattctctctt

SEQ ID NO: 5636144 - DNA, 14 bp, Homo sapiens
tacaatattttaag

SEQ ID NO: 5636145 - DNA, 15 bp, Homo sapiens
tacaatattttaagc

SEQ ID NO: 5636146 - DNA, 17 bp, Homo sapiens
tacaatattttaagcat

SEQ ID NO: 5636147 - DNA, 17 bp, Homo sapiens
tacaatcagaaggtttc

SEQ ID NO: 5636148 - DNA, 15 bp, Homo sapiens
tacaatcagctgctt

SEQ ID NO: 5636149 - DNA, 18 bp, Homo sapiens
tacaatcagctgctttgt

SEQ ID NO: 5636150 - DNA, 20 bp, Homo sapiens
tacaatcagctgctttgtta

SEQ ID NO: 5636151 - DNA, 22 bp, Homo sapiens
tacaatcagctgctttgttacc

SEQ ID NO: 5636152 - DNA, 16 bp, Homo sapiens
tacaatcagttgactt

SEQ ID NO: 5636153 - DNA, 20 bp, Homo sapiens
tacaatcatggtcaagttcc

SEQ ID NO: 5636154 - DNA, 22 bp, Homo sapiens
tacaatcatggtcaagttccca

SEQ ID NO: 5636155 - DNA, 22 bp, Homo sapiens
tacaatcattgctgaaaatggt

SEQ ID NO: 5636156 - DNA, 13 bp, Homo sapiens
tacaatctattta

SEQ ID NO: 5636157 - DNA, 18 bp, Homo sapiens
tacaatctgtatctttga

SEQ ID NO: 5636158 - DNA, 20 bp, Homo sapiens
tacaatctgtatctttgaca

SEQ ID NO: 5636159 - DNA, 12 bp, Homo sapiens
tacaatcttggg

SEQ ID NO: 5636160 - DNA, 13 bp, Homo sapiens
tacaatcttggga

SEQ ID NO: 5636161 - DNA, 23 bp, Homo sapiens
tacaatctttattatgcattctt

SEQ ID NO: 5636162 - DNA, 15 bp, Homo sapiens
tacaatgaacactta

SEQ ID NO: 5636163 - DNA, 20 bp, Homo sapiens
tacaatgaactgcttttcct

SEQ ID NO: 5636164 - DNA, 21 bp, Homo sapiens
tacaatgactagtcacctggg

SEQ ID NO: 5636165 - DNA, 22 bp, Homo sapiens
tacaatgactagtcacctgggg

SEQ ID NO: 5636166 - DNA, 14 bp, Homo sapiens
tacaatgactttat

SEQ ID NO: 5636167 - DNA, 12 bp, Homo sapiens
tacaatgatggt

SEQ ID NO: 5636168 - DNA, 15 bp, Homo sapiens
tacaatgatggtaaa

SEQ ID NO: 5636169 - DNA, 23 bp, Homo sapiens
tacaatgatggtaaagccatgtt

SEQ ID NO: 5636170 - DNA, 14 bp, Homo sapiens
tacaatgatgtaaa

SEQ ID NO: 5636171 - DNA, 20 bp, Homo sapiens
tacaatgatgtataattaat

SEQ ID NO: 5636172 - DNA, 14 bp, Homo sapiens
tacaatggaaacaa

SEQ ID NO: 5636173 - DNA, 16 bp, Homo sapiens
tacaatggaataaatt

SEQ ID NO: 5636174 - DNA, 18 bp, Homo sapiens
tacaatggaataaattat

SEQ ID NO: 5636175 - DNA, 21 bp, Homo sapiens
tacaatggcccgacatttctt

SEQ ID NO: 5636176 - DNA, 19 bp, Homo sapiens
tacaatgggaaaacttcac

SEQ ID NO: 5636177 - DNA, 13 bp, Homo sapiens
tacaatggtttat

SEQ ID NO: 5636178 - DNA, 14 bp, Homo sapiens
tacaatggtttatt

SEQ ID NO: 5636179 - DNA, 17 bp, Homo sapiens
tacaatggtttattccc

SEQ ID NO: 5636180 - DNA, 20 bp, Homo sapiens
tacaatggtttattcccaag

SEQ ID NO: 5636181 - DNA, 23 bp, Homo sapiens
tacaatggtttattcccaagtat

SEQ ID NO: 5636182 - DNA, 14 bp, Homo sapiens
tacaatgtaaacca

SEQ ID NO: 5636183 - DNA, 12 bp, Homo sapiens
tacaatgtacaa

SEQ ID NO: 5636184 - DNA, 17 bp, Homo sapiens
tacaatgtacaattatg

SEQ ID NO: 5636185 - DNA, 19 bp, Homo sapiens
tacaatgtacaattatgtc

SEQ ID NO: 5636186 - DNA, 13 bp, Homo sapiens
tacaatgtagatg

SEQ ID NO: 5636187 - DNA, 21 bp, Homo sapiens
tacaatgtatctttattaaaa

SEQ ID NO: 5636188 - DNA, 16 bp, Homo sapiens
tacaatgtatgtacaa

SEQ ID NO: 5636189 - DNA, 14 bp, Homo sapiens
tacaatgtatttat

SEQ ID NO: 5636190 - DNA, 17 bp, Homo sapiens
tacaatgtatttattta

SEQ ID NO: 5636191 - DNA, 19 bp, Homo sapiens
tacaatgtatttatttaaa

SEQ ID NO: 5636192 - DNA, 11 bp, Homo sapiens
tacaatgtgaa

SEQ ID NO: 5636193 - DNA, 16 bp, Homo sapiens
tacaatgtgaacttta

SEQ ID NO: 5636194 - DNA, 20 bp, Homo sapiens
tacaatgtgaactttattaa

SEQ ID NO: 5636195 - DNA, 12 bp, Homo sapiens
tacaatgtgaat

SEQ ID NO: 5636196 - DNA, 13 bp, Homo sapiens
tacaatgtgaata

SEQ ID NO: 5636197 - DNA, 13 bp, Homo sapiens
tacaatgtgactt

SEQ ID NO: 5636198 - DNA, 20 bp, Homo sapiens
tacaatgtgtttttctccag

SEQ ID NO: 5636199 - DNA, 20 bp, Homo sapiens
tacaatgttctgttgtaaag

SEQ ID NO: 5636200 - DNA, 19 bp, Homo sapiens
tacaatgttgtatttgtta

SEQ ID NO: 5636201 - DNA, 13 bp, Homo sapiens
tacaatgttttat

SEQ ID NO: 5636202 - DNA, 12 bp, Homo sapiens
tacaattaaagg

SEQ ID NO: 5636203 - DNA, 21 bp, Homo sapiens
tacaattaaaggtcctgccct

SEQ ID NO: 5636204 - DNA, 22 bp, Homo sapiens
tacaattatttttacagttctc

SEQ ID NO: 5636205 - DNA, 21 bp, Homo sapiens
tacaattcattgttttgcaaa

SEQ ID NO: 5636206 - DNA, 19 bp, Homo sapiens
tacaattctttgttgctta

SEQ ID NO: 5636207 - DNA, 14 bp, Homo sapiens
tacaattgaaatga

SEQ ID NO: 5636208 - DNA, 16 bp, Homo sapiens
tacaattgaaatgact

SEQ ID NO: 5636209 - DNA, 15 bp, Homo sapiens
tacaattgatctttt

SEQ ID NO: 5636210 - DNA, 15 bp, Homo sapiens
tacaattgcactgct

SEQ ID NO: 5636211 - DNA, 19 bp, Homo sapiens
tacaattgcactgctgttc

SEQ ID NO: 5636212 - DNA, 17 bp, Homo sapiens
tacaattgtaaaactga

SEQ ID NO: 5636213 - DNA, 21 bp, Homo sapiens
tacaattgtaaaactgaggca

SEQ ID NO: 5636214 - DNA, 18 bp, Homo sapiens
tacaattgttatgatcta

SEQ ID NO: 5636215 - DNA, 17 bp, Homo sapiens
tacaatttacaaagtgt

SEQ ID NO: 5636216 - DNA, 23 bp, Homo sapiens
tacaatttacttttaataaagta

SEQ ID NO: 5636217 - DNA, 15 bp, Homo sapiens
tacaatttcaactac

SEQ ID NO: 5636218 - DNA, 17 bp, Homo sapiens
tacaatttccatatagt

SEQ ID NO: 5636219 - DNA, 14 bp, Homo sapiens
tacaatttctatta

SEQ ID NO: 5636220 - DNA, 16 bp, Homo sapiens
tacaatttgtactttt

SEQ ID NO: 5636221 - DNA, 23 bp, Homo sapiens
tacaatttgtacttttttcttaa

SEQ ID NO: 5636222 - DNA, 20 bp, Homo sapiens
tacaatttgttaattcctat

SEQ ID NO: 5636223 - DNA, 22 bp, Homo sapiens
tacaatttgttcttgtatttta

SEQ ID NO: 5636224 - DNA, 21 bp, Homo sapiens
tacaatttgtttttgcatttt

SEQ ID NO: 5636225 - DNA, 20 bp, Homo sapiens
tacaattttagtcactaaga

SEQ ID NO: 5636226 - DNA, 16 bp, Homo sapiens
tacaatttttaataaa

SEQ ID NO: 5636227 - DNA, 22 bp, Homo sapiens
tacaatttttatttcttttact

SEQ ID NO: 5636228 - DNA, 23 bp, Homo sapiens
tacaattttttatcatgcatgtc

SEQ ID NO: 5636229 - DNA, 18 bp, Homo sapiens
tacaattttttttattag

SEQ ID NO: 5636230 - DNA, 19 bp, Homo sapiens
tacaattttttttattagt

SEQ ID NO: 5636231 - DNA, 21 bp, Homo sapiens
tacaattttttttattagtat

SEQ ID NO: 5636232 - DNA, 18 bp, Homo sapiens
tacacaaaaaagtataga

SEQ ID NO: 5636233 - DNA, 23 bp, Homo sapiens
tacacaaaaagaaagctgtgaaa

SEQ ID NO: 5636234 - DNA, 20 bp, Homo sapiens
tacacaaaatcaaataatac

SEQ ID NO: 5636235 - DNA, 19 bp, Homo sapiens
tacacaaatacttattcat

SEQ ID NO: 5636236 - DNA, 21 bp, Homo sapiens
tacacaaatccctatgttgct

SEQ ID NO: 5636237 - DNA, 18 bp, Homo sapiens
tacacaactagttttgtt

SEQ ID NO: 5636238 - DNA, 15 bp, Homo sapiens
tacacaactcactcc

SEQ ID NO: 5636239 - DNA, 22 bp, Homo sapiens
tacacaactccactgtctttaa

SEQ ID NO: 5636240 - DNA, 22 bp, Homo sapiens
tacacaagactttccccatact

SEQ ID NO: 5636241 - DNA, 18 bp, Homo sapiens
tacacaaggacagaaccc

SEQ ID NO: 5636242 - DNA, 18 bp, Homo sapiens
tacacaaggagctttctt

SEQ ID NO: 5636243 - DNA, 23 bp, Homo sapiens
tacacaaggccagaaaaagaaga

SEQ ID NO: 5636244 - DNA, 17 bp, Homo sapiens
tacacaatacagtatta

SEQ ID NO: 5636245 - DNA, 21 bp, Homo sapiens
tacacaatatacgaaaagcca

SEQ ID NO: 5636246 - DNA, 17 bp, Homo sapiens
tacacaatggtttttaa

SEQ ID NO: 5636247 - DNA, 22 bp, Homo sapiens
tacacacaaaaaccttggcata

SEQ ID NO: 5636248 - DNA, 9 bp, Homo sapiens
tacacacac

SEQ ID NO: 5636249 - DNA, 12 bp, Homo sapiens
tacacacacaca

SEQ ID NO: 5636250 - DNA, 13 bp, Homo sapiens
tacacacacacac

SEQ ID NO: 5636251 - DNA, 18 bp, Homo sapiens
tacacacacacacacaca

SEQ ID NO: 5636252 - DNA, 18 bp, Homo sapiens
tacacacacacacacagc

SEQ ID NO: 5636253 - DNA, 22 bp, Homo sapiens
tacacacacacacacagccaca

SEQ ID NO: 5636254 - DNA, 17 bp, Homo sapiens
tacacacacacacatac

SEQ ID NO: 5636255 - DNA, 22 bp, Homo sapiens
tacacacacacagacatatata

SEQ ID NO: 5636256 - DNA, 13 bp, Homo sapiens
tacacacacactc

SEQ ID NO: 5636257 - DNA, 19 bp, Homo sapiens
tacacacacactccctgct

SEQ ID NO: 5636258 - DNA, 12 bp, Homo sapiens
tacacacacaga

SEQ ID NO: 5636259 - DNA, 14 bp, Homo sapiens
tacacacacagcct

SEQ ID NO: 5636260 - DNA, 18 bp, Homo sapiens
tacacacacccaggccca

SEQ ID NO: 5636261 - DNA, 21 bp, Homo sapiens
tacacacacgttgacgggccg

SEQ ID NO: 5636262 - DNA, 23 bp, Homo sapiens
tacacacacgttgacgggccgca

SEQ ID NO: 5636263 - DNA, 13 bp, Homo sapiens
tacacacccccag

SEQ ID NO: 5636264 - DNA, 16 bp, Homo sapiens
tacacacccccagaga

SEQ ID NO: 5636265 - DNA, 18 bp, Homo sapiens
tacacaccctccagcaca

SEQ ID NO: 5636266 - DNA, 19 bp, Homo sapiens
tacacaccctccagcacag

SEQ ID NO: 5636267 - DNA, 23 bp, Homo sapiens
tacacaccctccagcacagactg

SEQ ID NO: 5636268 - DNA, 13 bp, Homo sapiens
tacacaccctgcc

SEQ ID NO: 5636269 - DNA, 17 bp, Homo sapiens
tacacacctaagggaca

SEQ ID NO: 5636270 - DNA, 14 bp, Homo sapiens
tacacacgctgcct

SEQ ID NO: 5636271 - DNA, 23 bp, Homo sapiens
tacacacgctgccttcggtaccc

SEQ ID NO: 5636272 - DNA, 16 bp, Homo sapiens
tacacacgtaccttca

SEQ ID NO: 5636273 - DNA, 16 bp, Homo sapiens
tacacacgtgcaattt

SEQ ID NO: 5636274 - DNA, 15 bp, Homo sapiens
tacacactaacatca

SEQ ID NO: 5636275 - DNA, 13 bp, Homo sapiens
tacacactcagcc

SEQ ID NO: 5636276 - DNA, 18 bp, Homo sapiens
tacagtaggagcccagct

SEQ ID NO: 5636277 - DNA, 16 bp, Homo sapiens
tacagtagtgagaaga

SEQ ID NO: 5636278 - DNA, 18 bp, Homo sapiens
tacagtagtgagaagaat

SEQ ID NO: 5636279 - DNA, 18 bp, Homo sapiens
tacagtagtgtcatcact

SEQ ID NO: 5636280 - DNA, 14 bp, Homo sapiens
tacagtataattaa

SEQ ID NO: 5636281 - DNA, 16 bp, Homo sapiens
tacagtataattaaca

SEQ ID NO: 5636282 - DNA, 19 bp, Homo sapiens
tacagtataattaacatgt

SEQ ID NO: 5636283 - DNA, 12 bp, Homo sapiens
tacagtatataa

SEQ ID NO: 5636284 - DNA, 19 bp, Homo sapiens
tacagtatatcttaagata

SEQ ID NO: 5636285 - DNA, 21 bp, Homo sapiens
tacagtatattcttgtaaata

SEQ ID NO: 5636286 - DNA, 18 bp, Homo sapiens
tacagtatctcagggcct

SEQ ID NO: 5636287 - DNA, 15 bp, Homo sapiens
tacagtatgcttgct

SEQ ID NO: 5636288 - DNA, 22 bp, Homo sapiens
tacagtatgggggttgtaaatt

SEQ ID NO: 5636289 - DNA, 12 bp, Homo sapiens
tacagtatgtgt

SEQ ID NO: 5636290 - DNA, 13 bp, Homo sapiens
tacagtatgtgtc

SEQ ID NO: 5636291 - DNA, 17 bp, Homo sapiens
tacagtatgtgtctagc

SEQ ID NO: 5636292 - DNA, 18 bp, Homo sapiens
tacagtattatagacaaa

SEQ ID NO: 5636293 - DNA, 22 bp, Homo sapiens
tacagtattatagacaaaagaa

SEQ ID NO: 5636294 - DNA, 21 bp, Homo sapiens
tacagtattatttagtaaaat

SEQ ID NO: 5636295 - DNA, 17 bp, Homo sapiens
tacagtattcccactct

SEQ ID NO: 5636296 - DNA, 17 bp, Homo sapiens
tacagtattcttttaaa

SEQ ID NO: 5636297 - DNA, 22 bp, Homo sapiens
tacagtatttaccttcctttgt

SEQ ID NO: 5636298 - DNA, 20 bp, Homo sapiens
tacagtatttttcagatata

SEQ ID NO: 5636299 - DNA, 23 bp, Homo sapiens
tacagtatttttcagatataaat

SEQ ID NO: 5636300 - DNA, 14 bp, Homo sapiens
tacagtcaatttta

SEQ ID NO: 5636301 - DNA, 16 bp, Homo sapiens
tacagtcccagcacat

SEQ ID NO: 5636302 - DNA, 17 bp, Homo sapiens
tacagtcctcccatctc

SEQ ID NO: 5636303 - DNA, 15 bp, Homo sapiens
tacagtccttcaaaa

SEQ ID NO: 5636304 - DNA, 19 bp, Homo sapiens
tacagtccttcaaaatcct

SEQ ID NO: 5636305 - DNA, 13 bp, Homo sapiens
tacagtctatttg

SEQ ID NO: 5636306 - DNA, 20 bp, Homo sapiens
tacagtctctatttgatttg

SEQ ID NO: 5636307 - DNA, 22 bp, Homo sapiens
tacagtctctatttgatttgca

SEQ ID NO: 5636308 - DNA, 16 bp, Homo sapiens
tacagtctctttcttc

SEQ ID NO: 5636309 - DNA, 20 bp, Homo sapiens
tacagtctgtcttctgtata

SEQ ID NO: 5636310 - DNA, 13 bp, Homo sapiens
tacagtcttattt

SEQ ID NO: 5636311 - DNA, 15 bp, Homo sapiens
tacagtcttccacaa

SEQ ID NO: 5636312 - DNA, 20 bp, Homo sapiens
tacagtcttccatttgcaag

SEQ ID NO: 5636313 - DNA, 17 bp, Homo sapiens
tacagtcttgcagcagg

SEQ ID NO: 5636314 - DNA, 20 bp, Homo sapiens
tacagtctttctttctgaat

SEQ ID NO: 5636315 - DNA, 20 bp, Homo sapiens
tacagtgaaaatgtaagctg

SEQ ID NO: 5636316 - DNA, 21 bp, Homo sapiens
tacagtgaaatgagcagccct

SEQ ID NO: 5636317 - DNA, 16 bp, Homo sapiens
tacagtgaattgtctt

SEQ ID NO: 5636318 - DNA, 16 bp, Homo sapiens
tacagtgaatttctga

SEQ ID NO: 5636319 - DNA, 17 bp, Homo sapiens
tacagtgaatttctgat

SEQ ID NO: 5636320 - DNA, 17 bp, Homo sapiens
tacagtgactactatta

SEQ ID NO: 5636321 - DNA, 16 bp, Homo sapiens
tacagtgactccctgg

SEQ ID NO: 5636322 - DNA, 18 bp, Homo sapiens
tacagtgactccctggga

SEQ ID NO: 5636323 - DNA, 17 bp, Homo sapiens
tacagtgaggagggtgg

SEQ ID NO: 5636324 - DNA, 18 bp, Homo sapiens
tacagtgatcagttgctc

SEQ ID NO: 5636325 - DNA, 14 bp, Homo sapiens
tacagtgcagacag

SEQ ID NO: 5636326 - DNA, 22 bp, Homo sapiens
tacagtgcatagttgtagacaa

SEQ ID NO: 5636327 - DNA, 16 bp, Homo sapiens
tacagtgcctaaaata

SEQ ID NO: 5636328 - DNA, 12 bp, Homo sapiens
tacagtgcctgt

SEQ ID NO: 5636329 - DNA, 17 bp, Homo sapiens
tacagtgcctgtatctt

SEQ ID NO: 5636330 - DNA, 13 bp, Homo sapiens
tacagtgctttat

SEQ ID NO: 5636331 - DNA, 15 bp, Homo sapiens
tacagtgctttatgg

SEQ ID NO: 5636332 - DNA, 16 bp, Homo sapiens
tacagtggagaaatat

SEQ ID NO: 5636333 - DNA, 15 bp, Homo sapiens
tacagtggagggaga

SEQ ID NO: 5636334 - DNA, 19 bp, Homo sapiens
tacagtggagggagactga

SEQ ID NO: 5636335 - DNA, 15 bp, Homo sapiens
tacagtggagtgaga

SEQ ID NO: 5636336 - DNA, 21 bp, Homo sapiens
tacagtggttttatactgaag

SEQ ID NO: 5636337 - DNA, 18 bp, Homo sapiens
tacagtgtaaaaattcag

SEQ ID NO: 5636338 - DNA, 15 bp, Homo sapiens
tacagtgtacagtct

SEQ ID NO: 5636339 - DNA, 15 bp, Homo sapiens
tacagtgtacatgta

SEQ ID NO: 5636340 - DNA, 16 bp, Homo sapiens
tacagtgtatctcgaa

SEQ ID NO: 5636341 - DNA, 18 bp, Homo sapiens
tacagtgtctgtgtgtgt

SEQ ID NO: 5636342 - DNA, 12 bp, Homo sapiens
tacagtgtcttt

SEQ ID NO: 5636343 - DNA, 14 bp, Homo sapiens
tacagtgtcttttt

SEQ ID NO: 5636344 - DNA, 13 bp, Homo sapiens
tacagtgtgtgtg

SEQ ID NO: 5636345 - DNA, 15 bp, Homo sapiens
tacagtgttctgttt

SEQ ID NO: 5636346 - DNA, 20 bp, Homo sapiens
tacagttaggcaccagaaga

SEQ ID NO: 5636347 - DNA, 21 bp, Homo sapiens
tacagttagggctcctattca

SEQ ID NO: 5636348 - DNA, 22 bp, Homo sapiens
tacagttagggttttgcaataa

SEQ ID NO: 5636349 - DNA, 17 bp, Homo sapiens
tacagttatacatacct

SEQ ID NO: 5636350 - DNA, 16 bp, Homo sapiens
tacagttatcctgcaa

SEQ ID NO: 5636351 - DNA, 13 bp, Homo sapiens
tacagttatttca

SEQ ID NO: 5636352 - DNA, 15 bp, Homo sapiens
tacagttattttgga

SEQ ID NO: 5636353 - DNA, 12 bp, Homo sapiens
tacagttcagtt

SEQ ID NO: 5636354 - DNA, 18 bp, Homo sapiens
tacagttcctaggtataa

SEQ ID NO: 5636355 - DNA, 21 bp, Homo sapiens
tacagttctgtggtttcatgt

SEQ ID NO: 5636356 - DNA, 22 bp, Homo sapiens
tacagttcttcgggaagagagg

SEQ ID NO: 5636357 - DNA, 20 bp, Homo sapiens
tacagttctttcctctttct

SEQ ID NO: 5636358 - DNA, 23 bp, Homo sapiens
tacagttctttcctctttctgct

SEQ ID NO: 5636359 - DNA, 17 bp, Homo sapiens
tacagttgaaaaacagc

SEQ ID NO: 5636360 - DNA, 19 bp, Homo sapiens
tacagttgaaaacttgtaa

SEQ ID NO: 5636361 - DNA, 17 bp, Homo sapiens
tacagttgaaataactg

SEQ ID NO: 5636362 - DNA, 15 bp, Homo sapiens
tacagttgactggct

SEQ ID NO: 5636363 - DNA, 17 bp, Homo sapiens
tacagttgagctcaggt

SEQ ID NO: 5636364 - DNA, 15 bp, Homo sapiens
tacagttgatgtcga

SEQ ID NO: 5636365 - DNA, 13 bp, Homo sapiens
tacagttgcagga

SEQ ID NO: 5636366 - DNA, 20 bp, Homo sapiens
tacagttgggaagtctcagc

SEQ ID NO: 5636367 - DNA, 14 bp, Homo sapiens
tacagttgtcctga

SEQ ID NO: 5636368 - DNA, 22 bp, Homo sapiens
tacagttgtgataatagcattt

SEQ ID NO: 5636369 - DNA, 20 bp, Homo sapiens
tacagtttataaagccaaga

SEQ ID NO: 5636370 - DNA, 22 bp, Homo sapiens
tacagtttataaagccaagaat

SEQ ID NO: 5636371 - DNA, 19 bp, Homo sapiens
tacagtttatattgtggaa

SEQ ID NO: 5636372 - DNA, 17 bp, Homo sapiens
tacagtttattttctgt

SEQ ID NO: 5636373 - DNA, 12 bp, Homo sapiens
tacagtttcaaa

SEQ ID NO: 5636374 - DNA, 14 bp, Homo sapiens
tacagtttctgctt

SEQ ID NO: 5636375 - DNA, 17 bp, Homo sapiens
tacagtttcttcatgca

SEQ ID NO: 5636376 - DNA, 22 bp, Homo sapiens
tacagtttgactttttggaatt

SEQ ID NO: 5636377 - DNA, 16 bp, Homo sapiens
tacagtttgctgtact

SEQ ID NO: 5636378 - DNA, 21 bp, Homo sapiens
tacagtttgctgtactagaga

SEQ ID NO: 5636379 - DNA, 19 bp, Homo sapiens
tacagtttgtgttttaaaa

SEQ ID NO: 5636380 - DNA, 18 bp, Homo sapiens
tacagtttgttagtatga

SEQ ID NO: 5636381 - DNA, 19 bp, Homo sapiens
tacagtttgttagtatgag

SEQ ID NO: 5636382 - DNA, 17 bp, Homo sapiens
tacagtttgtttacaca

SEQ ID NO: 5636383 - DNA, 17 bp, Homo sapiens
tacagttttaactgtgg

SEQ ID NO: 5636384 - DNA, 19 bp, Homo sapiens
tacagttttaactgtggat

SEQ ID NO: 5636385 - DNA, 18 bp, Homo sapiens
tacagttttatgctcttt

SEQ ID NO: 5636386 - DNA, 19 bp, Homo sapiens
tacagttttatgctctttt

SEQ ID NO: 5636387 - DNA, 13 bp, Homo sapiens
tacagttttcatt

SEQ ID NO: 5636388 - DNA, 14 bp, Homo sapiens
tacagttttcctaa

SEQ ID NO: 5636389 - DNA, 15 bp, Homo sapiens
tacagttttgagtaa

SEQ ID NO: 5636390 - DNA, 15 bp, Homo sapiens
tacagttttgtggac

SEQ ID NO: 5636391 - DNA, 16 bp, Homo sapiens
tacagtttttttcttt

SEQ ID NO: 5636392 - DNA, 16 bp, Homo sapiens
tacataaaaaagtgtt

SEQ ID NO: 5636393 - DNA, 13 bp, Homo sapiens
tacataaaagaat

SEQ ID NO: 5636394 - DNA, 16 bp, Homo sapiens
tacataaaagaatgta

SEQ ID NO: 5636395 - DNA, 20 bp, Homo sapiens
tacataaaagaatgtacaga

SEQ ID NO: 5636396 - DNA, 15 bp, Homo sapiens
tacataaaagaattt

SEQ ID NO: 5636397 - DNA, 16 bp, Homo sapiens
tacataaaattttcta

SEQ ID NO: 5636398 - DNA, 14 bp, Homo sapiens
tacataaagactaa

SEQ ID NO: 5636399 - DNA, 22 bp, Homo sapiens
tacataaagactgtgctgagaa

SEQ ID NO: 5636400 - DNA, 18 bp, Homo sapiens
tacataaagctcccttga

SEQ ID NO: 5636401 - DNA, 13 bp, Homo sapiens
tacataaaggtgg

SEQ ID NO: 5636402 - DNA, 16 bp, Homo sapiens
tacataaatgcccagc

SEQ ID NO: 5636403 - DNA, 21 bp, Homo sapiens
tacataaattgcataaagcat

SEQ ID NO: 5636404 - DNA, 19 bp, Homo sapiens
tacataacaagaaaatcaa

SEQ ID NO: 5636405 - DNA, 14 bp, Homo sapiens
tacataacacattt

SEQ ID NO: 5636406 - DNA, 21 bp, Homo sapiens
tacataacaggcattgcacta

SEQ ID NO: 5636407 - DNA, 13 bp, Homo sapiens
tacataacattca

SEQ ID NO: 5636408 - DNA, 16 bp, Homo sapiens
tacataacattcaatt

SEQ ID NO: 5636409 - DNA, 15 bp, Homo sapiens
tacataactcctgtc

SEQ ID NO: 5636410 - DNA, 18 bp, Homo sapiens
tacataactcctgtccct

SEQ ID NO: 5636411 - DNA, 20 bp, Homo sapiens
tacataactcctgtcccttt

SEQ ID NO: 5636412 - DNA, 22 bp, Homo sapiens
tacataactcctgtcccttttc

SEQ ID NO: 5636413 - DNA, 23 bp, Homo sapiens
tacataactcctgtcccttttcc

SEQ ID NO: 5636414 - DNA, 22 bp, Homo sapiens
tacataacttgatatagaaagc

SEQ ID NO: 5636415 - DNA, 15 bp, Homo sapiens
tacataagaaatgta

SEQ ID NO: 5636416 - DNA, 17 bp, Homo sapiens
tacataagtaattcaag

SEQ ID NO: 5636417 - DNA, 19 bp, Homo sapiens
tacataagtaattcaagaa

SEQ ID NO: 5636418 - DNA, 22 bp, Homo sapiens
tacataatacacttgccctgct

SEQ ID NO: 5636419 - DNA, 18 bp, Homo sapiens
tacataatatatgacttc

SEQ ID NO: 5636420 - DNA, 18 bp, Homo sapiens
tacataatctctggaaat

SEQ ID NO: 5636421 - DNA, 15 bp, Homo sapiens
tacataatctgtaca

SEQ ID NO: 5636422 - DNA, 20 bp, Homo sapiens
tacataatctgtacaatgaa

SEQ ID NO: 5636423 - DNA, 17 bp, Homo sapiens
tacataatgcgtgcata

SEQ ID NO: 5636424 - DNA, 19 bp, Homo sapiens
tacataatgcgtgcatacc

SEQ ID NO: 5636425 - DNA, 20 bp, Homo sapiens
tacataatgcgtgcatacca

SEQ ID NO: 5636426 - DNA, 21 bp, Homo sapiens
tacataatgcgtgcataccac

SEQ ID NO: 5636427 - DNA, 24 bp, Homo sapiens
tacataatgcgtgcataccacttt

SEQ ID NO: 5636428 - DNA, 20 bp, Homo sapiens
tacataatgcttaatttcta

SEQ ID NO: 5636429 - DNA, 20 bp, Homo sapiens
tacataatgttagtagcact

SEQ ID NO: 5636430 - DNA, 17 bp, Homo sapiens
tacataattcactctga

SEQ ID NO: 5636431 - DNA, 19 bp, Homo sapiens
tacataattgattaaaatc

SEQ ID NO: 5636432 - DNA, 14 bp, Homo sapiens
tacataattgcatg

SEQ ID NO: 5636433 - DNA, 14 bp, Homo sapiens
tacataatttgcaa

SEQ ID NO: 5636434 - DNA, 16 bp, Homo sapiens
tacatacaacctatgt

SEQ ID NO: 5636435 - DNA, 21 bp, Homo sapiens
tacatacaacctatgtaattt

SEQ ID NO: 5636436 - DNA, 22 bp, Homo sapiens
tacatacaacctatgtaatttt

SEQ ID NO: 5636437 - DNA, 18 bp, Homo sapiens
tacatacacaccagggaa

SEQ ID NO: 5636438 - DNA, 13 bp, Homo sapiens
tacatacacatac

SEQ ID NO: 5636439 - DNA, 14 bp, Homo sapiens
tacatacacataca

SEQ ID NO: 5636440 - DNA, 16 bp, Homo sapiens
tacatacacatacata

SEQ ID NO: 5636441 - DNA, 16 bp, Homo sapiens
tacatacaccagcatt

SEQ ID NO: 5636442 - DNA, 20 bp, Homo sapiens
tacatacaccagcattcctt

SEQ ID NO: 5636443 - DNA, 13 bp, Homo sapiens
tacatacactgta

SEQ ID NO: 5636444 - DNA, 14 bp, Homo sapiens
tacatacacttgta

SEQ ID NO: 5636445 - DNA, 22 bp, Homo sapiens
tacatacacttgtataaatgta

SEQ ID NO: 5636446 - DNA, 14 bp, Homo sapiens
tacatacatacata

SEQ ID NO: 5636447 - DNA, 18 bp, Homo sapiens
tacatacatacatacata

SEQ ID NO: 5636448 - DNA, 17 bp, Homo sapiens
tacatacatacatatat

SEQ ID NO: 5636449 - DNA, 21 bp, Homo sapiens
tacataccggggctcctctcc

SEQ ID NO: 5636450 - DNA, 14 bp, Homo sapiens
tacatacctctctc

SEQ ID NO: 5636451 - DNA, 15 bp, Homo sapiens
tacatacgatttaag

SEQ ID NO: 5636452 - DNA, 16 bp, Homo sapiens
tacatacgatttaagg

SEQ ID NO: 5636453 - DNA, 17 bp, Homo sapiens
tacatacgatttaaggt

SEQ ID NO: 5636454 - DNA, 13 bp, Homo sapiens
taccaatatttaa

SEQ ID NO: 5636455 - DNA, 13 bp, Homo sapiens
taccaatctctgc

SEQ ID NO: 5636456 - DNA, 16 bp, Homo sapiens
taccaatctgggaaga

SEQ ID NO: 5636457 - DNA, 15 bp, Homo sapiens
taccaatctgtgaga

SEQ ID NO: 5636458 - DNA, 12 bp, Homo sapiens
taccaatgcatg

SEQ ID NO: 5636459 - DNA, 13 bp, Homo sapiens
taccaatgcatgc

SEQ ID NO: 5636460 - DNA, 14 bp, Homo sapiens
taccaatgctgttg

SEQ ID NO: 5636461 - DNA, 19 bp, Homo sapiens
taccaatgtaacactggcc

SEQ ID NO: 5636462 - DNA, 14 bp, Homo sapiens
taccaattatggaa

SEQ ID NO: 5636463 - DNA, 17 bp, Homo sapiens
taccaattgatgtttta

SEQ ID NO: 5636464 - DNA, 18 bp, Homo sapiens
taccacaaaagcaaaatt

SEQ ID NO: 5636465 - DNA, 19 bp, Homo sapiens
taccacaaaagcaaaattt

SEQ ID NO: 5636466 - DNA, 22 bp, Homo sapiens
taccacaaaagcaaaattttta

SEQ ID NO: 5636467 - DNA, 12 bp, Homo sapiens
taccacaagcct

SEQ ID NO: 5636468 - DNA, 13 bp, Homo sapiens
taccacaaggaaa

SEQ ID NO: 5636469 - DNA, 14 bp, Homo sapiens
taccacaaggaaaa

SEQ ID NO: 5636470 - DNA, 21 bp, Homo sapiens
taccacacacagcctgtccct

SEQ ID NO: 5636471 - DNA, 15 bp, Homo sapiens
taccacacactgttt

SEQ ID NO: 5636472 - DNA, 23 bp, Homo sapiens
taccacaccctgcctgctgtgga

SEQ ID NO: 5636473 - DNA, 14 bp, Homo sapiens
taccacactgagtt

SEQ ID NO: 5636474 - DNA, 15 bp, Homo sapiens
taccacactgagttc

SEQ ID NO: 5636475 - DNA, 16 bp, Homo sapiens
taccacagacttgcac

SEQ ID NO: 5636476 - DNA, 19 bp, Homo sapiens
taccacagacttgcactga

SEQ ID NO: 5636477 - DNA, 18 bp, Homo sapiens
taccacagctatttagaa

SEQ ID NO: 5636478 - DNA, 22 bp, Homo sapiens
taccacagctgcctccgggcct

SEQ ID NO: 5636479 - DNA, 18 bp, Homo sapiens
taccacaggatgcatatt

SEQ ID NO: 5636480 - DNA, 20 bp, Homo sapiens
taccacatctgctctaggga

SEQ ID NO: 5636481 - DNA, 15 bp, Homo sapiens
taccacattccatga

SEQ ID NO: 5636482 - DNA, 11 bp, Homo sapiens
taccaccaaca

SEQ ID NO: 5636483 - DNA, 12 bp, Homo sapiens
taccaccaacaa

SEQ ID NO: 5636484 - DNA, 15 bp, Homo sapiens
taccaccacaccaaa

SEQ ID NO: 5636485 - DNA, 13 bp, Homo sapiens
taccaccagctgt

SEQ ID NO: 5636486 - DNA, 18 bp, Homo sapiens
taccaccagtctgactgt

SEQ ID NO: 5636487 - DNA, 15 bp, Homo sapiens
taccacccaatgctg

SEQ ID NO: 5636488 - DNA, 17 bp, Homo sapiens
taccaccccttcctgtc

SEQ ID NO: 5636489 - DNA, 18 bp, Homo sapiens
taccaccccttcctgtcc

SEQ ID NO: 5636490 - DNA, 21 bp, Homo sapiens
taccaccctcgctgccaccca

SEQ ID NO: 5636491 - DNA, 23 bp, Homo sapiens
taccacccttcagaccccagttc

SEQ ID NO: 5636492 - DNA, 16 bp, Homo sapiens
taccaccgcatcctca

SEQ ID NO: 5636493 - DNA, 21 bp, Homo sapiens
taccacctaatgtttatagga

SEQ ID NO: 5636494 - DNA, 14 bp, Homo sapiens
taccacctgtacat

SEQ ID NO: 5636495 - DNA, 15 bp, Homo sapiens
taccacctttactgt

SEQ ID NO: 5636496 - DNA, 23 bp, Homo sapiens
taccacgaggaaaagaacaaaca

SEQ ID NO: 5636497 - DNA, 14 bp, Homo sapiens
taccactaattttg

SEQ ID NO: 5636498 - DNA, 16 bp, Homo sapiens
taccactctgtaattg

SEQ ID NO: 5636499 - DNA, 18 bp, Homo sapiens
taccactctgtaattgca

SEQ ID NO: 5636500 - DNA, 11 bp, Homo sapiens
taccactgaat

SEQ ID NO: 5636501 - DNA, 20 bp, Homo sapiens
taccactgaatctgtacaga

SEQ ID NO: 5636502 - DNA, 17 bp, Homo sapiens
taccactgagcccttgc

SEQ ID NO: 5636503 - DNA, 20 bp, Homo sapiens
taccactgagcccttgcaca

SEQ ID NO: 5636504 - DNA, 22 bp, Homo sapiens
taccactgctaataaatgacca

SEQ ID NO: 5636505 - DNA, 23 bp, Homo sapiens
taccactgctaataaatgaccag

SEQ ID NO: 5636506 - DNA, 22 bp, Homo sapiens
taccactgctgatattttctct

SEQ ID NO: 5636507 - DNA, 14 bp, Homo sapiens
taccacttagaaga

SEQ ID NO: 5636508 - DNA, 23 bp, Homo sapiens
taccacttatatcaacttatttt

SEQ ID NO: 5636509 - DNA, 15 bp, Homo sapiens
taccacttatttcta

SEQ ID NO: 5636510 - DNA, 21 bp, Homo sapiens
taccacttatttctaaatcct

SEQ ID NO: 5636511 - DNA, 16 bp, Homo sapiens
taccacttcctgaggc

SEQ ID NO: 5636512 - DNA, 12 bp, Homo sapiens
taccacttctgt

SEQ ID NO: 5636513 - DNA, 15 bp, Homo sapiens
taccacttctgtggg

SEQ ID NO: 5636514 - DNA, 15 bp, Homo sapiens
taccacttgcctttt

SEQ ID NO: 5636515 - DNA, 15 bp, Homo sapiens
taccacttttgcaaa

SEQ ID NO: 5636516 - DNA, 17 bp, Homo sapiens
taccacttttgcaaata

SEQ ID NO: 5636517 - DNA, 20 bp, Homo sapiens
taccactttttttaaccatt

SEQ ID NO: 5636518 - DNA, 14 bp, Homo sapiens
taccagaaaatgag

SEQ ID NO: 5636519 - DNA, 13 bp, Homo sapiens
taccagaaagcag

SEQ ID NO: 5636520 - DNA, 19 bp, Homo sapiens
taccagaaagctctacatt

SEQ ID NO: 5636521 - DNA, 12 bp, Homo sapiens
taccagaaatat

SEQ ID NO: 5636522 - DNA, 13 bp, Homo sapiens
taccagaagggaa

SEQ ID NO: 5636523 - DNA, 22 bp, Homo sapiens
taccagaagggcttcaaagata

SEQ ID NO: 5636524 - DNA, 16 bp, Homo sapiens
taccagaagtgaatta

SEQ ID NO: 5636525 - DNA, 15 bp, Homo sapiens
taccagacctcttct

SEQ ID NO: 5636526 - DNA, 21 bp, Homo sapiens
taccagactgcaggttggacc

SEQ ID NO: 5636527 - DNA, 14 bp, Homo sapiens
taccagacttcaag

SEQ ID NO: 5636528 - DNA, 13 bp, Homo sapiens
taccagagaaggt

SEQ ID NO: 5636529 - DNA, 14 bp, Homo sapiens
taccagagacctga

SEQ ID NO: 5636530 - DNA, 19 bp, Homo sapiens
taccagagacgcccagccc

SEQ ID NO: 5636531 - DNA, 22 bp, Homo sapiens
taccagaggaagttatggcagt

SEQ ID NO: 5636532 - DNA, 15 bp, Homo sapiens
taccagataactttt

SEQ ID NO: 5636533 - DNA, 23 bp, Homo sapiens
taccagatagctcaatactctct

SEQ ID NO: 5636534 - DNA, 18 bp, Homo sapiens
taccagatgaacatttca

SEQ ID NO: 5636535 - DNA, 21 bp, Homo sapiens
taccagattctgcctatgtaa

SEQ ID NO: 5636536 - DNA, 18 bp, Homo sapiens
taccagcaaaagtgcagt

SEQ ID NO: 5636537 - DNA, 20 bp, Homo sapiens
taccagcaaacagctgaaag

SEQ ID NO: 5636538 - DNA, 16 bp, Homo sapiens
taccagcagaaaacct

SEQ ID NO: 5636539 - DNA, 20 bp, Homo sapiens
taccagcagaaggatttttt

SEQ ID NO: 5636540 - DNA, 14 bp, Homo sapiens
taccagcagagcac

SEQ ID NO: 5636541 - DNA, 18 bp, Homo sapiens
taccagcagcaactgaaa

SEQ ID NO: 5636542 - DNA, 16 bp, Homo sapiens
taccagcatgttaact

SEQ ID NO: 5636543 - DNA, 17 bp, Homo sapiens
taccagcatgttaactt

SEQ ID NO: 5636544 - DNA, 20 bp, Homo sapiens
taccagcatgttaactttat

SEQ ID NO: 5636545 - DNA, 14 bp, Homo sapiens
taccagccactgga

SEQ ID NO: 5636546 - DNA, 23 bp, Homo sapiens
taccagccccccaccccacagat

SEQ ID NO: 5636547 - DNA, 15 bp, Homo sapiens
taccagcctgactag

SEQ ID NO: 5636548 - DNA, 19 bp, Homo sapiens
taccagcgcccgctgggct

SEQ ID NO: 5636549 - DNA, 19 bp, Homo sapiens
taccagctagccagtcact

SEQ ID NO: 5636550 - DNA, 16 bp, Homo sapiens
taccagctcctccagc

SEQ ID NO: 5636551 - DNA, 20 bp, Homo sapiens
taccagctcctccagccctg

SEQ ID NO: 5636552 - DNA, 14 bp, Homo sapiens
taccagctgcgctt

SEQ ID NO: 5636553 - DNA, 22 bp, Homo sapiens
taccagctgcgcttgcttttct

SEQ ID NO: 5636554 - DNA, 13 bp, Homo sapiens
taccagcttttaa

SEQ ID NO: 5636555 - DNA, 16 bp, Homo sapiens
taccaggacagaactt

SEQ ID NO: 5636556 - DNA, 13 bp, Homo sapiens
taccaggaccagt

SEQ ID NO: 5636557 - DNA, 12 bp, Homo sapiens
taccaggataaa

SEQ ID NO: 5636558 - DNA, 21 bp, Homo sapiens
taccaggcaacctcccatccc

SEQ ID NO: 5636559 - DNA, 12 bp, Homo sapiens
taccagggaagt

SEQ ID NO: 5636560 - DNA, 21 bp, Homo sapiens
taccagggagatttgctcaat

SEQ ID NO: 5636561 - DNA, 18 bp, Homo sapiens
taccagggtctctcaggg

SEQ ID NO: 5636562 - DNA, 19 bp, Homo sapiens
taccagggtctctcaggga

SEQ ID NO: 5636563 - DNA, 21 bp, Homo sapiens
taccaggtccattttgcctga

SEQ ID NO: 5636564 - DNA, 16 bp, Homo sapiens
taccaggtctcctcca

SEQ ID NO: 5636565 - DNA, 22 bp, Homo sapiens
taccaggtgctagggtgcctgc

SEQ ID NO: 5636566 - DNA, 18 bp, Homo sapiens
taccaggtgtgcctggaa

SEQ ID NO: 5636567 - DNA, 14 bp, Homo sapiens
taccaggttgaaag

SEQ ID NO: 5636568 - DNA, 15 bp, Homo sapiens
taccaggttgaaaga

SEQ ID NO: 5636569 - DNA, 18 bp, Homo sapiens
taccagtatttagaagcc

SEQ ID NO: 5636570 - DNA, 21 bp, Homo sapiens
taccagtcacctcctgctcct

SEQ ID NO: 5636571 - DNA, 18 bp, Homo sapiens
taccagtcgccctctgtg

SEQ ID NO: 5636572 - DNA, 13 bp, Homo sapiens
taccagtctattt

SEQ ID NO: 5636573 - DNA, 16 bp, Homo sapiens
taccagtctatttcca

SEQ ID NO: 5636574 - DNA, 22 bp, Homo sapiens
taccagtctgattataccatgt

SEQ ID NO: 5636575 - DNA, 15 bp, Homo sapiens
taccagtgaaccaaa

SEQ ID NO: 5636576 - DNA, 18 bp, Homo sapiens
taccagtgaaccaaagag

SEQ ID NO: 5636577 - DNA, 18 bp, Homo sapiens
taccagtgaatttttgca

SEQ ID NO: 5636578 - DNA, 22 bp, Homo sapiens
taccagtgaatttttgcaataa

SEQ ID NO: 5636579 - DNA, 23 bp, Homo sapiens
taccagtgcaggctggccagccg

SEQ ID NO: 5636580 - DNA, 14 bp, Homo sapiens
taccagtgggcatg

SEQ ID NO: 5636581 - DNA, 19 bp, Homo sapiens
taccagtgggcatgtatta

SEQ ID NO: 5636582 - DNA, 16 bp, Homo sapiens
taccagtgtaaattca

SEQ ID NO: 5636583 - DNA, 19 bp, Homo sapiens
taccagtgtactgctttca

SEQ ID NO: 5636584 - DNA, 11 bp, Homo sapiens
taccagtgtga

SEQ ID NO: 5636585 - DNA, 21 bp, Homo sapiens
taccagtgttaataaatggat

SEQ ID NO: 5636586 - DNA, 15 bp, Homo sapiens
taccagttaattact

SEQ ID NO: 5636587 - DNA, 18 bp, Homo sapiens
taccagttaatttttcca

SEQ ID NO: 5636588 - DNA, 17 bp, Homo sapiens
taccagttcttgcaata

SEQ ID NO: 5636589 - DNA, 22 bp, Homo sapiens
taccagttcttgcaataagata

SEQ ID NO: 5636590 - DNA, 14 bp, Homo sapiens
taccataaagcctt

SEQ ID NO: 5636591 - DNA, 17 bp, Homo sapiens
taccataaagcctttaa

SEQ ID NO: 5636592 - DNA, 13 bp, Homo sapiens
taccataatctta

SEQ ID NO: 5636593 - DNA, 17 bp, Homo sapiens
taccatactgtctctgg

SEQ ID NO: 5636594 - DNA, 16 bp, Homo sapiens
taccatagaaaaatgt

SEQ ID NO: 5636595 - DNA, 16 bp, Homo sapiens
taccatagagtaatga

SEQ ID NO: 5636596 - DNA, 19 bp, Homo sapiens
taccatagcgctgctctta

SEQ ID NO: 5636597 - DNA, 20 bp, Homo sapiens
taccatagctacatcagttt

SEQ ID NO: 5636598 - DNA, 14 bp, Homo sapiens
taccatatgaatga

SEQ ID NO: 5636599 - DNA, 15 bp, Homo sapiens
taccatatgaatgaa

SEQ ID NO: 5636600 - DNA, 15 bp, Homo sapiens
taccatatgtagcat

SEQ ID NO: 5636601 - DNA, 22 bp, Homo sapiens
taccatatgtagcattaaatat

SEQ ID NO: 5636602 - DNA, 18 bp, Homo sapiens
taccatatgtctgcttct

SEQ ID NO: 5636603 - DNA, 19 bp, Homo sapiens
taccatatgtctgcttctg

SEQ ID NO: 5636604 - DNA, 22 bp, Homo sapiens
taccatatttatccatttgtaa

SEQ ID NO: 5636605 - DNA, 13 bp, Homo sapiens
taccatcaaacaa

SEQ ID NO: 5636606 - DNA, 17 bp, Homo sapiens
taccatcactgagtttt

SEQ ID NO: 5636607 - DNA, 17 bp, Homo sapiens
taccatccttacaatgt

SEQ ID NO: 5636608 - DNA, 17 bp, Homo sapiens
taccatcggtcagcagg

SEQ ID NO: 5636609 - DNA, 13 bp, Homo sapiens
taccatctgcatg

SEQ ID NO: 5636610 - DNA, 14 bp, Homo sapiens
taccatctgctgcc

SEQ ID NO: 5636611 - DNA, 22 bp, Homo sapiens
taccatctgtcttgccagccag

SEQ ID NO: 5636612 - DNA, 22 bp, Homo sapiens
taccatcttaatctttatttta

SEQ ID NO: 5636613 - DNA, 14 bp, Homo sapiens
taccatgaacagaa

SEQ ID NO: 5636614 - DNA, 19 bp, Homo sapiens
taccatgaagtgaaaatgc

SEQ ID NO: 5636615 - DNA, 22 bp, Homo sapiens
taccatgagaagagggcctgtg

SEQ ID NO: 5636616 - DNA, 17 bp, Homo sapiens
taccatgagatgagatg

SEQ ID NO: 5636617 - DNA, 20 bp, Homo sapiens
taccatgagatgagatgacc

SEQ ID NO: 5636618 - DNA, 23 bp, Homo sapiens
taccatgagatgagatgaccacc

SEQ ID NO: 5636619 - DNA, 16 bp, Homo sapiens
taccatgccatttaaa

SEQ ID NO: 5636620 - DNA, 12 bp, Homo sapiens
taccatgctgct

SEQ ID NO: 5636621 - DNA, 23 bp, Homo sapiens
taccatgctgctttttggcacag

SEQ ID NO: 5636622 - DNA, 16 bp, Homo sapiens
taccatggtttgatat

SEQ ID NO: 5636623 - DNA, 13 bp, Homo sapiens
taccatgtaaata

SEQ ID NO: 5636624 - DNA, 17 bp, Homo sapiens
taccatgtgctacaggg

SEQ ID NO: 5636625 - DNA, 13 bp, Homo sapiens
taccattaaaata

SEQ ID NO: 5636626 - DNA, 14 bp, Homo sapiens
taccattaaaccat

SEQ ID NO: 5636627 - DNA, 22 bp, Homo sapiens
taccattaaaccatctccctgg

SEQ ID NO: 5636628 - DNA, 23 bp, Homo sapiens
taccattaatcagaaacatcatg

SEQ ID NO: 5636629 - DNA, 18 bp, Homo sapiens
taccattacttgtataaa

SEQ ID NO: 5636630 - DNA, 14 bp, Homo sapiens
taccattagcataa

SEQ ID NO: 5636631 - DNA, 22 bp, Homo sapiens
taccattatggataaagatgag

SEQ ID NO: 5636632 - DNA, 18 bp, Homo sapiens
taccattattatgtaaat

SEQ ID NO: 5636633 - DNA, 15 bp, Homo sapiens
taccttaaatgctta

SEQ ID NO: 5636634 - DNA, 21 bp, Homo sapiens
taccttaaattagtacagcac

SEQ ID NO: 5636635 - DNA, 17 bp, Homo sapiens
taccttaagatttttct

SEQ ID NO: 5636636 - DNA, 13 bp, Homo sapiens
taccttaattatt

SEQ ID NO: 5636637 - DNA, 17 bp, Homo sapiens
taccttaatttgactgt

SEQ ID NO: 5636638 - DNA, 22 bp, Homo sapiens
taccttagactgaaaaactgtt

SEQ ID NO: 5636639 - DNA, 19 bp, Homo sapiens
taccttagataatatttct

SEQ ID NO: 5636640 - DNA, 18 bp, Homo sapiens
taccttagcttcactcag

SEQ ID NO: 5636641 - DNA, 20 bp, Homo sapiens
taccttaggttctttctgaa

SEQ ID NO: 5636642 - DNA, 17 bp, Homo sapiens
taccttagtgcagttat

SEQ ID NO: 5636643 - DNA, 19 bp, Homo sapiens
taccttagtgcagttattt

SEQ ID NO: 5636644 - DNA, 15 bp, Homo sapiens
taccttatagagcac

SEQ ID NO: 5636645 - DNA, 16 bp, Homo sapiens
taccttatagagcaca

SEQ ID NO: 5636646 - DNA, 19 bp, Homo sapiens
taccttatagagcacaata

SEQ ID NO: 5636647 - DNA, 16 bp, Homo sapiens
taccttatagttactg

SEQ ID NO: 5636648 - DNA, 17 bp, Homo sapiens
taccttatagttactgt

SEQ ID NO: 5636649 - DNA, 18 bp, Homo sapiens
taccttatagttactgtg

SEQ ID NO: 5636650 - DNA, 18 bp, Homo sapiens
taccttatcactgcatta

SEQ ID NO: 5636651 - DNA, 14 bp, Homo sapiens
taccttatcttaca

SEQ ID NO: 5636652 - DNA, 23 bp, Homo sapiens
taccttatcttacaatattgatt

SEQ ID NO: 5636653 - DNA, 18 bp, Homo sapiens
taccttatgctacacaga

SEQ ID NO: 5636654 - DNA, 19 bp, Homo sapiens
taccttattgatctttgcc

SEQ ID NO: 5636655 - DNA, 15 bp, Homo sapiens
taccttattggatat

SEQ ID NO: 5636656 - DNA, 20 bp, Homo sapiens
taccttattggatatttgat

SEQ ID NO: 5636657 - DNA, 12 bp, Homo sapiens
taccttatttaa

SEQ ID NO: 5636658 - DNA, 23 bp, Homo sapiens
taccttatttaaaagattttatg

SEQ ID NO: 5636659 - DNA, 12 bp, Homo sapiens
taccttatttat

SEQ ID NO: 5636660 - DNA, 14 bp, Homo sapiens
taccttcaaacttt

SEQ ID NO: 5636661 - DNA, 15 bp, Homo sapiens
taccttcaaacttta

SEQ ID NO: 5636662 - DNA, 15 bp, Homo sapiens
taccttcaaagctga

SEQ ID NO: 5636663 - DNA, 19 bp, Homo sapiens
taccttcaaggctcttctt

SEQ ID NO: 5636664 - DNA, 22 bp, Homo sapiens
taccttcaaggctcttcttcct

SEQ ID NO: 5636665 - DNA, 14 bp, Homo sapiens
taccttcaataaag

SEQ ID NO: 5636666 - DNA, 15 bp, Homo sapiens
taccttcagatccta

SEQ ID NO: 5636667 - DNA, 18 bp, Homo sapiens
taccttcagccctggcca

SEQ ID NO: 5636668 - DNA, 14 bp, Homo sapiens
taccttcatgtgat

SEQ ID NO: 5636669 - DNA, 13 bp, Homo sapiens
taccttcatttca

SEQ ID NO: 5636670 - DNA, 14 bp, Homo sapiens
taccttcatttcat

SEQ ID NO: 5636671 - DNA, 18 bp, Homo sapiens
taccttccactctggaac

SEQ ID NO: 5636672 - DNA, 18 bp, Homo sapiens
taccttccacttccatgt

SEQ ID NO: 5636673 - DNA, 14 bp, Homo sapiens
taccttccatctca

SEQ ID NO: 5636674 - DNA, 15 bp, Homo sapiens
taccttccccagact

SEQ ID NO: 5636675 - DNA, 18 bp, Homo sapiens
taccttcccccagctttc

SEQ ID NO: 5636676 - DNA, 18 bp, Homo sapiens
taccttcctgtccctgag

SEQ ID NO: 5636677 - DNA, 18 bp, Homo sapiens
taccttccttcaactgct

SEQ ID NO: 5636678 - DNA, 15 bp, Homo sapiens
taccttccttccctg

SEQ ID NO: 5636679 - DNA, 17 bp, Homo sapiens
taccttcctttgtctta

SEQ ID NO: 5636680 - DNA, 24 bp, Homo sapiens
taccttctaaaagccattattatg

SEQ ID NO: 5636681 - DNA, 14 bp, Homo sapiens
taccttctcccagg

SEQ ID NO: 5636682 - DNA, 23 bp, Homo sapiens
taccttctcccaggcctctgccc

SEQ ID NO: 5636683 - DNA, 13 bp, Homo sapiens
taccttctcccca

SEQ ID NO: 5636684 - DNA, 22 bp, Homo sapiens
taccttctccctcatttcagga

SEQ ID NO: 5636685 - DNA, 19 bp, Homo sapiens
taccttctctacccatctc

SEQ ID NO: 5636686 - DNA, 19 bp, Homo sapiens
taccttctgatgaagttgt

SEQ ID NO: 5636687 - DNA, 14 bp, Homo sapiens
taccttctggttgc

SEQ ID NO: 5636688 - DNA, 17 bp, Homo sapiens
taccttctggttgcttc

SEQ ID NO: 5636689 - DNA, 15 bp, Homo sapiens
taccttctttctaat

SEQ ID NO: 5636690 - DNA, 11 bp, Homo sapiens
taccttgaaaa

SEQ ID NO: 5636691 - DNA, 20 bp, Homo sapiens
taccttgaccatcgtccttc

SEQ ID NO: 5636692 - DNA, 18 bp, Homo sapiens
taccttgacctttgtaca

SEQ ID NO: 5636693 - DNA, 23 bp, Homo sapiens
taccttgactttgttcacagcat

SEQ ID NO: 5636694 - DNA, 16 bp, Homo sapiens
taccttgagaccctct

SEQ ID NO: 5636695 - DNA, 20 bp, Homo sapiens
taccttgagaccctcttctc

SEQ ID NO: 5636696 - DNA, 21 bp, Homo sapiens
taccttgagaccctcttctct

SEQ ID NO: 5636697 - DNA, 22 bp, Homo sapiens
taccttgagaccctcttctctg

SEQ ID NO: 5636698 - DNA, 20 bp, Homo sapiens
taccttgccccaacccttct

SEQ ID NO: 5636699 - DNA, 21 bp, Homo sapiens
taccttgccccaacccttctt

SEQ ID NO: 5636700 - DNA, 23 bp, Homo sapiens
taccttgccccaacccttcttca

SEQ ID NO: 5636701 - DNA, 16 bp, Homo sapiens
taccttgcttttgctt

SEQ ID NO: 5636702 - DNA, 21 bp, Homo sapiens
taccttgcttttgcttctaga

SEQ ID NO: 5636703 - DNA, 16 bp, Homo sapiens
taccttggtcctgcct

SEQ ID NO: 5636704 - DNA, 18 bp, Homo sapiens
taccttggtcctgcctct

SEQ ID NO: 5636705 - DNA, 16 bp, Homo sapiens
taccttgtatactgta

SEQ ID NO: 5636706 - DNA, 16 bp, Homo sapiens
tacctttaattttaat

SEQ ID NO: 5636707 - DNA, 16 bp, Homo sapiens
tacctttacataattg

SEQ ID NO: 5636708 - DNA, 16 bp, Homo sapiens
tacctttacatatata

SEQ ID NO: 5636709 - DNA, 20 bp, Homo sapiens
tacctttacatattatcatg

SEQ ID NO: 5636710 - DNA, 14 bp, Homo sapiens
tacctttcaaagct

SEQ ID NO: 5636711 - DNA, 15 bp, Homo sapiens
tacctttcaaagctt

SEQ ID NO: 5636712 - DNA, 12 bp, Homo sapiens
tacctttcatac

SEQ ID NO: 5636713 - DNA, 21 bp, Homo sapiens
tacctttccacccagaccctc

SEQ ID NO: 5636714 - DNA, 15 bp, Homo sapiens
tacctttcctacatt

SEQ ID NO: 5636715 - DNA, 16 bp, Homo sapiens
tacctttctagcctta

SEQ ID NO: 5636716 - DNA, 19 bp, Homo sapiens
tacctttgaaatattaaaa

SEQ ID NO: 5636717 - DNA, 20 bp, Homo sapiens
tacctttgaattcaagaaca

SEQ ID NO: 5636718 - DNA, 14 bp, Homo sapiens
tacctttgctgtca

SEQ ID NO: 5636719 - DNA, 15 bp, Homo sapiens
tacctttggaaaaat

SEQ ID NO: 5636720 - DNA, 12 bp, Homo sapiens
tacctttgtagt

SEQ ID NO: 5636721 - DNA, 12 bp, Homo sapiens
tacctttgtcac

SEQ ID NO: 5636722 - DNA, 16 bp, Homo sapiens
taccttttaaaattga

SEQ ID NO: 5636723 - DNA, 21 bp, Homo sapiens
taccttttaacacctgatgtg

SEQ ID NO: 5636724 - DNA, 18 bp, Homo sapiens
taccttttaccagctttt

SEQ ID NO: 5636725 - DNA, 13 bp, Homo sapiens
taccttttatttt

SEQ ID NO: 5636726 - DNA, 17 bp, Homo sapiens
taccttttcagggctgg

SEQ ID NO: 5636727 - DNA, 11 bp, Homo sapiens
taccttttcta

SEQ ID NO: 5636728 - DNA, 12 bp, Homo sapiens
taccttttctat

SEQ ID NO: 5636729 - DNA, 13 bp, Homo sapiens
taccttttctata

SEQ ID NO: 5636730 - DNA, 23 bp, Homo sapiens
taccttttctataagttgtacca

SEQ ID NO: 5636731 - DNA, 15 bp, Homo sapiens
taccttttctcttca

SEQ ID NO: 5636732 - DNA, 17 bp, Homo sapiens
taccttttctcttttct

SEQ ID NO: 5636733 - DNA, 20 bp, Homo sapiens
taccttttctcttttctttc

SEQ ID NO: 5636734 - DNA, 23 bp, Homo sapiens
taccttttgataaaatgttcctt

SEQ ID NO: 5636735 - DNA, 12 bp, Homo sapiens
taccttttgtag

SEQ ID NO: 5636736 - DNA, 14 bp, Homo sapiens
taccttttgtctct

SEQ ID NO: 5636737 - DNA, 13 bp, Homo sapiens
taccttttgttac

SEQ ID NO: 5636738 - DNA, 19 bp, Homo sapiens
taccttttgttaccacaga

SEQ ID NO: 5636739 - DNA, 18 bp, Homo sapiens
tacctttttatatttaaa

SEQ ID NO: 5636740 - DNA, 20 bp, Homo sapiens
tacctttttatttgcatgtg

SEQ ID NO: 5636741 - DNA, 18 bp, Homo sapiens
tacctttttgtatgtgaa

SEQ ID NO: 5636742 - DNA, 16 bp, Homo sapiens
taccttttttgttcca

SEQ ID NO: 5636743 - DNA, 18 bp, Homo sapiens
taccttttttgttccact

SEQ ID NO: 5636744 - DNA, 21 bp, Homo sapiens
taccttttttgttttttcaaa

SEQ ID NO: 5636745 - DNA, 20 bp, Homo sapiens
taccttttttttacggaatt

SEQ ID NO: 5636746 - DNA, 20 bp, Homo sapiens
taccttttttttttcttggt

SEQ ID NO: 5636747 - DNA, 23 bp, Homo sapiens
tacgaaaaaatggtagcatttta

SEQ ID NO: 5636748 - DNA, 18 bp, Homo sapiens
tacgaaaagaggggaaga

SEQ ID NO: 5636749 - DNA, 16 bp, Homo sapiens
tacgaacaaaacacac

SEQ ID NO: 5636750 - DNA, 22 bp, Homo sapiens
tacgaacccctcccctcccccc

SEQ ID NO: 5636751 - DNA, 13 bp, Homo sapiens
tacgaagaggggt

SEQ ID NO: 5636752 - DNA, 20 bp, Homo sapiens
tacgaagagtatttttgaca

SEQ ID NO: 5636753 - DNA, 22 bp, Homo sapiens
tacgaagagtatttttgacaga

SEQ ID NO: 5636754 - DNA, 21 bp, Homo sapiens
tacgaataaacgcagaagagg

SEQ ID NO: 5636755 - DNA, 15 bp, Homo sapiens
tacgaatcttatttt

SEQ ID NO: 5636756 - DNA, 19 bp, Homo sapiens
tacgaatcttatttttcct

SEQ ID NO: 5636757 - DNA, 17 bp, Homo sapiens
tacgaatgcccctgttc

SEQ ID NO: 5636758 - DNA, 13 bp, Homo sapiens
tacgaatttctat

SEQ ID NO: 5636759 - DNA, 15 bp, Homo sapiens
tacgaatttctatag

SEQ ID NO: 5636760 - DNA, 22 bp, Homo sapiens
tacgacaaagcatcattgtaaa

SEQ ID NO: 5636761 - DNA, 23 bp, Homo sapiens
tacgacagtacactgtcagcagg

SEQ ID NO: 5636762 - DNA, 17 bp, Homo sapiens
tacgacctgtctgttct

SEQ ID NO: 5636763 - DNA, 18 bp, Homo sapiens
tacgagaaaatctgcatg

SEQ ID NO: 5636764 - DNA, 19 bp, Homo sapiens
tacgagggaggaacacctg

SEQ ID NO: 5636765 - DNA, 20 bp, Homo sapiens
tacgagggaggaacacctga

SEQ ID NO: 5636766 - DNA, 21 bp, Homo sapiens
tacgagggaggaacacctgat

SEQ ID NO: 5636767 - DNA, 14 bp, Homo sapiens
tacgagttttccct

SEQ ID NO: 5636768 - DNA, 19 bp, Homo sapiens
tacgatatttcgtttggtc

SEQ ID NO: 5636769 - DNA, 15 bp, Homo sapiens
tacgatgtaaatttt

SEQ ID NO: 5636770 - DNA, 15 bp, Homo sapiens
tacgatgttaaaaca

SEQ ID NO: 5636771 - DNA, 16 bp, Homo sapiens
tacgatgttaaaacaa

SEQ ID NO: 5636772 - DNA, 15 bp, Homo sapiens
tacgcaaggaaggac

SEQ ID NO: 5636773 - DNA, 16 bp, Homo sapiens
tacgcaattgtatata

SEQ ID NO: 5636774 - DNA, 14 bp, Homo sapiens
tacgcacagacagg

SEQ ID NO: 5636775 - DNA, 16 bp, Homo sapiens
tacgcacataccttca

SEQ ID NO: 5636776 - DNA, 16 bp, Homo sapiens
tacgcagaggaatttt

SEQ ID NO: 5636777 - DNA, 14 bp, Homo sapiens
tacgcagatgctgt

SEQ ID NO: 5636778 - DNA, 15 bp, Homo sapiens
tacgcatcccatctc

SEQ ID NO: 5636779 - DNA, 19 bp, Homo sapiens
tacgcattaagggcctgct

SEQ ID NO: 5636780 - DNA, 21 bp, Homo sapiens
tacgcattaagggcctgctgg

SEQ ID NO: 5636781 - DNA, 23 bp, Homo sapiens
tacgccaatgttatgccagctcc

SEQ ID NO: 5636782 - DNA, 15 bp, Homo sapiens
tacgcccaggacagc

SEQ ID NO: 5636783 - DNA, 16 bp, Homo sapiens
tacgcccaggacagct

SEQ ID NO: 5636784 - DNA, 17 bp, Homo sapiens
tacgcccatctcaggac

SEQ ID NO: 5636785 - DNA, 20 bp, Homo sapiens
tacgccctgttcccttcctg

SEQ ID NO: 5636786 - DNA, 20 bp, Homo sapiens
tacgcctgtaaatgtattca

SEQ ID NO: 5636787 - DNA, 20 bp, Homo sapiens
tacgctaagcctggaagcca

SEQ ID NO: 5636788 - DNA, 12 bp, Homo sapiens
tacgctctcgtc

SEQ ID NO: 5636789 - DNA, 13 bp, Homo sapiens
tacgctctctgtc

SEQ ID NO: 5636790 - DNA, 19 bp, Homo sapiens
tacgctgaggcctgggagt

SEQ ID NO: 5636791 - DNA, 17 bp, Homo sapiens
tacgctgcgtgccatga

SEQ ID NO: 5636792 - DNA, 13 bp, Homo sapiens
tacgctggtctgg

SEQ ID NO: 5636793 - DNA, 13 bp, Homo sapiens
tacgctggtgctg

SEQ ID NO: 5636794 - DNA, 13 bp, Homo sapiens
tacgctgtctgta

SEQ ID NO: 5636795 - DNA, 13 bp, Homo sapiens
tacgcttgcttgt

SEQ ID NO: 5636796 - DNA, 17 bp, Homo sapiens
tacgcttgcttgtcttt

SEQ ID NO: 5636797 - DNA, 14 bp, Homo sapiens
tacgctttgattca

SEQ ID NO: 5636798 - DNA, 12 bp, Homo sapiens
tacgctttgtca

SEQ ID NO: 5636799 - DNA, 17 bp, Homo sapiens
tacgcttttaatgaaaa

SEQ ID NO: 5636800 - DNA, 22 bp, Homo sapiens
tacggaaaaaattgtattgaaa

SEQ ID NO: 5636801 - DNA, 13 bp, Homo sapiens
tacggaattccaa

SEQ ID NO: 5636802 - DNA, 13 bp, Homo sapiens
tacggacaccccc

SEQ ID NO: 5636803 - DNA, 17 bp, Homo sapiens
tacggacagagaccaag

SEQ ID NO: 5636804 - DNA, 12 bp, Homo sapiens
tacggagaagaa

SEQ ID NO: 5636805 - DNA, 15 bp, Homo sapiens
tacggagggaccagg

SEQ ID NO: 5636806 - DNA, 20 bp, Homo sapiens
tacggagggaggacatcata

SEQ ID NO: 5636807 - DNA, 21 bp, Homo sapiens
tacggctatctagttgtctga

SEQ ID NO: 5636808 - DNA, 13 bp, Homo sapiens
tacggctgctgca

SEQ ID NO: 5636809 - DNA, 14 bp, Homo sapiens
tacgggaatgtgct

SEQ ID NO: 5636810 - DNA, 18 bp, Homo sapiens
tacggggaaaatgcattt

SEQ ID NO: 5636811 - DNA, 20 bp, Homo sapiens
tacgggggttccctttcccc

SEQ ID NO: 5636812 - DNA, 16 bp, Homo sapiens
tactcttgaattcctg

SEQ ID NO: 5636813 - DNA, 16 bp, Homo sapiens
tactcttgatgtgaag

SEQ ID NO: 5636814 - DNA, 19 bp, Homo sapiens
tactcttgtaagattttga

SEQ ID NO: 5636815 - DNA, 21 bp, Homo sapiens
tactcttgtaagattttgaaa

SEQ ID NO: 5636816 - DNA, 23 bp, Homo sapiens
tactcttgtaagattttgaaaac

SEQ ID NO: 5636817 - DNA, 17 bp, Homo sapiens
tactcttgttgagttct

SEQ ID NO: 5636818 - DNA, 19 bp, Homo sapiens
tactctttacccttgagcc

SEQ ID NO: 5636819 - DNA, 21 bp, Homo sapiens
tactctttacccttgagccct

SEQ ID NO: 5636820 - DNA, 17 bp, Homo sapiens
tactctttctctcccct

SEQ ID NO: 5636821 - DNA, 22 bp, Homo sapiens
tactctttctctcccctcctct

SEQ ID NO: 5636822 - DNA, 16 bp, Homo sapiens
tactctttctgtatat

SEQ ID NO: 5636823 - DNA, 19 bp, Homo sapiens
tactctttgggatcttgaa

SEQ ID NO: 5636824 - DNA, 16 bp, Homo sapiens
tactcttttgaagtgt

SEQ ID NO: 5636825 - DNA, 19 bp, Homo sapiens
tactctttttcaataaatt

SEQ ID NO: 5636826 - DNA, 18 bp, Homo sapiens
tactctttttctaaagtg

SEQ ID NO: 5636827 - DNA, 20 bp, Homo sapiens
tactctttttctaaagtgtt

SEQ ID NO: 5636828 - DNA, 20 bp, Homo sapiens
tactgaaaaaaaaagcttgt

SEQ ID NO: 5636829 - DNA, 18 bp, Homo sapiens
tactgaaaaaatgctgag

SEQ ID NO: 5636830 - DNA, 20 bp, Homo sapiens
tactgaaaaaatgctgagcc

SEQ ID NO: 5636831 - DNA, 17 bp, Homo sapiens
tactgaaaaaggtgatt

SEQ ID NO: 5636832 - DNA, 18 bp, Homo sapiens
tactgaaagatctctgtc

SEQ ID NO: 5636833 - DNA, 13 bp, Homo sapiens
tactgaaagcaaa

SEQ ID NO: 5636834 - DNA, 19 bp, Homo sapiens
tactgaaataaacgtctta

SEQ ID NO: 5636835 - DNA, 22 bp, Homo sapiens
tactgaaataaacgtcttaaat

SEQ ID NO: 5636836 - DNA, 23 bp, Homo sapiens
tactgaaatgcgctctttaattt

SEQ ID NO: 5636837 - DNA, 23 bp, Homo sapiens
tactgaaatttgttatacttcaa

SEQ ID NO: 5636838 - DNA, 18 bp, Homo sapiens
tactgaacatctgagtcc

SEQ ID NO: 5636839 - DNA, 16 bp, Homo sapiens
tactgaaccacttgta

SEQ ID NO: 5636840 - DNA, 17 bp, Homo sapiens
tactgaaccacttgtag

SEQ ID NO: 5636841 - DNA, 17 bp, Homo sapiens
tactgaaccactttgat

SEQ ID NO: 5636842 - DNA, 15 bp, Homo sapiens
tactgaaccagccac

SEQ ID NO: 5636843 - DNA, 16 bp, Homo sapiens
tactgaaccaggccag

SEQ ID NO: 5636844 - DNA, 17 bp, Homo sapiens
tactgaaccctgcctct

SEQ ID NO: 5636845 - DNA, 22 bp, Homo sapiens
tactgaactacatgcataaact

SEQ ID NO: 5636846 - DNA, 13 bp, Homo sapiens
tactgaagccaaa

SEQ ID NO: 5636847 - DNA, 12 bp, Homo sapiens
tactgaaggaaa

SEQ ID NO: 5636848 - DNA, 18 bp, Homo sapiens
tactgaaggaaaaacaca

SEQ ID NO: 5636849 - DNA, 23 bp, Homo sapiens
tactgaagggaacagcctgagcc

SEQ ID NO: 5636850 - DNA, 17 bp, Homo sapiens
tactgaaggtaaaattg

SEQ ID NO: 5636851 - DNA, 19 bp, Homo sapiens
tactgaagtcttttctgtc

SEQ ID NO: 5636852 - DNA, 21 bp, Homo sapiens
tactgaagttatctgtgttat

SEQ ID NO: 5636853 - DNA, 16 bp, Homo sapiens
tactgaagttgggaaa

SEQ ID NO: 5636854 - DNA, 11 bp, Homo sapiens
tactgaataaa

SEQ ID NO: 5636855 - DNA, 23 bp, Homo sapiens
tactgaatataaaaacatttgta

SEQ ID NO: 5636856 - DNA, 19 bp, Homo sapiens
tactgaatgaagcagtatt

SEQ ID NO: 5636857 - DNA, 21 bp, Homo sapiens
tactgaatgaagcagtatttt

SEQ ID NO: 5636858 - DNA, 17 bp, Homo sapiens
tactgaatgatctattc

SEQ ID NO: 5636859 - DNA, 19 bp, Homo sapiens
tactgaatgtcattgaaaa

SEQ ID NO: 5636860 - DNA, 16 bp, Homo sapiens
tactgaatgttagaag

SEQ ID NO: 5636861 - DNA, 15 bp, Homo sapiens
tactgaatttgctaa

SEQ ID NO: 5636862 - DNA, 19 bp, Homo sapiens
tactgaatttttaaaatgc

SEQ ID NO: 5636863 - DNA, 23 bp, Homo sapiens
tactgacactttgccagaaagca

SEQ ID NO: 5636864 - DNA, 14 bp, Homo sapiens
tactgacagaaatg

SEQ ID NO: 5636865 - DNA, 18 bp, Homo sapiens
tactgacagggagcagcc

SEQ ID NO: 5636866 - DNA, 17 bp, Homo sapiens
tactgacatggtgctgt

SEQ ID NO: 5636867 - DNA, 19 bp, Homo sapiens
tactgacatggtgctgtgt

SEQ ID NO: 5636868 - DNA, 13 bp, Homo sapiens
tactgacccaact

SEQ ID NO: 5636869 - DNA, 16 bp, Homo sapiens
tactgactatattttc

SEQ ID NO: 5636870 - DNA, 13 bp, Homo sapiens
tactgacttggat

SEQ ID NO: 5636871 - DNA, 16 bp, Homo sapiens
tactgactttgcttgc

SEQ ID NO: 5636872 - DNA, 18 bp, Homo sapiens
tactgactttgcttgctt

SEQ ID NO: 5636873 - DNA, 20 bp, Homo sapiens
tactgacttttctttttaat

SEQ ID NO: 5636874 - DNA, 17 bp, Homo sapiens
tactgagaaaacctgtt

SEQ ID NO: 5636875 - DNA, 19 bp, Homo sapiens
tactgagacaaaaaggaaa

SEQ ID NO: 5636876 - DNA, 22 bp, Homo sapiens
tactgagacaaaaaggaaacat

SEQ ID NO: 5636877 - DNA, 14 bp, Homo sapiens
tactgagacttgtt

SEQ ID NO: 5636878 - DNA, 18 bp, Homo sapiens
tactgagacttgttcttg

SEQ ID NO: 5636879 - DNA, 19 bp, Homo sapiens
tactgagacttgttcttgg

SEQ ID NO: 5636880 - DNA, 21 bp, Homo sapiens
tactgagacttgttcttggtt

SEQ ID NO: 5636881 - DNA, 14 bp, Homo sapiens
tactgagagaaggt

SEQ ID NO: 5636882 - DNA, 18 bp, Homo sapiens
tactgagagaaggtgaaa

SEQ ID NO: 5636883 - DNA, 22 bp, Homo sapiens
tactgagaggaggggtaaatat

SEQ ID NO: 5636884 - DNA, 20 bp, Homo sapiens
tactgagagtgcaaattgta

SEQ ID NO: 5636885 - DNA, 16 bp, Homo sapiens
tactgagcactgaacc

SEQ ID NO: 5636886 - DNA, 18 bp, Homo sapiens
tactgagcagtgatattc

SEQ ID NO: 5636887 - DNA, 21 bp, Homo sapiens
tactgagcatttgcacctctg

SEQ ID NO: 5636888 - DNA, 22 bp, Homo sapiens
tactgagcatttgcacctctgt

SEQ ID NO: 5636889 - DNA, 15 bp, Homo sapiens
tactgagccttgtaa

SEQ ID NO: 5636890 - DNA, 18 bp, Homo sapiens
tactgagcgagctgggcc

SEQ ID NO: 5636891 - DNA, 16 bp, Homo sapiens
tactgagctgagacca

SEQ ID NO: 5636892 - DNA, 14 bp, Homo sapiens
tactgagcttctct

SEQ ID NO: 5636893 - DNA, 17 bp, Homo sapiens
tactgagcttctctgtg

SEQ ID NO: 5636894 - DNA, 22 bp, Homo sapiens
tactgaggatatggacactggt

SEQ ID NO: 5636895 - DNA, 16 bp, Homo sapiens
tactgaggcaggggag

SEQ ID NO: 5636896 - DNA, 19 bp, Homo sapiens
tactgaggtgctatgaagc

SEQ ID NO: 5636897 - DNA, 14 bp, Homo sapiens
tactgaggtggtgg

SEQ ID NO: 5636898 - DNA, 20 bp, Homo sapiens
tactgagtatgtggaaggca

SEQ ID NO: 5636899 - DNA, 14 bp, Homo sapiens
tactgagtgagtta

SEQ ID NO: 5636900 - DNA, 17 bp, Homo sapiens
tactgagttctcatcca

SEQ ID NO: 5636901 - DNA, 20 bp, Homo sapiens
tactgagttcttacttgagt

SEQ ID NO: 5636902 - DNA, 15 bp, Homo sapiens
tactgatactattca

SEQ ID NO: 5636903 - DNA, 18 bp, Homo sapiens
tactgatactattcaatg

SEQ ID NO: 5636904 - DNA, 21 bp, Homo sapiens
tactgatatttatagaacagt

SEQ ID NO: 5636905 - DNA, 19 bp, Homo sapiens
tactgatcatctgctgtga

SEQ ID NO: 5636906 - DNA, 16 bp, Homo sapiens
tactgatcatgcattg

SEQ ID NO: 5636907 - DNA, 17 bp, Homo sapiens
tactgatcatgcattgt

SEQ ID NO: 5636908 - DNA, 18 bp, Homo sapiens
tactgatgagtcttgatc

SEQ ID NO: 5636909 - DNA, 18 bp, Homo sapiens
tactgatgttcctttgga

SEQ ID NO: 5636910 - DNA, 19 bp, Homo sapiens
tactgattaacaaataaat

SEQ ID NO: 5636911 - DNA, 21 bp, Homo sapiens
tactgattaacaaataaattg

SEQ ID NO: 5636912 - DNA, 18 bp, Homo sapiens
tactgattagagtggtta

SEQ ID NO: 5636913 - DNA, 22 bp, Homo sapiens
tactgattagagtggttattca

SEQ ID NO: 5636914 - DNA, 13 bp, Homo sapiens
tactgattatgaa

SEQ ID NO: 5636915 - DNA, 15 bp, Homo sapiens
tactgattatgaaat

SEQ ID NO: 5636916 - DNA, 17 bp, Homo sapiens
tactgattatgaaatgt

SEQ ID NO: 5636917 - DNA, 22 bp, Homo sapiens
tactgattattttcttcatcca

SEQ ID NO: 5636918 - DNA, 22 bp, Homo sapiens
tactgattcaagaacaagcaat

SEQ ID NO: 5636919 - DNA, 14 bp, Homo sapiens
tactgattcaattt

SEQ ID NO: 5636920 - DNA, 20 bp, Homo sapiens
tactgattcaatttgatgtg

SEQ ID NO: 5636921 - DNA, 17 bp, Homo sapiens
tactgattgggaggtgc

SEQ ID NO: 5636922 - DNA, 15 bp, Homo sapiens
tactgattgtttcat

SEQ ID NO: 5636923 - DNA, 22 bp, Homo sapiens
tactgatttagaagcaaagatt

SEQ ID NO: 5636924 - DNA, 22 bp, Homo sapiens
tactgatttggccgttttgtga

SEQ ID NO: 5636925 - DNA, 21 bp, Homo sapiens
tactgatttgggctgaatgta

SEQ ID NO: 5636926 - DNA, 20 bp, Homo sapiens
tactgattttaaaatgaata

SEQ ID NO: 5636927 - DNA, 16 bp, Homo sapiens
tactgatttttaagtc

SEQ ID NO: 5636928 - DNA, 15 bp, Homo sapiens
tactgcaaaaagtac

SEQ ID NO: 5636929 - DNA, 18 bp, Homo sapiens
tactgcaaaggcttgtgg

SEQ ID NO: 5636930 - DNA, 14 bp, Homo sapiens
tactgcaaatcagg

SEQ ID NO: 5636931 - DNA, 18 bp, Homo sapiens
tactgcaaatgtcatcag

SEQ ID NO: 5636932 - DNA, 21 bp, Homo sapiens
tactgcaaggttcaacttatt

SEQ ID NO: 5636933 - DNA, 20 bp, Homo sapiens
tactgcaatatttggattgt

SEQ ID NO: 5636934 - DNA, 13 bp, Homo sapiens
tactgcacatttt

SEQ ID NO: 5636935 - DNA, 15 bp, Homo sapiens
tactgcacattttgt

SEQ ID NO: 5636936 - DNA, 17 bp, Homo sapiens
tactgcacccagcatca

SEQ ID NO: 5636937 - DNA, 22 bp, Homo sapiens
tactgcacgtaacactcctcct

SEQ ID NO: 5636938 - DNA, 17 bp, Homo sapiens
tactgcactccagcctg

SEQ ID NO: 5636939 - DNA, 17 bp, Homo sapiens
tactgcactttccccct

SEQ ID NO: 5636940 - DNA, 21 bp, Homo sapiens
tactgcactttcccccttccc

SEQ ID NO: 5636941 - DNA, 15 bp, Homo sapiens
tactgcagcacctcc

SEQ ID NO: 5636942 - DNA, 22 bp, Homo sapiens
tactgcagcctttgcctccccg

SEQ ID NO: 5636943 - DNA, 10 bp, Homo sapiens
tactgcaggg

SEQ ID NO: 5636944 - DNA, 14 bp, Homo sapiens
tactgcagggccag

SEQ ID NO: 5636945 - DNA, 16 bp, Homo sapiens
tactgcagggccagga

SEQ ID NO: 5636946 - DNA, 15 bp, Homo sapiens
tactgcatacttttt

SEQ ID NO: 5636947 - DNA, 17 bp, Homo sapiens
tactgcatactttttaa

SEQ ID NO: 5636948 - DNA, 17 bp, Homo sapiens
tactgcatgtgacttct

SEQ ID NO: 5636949 - DNA, 16 bp, Homo sapiens
tactgcattatttgag

SEQ ID NO: 5636950 - DNA, 19 bp, Homo sapiens
tactgcattctctcccatc

SEQ ID NO: 5636951 - DNA, 17 bp, Homo sapiens
tactgcattcttctgat

SEQ ID NO: 5636952 - DNA, 14 bp, Homo sapiens
tactgcattttcac

SEQ ID NO: 5636953 - DNA, 16 bp, Homo sapiens
tactgcattttcacaa

SEQ ID NO: 5636954 - DNA, 19 bp, Homo sapiens
tactgcattttttactttt

SEQ ID NO: 5636955 - DNA, 17 bp, Homo sapiens
tactgccaaaacattta

SEQ ID NO: 5636956 - DNA, 20 bp, Homo sapiens
tactgccaaaacatttatga

SEQ ID NO: 5636957 - DNA, 18 bp, Homo sapiens
tactgccaaaaccaaatt

SEQ ID NO: 5636958 - DNA, 19 bp, Homo sapiens
tactgccaacctcgctcca

SEQ ID NO: 5636959 - DNA, 14 bp, Homo sapiens
tactgccactcttt

SEQ ID NO: 5636960 - DNA, 15 bp, Homo sapiens
tactgccactgtgtg

SEQ ID NO: 5636961 - DNA, 16 bp, Homo sapiens
tactgccagatgctga

SEQ ID NO: 5636962 - DNA, 17 bp, Homo sapiens
tactgccagatgctgat

SEQ ID NO: 5636963 - DNA, 21 bp, Homo sapiens
tactgccagatgctgatgttc

SEQ ID NO: 5636964 - DNA, 22 bp, Homo sapiens
tactgccatcctggcccagggc

SEQ ID NO: 5636965 - DNA, 15 bp, Homo sapiens
tactgcccacatttg

SEQ ID NO: 5636966 - DNA, 22 bp, Homo sapiens
tactgcccaggcctgcctgttc

SEQ ID NO: 5636967 - DNA, 22 bp, Homo sapiens
tactgccctccagctctttcct

SEQ ID NO: 5636968 - DNA, 12 bp, Homo sapiens
tactgccctttc

SEQ ID NO: 5636969 - DNA, 22 bp, Homo sapiens
tactgccgaaacccttgactgt

SEQ ID NO: 5636970 - DNA, 20 bp, Homo sapiens
tactgccgaagaattgtctt

SEQ ID NO: 5636971 - DNA, 23 bp, Homo sapiens
tactgccgaagaattgtcttgca

SEQ ID NO: 5636972 - DNA, 19 bp, Homo sapiens
tactgccggtcacccaggc

SEQ ID NO: 5636973 - DNA, 21 bp, Homo sapiens
tactgcctataatcttataca

SEQ ID NO: 5636974 - DNA, 21 bp, Homo sapiens
tactgcctattttaataaaca

SEQ ID NO: 5636975 - DNA, 12 bp, Homo sapiens
tactgcctgctt

SEQ ID NO: 5636976 - DNA, 16 bp, Homo sapiens
tactgcctgcttgggg

SEQ ID NO: 5636977 - DNA, 12 bp, Homo sapiens
tactgccttaat

SEQ ID NO: 5636978 - DNA, 13 bp, Homo sapiens
tactgccttgaaa

SEQ ID NO: 5636979 - DNA, 14 bp, Homo sapiens
tactgccttgaaaa

SEQ ID NO: 5636980 - DNA, 19 bp, Homo sapiens
tactgccttgtttaatgtt

SEQ ID NO: 5636981 - DNA, 15 bp, Homo sapiens
tactgctaatgttga

SEQ ID NO: 5636982 - DNA, 16 bp, Homo sapiens
tactgctaatgttgat

SEQ ID NO: 5636983 - DNA, 19 bp, Homo sapiens
tactgctatctactaagtt

SEQ ID NO: 5636984 - DNA, 14 bp, Homo sapiens
tactgctcaggctg

SEQ ID NO: 5636985 - DNA, 22 bp, Homo sapiens
tactgctcaggctgcagctgga

SEQ ID NO: 5636986 - DNA, 14 bp, Homo sapiens
tactgctcctgtgg

SEQ ID NO: 5636987 - DNA, 18 bp, Homo sapiens
tactgctcctgtggcagg

SEQ ID NO: 5636988 - DNA, 15 bp, Homo sapiens
tacttcactttaatt

SEQ ID NO: 5636989 - DNA, 16 bp, Homo sapiens
tacttcactttcatct

SEQ ID NO: 5636990 - DNA, 14 bp, Homo sapiens
tacttcagcaagag

SEQ ID NO: 5636991 - DNA, 17 bp, Homo sapiens
tacttcagcaagagaga

SEQ ID NO: 5636992 - DNA, 21 bp, Homo sapiens
tacttcagcaagagagaacct

SEQ ID NO: 5636993 - DNA, 14 bp, Homo sapiens
tacttcagctttgt

SEQ ID NO: 5636994 - DNA, 19 bp, Homo sapiens
tacttcaggggcacttcat

SEQ ID NO: 5636995 - DNA, 12 bp, Homo sapiens
tacttcagtatg

SEQ ID NO: 5636996 - DNA, 18 bp, Homo sapiens
tacttcagtatgtgtcaa

SEQ ID NO: 5636997 - DNA, 16 bp, Homo sapiens
tacttcagttctcatc

SEQ ID NO: 5636998 - DNA, 23 bp, Homo sapiens
tacttcataagatattctttaca

SEQ ID NO: 5636999 - DNA, 24 bp, Homo sapiens
tacttcataagatattctttacaa

SEQ ID NO: 5637000 - DNA, 18 bp, Homo sapiens
tacttcatgtaatccaaa

SEQ ID NO: 5637001 - DNA, 18 bp, Homo sapiens
tacttcattaatttcaat

SEQ ID NO: 5637002 - DNA, 14 bp, Homo sapiens
tacttccaagaaaa

SEQ ID NO: 5637003 - DNA, 11 bp, Homo sapiens
tacttccagca

SEQ ID NO: 5637004 - DNA, 12 bp, Homo sapiens
tacttccagcaa

SEQ ID NO: 5637005 - DNA, 21 bp, Homo sapiens
tacttccataggacatactgc

SEQ ID NO: 5637006 - DNA, 15 bp, Homo sapiens
tacttccccacccct

SEQ ID NO: 5637007 - DNA, 18 bp, Homo sapiens
tacttccccagctctcag

SEQ ID NO: 5637008 - DNA, 19 bp, Homo sapiens
tacttcccccaccctgggt

SEQ ID NO: 5637009 - DNA, 14 bp, Homo sapiens
tacttcccctggga

SEQ ID NO: 5637010 - DNA, 15 bp, Homo sapiens
tacttccccttccta

SEQ ID NO: 5637011 - DNA, 19 bp, Homo sapiens
tacttcccgggccagggct

SEQ ID NO: 5637012 - DNA, 20 bp, Homo sapiens
tacttcccgggccagggctg

SEQ ID NO: 5637013 - DNA, 16 bp, Homo sapiens
tacttcctcctcccca

SEQ ID NO: 5637014 - DNA, 21 bp, Homo sapiens
tacttcctcctcctcctcctg

SEQ ID NO: 5637015 - DNA, 18 bp, Homo sapiens
tacttcctctaggaaatg

SEQ ID NO: 5637016 - DNA, 12 bp, Homo sapiens
tacttcctctgt

SEQ ID NO: 5637017 - DNA, 19 bp, Homo sapiens
tacttcctctgtgaactgt

SEQ ID NO: 5637018 - DNA, 22 bp, Homo sapiens
tacttcctgagtggccagggaa

SEQ ID NO: 5637019 - DNA, 12 bp, Homo sapiens
tacttcctgcct

SEQ ID NO: 5637020 - DNA, 14 bp, Homo sapiens
tacttcctggcctc

SEQ ID NO: 5637021 - DNA, 23 bp, Homo sapiens
tacttcctgggatgatgtgtgaa

SEQ ID NO: 5637022 - DNA, 23 bp, Homo sapiens
tacttcctgtgacttcagctctg

SEQ ID NO: 5637023 - DNA, 13 bp, Homo sapiens
tacttcctttctc

SEQ ID NO: 5637024 - DNA, 20 bp, Homo sapiens
tacttcggggctgggaagtc

SEQ ID NO: 5637025 - DNA, 21 bp, Homo sapiens
tacttcgtcttcgccctctga

SEQ ID NO: 5637026 - DNA, 17 bp, Homo sapiens
tacttctaaatcagaaa

SEQ ID NO: 5637027 - DNA, 20 bp, Homo sapiens
tacttctaaatcagaaatag

SEQ ID NO: 5637028 - DNA, 13 bp, Homo sapiens
tacttctccaccc

SEQ ID NO: 5637029 - DNA, 16 bp, Homo sapiens
tacttctctaattctt

SEQ ID NO: 5637030 - DNA, 14 bp, Homo sapiens
tacttctctataaa

SEQ ID NO: 5637031 - DNA, 13 bp, Homo sapiens
tacttctctgagt

SEQ ID NO: 5637032 - DNA, 17 bp, Homo sapiens
tacttctgactttactt

SEQ ID NO: 5637033 - DNA, 21 bp, Homo sapiens
tacttctgagaccttgtttca

SEQ ID NO: 5637034 - DNA, 16 bp, Homo sapiens
tacttctgagccccag

SEQ ID NO: 5637035 - DNA, 19 bp, Homo sapiens
tacttctgagccccagccc

SEQ ID NO: 5637036 - DNA, 12 bp, Homo sapiens
tacttctgctgt

SEQ ID NO: 5637037 - DNA, 22 bp, Homo sapiens
tacttctggcataactaaaatt

SEQ ID NO: 5637038 - DNA, 16 bp, Homo sapiens
tacttctgtaattgtg

SEQ ID NO: 5637039 - DNA, 22 bp, Homo sapiens
tacttctgtaattgtgtggatt

SEQ ID NO: 5637040 - DNA, 15 bp, Homo sapiens
tacttctgtgtctgt

SEQ ID NO: 5637041 - DNA, 16 bp, Homo sapiens
tacttctgtgtctgtc

SEQ ID NO: 5637042 - DNA, 18 bp, Homo sapiens
tacttctgtgtgcaattg

SEQ ID NO: 5637043 - DNA, 14 bp, Homo sapiens
tacttctgtttctc

SEQ ID NO: 5637044 - DNA, 14 bp, Homo sapiens
tacttcttatacat

SEQ ID NO: 5637045 - DNA, 15 bp, Homo sapiens
tacttcttattgcaa

SEQ ID NO: 5637046 - DNA, 18 bp, Homo sapiens
tacttcttatttttctta

SEQ ID NO: 5637047 - DNA, 18 bp, Homo sapiens
tacttcttcattcaatac

SEQ ID NO: 5637048 - DNA, 17 bp, Homo sapiens
tacttcttctgtaatat

SEQ ID NO: 5637049 - DNA, 20 bp, Homo sapiens
tacttcttgaatataaaaaa

SEQ ID NO: 5637050 - DNA, 13 bp, Homo sapiens
tacttcttggaaa

SEQ ID NO: 5637051 - DNA, 19 bp, Homo sapiens
tacttcttgtgtgtatgca

SEQ ID NO: 5637052 - DNA, 16 bp, Homo sapiens
tacttctttagcattt

SEQ ID NO: 5637053 - DNA, 20 bp, Homo sapiens
tacttctttattttttaact

SEQ ID NO: 5637054 - DNA, 14 bp, Homo sapiens
tacttctttttcat

SEQ ID NO: 5637055 - DNA, 15 bp, Homo sapiens
tacttctttttcatt

SEQ ID NO: 5637056 - DNA, 20 bp, Homo sapiens
tacttcttttttcaaaagaa

SEQ ID NO: 5637057 - DNA, 22 bp, Homo sapiens
tacttcttttttcaaaagaaag

SEQ ID NO: 5637058 - DNA, 19 bp, Homo sapiens
tacttgaaaataataaagt

SEQ ID NO: 5637059 - DNA, 18 bp, Homo sapiens
tacttgaaaccagtattt

SEQ ID NO: 5637060 - DNA, 20 bp, Homo sapiens
tacttgaaatctaggattat

SEQ ID NO: 5637061 - DNA, 12 bp, Homo sapiens
tacttgaaccat

SEQ ID NO: 5637062 - DNA, 21 bp, Homo sapiens
tacttgaaccataaaatgtcc

SEQ ID NO: 5637063 - DNA, 16 bp, Homo sapiens
tacttgaacgttttct

SEQ ID NO: 5637064 - DNA, 18 bp, Homo sapiens
tacttgaacgttttctaa

SEQ ID NO: 5637065 - DNA, 20 bp, Homo sapiens
tacttgaacgttttctaatt

SEQ ID NO: 5637066 - DNA, 21 bp, Homo sapiens
tacttgaacgttttctaattg

SEQ ID NO: 5637067 - DNA, 23 bp, Homo sapiens
tacttgaacgttttctaattgct

SEQ ID NO: 5637068 - DNA, 19 bp, Homo sapiens
tacttgaactgttgccctt

SEQ ID NO: 5637069 - DNA, 22 bp, Homo sapiens
tacttgaactgttgcccttctg

SEQ ID NO: 5637070 - DNA, 24 bp, Homo sapiens
tacttgaagaaacagagtggcctc

SEQ ID NO: 5637071 - DNA, 15 bp, Homo sapiens
tacttgaagggccag

SEQ ID NO: 5637072 - DNA, 16 bp, Homo sapiens
tacttgaagggccaga

SEQ ID NO: 5637073 - DNA, 18 bp, Homo sapiens
tacttgaagggccagagc

SEQ ID NO: 5637074 - DNA, 19 bp, Homo sapiens
tacttgaagggccagagcc

SEQ ID NO: 5637075 - DNA, 21 bp, Homo sapiens
tacttgaagggccagagccag

SEQ ID NO: 5637076 - DNA, 19 bp, Homo sapiens
tacttgaaggtacacccca

SEQ ID NO: 5637077 - DNA, 23 bp, Homo sapiens
tacttgaagtctaaaagcagaaa

SEQ ID NO: 5637078 - DNA, 14 bp, Homo sapiens
tacttgaatagtat

SEQ ID NO: 5637079 - DNA, 23 bp, Homo sapiens
tacttgaatcagacattttaagg

SEQ ID NO: 5637080 - DNA, 19 bp, Homo sapiens
tacttgaatcagatggtgt

SEQ ID NO: 5637081 - DNA, 23 bp, Homo sapiens
tacttgaatcagatggtgtcatt

SEQ ID NO: 5637082 - DNA, 13 bp, Homo sapiens
tacttgaatgtag

SEQ ID NO: 5637083 - DNA, 16 bp, Homo sapiens
tacttgactcagtgat

SEQ ID NO: 5637084 - DNA, 15 bp, Homo sapiens
tacttgactcattta

SEQ ID NO: 5637085 - DNA, 17 bp, Homo sapiens
tacttgagataatctaa

SEQ ID NO: 5637086 - DNA, 13 bp, Homo sapiens
tacttgagctgta

SEQ ID NO: 5637087 - DNA, 16 bp, Homo sapiens
tacttgagtatcataa

SEQ ID NO: 5637088 - DNA, 15 bp, Homo sapiens
tacttgagtgtgcaa

SEQ ID NO: 5637089 - DNA, 16 bp, Homo sapiens
tacttgataagggact

SEQ ID NO: 5637090 - DNA, 19 bp, Homo sapiens
tacttgataatattagtga

SEQ ID NO: 5637091 - DNA, 15 bp, Homo sapiens
tacttgatactgaat

SEQ ID NO: 5637092 - DNA, 16 bp, Homo sapiens
tacttgatatttcctt

SEQ ID NO: 5637093 - DNA, 16 bp, Homo sapiens
tacttgatcattctca

SEQ ID NO: 5637094 - DNA, 18 bp, Homo sapiens
tacttgatcattctcagt

SEQ ID NO: 5637095 - DNA, 14 bp, Homo sapiens
tacttgatgcactt

SEQ ID NO: 5637096 - DNA, 22 bp, Homo sapiens
tacttgatttgatgtgactttt

SEQ ID NO: 5637097 - DNA, 14 bp, Homo sapiens
tacttgatttttca

SEQ ID NO: 5637098 - DNA, 15 bp, Homo sapiens
tacttgcaaaatgga

SEQ ID NO: 5637099 - DNA, 13 bp, Homo sapiens
tacttgcaactaa

SEQ ID NO: 5637100 - DNA, 11 bp, Homo sapiens
tacttgcacaa

SEQ ID NO: 5637101 - DNA, 12 bp, Homo sapiens
tacttgcacaag

SEQ ID NO: 5637102 - DNA, 14 bp, Homo sapiens
tacttgcactcttc

SEQ ID NO: 5637103 - DNA, 16 bp, Homo sapiens
tacttgcactcttcta

SEQ ID NO: 5637104 - DNA, 16 bp, Homo sapiens
tacttgcactctttaa

SEQ ID NO: 5637105 - DNA, 14 bp, Homo sapiens
tacttgcagttgtg

SEQ ID NO: 5637106 - DNA, 16 bp, Homo sapiens
tacttgccctgaccat

SEQ ID NO: 5637107 - DNA, 22 bp, Homo sapiens
tacttgccctgaccatgcattt

SEQ ID NO: 5637108 - DNA, 16 bp, Homo sapiens
tacttgctcaggtact

SEQ ID NO: 5637109 - DNA, 17 bp, Homo sapiens
tacttgctcaggtactt

SEQ ID NO: 5637110 - DNA, 15 bp, Homo sapiens
tacttgctctctgag

SEQ ID NO: 5637111 - DNA, 12 bp, Homo sapiens
tacttgctctgg

SEQ ID NO: 5637112 - DNA, 17 bp, Homo sapiens
tacttgctctggacctg

SEQ ID NO: 5637113 - DNA, 13 bp, Homo sapiens
tacttgctcttga

SEQ ID NO: 5637114 - DNA, 19 bp, Homo sapiens
tacttgctcttgatgcctg

SEQ ID NO: 5637115 - DNA, 21 bp, Homo sapiens
tacttgctcttgatgcctggc

SEQ ID NO: 5637116 - DNA, 18 bp, Homo sapiens
tacttgcttattacattt

SEQ ID NO: 5637117 - DNA, 19 bp, Homo sapiens
tacttgcttattacattta

SEQ ID NO: 5637118 - DNA, 15 bp, Homo sapiens
tacttgcttcagtgg

SEQ ID NO: 5637119 - DNA, 15 bp, Homo sapiens
tacttgcttctgctg

SEQ ID NO: 5637120 - DNA, 19 bp, Homo sapiens
tacttgcttgtattgtaaa

SEQ ID NO: 5637121 - DNA, 21 bp, Homo sapiens
tacttgctttcaattgacaaa

SEQ ID NO: 5637122 - DNA, 15 bp, Homo sapiens
tacttgctttgagtt

SEQ ID NO: 5637123 - DNA, 16 bp, Homo sapiens
tacttgctttgagttg

SEQ ID NO: 5637124 - DNA, 15 bp, Homo sapiens
tacttggaaataata

SEQ ID NO: 5637125 - DNA, 16 bp, Homo sapiens
tacttggaactaggct

SEQ ID NO: 5637126 - DNA, 21 bp, Homo sapiens
tacttggaattctaattgttt

SEQ ID NO: 5637127 - DNA, 17 bp, Homo sapiens
tacttggagtaattgca

SEQ ID NO: 5637128 - DNA, 16 bp, Homo sapiens
tacttggcaaattctg

SEQ ID NO: 5637129 - DNA, 13 bp, Homo sapiens
tacttggcaccaa

SEQ ID NO: 5637130 - DNA, 20 bp, Homo sapiens
tacttggcaccaataaagga

SEQ ID NO: 5637131 - DNA, 15 bp, Homo sapiens
tacttggcaggctga

SEQ ID NO: 5637132 - DNA, 16 bp, Homo sapiens
tacttggcattgagta

SEQ ID NO: 5637133 - DNA, 21 bp, Homo sapiens
tacttggcccccttcaggagc

SEQ ID NO: 5637134 - DNA, 23 bp, Homo sapiens
tacttggcccccttcaggagcct

SEQ ID NO: 5637135 - DNA, 20 bp, Homo sapiens
tacttggctgcttcctgtga

SEQ ID NO: 5637136 - DNA, 19 bp, Homo sapiens
tacttgggaagctgaggcg

SEQ ID NO: 5637137 - DNA, 14 bp, Homo sapiens
tacttgggagcctg

SEQ ID NO: 5637138 - DNA, 22 bp, Homo sapiens
tacttgggagcctgaggcagga

SEQ ID NO: 5637139 - DNA, 12 bp, Homo sapiens
tacttgggaggc

SEQ ID NO: 5637140 - DNA, 19 bp, Homo sapiens
tacttgggaggccgaggca

SEQ ID NO: 5637141 - DNA, 22 bp, Homo sapiens
tacttggtcccgtggatgctct

SEQ ID NO: 5637142 - DNA, 13 bp, Homo sapiens
tacttggtttgtg

SEQ ID NO: 5637143 - DNA, 21 bp, Homo sapiens
tacttgtaaaatgcttttcac

SEQ ID NO: 5637144 - DNA, 23 bp, Homo sapiens
tacttgtaaaatgcttttcactt

SEQ ID NO: 5637145 - DNA, 19 bp, Homo sapiens
tacttgtaaatataaagac

SEQ ID NO: 5637146 - DNA, 14 bp, Homo sapiens
tacttgtaatttct

SEQ ID NO: 5637147 - DNA, 21 bp, Homo sapiens
tacttgtaatttctaactcct

SEQ ID NO: 5637148 - DNA, 14 bp, Homo sapiens
tacttgtattccct

SEQ ID NO: 5637149 - DNA, 15 bp, Homo sapiens
tacttgtcaaagaag

SEQ ID NO: 5637150 - DNA, 20 bp, Homo sapiens
tacttgtcaatatttaaaca

SEQ ID NO: 5637151 - DNA, 18 bp, Homo sapiens
tacttgtctgaggcctca

SEQ ID NO: 5637152 - DNA, 16 bp, Homo sapiens
tacttgtctgtcaaat

SEQ ID NO: 5637153 - DNA, 14 bp, Homo sapiens
tacttgtctttgat

SEQ ID NO: 5637154 - DNA, 11 bp, Homo sapiens
tacttgtgaaa

SEQ ID NO: 5637155 - DNA, 19 bp, Homo sapiens
tacttgtgaaacacagctg

SEQ ID NO: 5637156 - DNA, 17 bp, Homo sapiens
tacttgtgaacatgcct

SEQ ID NO: 5637157 - DNA, 18 bp, Homo sapiens
tacttgtgaacatgcctt

SEQ ID NO: 5637158 - DNA, 18 bp, Homo sapiens
tacttgtggacacagctc

SEQ ID NO: 5637159 - DNA, 15 bp, Homo sapiens
tacttgtggactaaa

SEQ ID NO: 5637160 - DNA, 19 bp, Homo sapiens
tacttgtggactaaaagat

SEQ ID NO: 5637161 - DNA, 22 bp, Homo sapiens
tacttgtggactaaaagatata

SEQ ID NO: 5637162 - DNA, 18 bp, Homo sapiens
tacttgtggtgtgaccat

SEQ ID NO: 5637163 - DNA, 18 bp, Homo sapiens
tacttgtgttacttgcca

SEQ ID NO: 5637164 - DNA, 16 bp, Homo sapiens
tacttgtgttcattga

SEQ ID NO: 5637165 - DNA, 22 bp, Homo sapiens
tacttgttcaaaatatgttctt

SEQ ID NO: 5637166 - DNA, 16 bp, Homo sapiens
tagaaatcattttgca

SEQ ID NO: 5637167 - DNA, 17 bp, Homo sapiens
tagaaatctaaaagaat

SEQ ID NO: 5637168 - DNA, 21 bp, Homo sapiens
tagaaatctatcttaaaacct

SEQ ID NO: 5637169 - DNA, 17 bp, Homo sapiens
tagaaatctgtcctgtg

SEQ ID NO: 5637170 - DNA, 11 bp, Homo sapiens
tagaaatgatt

SEQ ID NO: 5637171 - DNA, 13 bp, Homo sapiens
tagaaatgcatat

SEQ ID NO: 5637172 - DNA, 16 bp, Homo sapiens
tagaaatggaaatttt

SEQ ID NO: 5637173 - DNA, 12 bp, Homo sapiens
tagaaatgggaa

SEQ ID NO: 5637174 - DNA, 16 bp, Homo sapiens
tagaaatgggaatcat

SEQ ID NO: 5637175 - DNA, 17 bp, Homo sapiens
tagaaatgggaatcatg

SEQ ID NO: 5637176 - DNA, 19 bp, Homo sapiens
tagaaatgtaaactgccat

SEQ ID NO: 5637177 - DNA, 19 bp, Homo sapiens
tagaaatgtaacttttgta

SEQ ID NO: 5637178 - DNA, 20 bp, Homo sapiens
tagaaatgtaggtcctcaga

SEQ ID NO: 5637179 - DNA, 15 bp, Homo sapiens
tagaaatgtgaatga

SEQ ID NO: 5637180 - DNA, 15 bp, Homo sapiens
tagaaatgtttcata

SEQ ID NO: 5637181 - DNA, 12 bp, Homo sapiens
tagaaattacaa

SEQ ID NO: 5637182 - DNA, 19 bp, Homo sapiens
tagaaattacaagtttcag

SEQ ID NO: 5637183 - DNA, 22 bp, Homo sapiens
tagaaattaccagagttgttct

SEQ ID NO: 5637184 - DNA, 14 bp, Homo sapiens
tagaaattactgga

SEQ ID NO: 5637185 - DNA, 18 bp, Homo sapiens
tagaaattataattttag

SEQ ID NO: 5637186 - DNA, 14 bp, Homo sapiens
tagaaattctaact

SEQ ID NO: 5637187 - DNA, 13 bp, Homo sapiens
tagaaattctata

SEQ ID NO: 5637188 - DNA, 20 bp, Homo sapiens
tagaaattctataagagaca

SEQ ID NO: 5637189 - DNA, 13 bp, Homo sapiens
tagaaattctgaa

SEQ ID NO: 5637190 - DNA, 14 bp, Homo sapiens
tagaaattcttaat

SEQ ID NO: 5637191 - DNA, 21 bp, Homo sapiens
tagaaattcttcatgaacata

SEQ ID NO: 5637192 - DNA, 19 bp, Homo sapiens
tagaaatttgcccctggca

SEQ ID NO: 5637193 - DNA, 22 bp, Homo sapiens
tagaaatttgcccctggcaaat

SEQ ID NO: 5637194 - DNA, 14 bp, Homo sapiens
tagaaattttacaa

SEQ ID NO: 5637195 - DNA, 23 bp, Homo sapiens
tagaaattttatctcttcttcct

SEQ ID NO: 5637196 - DNA, 14 bp, Homo sapiens
tagaaattttgtaa

SEQ ID NO: 5637197 - DNA, 17 bp, Homo sapiens
tagaaattttgtaagaa

SEQ ID NO: 5637198 - DNA, 22 bp, Homo sapiens
tagaaattttgtaagaaggcaa

SEQ ID NO: 5637199 - DNA, 13 bp, Homo sapiens
tagaaattttgtt

SEQ ID NO: 5637200 - DNA, 19 bp, Homo sapiens
tagaacaaaagaggattag

SEQ ID NO: 5637201 - DNA, 23 bp, Homo sapiens
tagaacaagatgcactcgctgtg

SEQ ID NO: 5637202 - DNA, 17 bp, Homo sapiens
tagaacaagccagagcc

SEQ ID NO: 5637203 - DNA, 17 bp, Homo sapiens
tagaacaatagctattg

SEQ ID NO: 5637204 - DNA, 23 bp, Homo sapiens
tagaacaatagctattgcatgta

SEQ ID NO: 5637205 - DNA, 19 bp, Homo sapiens
tagaacacaagggatataa

SEQ ID NO: 5637206 - DNA, 20 bp, Homo sapiens
tagaacacaagggatataaa

SEQ ID NO: 5637207 - DNA, 12 bp, Homo sapiens
tagaacacacac

SEQ ID NO: 5637208 - DNA, 19 bp, Homo sapiens
tagaacacagagtgtgttt

SEQ ID NO: 5637209 - DNA, 15 bp, Homo sapiens
tagaacacaggcaaa

SEQ ID NO: 5637210 - DNA, 18 bp, Homo sapiens
tagaacacccactggcca

SEQ ID NO: 5637211 - DNA, 18 bp, Homo sapiens
tagaacactaattcataa

SEQ ID NO: 5637212 - DNA, 19 bp, Homo sapiens
tagaacactaattcataat

SEQ ID NO: 5637213 - DNA, 12 bp, Homo sapiens
tagaacactatt

SEQ ID NO: 5637214 - DNA, 17 bp, Homo sapiens
tagaacactattttcag

SEQ ID NO: 5637215 - DNA, 20 bp, Homo sapiens
tagaacactattttcagaat

SEQ ID NO: 5637216 - DNA, 23 bp, Homo sapiens
tagaacactgatggattccaacc

SEQ ID NO: 5637217 - DNA, 15 bp, Homo sapiens
tagaacagaaaacaa

SEQ ID NO: 5637218 - DNA, 17 bp, Homo sapiens
tagaacagataatcagt

SEQ ID NO: 5637219 - DNA, 19 bp, Homo sapiens
tagaacaggacctctgctt

SEQ ID NO: 5637220 - DNA, 18 bp, Homo sapiens
tagaacagggtttctcag

SEQ ID NO: 5637221 - DNA, 12 bp, Homo sapiens
tagaacaggttt

SEQ ID NO: 5637222 - DNA, 14 bp, Homo sapiens
tagaacaggttttt

SEQ ID NO: 5637223 - DNA, 20 bp, Homo sapiens
tagaacagtttacttggaaa

SEQ ID NO: 5637224 - DNA, 18 bp, Homo sapiens
tagaacatccctgccagc

SEQ ID NO: 5637225 - DNA, 17 bp, Homo sapiens
tagaacatccctgggca

SEQ ID NO: 5637226 - DNA, 22 bp, Homo sapiens
tagaacatccttaaatgtctaa

SEQ ID NO: 5637227 - DNA, 17 bp, Homo sapiens
tagaacatgcacattta

SEQ ID NO: 5637228 - DNA, 19 bp, Homo sapiens
tagaacatgcacatttata

SEQ ID NO: 5637229 - DNA, 21 bp, Homo sapiens
tagaacatgcacatttatata

SEQ ID NO: 5637230 - DNA, 14 bp, Homo sapiens
tagaacattcactt

SEQ ID NO: 5637231 - DNA, 21 bp, Homo sapiens
tagaacattcacttttgttaa

SEQ ID NO: 5637232 - DNA, 18 bp, Homo sapiens
tagaacattgatctgttt

SEQ ID NO: 5637233 - DNA, 15 bp, Homo sapiens
tagaaccaagcttca

SEQ ID NO: 5637234 - DNA, 21 bp, Homo sapiens
tagaaccaagcttcagagcct

SEQ ID NO: 5637235 - DNA, 22 bp, Homo sapiens
tagaaccaagcttcagagccta

SEQ ID NO: 5637236 - DNA, 17 bp, Homo sapiens
tagaaccacagcagaca

SEQ ID NO: 5637237 - DNA, 18 bp, Homo sapiens
tagaaccacagcagacac

SEQ ID NO: 5637238 - DNA, 23 bp, Homo sapiens
tagaaccaccaaaattatagctt

SEQ ID NO: 5637239 - DNA, 12 bp, Homo sapiens
tagaaccacttc

SEQ ID NO: 5637240 - DNA, 22 bp, Homo sapiens
tagaaccctctgttccttccct

SEQ ID NO: 5637241 - DNA, 16 bp, Homo sapiens
tagaacccttctgctt

SEQ ID NO: 5637242 - DNA, 16 bp, Homo sapiens
tagaacccttgcacag

SEQ ID NO: 5637243 - DNA, 15 bp, Homo sapiens
tagaacctaacaccc

SEQ ID NO: 5637244 - DNA, 15 bp, Homo sapiens
tagaacctaattcaa

SEQ ID NO: 5637245 - DNA, 13 bp, Homo sapiens
tagaacctagaag

SEQ ID NO: 5637246 - DNA, 23 bp, Homo sapiens
tagaacctagagaagctaaaacc

SEQ ID NO: 5637247 - DNA, 21 bp, Homo sapiens
tagaacctcgaggtttctcaa

SEQ ID NO: 5637248 - DNA, 19 bp, Homo sapiens
tagaacctgcatttaagaa

SEQ ID NO: 5637249 - DNA, 22 bp, Homo sapiens
tagaacctggagagctagaacc

SEQ ID NO: 5637250 - DNA, 13 bp, Homo sapiens
tagaacctggagg

SEQ ID NO: 5637251 - DNA, 14 bp, Homo sapiens
tagaacctgggctg

SEQ ID NO: 5637252 - DNA, 17 bp, Homo sapiens
tagaacctgggctgtgc

SEQ ID NO: 5637253 - DNA, 19 bp, Homo sapiens
tagaacgagcctggaagca

SEQ ID NO: 5637254 - DNA, 14 bp, Homo sapiens
tagaactagccaaa

SEQ ID NO: 5637255 - DNA, 14 bp, Homo sapiens
tagaactatcattt

SEQ ID NO: 5637256 - DNA, 16 bp, Homo sapiens
tagaactatctgcatt

SEQ ID NO: 5637257 - DNA, 19 bp, Homo sapiens
tagaactcagttttaacta

SEQ ID NO: 5637258 - DNA, 16 bp, Homo sapiens
tagaactccctttcaa

SEQ ID NO: 5637259 - DNA, 17 bp, Homo sapiens
tagaactccctttcaac

SEQ ID NO: 5637260 - DNA, 12 bp, Homo sapiens
tagaactcctgt

SEQ ID NO: 5637261 - DNA, 15 bp, Homo sapiens
tagaactcctgtctt

SEQ ID NO: 5637262 - DNA, 15 bp, Homo sapiens
tagaactgattacat

SEQ ID NO: 5637263 - DNA, 20 bp, Homo sapiens
tagaactgtcccacaaaata

SEQ ID NO: 5637264 - DNA, 21 bp, Homo sapiens
tagaactgtcccacaaaatat

SEQ ID NO: 5637265 - DNA, 16 bp, Homo sapiens
tagaactgtctgtgaa

SEQ ID NO: 5637266 - DNA, 12 bp, Homo sapiens
tagaactgttca

SEQ ID NO: 5637267 - DNA, 19 bp, Homo sapiens
tagaactgttcatttccac

SEQ ID NO: 5637268 - DNA, 17 bp, Homo sapiens
tagaacttagttttgtt

SEQ ID NO: 5637269 - DNA, 22 bp, Homo sapiens
tagaacttcaaaatgttcgtat

SEQ ID NO: 5637270 - DNA, 19 bp, Homo sapiens
tagaacttgaactaacata

SEQ ID NO: 5637271 - DNA, 15 bp, Homo sapiens
tagaacttgcctttt

SEQ ID NO: 5637272 - DNA, 22 bp, Homo sapiens
tagaacttgttgctgattttga

SEQ ID NO: 5637273 - DNA, 21 bp, Homo sapiens
tagaactttctgctttgcaca

SEQ ID NO: 5637274 - DNA, 22 bp, Homo sapiens
tagaactttgcatagcagctgc

SEQ ID NO: 5637275 - DNA, 20 bp, Homo sapiens
tagaactttgccagtcttta

SEQ ID NO: 5637276 - DNA, 15 bp, Homo sapiens
tagaacttttttaaa

SEQ ID NO: 5637277 - DNA, 18 bp, Homo sapiens
tagaacttttttaaataa

SEQ ID NO: 5637278 - DNA, 20 bp, Homo sapiens
tagaacttttttaaataaac

SEQ ID NO: 5637279 - DNA, 15 bp, Homo sapiens
tagaagaaaaaagaa

SEQ ID NO: 5637280 - DNA, 13 bp, Homo sapiens
tagaagaaaaccc

SEQ ID NO: 5637281 - DNA, 14 bp, Homo sapiens
tagaagaaaacccg

SEQ ID NO: 5637282 - DNA, 20 bp, Homo sapiens
tagaagaaaagcactgggag

SEQ ID NO: 5637283 - DNA, 16 bp, Homo sapiens
tagaagaaaagcccat

SEQ ID NO: 5637284 - DNA, 13 bp, Homo sapiens
tagaagaaagaaa

SEQ ID NO: 5637285 - DNA, 14 bp, Homo sapiens
tagaagaaagaaaa

SEQ ID NO: 5637286 - DNA, 16 bp, Homo sapiens
tagaagaaagatgttt

SEQ ID NO: 5637287 - DNA, 13 bp, Homo sapiens
tagaagaaagcaa

SEQ ID NO: 5637288 - DNA, 14 bp, Homo sapiens
tagaagaaagcaaa

SEQ ID NO: 5637289 - DNA, 21 bp, Homo sapiens
tagaagaaataatttttctta

SEQ ID NO: 5637290 - DNA, 17 bp, Homo sapiens
tagaagaaatgaaattt

SEQ ID NO: 5637291 - DNA, 19 bp, Homo sapiens
tagaagaaatgaaatttta

SEQ ID NO: 5637292 - DNA, 23 bp, Homo sapiens
tagaagaaatgaaattttaccaa

SEQ ID NO: 5637293 - DNA, 15 bp, Homo sapiens
tagaagaacagcaga

SEQ ID NO: 5637294 - DNA, 22 bp, Homo sapiens
tagaagaacatccaaggagaaa

SEQ ID NO: 5637295 - DNA, 14 bp, Homo sapiens
tagaagaagaggaa

SEQ ID NO: 5637296 - DNA, 19 bp, Homo sapiens
tagaagaaggactgaagaa

SEQ ID NO: 5637297 - DNA, 22 bp, Homo sapiens
tagaagaaggactgaagaaaat

SEQ ID NO: 5637298 - DNA, 21 bp, Homo sapiens
tagaagaatacaaacatattt

SEQ ID NO: 5637299 - DNA, 16 bp, Homo sapiens
tagaagaatgcatgct

SEQ ID NO: 5637300 - DNA, 20 bp, Homo sapiens
tagaagacaattgacaacag

SEQ ID NO: 5637301 - DNA, 13 bp, Homo sapiens
tagaagacattta

SEQ ID NO: 5637302 - DNA, 21 bp, Homo sapiens
tagaagactctaccagactgt

SEQ ID NO: 5637303 - DNA, 22 bp, Homo sapiens
tagaagagagaggttgaaaaac

SEQ ID NO: 5637304 - DNA, 19 bp, Homo sapiens
tagaagagcacagagccct

SEQ ID NO: 5637305 - DNA, 13 bp, Homo sapiens
tagaagagcctga

SEQ ID NO: 5637306 - DNA, 22 bp, Homo sapiens
tagaagaggtagtgtgaatatt

SEQ ID NO: 5637307 - DNA, 19 bp, Homo sapiens
tagaagataggtgagcaac

SEQ ID NO: 5637308 - DNA, 20 bp, Homo sapiens
tagaagatcacagcagggcc

SEQ ID NO: 5637309 - DNA, 20 bp, Homo sapiens
tagaagatccacatcctcta

SEQ ID NO: 5637310 - DNA, 14 bp, Homo sapiens
tagaagatgaatca

SEQ ID NO: 5637311 - DNA, 19 bp, Homo sapiens
tagaagatgaatcagtatg

SEQ ID NO: 5637312 - DNA, 20 bp, Homo sapiens
tagaagatgaatcagtatga

SEQ ID NO: 5637313 - DNA, 19 bp, Homo sapiens
tagaagatgcagttcaaaa

SEQ ID NO: 5637314 - DNA, 19 bp, Homo sapiens
tagaagatggactctgaaa

SEQ ID NO: 5637315 - DNA, 14 bp, Homo sapiens
tagaagatgtgtaa

SEQ ID NO: 5637316 - DNA, 14 bp, Homo sapiens
tagaagatgtttgc

SEQ ID NO: 5637317 - DNA, 15 bp, Homo sapiens
tagaagattctatgt

SEQ ID NO: 5637318 - DNA, 18 bp, Homo sapiens
tagaagattctatgttaa

SEQ ID NO: 5637319 - DNA, 21 bp, Homo sapiens
tagaagattgttggtgaattt

SEQ ID NO: 5637320 - DNA, 15 bp, Homo sapiens
tagaagcaaggagaa

SEQ ID NO: 5637321 - DNA, 20 bp, Homo sapiens
tagaagcaaggagaaaatat

SEQ ID NO: 5637322 - DNA, 11 bp, Homo sapiens
tagaagcagaa

SEQ ID NO: 5637323 - DNA, 23 bp, Homo sapiens
tagaagcagcgagtgcatgggct

SEQ ID NO: 5637324 - DNA, 17 bp, Homo sapiens
tagaagccaagacagtg

SEQ ID NO: 5637325 - DNA, 19 bp, Homo sapiens
tagaagccaagggaaaggg

SEQ ID NO: 5637326 - DNA, 21 bp, Homo sapiens
tagaagccacccttccctgcc

SEQ ID NO: 5637327 - DNA, 23 bp, Homo sapiens
tagaagccacccttccctgcctc

SEQ ID NO: 5637328 - DNA, 21 bp, Homo sapiens
tagaagccatcctaaggtgct

SEQ ID NO: 5637329 - DNA, 20 bp, Homo sapiens
tagaagccatctgacagcag

SEQ ID NO: 5637330 - DNA, 23 bp, Homo sapiens
tagaagccatgggacctcctccc

SEQ ID NO: 5637331 - DNA, 21 bp, Homo sapiens
tagaagcctgacaactcattt

SEQ ID NO: 5637332 - DNA, 22 bp, Homo sapiens
tagaagctcaggttccctgcca

SEQ ID NO: 5637333 - DNA, 12 bp, Homo sapiens
tagaagctcttg

SEQ ID NO: 5637334 - DNA, 14 bp, Homo sapiens
tagaagctcttgga

SEQ ID NO: 5637335 - DNA, 16 bp, Homo sapiens
tagaagctgtagtagc

SEQ ID NO: 5637336 - DNA, 14 bp, Homo sapiens
tagaagcttcagca

SEQ ID NO: 5637337 - DNA, 21 bp, Homo sapiens
tagaaggaaaacctagaaaac

SEQ ID NO: 5637338 - DNA, 13 bp, Homo sapiens
tagaaggaaacta

SEQ ID NO: 5637339 - DNA, 19 bp, Homo sapiens
tagaaggaagtgtgtttgc

SEQ ID NO: 5637340 - DNA, 16 bp, Homo sapiens
tagaaggaatttgtac

SEQ ID NO: 5637341 - DNA, 17 bp, Homo sapiens
tagaaggagacagagct

SEQ ID NO: 5637342 - DNA, 23 bp, Homo sapiens
tagaaggagacagagctggttgg

SEQ ID NO: 5637343 - DNA, 17 bp, Homo sapiens
tagactgtgccagaggc

SEQ ID NO: 5637344 - DNA, 20 bp, Homo sapiens
tagactgtgtctgaatcatg

SEQ ID NO: 5637345 - DNA, 21 bp, Homo sapiens
tagactgtgtctgaatcatgt

SEQ ID NO: 5637346 - DNA, 16 bp, Homo sapiens
tagactgttgggacag

SEQ ID NO: 5637347 - DNA, 15 bp, Homo sapiens
tagacttatagtcct

SEQ ID NO: 5637348 - DNA, 22 bp, Homo sapiens
tagacttatattttataatcag

SEQ ID NO: 5637349 - DNA, 16 bp, Homo sapiens
tagacttcagagagaa

SEQ ID NO: 5637350 - DNA, 16 bp, Homo sapiens
tagacttccacaaaat

SEQ ID NO: 5637351 - DNA, 13 bp, Homo sapiens
tagacttctctta

SEQ ID NO: 5637352 - DNA, 16 bp, Homo sapiens
tagacttctgagtaat

SEQ ID NO: 5637353 - DNA, 19 bp, Homo sapiens
tagacttctgctttccaca

SEQ ID NO: 5637354 - DNA, 13 bp, Homo sapiens
tagacttctggtt

SEQ ID NO: 5637355 - DNA, 14 bp, Homo sapiens
tagacttctggttg

SEQ ID NO: 5637356 - DNA, 17 bp, Homo sapiens
tagacttctggttgtat

SEQ ID NO: 5637357 - DNA, 18 bp, Homo sapiens
tagacttctgttttcaat

SEQ ID NO: 5637358 - DNA, 23 bp, Homo sapiens
tagacttgaaaagagacaggcag

SEQ ID NO: 5637359 - DNA, 21 bp, Homo sapiens
tagacttgaaagttttccagt

SEQ ID NO: 5637360 - DNA, 16 bp, Homo sapiens
tagacttgaggaaacc

SEQ ID NO: 5637361 - DNA, 15 bp, Homo sapiens
tagacttggacccaa

SEQ ID NO: 5637362 - DNA, 18 bp, Homo sapiens
tagacttggacccaaaaa

SEQ ID NO: 5637363 - DNA, 22 bp, Homo sapiens
tagacttggagaatactgccaa

SEQ ID NO: 5637364 - DNA, 22 bp, Homo sapiens
tagacttgggatggggagggag

SEQ ID NO: 5637365 - DNA, 18 bp, Homo sapiens
tagacttgtgctgatcgt

SEQ ID NO: 5637366 - DNA, 20 bp, Homo sapiens
tagactttaattcttctctt

SEQ ID NO: 5637367 - DNA, 19 bp, Homo sapiens
tagactttagaaataaatg

SEQ ID NO: 5637368 - DNA, 18 bp, Homo sapiens
tagactttatgcaataaa

SEQ ID NO: 5637369 - DNA, 15 bp, Homo sapiens
tagactttctcagtg

SEQ ID NO: 5637370 - DNA, 20 bp, Homo sapiens
tagacttttccaatatgtga

SEQ ID NO: 5637371 - DNA, 13 bp, Homo sapiens
tagagaaaacctt

SEQ ID NO: 5637372 - DNA, 13 bp, Homo sapiens
tagagaaaaggct

SEQ ID NO: 5637373 - DNA, 13 bp, Homo sapiens
tagagaaaagtgt

SEQ ID NO: 5637374 - DNA, 17 bp, Homo sapiens
tagagaaaagtgtatta

SEQ ID NO: 5637375 - DNA, 17 bp, Homo sapiens
tagagaaaattcaggtc

SEQ ID NO: 5637376 - DNA, 20 bp, Homo sapiens
tagagaaagacaaaatgtga

SEQ ID NO: 5637377 - DNA, 13 bp, Homo sapiens
tagagaacaaagg

SEQ ID NO: 5637378 - DNA, 22 bp, Homo sapiens
tagagaacaaagtaaaagtagt

SEQ ID NO: 5637379 - DNA, 12 bp, Homo sapiens
tagagaactgaa

SEQ ID NO: 5637380 - DNA, 15 bp, Homo sapiens
tagagaactgaaaag

SEQ ID NO: 5637381 - DNA, 20 bp, Homo sapiens
tagagaactgtcaccctgag

SEQ ID NO: 5637382 - DNA, 21 bp, Homo sapiens
tagagaactgtcaccctgagg

SEQ ID NO: 5637383 - DNA, 13 bp, Homo sapiens
tagagaagcaagt

SEQ ID NO: 5637384 - DNA, 16 bp, Homo sapiens
tagagaagcaagtaaa

SEQ ID NO: 5637385 - DNA, 14 bp, Homo sapiens
tagagaagccataa

SEQ ID NO: 5637386 - DNA, 22 bp, Homo sapiens
tagagaagccttttccataaag

SEQ ID NO: 5637387 - DNA, 13 bp, Homo sapiens
tagagaaggaccc

SEQ ID NO: 5637388 - DNA, 23 bp, Homo sapiens
tagagaagggagacattgtttgg

SEQ ID NO: 5637389 - DNA, 16 bp, Homo sapiens
tagagaagtaagcaga

SEQ ID NO: 5637390 - DNA, 15 bp, Homo sapiens
tagagaagtatccaa

SEQ ID NO: 5637391 - DNA, 15 bp, Homo sapiens
tagagaatgaaagga

SEQ ID NO: 5637392 - DNA, 18 bp, Homo sapiens
tagagaatgccctcagct

SEQ ID NO: 5637393 - DNA, 18 bp, Homo sapiens
tagagaatgggatgtgtg

SEQ ID NO: 5637394 - DNA, 17 bp, Homo sapiens
tagagaatgttccagac

SEQ ID NO: 5637395 - DNA, 22 bp, Homo sapiens
tagagaatgttccagacattct

SEQ ID NO: 5637396 - DNA, 15 bp, Homo sapiens
tagagacacagagat

SEQ ID NO: 5637397 - DNA, 13 bp, Homo sapiens
tagagacagatgc

SEQ ID NO: 5637398 - DNA, 18 bp, Homo sapiens
tagagacagatgctggtg

SEQ ID NO: 5637399 - DNA, 11 bp, Homo sapiens
tagagacaggg

SEQ ID NO: 5637400 - DNA, 14 bp, Homo sapiens
tagagacagggtct

SEQ ID NO: 5637401 - DNA, 16 bp, Homo sapiens
tagagactagacaaat

SEQ ID NO: 5637402 - DNA, 14 bp, Homo sapiens
tagagactctgtga

SEQ ID NO: 5637403 - DNA, 15 bp, Homo sapiens
tagagactctgtgat

SEQ ID NO: 5637404 - DNA, 21 bp, Homo sapiens
tagagacttttttctagtaca

SEQ ID NO: 5637405 - DNA, 17 bp, Homo sapiens
tagagagaaaaagaaag

SEQ ID NO: 5637406 - DNA, 15 bp, Homo sapiens
tagagagaataaatt

SEQ ID NO: 5637407 - DNA, 17 bp, Homo sapiens
tagagagagctgtatta

SEQ ID NO: 5637408 - DNA, 19 bp, Homo sapiens
tagagagatgagaagccag

SEQ ID NO: 5637409 - DNA, 20 bp, Homo sapiens
tagagagatgagaagccagg

SEQ ID NO: 5637410 - DNA, 16 bp, Homo sapiens
tagagagcagaaataa

SEQ ID NO: 5637411 - DNA, 17 bp, Homo sapiens
tagagagcagaaataaa

SEQ ID NO: 5637412 - DNA, 20 bp, Homo sapiens
tagagagcatctgcaacaaa

SEQ ID NO: 5637413 - DNA, 19 bp, Homo sapiens
tagagagcctgtcaccaga

SEQ ID NO: 5637414 - DNA, 15 bp, Homo sapiens
tagagagccttaact

SEQ ID NO: 5637415 - DNA, 13 bp, Homo sapiens
tagagagctattt

SEQ ID NO: 5637416 - DNA, 22 bp, Homo sapiens
tagagaggacaatactggggtt

SEQ ID NO: 5637417 - DNA, 15 bp, Homo sapiens
tagagaggagaaagg

SEQ ID NO: 5637418 - DNA, 13 bp, Homo sapiens
tagagaggcccgc

SEQ ID NO: 5637419 - DNA, 23 bp, Homo sapiens
tagagaggggcctctggctgcct

SEQ ID NO: 5637420 - DNA, 10 bp, Homo sapiens
tagagaggtt

SEQ ID NO: 5637421 - DNA, 20 bp, Homo sapiens
tagagagtctccaagagaac

SEQ ID NO: 5637422 - DNA, 15 bp, Homo sapiens
tagagataaatattt

SEQ ID NO: 5637423 - DNA, 14 bp, Homo sapiens
tagagataattctg

SEQ ID NO: 5637424 - DNA, 18 bp, Homo sapiens
tagagatacagtatacct

SEQ ID NO: 5637425 - DNA, 16 bp, Homo sapiens
tagagataggaaactg

SEQ ID NO: 5637426 - DNA, 15 bp, Homo sapiens
tagagatatttcaag

SEQ ID NO: 5637427 - DNA, 22 bp, Homo sapiens
tagagatatttcaagctcatgt

SEQ ID NO: 5637428 - DNA, 19 bp, Homo sapiens
tagagatattttgggtata

SEQ ID NO: 5637429 - DNA, 16 bp, Homo sapiens
tagagatattttgtaa

SEQ ID NO: 5637430 - DNA, 21 bp, Homo sapiens
tagagatattttgtaaaatgt

SEQ ID NO: 5637431 - DNA, 17 bp, Homo sapiens
tagagatatttttatat

SEQ ID NO: 5637432 - DNA, 18 bp, Homo sapiens
tagagatatttttatata

SEQ ID NO: 5637433 - DNA, 17 bp, Homo sapiens
tagagatatttttgtac

SEQ ID NO: 5637434 - DNA, 23 bp, Homo sapiens
tagagatgaagtttgtagttgtt

SEQ ID NO: 5637435 - DNA, 14 bp, Homo sapiens
tagagatgcattca

SEQ ID NO: 5637436 - DNA, 17 bp, Homo sapiens
tagagatggagtcttgc

SEQ ID NO: 5637437 - DNA, 17 bp, Homo sapiens
tagagattacctcctga

SEQ ID NO: 5637438 - DNA, 18 bp, Homo sapiens
tagagattacctcctgag

SEQ ID NO: 5637439 - DNA, 21 bp, Homo sapiens
tagagattacctcctgagaaa

SEQ ID NO: 5637440 - DNA, 19 bp, Homo sapiens
tagagattcccctggacca

SEQ ID NO: 5637441 - DNA, 21 bp, Homo sapiens
tagagattgacttcagaaact

SEQ ID NO: 5637442 - DNA, 20 bp, Homo sapiens
tagagattgcatttttatta

SEQ ID NO: 5637443 - DNA, 15 bp, Homo sapiens
tagagattgtacatt

SEQ ID NO: 5637444 - DNA, 13 bp, Homo sapiens
tagagattttaca

SEQ ID NO: 5637445 - DNA, 15 bp, Homo sapiens
tagagattttcattt

SEQ ID NO: 5637446 - DNA, 21 bp, Homo sapiens
tagagcaaaatcaacatgact

SEQ ID NO: 5637447 - DNA, 21 bp, Homo sapiens
tagagcaaaattgatgtgttt

SEQ ID NO: 5637448 - DNA, 21 bp, Homo sapiens
tagagcaaagacttaatcata

SEQ ID NO: 5637449 - DNA, 20 bp, Homo sapiens
tagagcaaagcatcaaagaa

SEQ ID NO: 5637450 - DNA, 19 bp, Homo sapiens
tagagcaatgttggttttt

SEQ ID NO: 5637451 - DNA, 12 bp, Homo sapiens
tagagcacaata

SEQ ID NO: 5637452 - DNA, 20 bp, Homo sapiens
tagagcacctagtccagtga

SEQ ID NO: 5637453 - DNA, 16 bp, Homo sapiens
tagagcactgccacca

SEQ ID NO: 5637454 - DNA, 12 bp, Homo sapiens
tagagcagaaat

SEQ ID NO: 5637455 - DNA, 14 bp, Homo sapiens
tagagcagaaattc

SEQ ID NO: 5637456 - DNA, 14 bp, Homo sapiens
tagagcagcccaaa

SEQ ID NO: 5637457 - DNA, 13 bp, Homo sapiens
tagagcagcctgc

SEQ ID NO: 5637458 - DNA, 16 bp, Homo sapiens
tagagcaggactgatg

SEQ ID NO: 5637459 - DNA, 20 bp, Homo sapiens
tagagcaggcgttcagctca

SEQ ID NO: 5637460 - DNA, 22 bp, Homo sapiens
tagagcaggcgttcagctcact

SEQ ID NO: 5637461 - DNA, 13 bp, Homo sapiens
tagagcatatttg

SEQ ID NO: 5637462 - DNA, 22 bp, Homo sapiens
tagagcatatttgccaataaag

SEQ ID NO: 5637463 - DNA, 19 bp, Homo sapiens
tagagcatctcatttataa

SEQ ID NO: 5637464 - DNA, 23 bp, Homo sapiens
tagagcatctgtcccactgggac

SEQ ID NO: 5637465 - DNA, 17 bp, Homo sapiens
tagagcatgctgcctga

SEQ ID NO: 5637466 - DNA, 12 bp, Homo sapiens
tagagcattaaa

SEQ ID NO: 5637467 - DNA, 13 bp, Homo sapiens
tagagcattaaaa

SEQ ID NO: 5637468 - DNA, 14 bp, Homo sapiens
tagagcattaaaat

SEQ ID NO: 5637469 - DNA, 16 bp, Homo sapiens
tagagcattaaaataa

SEQ ID NO: 5637470 - DNA, 18 bp, Homo sapiens
tagagcattaaaataact

SEQ ID NO: 5637471 - DNA, 23 bp, Homo sapiens
tagagcattctggggtggggctt

SEQ ID NO: 5637472 - DNA, 19 bp, Homo sapiens
tagagcattgaattggaga

SEQ ID NO: 5637473 - DNA, 20 bp, Homo sapiens
tagagccaactgattttgta

SEQ ID NO: 5637474 - DNA, 17 bp, Homo sapiens
tagagccaagctgcaca

SEQ ID NO: 5637475 - DNA, 12 bp, Homo sapiens
tagagccaatta

SEQ ID NO: 5637476 - DNA, 14 bp, Homo sapiens
tagagccagccttg

SEQ ID NO: 5637477 - DNA, 13 bp, Homo sapiens
tagagccagcttg

SEQ ID NO: 5637478 - DNA, 12 bp, Homo sapiens
tagagccaggca

SEQ ID NO: 5637479 - DNA, 14 bp, Homo sapiens
tagagccaggcaca

SEQ ID NO: 5637480 - DNA, 19 bp, Homo sapiens
tagagccaggcacacactg

SEQ ID NO: 5637481 - DNA, 21 bp, Homo sapiens
tagagccaggcacacactgtg

SEQ ID NO: 5637482 - DNA, 18 bp, Homo sapiens
tagagcccctactgtggg

SEQ ID NO: 5637483 - DNA, 13 bp, Homo sapiens
tagagcccctcct

SEQ ID NO: 5637484 - DNA, 16 bp, Homo sapiens
tagagccctccacatt

SEQ ID NO: 5637485 - DNA, 17 bp, Homo sapiens
tagagccctctcctccc

SEQ ID NO: 5637486 - DNA, 15 bp, Homo sapiens
tagagccctggccag

SEQ ID NO: 5637487 - DNA, 18 bp, Homo sapiens
tagagccctggccagccc

SEQ ID NO: 5637488 - DNA, 17 bp, Homo sapiens
tagagcctcttggggaa

SEQ ID NO: 5637489 - DNA, 20 bp, Homo sapiens
tagagcctcttggggaaggg

SEQ ID NO: 5637490 - DNA, 13 bp, Homo sapiens
tagagcctgcctg

SEQ ID NO: 5637491 - DNA, 17 bp, Homo sapiens
tagagcctgctggatct

SEQ ID NO: 5637492 - DNA, 17 bp, Homo sapiens
tagagcctgtaaacttt

SEQ ID NO: 5637493 - DNA, 19 bp, Homo sapiens
tagagccttgacaatgttg

SEQ ID NO: 5637494 - DNA, 19 bp, Homo sapiens
tagagcgcggctggctctg

SEQ ID NO: 5637495 - DNA, 22 bp, Homo sapiens
tagagcggagaaaggaagggct

SEQ ID NO: 5637496 - DNA, 21 bp, Homo sapiens
tagagcgggatggggatggga

SEQ ID NO: 5637497 - DNA, 16 bp, Homo sapiens
tagagctaaaaaggcc

SEQ ID NO: 5637498 - DNA, 14 bp, Homo sapiens
tagagctagctgcc

SEQ ID NO: 5637499 - DNA, 17 bp, Homo sapiens
tagagctagctgccact

SEQ ID NO: 5637500 - DNA, 13 bp, Homo sapiens
tagagctcctccc

SEQ ID NO: 5637501 - DNA, 19 bp, Homo sapiens
tagagctgatccagagcac

SEQ ID NO: 5637502 - DNA, 22 bp, Homo sapiens
tagagctgccactgggcacctg

SEQ ID NO: 5637503 - DNA, 12 bp, Homo sapiens
tagagctgggaa

SEQ ID NO: 5637504 - DNA, 16 bp, Homo sapiens
tagagctgggtggcct

SEQ ID NO: 5637505 - DNA, 17 bp, Homo sapiens
tagagctgttcaacatc

SEQ ID NO: 5637506 - DNA, 19 bp, Homo sapiens
tagagcttctgtattttca

SEQ ID NO: 5637507 - DNA, 15 bp, Homo sapiens
tagagcttggacagt

SEQ ID NO: 5637508 - DNA, 19 bp, Homo sapiens
tagagcttggacagtctga

SEQ ID NO: 5637509 - DNA, 12 bp, Homo sapiens
tagagctttctt

SEQ ID NO: 5637510 - DNA, 15 bp, Homo sapiens
tagagctttttaata

SEQ ID NO: 5637511 - DNA, 20 bp, Homo sapiens
tagaggaaaatcaatgcttt

SEQ ID NO: 5637512 - DNA, 21 bp, Homo sapiens
tagaggaaagggatggtaagt

SEQ ID NO: 5637513 - DNA, 20 bp, Homo sapiens
tagaggaaataagaaaaatc

SEQ ID NO: 5637514 - DNA, 15 bp, Homo sapiens
tagaggaacccaaga

SEQ ID NO: 5637515 - DNA, 22 bp, Homo sapiens
tagaggaatttaaagaggaaaa

SEQ ID NO: 5637516 - DNA, 16 bp, Homo sapiens
tagaggaccaggactt

SEQ ID NO: 5637517 - DNA, 22 bp, Homo sapiens
tagaggagaaactggaactctc

SEQ ID NO: 5637518 - DNA, 13 bp, Homo sapiens
tagaggagctgct

SEQ ID NO: 5637519 - DNA, 22 bp, Homo sapiens
tagaggagggcatgggagggag

SEQ ID NO: 5637520 - DNA, 22 bp, Homo sapiens
tagaggatggtcttacagcagg

SEQ ID NO: 5637521 - DNA, 14 bp, Homo sapiens
tagaggatgtggca

SEQ ID NO: 5637522 - DNA, 20 bp, Homo sapiens
tagcacaggctgagtgcagg

SEQ ID NO: 5637523 - DNA, 17 bp, Homo sapiens
tagcacagtatttaaca

SEQ ID NO: 5637524 - DNA, 21 bp, Homo sapiens
tagcacagtatttaacattct

SEQ ID NO: 5637525 - DNA, 18 bp, Homo sapiens
tagcacataaactttggg

SEQ ID NO: 5637526 - DNA, 16 bp, Homo sapiens
tagcacatatttcaca

SEQ ID NO: 5637527 - DNA, 22 bp, Homo sapiens
tagcacatcactgagaagatgg

SEQ ID NO: 5637528 - DNA, 21 bp, Homo sapiens
tagcacatcatggcagtggga

SEQ ID NO: 5637529 - DNA, 17 bp, Homo sapiens
tagcacatgattttctt

SEQ ID NO: 5637530 - DNA, 15 bp, Homo sapiens
tagcacatgcttcaa

SEQ ID NO: 5637531 - DNA, 20 bp, Homo sapiens
tagcacatggtttaaatatg

SEQ ID NO: 5637532 - DNA, 19 bp, Homo sapiens
tagcacatgttgatttcct

SEQ ID NO: 5637533 - DNA, 13 bp, Homo sapiens
tagcacatgtttt

SEQ ID NO: 5637534 - DNA, 14 bp, Homo sapiens
tagcacatgtttta

SEQ ID NO: 5637535 - DNA, 13 bp, Homo sapiens
tagcaccagcttg

SEQ ID NO: 5637536 - DNA, 13 bp, Homo sapiens
tagcaccagggaa

SEQ ID NO: 5637537 - DNA, 14 bp, Homo sapiens
tagcaccagggaag

SEQ ID NO: 5637538 - DNA, 19 bp, Homo sapiens
tagcacccatatctgtgtg

SEQ ID NO: 5637539 - DNA, 10 bp, Homo sapiens
tagcaccctg

SEQ ID NO: 5637540 - DNA, 14 bp, Homo sapiens
tagcacctccccag

SEQ ID NO: 5637541 - DNA, 18 bp, Homo sapiens
tagcacctccccagacag

SEQ ID NO: 5637542 - DNA, 19 bp, Homo sapiens
tagcacctccccagacagg

SEQ ID NO: 5637543 - DNA, 22 bp, Homo sapiens
tagcaccttcagggctgagttc

SEQ ID NO: 5637544 - DNA, 21 bp, Homo sapiens
tagcacgctgcctgccaaagt

SEQ ID NO: 5637545 - DNA, 21 bp, Homo sapiens
tagcacggagtgttggggctg

SEQ ID NO: 5637546 - DNA, 19 bp, Homo sapiens
tagcacgggttaagatctg

SEQ ID NO: 5637547 - DNA, 19 bp, Homo sapiens
tagcacgtttaaagttctg

SEQ ID NO: 5637548 - DNA, 16 bp, Homo sapiens
tagcactaccactcct

SEQ ID NO: 5637549 - DNA, 19 bp, Homo sapiens
tagcactactaaaagttta

SEQ ID NO: 5637550 - DNA, 14 bp, Homo sapiens
tagcactaggcacc

SEQ ID NO: 5637551 - DNA, 17 bp, Homo sapiens
tagcactatttaaaata

SEQ ID NO: 5637552 - DNA, 14 bp, Homo sapiens
tagcactcacatgc

SEQ ID NO: 5637553 - DNA, 15 bp, Homo sapiens
tagcactcacatgct

SEQ ID NO: 5637554 - DNA, 13 bp, Homo sapiens
tagcactgagcaa

SEQ ID NO: 5637555 - DNA, 11 bp, Homo sapiens
tagcactgagg

SEQ ID NO: 5637556 - DNA, 19 bp, Homo sapiens
tagcactgccccacatgca

SEQ ID NO: 5637557 - DNA, 20 bp, Homo sapiens
tagcactgccccacatgcat

SEQ ID NO: 5637558 - DNA, 19 bp, Homo sapiens
tagcacttaaattcctcaa

SEQ ID NO: 5637559 - DNA, 17 bp, Homo sapiens
tagcacttatgttactg

SEQ ID NO: 5637560 - DNA, 12 bp, Homo sapiens
tagcactttata

SEQ ID NO: 5637561 - DNA, 15 bp, Homo sapiens
tagcactttcattgc

SEQ ID NO: 5637562 - DNA, 20 bp, Homo sapiens
tagcactttcattgccagtg

SEQ ID NO: 5637563 - DNA, 15 bp, Homo sapiens
tagcactttgaaata

SEQ ID NO: 5637564 - DNA, 17 bp, Homo sapiens
tagcactttgaaatacc

SEQ ID NO: 5637565 - DNA, 19 bp, Homo sapiens
tagcagaaaatataaatgg

SEQ ID NO: 5637566 - DNA, 22 bp, Homo sapiens
tagcagaagaaaaagttgcagt

SEQ ID NO: 5637567 - DNA, 19 bp, Homo sapiens
tagcagaatggagaaagta

SEQ ID NO: 5637568 - DNA, 17 bp, Homo sapiens
tagcagacaacacacaa

SEQ ID NO: 5637569 - DNA, 19 bp, Homo sapiens
tagcagacagaaactggat

SEQ ID NO: 5637570 - DNA, 19 bp, Homo sapiens
tagcagacaggccccgtga

SEQ ID NO: 5637571 - DNA, 23 bp, Homo sapiens
tagcagacgtatattgtatcatt

SEQ ID NO: 5637572 - DNA, 23 bp, Homo sapiens
tagcagactttcccaaatgtatt

SEQ ID NO: 5637573 - DNA, 19 bp, Homo sapiens
tagcagagaatgaaagggc

SEQ ID NO: 5637574 - DNA, 23 bp, Homo sapiens
tagcagagaatgaaagggcccag

SEQ ID NO: 5637575 - DNA, 18 bp, Homo sapiens
tagcagagagactttcag

SEQ ID NO: 5637576 - DNA, 11 bp, Homo sapiens
tagcagagcct

SEQ ID NO: 5637577 - DNA, 16 bp, Homo sapiens
tagcagaggggccagg

SEQ ID NO: 5637578 - DNA, 19 bp, Homo sapiens
tagcagaggggccaggccc

SEQ ID NO: 5637579 - DNA, 20 bp, Homo sapiens
tagcagaggggccaggccca

SEQ ID NO: 5637580 - DNA, 22 bp, Homo sapiens
tagcagaggggtaagagaggat

SEQ ID NO: 5637581 - DNA, 11 bp, Homo sapiens
tagcagagtct

SEQ ID NO: 5637582 - DNA, 15 bp, Homo sapiens
tagcagagtctgtct

SEQ ID NO: 5637583 - DNA, 16 bp, Homo sapiens
tagcagagtctgtctc

SEQ ID NO: 5637584 - DNA, 22 bp, Homo sapiens
tagcagagtgaggatgtgtttt

SEQ ID NO: 5637585 - DNA, 16 bp, Homo sapiens
tagcagagttaaatct

SEQ ID NO: 5637586 - DNA, 12 bp, Homo sapiens
tagcagatggtt

SEQ ID NO: 5637587 - DNA, 21 bp, Homo sapiens
tagcagatggtttccacattt

SEQ ID NO: 5637588 - DNA, 21 bp, Homo sapiens
tagcagcaaaaatataaaata

SEQ ID NO: 5637589 - DNA, 12 bp, Homo sapiens
tagcagcaaata

SEQ ID NO: 5637590 - DNA, 15 bp, Homo sapiens
tagcagcaactgaag

SEQ ID NO: 5637591 - DNA, 16 bp, Homo sapiens
tagcagcaactgaaga

SEQ ID NO: 5637592 - DNA, 20 bp, Homo sapiens
tagcagcaccgttctgtgca

SEQ ID NO: 5637593 - DNA, 11 bp, Homo sapiens
tagcagcactt

SEQ ID NO: 5637594 - DNA, 14 bp, Homo sapiens
tagcagcagaggca

SEQ ID NO: 5637595 - DNA, 15 bp, Homo sapiens
tagcagcaggctcag

SEQ ID NO: 5637596 - DNA, 17 bp, Homo sapiens
tagcagcaggctcaggc

SEQ ID NO: 5637597 - DNA, 12 bp, Homo sapiens
tagcagcattac

SEQ ID NO: 5637598 - DNA, 16 bp, Homo sapiens
tagcagccagttcaaa

SEQ ID NO: 5637599 - DNA, 15 bp, Homo sapiens
tagcagcccaccctg

SEQ ID NO: 5637600 - DNA, 17 bp, Homo sapiens
tagcagcccaccctgct

SEQ ID NO: 5637601 - DNA, 22 bp, Homo sapiens
tagcagccccgggagggcggca

SEQ ID NO: 5637602 - DNA, 12 bp, Homo sapiens
tagcagcccttg

SEQ ID NO: 5637603 - DNA, 23 bp, Homo sapiens
tagcagcccttgtgtgtgccctg

SEQ ID NO: 5637604 - DNA, 15 bp, Homo sapiens
tagcagcctggctcc

SEQ ID NO: 5637605 - DNA, 21 bp, Homo sapiens
tagcagcctggctcccctggg

SEQ ID NO: 5637606 - DNA, 13 bp, Homo sapiens
tagcagcctttct

SEQ ID NO: 5637607 - DNA, 19 bp, Homo sapiens
tagcagcgctcgctgacag

SEQ ID NO: 5637608 - DNA, 14 bp, Homo sapiens
tagcagctatgtaa

SEQ ID NO: 5637609 - DNA, 11 bp, Homo sapiens
tagcagctcag

SEQ ID NO: 5637610 - DNA, 13 bp, Homo sapiens
tagcagctcaggc

SEQ ID NO: 5637611 - DNA, 14 bp, Homo sapiens
tagcagctcaggcg

SEQ ID NO: 5637612 - DNA, 19 bp, Homo sapiens
tagcagctcttcccctttc

SEQ ID NO: 5637613 - DNA, 22 bp, Homo sapiens
tagcagctcttcccctttcctg

SEQ ID NO: 5637614 - DNA, 11 bp, Homo sapiens
tagcagctgca

SEQ ID NO: 5637615 - DNA, 12 bp, Homo sapiens
tagcagctggac

SEQ ID NO: 5637616 - DNA, 12 bp, Homo sapiens
tagcagctggcc

SEQ ID NO: 5637617 - DNA, 15 bp, Homo sapiens
tagcagcttccagat

SEQ ID NO: 5637618 - DNA, 23 bp, Homo sapiens
tagcagcttctgtcctcttctgt

SEQ ID NO: 5637619 - DNA, 20 bp, Homo sapiens
tagcaggaacttctagctca

SEQ ID NO: 5637620 - DNA, 21 bp, Homo sapiens
tagcaggaacttctagctcat

SEQ ID NO: 5637621 - DNA, 16 bp, Homo sapiens
tagcaggacctgccaa

SEQ ID NO: 5637622 - DNA, 15 bp, Homo sapiens
tagcaggactaggca

SEQ ID NO: 5637623 - DNA, 16 bp, Homo sapiens
tagcaggatctgccca

SEQ ID NO: 5637624 - DNA, 15 bp, Homo sapiens
tagcaggcacaggac

SEQ ID NO: 5637625 - DNA, 18 bp, Homo sapiens
tagcaggccaaggtctga

SEQ ID NO: 5637626 - DNA, 22 bp, Homo sapiens
tagcaggccaaggtctgagcca

SEQ ID NO: 5637627 - DNA, 14 bp, Homo sapiens
tagcaggcccagct

SEQ ID NO: 5637628 - DNA, 14 bp, Homo sapiens
tagcaggcccccta

SEQ ID NO: 5637629 - DNA, 18 bp, Homo sapiens
tagcaggccccctaggat

SEQ ID NO: 5637630 - DNA, 14 bp, Homo sapiens
tagcagggaaaata

SEQ ID NO: 5637631 - DNA, 16 bp, Homo sapiens
tagcagggacaggaga

SEQ ID NO: 5637632 - DNA, 16 bp, Homo sapiens
tagcagggatgttcct

SEQ ID NO: 5637633 - DNA, 15 bp, Homo sapiens
tagcagggctgggct

SEQ ID NO: 5637634 - DNA, 15 bp, Homo sapiens
tagcaggtggtcctg

SEQ ID NO: 5637635 - DNA, 22 bp, Homo sapiens
tagcaggtggtcctgagacctg

SEQ ID NO: 5637636 - DNA, 18 bp, Homo sapiens
tagcaggtgtaataagac

SEQ ID NO: 5637637 - DNA, 15 bp, Homo sapiens
tagcaggtttcacta

SEQ ID NO: 5637638 - DNA, 15 bp, Homo sapiens
tagcagtaaatactt

SEQ ID NO: 5637639 - DNA, 20 bp, Homo sapiens
tagcagtaaatacttgcagt

SEQ ID NO: 5637640 - DNA, 13 bp, Homo sapiens
tagcagtcatcat

SEQ ID NO: 5637641 - DNA, 23 bp, Homo sapiens
tagcagtccaaagaacaagaaat

SEQ ID NO: 5637642 - DNA, 16 bp, Homo sapiens
tagcagtccccttccc

SEQ ID NO: 5637643 - DNA, 13 bp, Homo sapiens
tagcagtgatttt

SEQ ID NO: 5637644 - DNA, 12 bp, Homo sapiens
tagcagtgctag

SEQ ID NO: 5637645 - DNA, 22 bp, Homo sapiens
tagcagtggatgttagcctgca

SEQ ID NO: 5637646 - DNA, 17 bp, Homo sapiens
tagcagtggcaaaatat

SEQ ID NO: 5637647 - DNA, 14 bp, Homo sapiens
tagcagtgtaccca

SEQ ID NO: 5637648 - DNA, 19 bp, Homo sapiens
tagcagtgtacccacgctg

SEQ ID NO: 5637649 - DNA, 15 bp, Homo sapiens
tagcagttataacag

SEQ ID NO: 5637650 - DNA, 21 bp, Homo sapiens
tagcagttataacagatgtga

SEQ ID NO: 5637651 - DNA, 23 bp, Homo sapiens
tagcagttataacagatgtgaaa

SEQ ID NO: 5637652 - DNA, 14 bp, Homo sapiens
tagcagttctgcaa

SEQ ID NO: 5637653 - DNA, 16 bp, Homo sapiens
tagcagttctgcaaat

SEQ ID NO: 5637654 - DNA, 17 bp, Homo sapiens
tagcagttctgcaaata

SEQ ID NO: 5637655 - DNA, 15 bp, Homo sapiens
tagcagtttcctcag

SEQ ID NO: 5637656 - DNA, 19 bp, Homo sapiens
tagcagtttcctcagtgat

SEQ ID NO: 5637657 - DNA, 17 bp, Homo sapiens
tagcagtttgcctctgc

SEQ ID NO: 5637658 - DNA, 23 bp, Homo sapiens
tagcagtttgcctctgcacgtgc

SEQ ID NO: 5637659 - DNA, 14 bp, Homo sapiens
tagcagttttgaaa

SEQ ID NO: 5637660 - DNA, 17 bp, Homo sapiens
tagcataaaaaccacat

SEQ ID NO: 5637661 - DNA, 15 bp, Homo sapiens
tagcataaatttaat

SEQ ID NO: 5637662 - DNA, 19 bp, Homo sapiens
tagcataaatttaatgtag

SEQ ID NO: 5637663 - DNA, 15 bp, Homo sapiens
tagcataaggtctgg

SEQ ID NO: 5637664 - DNA, 14 bp, Homo sapiens
tagcataatatgaa

SEQ ID NO: 5637665 - DNA, 20 bp, Homo sapiens
tagcataatatgaagccttt

SEQ ID NO: 5637666 - DNA, 14 bp, Homo sapiens
tagcatacacattt

SEQ ID NO: 5637667 - DNA, 19 bp, Homo sapiens
tagcatacaccaaacattt

SEQ ID NO: 5637668 - DNA, 20 bp, Homo sapiens
tagcatacaccaaacatttc

SEQ ID NO: 5637669 - DNA, 21 bp, Homo sapiens
tagcatacaccaaacatttct

SEQ ID NO: 5637670 - DNA, 15 bp, Homo sapiens
tagcatacatttata

SEQ ID NO: 5637671 - DNA, 21 bp, Homo sapiens
tagcatacatttataatgttt

SEQ ID NO: 5637672 - DNA, 19 bp, Homo sapiens
tagcatacgtacacatttt

SEQ ID NO: 5637673 - DNA, 23 bp, Homo sapiens
tagcatactgatgagacaacaca

SEQ ID NO: 5637674 - DNA, 20 bp, Homo sapiens
tagcatactgtgtatgtttt

SEQ ID NO: 5637675 - DNA, 13 bp, Homo sapiens
tagcatataaatg

SEQ ID NO: 5637676 - DNA, 18 bp, Homo sapiens
tagcatataattctatat

SEQ ID NO: 5637677 - DNA, 18 bp, Homo sapiens
tagcatatcctcaattat

SEQ ID NO: 5637678 - DNA, 20 bp, Homo sapiens
tagcatatcctcaattatct

SEQ ID NO: 5637679 - DNA, 21 bp, Homo sapiens
tagcatatgacaaatgtttct

SEQ ID NO: 5637680 - DNA, 14 bp, Homo sapiens
tagcatatgagttt

SEQ ID NO: 5637681 - DNA, 17 bp, Homo sapiens
tagcatcacttaaaaca

SEQ ID NO: 5637682 - DNA, 23 bp, Homo sapiens
tagcatcacttaaaacacgtttt

SEQ ID NO: 5637683 - DNA, 16 bp, Homo sapiens
tagcatcccatctcag

SEQ ID NO: 5637684 - DNA, 18 bp, Homo sapiens
tagcatcctaagaaatat

SEQ ID NO: 5637685 - DNA, 22 bp, Homo sapiens
tagcatcctaagaaatatgtga

SEQ ID NO: 5637686 - DNA, 15 bp, Homo sapiens
tagcatcctgattat

SEQ ID NO: 5637687 - DNA, 18 bp, Homo sapiens
tagcatcctgattattga

SEQ ID NO: 5637688 - DNA, 13 bp, Homo sapiens
tagcatcctggaa

SEQ ID NO: 5637689 - DNA, 16 bp, Homo sapiens
tagcatcctggaatat

SEQ ID NO: 5637690 - DNA, 18 bp, Homo sapiens
tagcatcctggaatatct

SEQ ID NO: 5637691 - DNA, 22 bp, Homo sapiens
tagcatctcaggagatttcatg

SEQ ID NO: 5637692 - DNA, 18 bp, Homo sapiens
tagcatctgcattgccca

SEQ ID NO: 5637693 - DNA, 13 bp, Homo sapiens
tagcatcttcctc

SEQ ID NO: 5637694 - DNA, 16 bp, Homo sapiens
tagcatcttctggagt

SEQ ID NO: 5637695 - DNA, 22 bp, Homo sapiens
tagcatgaacttgtgggatggt

SEQ ID NO: 5637696 - DNA, 13 bp, Homo sapiens
tagcatgaatgtt

SEQ ID NO: 5637697 - DNA, 16 bp, Homo sapiens
tagcatgaatgttttt

SEQ ID NO: 5637698 - DNA, 21 bp, Homo sapiens
tagcatgacaagccccaggca

SEQ ID NO: 5637699 - DNA, 14 bp, Homo sapiens
tagcatgacaggct

SEQ ID NO: 5637700 - DNA, 15 bp, Homo sapiens
tagcatgacatttct

SEQ ID NO: 5637701 - DNA, 19 bp, Homo sapiens
tagctggagtgccatggct

SEQ ID NO: 5637702 - DNA, 16 bp, Homo sapiens
tagctggcaagaatgg

SEQ ID NO: 5637703 - DNA, 15 bp, Homo sapiens
tagctggcaggacac

SEQ ID NO: 5637704 - DNA, 16 bp, Homo sapiens
tagctgggaaagcata

SEQ ID NO: 5637705 - DNA, 22 bp, Homo sapiens
tagctgggactacagatgtggg

SEQ ID NO: 5637706 - DNA, 17 bp, Homo sapiens
tagctgggactacaggc

SEQ ID NO: 5637707 - DNA, 20 bp, Homo sapiens
tagctgggactacaggcacc

SEQ ID NO: 5637708 - DNA, 22 bp, Homo sapiens
tagctgggatcacagctgcagg

SEQ ID NO: 5637709 - DNA, 15 bp, Homo sapiens
tagctgggattacag

SEQ ID NO: 5637710 - DNA, 23 bp, Homo sapiens
tagctgggatttgaactgagccg

SEQ ID NO: 5637711 - DNA, 12 bp, Homo sapiens
tagctgggcctg

SEQ ID NO: 5637712 - DNA, 19 bp, Homo sapiens
tagctggggcttcaccagt

SEQ ID NO: 5637713 - DNA, 19 bp, Homo sapiens
tagctgggggcgcagagga

SEQ ID NO: 5637714 - DNA, 18 bp, Homo sapiens
tagctggtgtcagcccct

SEQ ID NO: 5637715 - DNA, 22 bp, Homo sapiens
tagctggttaaccttgaagtga

SEQ ID NO: 5637716 - DNA, 18 bp, Homo sapiens
tagctggttcctgctaga

SEQ ID NO: 5637717 - DNA, 17 bp, Homo sapiens
tagctgtaaggcatgaa

SEQ ID NO: 5637718 - DNA, 19 bp, Homo sapiens
tagctgtaaggcatgaagg

SEQ ID NO: 5637719 - DNA, 19 bp, Homo sapiens
tagctgtaagggcagtgcc

SEQ ID NO: 5637720 - DNA, 16 bp, Homo sapiens
tagctgtactataagt

SEQ ID NO: 5637721 - DNA, 21 bp, Homo sapiens
tagctgtagttttccctgcac

SEQ ID NO: 5637722 - DNA, 22 bp, Homo sapiens
tagctgtattcatatattgcat

SEQ ID NO: 5637723 - DNA, 16 bp, Homo sapiens
tagctgtattgaatca

SEQ ID NO: 5637724 - DNA, 21 bp, Homo sapiens
tagctgtcacatacaactttt

SEQ ID NO: 5637725 - DNA, 15 bp, Homo sapiens
tagctgtctctcttg

SEQ ID NO: 5637726 - DNA, 14 bp, Homo sapiens
tagctgtctgtgaa

SEQ ID NO: 5637727 - DNA, 16 bp, Homo sapiens
tagctgtctgtgaata

SEQ ID NO: 5637728 - DNA, 20 bp, Homo sapiens
tagctgtgaatggctgtgcc

SEQ ID NO: 5637729 - DNA, 16 bp, Homo sapiens
tagctgtgacctctcc

SEQ ID NO: 5637730 - DNA, 24 bp, Homo sapiens
tagctgtgacctgctgagctctga

SEQ ID NO: 5637731 - DNA, 20 bp, Homo sapiens
tagctgtggcctcaccctga

SEQ ID NO: 5637732 - DNA, 14 bp, Homo sapiens
tagctgtgtgaaat

SEQ ID NO: 5637733 - DNA, 11 bp, Homo sapiens
tagctgtgtta

SEQ ID NO: 5637734 - DNA, 19 bp, Homo sapiens
tagctgttctaattaagaa

SEQ ID NO: 5637735 - DNA, 20 bp, Homo sapiens
tagctgttctaattaagaaa

SEQ ID NO: 5637736 - DNA, 13 bp, Homo sapiens
tagctgttgagct

SEQ ID NO: 5637737 - DNA, 16 bp, Homo sapiens
tagctgttgagctgtt

SEQ ID NO: 5637738 - DNA, 17 bp, Homo sapiens
tagctgttggaatgttg

SEQ ID NO: 5637739 - DNA, 20 bp, Homo sapiens
tagctgttggaatgttgtta

SEQ ID NO: 5637740 - DNA, 22 bp, Homo sapiens
tagctgttggaatgttgttaaa

SEQ ID NO: 5637741 - DNA, 22 bp, Homo sapiens
tagctgtttactgacatggtgc

SEQ ID NO: 5637742 - DNA, 14 bp, Homo sapiens
tagctgtttcaaat

SEQ ID NO: 5637743 - DNA, 18 bp, Homo sapiens
tagctgtttcaaatgtgc

SEQ ID NO: 5637744 - DNA, 20 bp, Homo sapiens
tagctgttttagctgaggga

SEQ ID NO: 5637745 - DNA, 21 bp, Homo sapiens
tagctgttttgaataacatag

SEQ ID NO: 5637746 - DNA, 19 bp, Homo sapiens
tagctgttttgtgtatatt

SEQ ID NO: 5637747 - DNA, 18 bp, Homo sapiens
tagcttaaaaaaaggaaa

SEQ ID NO: 5637748 - DNA, 15 bp, Homo sapiens
tagcttaactaattt

SEQ ID NO: 5637749 - DNA, 19 bp, Homo sapiens
tagcttaactaatttgaat

SEQ ID NO: 5637750 - DNA, 20 bp, Homo sapiens
tagcttaagggaatatgcat

SEQ ID NO: 5637751 - DNA, 20 bp, Homo sapiens
tagcttaatcttaatgtctg

SEQ ID NO: 5637752 - DNA, 21 bp, Homo sapiens
tagcttacaagccagctggag

SEQ ID NO: 5637753 - DNA, 20 bp, Homo sapiens
tagcttacactgaggactgt

SEQ ID NO: 5637754 - DNA, 15 bp, Homo sapiens
tagcttacctgaaca

SEQ ID NO: 5637755 - DNA, 19 bp, Homo sapiens
tagcttacctgggcacaaa

SEQ ID NO: 5637756 - DNA, 17 bp, Homo sapiens
tagcttagagcctccct

SEQ ID NO: 5637757 - DNA, 19 bp, Homo sapiens
tagcttagagcctccctca

SEQ ID NO: 5637758 - DNA, 17 bp, Homo sapiens
tagcttatacaattcag

SEQ ID NO: 5637759 - DNA, 15 bp, Homo sapiens
tagcttatctacttc

SEQ ID NO: 5637760 - DNA, 14 bp, Homo sapiens
tagcttatctccct

SEQ ID NO: 5637761 - DNA, 22 bp, Homo sapiens
tagcttatctccctgcttcata

SEQ ID NO: 5637762 - DNA, 21 bp, Homo sapiens
tagcttatctgcccctccccc

SEQ ID NO: 5637763 - DNA, 15 bp, Homo sapiens
tagcttatctttctt

SEQ ID NO: 5637764 - DNA, 16 bp, Homo sapiens
tagcttatgaaaagaa

SEQ ID NO: 5637765 - DNA, 14 bp, Homo sapiens
tagcttattataga

SEQ ID NO: 5637766 - DNA, 19 bp, Homo sapiens
tagcttatttttacagtta

SEQ ID NO: 5637767 - DNA, 21 bp, Homo sapiens
tagcttcaccccaatcccagc

SEQ ID NO: 5637768 - DNA, 16 bp, Homo sapiens
tagcttcagtcattaa

SEQ ID NO: 5637769 - DNA, 21 bp, Homo sapiens
tagcttcagtcattaaattac

SEQ ID NO: 5637770 - DNA, 14 bp, Homo sapiens
tagcttcagttgtt

SEQ ID NO: 5637771 - DNA, 15 bp, Homo sapiens
tagcttcatgcctca

SEQ ID NO: 5637772 - DNA, 16 bp, Homo sapiens
tagcttcatgcctcag

SEQ ID NO: 5637773 - DNA, 18 bp, Homo sapiens
tagcttcatgcctcagtt

SEQ ID NO: 5637774 - DNA, 14 bp, Homo sapiens
tagcttccacctca

SEQ ID NO: 5637775 - DNA, 15 bp, Homo sapiens
tagcttccacctcat

SEQ ID NO: 5637776 - DNA, 22 bp, Homo sapiens
tagcttccctcccctctagttt

SEQ ID NO: 5637777 - DNA, 19 bp, Homo sapiens
tagcttcctccagaggagg

SEQ ID NO: 5637778 - DNA, 19 bp, Homo sapiens
tagcttctcttctttctga

SEQ ID NO: 5637779 - DNA, 17 bp, Homo sapiens
tagcttctgacctcagc

SEQ ID NO: 5637780 - DNA, 15 bp, Homo sapiens
tagcttctgcttttc

SEQ ID NO: 5637781 - DNA, 22 bp, Homo sapiens
tagcttctgcttttctgccctg

SEQ ID NO: 5637782 - DNA, 15 bp, Homo sapiens
tagcttctgtgtgtg

SEQ ID NO: 5637783 - DNA, 15 bp, Homo sapiens
tagcttgaaaacttg

SEQ ID NO: 5637784 - DNA, 19 bp, Homo sapiens
tagcttgaaggatctgttt

SEQ ID NO: 5637785 - DNA, 20 bp, Homo sapiens
tagcttgattgctcagagaa

SEQ ID NO: 5637786 - DNA, 15 bp, Homo sapiens
tagcttggggccagg

SEQ ID NO: 5637787 - DNA, 17 bp, Homo sapiens
tagcttggggccaggga

SEQ ID NO: 5637788 - DNA, 16 bp, Homo sapiens
tagcttgtctattatt

SEQ ID NO: 5637789 - DNA, 20 bp, Homo sapiens
tagcttgttagtaatgctct

SEQ ID NO: 5637790 - DNA, 15 bp, Homo sapiens
tagcttgttccctgt

SEQ ID NO: 5637791 - DNA, 17 bp, Homo sapiens
tagcttgtttctgtcaa

SEQ ID NO: 5637792 - DNA, 19 bp, Homo sapiens
tagctttaaaaccacagct

SEQ ID NO: 5637793 - DNA, 14 bp, Homo sapiens
tagctttaaaaggg

SEQ ID NO: 5637794 - DNA, 16 bp, Homo sapiens
tagctttagaccctgg

SEQ ID NO: 5637795 - DNA, 19 bp, Homo sapiens
tagctttatatatggacat

SEQ ID NO: 5637796 - DNA, 19 bp, Homo sapiens
tagctttattttttaagta

SEQ ID NO: 5637797 - DNA, 15 bp, Homo sapiens
tagctttccacagga

SEQ ID NO: 5637798 - DNA, 13 bp, Homo sapiens
tagctttccacat

SEQ ID NO: 5637799 - DNA, 15 bp, Homo sapiens
tagctttccctgtgc

SEQ ID NO: 5637800 - DNA, 13 bp, Homo sapiens
tagctttcctgga

SEQ ID NO: 5637801 - DNA, 14 bp, Homo sapiens
tagctttcctggaa

SEQ ID NO: 5637802 - DNA, 23 bp, Homo sapiens
tagctttctcctcatccatttct

SEQ ID NO: 5637803 - DNA, 12 bp, Homo sapiens
tagctttctgga

SEQ ID NO: 5637804 - DNA, 15 bp, Homo sapiens
tagctttctggatgg

SEQ ID NO: 5637805 - DNA, 13 bp, Homo sapiens
tagctttgaaact

SEQ ID NO: 5637806 - DNA, 21 bp, Homo sapiens
tagctttgcaaccttgtactt

SEQ ID NO: 5637807 - DNA, 22 bp, Homo sapiens
tagctttggaagtttagctctg

SEQ ID NO: 5637808 - DNA, 15 bp, Homo sapiens
tagctttgtgtttgg

SEQ ID NO: 5637809 - DNA, 23 bp, Homo sapiens
tagctttgtgtttggtttacatt

SEQ ID NO: 5637810 - DNA, 15 bp, Homo sapiens
tagcttttagcctgg

SEQ ID NO: 5637811 - DNA, 14 bp, Homo sapiens
tagcttttaggaaa

SEQ ID NO: 5637812 - DNA, 14 bp, Homo sapiens
tagcttttatgtga

SEQ ID NO: 5637813 - DNA, 14 bp, Homo sapiens
tagcttttattgta

SEQ ID NO: 5637814 - DNA, 18 bp, Homo sapiens
tagcttttattgtataaa

SEQ ID NO: 5637815 - DNA, 13 bp, Homo sapiens
tagcttttcacct

SEQ ID NO: 5637816 - DNA, 13 bp, Homo sapiens
tagcttttcactt

SEQ ID NO: 5637817 - DNA, 17 bp, Homo sapiens
tagcttttccctgtcct

SEQ ID NO: 5637818 - DNA, 14 bp, Homo sapiens
tagcttttccttcc

SEQ ID NO: 5637819 - DNA, 14 bp, Homo sapiens
tagcttttgattag

SEQ ID NO: 5637820 - DNA, 23 bp, Homo sapiens
tagcttttgcaacatggtccagt

SEQ ID NO: 5637821 - DNA, 14 bp, Homo sapiens
tagcttttggggag

SEQ ID NO: 5637822 - DNA, 12 bp, Homo sapiens
tagcttttgtgg

SEQ ID NO: 5637823 - DNA, 20 bp, Homo sapiens
tagcttttgtgggggactgt

SEQ ID NO: 5637824 - DNA, 19 bp, Homo sapiens
tagcttttgtgtcttacat

SEQ ID NO: 5637825 - DNA, 15 bp, Homo sapiens
tagctttttaaaaca

SEQ ID NO: 5637826 - DNA, 17 bp, Homo sapiens
tagctttttaaaacatt

SEQ ID NO: 5637827 - DNA, 18 bp, Homo sapiens
tagctttttaaaacatta

SEQ ID NO: 5637828 - DNA, 13 bp, Homo sapiens
tagcttttttctc

SEQ ID NO: 5637829 - DNA, 23 bp, Homo sapiens
tagcttttttctctgatacagaa

SEQ ID NO: 5637830 - DNA, 15 bp, Homo sapiens
taggaaaaaaactgg

SEQ ID NO: 5637831 - DNA, 23 bp, Homo sapiens
taggaaaaaaactgggataactg

SEQ ID NO: 5637832 - DNA, 22 bp, Homo sapiens
taggaaaaaattgaaagaactt

SEQ ID NO: 5637833 - DNA, 14 bp, Homo sapiens
taggaaaaactgat

SEQ ID NO: 5637834 - DNA, 18 bp, Homo sapiens
taggaaaaagctttactc

SEQ ID NO: 5637835 - DNA, 11 bp, Homo sapiens
taggaaaacca

SEQ ID NO: 5637836 - DNA, 22 bp, Homo sapiens
taggaaaagaaatctatagaaa

SEQ ID NO: 5637837 - DNA, 18 bp, Homo sapiens
taggaaaagcatctgcca

SEQ ID NO: 5637838 - DNA, 17 bp, Homo sapiens
taggaaaagtacattta

SEQ ID NO: 5637839 - DNA, 21 bp, Homo sapiens
taggaaaatcatgtgctcaga

SEQ ID NO: 5637840 - DNA, 13 bp, Homo sapiens
taggaaaatgaga

SEQ ID NO: 5637841 - DNA, 15 bp, Homo sapiens
taggaaaatgtacat

SEQ ID NO: 5637842 - DNA, 16 bp, Homo sapiens
taggaaaatgtacata

SEQ ID NO: 5637843 - DNA, 23 bp, Homo sapiens
taggaaaattggacattaagcat

SEQ ID NO: 5637844 - DNA, 10 bp, Homo sapiens
taggaaacac

SEQ ID NO: 5637845 - DNA, 19 bp, Homo sapiens
taggaaacagaaaagagaa

SEQ ID NO: 5637846 - DNA, 22 bp, Homo sapiens
taggaaacagaaaagagaagaa

SEQ ID NO: 5637847 - DNA, 18 bp, Homo sapiens
taggaaaccaccctgagg

SEQ ID NO: 5637848 - DNA, 24 bp, Homo sapiens
taggaaacccaaggaacaagagaa

SEQ ID NO: 5637849 - DNA, 14 bp, Homo sapiens
taggaaactctcca

SEQ ID NO: 5637850 - DNA, 21 bp, Homo sapiens
taggaaagatttaatgttaca

SEQ ID NO: 5637851 - DNA, 21 bp, Homo sapiens
taggaaagcctcactgatata

SEQ ID NO: 5637852 - DNA, 11 bp, Homo sapiens
taggaaaggat

SEQ ID NO: 5637853 - DNA, 19 bp, Homo sapiens
taggaaagggaagcctgac

SEQ ID NO: 5637854 - DNA, 16 bp, Homo sapiens
taggaaataaaacctt

SEQ ID NO: 5637855 - DNA, 17 bp, Homo sapiens
taggaaataaaaccttt

SEQ ID NO: 5637856 - DNA, 18 bp, Homo sapiens
taggaaataaaattaatg

SEQ ID NO: 5637857 - DNA, 15 bp, Homo sapiens
taggaaataaatcta

SEQ ID NO: 5637858 - DNA, 16 bp, Homo sapiens
taggaaatccagggtg

SEQ ID NO: 5637859 - DNA, 23 bp, Homo sapiens
taggaaatcttgtccagagacaa

SEQ ID NO: 5637860 - DNA, 14 bp, Homo sapiens
taggaaatgaatgt

SEQ ID NO: 5637861 - DNA, 16 bp, Homo sapiens
taggaaatgaatgtgt

SEQ ID NO: 5637862 - DNA, 19 bp, Homo sapiens
taggaaatgaatgtgtgtg

SEQ ID NO: 5637863 - DNA, 19 bp, Homo sapiens
taggaaatggtttccatct

SEQ ID NO: 5637864 - DNA, 17 bp, Homo sapiens
taggaaattgaacctgg

SEQ ID NO: 5637865 - DNA, 19 bp, Homo sapiens
taggaaattgattttgaaa

SEQ ID NO: 5637866 - DNA, 14 bp, Homo sapiens
taggaaatttaaga

SEQ ID NO: 5637867 - DNA, 20 bp, Homo sapiens
taggaaatttatacaaagaa

SEQ ID NO: 5637868 - DNA, 22 bp, Homo sapiens
taggaacaagctggcttctgtg

SEQ ID NO: 5637869 - DNA, 18 bp, Homo sapiens
taggaacaatctttgctg

SEQ ID NO: 5637870 - DNA, 14 bp, Homo sapiens
taggaacactcctt

SEQ ID NO: 5637871 - DNA, 17 bp, Homo sapiens
taggaacactccttcac

SEQ ID NO: 5637872 - DNA, 22 bp, Homo sapiens
taggaacagagtatatatgtac

SEQ ID NO: 5637873 - DNA, 16 bp, Homo sapiens
taggaacagcagtgtt

SEQ ID NO: 5637874 - DNA, 23 bp, Homo sapiens
taggaacagcagtgttctcacag

SEQ ID NO: 5637875 - DNA, 22 bp, Homo sapiens
taggaaccaacaaggaaacttt

SEQ ID NO: 5637876 - DNA, 23 bp, Homo sapiens
taggaaccaacaaggaaactttc

SEQ ID NO: 5637877 - DNA, 17 bp, Homo sapiens
taggaacccagctctca

SEQ ID NO: 5637878 - DNA, 17 bp, Homo sapiens
taggggtcaggctccat

SEQ ID NO: 5637879 - DNA, 17 bp, Homo sapiens
taggggtcctgggggca

SEQ ID NO: 5637880 - DNA, 17 bp, Homo sapiens
taggggtgaaggagggg

SEQ ID NO: 5637881 - DNA, 19 bp, Homo sapiens
taggggttaaagcagacag

SEQ ID NO: 5637882 - DNA, 13 bp, Homo sapiens
tagggtaaaaatt

SEQ ID NO: 5637883 - DNA, 14 bp, Homo sapiens
tagggtaaaaattg

SEQ ID NO: 5637884 - DNA, 12 bp, Homo sapiens
tagggtaaatca

SEQ ID NO: 5637885 - DNA, 13 bp, Homo sapiens
tagggtaaatcag

SEQ ID NO: 5637886 - DNA, 16 bp, Homo sapiens
tagggtaaatcagtaa

SEQ ID NO: 5637887 - DNA, 18 bp, Homo sapiens
tagggtaaggtgccttct

SEQ ID NO: 5637888 - DNA, 15 bp, Homo sapiens
tagggtacatggtgc

SEQ ID NO: 5637889 - DNA, 22 bp, Homo sapiens
tagggtacatttataattgcat

SEQ ID NO: 5637890 - DNA, 16 bp, Homo sapiens
tagggtactaaattta

SEQ ID NO: 5637891 - DNA, 13 bp, Homo sapiens
tagggtagaatga

SEQ ID NO: 5637892 - DNA, 14 bp, Homo sapiens
tagggtaggggaag

SEQ ID NO: 5637893 - DNA, 13 bp, Homo sapiens
tagggtataatgt

SEQ ID NO: 5637894 - DNA, 20 bp, Homo sapiens
tagggtcactttgccattat

SEQ ID NO: 5637895 - DNA, 20 bp, Homo sapiens
tagggtccatatgagggaaa

SEQ ID NO: 5637896 - DNA, 21 bp, Homo sapiens
tagggtcccccttcgtggagc

SEQ ID NO: 5637897 - DNA, 16 bp, Homo sapiens
tagggtccttgaaaca

SEQ ID NO: 5637898 - DNA, 15 bp, Homo sapiens
tagggtcggaaccca

SEQ ID NO: 5637899 - DNA, 13 bp, Homo sapiens
tagggtctaccaa

SEQ ID NO: 5637900 - DNA, 20 bp, Homo sapiens
tagggtctgcagcctgctgg

SEQ ID NO: 5637901 - DNA, 14 bp, Homo sapiens
tagggtgaggcgtg

SEQ ID NO: 5637902 - DNA, 23 bp, Homo sapiens
tagggtgctctgaggtcaataaa

SEQ ID NO: 5637903 - DNA, 15 bp, Homo sapiens
tagggtggcagaagt

SEQ ID NO: 5637904 - DNA, 15 bp, Homo sapiens
tagggtgggccttca

SEQ ID NO: 5637905 - DNA, 18 bp, Homo sapiens
tagggtgggcgtgctgcg

SEQ ID NO: 5637906 - DNA, 12 bp, Homo sapiens
tagggtttaatc

SEQ ID NO: 5637907 - DNA, 19 bp, Homo sapiens
tagggtttccctactgaag

SEQ ID NO: 5637908 - DNA, 12 bp, Homo sapiens
tagggtttgaca

SEQ ID NO: 5637909 - DNA, 17 bp, Homo sapiens
tagggttttcagatgaa

SEQ ID NO: 5637910 - DNA, 23 bp, Homo sapiens
tagggttttcagatgaaaagaaa

SEQ ID NO: 5637911 - DNA, 18 bp, Homo sapiens
tagggttttctatttctt

SEQ ID NO: 5637912 - DNA, 16 bp, Homo sapiens
taggtaaataaagctc

SEQ ID NO: 5637913 - DNA, 11 bp, Homo sapiens
taggtaaatct

SEQ ID NO: 5637914 - DNA, 16 bp, Homo sapiens
taggtaaatctagagt

SEQ ID NO: 5637915 - DNA, 18 bp, Homo sapiens
taggtaacttattagaaa

SEQ ID NO: 5637916 - DNA, 13 bp, Homo sapiens
taggtaacttcat

SEQ ID NO: 5637917 - DNA, 16 bp, Homo sapiens
taggtaagctgtgcct

SEQ ID NO: 5637918 - DNA, 23 bp, Homo sapiens
taggtaagctgtgccttcagctg

SEQ ID NO: 5637919 - DNA, 14 bp, Homo sapiens
taggtacacagctc

SEQ ID NO: 5637920 - DNA, 20 bp, Homo sapiens
taggtagaagtgagcaaaaa

SEQ ID NO: 5637921 - DNA, 17 bp, Homo sapiens
taggtagaggcatttgt

SEQ ID NO: 5637922 - DNA, 16 bp, Homo sapiens
taggtagcaacaacag

SEQ ID NO: 5637923 - DNA, 13 bp, Homo sapiens
taggtagcacagc

SEQ ID NO: 5637924 - DNA, 19 bp, Homo sapiens
taggtagcctgctgtgggg

SEQ ID NO: 5637925 - DNA, 12 bp, Homo sapiens
taggtaggagac

SEQ ID NO: 5637926 - DNA, 13 bp, Homo sapiens
taggtaggagacc

SEQ ID NO: 5637927 - DNA, 18 bp, Homo sapiens
taggtaggcttctacctg

SEQ ID NO: 5637928 - DNA, 16 bp, Homo sapiens
taggtataaaaaataa

SEQ ID NO: 5637929 - DNA, 21 bp, Homo sapiens
taggtataaaaaataagtaaa

SEQ ID NO: 5637930 - DNA, 22 bp, Homo sapiens
taggtataaaaaataagtaaag

SEQ ID NO: 5637931 - DNA, 20 bp, Homo sapiens
taggtataagtggtgtgtgt

SEQ ID NO: 5637932 - DNA, 19 bp, Homo sapiens
taggtatctttatagttgt

SEQ ID NO: 5637933 - DNA, 17 bp, Homo sapiens
taggtatgatctcttct

SEQ ID NO: 5637934 - DNA, 22 bp, Homo sapiens
taggtatgatctcttctggtgt

SEQ ID NO: 5637935 - DNA, 16 bp, Homo sapiens
taggtatgctattatc

SEQ ID NO: 5637936 - DNA, 19 bp, Homo sapiens
taggtatgtctgtgccatt

SEQ ID NO: 5637937 - DNA, 21 bp, Homo sapiens
taggtatgtttgtaacttttt

SEQ ID NO: 5637938 - DNA, 18 bp, Homo sapiens
taggtattacaagtaatg

SEQ ID NO: 5637939 - DNA, 14 bp, Homo sapiens
taggtatttaagac

SEQ ID NO: 5637940 - DNA, 16 bp, Homo sapiens
taggtcaaactcccta

SEQ ID NO: 5637941 - DNA, 16 bp, Homo sapiens
taggtcaagaagaaga

SEQ ID NO: 5637942 - DNA, 19 bp, Homo sapiens
taggtcaagtaataaaaag

SEQ ID NO: 5637943 - DNA, 23 bp, Homo sapiens
taggtcaataacactgtatttta

SEQ ID NO: 5637944 - DNA, 15 bp, Homo sapiens
taggtcactcctggg

SEQ ID NO: 5637945 - DNA, 15 bp, Homo sapiens
taggtcactctccag

SEQ ID NO: 5637946 - DNA, 20 bp, Homo sapiens
taggtcactggctctccaag

SEQ ID NO: 5637947 - DNA, 18 bp, Homo sapiens
taggtcagtacccacctg

SEQ ID NO: 5637948 - DNA, 23 bp, Homo sapiens
taggtcagtacccacctgagctt

SEQ ID NO: 5637949 - DNA, 16 bp, Homo sapiens
taggtcagtgcaaata

SEQ ID NO: 5637950 - DNA, 17 bp, Homo sapiens
taggtcataaagcattg

SEQ ID NO: 5637951 - DNA, 15 bp, Homo sapiens
taggtcatatgttgt

SEQ ID NO: 5637952 - DNA, 17 bp, Homo sapiens
taggtcatgatttctgt

SEQ ID NO: 5637953 - DNA, 23 bp, Homo sapiens
taggtcatgatttctgtgaagca

SEQ ID NO: 5637954 - DNA, 15 bp, Homo sapiens
taggtcatgtctgta

SEQ ID NO: 5637955 - DNA, 15 bp, Homo sapiens
taggtcatttgtaga

SEQ ID NO: 5637956 - DNA, 21 bp, Homo sapiens
taggtccgtccggtgtgtcag

SEQ ID NO: 5637957 - DNA, 15 bp, Homo sapiens
taggtcctcagaaag

SEQ ID NO: 5637958 - DNA, 19 bp, Homo sapiens
taggtcgttttaaaaacaa

SEQ ID NO: 5637959 - DNA, 20 bp, Homo sapiens
taggtctagcctatgtggat

SEQ ID NO: 5637960 - DNA, 16 bp, Homo sapiens
taggtctcatgcccac

SEQ ID NO: 5637961 - DNA, 13 bp, Homo sapiens
taggtctccaccc

SEQ ID NO: 5637962 - DNA, 14 bp, Homo sapiens
taggtctccacccc

SEQ ID NO: 5637963 - DNA, 16 bp, Homo sapiens
taggtctcctcagggt

SEQ ID NO: 5637964 - DNA, 14 bp, Homo sapiens
taggtctcttcccc

SEQ ID NO: 5637965 - DNA, 17 bp, Homo sapiens
taggtctcttctcccag

SEQ ID NO: 5637966 - DNA, 22 bp, Homo sapiens
taggtctgaaatttttcttctt

SEQ ID NO: 5637967 - DNA, 16 bp, Homo sapiens
taggtctgaaggcctc

SEQ ID NO: 5637968 - DNA, 17 bp, Homo sapiens
taggtctgaaggcctcc

SEQ ID NO: 5637969 - DNA, 22 bp, Homo sapiens
taggtctgaccaaaaccagagg

SEQ ID NO: 5637970 - DNA, 21 bp, Homo sapiens
taggtctgttgaagtgcatgt

SEQ ID NO: 5637971 - DNA, 22 bp, Homo sapiens
taggtctgttgaagtgcatgtt

SEQ ID NO: 5637972 - DNA, 21 bp, Homo sapiens
taggtcttaatacacacagtt

SEQ ID NO: 5637973 - DNA, 14 bp, Homo sapiens
taggtcttcctgtg

SEQ ID NO: 5637974 - DNA, 17 bp, Homo sapiens
taggtcttcctgtggct

SEQ ID NO: 5637975 - DNA, 18 bp, Homo sapiens
taggtcttcctgtggctc

SEQ ID NO: 5637976 - DNA, 23 bp, Homo sapiens
taggtcttcctgtggctccctct

SEQ ID NO: 5637977 - DNA, 17 bp, Homo sapiens
taggtcttgctggaaga

SEQ ID NO: 5637978 - DNA, 20 bp, Homo sapiens
taggtcttgctggaagacag

SEQ ID NO: 5637979 - DNA, 14 bp, Homo sapiens
taggtctttctctc

SEQ ID NO: 5637980 - DNA, 22 bp, Homo sapiens
taggtgaacagtcacgcctgaa

SEQ ID NO: 5637981 - DNA, 18 bp, Homo sapiens
taggtgaagggatggggg

SEQ ID NO: 5637982 - DNA, 22 bp, Homo sapiens
taggtgaccccatctctgctgc

SEQ ID NO: 5637983 - DNA, 16 bp, Homo sapiens
taggtgataaaatttt

SEQ ID NO: 5637984 - DNA, 19 bp, Homo sapiens
taggtgatccatgtaactg

SEQ ID NO: 5637985 - DNA, 21 bp, Homo sapiens
taggtgatccatgtaactgcc

SEQ ID NO: 5637986 - DNA, 22 bp, Homo sapiens
taggtgatggccagtcatgtgc

SEQ ID NO: 5637987 - DNA, 17 bp, Homo sapiens
taggtgcagctcctcag

SEQ ID NO: 5637988 - DNA, 20 bp, Homo sapiens
taggtgccaggcatgtccta

SEQ ID NO: 5637989 - DNA, 17 bp, Homo sapiens
taggtgcccagggccag

SEQ ID NO: 5637990 - DNA, 14 bp, Homo sapiens
taggtgcctcctgt

SEQ ID NO: 5637991 - DNA, 18 bp, Homo sapiens
taggtgcctcctgtctta

SEQ ID NO: 5637992 - DNA, 16 bp, Homo sapiens
taggtgctaattaata

SEQ ID NO: 5637993 - DNA, 23 bp, Homo sapiens
taggtgctacaaaaacacagcaa

SEQ ID NO: 5637994 - DNA, 11 bp, Homo sapiens
taggtgctggc

SEQ ID NO: 5637995 - DNA, 14 bp, Homo sapiens
taggtgctggcatg

SEQ ID NO: 5637996 - DNA, 22 bp, Homo sapiens
taggtgctggcatgtctgggtc

SEQ ID NO: 5637997 - DNA, 12 bp, Homo sapiens
taggtgctggcc

SEQ ID NO: 5637998 - DNA, 21 bp, Homo sapiens
taggtgctttagagataattg

SEQ ID NO: 5637999 - DNA, 18 bp, Homo sapiens
taggtggaaagagaaatg

SEQ ID NO: 5638000 - DNA, 19 bp, Homo sapiens
taggtggaaagagaaatga

SEQ ID NO: 5638001 - DNA, 18 bp, Homo sapiens
taggtggaggttgtgcat

SEQ ID NO: 5638002 - DNA, 20 bp, Homo sapiens
taggtggccgctcctccctg

SEQ ID NO: 5638003 - DNA, 12 bp, Homo sapiens
taggtgggagcc

SEQ ID NO: 5638004 - DNA, 22 bp, Homo sapiens
taggtgggattacaggtgccca

SEQ ID NO: 5638005 - DNA, 20 bp, Homo sapiens
taggtgggccagcccctccc

SEQ ID NO: 5638006 - DNA, 21 bp, Homo sapiens
taggtgggccagcccctccca

SEQ ID NO: 5638007 - DNA, 22 bp, Homo sapiens
taggtgggtaggagcccttctc

SEQ ID NO: 5638008 - DNA, 22 bp, Homo sapiens
taggtggtaaaacctgttctcc

SEQ ID NO: 5638009 - DNA, 20 bp, Homo sapiens
taggtggtgttgagaaagaa

SEQ ID NO: 5638010 - DNA, 19 bp, Homo sapiens
taggtgtaaatgagaagac

SEQ ID NO: 5638011 - DNA, 19 bp, Homo sapiens
taggtgtcccccaccccca

SEQ ID NO: 5638012 - DNA, 18 bp, Homo sapiens
taggtgtctctgggcctg

SEQ ID NO: 5638013 - DNA, 19 bp, Homo sapiens
taggtgtctctgggcctgt

SEQ ID NO: 5638014 - DNA, 21 bp, Homo sapiens
taggtgtctctgggcctgtgt

SEQ ID NO: 5638015 - DNA, 23 bp, Homo sapiens
taggtgtgactgaatttcttttg

SEQ ID NO: 5638016 - DNA, 22 bp, Homo sapiens
taggtgtgatttcctaatatga

SEQ ID NO: 5638017 - DNA, 22 bp, Homo sapiens
taggtgttaggcatgtcccacc

SEQ ID NO: 5638018 - DNA, 14 bp, Homo sapiens
taggtgttatgtat

SEQ ID NO: 5638019 - DNA, 17 bp, Homo sapiens
taggtgttcaggccagt

SEQ ID NO: 5638020 - DNA, 14 bp, Homo sapiens
taggtgtttgggat

SEQ ID NO: 5638021 - DNA, 13 bp, Homo sapiens
taggttaaagcta

SEQ ID NO: 5638022 - DNA, 19 bp, Homo sapiens
taggttaactatgtacaat

SEQ ID NO: 5638023 - DNA, 13 bp, Homo sapiens
taggttaataaag

SEQ ID NO: 5638024 - DNA, 16 bp, Homo sapiens
taggttaataggagga

SEQ ID NO: 5638025 - DNA, 22 bp, Homo sapiens
taggttaattccaattatatga

SEQ ID NO: 5638026 - DNA, 12 bp, Homo sapiens
taggttatacaa

SEQ ID NO: 5638027 - DNA, 22 bp, Homo sapiens
taggttatcaaaactgttgtca

SEQ ID NO: 5638028 - DNA, 18 bp, Homo sapiens
taggttatctttttaaaa

SEQ ID NO: 5638029 - DNA, 19 bp, Homo sapiens
taggttatctttttaaaaa

SEQ ID NO: 5638030 - DNA, 22 bp, Homo sapiens
taggttattatgattagctttg

SEQ ID NO: 5638031 - DNA, 15 bp, Homo sapiens
taggttatttaaaat

SEQ ID NO: 5638032 - DNA, 14 bp, Homo sapiens
taggttcaattccc

SEQ ID NO: 5638033 - DNA, 15 bp, Homo sapiens
taggttcagccaagg

SEQ ID NO: 5638034 - DNA, 17 bp, Homo sapiens
taggttccccaatccat

SEQ ID NO: 5638035 - DNA, 17 bp, Homo sapiens
taggttccctgttcttc

SEQ ID NO: 5638036 - DNA, 21 bp, Homo sapiens
taggttccctgttcttcctcc

SEQ ID NO: 5638037 - DNA, 21 bp, Homo sapiens
taggttctaaagttctaagat

SEQ ID NO: 5638038 - DNA, 14 bp, Homo sapiens
taggttctgaacag

SEQ ID NO: 5638039 - DNA, 21 bp, Homo sapiens
taggttctgctttctgataca

SEQ ID NO: 5638040 - DNA, 21 bp, Homo sapiens
taggttctgtagagccaatta

SEQ ID NO: 5638041 - DNA, 14 bp, Homo sapiens
taggttctgtctgt

SEQ ID NO: 5638042 - DNA, 16 bp, Homo sapiens
taggttgcacactttg

SEQ ID NO: 5638043 - DNA, 17 bp, Homo sapiens
taggttggacagccccc

SEQ ID NO: 5638044 - DNA, 13 bp, Homo sapiens
taggttgggacac

SEQ ID NO: 5638045 - DNA, 12 bp, Homo sapiens
taggttgtgaat

SEQ ID NO: 5638046 - DNA, 15 bp, Homo sapiens
taggtttaactcaga

SEQ ID NO: 5638047 - DNA, 17 bp, Homo sapiens
taggtttaactcagatc

SEQ ID NO: 5638048 - DNA, 12 bp, Homo sapiens
taggtttactgt

SEQ ID NO: 5638049 - DNA, 15 bp, Homo sapiens
taggtttactgtgaa

SEQ ID NO: 5638050 - DNA, 19 bp, Homo sapiens
taggtttactgtgaagaga

SEQ ID NO: 5638051 - DNA, 17 bp, Homo sapiens
taggtttatgacagtaa

SEQ ID NO: 5638052 - DNA, 19 bp, Homo sapiens
taggtttatgacagtaatt

SEQ ID NO: 5638053 - DNA, 20 bp, Homo sapiens
taggtttatgacagtaattg

SEQ ID NO: 5638054 - DNA, 21 bp, Homo sapiens
taggtttatgacagtaattgt

SEQ ID NO: 5638055 - DNA, 20 bp, Homo sapiens
tagtgtcttcctagtatatt

SEQ ID NO: 5638056 - DNA, 17 bp, Homo sapiens
tagtgtgaaatatatta

SEQ ID NO: 5638057 - DNA, 21 bp, Homo sapiens
tagtgtgacagtttccaaatt

SEQ ID NO: 5638058 - DNA, 11 bp, Homo sapiens
tagtgtgactc

SEQ ID NO: 5638059 - DNA, 22 bp, Homo sapiens
tagtgtgagtggcagccatgcc

SEQ ID NO: 5638060 - DNA, 23 bp, Homo sapiens
tagtgtgatttttttcacattta

SEQ ID NO: 5638061 - DNA, 14 bp, Homo sapiens
tagtgtgctgctgt

SEQ ID NO: 5638062 - DNA, 19 bp, Homo sapiens
tagtgtgctgctgttctgt

SEQ ID NO: 5638063 - DNA, 22 bp, Homo sapiens
tagtgtggaaattaagaagaaa

SEQ ID NO: 5638064 - DNA, 22 bp, Homo sapiens
tagtgtggttttctgtttctaa

SEQ ID NO: 5638065 - DNA, 15 bp, Homo sapiens
tagtgtgtaaaatta

SEQ ID NO: 5638066 - DNA, 16 bp, Homo sapiens
tagtgtgtaaaattaa

SEQ ID NO: 5638067 - DNA, 14 bp, Homo sapiens
tagtgttaaagaga

SEQ ID NO: 5638068 - DNA, 14 bp, Homo sapiens
tagtgttaactgtt

SEQ ID NO: 5638069 - DNA, 14 bp, Homo sapiens
tagtgttaatcaat

SEQ ID NO: 5638070 - DNA, 16 bp, Homo sapiens
tagtgttaatccagag

SEQ ID NO: 5638071 - DNA, 19 bp, Homo sapiens
tagtgttagttataaatag

SEQ ID NO: 5638072 - DNA, 14 bp, Homo sapiens
tagtgttattgcca

SEQ ID NO: 5638073 - DNA, 16 bp, Homo sapiens
tagtgttcaaatactt

SEQ ID NO: 5638074 - DNA, 14 bp, Homo sapiens
tagtgttcacaaac

SEQ ID NO: 5638075 - DNA, 16 bp, Homo sapiens
tagtgttcacaaactg

SEQ ID NO: 5638076 - DNA, 13 bp, Homo sapiens
tagtgttcataaa

SEQ ID NO: 5638077 - DNA, 13 bp, Homo sapiens
tagtgttctagat

SEQ ID NO: 5638078 - DNA, 16 bp, Homo sapiens
tagtgttctctgtatt

SEQ ID NO: 5638079 - DNA, 16 bp, Homo sapiens
tagtgttctgctcctg

SEQ ID NO: 5638080 - DNA, 19 bp, Homo sapiens
tagtgttctgctcctgctt

SEQ ID NO: 5638081 - DNA, 15 bp, Homo sapiens
tagtgttctgtttgt

SEQ ID NO: 5638082 - DNA, 17 bp, Homo sapiens
tagtgttgaggagggga

SEQ ID NO: 5638083 - DNA, 21 bp, Homo sapiens
tagtgttgggtggaggatgga

SEQ ID NO: 5638084 - DNA, 17 bp, Homo sapiens
tagtgttgtatttctat

SEQ ID NO: 5638085 - DNA, 14 bp, Homo sapiens
tagtgttgtccagg

SEQ ID NO: 5638086 - DNA, 18 bp, Homo sapiens
tagtgtttcgttaagcag

SEQ ID NO: 5638087 - DNA, 17 bp, Homo sapiens
tagtgtttctagctaaa

SEQ ID NO: 5638088 - DNA, 17 bp, Homo sapiens
tagtgtttctgtgcatg

SEQ ID NO: 5638089 - DNA, 21 bp, Homo sapiens
tagtgtttggacagctgataa

SEQ ID NO: 5638090 - DNA, 20 bp, Homo sapiens
tagtgtttgggtatattcat

SEQ ID NO: 5638091 - DNA, 16 bp, Homo sapiens
tagtgttttaaaacac

SEQ ID NO: 5638092 - DNA, 23 bp, Homo sapiens
tagtgttttcaattttaaacata

SEQ ID NO: 5638093 - DNA, 19 bp, Homo sapiens
tagtgttttcattctggtc

SEQ ID NO: 5638094 - DNA, 18 bp, Homo sapiens
tagtgttttgtacttgtt

SEQ ID NO: 5638095 - DNA, 23 bp, Homo sapiens
tagtgtttttttatttctactgt

SEQ ID NO: 5638096 - DNA, 21 bp, Homo sapiens
tagttaaaaaaaaaaaaagga

SEQ ID NO: 5638097 - DNA, 14 bp, Homo sapiens
tagttaaaaattaa

SEQ ID NO: 5638098 - DNA, 19 bp, Homo sapiens
tagttaaaaattaaatatt

SEQ ID NO: 5638099 - DNA, 20 bp, Homo sapiens
tagttaaaaattaaatattt

SEQ ID NO: 5638100 - DNA, 15 bp, Homo sapiens
tagttaaaacacata

SEQ ID NO: 5638101 - DNA, 17 bp, Homo sapiens
tagttaaaacagctatt

SEQ ID NO: 5638102 - DNA, 12 bp, Homo sapiens
tagttaaaactc

SEQ ID NO: 5638103 - DNA, 14 bp, Homo sapiens
tagttaaaatgctg

SEQ ID NO: 5638104 - DNA, 21 bp, Homo sapiens
tagttaaagaaaggaaaagaa

SEQ ID NO: 5638105 - DNA, 16 bp, Homo sapiens
tagttaaataactgtg

SEQ ID NO: 5638106 - DNA, 17 bp, Homo sapiens
tagttaaataactgtgt

SEQ ID NO: 5638107 - DNA, 14 bp, Homo sapiens
tagttaacacacta

SEQ ID NO: 5638108 - DNA, 20 bp, Homo sapiens
tagttaagcaaatttcattt

SEQ ID NO: 5638109 - DNA, 15 bp, Homo sapiens
tagttaaggcaaatc

SEQ ID NO: 5638110 - DNA, 22 bp, Homo sapiens
tagttaaggcaaatcaggtaaa

SEQ ID NO: 5638111 - DNA, 20 bp, Homo sapiens
tagttaagtcatccacagcc

SEQ ID NO: 5638112 - DNA, 21 bp, Homo sapiens
tagttaagtcgctgaacaatt

SEQ ID NO: 5638113 - DNA, 20 bp, Homo sapiens
tagttaataatctatgatga

SEQ ID NO: 5638114 - DNA, 14 bp, Homo sapiens
tagttaatataaat

SEQ ID NO: 5638115 - DNA, 16 bp, Homo sapiens
tagttaatcatcaaga

SEQ ID NO: 5638116 - DNA, 12 bp, Homo sapiens
tagttaatttat

SEQ ID NO: 5638117 - DNA, 16 bp, Homo sapiens
tagttaatttatctaa

SEQ ID NO: 5638118 - DNA, 18 bp, Homo sapiens
tagttaatttatctaaat

SEQ ID NO: 5638119 - DNA, 14 bp, Homo sapiens
tagttacagctgtg

SEQ ID NO: 5638120 - DNA, 13 bp, Homo sapiens
tagttacatgaat

SEQ ID NO: 5638121 - DNA, 20 bp, Homo sapiens
tagttacattaatgcccagc

SEQ ID NO: 5638122 - DNA, 17 bp, Homo sapiens
tagttaccttatagtta

SEQ ID NO: 5638123 - DNA, 18 bp, Homo sapiens
tagttaccttatagttac

SEQ ID NO: 5638124 - DNA, 22 bp, Homo sapiens
tagttaccttatagttactgtg

SEQ ID NO: 5638125 - DNA, 18 bp, Homo sapiens
tagttacgtataatgctt

SEQ ID NO: 5638126 - DNA, 22 bp, Homo sapiens
tagttacgtataatgctttctg

SEQ ID NO: 5638127 - DNA, 15 bp, Homo sapiens
tagttactatatgcc

SEQ ID NO: 5638128 - DNA, 11 bp, Homo sapiens
tagttactgtg

SEQ ID NO: 5638129 - DNA, 18 bp, Homo sapiens
tagttactgtgtaattag

SEQ ID NO: 5638130 - DNA, 16 bp, Homo sapiens
tagttagaattggaaa

SEQ ID NO: 5638131 - DNA, 12 bp, Homo sapiens
tagttagacaat

SEQ ID NO: 5638132 - DNA, 15 bp, Homo sapiens
tagttagcatacaca

SEQ ID NO: 5638133 - DNA, 16 bp, Homo sapiens
tagttagcatccaggc

SEQ ID NO: 5638134 - DNA, 15 bp, Homo sapiens
tagttagccctcagt

SEQ ID NO: 5638135 - DNA, 18 bp, Homo sapiens
tagttaggaaataaaacc

SEQ ID NO: 5638136 - DNA, 15 bp, Homo sapiens
tagttaggatagcat

SEQ ID NO: 5638137 - DNA, 20 bp, Homo sapiens
tagttaggatagcatttttg

SEQ ID NO: 5638138 - DNA, 13 bp, Homo sapiens
tagttaggcctgg

SEQ ID NO: 5638139 - DNA, 15 bp, Homo sapiens
tagttaggtgtgcca

SEQ ID NO: 5638140 - DNA, 16 bp, Homo sapiens
tagttaggtgtgccaa

SEQ ID NO: 5638141 - DNA, 16 bp, Homo sapiens
tagttagtagcatgtt

SEQ ID NO: 5638142 - DNA, 22 bp, Homo sapiens
tagttagttttggttatttcta

SEQ ID NO: 5638143 - DNA, 22 bp, Homo sapiens
tagttataaaaggctttagtag

SEQ ID NO: 5638144 - DNA, 21 bp, Homo sapiens
tagttataaaccaatgaaatt

SEQ ID NO: 5638145 - DNA, 19 bp, Homo sapiens
tagttatacatcttcatta

SEQ ID NO: 5638146 - DNA, 19 bp, Homo sapiens
tagttatacttatttgtat

SEQ ID NO: 5638147 - DNA, 12 bp, Homo sapiens
tagttatagtgt

SEQ ID NO: 5638148 - DNA, 14 bp, Homo sapiens
tagttatagtgttt

SEQ ID NO: 5638149 - DNA, 16 bp, Homo sapiens
tagttatagtttcaga

SEQ ID NO: 5638150 - DNA, 15 bp, Homo sapiens
tagttatataattgt

SEQ ID NO: 5638151 - DNA, 15 bp, Homo sapiens
tagttatatattcct

SEQ ID NO: 5638152 - DNA, 16 bp, Homo sapiens
tagttatatattcctt

SEQ ID NO: 5638153 - DNA, 13 bp, Homo sapiens
tagttatcatgtt

SEQ ID NO: 5638154 - DNA, 19 bp, Homo sapiens
tagttatcttttaattaca

SEQ ID NO: 5638155 - DNA, 13 bp, Homo sapiens
tagttatgtaaat

SEQ ID NO: 5638156 - DNA, 21 bp, Homo sapiens
tagttatgtaaataattcttt

SEQ ID NO: 5638157 - DNA, 12 bp, Homo sapiens
tagttatgtctt

SEQ ID NO: 5638158 - DNA, 13 bp, Homo sapiens
tagttatgtcttt

SEQ ID NO: 5638159 - DNA, 14 bp, Homo sapiens
tagttattaaatgt

SEQ ID NO: 5638160 - DNA, 15 bp, Homo sapiens
tagttattattgctg

SEQ ID NO: 5638161 - DNA, 18 bp, Homo sapiens
tagttattattgctgttt

SEQ ID NO: 5638162 - DNA, 12 bp, Homo sapiens
tagttattggat

SEQ ID NO: 5638163 - DNA, 14 bp, Homo sapiens
tagttattggatca

SEQ ID NO: 5638164 - DNA, 20 bp, Homo sapiens
tagttatttaagaagaatga

SEQ ID NO: 5638165 - DNA, 18 bp, Homo sapiens
tagttatttacttgaaag

SEQ ID NO: 5638166 - DNA, 18 bp, Homo sapiens
tagttattttaatacctt

SEQ ID NO: 5638167 - DNA, 23 bp, Homo sapiens
tagttattttataatcaatgaat

SEQ ID NO: 5638168 - DNA, 14 bp, Homo sapiens
tagttattttatag

SEQ ID NO: 5638169 - DNA, 20 bp, Homo sapiens
tagttcaaaacaaccacttt

SEQ ID NO: 5638170 - DNA, 15 bp, Homo sapiens
tagttcaagaaatga

SEQ ID NO: 5638171 - DNA, 18 bp, Homo sapiens
tagttcaagaaatgaaga

SEQ ID NO: 5638172 - DNA, 21 bp, Homo sapiens
tagttcaagaaatgaagagct

SEQ ID NO: 5638173 - DNA, 12 bp, Homo sapiens
tagttcaataca

SEQ ID NO: 5638174 - DNA, 15 bp, Homo sapiens
tagttcaatacagtg

SEQ ID NO: 5638175 - DNA, 21 bp, Homo sapiens
tagttcaatacagtgaaggtc

SEQ ID NO: 5638176 - DNA, 19 bp, Homo sapiens
tagttcaatatttgttact

SEQ ID NO: 5638177 - DNA, 23 bp, Homo sapiens
tagttcaatcctgattcatattt

SEQ ID NO: 5638178 - DNA, 11 bp, Homo sapiens
tagttcaatgc

SEQ ID NO: 5638179 - DNA, 21 bp, Homo sapiens
tagttcaatttcatgtttctt

SEQ ID NO: 5638180 - DNA, 17 bp, Homo sapiens
tagttcagaaggaagca

SEQ ID NO: 5638181 - DNA, 14 bp, Homo sapiens
tagttcaggatttg

SEQ ID NO: 5638182 - DNA, 21 bp, Homo sapiens
tagttcaggatttggtttttc

SEQ ID NO: 5638183 - DNA, 21 bp, Homo sapiens
tagttcatagttggaaatatt

SEQ ID NO: 5638184 - DNA, 13 bp, Homo sapiens
tagttcatatata

SEQ ID NO: 5638185 - DNA, 14 bp, Homo sapiens
tagttcatatatac

SEQ ID NO: 5638186 - DNA, 20 bp, Homo sapiens
tagttcatcccttctcttcc

SEQ ID NO: 5638187 - DNA, 14 bp, Homo sapiens
tagttcatgtaaat

SEQ ID NO: 5638188 - DNA, 20 bp, Homo sapiens
tagttcattgtaaatgaaca

SEQ ID NO: 5638189 - DNA, 17 bp, Homo sapiens
tagttccacacaggttt

SEQ ID NO: 5638190 - DNA, 21 bp, Homo sapiens
tagttccacacaggtttgtaa

SEQ ID NO: 5638191 - DNA, 20 bp, Homo sapiens
tagttccacttatagcctct

SEQ ID NO: 5638192 - DNA, 21 bp, Homo sapiens
tagttccagaaaacctctcct

SEQ ID NO: 5638193 - DNA, 21 bp, Homo sapiens
tagttccagtcctaactttct

SEQ ID NO: 5638194 - DNA, 14 bp, Homo sapiens
tagttccagtttct

SEQ ID NO: 5638195 - DNA, 18 bp, Homo sapiens
tagttccagtttctcctt

SEQ ID NO: 5638196 - DNA, 16 bp, Homo sapiens
tagttccattctatga

SEQ ID NO: 5638197 - DNA, 18 bp, Homo sapiens
tagttccattctatgact

SEQ ID NO: 5638198 - DNA, 15 bp, Homo sapiens
tagttcccaggtgat

SEQ ID NO: 5638199 - DNA, 16 bp, Homo sapiens
tagttcccctgtttat

SEQ ID NO: 5638200 - DNA, 19 bp, Homo sapiens
tagttcccctgtttattca

SEQ ID NO: 5638201 - DNA, 15 bp, Homo sapiens
tagttccctcagtgt

SEQ ID NO: 5638202 - DNA, 13 bp, Homo sapiens
tagttccctctgc

SEQ ID NO: 5638203 - DNA, 14 bp, Homo sapiens
tagttccctctgcc

SEQ ID NO: 5638204 - DNA, 15 bp, Homo sapiens
tagttccctctgcct

SEQ ID NO: 5638205 - DNA, 18 bp, Homo sapiens
tagttccctctgcctggg

SEQ ID NO: 5638206 - DNA, 22 bp, Homo sapiens
tagttccctctgcctgggatgc

SEQ ID NO: 5638207 - DNA, 19 bp, Homo sapiens
tagttccctctgctcagcc

SEQ ID NO: 5638208 - DNA, 19 bp, Homo sapiens
tagttcctaagaagcttct

SEQ ID NO: 5638209 - DNA, 21 bp, Homo sapiens
tagttcctgctaaaacaatga

SEQ ID NO: 5638210 - DNA, 17 bp, Homo sapiens
tagttcctgtgcacagc

SEQ ID NO: 5638211 - DNA, 18 bp, Homo sapiens
tagttcctgtggccagga

SEQ ID NO: 5638212 - DNA, 21 bp, Homo sapiens
tagttccttactgtttacagt

SEQ ID NO: 5638213 - DNA, 14 bp, Homo sapiens
tagttccttgcctt

SEQ ID NO: 5638214 - DNA, 15 bp, Homo sapiens
tagttccttgcctta

SEQ ID NO: 5638215 - DNA, 17 bp, Homo sapiens
tagttcctttatttaat

SEQ ID NO: 5638216 - DNA, 13 bp, Homo sapiens
tagttctaagact

SEQ ID NO: 5638217 - DNA, 14 bp, Homo sapiens
tagttctaagactc

SEQ ID NO: 5638218 - DNA, 15 bp, Homo sapiens
tagttctaagactca

SEQ ID NO: 5638219 - DNA, 12 bp, Homo sapiens
tagttctactcc

SEQ ID NO: 5638220 - DNA, 14 bp, Homo sapiens
tagttctagaaaaa

SEQ ID NO: 5638221 - DNA, 11 bp, Homo sapiens
tagttctagac

SEQ ID NO: 5638222 - DNA, 12 bp, Homo sapiens
tagttctagaca

SEQ ID NO: 5638223 - DNA, 23 bp, Homo sapiens
tagttctagacatggaggttcta

SEQ ID NO: 5638224 - DNA, 23 bp, Homo sapiens
tagttctagtgcagctgaaattg

SEQ ID NO: 5638225 - DNA, 20 bp, Homo sapiens
tagttctatccttttgcctg

SEQ ID NO: 5638226 - DNA, 22 bp, Homo sapiens
tagttctcaatcactgctcccc

SEQ ID NO: 5638227 - DNA, 18 bp, Homo sapiens
tagttctcttatctttga

SEQ ID NO: 5638228 - DNA, 12 bp, Homo sapiens
tagttctgactt

SEQ ID NO: 5638229 - DNA, 16 bp, Homo sapiens
tagttctgactttgaa

SEQ ID NO: 5638230 - DNA, 17 bp, Homo sapiens
tagttctgaggtccctg

SEQ ID NO: 5638231 - DNA, 11 bp, Homo sapiens
tagttctgcaa

SEQ ID NO: 5638232 - DNA, 23 bp, Homo sapiens
tagttctgcaataacagttttaa

SEQ ID NO: 5638233 - DNA, 16 bp, Homo sapiens
tagttctgccaggcaa

SEQ ID NO: 5638234 - DNA, 20 bp, Homo sapiens
tataaaggaccctgtttctg

SEQ ID NO: 5638235 - DNA, 21 bp, Homo sapiens
tataaaggaccctgtttctgt

SEQ ID NO: 5638236 - DNA, 17 bp, Homo sapiens
tataaaggcaaggaaat

SEQ ID NO: 5638237 - DNA, 14 bp, Homo sapiens
tataaagggtcagg

SEQ ID NO: 5638238 - DNA, 15 bp, Homo sapiens
tataaaggttatgaa

SEQ ID NO: 5638239 - DNA, 20 bp, Homo sapiens
tataaaggttatgaaacata

SEQ ID NO: 5638240 - DNA, 24 bp, Homo sapiens
tataaaggttatgaaacatatcat

SEQ ID NO: 5638241 - DNA, 15 bp, Homo sapiens
tataaagtaaagcta

SEQ ID NO: 5638242 - DNA, 22 bp, Homo sapiens
tataaagtaacccataatctgc

SEQ ID NO: 5638243 - DNA, 19 bp, Homo sapiens
tataaagtacccatctagt

SEQ ID NO: 5638244 - DNA, 23 bp, Homo sapiens
tataaagtacccatctagtactt

SEQ ID NO: 5638245 - DNA, 14 bp, Homo sapiens
tataaagtagaaat

SEQ ID NO: 5638246 - DNA, 20 bp, Homo sapiens
tataaagtatatattaggat

SEQ ID NO: 5638247 - DNA, 14 bp, Homo sapiens
tataaagtatatgt

SEQ ID NO: 5638248 - DNA, 18 bp, Homo sapiens
tataaagtatatgttctg

SEQ ID NO: 5638249 - DNA, 11 bp, Homo sapiens
tataaagtcag

SEQ ID NO: 5638250 - DNA, 14 bp, Homo sapiens
tataaagtcagtga

SEQ ID NO: 5638251 - DNA, 22 bp, Homo sapiens
tataaagtctaagcaagatgtt

SEQ ID NO: 5638252 - DNA, 23 bp, Homo sapiens
tataaagtctaagcaagatgttt

SEQ ID NO: 5638253 - DNA, 14 bp, Homo sapiens
tataaagtgattga

SEQ ID NO: 5638254 - DNA, 19 bp, Homo sapiens
tataaagtgcctcggacag

SEQ ID NO: 5638255 - DNA, 19 bp, Homo sapiens
tataaagtgcttgtgtaat

SEQ ID NO: 5638256 - DNA, 19 bp, Homo sapiens
tataaagtggaagtatgta

SEQ ID NO: 5638257 - DNA, 18 bp, Homo sapiens
tataaagttttatatatt

SEQ ID NO: 5638258 - DNA, 21 bp, Homo sapiens
tataaagttttatatattata

SEQ ID NO: 5638259 - DNA, 20 bp, Homo sapiens
tataaagttttatttgaatg

SEQ ID NO: 5638260 - DNA, 21 bp, Homo sapiens
tataaagtttttttatttctt

SEQ ID NO: 5638261 - DNA, 12 bp, Homo sapiens
tataaataaata

SEQ ID NO: 5638262 - DNA, 20 bp, Homo sapiens
tataaataaataaaaatatt

SEQ ID NO: 5638263 - DNA, 14 bp, Homo sapiens
tataaataaatata

SEQ ID NO: 5638264 - DNA, 17 bp, Homo sapiens
tataaataaatatatat

SEQ ID NO: 5638265 - DNA, 13 bp, Homo sapiens
tataaataaatgc

SEQ ID NO: 5638266 - DNA, 15 bp, Homo sapiens
tataaataaatgcca

SEQ ID NO: 5638267 - DNA, 20 bp, Homo sapiens
tataaataagagcatgattt

SEQ ID NO: 5638268 - DNA, 19 bp, Homo sapiens
tataaataataaagaactc

SEQ ID NO: 5638269 - DNA, 14 bp, Homo sapiens
tataaataataata

SEQ ID NO: 5638270 - DNA, 20 bp, Homo sapiens
tataaatacaaatctgtata

SEQ ID NO: 5638271 - DNA, 22 bp, Homo sapiens
tataaatacaaatctgtataaa

SEQ ID NO: 5638272 - DNA, 23 bp, Homo sapiens
tataaatacgtattacaaacaag

SEQ ID NO: 5638273 - DNA, 19 bp, Homo sapiens
tataaatactatagttata

SEQ ID NO: 5638274 - DNA, 18 bp, Homo sapiens
tataaatactgcaaatca

SEQ ID NO: 5638275 - DNA, 14 bp, Homo sapiens
tataaatagaatgt

SEQ ID NO: 5638276 - DNA, 16 bp, Homo sapiens
tataaatagaatgtaa

SEQ ID NO: 5638277 - DNA, 15 bp, Homo sapiens
tataaatagctgaaa

SEQ ID NO: 5638278 - DNA, 13 bp, Homo sapiens
tataaatatatat

SEQ ID NO: 5638279 - DNA, 20 bp, Homo sapiens
tataaatatatataaagaat

SEQ ID NO: 5638280 - DNA, 23 bp, Homo sapiens
tataaatatatataaatatatat

SEQ ID NO: 5638281 - DNA, 23 bp, Homo sapiens
tataaatatatatttttcaaata

SEQ ID NO: 5638282 - DNA, 15 bp, Homo sapiens
tataaatatattatt

SEQ ID NO: 5638283 - DNA, 20 bp, Homo sapiens
tataaatatattgtatattt

SEQ ID NO: 5638284 - DNA, 15 bp, Homo sapiens
tataaatatatttaa

SEQ ID NO: 5638285 - DNA, 13 bp, Homo sapiens
tataaatatcaca

SEQ ID NO: 5638286 - DNA, 18 bp, Homo sapiens
tataaatatcagtattct

SEQ ID NO: 5638287 - DNA, 12 bp, Homo sapiens
tataaatatcta

SEQ ID NO: 5638288 - DNA, 10 bp, Homo sapiens
tataaatatg

SEQ ID NO: 5638289 - DNA, 16 bp, Homo sapiens
tataaatcaatgtcac

SEQ ID NO: 5638290 - DNA, 14 bp, Homo sapiens
tataaatcagtatt

SEQ ID NO: 5638291 - DNA, 22 bp, Homo sapiens
tataaatcatattgatgaaaag

SEQ ID NO: 5638292 - DNA, 20 bp, Homo sapiens
tataaatccaatatcatgtc

SEQ ID NO: 5638293 - DNA, 19 bp, Homo sapiens
tataaatcgcttttgataa

SEQ ID NO: 5638294 - DNA, 13 bp, Homo sapiens
tataaatgaagta

SEQ ID NO: 5638295 - DNA, 22 bp, Homo sapiens
tataaatgaagtattatctgta

SEQ ID NO: 5638296 - DNA, 21 bp, Homo sapiens
tataaatgaagtttatacagt

SEQ ID NO: 5638297 - DNA, 24 bp, Homo sapiens
tataaatgaagtttatacagtaca

SEQ ID NO: 5638298 - DNA, 18 bp, Homo sapiens
tataaatgacaaagtgtt

SEQ ID NO: 5638299 - DNA, 16 bp, Homo sapiens
tataaatgacattatt

SEQ ID NO: 5638300 - DNA, 20 bp, Homo sapiens
tataaatgacattattaaag

SEQ ID NO: 5638301 - DNA, 17 bp, Homo sapiens
tataaatgactattgta

SEQ ID NO: 5638302 - DNA, 19 bp, Homo sapiens
tataaatgatatcaaagaa

SEQ ID NO: 5638303 - DNA, 16 bp, Homo sapiens
tataaatgcaaataac

SEQ ID NO: 5638304 - DNA, 21 bp, Homo sapiens
tataaatgcaaatgtgcattt

SEQ ID NO: 5638305 - DNA, 17 bp, Homo sapiens
tataaatgcaataagaa

SEQ ID NO: 5638306 - DNA, 11 bp, Homo sapiens
tataaatgcat

SEQ ID NO: 5638307 - DNA, 14 bp, Homo sapiens
tataaatgcatgat

SEQ ID NO: 5638308 - DNA, 22 bp, Homo sapiens
tataaatgcatgattttataca

SEQ ID NO: 5638309 - DNA, 23 bp, Homo sapiens
tataaatgcatgattttatacat

SEQ ID NO: 5638310 - DNA, 19 bp, Homo sapiens
tataaatgccagagccaac

SEQ ID NO: 5638311 - DNA, 16 bp, Homo sapiens
tataaatggacctttt

SEQ ID NO: 5638312 - DNA, 19 bp, Homo sapiens
tataaatggaccttttata

SEQ ID NO: 5638313 - DNA, 16 bp, Homo sapiens
tataaatggacttgct

SEQ ID NO: 5638314 - DNA, 17 bp, Homo sapiens
tataaatggacttgctt

SEQ ID NO: 5638315 - DNA, 17 bp, Homo sapiens
tataaatgggaacattt

SEQ ID NO: 5638316 - DNA, 20 bp, Homo sapiens
tataaatggtgagaattaaa

SEQ ID NO: 5638317 - DNA, 22 bp, Homo sapiens
tataaatggtgagaattaaaat

SEQ ID NO: 5638318 - DNA, 19 bp, Homo sapiens
tataaatgtaaaaatgaag

SEQ ID NO: 5638319 - DNA, 13 bp, Homo sapiens
tataaatgtacat

SEQ ID NO: 5638320 - DNA, 20 bp, Homo sapiens
tataaatgtacatttccaaa

SEQ ID NO: 5638321 - DNA, 16 bp, Homo sapiens
tataaatgtataaata

SEQ ID NO: 5638322 - DNA, 20 bp, Homo sapiens
tataaatgtataaatataca

SEQ ID NO: 5638323 - DNA, 16 bp, Homo sapiens
tataaatgtatataca

SEQ ID NO: 5638324 - DNA, 19 bp, Homo sapiens
tataaatgtatatacacat

SEQ ID NO: 5638325 - DNA, 12 bp, Homo sapiens
tataaatgtcta

SEQ ID NO: 5638326 - DNA, 17 bp, Homo sapiens
tataaatgtctttaatg

SEQ ID NO: 5638327 - DNA, 14 bp, Homo sapiens
tataaatgtgtggt

SEQ ID NO: 5638328 - DNA, 15 bp, Homo sapiens
tataaatgtgtttat

SEQ ID NO: 5638329 - DNA, 17 bp, Homo sapiens
tataaatgttagttcta

SEQ ID NO: 5638330 - DNA, 20 bp, Homo sapiens
tataaatgtttatattgttt

SEQ ID NO: 5638331 - DNA, 20 bp, Homo sapiens
tataaatgtttcatgaagaa

SEQ ID NO: 5638332 - DNA, 17 bp, Homo sapiens
tataaatgtttggaaag

SEQ ID NO: 5638333 - DNA, 23 bp, Homo sapiens
tataaatgtttggaaaggttcta

SEQ ID NO: 5638334 - DNA, 19 bp, Homo sapiens
tataaattaaatatatgta

SEQ ID NO: 5638335 - DNA, 11 bp, Homo sapiens
tataaattaag

SEQ ID NO: 5638336 - DNA, 16 bp, Homo sapiens
tataaattaagaagag

SEQ ID NO: 5638337 - DNA, 16 bp, Homo sapiens
tataaattaatacata

SEQ ID NO: 5638338 - DNA, 18 bp, Homo sapiens
tataaattacatgcatga

SEQ ID NO: 5638339 - DNA, 18 bp, Homo sapiens
tataaattactatctgtt

SEQ ID NO: 5638340 - DNA, 16 bp, Homo sapiens
tataaattatctgaat

SEQ ID NO: 5638341 - DNA, 17 bp, Homo sapiens
tataaattatctgaata

SEQ ID NO: 5638342 - DNA, 16 bp, Homo sapiens
tataaattatgaagga

SEQ ID NO: 5638343 - DNA, 17 bp, Homo sapiens
tataaattatgaaggac

SEQ ID NO: 5638344 - DNA, 16 bp, Homo sapiens
tataaattatgtttat

SEQ ID NO: 5638345 - DNA, 16 bp, Homo sapiens
tataaattattcagaa

SEQ ID NO: 5638346 - DNA, 22 bp, Homo sapiens
tataaattattcagaactattt

SEQ ID NO: 5638347 - DNA, 13 bp, Homo sapiens
tataaattcactt

SEQ ID NO: 5638348 - DNA, 16 bp, Homo sapiens
tataaattctactaag

SEQ ID NO: 5638349 - DNA, 13 bp, Homo sapiens
tataaattctgtg

SEQ ID NO: 5638350 - DNA, 17 bp, Homo sapiens
tataaattctgtgggtc

SEQ ID NO: 5638351 - DNA, 14 bp, Homo sapiens
tataaattgtacat

SEQ ID NO: 5638352 - DNA, 17 bp, Homo sapiens
tataaattgtacatttt

SEQ ID NO: 5638353 - DNA, 19 bp, Homo sapiens
tataaattgtacattttgt

SEQ ID NO: 5638354 - DNA, 14 bp, Homo sapiens
tataaattgtcttt

SEQ ID NO: 5638355 - DNA, 15 bp, Homo sapiens
tataaatttaagcaa

SEQ ID NO: 5638356 - DNA, 20 bp, Homo sapiens
tataaatttcgcttcttaga

SEQ ID NO: 5638357 - DNA, 14 bp, Homo sapiens
tataaattttcaga

SEQ ID NO: 5638358 - DNA, 19 bp, Homo sapiens
tataaattttgtacatttt

SEQ ID NO: 5638359 - DNA, 21 bp, Homo sapiens
tataacaacgtctttttgttt

SEQ ID NO: 5638360 - DNA, 21 bp, Homo sapiens
tataacaagccaaacattctt

SEQ ID NO: 5638361 - DNA, 20 bp, Homo sapiens
tataacaatataactgagtt

SEQ ID NO: 5638362 - DNA, 16 bp, Homo sapiens
tataacaatatatgat

SEQ ID NO: 5638363 - DNA, 20 bp, Homo sapiens
tataacaatgttaaatgcaa

SEQ ID NO: 5638364 - DNA, 14 bp, Homo sapiens
tataacacattttt

SEQ ID NO: 5638365 - DNA, 23 bp, Homo sapiens
tataacacatttttttgcatgca

SEQ ID NO: 5638366 - DNA, 19 bp, Homo sapiens
tataacagaaagtttgtaa

SEQ ID NO: 5638367 - DNA, 18 bp, Homo sapiens
tataacagatgtgaaaat

SEQ ID NO: 5638368 - DNA, 19 bp, Homo sapiens
tataacagatgtgaaaata

SEQ ID NO: 5638369 - DNA, 12 bp, Homo sapiens
tataacaggtta

SEQ ID NO: 5638370 - DNA, 13 bp, Homo sapiens
tataacaggttat

SEQ ID NO: 5638371 - DNA, 16 bp, Homo sapiens
tataacagttatattt

SEQ ID NO: 5638372 - DNA, 17 bp, Homo sapiens
tataacagttatatttt

SEQ ID NO: 5638373 - DNA, 23 bp, Homo sapiens
tataacagttttgagtaattcaa

SEQ ID NO: 5638374 - DNA, 14 bp, Homo sapiens
tataacatatttat

SEQ ID NO: 5638375 - DNA, 15 bp, Homo sapiens
tataacatgaaatga

SEQ ID NO: 5638376 - DNA, 22 bp, Homo sapiens
tataacattatataacaaaaaa

SEQ ID NO: 5638377 - DNA, 14 bp, Homo sapiens
tataacattcaatt

SEQ ID NO: 5638378 - DNA, 12 bp, Homo sapiens
tataacattctg

SEQ ID NO: 5638379 - DNA, 19 bp, Homo sapiens
tataacattgtatgttaat

SEQ ID NO: 5638380 - DNA, 16 bp, Homo sapiens
tataaccaatgtttaa

SEQ ID NO: 5638381 - DNA, 20 bp, Homo sapiens
tataaccacaaagcacagtt

SEQ ID NO: 5638382 - DNA, 22 bp, Homo sapiens
tataaccaccaagtattaaact

SEQ ID NO: 5638383 - DNA, 20 bp, Homo sapiens
tataaccagtttagcttttt

SEQ ID NO: 5638384 - DNA, 15 bp, Homo sapiens
tataaccatatgata

SEQ ID NO: 5638385 - DNA, 15 bp, Homo sapiens
tataaccatgagaat

SEQ ID NO: 5638386 - DNA, 16 bp, Homo sapiens
tataaccattacatgt

SEQ ID NO: 5638387 - DNA, 18 bp, Homo sapiens
tataacccactgctgaaa

SEQ ID NO: 5638388 - DNA, 16 bp, Homo sapiens
tataaccccagcctga

SEQ ID NO: 5638389 - DNA, 15 bp, Homo sapiens
tataaccccagctcc

SEQ ID NO: 5638390 - DNA, 16 bp, Homo sapiens
tataacccctgcctgg

SEQ ID NO: 5638391 - DNA, 22 bp, Homo sapiens
tataacctagttaaagaaagga

SEQ ID NO: 5638392 - DNA, 14 bp, Homo sapiens
tataacctggcaaa

SEQ ID NO: 5638393 - DNA, 14 bp, Homo sapiens
tataacctgtagga

SEQ ID NO: 5638394 - DNA, 20 bp, Homo sapiens
tataaccttaatttattatt

SEQ ID NO: 5638395 - DNA, 23 bp, Homo sapiens
tataaccttcatttttaagactg

SEQ ID NO: 5638396 - DNA, 20 bp, Homo sapiens
tataacgttctcagtccttt

SEQ ID NO: 5638397 - DNA, 14 bp, Homo sapiens
tataactaacatgt

SEQ ID NO: 5638398 - DNA, 20 bp, Homo sapiens
tataactaagggggtagaag

SEQ ID NO: 5638399 - DNA, 21 bp, Homo sapiens
tataactacattaaaagcttt

SEQ ID NO: 5638400 - DNA, 18 bp, Homo sapiens
tataactagtcctttact

SEQ ID NO: 5638401 - DNA, 14 bp, Homo sapiens
tataactatataaa

SEQ ID NO: 5638402 - DNA, 17 bp, Homo sapiens
tataactatataaatga

SEQ ID NO: 5638403 - DNA, 19 bp, Homo sapiens
tataactatgttgataaaa

SEQ ID NO: 5638404 - DNA, 15 bp, Homo sapiens
tataactattacagt

SEQ ID NO: 5638405 - DNA, 17 bp, Homo sapiens
tataactcatcataaaa

SEQ ID NO: 5638406 - DNA, 23 bp, Homo sapiens
tataactctgcactactcctctg

SEQ ID NO: 5638407 - DNA, 13 bp, Homo sapiens
tataactgtacaa

SEQ ID NO: 5638408 - DNA, 12 bp, Homo sapiens
tataactgtctt

SEQ ID NO: 5638409 - DNA, 22 bp, Homo sapiens
tataactgttgttgataaggaa

SEQ ID NO: 5638410 - DNA, 20 bp, Homo sapiens
tataacttaaaaatgtaaat

SEQ ID NO: 5638411 - DNA, 14 bp, Homo sapiens
tatacatacatgta

SEQ ID NO: 5638412 - DNA, 15 bp, Homo sapiens
tatacatacatgtat

SEQ ID NO: 5638413 - DNA, 19 bp, Homo sapiens
tatacatacgcaattgtat

SEQ ID NO: 5638414 - DNA, 22 bp, Homo sapiens
tatacatacgcaattgtatata

SEQ ID NO: 5638415 - DNA, 23 bp, Homo sapiens
tatacatacgcaattgtatatat

SEQ ID NO: 5638416 - DNA, 19 bp, Homo sapiens
tatacatacttacatgtgt

SEQ ID NO: 5638417 - DNA, 16 bp, Homo sapiens
tatacatagtctttgt

SEQ ID NO: 5638418 - DNA, 23 bp, Homo sapiens
tatacatatcagaaaagtagaat

SEQ ID NO: 5638419 - DNA, 21 bp, Homo sapiens
tatacatatctttattaatca

SEQ ID NO: 5638420 - DNA, 19 bp, Homo sapiens
tatacatatgagaatatac

SEQ ID NO: 5638421 - DNA, 20 bp, Homo sapiens
tatacatatgatcaaatact

SEQ ID NO: 5638422 - DNA, 19 bp, Homo sapiens
tatacatatgtagactata

SEQ ID NO: 5638423 - DNA, 23 bp, Homo sapiens
tatacatatgtagactatataca

SEQ ID NO: 5638424 - DNA, 16 bp, Homo sapiens
tatacatatgtatgtg

SEQ ID NO: 5638425 - DNA, 17 bp, Homo sapiens
tatacatatgtatgtgt

SEQ ID NO: 5638426 - DNA, 19 bp, Homo sapiens
tatacatatgtatgtgtga

SEQ ID NO: 5638427 - DNA, 15 bp, Homo sapiens
tatacatattgtata

SEQ ID NO: 5638428 - DNA, 16 bp, Homo sapiens
tatacatattgtatat

SEQ ID NO: 5638429 - DNA, 14 bp, Homo sapiens
tatacatcaccttt

SEQ ID NO: 5638430 - DNA, 16 bp, Homo sapiens
tatacatcacgttaaa

SEQ ID NO: 5638431 - DNA, 15 bp, Homo sapiens
tatacatcacttcct

SEQ ID NO: 5638432 - DNA, 18 bp, Homo sapiens
tatacatcctattttgta

SEQ ID NO: 5638433 - DNA, 16 bp, Homo sapiens
tatacatcctgggtaa

SEQ ID NO: 5638434 - DNA, 11 bp, Homo sapiens
tatacatctta

SEQ ID NO: 5638435 - DNA, 20 bp, Homo sapiens
tatacatcttatagatgcaa

SEQ ID NO: 5638436 - DNA, 15 bp, Homo sapiens
tatacatcttcatta

SEQ ID NO: 5638437 - DNA, 21 bp, Homo sapiens
tatacatgaagaatagaaaca

SEQ ID NO: 5638438 - DNA, 18 bp, Homo sapiens
tatacatgaatcatagcc

SEQ ID NO: 5638439 - DNA, 20 bp, Homo sapiens
tatacatgacactgaaatgc

SEQ ID NO: 5638440 - DNA, 23 bp, Homo sapiens
tatacatgacactgaaatgcctt

SEQ ID NO: 5638441 - DNA, 11 bp, Homo sapiens
tatacatgcca

SEQ ID NO: 5638442 - DNA, 13 bp, Homo sapiens
tatacatgccagt

SEQ ID NO: 5638443 - DNA, 13 bp, Homo sapiens
tatacatggaatc

SEQ ID NO: 5638444 - DNA, 22 bp, Homo sapiens
tatacatggaatcgaagtgttt

SEQ ID NO: 5638445 - DNA, 17 bp, Homo sapiens
tatacatgtaaaaatgt

SEQ ID NO: 5638446 - DNA, 18 bp, Homo sapiens
tatacatgtaaaaatgtt

SEQ ID NO: 5638447 - DNA, 18 bp, Homo sapiens
tatacatgtcaatggcct

SEQ ID NO: 5638448 - DNA, 18 bp, Homo sapiens
tatacatgtgatacattt

SEQ ID NO: 5638449 - DNA, 18 bp, Homo sapiens
tatacatgtgtgtatata

SEQ ID NO: 5638450 - DNA, 20 bp, Homo sapiens
tatacatgttggaaatgtgt

SEQ ID NO: 5638451 - DNA, 20 bp, Homo sapiens
tatacatgtttatgtaaaca

SEQ ID NO: 5638452 - DNA, 13 bp, Homo sapiens
tatacatgtttgc

SEQ ID NO: 5638453 - DNA, 22 bp, Homo sapiens
tatacattacatctgagtattt

SEQ ID NO: 5638454 - DNA, 18 bp, Homo sapiens
tatacattagacacacat

SEQ ID NO: 5638455 - DNA, 16 bp, Homo sapiens
tatacattagtaaatg

SEQ ID NO: 5638456 - DNA, 19 bp, Homo sapiens
tatacattagtaaatgtct

SEQ ID NO: 5638457 - DNA, 20 bp, Homo sapiens
tatacattagtaaatgtctt

SEQ ID NO: 5638458 - DNA, 23 bp, Homo sapiens
tatacattagtaaatgtctttgt

SEQ ID NO: 5638459 - DNA, 21 bp, Homo sapiens
tatacattagttttaatctct

SEQ ID NO: 5638460 - DNA, 14 bp, Homo sapiens
tatacattcctgag

SEQ ID NO: 5638461 - DNA, 22 bp, Homo sapiens
tatacattctttatcttgacat

SEQ ID NO: 5638462 - DNA, 12 bp, Homo sapiens
tatacatttaaa

SEQ ID NO: 5638463 - DNA, 14 bp, Homo sapiens
tatacatttaaaga

SEQ ID NO: 5638464 - DNA, 13 bp, Homo sapiens
tatacatttagtt

SEQ ID NO: 5638465 - DNA, 13 bp, Homo sapiens
tatacatttgttg

SEQ ID NO: 5638466 - DNA, 15 bp, Homo sapiens
tatacattttctaaa

SEQ ID NO: 5638467 - DNA, 22 bp, Homo sapiens
tataccaaagcacattttaaaa

SEQ ID NO: 5638468 - DNA, 16 bp, Homo sapiens
tataccaactaaaacc

SEQ ID NO: 5638469 - DNA, 15 bp, Homo sapiens
tataccaataaagtg

SEQ ID NO: 5638470 - DNA, 18 bp, Homo sapiens
tataccaatgtgttttct

SEQ ID NO: 5638471 - DNA, 22 bp, Homo sapiens
tataccaatgtgttttctgtag

SEQ ID NO: 5638472 - DNA, 15 bp, Homo sapiens
tataccacagtcttt

SEQ ID NO: 5638473 - DNA, 13 bp, Homo sapiens
tataccacctgta

SEQ ID NO: 5638474 - DNA, 16 bp, Homo sapiens
tataccacctgtacat

SEQ ID NO: 5638475 - DNA, 19 bp, Homo sapiens
tataccacctgtacataca

SEQ ID NO: 5638476 - DNA, 17 bp, Homo sapiens
tataccagatgaacatt

SEQ ID NO: 5638477 - DNA, 18 bp, Homo sapiens
tataccagatgaacattt

SEQ ID NO: 5638478 - DNA, 13 bp, Homo sapiens
tataccagcaaaa

SEQ ID NO: 5638479 - DNA, 13 bp, Homo sapiens
tataccatatgtc

SEQ ID NO: 5638480 - DNA, 19 bp, Homo sapiens
tataccatggtgaattaat

SEQ ID NO: 5638481 - DNA, 16 bp, Homo sapiens
tatacccagaaagtta

SEQ ID NO: 5638482 - DNA, 15 bp, Homo sapiens
tatacccagtgagga

SEQ ID NO: 5638483 - DNA, 16 bp, Homo sapiens
tataccccaaattgtg

SEQ ID NO: 5638484 - DNA, 17 bp, Homo sapiens
tataccccctgcaaagc

SEQ ID NO: 5638485 - DNA, 19 bp, Homo sapiens
tataccccttacttagcat

SEQ ID NO: 5638486 - DNA, 22 bp, Homo sapiens
tataccctaagatgaagctgtt

SEQ ID NO: 5638487 - DNA, 21 bp, Homo sapiens
tataccctaggtctccacccc

SEQ ID NO: 5638488 - DNA, 15 bp, Homo sapiens
tataccctttttcat

SEQ ID NO: 5638489 - DNA, 14 bp, Homo sapiens
tataccgatcagga

SEQ ID NO: 5638490 - DNA, 18 bp, Homo sapiens
tataccgcagagtatttg

SEQ ID NO: 5638491 - DNA, 22 bp, Homo sapiens
tataccggagctccagtttctc

SEQ ID NO: 5638492 - DNA, 16 bp, Homo sapiens
tatacctaactgaata

SEQ ID NO: 5638493 - DNA, 17 bp, Homo sapiens
tatacctataatgtgtg

SEQ ID NO: 5638494 - DNA, 17 bp, Homo sapiens
tatacctcatttttcat

SEQ ID NO: 5638495 - DNA, 19 bp, Homo sapiens
tatacctctaactgtgcaa

SEQ ID NO: 5638496 - DNA, 13 bp, Homo sapiens
tatacctcttgaa

SEQ ID NO: 5638497 - DNA, 21 bp, Homo sapiens
tatacctgagcctcaaccttc

SEQ ID NO: 5638498 - DNA, 20 bp, Homo sapiens
tatacctgattttttttcct

SEQ ID NO: 5638499 - DNA, 18 bp, Homo sapiens
tatacctgcacgttcata

SEQ ID NO: 5638500 - DNA, 18 bp, Homo sapiens
tatacctgccttttaagt

SEQ ID NO: 5638501 - DNA, 13 bp, Homo sapiens
tatacctggcttt

SEQ ID NO: 5638502 - DNA, 18 bp, Homo sapiens
tatacctgtttaaattgc

SEQ ID NO: 5638503 - DNA, 19 bp, Homo sapiens
tatacctgtttaaattgct

SEQ ID NO: 5638504 - DNA, 21 bp, Homo sapiens
tatacctgtttaaattgctca

SEQ ID NO: 5638505 - DNA, 20 bp, Homo sapiens
tataccttctgacagcccaa

SEQ ID NO: 5638506 - DNA, 14 bp, Homo sapiens
tatacctttgaaat

SEQ ID NO: 5638507 - DNA, 14 bp, Homo sapiens
tatacgaaaagcca

SEQ ID NO: 5638508 - DNA, 19 bp, Homo sapiens
tatacgaaaagccagcttg

SEQ ID NO: 5638509 - DNA, 15 bp, Homo sapiens
tatacgaacaaaaca

SEQ ID NO: 5638510 - DNA, 15 bp, Homo sapiens
tatacgcttttcttt

SEQ ID NO: 5638511 - DNA, 15 bp, Homo sapiens
tatacgtacatacac

SEQ ID NO: 5638512 - DNA, 15 bp, Homo sapiens
tatacgtataaatat

SEQ ID NO: 5638513 - DNA, 22 bp, Homo sapiens
tatacgtgaaaattatttgaaa

SEQ ID NO: 5638514 - DNA, 13 bp, Homo sapiens
tatacgtgtagct

SEQ ID NO: 5638515 - DNA, 13 bp, Homo sapiens
tatacgtttcaaa

SEQ ID NO: 5638516 - DNA, 18 bp, Homo sapiens
tatactaaaccaactcta

SEQ ID NO: 5638517 - DNA, 10 bp, Homo sapiens
tatactaata

SEQ ID NO: 5638518 - DNA, 15 bp, Homo sapiens
tatactaataaaaag

SEQ ID NO: 5638519 - DNA, 18 bp, Homo sapiens
tatactaataaaaaggtt

SEQ ID NO: 5638520 - DNA, 19 bp, Homo sapiens
tatactaataaaaaggttt

SEQ ID NO: 5638521 - DNA, 23 bp, Homo sapiens
tatactaccatagtgagccatga

SEQ ID NO: 5638522 - DNA, 17 bp, Homo sapiens
tatactaccctgggctc

SEQ ID NO: 5638523 - DNA, 20 bp, Homo sapiens
tatactatagtaccagtagg

SEQ ID NO: 5638524 - DNA, 13 bp, Homo sapiens
tatactatatgaa

SEQ ID NO: 5638525 - DNA, 16 bp, Homo sapiens
tatactatatgaaaag

SEQ ID NO: 5638526 - DNA, 14 bp, Homo sapiens
tatactatattaac

SEQ ID NO: 5638527 - DNA, 16 bp, Homo sapiens
tatactatatttatgg

SEQ ID NO: 5638528 - DNA, 13 bp, Homo sapiens
tatactatgaaat

SEQ ID NO: 5638529 - DNA, 23 bp, Homo sapiens
tatactatttattaaaaccattc

SEQ ID NO: 5638530 - DNA, 23 bp, Homo sapiens
tatactcagggattccttctaag

SEQ ID NO: 5638531 - DNA, 13 bp, Homo sapiens
tatactcatttgg

SEQ ID NO: 5638532 - DNA, 15 bp, Homo sapiens
tatactcatttggat

SEQ ID NO: 5638533 - DNA, 18 bp, Homo sapiens
tatactccagtgtacata

SEQ ID NO: 5638534 - DNA, 16 bp, Homo sapiens
tatactccatacataa

SEQ ID NO: 5638535 - DNA, 20 bp, Homo sapiens
tatactccttaaaaatgtat

SEQ ID NO: 5638536 - DNA, 14 bp, Homo sapiens
tatactctcccaga

SEQ ID NO: 5638537 - DNA, 17 bp, Homo sapiens
tatactctctgaaatat

SEQ ID NO: 5638538 - DNA, 14 bp, Homo sapiens
tatactctcttccc

SEQ ID NO: 5638539 - DNA, 23 bp, Homo sapiens
tatactcttgaattcctctcaaa

SEQ ID NO: 5638540 - DNA, 22 bp, Homo sapiens
tatactctttctgtatatactt

SEQ ID NO: 5638541 - DNA, 12 bp, Homo sapiens
tatactgaagga

SEQ ID NO: 5638542 - DNA, 23 bp, Homo sapiens
tatactgatcttcattaccaata

SEQ ID NO: 5638543 - DNA, 15 bp, Homo sapiens
tatactgatttaatt

SEQ ID NO: 5638544 - DNA, 12 bp, Homo sapiens
tatactgcatac

SEQ ID NO: 5638545 - DNA, 16 bp, Homo sapiens
tatactgcatactttt

SEQ ID NO: 5638546 - DNA, 22 bp, Homo sapiens
tatactgcatatcctggtgtct

SEQ ID NO: 5638547 - DNA, 16 bp, Homo sapiens
tatactgctatttaca

SEQ ID NO: 5638548 - DNA, 18 bp, Homo sapiens
tatactgctctataaata

SEQ ID NO: 5638549 - DNA, 16 bp, Homo sapiens
tatactggagaagtct

SEQ ID NO: 5638550 - DNA, 16 bp, Homo sapiens
tatactgggttcttgt

SEQ ID NO: 5638551 - DNA, 15 bp, Homo sapiens
tatactgggtttcaa

SEQ ID NO: 5638552 - DNA, 24 bp, Homo sapiens
tatactggttatagttgatatgta

SEQ ID NO: 5638553 - DNA, 20 bp, Homo sapiens
tatactgtaaaagttataat

SEQ ID NO: 5638554 - DNA, 12 bp, Homo sapiens
tatactgtaaag

SEQ ID NO: 5638555 - DNA, 14 bp, Homo sapiens
tatactgtaaagaa

SEQ ID NO: 5638556 - DNA, 15 bp, Homo sapiens
tatactgtaaagaaa

SEQ ID NO: 5638557 - DNA, 11 bp, Homo sapiens
tatactgtaat

SEQ ID NO: 5638558 - DNA, 15 bp, Homo sapiens
tatactgtaatttag

SEQ ID NO: 5638559 - DNA, 15 bp, Homo sapiens
tatactgtacaataa

SEQ ID NO: 5638560 - DNA, 13 bp, Homo sapiens
tatactgtacatg

SEQ ID NO: 5638561 - DNA, 13 bp, Homo sapiens
tatactgtagcaa

SEQ ID NO: 5638562 - DNA, 21 bp, Homo sapiens
tatactgtagcaatatatttg

SEQ ID NO: 5638563 - DNA, 13 bp, Homo sapiens
tatactgtaggtg

SEQ ID NO: 5638564 - DNA, 18 bp, Homo sapiens
tatactgtaggtgttatg

SEQ ID NO: 5638565 - DNA, 18 bp, Homo sapiens
tatactgtgtcatggtga

SEQ ID NO: 5638566 - DNA, 19 bp, Homo sapiens
tatactgtgtcatggtgat

SEQ ID NO: 5638567 - DNA, 17 bp, Homo sapiens
tatactgttatccatat

SEQ ID NO: 5638568 - DNA, 16 bp, Homo sapiens
tatactgtttgtaata

SEQ ID NO: 5638569 - DNA, 19 bp, Homo sapiens
tatactgtttgtaatatac

SEQ ID NO: 5638570 - DNA, 21 bp, Homo sapiens
tatacttaaaaaatcctgccc

SEQ ID NO: 5638571 - DNA, 22 bp, Homo sapiens
tatacttaaaaaatcctgccca

SEQ ID NO: 5638572 - DNA, 16 bp, Homo sapiens
tatacttaaaatgaca

SEQ ID NO: 5638573 - DNA, 15 bp, Homo sapiens
tatacttaaacagct

SEQ ID NO: 5638574 - DNA, 17 bp, Homo sapiens
tatacttaaacagcttt

SEQ ID NO: 5638575 - DNA, 18 bp, Homo sapiens
tatacttaaacagctttt

SEQ ID NO: 5638576 - DNA, 14 bp, Homo sapiens
tatacttaataaaa

SEQ ID NO: 5638577 - DNA, 16 bp, Homo sapiens
tatacttaataaaaca

SEQ ID NO: 5638578 - DNA, 18 bp, Homo sapiens
tatacttaataaaacatt

SEQ ID NO: 5638579 - DNA, 16 bp, Homo sapiens
tatacttaatctaaga

SEQ ID NO: 5638580 - DNA, 17 bp, Homo sapiens
tatacttatcacatttt

SEQ ID NO: 5638581 - DNA, 12 bp, Homo sapiens
tatacttcaaaa

SEQ ID NO: 5638582 - DNA, 13 bp, Homo sapiens
tatacttcaaatg

SEQ ID NO: 5638583 - DNA, 15 bp, Homo sapiens
tatacttcacactga

SEQ ID NO: 5638584 - DNA, 20 bp, Homo sapiens
tatacttcacactgaactca

SEQ ID NO: 5638585 - DNA, 21 bp, Homo sapiens
tatacttccttacttttaagg

SEQ ID NO: 5638586 - DNA, 13 bp, Homo sapiens
tatacttgaacaa

SEQ ID NO: 5638587 - DNA, 13 bp, Homo sapiens
tatacttgactct

SEQ ID NO: 5638588 - DNA, 20 bp, Homo sapiens
tatacttgactctaatatga

SEQ ID NO: 5638589 - DNA, 23 bp, Homo sapiens
tatacttgctttgtgttctttgt

SEQ ID NO: 5638590 - DNA, 19 bp, Homo sapiens
tatatcagaatctgtgtga

SEQ ID NO: 5638591 - DNA, 15 bp, Homo sapiens
tatatcagcctgagt

SEQ ID NO: 5638592 - DNA, 11 bp, Homo sapiens
tatatcagctc

SEQ ID NO: 5638593 - DNA, 17 bp, Homo sapiens
tatatcaggtgtataaa

SEQ ID NO: 5638594 - DNA, 23 bp, Homo sapiens
tatatcaggtgtataaatgtaca

SEQ ID NO: 5638595 - DNA, 16 bp, Homo sapiens
tatatcagtacctctc

SEQ ID NO: 5638596 - DNA, 14 bp, Homo sapiens
tatatcataaagta

SEQ ID NO: 5638597 - DNA, 14 bp, Homo sapiens
tatatcataactta

SEQ ID NO: 5638598 - DNA, 17 bp, Homo sapiens
tatatcatacagttttc

SEQ ID NO: 5638599 - DNA, 20 bp, Homo sapiens
tatatcatacagttttcatt

SEQ ID NO: 5638600 - DNA, 21 bp, Homo sapiens
tatatcatacattgttttcaa

SEQ ID NO: 5638601 - DNA, 14 bp, Homo sapiens
tatatcatatttct

SEQ ID NO: 5638602 - DNA, 19 bp, Homo sapiens
tatatcatatttctgtgga

SEQ ID NO: 5638603 - DNA, 17 bp, Homo sapiens
tatatcatgaagccttg

SEQ ID NO: 5638604 - DNA, 14 bp, Homo sapiens
tatatcatgcaaaa

SEQ ID NO: 5638605 - DNA, 19 bp, Homo sapiens
tatatcatgtaaagaaatg

SEQ ID NO: 5638606 - DNA, 15 bp, Homo sapiens
tatatcattctacag

SEQ ID NO: 5638607 - DNA, 22 bp, Homo sapiens
tatatcattggaacaactgata

SEQ ID NO: 5638608 - DNA, 17 bp, Homo sapiens
tatatccagttcctgct

SEQ ID NO: 5638609 - DNA, 22 bp, Homo sapiens
tatatccagttcctgctctctg

SEQ ID NO: 5638610 - DNA, 21 bp, Homo sapiens
tatatccatgatcacacagct

SEQ ID NO: 5638611 - DNA, 16 bp, Homo sapiens
tatatccatgtactgt

SEQ ID NO: 5638612 - DNA, 19 bp, Homo sapiens
tatatccctgataaatatt

SEQ ID NO: 5638613 - DNA, 15 bp, Homo sapiens
tatatcctgtgtacc

SEQ ID NO: 5638614 - DNA, 16 bp, Homo sapiens
tatatcctgtttgtat

SEQ ID NO: 5638615 - DNA, 21 bp, Homo sapiens
tatatccttgacaccttactt

SEQ ID NO: 5638616 - DNA, 16 bp, Homo sapiens
tatatcctttctaaca

SEQ ID NO: 5638617 - DNA, 21 bp, Homo sapiens
tatatccttttcttctatgta

SEQ ID NO: 5638618 - DNA, 16 bp, Homo sapiens
tatatcgttatcactg

SEQ ID NO: 5638619 - DNA, 18 bp, Homo sapiens
tatatctaaattgaataa

SEQ ID NO: 5638620 - DNA, 15 bp, Homo sapiens
tatatctaacttcga

SEQ ID NO: 5638621 - DNA, 13 bp, Homo sapiens
tatatctacacat

SEQ ID NO: 5638622 - DNA, 21 bp, Homo sapiens
tatatctaccccagactagat

SEQ ID NO: 5638623 - DNA, 22 bp, Homo sapiens
tatatctaggtttatgacagta

SEQ ID NO: 5638624 - DNA, 20 bp, Homo sapiens
tatatctataaacactgttt

SEQ ID NO: 5638625 - DNA, 13 bp, Homo sapiens
tatatctatatat

SEQ ID NO: 5638626 - DNA, 17 bp, Homo sapiens
tatatctatatgtactt

SEQ ID NO: 5638627 - DNA, 19 bp, Homo sapiens
tatatctatctatttgagg

SEQ ID NO: 5638628 - DNA, 15 bp, Homo sapiens
tatatctattattca

SEQ ID NO: 5638629 - DNA, 17 bp, Homo sapiens
tatatctcaaattgtaa

SEQ ID NO: 5638630 - DNA, 12 bp, Homo sapiens
tatatctgaaaa

SEQ ID NO: 5638631 - DNA, 16 bp, Homo sapiens
tatatctgaaaactgg

SEQ ID NO: 5638632 - DNA, 14 bp, Homo sapiens
tatatctgagcaag

SEQ ID NO: 5638633 - DNA, 16 bp, Homo sapiens
tatatctgagcaagga

SEQ ID NO: 5638634 - DNA, 18 bp, Homo sapiens
tatatctgaggaattctg

SEQ ID NO: 5638635 - DNA, 20 bp, Homo sapiens
tatatctgataaaattgtga

SEQ ID NO: 5638636 - DNA, 21 bp, Homo sapiens
tatatctgataaaattgtgat

SEQ ID NO: 5638637 - DNA, 17 bp, Homo sapiens
tatatctgctgtccaga

SEQ ID NO: 5638638 - DNA, 17 bp, Homo sapiens
tatatctgcttcagtgg

SEQ ID NO: 5638639 - DNA, 21 bp, Homo sapiens
tatatctggatttttacaaat

SEQ ID NO: 5638640 - DNA, 12 bp, Homo sapiens
tatatctgtaaa

SEQ ID NO: 5638641 - DNA, 14 bp, Homo sapiens
tatatctgtaaatt

SEQ ID NO: 5638642 - DNA, 23 bp, Homo sapiens
tatatctgtaacactattacagt

SEQ ID NO: 5638643 - DNA, 15 bp, Homo sapiens
tatatctgtaatata

SEQ ID NO: 5638644 - DNA, 15 bp, Homo sapiens
tatatctgtctttta

SEQ ID NO: 5638645 - DNA, 14 bp, Homo sapiens
tatatctgtggtct

SEQ ID NO: 5638646 - DNA, 21 bp, Homo sapiens
tatatcttggcaggtaggaat

SEQ ID NO: 5638647 - DNA, 14 bp, Homo sapiens
tatatcttgtagct

SEQ ID NO: 5638648 - DNA, 17 bp, Homo sapiens
tatatcttgtttacaat

SEQ ID NO: 5638649 - DNA, 18 bp, Homo sapiens
tatatctttaataagtaa

SEQ ID NO: 5638650 - DNA, 22 bp, Homo sapiens
tatatctttatgcaaaaacata

SEQ ID NO: 5638651 - DNA, 19 bp, Homo sapiens
tatatctttgtaaattatt

SEQ ID NO: 5638652 - DNA, 14 bp, Homo sapiens
tatatcttttggtt

SEQ ID NO: 5638653 - DNA, 20 bp, Homo sapiens
tatatcttttggttattcta

SEQ ID NO: 5638654 - DNA, 14 bp, Homo sapiens
tatatctttttcca

SEQ ID NO: 5638655 - DNA, 22 bp, Homo sapiens
tatatgaaaacaagttccaaat

SEQ ID NO: 5638656 - DNA, 14 bp, Homo sapiens
tatatgaaaacctg

SEQ ID NO: 5638657 - DNA, 14 bp, Homo sapiens
tatatgaaaactaa

SEQ ID NO: 5638658 - DNA, 20 bp, Homo sapiens
tatatgaaataagtaaatgt

SEQ ID NO: 5638659 - DNA, 18 bp, Homo sapiens
tatatgaaatgtttcact

SEQ ID NO: 5638660 - DNA, 19 bp, Homo sapiens
tatatgaacttaacatgct

SEQ ID NO: 5638661 - DNA, 16 bp, Homo sapiens
tatatgaagctcttga

SEQ ID NO: 5638662 - DNA, 19 bp, Homo sapiens
tatatgaatattacatgta

SEQ ID NO: 5638663 - DNA, 14 bp, Homo sapiens
tatatgaccagaag

SEQ ID NO: 5638664 - DNA, 19 bp, Homo sapiens
tatatgaccagaagccttg

SEQ ID NO: 5638665 - DNA, 14 bp, Homo sapiens
tatatgagaagaat

SEQ ID NO: 5638666 - DNA, 19 bp, Homo sapiens
tatatgaggacttgtgtct

SEQ ID NO: 5638667 - DNA, 15 bp, Homo sapiens
tatatgaggatgtat

SEQ ID NO: 5638668 - DNA, 17 bp, Homo sapiens
tatatgaggctacagaa

SEQ ID NO: 5638669 - DNA, 21 bp, Homo sapiens
tatatgatgaaattcttatgt

SEQ ID NO: 5638670 - DNA, 20 bp, Homo sapiens
tatatgatgtggacatatgt

SEQ ID NO: 5638671 - DNA, 14 bp, Homo sapiens
tatatgattaaatt

SEQ ID NO: 5638672 - DNA, 17 bp, Homo sapiens
tatatgattctctgtgg

SEQ ID NO: 5638673 - DNA, 20 bp, Homo sapiens
tatatgattgtataatgtga

SEQ ID NO: 5638674 - DNA, 22 bp, Homo sapiens
tatatgattgtataatgtgatt

SEQ ID NO: 5638675 - DNA, 16 bp, Homo sapiens
tatatgatttatagtt

SEQ ID NO: 5638676 - DNA, 21 bp, Homo sapiens
tatatgcacatgtaacccaaa

SEQ ID NO: 5638677 - DNA, 10 bp, Homo sapiens
tatatgcacc

SEQ ID NO: 5638678 - DNA, 22 bp, Homo sapiens
tatatgcagtctctttatttta

SEQ ID NO: 5638679 - DNA, 21 bp, Homo sapiens
tatatgcataaacaacagtac

SEQ ID NO: 5638680 - DNA, 15 bp, Homo sapiens
tatatgcatgcacag

SEQ ID NO: 5638681 - DNA, 17 bp, Homo sapiens
tatatgccaagctaatt

SEQ ID NO: 5638682 - DNA, 18 bp, Homo sapiens
tatatgccaagctaattt

SEQ ID NO: 5638683 - DNA, 19 bp, Homo sapiens
tatatgcccattcttttca

SEQ ID NO: 5638684 - DNA, 17 bp, Homo sapiens
tatatgccgtataaaag

SEQ ID NO: 5638685 - DNA, 18 bp, Homo sapiens
tatatgccttaagccaat

SEQ ID NO: 5638686 - DNA, 18 bp, Homo sapiens
tatatgcctttttcctag

SEQ ID NO: 5638687 - DNA, 16 bp, Homo sapiens
tatatgctatttctat

SEQ ID NO: 5638688 - DNA, 17 bp, Homo sapiens
tatatgctcaaccagaa

SEQ ID NO: 5638689 - DNA, 16 bp, Homo sapiens
tatatgctgtatttct

SEQ ID NO: 5638690 - DNA, 17 bp, Homo sapiens
tatatgcttactgatat

SEQ ID NO: 5638691 - DNA, 18 bp, Homo sapiens
tatatgcttcacatagca

SEQ ID NO: 5638692 - DNA, 14 bp, Homo sapiens
tatatgcttctgtt

SEQ ID NO: 5638693 - DNA, 18 bp, Homo sapiens
tatatgctttattaatgt

SEQ ID NO: 5638694 - DNA, 21 bp, Homo sapiens
tatatgcttttttgcaataag

SEQ ID NO: 5638695 - DNA, 17 bp, Homo sapiens
tatatggaacattttct

SEQ ID NO: 5638696 - DNA, 17 bp, Homo sapiens
tatatggaacgcatttt

SEQ ID NO: 5638697 - DNA, 16 bp, Homo sapiens
tatatggaagaaagta

SEQ ID NO: 5638698 - DNA, 21 bp, Homo sapiens
tatatggaagataattttatg

SEQ ID NO: 5638699 - DNA, 22 bp, Homo sapiens
tatatggaagataattttatgt

SEQ ID NO: 5638700 - DNA, 15 bp, Homo sapiens
tatatggaataagtg

SEQ ID NO: 5638701 - DNA, 20 bp, Homo sapiens
tatatggaataagtgtacat

SEQ ID NO: 5638702 - DNA, 22 bp, Homo sapiens
tatatggaataagtgtacatat

SEQ ID NO: 5638703 - DNA, 14 bp, Homo sapiens
tatatggacaaatg

SEQ ID NO: 5638704 - DNA, 12 bp, Homo sapiens
tatatggacttt

SEQ ID NO: 5638705 - DNA, 14 bp, Homo sapiens
tatatggatcagag

SEQ ID NO: 5638706 - DNA, 16 bp, Homo sapiens
tatatggatgattcag

SEQ ID NO: 5638707 - DNA, 14 bp, Homo sapiens
tatatggcaaatag

SEQ ID NO: 5638708 - DNA, 16 bp, Homo sapiens
tatatggcaaatagcc

SEQ ID NO: 5638709 - DNA, 19 bp, Homo sapiens
tatatggcagagttgtaaa

SEQ ID NO: 5638710 - DNA, 19 bp, Homo sapiens
tatatggcaggagctactg

SEQ ID NO: 5638711 - DNA, 20 bp, Homo sapiens
tatatggcatatttatattg

SEQ ID NO: 5638712 - DNA, 15 bp, Homo sapiens
tatatggcatttgca

SEQ ID NO: 5638713 - DNA, 21 bp, Homo sapiens
tatatggcgttttgtctgtgt

SEQ ID NO: 5638714 - DNA, 20 bp, Homo sapiens
tatatggggatggtagtttt

SEQ ID NO: 5638715 - DNA, 20 bp, Homo sapiens
tatatgggggaaaattattt

SEQ ID NO: 5638716 - DNA, 21 bp, Homo sapiens
tatatgggggaaaattatttt

SEQ ID NO: 5638717 - DNA, 20 bp, Homo sapiens
tatatgggtatatattcatc

SEQ ID NO: 5638718 - DNA, 22 bp, Homo sapiens
tatatgggtcttcactctgact

SEQ ID NO: 5638719 - DNA, 15 bp, Homo sapiens
tatatggtccactgg

SEQ ID NO: 5638720 - DNA, 18 bp, Homo sapiens
tatatggttctccaagaa

SEQ ID NO: 5638721 - DNA, 23 bp, Homo sapiens
tatatggttctccaagaaactga

SEQ ID NO: 5638722 - DNA, 12 bp, Homo sapiens
tatatgtaaatg

SEQ ID NO: 5638723 - DNA, 19 bp, Homo sapiens
tatatgtaacagtttaaaa

SEQ ID NO: 5638724 - DNA, 13 bp, Homo sapiens
tatatgtaatata

SEQ ID NO: 5638725 - DNA, 11 bp, Homo sapiens
tatatgtacag

SEQ ID NO: 5638726 - DNA, 14 bp, Homo sapiens
tatatgtacagtta

SEQ ID NO: 5638727 - DNA, 20 bp, Homo sapiens
tatatgtacagttatacata

SEQ ID NO: 5638728 - DNA, 19 bp, Homo sapiens
tatatgtaccctctgaaat

SEQ ID NO: 5638729 - DNA, 15 bp, Homo sapiens
tatatgtagagaaag

SEQ ID NO: 5638730 - DNA, 21 bp, Homo sapiens
tatatgtagccagacagttta

SEQ ID NO: 5638731 - DNA, 14 bp, Homo sapiens
tatatgtatacata

SEQ ID NO: 5638732 - DNA, 13 bp, Homo sapiens
tatatgtatatct

SEQ ID NO: 5638733 - DNA, 14 bp, Homo sapiens
tatatgtatatctg

SEQ ID NO: 5638734 - DNA, 14 bp, Homo sapiens
tatatgtatatgta

SEQ ID NO: 5638735 - DNA, 15 bp, Homo sapiens
tatatgtatattgtc

SEQ ID NO: 5638736 - DNA, 11 bp, Homo sapiens
tatatgtatgt

SEQ ID NO: 5638737 - DNA, 16 bp, Homo sapiens
tatatgtatgtaaaaa

SEQ ID NO: 5638738 - DNA, 16 bp, Homo sapiens
tatatgtatgtgttta

SEQ ID NO: 5638739 - DNA, 18 bp, Homo sapiens
tatatgtatgtgtttaga

SEQ ID NO: 5638740 - DNA, 14 bp, Homo sapiens
tatatgtattccct

SEQ ID NO: 5638741 - DNA, 15 bp, Homo sapiens
tatatgtattccctt

SEQ ID NO: 5638742 - DNA, 11 bp, Homo sapiens
tatatgtattt

SEQ ID NO: 5638743 - DNA, 16 bp, Homo sapiens
tatatgtatttaagat

SEQ ID NO: 5638744 - DNA, 23 bp, Homo sapiens
tatatgtatttaagatgtacatt

SEQ ID NO: 5638745 - DNA, 17 bp, Homo sapiens
tatatgtatttattgtc

SEQ ID NO: 5638746 - DNA, 15 bp, Homo sapiens
tatatgtcctattca

SEQ ID NO: 5638747 - DNA, 12 bp, Homo sapiens
tatatgtctgat

SEQ ID NO: 5638748 - DNA, 19 bp, Homo sapiens
tatatgtgaaaaaaatgag

SEQ ID NO: 5638749 - DNA, 13 bp, Homo sapiens
tatatgtgaaaca

SEQ ID NO: 5638750 - DNA, 22 bp, Homo sapiens
tatatgtgacactgcagcagaa

SEQ ID NO: 5638751 - DNA, 13 bp, Homo sapiens
tatatgtgagaaa

SEQ ID NO: 5638752 - DNA, 14 bp, Homo sapiens
tatatgtgcagtct

SEQ ID NO: 5638753 - DNA, 17 bp, Homo sapiens
tatatgtgccacatttt

SEQ ID NO: 5638754 - DNA, 20 bp, Homo sapiens
tatatgtggactaaatatct

SEQ ID NO: 5638755 - DNA, 22 bp, Homo sapiens
tatatgtggactaaatatctgt

SEQ ID NO: 5638756 - DNA, 14 bp, Homo sapiens
tatatgtgtataca

SEQ ID NO: 5638757 - DNA, 14 bp, Homo sapiens
tatatgtgtatata

SEQ ID NO: 5638758 - DNA, 18 bp, Homo sapiens
tatatgtgtatatataca

SEQ ID NO: 5638759 - DNA, 20 bp, Homo sapiens
tatatgtgtatatatacata

SEQ ID NO: 5638760 - DNA, 14 bp, Homo sapiens
tatatgtgtatgca

SEQ ID NO: 5638761 - DNA, 14 bp, Homo sapiens
tatatgtgtgccta

SEQ ID NO: 5638762 - DNA, 19 bp, Homo sapiens
tatatgtgtgtgtatgttt

SEQ ID NO: 5638763 - DNA, 22 bp, Homo sapiens
tatatgtgtgtgtatgtttgca

SEQ ID NO: 5638764 - DNA, 19 bp, Homo sapiens
tatatgtgtgtttaaataa

SEQ ID NO: 5638765 - DNA, 12 bp, Homo sapiens
tatatgttcata

SEQ ID NO: 5638766 - DNA, 20 bp, Homo sapiens
tatatgttgaatgttaacag

SEQ ID NO: 5638767 - DNA, 18 bp, Homo sapiens
tatatgttgaccattcca

SEQ ID NO: 5638768 - DNA, 14 bp, Homo sapiens
tatatgttggttta

SEQ ID NO: 5638769 - DNA, 14 bp, Homo sapiens
tatcacaaatctta

SEQ ID NO: 5638770 - DNA, 16 bp, Homo sapiens
tatcacaaatcttaac

SEQ ID NO: 5638771 - DNA, 14 bp, Homo sapiens
tatcacacaaagca

SEQ ID NO: 5638772 - DNA, 13 bp, Homo sapiens
tatcacacaatat

SEQ ID NO: 5638773 - DNA, 20 bp, Homo sapiens
tatcacacacattgctgtga

SEQ ID NO: 5638774 - DNA, 13 bp, Homo sapiens
tatcacacttctg

SEQ ID NO: 5638775 - DNA, 17 bp, Homo sapiens
tatcacacttgcaaatg

SEQ ID NO: 5638776 - DNA, 13 bp, Homo sapiens
tatcacactttgt

SEQ ID NO: 5638777 - DNA, 16 bp, Homo sapiens
tatcacaggccagatg

SEQ ID NO: 5638778 - DNA, 21 bp, Homo sapiens
tatcacagtattatctgtgtt

SEQ ID NO: 5638779 - DNA, 11 bp, Homo sapiens
tatcacagtgt

SEQ ID NO: 5638780 - DNA, 12 bp, Homo sapiens
tatcacagtgtt

SEQ ID NO: 5638781 - DNA, 20 bp, Homo sapiens
tatcacatacaatttgcact

SEQ ID NO: 5638782 - DNA, 21 bp, Homo sapiens
tatcacatcaagcatgcaata

SEQ ID NO: 5638783 - DNA, 12 bp, Homo sapiens
tatcacatgtat

SEQ ID NO: 5638784 - DNA, 18 bp, Homo sapiens
tatcacatgtatgttttg

SEQ ID NO: 5638785 - DNA, 12 bp, Homo sapiens
tatcacatgttt

SEQ ID NO: 5638786 - DNA, 20 bp, Homo sapiens
tatcacattaatctcaaaga

SEQ ID NO: 5638787 - DNA, 18 bp, Homo sapiens
tatcaccagagagggact

SEQ ID NO: 5638788 - DNA, 21 bp, Homo sapiens
tatcaccaggatttatacata

SEQ ID NO: 5638789 - DNA, 14 bp, Homo sapiens
tatcaccagtgcat

SEQ ID NO: 5638790 - DNA, 15 bp, Homo sapiens
tatcaccatgattta

SEQ ID NO: 5638791 - DNA, 16 bp, Homo sapiens
tatcaccatgatttaa

SEQ ID NO: 5638792 - DNA, 19 bp, Homo sapiens
tatcacccagaagaaaata

SEQ ID NO: 5638793 - DNA, 15 bp, Homo sapiens
tatcaccctcagctg

SEQ ID NO: 5638794 - DNA, 17 bp, Homo sapiens
tatcacccttccctgct

SEQ ID NO: 5638795 - DNA, 23 bp, Homo sapiens
tatcaccgtgggctccctgactg

SEQ ID NO: 5638796 - DNA, 18 bp, Homo sapiens
tatcacctaagcacttct

SEQ ID NO: 5638797 - DNA, 14 bp, Homo sapiens
tatcacctcccctc

SEQ ID NO: 5638798 - DNA, 18 bp, Homo sapiens
tatcacctcgagaagtaa

SEQ ID NO: 5638799 - DNA, 17 bp, Homo sapiens
tatcacctctcttcagc

SEQ ID NO: 5638800 - DNA, 21 bp, Homo sapiens
tatcacctgaattattaatga

SEQ ID NO: 5638801 - DNA, 12 bp, Homo sapiens
tatcacctggct

SEQ ID NO: 5638802 - DNA, 18 bp, Homo sapiens
tatcacctggcttgttta

SEQ ID NO: 5638803 - DNA, 20 bp, Homo sapiens
tatcacctgtcttgcctttt

SEQ ID NO: 5638804 - DNA, 23 bp, Homo sapiens
tatcacgtacaccatatgcaagt

SEQ ID NO: 5638805 - DNA, 21 bp, Homo sapiens
tatcacgttgaaccacgtgaa

SEQ ID NO: 5638806 - DNA, 20 bp, Homo sapiens
tatcactaaataaacacgat

SEQ ID NO: 5638807 - DNA, 20 bp, Homo sapiens
tatcactaataaagtctgtc

SEQ ID NO: 5638808 - DNA, 17 bp, Homo sapiens
tatcactaatttcttct

SEQ ID NO: 5638809 - DNA, 13 bp, Homo sapiens
tatcactcattaa

SEQ ID NO: 5638810 - DNA, 23 bp, Homo sapiens
tatcactctaaaaaacattttta

SEQ ID NO: 5638811 - DNA, 13 bp, Homo sapiens
tatcactgaagga

SEQ ID NO: 5638812 - DNA, 20 bp, Homo sapiens
tatcactgcagtcacctctt

SEQ ID NO: 5638813 - DNA, 13 bp, Homo sapiens
tatcactgcatta

SEQ ID NO: 5638814 - DNA, 19 bp, Homo sapiens
tatcactgccttcgtttat

SEQ ID NO: 5638815 - DNA, 21 bp, Homo sapiens
tatcactgccttcgtttatat

SEQ ID NO: 5638816 - DNA, 20 bp, Homo sapiens
tatcactgctttttccttag

SEQ ID NO: 5638817 - DNA, 14 bp, Homo sapiens
tatcactgtctttg

SEQ ID NO: 5638818 - DNA, 16 bp, Homo sapiens
tatcacttaaacttgc

SEQ ID NO: 5638819 - DNA, 15 bp, Homo sapiens
tatcacttacatttt

SEQ ID NO: 5638820 - DNA, 15 bp, Homo sapiens
tatcactttaagttt

SEQ ID NO: 5638821 - DNA, 18 bp, Homo sapiens
tatcactttgtattctct

SEQ ID NO: 5638822 - DNA, 14 bp, Homo sapiens
tatcactttttgaa

SEQ ID NO: 5638823 - DNA, 17 bp, Homo sapiens
tatcactttttgaacta

SEQ ID NO: 5638824 - DNA, 12 bp, Homo sapiens
tatcagaaaagt

SEQ ID NO: 5638825 - DNA, 20 bp, Homo sapiens
tatcagaaaagtagaattat

SEQ ID NO: 5638826 - DNA, 21 bp, Homo sapiens
tatcagaaaagtagaattata

SEQ ID NO: 5638827 - DNA, 22 bp, Homo sapiens
tatcagaaacagtattttcttc

SEQ ID NO: 5638828 - DNA, 17 bp, Homo sapiens
tatcagaaagatcaaat

SEQ ID NO: 5638829 - DNA, 14 bp, Homo sapiens
tatcagaaatacaa

SEQ ID NO: 5638830 - DNA, 14 bp, Homo sapiens
tatcagaaatgaaa

SEQ ID NO: 5638831 - DNA, 18 bp, Homo sapiens
tatcagaaatgaaacaga

SEQ ID NO: 5638832 - DNA, 20 bp, Homo sapiens
tatcagaactcctttctaag

SEQ ID NO: 5638833 - DNA, 13 bp, Homo sapiens
tatcagaatttgt

SEQ ID NO: 5638834 - DNA, 20 bp, Homo sapiens
tatcagaatttgtgttgaag

SEQ ID NO: 5638835 - DNA, 13 bp, Homo sapiens
tatcagacaagca

SEQ ID NO: 5638836 - DNA, 14 bp, Homo sapiens
tatcagacaagcac

SEQ ID NO: 5638837 - DNA, 15 bp, Homo sapiens
tatcagacaagcact

SEQ ID NO: 5638838 - DNA, 16 bp, Homo sapiens
tatcagacaagcacta

SEQ ID NO: 5638839 - DNA, 13 bp, Homo sapiens
tatcagacctctg

SEQ ID NO: 5638840 - DNA, 23 bp, Homo sapiens
tatcagacgtgctccctcccatc

SEQ ID NO: 5638841 - DNA, 21 bp, Homo sapiens
tatcagactcagttttttgta

SEQ ID NO: 5638842 - DNA, 13 bp, Homo sapiens
tatcagacttcac

SEQ ID NO: 5638843 - DNA, 22 bp, Homo sapiens
tatcagagctcttaatgttgct

SEQ ID NO: 5638844 - DNA, 17 bp, Homo sapiens
tatcagaggcctataat

SEQ ID NO: 5638845 - DNA, 18 bp, Homo sapiens
tatcagagtatccactgt

SEQ ID NO: 5638846 - DNA, 17 bp, Homo sapiens
tatcagatattttcata

SEQ ID NO: 5638847 - DNA, 18 bp, Homo sapiens
tatcagatattttcatat

SEQ ID NO: 5638848 - DNA, 15 bp, Homo sapiens
tatcagattgctttt

SEQ ID NO: 5638849 - DNA, 17 bp, Homo sapiens
tatcagattgcttttgt

SEQ ID NO: 5638850 - DNA, 16 bp, Homo sapiens
tatcagatttcattaa

SEQ ID NO: 5638851 - DNA, 14 bp, Homo sapiens
tatcagcaaaaaag

SEQ ID NO: 5638852 - DNA, 14 bp, Homo sapiens
tatcagcaaagaaa

SEQ ID NO: 5638853 - DNA, 21 bp, Homo sapiens
tatcagcaatgccccaaactt

SEQ ID NO: 5638854 - DNA, 14 bp, Homo sapiens
tatcagcactggat

SEQ ID NO: 5638855 - DNA, 15 bp, Homo sapiens
tatcagcagcaacaa

SEQ ID NO: 5638856 - DNA, 15 bp, Homo sapiens
tatcagcatgaagaa

SEQ ID NO: 5638857 - DNA, 11 bp, Homo sapiens
tatcagcctgt

SEQ ID NO: 5638858 - DNA, 13 bp, Homo sapiens
tatcagcctgtct

SEQ ID NO: 5638859 - DNA, 22 bp, Homo sapiens
tatcagcctgtctcttccatat

SEQ ID NO: 5638860 - DNA, 19 bp, Homo sapiens
tatcagcggccccttgact

SEQ ID NO: 5638861 - DNA, 21 bp, Homo sapiens
tatcagctctaaagcagagat

SEQ ID NO: 5638862 - DNA, 18 bp, Homo sapiens
tatcagctctatgtcaat

SEQ ID NO: 5638863 - DNA, 14 bp, Homo sapiens
tatcagctctctgc

SEQ ID NO: 5638864 - DNA, 16 bp, Homo sapiens
tatcagctctctgctg

SEQ ID NO: 5638865 - DNA, 18 bp, Homo sapiens
tatcagctctctgctggg

SEQ ID NO: 5638866 - DNA, 21 bp, Homo sapiens
tatcagctttgataattgtgt

SEQ ID NO: 5638867 - DNA, 20 bp, Homo sapiens
tatcaggacccagaggaagg

SEQ ID NO: 5638868 - DNA, 19 bp, Homo sapiens
tatcaggactgtgaccaaa

SEQ ID NO: 5638869 - DNA, 11 bp, Homo sapiens
tatcaggaggg

SEQ ID NO: 5638870 - DNA, 17 bp, Homo sapiens
tatcaggagtccactgc

SEQ ID NO: 5638871 - DNA, 19 bp, Homo sapiens
tatcaggagtccactgcct

SEQ ID NO: 5638872 - DNA, 14 bp, Homo sapiens
tatcaggcaagata

SEQ ID NO: 5638873 - DNA, 19 bp, Homo sapiens
tatcaggcacaggcaggaa

SEQ ID NO: 5638874 - DNA, 22 bp, Homo sapiens
tatcagggaaactaagattctt

SEQ ID NO: 5638875 - DNA, 15 bp, Homo sapiens
tatcagggaggaaga

SEQ ID NO: 5638876 - DNA, 17 bp, Homo sapiens
tatcagggcaagctcat

SEQ ID NO: 5638877 - DNA, 18 bp, Homo sapiens
tatcaggggaatttcagg

SEQ ID NO: 5638878 - DNA, 13 bp, Homo sapiens
tatcaggtaataa

SEQ ID NO: 5638879 - DNA, 23 bp, Homo sapiens
tatcaggtgcccatccctggaag

SEQ ID NO: 5638880 - DNA, 17 bp, Homo sapiens
tatcaggtgctgccatc

SEQ ID NO: 5638881 - DNA, 18 bp, Homo sapiens
tatcaggtgtataaatgt

SEQ ID NO: 5638882 - DNA, 21 bp, Homo sapiens
tatcaggtgtataaatgtaca

SEQ ID NO: 5638883 - DNA, 16 bp, Homo sapiens
tatcagtagaaagagt

SEQ ID NO: 5638884 - DNA, 17 bp, Homo sapiens
tatcagtagaaagagtg

SEQ ID NO: 5638885 - DNA, 20 bp, Homo sapiens
tatcagtagtgtacattacc

SEQ ID NO: 5638886 - DNA, 15 bp, Homo sapiens
tatcagtatggtgct

SEQ ID NO: 5638887 - DNA, 23 bp, Homo sapiens
tatcagtcatgacagatgaagaa

SEQ ID NO: 5638888 - DNA, 15 bp, Homo sapiens
tatcagtcatgagga

SEQ ID NO: 5638889 - DNA, 17 bp, Homo sapiens
tatcagtcgttttagtg

SEQ ID NO: 5638890 - DNA, 21 bp, Homo sapiens
tatcagtcgttttagtgtctg

SEQ ID NO: 5638891 - DNA, 15 bp, Homo sapiens
tatcagtgaagcagt

SEQ ID NO: 5638892 - DNA, 14 bp, Homo sapiens
tatcagtgaatata

SEQ ID NO: 5638893 - DNA, 22 bp, Homo sapiens
tatcagtgacagagttcactat

SEQ ID NO: 5638894 - DNA, 22 bp, Homo sapiens
tatcagtgacttctgaatcctt

SEQ ID NO: 5638895 - DNA, 23 bp, Homo sapiens
tatcagtgatggtctcacagagc

SEQ ID NO: 5638896 - DNA, 11 bp, Homo sapiens
tatcagtgctt

SEQ ID NO: 5638897 - DNA, 16 bp, Homo sapiens
tatcagtgcttaatgt

SEQ ID NO: 5638898 - DNA, 18 bp, Homo sapiens
tatcagtgctttgttgat

SEQ ID NO: 5638899 - DNA, 13 bp, Homo sapiens
tatcagtgtcctt

SEQ ID NO: 5638900 - DNA, 17 bp, Homo sapiens
tatcagtgtcctttcca

SEQ ID NO: 5638901 - DNA, 17 bp, Homo sapiens
tatcagtgttgtctcat

SEQ ID NO: 5638902 - DNA, 21 bp, Homo sapiens
tatcagtgttttaaattctga

SEQ ID NO: 5638903 - DNA, 20 bp, Homo sapiens
tatcagttaaaatcacattt

SEQ ID NO: 5638904 - DNA, 15 bp, Homo sapiens
tatcagttaacatta

SEQ ID NO: 5638905 - DNA, 15 bp, Homo sapiens
tatcagttactcagc

SEQ ID NO: 5638906 - DNA, 18 bp, Homo sapiens
tatcagttactcagccct

SEQ ID NO: 5638907 - DNA, 23 bp, Homo sapiens
tatcagttatcctttgtgagcct

SEQ ID NO: 5638908 - DNA, 20 bp, Homo sapiens
tatcagttatctgtttgtta

SEQ ID NO: 5638909 - DNA, 22 bp, Homo sapiens
tatcagtttgatcacactattt

SEQ ID NO: 5638910 - DNA, 18 bp, Homo sapiens
tatcagttttatagcttt

SEQ ID NO: 5638911 - DNA, 20 bp, Homo sapiens
tatcataaaggatatttcaa

SEQ ID NO: 5638912 - DNA, 21 bp, Homo sapiens
tatcataaaggatatttcaaa

SEQ ID NO: 5638913 - DNA, 13 bp, Homo sapiens
tatcataaagtat

SEQ ID NO: 5638914 - DNA, 15 bp, Homo sapiens
tatcataacatctgg

SEQ ID NO: 5638915 - DNA, 15 bp, Homo sapiens
tatcataatttcttt

SEQ ID NO: 5638916 - DNA, 18 bp, Homo sapiens
tatcataccctttattct

SEQ ID NO: 5638917 - DNA, 21 bp, Homo sapiens
tatcatacgttgatagtttac

SEQ ID NO: 5638918 - DNA, 15 bp, Homo sapiens
tatcatactgagact

SEQ ID NO: 5638919 - DNA, 14 bp, Homo sapiens
tatcatactgattt

SEQ ID NO: 5638920 - DNA, 20 bp, Homo sapiens
tatcatactgttttgaataa

SEQ ID NO: 5638921 - DNA, 15 bp, Homo sapiens
tatcataggtacaat

SEQ ID NO: 5638922 - DNA, 15 bp, Homo sapiens
tatcatataaacatt

SEQ ID NO: 5638923 - DNA, 17 bp, Homo sapiens
tatcatataaacatttt

SEQ ID NO: 5638924 - DNA, 20 bp, Homo sapiens
tatcatataaacattttatt

SEQ ID NO: 5638925 - DNA, 21 bp, Homo sapiens
tatcatatatatacatacatg

SEQ ID NO: 5638926 - DNA, 15 bp, Homo sapiens
tatcatatattaaaa

SEQ ID NO: 5638927 - DNA, 21 bp, Homo sapiens
tatcatatattaaaacaataa

SEQ ID NO: 5638928 - DNA, 15 bp, Homo sapiens
tatcatatatttaat

SEQ ID NO: 5638929 - DNA, 19 bp, Homo sapiens
tatcatatatttaatctta

SEQ ID NO: 5638930 - DNA, 21 bp, Homo sapiens
tatcatatgtatctaaatgaa

SEQ ID NO: 5638931 - DNA, 20 bp, Homo sapiens
tatcatattaacatattcta

SEQ ID NO: 5638932 - DNA, 14 bp, Homo sapiens
tatcatattattat

SEQ ID NO: 5638933 - DNA, 18 bp, Homo sapiens
tatcatattctaaaagta

SEQ ID NO: 5638934 - DNA, 20 bp, Homo sapiens
tatcatcacaaatggctaca

SEQ ID NO: 5638935 - DNA, 21 bp, Homo sapiens
tatcatcagcatacctttatt

SEQ ID NO: 5638936 - DNA, 16 bp, Homo sapiens
tatcatcagtattgaa

SEQ ID NO: 5638937 - DNA, 14 bp, Homo sapiens
tatcatccacacat

SEQ ID NO: 5638938 - DNA, 15 bp, Homo sapiens
tatcatccacacatg

SEQ ID NO: 5638939 - DNA, 15 bp, Homo sapiens
tatcatcccaacagc

SEQ ID NO: 5638940 - DNA, 19 bp, Homo sapiens
tatcatcccaacagccaag

SEQ ID NO: 5638941 - DNA, 12 bp, Homo sapiens
tatcatcggagt

SEQ ID NO: 5638942 - DNA, 12 bp, Homo sapiens
tatcatctaaat

SEQ ID NO: 5638943 - DNA, 23 bp, Homo sapiens
tatcatctccatcatatgcctga

SEQ ID NO: 5638944 - DNA, 15 bp, Homo sapiens
tatcatctcttaaat

SEQ ID NO: 5638945 - DNA, 19 bp, Homo sapiens
tatcatctggataggagcc

SEQ ID NO: 5638946 - DNA, 13 bp, Homo sapiens
tatcatctgtcat

SEQ ID NO: 5638947 - DNA, 20 bp, Homo sapiens
tatcatgaaacacttctcat

SEQ ID NO: 5638948 - DNA, 19 bp, Homo sapiens
tatctatatcatatttctg

SEQ ID NO: 5638949 - DNA, 16 bp, Homo sapiens
tatctatatgtacttg

SEQ ID NO: 5638950 - DNA, 16 bp, Homo sapiens
tatctatattctaaag

SEQ ID NO: 5638951 - DNA, 23 bp, Homo sapiens
tatctatattttacataaattta

SEQ ID NO: 5638952 - DNA, 18 bp, Homo sapiens
tatctatcctgaatctaa

SEQ ID NO: 5638953 - DNA, 14 bp, Homo sapiens
tatctatcggaaga

SEQ ID NO: 5638954 - DNA, 16 bp, Homo sapiens
tatctatcggaagaac

SEQ ID NO: 5638955 - DNA, 20 bp, Homo sapiens
tatctatcggaagaacatga

SEQ ID NO: 5638956 - DNA, 17 bp, Homo sapiens
tatctatctatttgagg

SEQ ID NO: 5638957 - DNA, 14 bp, Homo sapiens
tatctatgaaaacc

SEQ ID NO: 5638958 - DNA, 14 bp, Homo sapiens
tatctatggaaatg

SEQ ID NO: 5638959 - DNA, 17 bp, Homo sapiens
tatctatggaaatgtga

SEQ ID NO: 5638960 - DNA, 15 bp, Homo sapiens
tatctatgtcctgga

SEQ ID NO: 5638961 - DNA, 17 bp, Homo sapiens
tatctatgtggaaaaca

SEQ ID NO: 5638962 - DNA, 16 bp, Homo sapiens
tatctatgttttacca

SEQ ID NO: 5638963 - DNA, 20 bp, Homo sapiens
tatctattaaaattgccatt

SEQ ID NO: 5638964 - DNA, 19 bp, Homo sapiens
tatctattaaagtgacttt

SEQ ID NO: 5638965 - DNA, 12 bp, Homo sapiens
tatctattaata

SEQ ID NO: 5638966 - DNA, 17 bp, Homo sapiens
tatctattaatatatgt

SEQ ID NO: 5638967 - DNA, 13 bp, Homo sapiens
tatctattagata

SEQ ID NO: 5638968 - DNA, 18 bp, Homo sapiens
tatctattctgagaaaac

SEQ ID NO: 5638969 - DNA, 18 bp, Homo sapiens
tatctatttatctgtctg

SEQ ID NO: 5638970 - DNA, 19 bp, Homo sapiens
tatctatttatctgtctga

SEQ ID NO: 5638971 - DNA, 17 bp, Homo sapiens
tatctatttgaataaat

SEQ ID NO: 5638972 - DNA, 20 bp, Homo sapiens
tatctatttgtatatataca

SEQ ID NO: 5638973 - DNA, 14 bp, Homo sapiens
tatctcaaattgta

SEQ ID NO: 5638974 - DNA, 15 bp, Homo sapiens
tatctcaactctgtt

SEQ ID NO: 5638975 - DNA, 16 bp, Homo sapiens
tatctcaactctgttt

SEQ ID NO: 5638976 - DNA, 21 bp, Homo sapiens
tatctcaactctgtttatttg

SEQ ID NO: 5638977 - DNA, 18 bp, Homo sapiens
tatctcaagataggaaga

SEQ ID NO: 5638978 - DNA, 19 bp, Homo sapiens
tatctcaagtaaaacaaat

SEQ ID NO: 5638979 - DNA, 15 bp, Homo sapiens
tatctcaatctgcag

SEQ ID NO: 5638980 - DNA, 16 bp, Homo sapiens
tatctcaatgaaccat

SEQ ID NO: 5638981 - DNA, 16 bp, Homo sapiens
tatctcacagcacact

SEQ ID NO: 5638982 - DNA, 23 bp, Homo sapiens
tatctcacctaatggttgtacat

SEQ ID NO: 5638983 - DNA, 16 bp, Homo sapiens
tatctcactgttttat

SEQ ID NO: 5638984 - DNA, 19 bp, Homo sapiens
tatctcagaaagtgcctga

SEQ ID NO: 5638985 - DNA, 16 bp, Homo sapiens
tatctcagatatttgc

SEQ ID NO: 5638986 - DNA, 17 bp, Homo sapiens
tatctcagatatttgca

SEQ ID NO: 5638987 - DNA, 15 bp, Homo sapiens
tatctcagatgttaa

SEQ ID NO: 5638988 - DNA, 19 bp, Homo sapiens
tatctcagatgttaaaata

SEQ ID NO: 5638989 - DNA, 13 bp, Homo sapiens
tatctcagccata

SEQ ID NO: 5638990 - DNA, 19 bp, Homo sapiens
tatctcaggaagtccagcc

SEQ ID NO: 5638991 - DNA, 18 bp, Homo sapiens
tatctcagggagggaagg

SEQ ID NO: 5638992 - DNA, 21 bp, Homo sapiens
tatctcagtctaaggtctcat

SEQ ID NO: 5638993 - DNA, 17 bp, Homo sapiens
tatctcatactgtctgg

SEQ ID NO: 5638994 - DNA, 21 bp, Homo sapiens
tatctcatagggatgctgtga

SEQ ID NO: 5638995 - DNA, 16 bp, Homo sapiens
tatctcatctgtctcg

SEQ ID NO: 5638996 - DNA, 21 bp, Homo sapiens
tatctcatgccagtgccttat

SEQ ID NO: 5638997 - DNA, 13 bp, Homo sapiens
tatctcattgcaa

SEQ ID NO: 5638998 - DNA, 22 bp, Homo sapiens
tatctccagccaatttcaaaga

SEQ ID NO: 5638999 - DNA, 16 bp, Homo sapiens
tatctccatactttgg

SEQ ID NO: 5639000 - DNA, 18 bp, Homo sapiens
tatctccatactttggat

SEQ ID NO: 5639001 - DNA, 23 bp, Homo sapiens
tatctccatccttaactgtccag

SEQ ID NO: 5639002 - DNA, 17 bp, Homo sapiens
tatctccatggccctgt

SEQ ID NO: 5639003 - DNA, 13 bp, Homo sapiens
tatctccctgctt

SEQ ID NO: 5639004 - DNA, 18 bp, Homo sapiens
tatctccctgcttcatat

SEQ ID NO: 5639005 - DNA, 19 bp, Homo sapiens
tatctccctggagaagcac

SEQ ID NO: 5639006 - DNA, 12 bp, Homo sapiens
tatctccctggc

SEQ ID NO: 5639007 - DNA, 19 bp, Homo sapiens
tatctccggctcccagcct

SEQ ID NO: 5639008 - DNA, 20 bp, Homo sapiens
tatctccggctcccagcctc

SEQ ID NO: 5639009 - DNA, 11 bp, Homo sapiens
tatctcctgac

SEQ ID NO: 5639010 - DNA, 19 bp, Homo sapiens
tatctccttcccaccccta

SEQ ID NO: 5639011 - DNA, 20 bp, Homo sapiens
tatctccttcccacccctac

SEQ ID NO: 5639012 - DNA, 20 bp, Homo sapiens
tatctcctttgaagaaggca

SEQ ID NO: 5639013 - DNA, 23 bp, Homo sapiens
tatctcctttgaagaaggcaagg

SEQ ID NO: 5639014 - DNA, 19 bp, Homo sapiens
tatctcgaatttgaagaga

SEQ ID NO: 5639015 - DNA, 20 bp, Homo sapiens
tatctcgctagccatatatt

SEQ ID NO: 5639016 - DNA, 19 bp, Homo sapiens
tatctcggactttgcagga

SEQ ID NO: 5639017 - DNA, 22 bp, Homo sapiens
tatctcgtaatagcttctgtgt

SEQ ID NO: 5639018 - DNA, 12 bp, Homo sapiens
tatctctacttt

SEQ ID NO: 5639019 - DNA, 15 bp, Homo sapiens
tatctctactttcct

SEQ ID NO: 5639020 - DNA, 21 bp, Homo sapiens
tatctctagatgcaaatacat

SEQ ID NO: 5639021 - DNA, 17 bp, Homo sapiens
tatctctaggctgtttt

SEQ ID NO: 5639022 - DNA, 16 bp, Homo sapiens
tatctctagtccctgt

SEQ ID NO: 5639023 - DNA, 22 bp, Homo sapiens
tatctctagtccctgtgttctg

SEQ ID NO: 5639024 - DNA, 16 bp, Homo sapiens
tatctctatttaatat

SEQ ID NO: 5639025 - DNA, 14 bp, Homo sapiens
tatctctcccttct

SEQ ID NO: 5639026 - DNA, 18 bp, Homo sapiens
tatctctcccttctttac

SEQ ID NO: 5639027 - DNA, 12 bp, Homo sapiens
tatctctctgtg

SEQ ID NO: 5639028 - DNA, 16 bp, Homo sapiens
tatctctgaagcatgt

SEQ ID NO: 5639029 - DNA, 18 bp, Homo sapiens
tatctctgaagcatgttt

SEQ ID NO: 5639030 - DNA, 22 bp, Homo sapiens
tatctctgccaacatgaggaca

SEQ ID NO: 5639031 - DNA, 11 bp, Homo sapiens
tatctctgccg

SEQ ID NO: 5639032 - DNA, 16 bp, Homo sapiens
tatctctgccgtctct

SEQ ID NO: 5639033 - DNA, 20 bp, Homo sapiens
tatctctgtctaccatctcc

SEQ ID NO: 5639034 - DNA, 18 bp, Homo sapiens
tatctctgtgtgcacaaa

SEQ ID NO: 5639035 - DNA, 12 bp, Homo sapiens
tatctcttcagt

SEQ ID NO: 5639036 - DNA, 14 bp, Homo sapiens
tatctcttcctgtc

SEQ ID NO: 5639037 - DNA, 13 bp, Homo sapiens
tatctcttgccct

SEQ ID NO: 5639038 - DNA, 14 bp, Homo sapiens
tatctcttggaaaa

SEQ ID NO: 5639039 - DNA, 19 bp, Homo sapiens
tatctcttggaaaataaga

SEQ ID NO: 5639040 - DNA, 18 bp, Homo sapiens
tatctctttctctctttc

SEQ ID NO: 5639041 - DNA, 17 bp, Homo sapiens
tatctctttctttctct

SEQ ID NO: 5639042 - DNA, 18 bp, Homo sapiens
tatctctttgatctactt

SEQ ID NO: 5639043 - DNA, 22 bp, Homo sapiens
tatctctttgatctacttgcct

SEQ ID NO: 5639044 - DNA, 16 bp, Homo sapiens
tatctcttttatattt

SEQ ID NO: 5639045 - DNA, 23 bp, Homo sapiens
tatctcttttgaatccatgcttg

SEQ ID NO: 5639046 - DNA, 13 bp, Homo sapiens
tatctgaaagtca

SEQ ID NO: 5639047 - DNA, 14 bp, Homo sapiens
tatctgaacacata

SEQ ID NO: 5639048 - DNA, 21 bp, Homo sapiens
tatctgaacacatactagaaa

SEQ ID NO: 5639049 - DNA, 22 bp, Homo sapiens
tatctgaacacatactagaaag

SEQ ID NO: 5639050 - DNA, 14 bp, Homo sapiens
tatctgaaccaaga

SEQ ID NO: 5639051 - DNA, 14 bp, Homo sapiens
tatctgaagggaat

SEQ ID NO: 5639052 - DNA, 12 bp, Homo sapiens
tatctgaatgtt

SEQ ID NO: 5639053 - DNA, 20 bp, Homo sapiens
tatctgaatttttaaacaag

SEQ ID NO: 5639054 - DNA, 18 bp, Homo sapiens
tatctgacatctctgcaa

SEQ ID NO: 5639055 - DNA, 23 bp, Homo sapiens
tatctgacccactttgtaatttt

SEQ ID NO: 5639056 - DNA, 21 bp, Homo sapiens
tatctgagcgtttaaagtact

SEQ ID NO: 5639057 - DNA, 16 bp, Homo sapiens
tatctgaggaattctg

SEQ ID NO: 5639058 - DNA, 18 bp, Homo sapiens
tatctgaggaattctgta

SEQ ID NO: 5639059 - DNA, 23 bp, Homo sapiens
tatctgaggcactgataatatgt

SEQ ID NO: 5639060 - DNA, 17 bp, Homo sapiens
tatctgagttgccaaga

SEQ ID NO: 5639061 - DNA, 17 bp, Homo sapiens
tatctgagttgtgcctc

SEQ ID NO: 5639062 - DNA, 15 bp, Homo sapiens
tatctgataaaattg

SEQ ID NO: 5639063 - DNA, 21 bp, Homo sapiens
tatctgatcgggataacaaaa

SEQ ID NO: 5639064 - DNA, 16 bp, Homo sapiens
tatctgatcttcctca

SEQ ID NO: 5639065 - DNA, 16 bp, Homo sapiens
tatctgattcctttaa

SEQ ID NO: 5639066 - DNA, 22 bp, Homo sapiens
tatctgattttgtgcaaaagct

SEQ ID NO: 5639067 - DNA, 23 bp, Homo sapiens
tatctgcaatgtttttgtgtaga

SEQ ID NO: 5639068 - DNA, 12 bp, Homo sapiens
tatctgcactct

SEQ ID NO: 5639069 - DNA, 21 bp, Homo sapiens
tatctgcactctaaactgcaa

SEQ ID NO: 5639070 - DNA, 16 bp, Homo sapiens
tatctgcagaatgggc

SEQ ID NO: 5639071 - DNA, 13 bp, Homo sapiens
tatctgcatatgt

SEQ ID NO: 5639072 - DNA, 11 bp, Homo sapiens
tatctgcattt

SEQ ID NO: 5639073 - DNA, 19 bp, Homo sapiens
tatctgcatttaccactgt

SEQ ID NO: 5639074 - DNA, 21 bp, Homo sapiens
tatctgccaaattgagataat

SEQ ID NO: 5639075 - DNA, 18 bp, Homo sapiens
tatctgcccctcccccac

SEQ ID NO: 5639076 - DNA, 20 bp, Homo sapiens
tatctgcccctcccccactt

SEQ ID NO: 5639077 - DNA, 14 bp, Homo sapiens
tatctgcctgacag

SEQ ID NO: 5639078 - DNA, 18 bp, Homo sapiens
tatctgcctggcctggct

SEQ ID NO: 5639079 - DNA, 19 bp, Homo sapiens
tatctgcctggcctggctc

SEQ ID NO: 5639080 - DNA, 20 bp, Homo sapiens
tatctgctgcctctgaaaat

SEQ ID NO: 5639081 - DNA, 15 bp, Homo sapiens
tatctgctgtatgtc

SEQ ID NO: 5639082 - DNA, 17 bp, Homo sapiens
tatctgctgtccagaca

SEQ ID NO: 5639083 - DNA, 13 bp, Homo sapiens
tatctgctgttct

SEQ ID NO: 5639084 - DNA, 16 bp, Homo sapiens
tatctgctgttcttca

SEQ ID NO: 5639085 - DNA, 17 bp, Homo sapiens
tatctgctgttcttcag

SEQ ID NO: 5639086 - DNA, 12 bp, Homo sapiens
tatctggaattt

SEQ ID NO: 5639087 - DNA, 22 bp, Homo sapiens
tatctggccccaggtagaaact

SEQ ID NO: 5639088 - DNA, 23 bp, Homo sapiens
tatctggccctcgacactcacca

SEQ ID NO: 5639089 - DNA, 19 bp, Homo sapiens
tatctggcctaaaatcttg

SEQ ID NO: 5639090 - DNA, 17 bp, Homo sapiens
tatctggcttccctgga

SEQ ID NO: 5639091 - DNA, 18 bp, Homo sapiens
tatctgggaactgtgcct

SEQ ID NO: 5639092 - DNA, 21 bp, Homo sapiens
tatctgggagatgacctgcct

SEQ ID NO: 5639093 - DNA, 18 bp, Homo sapiens
tatctgggattattcttt

SEQ ID NO: 5639094 - DNA, 22 bp, Homo sapiens
tatctgggattattctttgaaa

SEQ ID NO: 5639095 - DNA, 16 bp, Homo sapiens
tatctgggcttaataa

SEQ ID NO: 5639096 - DNA, 18 bp, Homo sapiens
tatctgggcttcctggag

SEQ ID NO: 5639097 - DNA, 22 bp, Homo sapiens
tatctgggtaagaagaaagcaa

SEQ ID NO: 5639098 - DNA, 22 bp, Homo sapiens
tatctgggttttagaaattcta

SEQ ID NO: 5639099 - DNA, 22 bp, Homo sapiens
tatctggtatatgtcattattt

SEQ ID NO: 5639100 - DNA, 16 bp, Homo sapiens
tatctggtatctgcat

SEQ ID NO: 5639101 - DNA, 16 bp, Homo sapiens
tatctggttatatcat

SEQ ID NO: 5639102 - DNA, 21 bp, Homo sapiens
tatctgtaaatttaactgcat

SEQ ID NO: 5639103 - DNA, 17 bp, Homo sapiens
tatctgtaacactatta

SEQ ID NO: 5639104 - DNA, 23 bp, Homo sapiens
tatctgtaacccttgaatttcta

SEQ ID NO: 5639105 - DNA, 21 bp, Homo sapiens
tatctgtaatatataatcaaa

SEQ ID NO: 5639106 - DNA, 22 bp, Homo sapiens
tatctgtacatactttttcaag

SEQ ID NO: 5639107 - DNA, 24 bp, Homo sapiens
tatctgtacctgcccccactcagc

SEQ ID NO: 5639108 - DNA, 17 bp, Homo sapiens
tatctgtattggcagca

SEQ ID NO: 5639109 - DNA, 19 bp, Homo sapiens
tatctgtattggcagcaca

SEQ ID NO: 5639110 - DNA, 21 bp, Homo sapiens
tatctgtattggcagcacagc

SEQ ID NO: 5639111 - DNA, 13 bp, Homo sapiens
tatctgtatttat

SEQ ID NO: 5639112 - DNA, 15 bp, Homo sapiens
tatctgtcagctgca

SEQ ID NO: 5639113 - DNA, 20 bp, Homo sapiens
tatctgtcatttgagcaggg

SEQ ID NO: 5639114 - DNA, 17 bp, Homo sapiens
tatctgtcccctgctac

SEQ ID NO: 5639115 - DNA, 12 bp, Homo sapiens
tatctgtctact

SEQ ID NO: 5639116 - DNA, 21 bp, Homo sapiens
tatctgtctactttctcttgt

SEQ ID NO: 5639117 - DNA, 12 bp, Homo sapiens
tatctgtctgag

SEQ ID NO: 5639118 - DNA, 19 bp, Homo sapiens
tatctgtctgagccctgcc

SEQ ID NO: 5639119 - DNA, 14 bp, Homo sapiens
tatctgtctttatg

SEQ ID NO: 5639120 - DNA, 15 bp, Homo sapiens
tatctgtctttatga

SEQ ID NO: 5639121 - DNA, 17 bp, Homo sapiens
tatctgtgaaatatcat

SEQ ID NO: 5639122 - DNA, 20 bp, Homo sapiens
tatctgtgcttctaatatta

SEQ ID NO: 5639123 - DNA, 22 bp, Homo sapiens
tatctgtggagttcctgctccg

SEQ ID NO: 5639124 - DNA, 23 bp, Homo sapiens
tatctgtggattcagcttctgtt

SEQ ID NO: 5639125 - DNA, 16 bp, Homo sapiens
tatgatttcattatca

SEQ ID NO: 5639126 - DNA, 14 bp, Homo sapiens
tatgatttccttca

SEQ ID NO: 5639127 - DNA, 18 bp, Homo sapiens
tatgatttccttcaatgt

SEQ ID NO: 5639128 - DNA, 14 bp, Homo sapiens
tatgatttctgaat

SEQ ID NO: 5639129 - DNA, 14 bp, Homo sapiens
tatgatttgttcct

SEQ ID NO: 5639130 - DNA, 17 bp, Homo sapiens
tatgatttgttcctttc

SEQ ID NO: 5639131 - DNA, 16 bp, Homo sapiens
tatgatttgttttgaa

SEQ ID NO: 5639132 - DNA, 18 bp, Homo sapiens
tatgattttatttaaact

SEQ ID NO: 5639133 - DNA, 17 bp, Homo sapiens
tatgatttttacaataa

SEQ ID NO: 5639134 - DNA, 16 bp, Homo sapiens
tatgattttttaaaag

SEQ ID NO: 5639135 - DNA, 17 bp, Homo sapiens
tatgattttttaaaaga

SEQ ID NO: 5639136 - DNA, 18 bp, Homo sapiens
tatgattttttaaaagaa

SEQ ID NO: 5639137 - DNA, 16 bp, Homo sapiens
tatgattttttcatga

SEQ ID NO: 5639138 - DNA, 14 bp, Homo sapiens
tatgcaaaactttt

SEQ ID NO: 5639139 - DNA, 22 bp, Homo sapiens
tatgcaaaagcagctaaatgta

SEQ ID NO: 5639140 - DNA, 11 bp, Homo sapiens
tatgcaaaagg

SEQ ID NO: 5639141 - DNA, 22 bp, Homo sapiens
tatgcaaaagttctgacttgac

SEQ ID NO: 5639142 - DNA, 22 bp, Homo sapiens
tatgcaaaatagacatctttaa

SEQ ID NO: 5639143 - DNA, 18 bp, Homo sapiens
tatgcaaaatttagaaga

SEQ ID NO: 5639144 - DNA, 13 bp, Homo sapiens
tatgcaaagcact

SEQ ID NO: 5639145 - DNA, 14 bp, Homo sapiens
tatgcaaagcactg

SEQ ID NO: 5639146 - DNA, 15 bp, Homo sapiens
tatgcaaagcactga

SEQ ID NO: 5639147 - DNA, 13 bp, Homo sapiens
tatgcaaatacaa

SEQ ID NO: 5639148 - DNA, 14 bp, Homo sapiens
tatgcaaattccca

SEQ ID NO: 5639149 - DNA, 15 bp, Homo sapiens
tatgcaagcagcttt

SEQ ID NO: 5639150 - DNA, 17 bp, Homo sapiens
tatgcaagcagtttcaa

SEQ ID NO: 5639151 - DNA, 17 bp, Homo sapiens
tatgcaaggaaggaaag

SEQ ID NO: 5639152 - DNA, 16 bp, Homo sapiens
tatgcaaggggaaacc

SEQ ID NO: 5639153 - DNA, 23 bp, Homo sapiens
tatgcaagtcgccaggcaggagg

SEQ ID NO: 5639154 - DNA, 13 bp, Homo sapiens
tatgcaagtggga

SEQ ID NO: 5639155 - DNA, 21 bp, Homo sapiens
tatgcaataaaattatttgca

SEQ ID NO: 5639156 - DNA, 14 bp, Homo sapiens
tatgcaataaatat

SEQ ID NO: 5639157 - DNA, 16 bp, Homo sapiens
tatgcaataaatatta

SEQ ID NO: 5639158 - DNA, 18 bp, Homo sapiens
tatgcaataatccacccc

SEQ ID NO: 5639159 - DNA, 16 bp, Homo sapiens
tatgcaatatatgttc

SEQ ID NO: 5639160 - DNA, 20 bp, Homo sapiens
tatgcaatgtatagtgtcta

SEQ ID NO: 5639161 - DNA, 16 bp, Homo sapiens
tatgcaattcagtgtt

SEQ ID NO: 5639162 - DNA, 19 bp, Homo sapiens
tatgcaatttttaaactag

SEQ ID NO: 5639163 - DNA, 23 bp, Homo sapiens
tatgcacaccaaattgctgagat

SEQ ID NO: 5639164 - DNA, 22 bp, Homo sapiens
tatgcacacttttaattttgtc

SEQ ID NO: 5639165 - DNA, 15 bp, Homo sapiens
tatgcacagagccca

SEQ ID NO: 5639166 - DNA, 12 bp, Homo sapiens
tatgcacagcct

SEQ ID NO: 5639167 - DNA, 13 bp, Homo sapiens
tatgcacatatgg

SEQ ID NO: 5639168 - DNA, 19 bp, Homo sapiens
tatgcacatatggactctg

SEQ ID NO: 5639169 - DNA, 20 bp, Homo sapiens
tatgcacatatggactctgc

SEQ ID NO: 5639170 - DNA, 20 bp, Homo sapiens
tatgcaccaggtctcaaggt

SEQ ID NO: 5639171 - DNA, 18 bp, Homo sapiens
tatgcacctataaatact

SEQ ID NO: 5639172 - DNA, 17 bp, Homo sapiens
tatgcacgaccttggga

SEQ ID NO: 5639173 - DNA, 23 bp, Homo sapiens
tatgcacgttaacagcgtgtcaa

SEQ ID NO: 5639174 - DNA, 16 bp, Homo sapiens
tatgcactaaatatga

SEQ ID NO: 5639175 - DNA, 16 bp, Homo sapiens
tatgcactaagtctct

SEQ ID NO: 5639176 - DNA, 17 bp, Homo sapiens
tatgcactaatcaatac

SEQ ID NO: 5639177 - DNA, 22 bp, Homo sapiens
tatgcactgaagagctcttggc

SEQ ID NO: 5639178 - DNA, 13 bp, Homo sapiens
tatgcactggcca

SEQ ID NO: 5639179 - DNA, 23 bp, Homo sapiens
tatgcactgtggtttcagatgtg

SEQ ID NO: 5639180 - DNA, 22 bp, Homo sapiens
tatgcacttataattttcctaa

SEQ ID NO: 5639181 - DNA, 17 bp, Homo sapiens
tatgcactttccctaga

SEQ ID NO: 5639182 - DNA, 18 bp, Homo sapiens
tatgcacttttccccaat

SEQ ID NO: 5639183 - DNA, 22 bp, Homo sapiens
tatgcagaaatagacaaaaagt

SEQ ID NO: 5639184 - DNA, 18 bp, Homo sapiens
tatgcagaacacatttca

SEQ ID NO: 5639185 - DNA, 16 bp, Homo sapiens
tatgcagaatggcatt

SEQ ID NO: 5639186 - DNA, 18 bp, Homo sapiens
tatgcagacatctctgga

SEQ ID NO: 5639187 - DNA, 21 bp, Homo sapiens
tatgcagacatctctggagcc

SEQ ID NO: 5639188 - DNA, 12 bp, Homo sapiens
tatgcagagctt

SEQ ID NO: 5639189 - DNA, 18 bp, Homo sapiens
tatgcagaggtccacaac

SEQ ID NO: 5639190 - DNA, 18 bp, Homo sapiens
tatgcagatacttattaa

SEQ ID NO: 5639191 - DNA, 16 bp, Homo sapiens
tatgcagcaaatatat

SEQ ID NO: 5639192 - DNA, 13 bp, Homo sapiens
tatgcagccaacc

SEQ ID NO: 5639193 - DNA, 12 bp, Homo sapiens
tatgcagcctgc

SEQ ID NO: 5639194 - DNA, 15 bp, Homo sapiens
tatgcagcctgctct

SEQ ID NO: 5639195 - DNA, 20 bp, Homo sapiens
tatgcagcttggagacagga

SEQ ID NO: 5639196 - DNA, 21 bp, Homo sapiens
tatgcaggcagattaataaca

SEQ ID NO: 5639197 - DNA, 13 bp, Homo sapiens
tatgcagggaggc

SEQ ID NO: 5639198 - DNA, 18 bp, Homo sapiens
tatgcagtactaaaatta

SEQ ID NO: 5639199 - DNA, 19 bp, Homo sapiens
tatgcagtattgagcactg

SEQ ID NO: 5639200 - DNA, 23 bp, Homo sapiens
tatgcagtctctttattttacta

SEQ ID NO: 5639201 - DNA, 13 bp, Homo sapiens
tatgcagtgaact

SEQ ID NO: 5639202 - DNA, 18 bp, Homo sapiens
tatgcagtgaactatttt

SEQ ID NO: 5639203 - DNA, 23 bp, Homo sapiens
tatgcagttgataagaggaattt

SEQ ID NO: 5639204 - DNA, 17 bp, Homo sapiens
tatgcataaaaaaatga

SEQ ID NO: 5639205 - DNA, 13 bp, Homo sapiens
tatgcataaagcc

SEQ ID NO: 5639206 - DNA, 17 bp, Homo sapiens
tatgcatatatatgtat

SEQ ID NO: 5639207 - DNA, 23 bp, Homo sapiens
tatgcatcagataacaactgtga

SEQ ID NO: 5639208 - DNA, 17 bp, Homo sapiens
tatgcatcatttcagga

SEQ ID NO: 5639209 - DNA, 18 bp, Homo sapiens
tatgcatcatttcaggag

SEQ ID NO: 5639210 - DNA, 17 bp, Homo sapiens
tatgcatctttgagaat

SEQ ID NO: 5639211 - DNA, 13 bp, Homo sapiens
tatgcatgaagta

SEQ ID NO: 5639212 - DNA, 22 bp, Homo sapiens
tatgcatgaagtaatatgcaca

SEQ ID NO: 5639213 - DNA, 16 bp, Homo sapiens
tatgcatgagaactaa

SEQ ID NO: 5639214 - DNA, 17 bp, Homo sapiens
tatgcatgcagtcttgt

SEQ ID NO: 5639215 - DNA, 12 bp, Homo sapiens
tatgcatgccag

SEQ ID NO: 5639216 - DNA, 18 bp, Homo sapiens
tatgcatgcccttccttt

SEQ ID NO: 5639217 - DNA, 19 bp, Homo sapiens
tatgcatgctaaattatta

SEQ ID NO: 5639218 - DNA, 20 bp, Homo sapiens
tatgcatggaaacctgaaaa

SEQ ID NO: 5639219 - DNA, 20 bp, Homo sapiens
tatgcatggtgccccaggac

SEQ ID NO: 5639220 - DNA, 23 bp, Homo sapiens
tatgcatggtgccccaggaccag

SEQ ID NO: 5639221 - DNA, 22 bp, Homo sapiens
tatgcatggtgtagatgccctg

SEQ ID NO: 5639222 - DNA, 18 bp, Homo sapiens
tatgcatggtttcagcac

SEQ ID NO: 5639223 - DNA, 19 bp, Homo sapiens
tatgcatggtttcagcact

SEQ ID NO: 5639224 - DNA, 20 bp, Homo sapiens
tatgcatggtttcagcacta

SEQ ID NO: 5639225 - DNA, 15 bp, Homo sapiens
tatgcatgtagcata

SEQ ID NO: 5639226 - DNA, 14 bp, Homo sapiens
tatgcatgtgtgtg

SEQ ID NO: 5639227 - DNA, 22 bp, Homo sapiens
tatgcatgttgtctaagaaatt

SEQ ID NO: 5639228 - DNA, 12 bp, Homo sapiens
tatgcattcaca

SEQ ID NO: 5639229 - DNA, 12 bp, Homo sapiens
tatgcattcttt

SEQ ID NO: 5639230 - DNA, 21 bp, Homo sapiens
tatgcatttaaatacagtctt

SEQ ID NO: 5639231 - DNA, 12 bp, Homo sapiens
tatgcatttatg

SEQ ID NO: 5639232 - DNA, 14 bp, Homo sapiens
tatgcatttatgca

SEQ ID NO: 5639233 - DNA, 16 bp, Homo sapiens
tatgcatttatgcatg

SEQ ID NO: 5639234 - DNA, 13 bp, Homo sapiens
tatgcatttcatt

SEQ ID NO: 5639235 - DNA, 23 bp, Homo sapiens
tatgcatttcattcaaatcagtg

SEQ ID NO: 5639236 - DNA, 24 bp, Homo sapiens
tatgcatttgaaaattttgatgtt

SEQ ID NO: 5639237 - DNA, 15 bp, Homo sapiens
tatgcattttcttca

SEQ ID NO: 5639238 - DNA, 16 bp, Homo sapiens
tatgcattttcttcac

SEQ ID NO: 5639239 - DNA, 20 bp, Homo sapiens
tatgcattttcttcacagtg

SEQ ID NO: 5639240 - DNA, 19 bp, Homo sapiens
tatgccaaatgttaactgc

SEQ ID NO: 5639241 - DNA, 19 bp, Homo sapiens
tatgccaagtccctggaaa

SEQ ID NO: 5639242 - DNA, 23 bp, Homo sapiens
tatgccaccagcgaactctcaga

SEQ ID NO: 5639243 - DNA, 14 bp, Homo sapiens
tatgccacctgcag

SEQ ID NO: 5639244 - DNA, 15 bp, Homo sapiens
tatgccacctgcagc

SEQ ID NO: 5639245 - DNA, 16 bp, Homo sapiens
tatgccacctgcagcg

SEQ ID NO: 5639246 - DNA, 20 bp, Homo sapiens
tatgccacctgcagcgtctg

SEQ ID NO: 5639247 - DNA, 22 bp, Homo sapiens
tatgccactgcactccagcctg

SEQ ID NO: 5639248 - DNA, 14 bp, Homo sapiens
tatgccacttcctt

SEQ ID NO: 5639249 - DNA, 14 bp, Homo sapiens
tatgccagctcagt

SEQ ID NO: 5639250 - DNA, 23 bp, Homo sapiens
tatgccagcttggacatcagtgt

SEQ ID NO: 5639251 - DNA, 17 bp, Homo sapiens
tatgccaggctgtgcta

SEQ ID NO: 5639252 - DNA, 22 bp, Homo sapiens
tatgccagtgactgctgcgctg

SEQ ID NO: 5639253 - DNA, 14 bp, Homo sapiens
tatgccatgatgga

SEQ ID NO: 5639254 - DNA, 18 bp, Homo sapiens
tatgccatgatttttggt

SEQ ID NO: 5639255 - DNA, 18 bp, Homo sapiens
tatgccatgttaatattt

SEQ ID NO: 5639256 - DNA, 14 bp, Homo sapiens
tatgccattaaaaa

SEQ ID NO: 5639257 - DNA, 16 bp, Homo sapiens
tatgccattgcactcc

SEQ ID NO: 5639258 - DNA, 23 bp, Homo sapiens
tatgccatttcttctctctgttc

SEQ ID NO: 5639259 - DNA, 23 bp, Homo sapiens
tatgcccacatttagtctcttta

SEQ ID NO: 5639260 - DNA, 13 bp, Homo sapiens
tatgcccagctgt

SEQ ID NO: 5639261 - DNA, 17 bp, Homo sapiens
tatgcccagctgtgctg

SEQ ID NO: 5639262 - DNA, 18 bp, Homo sapiens
tatgcccagtttctgcct

SEQ ID NO: 5639263 - DNA, 20 bp, Homo sapiens
tatgccctcagatggagaca

SEQ ID NO: 5639264 - DNA, 13 bp, Homo sapiens
tatgccctgcaga

SEQ ID NO: 5639265 - DNA, 18 bp, Homo sapiens
tatgccctgcagagcaat

SEQ ID NO: 5639266 - DNA, 22 bp, Homo sapiens
tatgccctgcagagcaataaca

SEQ ID NO: 5639267 - DNA, 16 bp, Homo sapiens
tatgccggatgtgctt

SEQ ID NO: 5639268 - DNA, 23 bp, Homo sapiens
tatgccggatgtgcttttctcca

SEQ ID NO: 5639269 - DNA, 13 bp, Homo sapiens
tatgcctacagcc

SEQ ID NO: 5639270 - DNA, 15 bp, Homo sapiens
tatgcctatatttat

SEQ ID NO: 5639271 - DNA, 16 bp, Homo sapiens
tatgcctccatttcag

SEQ ID NO: 5639272 - DNA, 14 bp, Homo sapiens
tatgcctctccttt

SEQ ID NO: 5639273 - DNA, 15 bp, Homo sapiens
tatgcctctcctttg

SEQ ID NO: 5639274 - DNA, 17 bp, Homo sapiens
tatgcctctcctttgta

SEQ ID NO: 5639275 - DNA, 16 bp, Homo sapiens
tatgcctctgtattta

SEQ ID NO: 5639276 - DNA, 20 bp, Homo sapiens
tatgcctgagttataaatat

SEQ ID NO: 5639277 - DNA, 18 bp, Homo sapiens
tatgcctgattcatagta

SEQ ID NO: 5639278 - DNA, 18 bp, Homo sapiens
tatgcctgcactgggaag

SEQ ID NO: 5639279 - DNA, 22 bp, Homo sapiens
tatgcctgcgccatcttcacat

SEQ ID NO: 5639280 - DNA, 23 bp, Homo sapiens
tatgcctgcgccatcttcacatt

SEQ ID NO: 5639281 - DNA, 14 bp, Homo sapiens
tatgcctgctcttt

SEQ ID NO: 5639282 - DNA, 17 bp, Homo sapiens
tatgcctgttgcaggca

SEQ ID NO: 5639283 - DNA, 13 bp, Homo sapiens
tatgccttaattt

SEQ ID NO: 5639284 - DNA, 21 bp, Homo sapiens
tatgccttaatttagaaactg

SEQ ID NO: 5639285 - DNA, 23 bp, Homo sapiens
tatgccttaatttagaaactgaa

SEQ ID NO: 5639286 - DNA, 18 bp, Homo sapiens
tatgccttatgtaattat

SEQ ID NO: 5639287 - DNA, 23 bp, Homo sapiens
tatgccttatgtaattattttct

SEQ ID NO: 5639288 - DNA, 13 bp, Homo sapiens
tatgccttcaaat

SEQ ID NO: 5639289 - DNA, 14 bp, Homo sapiens
tatgccttcaaata

SEQ ID NO: 5639290 - DNA, 16 bp, Homo sapiens
tatgccttcactacaa

SEQ ID NO: 5639291 - DNA, 17 bp, Homo sapiens
tatgccttcctgtttaa

SEQ ID NO: 5639292 - DNA, 14 bp, Homo sapiens
tatgccttcttatt

SEQ ID NO: 5639293 - DNA, 18 bp, Homo sapiens
tatgccttggggaggaca

SEQ ID NO: 5639294 - DNA, 14 bp, Homo sapiens
tatgcctttagtca

SEQ ID NO: 5639295 - DNA, 15 bp, Homo sapiens
tatgcgcaaatacaa

SEQ ID NO: 5639296 - DNA, 21 bp, Homo sapiens
tatgcgccctggtatgtgcct

SEQ ID NO: 5639297 - DNA, 18 bp, Homo sapiens
tatgcggtgacggcgggg

SEQ ID NO: 5639298 - DNA, 21 bp, Homo sapiens
tatgcggttcttacagcacat

SEQ ID NO: 5639299 - DNA, 13 bp, Homo sapiens
tatgctaaatgtt

SEQ ID NO: 5639300 - DNA, 14 bp, Homo sapiens
tatgctaagaattt

SEQ ID NO: 5639301 - DNA, 15 bp, Homo sapiens
tatgctaattgaaca

SEQ ID NO: 5639302 - DNA, 18 bp, Homo sapiens
tatgctacacatatgtgc

SEQ ID NO: 5639303 - DNA, 23 bp, Homo sapiens
tatgtaggtaaaagtagaagcat

SEQ ID NO: 5639304 - DNA, 17 bp, Homo sapiens
tatgtaggtaagactgt

SEQ ID NO: 5639305 - DNA, 15 bp, Homo sapiens
tatgtagtcataata

SEQ ID NO: 5639306 - DNA, 18 bp, Homo sapiens
tatgtagtcataataaat

SEQ ID NO: 5639307 - DNA, 13 bp, Homo sapiens
tatgtagtggttt

SEQ ID NO: 5639308 - DNA, 17 bp, Homo sapiens
tatgtataaaatgtaac

SEQ ID NO: 5639309 - DNA, 12 bp, Homo sapiens
tatgtataaaca

SEQ ID NO: 5639310 - DNA, 13 bp, Homo sapiens
tatgtataaacat

SEQ ID NO: 5639311 - DNA, 17 bp, Homo sapiens
tatgtataaattaatac

SEQ ID NO: 5639312 - DNA, 16 bp, Homo sapiens
tatgtataatatatat

SEQ ID NO: 5639313 - DNA, 15 bp, Homo sapiens
tatgtataattcaaa

SEQ ID NO: 5639314 - DNA, 15 bp, Homo sapiens
tatgtataatttcac

SEQ ID NO: 5639315 - DNA, 9 bp, Homo sapiens
tatgtatac

SEQ ID NO: 5639316 - DNA, 12 bp, Homo sapiens
tatgtatacaca

SEQ ID NO: 5639317 - DNA, 15 bp, Homo sapiens
tatgtatacacacat

SEQ ID NO: 5639318 - DNA, 17 bp, Homo sapiens
tatgtatacacacatat

SEQ ID NO: 5639319 - DNA, 21 bp, Homo sapiens
tatgtatacacacatatacat

SEQ ID NO: 5639320 - DNA, 22 bp, Homo sapiens
tatgtatacacacatatacata

SEQ ID NO: 5639321 - DNA, 13 bp, Homo sapiens
tatgtatacatat

SEQ ID NO: 5639322 - DNA, 24 bp, Homo sapiens
tatgtatacatatagatagataat

SEQ ID NO: 5639323 - DNA, 13 bp, Homo sapiens
tatgtatacatgt

SEQ ID NO: 5639324 - DNA, 16 bp, Homo sapiens
tatgtatacgcacgca

SEQ ID NO: 5639325 - DNA, 23 bp, Homo sapiens
tatgtatacttatcttgctccat

SEQ ID NO: 5639326 - DNA, 14 bp, Homo sapiens
tatgtatagaaaat

SEQ ID NO: 5639327 - DNA, 15 bp, Homo sapiens
tatgtatagaaaata

SEQ ID NO: 5639328 - DNA, 19 bp, Homo sapiens
tatgtatatatatgtatgt

SEQ ID NO: 5639329 - DNA, 20 bp, Homo sapiens
tatgtatatatatgtatgta

SEQ ID NO: 5639330 - DNA, 15 bp, Homo sapiens
tatgtatatatattc

SEQ ID NO: 5639331 - DNA, 14 bp, Homo sapiens
tatgtatatcttct

SEQ ID NO: 5639332 - DNA, 16 bp, Homo sapiens
tatgtatatgtatatc

SEQ ID NO: 5639333 - DNA, 19 bp, Homo sapiens
tatgtatatgtatatctat

SEQ ID NO: 5639334 - DNA, 18 bp, Homo sapiens
tatgtatattaaaaaaga

SEQ ID NO: 5639335 - DNA, 17 bp, Homo sapiens
tatgtatattctatttt

SEQ ID NO: 5639336 - DNA, 16 bp, Homo sapiens
tatgtatattttaata

SEQ ID NO: 5639337 - DNA, 23 bp, Homo sapiens
tatgtatctaaatgaaaagagaa

SEQ ID NO: 5639338 - DNA, 15 bp, Homo sapiens
tatgtatcttagtta

SEQ ID NO: 5639339 - DNA, 22 bp, Homo sapiens
tatgtatctttataattgatga

SEQ ID NO: 5639340 - DNA, 18 bp, Homo sapiens
tatgtatggatatatttg

SEQ ID NO: 5639341 - DNA, 17 bp, Homo sapiens
tatgtatggtgcaatgt

SEQ ID NO: 5639342 - DNA, 19 bp, Homo sapiens
tatgtatgtgccaattttg

SEQ ID NO: 5639343 - DNA, 20 bp, Homo sapiens
tatgtatgtgccaattttgt

SEQ ID NO: 5639344 - DNA, 13 bp, Homo sapiens
tatgtatgtgttt

SEQ ID NO: 5639345 - DNA, 16 bp, Homo sapiens
tatgtatgtgtttaga

SEQ ID NO: 5639346 - DNA, 22 bp, Homo sapiens
tatgtatgtgtttagaattgaa

SEQ ID NO: 5639347 - DNA, 13 bp, Homo sapiens
tatgtatgttaat

SEQ ID NO: 5639348 - DNA, 14 bp, Homo sapiens
tatgtattaacact

SEQ ID NO: 5639349 - DNA, 22 bp, Homo sapiens
tatgtattaacactactcaaag

SEQ ID NO: 5639350 - DNA, 14 bp, Homo sapiens
tatgtattaacttg

SEQ ID NO: 5639351 - DNA, 19 bp, Homo sapiens
tatgtattaagccaaacat

SEQ ID NO: 5639352 - DNA, 18 bp, Homo sapiens
tatgtattaataaataga

SEQ ID NO: 5639353 - DNA, 16 bp, Homo sapiens
tatgtattaccagccc

SEQ ID NO: 5639354 - DNA, 18 bp, Homo sapiens
tatgtattaccagccccc

SEQ ID NO: 5639355 - DNA, 21 bp, Homo sapiens
tatgtattatttataattcct

SEQ ID NO: 5639356 - DNA, 20 bp, Homo sapiens
tatgtattcccttcctctga

SEQ ID NO: 5639357 - DNA, 22 bp, Homo sapiens
tatgtattcccttgtattttgt

SEQ ID NO: 5639358 - DNA, 15 bp, Homo sapiens
tatgtattctcttct

SEQ ID NO: 5639359 - DNA, 16 bp, Homo sapiens
tatgtattctgtaaaa

SEQ ID NO: 5639360 - DNA, 14 bp, Homo sapiens
tatgtattcttttc

SEQ ID NO: 5639361 - DNA, 14 bp, Homo sapiens
tatgtatttaaaaa

SEQ ID NO: 5639362 - DNA, 21 bp, Homo sapiens
tatgtatttaagatgtacatt

SEQ ID NO: 5639363 - DNA, 22 bp, Homo sapiens
tatgtatttataatttaaatga

SEQ ID NO: 5639364 - DNA, 15 bp, Homo sapiens
tatgtattttaaaat

SEQ ID NO: 5639365 - DNA, 16 bp, Homo sapiens
tatgtattttatgtat

SEQ ID NO: 5639366 - DNA, 19 bp, Homo sapiens
tatgtattttccaagtaaa

SEQ ID NO: 5639367 - DNA, 15 bp, Homo sapiens
tatgtattttcctaa

SEQ ID NO: 5639368 - DNA, 13 bp, Homo sapiens
tatgtcaaaaata

SEQ ID NO: 5639369 - DNA, 16 bp, Homo sapiens
tatgtcaaaaatattt

SEQ ID NO: 5639370 - DNA, 17 bp, Homo sapiens
tatgtcaaaaatatttt

SEQ ID NO: 5639371 - DNA, 11 bp, Homo sapiens
tatgtcaaatt

SEQ ID NO: 5639372 - DNA, 16 bp, Homo sapiens
tatgtcaatcttaaga

SEQ ID NO: 5639373 - DNA, 18 bp, Homo sapiens
tatgtcaattcattaata

SEQ ID NO: 5639374 - DNA, 11 bp, Homo sapiens
tatgtcactca

SEQ ID NO: 5639375 - DNA, 18 bp, Homo sapiens
tatgtcagacatgaaaac

SEQ ID NO: 5639376 - DNA, 13 bp, Homo sapiens
tatgtcagcagct

SEQ ID NO: 5639377 - DNA, 16 bp, Homo sapiens
tatgtcagcagctctg

SEQ ID NO: 5639378 - DNA, 15 bp, Homo sapiens
tatgtcagtccctgg

SEQ ID NO: 5639379 - DNA, 16 bp, Homo sapiens
tatgtcagtgatgact

SEQ ID NO: 5639380 - DNA, 12 bp, Homo sapiens
tatgtcagttat

SEQ ID NO: 5639381 - DNA, 13 bp, Homo sapiens
tatgtcatagaaa

SEQ ID NO: 5639382 - DNA, 18 bp, Homo sapiens
tatgtcatagtttaattg

SEQ ID NO: 5639383 - DNA, 15 bp, Homo sapiens
tatgtcatgcctcac

SEQ ID NO: 5639384 - DNA, 13 bp, Homo sapiens
tatgtcattaaag

SEQ ID NO: 5639385 - DNA, 16 bp, Homo sapiens
tatgtcattatttatt

SEQ ID NO: 5639386 - DNA, 17 bp, Homo sapiens
tatgtcattatttattg

SEQ ID NO: 5639387 - DNA, 22 bp, Homo sapiens
tatgtcattatttattgttaaa

SEQ ID NO: 5639388 - DNA, 12 bp, Homo sapiens
tatgtcatttca

SEQ ID NO: 5639389 - DNA, 15 bp, Homo sapiens
tatgtcatttcatgt

SEQ ID NO: 5639390 - DNA, 17 bp, Homo sapiens
tatgtcattttcagatc

SEQ ID NO: 5639391 - DNA, 19 bp, Homo sapiens
tatgtcatttttaatgtat

SEQ ID NO: 5639392 - DNA, 22 bp, Homo sapiens
tatgtccaccacttcaggggat

SEQ ID NO: 5639393 - DNA, 15 bp, Homo sapiens
tatgtccactgttct

SEQ ID NO: 5639394 - DNA, 20 bp, Homo sapiens
tatgtccagaagagtcaaag

SEQ ID NO: 5639395 - DNA, 21 bp, Homo sapiens
tatgtccagaagagtcaaagt

SEQ ID NO: 5639396 - DNA, 23 bp, Homo sapiens
tatgtccagaagagtcaaagtag

SEQ ID NO: 5639397 - DNA, 15 bp, Homo sapiens
tatgtccatatctaa

SEQ ID NO: 5639398 - DNA, 14 bp, Homo sapiens
tatgtccattcact

SEQ ID NO: 5639399 - DNA, 14 bp, Homo sapiens
tatgtcccagcccc

SEQ ID NO: 5639400 - DNA, 13 bp, Homo sapiens
tatgtcccatgac

SEQ ID NO: 5639401 - DNA, 22 bp, Homo sapiens
tatgtccccataagacaaacac

SEQ ID NO: 5639402 - DNA, 18 bp, Homo sapiens
tatgtccggctttaacta

SEQ ID NO: 5639403 - DNA, 16 bp, Homo sapiens
tatgtcgatgcacagt

SEQ ID NO: 5639404 - DNA, 22 bp, Homo sapiens
tatgtcgtagaattccttcgaa

SEQ ID NO: 5639405 - DNA, 20 bp, Homo sapiens
tatgtcgtcgagctcccccc

SEQ ID NO: 5639406 - DNA, 16 bp, Homo sapiens
tatgtctaaagagctt

SEQ ID NO: 5639407 - DNA, 16 bp, Homo sapiens
tatgtctagaaagtaa

SEQ ID NO: 5639408 - DNA, 18 bp, Homo sapiens
tatgtctagagcctcttg

SEQ ID NO: 5639409 - DNA, 16 bp, Homo sapiens
tatgtctagataaaag

SEQ ID NO: 5639410 - DNA, 18 bp, Homo sapiens
tatgtctagcacatgttg

SEQ ID NO: 5639411 - DNA, 14 bp, Homo sapiens
tatgtctatgtgta

SEQ ID NO: 5639412 - DNA, 18 bp, Homo sapiens
tatgtctatgtgtatata

SEQ ID NO: 5639413 - DNA, 14 bp, Homo sapiens
tatgtctcatgttt

SEQ ID NO: 5639414 - DNA, 22 bp, Homo sapiens
tatgtctctagcagtgagtact

SEQ ID NO: 5639415 - DNA, 13 bp, Homo sapiens
tatgtctctgcct

SEQ ID NO: 5639416 - DNA, 18 bp, Homo sapiens
tatgtctcttgagcatca

SEQ ID NO: 5639417 - DNA, 19 bp, Homo sapiens
tatgtctcttgagcatcaa

SEQ ID NO: 5639418 - DNA, 13 bp, Homo sapiens
tatgtctgcaggt

SEQ ID NO: 5639419 - DNA, 18 bp, Homo sapiens
tatgtctgctcctttccc

SEQ ID NO: 5639420 - DNA, 21 bp, Homo sapiens
tatgtctgcttctgtccagga

SEQ ID NO: 5639421 - DNA, 21 bp, Homo sapiens
tatgtctggttctcaattcca

SEQ ID NO: 5639422 - DNA, 22 bp, Homo sapiens
tatgtctggttctcaattccaa

SEQ ID NO: 5639423 - DNA, 17 bp, Homo sapiens
tatgtctgtctttgcaa

SEQ ID NO: 5639424 - DNA, 11 bp, Homo sapiens
tatgtctgtga

SEQ ID NO: 5639425 - DNA, 12 bp, Homo sapiens
tatgtctgtgat

SEQ ID NO: 5639426 - DNA, 13 bp, Homo sapiens
tatgtctgtgcca

SEQ ID NO: 5639427 - DNA, 14 bp, Homo sapiens
tatgtctgtgtatg

SEQ ID NO: 5639428 - DNA, 16 bp, Homo sapiens
tatgtctgtgtatgta

SEQ ID NO: 5639429 - DNA, 16 bp, Homo sapiens
tatgtctgtttaagaa

SEQ ID NO: 5639430 - DNA, 14 bp, Homo sapiens
tatgtcttataaga

SEQ ID NO: 5639431 - DNA, 22 bp, Homo sapiens
tatgtcttattttattatttct

SEQ ID NO: 5639432 - DNA, 16 bp, Homo sapiens
tatgtcttcaaaatat

SEQ ID NO: 5639433 - DNA, 15 bp, Homo sapiens
tatgtcttcttttgt

SEQ ID NO: 5639434 - DNA, 15 bp, Homo sapiens
tatgtcttgaaacat

SEQ ID NO: 5639435 - DNA, 22 bp, Homo sapiens
tatgtcttgcaaagcctttaaa

SEQ ID NO: 5639436 - DNA, 17 bp, Homo sapiens
tatgtcttggacactgt

SEQ ID NO: 5639437 - DNA, 21 bp, Homo sapiens
tatgtcttggacactgtacaa

SEQ ID NO: 5639438 - DNA, 17 bp, Homo sapiens
tatgtcttttatatttg

SEQ ID NO: 5639439 - DNA, 23 bp, Homo sapiens
tatgtcttttgatgaatagaagt

SEQ ID NO: 5639440 - DNA, 15 bp, Homo sapiens
tatgtgaaacaatgt

SEQ ID NO: 5639441 - DNA, 17 bp, Homo sapiens
tatgtgaaacatgtttc

SEQ ID NO: 5639442 - DNA, 17 bp, Homo sapiens
tatgtgaaactctatta

SEQ ID NO: 5639443 - DNA, 20 bp, Homo sapiens
tatgtgaaaggaacattttt

SEQ ID NO: 5639444 - DNA, 22 bp, Homo sapiens
tatgtgaaaggatatgaatctg

SEQ ID NO: 5639445 - DNA, 16 bp, Homo sapiens
tatgtgaaagtgtaaa

SEQ ID NO: 5639446 - DNA, 21 bp, Homo sapiens
tatgtgaaagtgtaaaataga

SEQ ID NO: 5639447 - DNA, 18 bp, Homo sapiens
tatgtgaaatgctttctg

SEQ ID NO: 5639448 - DNA, 22 bp, Homo sapiens
tatgtgaacaaatcaaattgct

SEQ ID NO: 5639449 - DNA, 16 bp, Homo sapiens
tatgtgaacattccta

SEQ ID NO: 5639450 - DNA, 14 bp, Homo sapiens
tatgtgaacattta

SEQ ID NO: 5639451 - DNA, 19 bp, Homo sapiens
tatgtgaaggtgtttcaaa

SEQ ID NO: 5639452 - DNA, 22 bp, Homo sapiens
tatgtgaatatttgtaaaaata

SEQ ID NO: 5639453 - DNA, 13 bp, Homo sapiens
tatgtgaatctgg

SEQ ID NO: 5639454 - DNA, 12 bp, Homo sapiens
tatgtgaatgat

SEQ ID NO: 5639455 - DNA, 14 bp, Homo sapiens
tatgtgaatttgag

SEQ ID NO: 5639456 - DNA, 22 bp, Homo sapiens
tatgtgacaacatttttgtaca

SEQ ID NO: 5639457 - DNA, 14 bp, Homo sapiens
tatgtgacattaac

SEQ ID NO: 5639458 - DNA, 19 bp, Homo sapiens
tatgtgacatttctcttcc

SEQ ID NO: 5639459 - DNA, 14 bp, Homo sapiens
tatgtgacatttta

SEQ ID NO: 5639460 - DNA, 15 bp, Homo sapiens
tatgtgacttttctg

SEQ ID NO: 5639461 - DNA, 20 bp, Homo sapiens
tatgtgagaaatcagaattg

SEQ ID NO: 5639462 - DNA, 12 bp, Homo sapiens
tatgtgagaaca

SEQ ID NO: 5639463 - DNA, 17 bp, Homo sapiens
tatgtgagcgagcaagc

SEQ ID NO: 5639464 - DNA, 20 bp, Homo sapiens
tatgtgagctaggagaaggg

SEQ ID NO: 5639465 - DNA, 23 bp, Homo sapiens
tatgtgagctaggagaagggctg

SEQ ID NO: 5639466 - DNA, 15 bp, Homo sapiens
tatgtgaggtaatta

SEQ ID NO: 5639467 - DNA, 19 bp, Homo sapiens
tatgtgagtagtcttatgt

SEQ ID NO: 5639468 - DNA, 19 bp, Homo sapiens
tatgtgagtgaaagtactt

SEQ ID NO: 5639469 - DNA, 13 bp, Homo sapiens
tatgtgagtgtgt

SEQ ID NO: 5639470 - DNA, 23 bp, Homo sapiens
tatgtgagtgtgtgtttgtgctg

SEQ ID NO: 5639471 - DNA, 17 bp, Homo sapiens
tatgtgagtttcagaaa

SEQ ID NO: 5639472 - DNA, 20 bp, Homo sapiens
tatgtgagtttcagaaattc

SEQ ID NO: 5639473 - DNA, 20 bp, Homo sapiens
tatgtgatatctgaacacat

SEQ ID NO: 5639474 - DNA, 13 bp, Homo sapiens
tatgtgatgaaac

SEQ ID NO: 5639475 - DNA, 13 bp, Homo sapiens
tatgtgatgccaa

SEQ ID NO: 5639476 - DNA, 16 bp, Homo sapiens
tatgtgattttaactc

SEQ ID NO: 5639477 - DNA, 15 bp, Homo sapiens
tatgtgattttcaaa

SEQ ID NO: 5639478 - DNA, 20 bp, Homo sapiens
tatgtgcaaggtgataggaa

SEQ ID NO: 5639479 - DNA, 15 bp, Homo sapiens
tatgtgcacatgtgt

SEQ ID NO: 5639480 - DNA, 21 bp, Homo sapiens
tatgtgcacatgtgtctgtgt

SEQ ID NO: 5639481 - DNA, 12 bp, Homo sapiens
tatgtgcactgt

SEQ ID NO: 5639482 - DNA, 17 bp, Homo sapiens
tatgtgcactgtcactt

SEQ ID NO: 5639483 - DNA, 14 bp, Homo sapiens
tattacttctgcta

SEQ ID NO: 5639484 - DNA, 13 bp, Homo sapiens
tattacttctgtt

SEQ ID NO: 5639485 - DNA, 17 bp, Homo sapiens
tattacttctgtttctc

SEQ ID NO: 5639486 - DNA, 12 bp, Homo sapiens
tattacttgaac

SEQ ID NO: 5639487 - DNA, 21 bp, Homo sapiens
tattacttgaactttccaaaa

SEQ ID NO: 5639488 - DNA, 14 bp, Homo sapiens
tattacttggcaaa

SEQ ID NO: 5639489 - DNA, 19 bp, Homo sapiens
tattacttgtaaatataaa

SEQ ID NO: 5639490 - DNA, 23 bp, Homo sapiens
tattacttgtaaatataaagacg

SEQ ID NO: 5639491 - DNA, 21 bp, Homo sapiens
tattacttgtttgtaagattt

SEQ ID NO: 5639492 - DNA, 15 bp, Homo sapiens
tattactttaaatta

SEQ ID NO: 5639493 - DNA, 21 bp, Homo sapiens
tattactttatgaacaatttt

SEQ ID NO: 5639494 - DNA, 17 bp, Homo sapiens
tattactttctgccgct

SEQ ID NO: 5639495 - DNA, 16 bp, Homo sapiens
tattactttgtctttt

SEQ ID NO: 5639496 - DNA, 20 bp, Homo sapiens
tattactttgtcttttcaat

SEQ ID NO: 5639497 - DNA, 17 bp, Homo sapiens
tattacttttctgcaat

SEQ ID NO: 5639498 - DNA, 14 bp, Homo sapiens
tattacttttgtaa

SEQ ID NO: 5639499 - DNA, 15 bp, Homo sapiens
tattacttttgtaaa

SEQ ID NO: 5639500 - DNA, 17 bp, Homo sapiens
tattacttttgtaaata

SEQ ID NO: 5639501 - DNA, 18 bp, Homo sapiens
tattacttttgtaaatat

SEQ ID NO: 5639502 - DNA, 18 bp, Homo sapiens
tattagaaaactttgtta

SEQ ID NO: 5639503 - DNA, 12 bp, Homo sapiens
tattagaaagcc

SEQ ID NO: 5639504 - DNA, 19 bp, Homo sapiens
tattagaaagtgctgaatt

SEQ ID NO: 5639505 - DNA, 23 bp, Homo sapiens
tattagaaattagaaaaaaatta

SEQ ID NO: 5639506 - DNA, 17 bp, Homo sapiens
tattagaatataaaaaa

SEQ ID NO: 5639507 - DNA, 23 bp, Homo sapiens
tattagaatcaaacattttgaaa

SEQ ID NO: 5639508 - DNA, 21 bp, Homo sapiens
tattagactctctagttttat

SEQ ID NO: 5639509 - DNA, 14 bp, Homo sapiens
tattagacttctaa

SEQ ID NO: 5639510 - DNA, 23 bp, Homo sapiens
tattagacttctgttttcaatct

SEQ ID NO: 5639511 - DNA, 16 bp, Homo sapiens
tattagactttagaaa

SEQ ID NO: 5639512 - DNA, 16 bp, Homo sapiens
tattagagcattgaat

SEQ ID NO: 5639513 - DNA, 19 bp, Homo sapiens
tattagagtatttcccttc

SEQ ID NO: 5639514 - DNA, 19 bp, Homo sapiens
tattagatacacttcttaa

SEQ ID NO: 5639515 - DNA, 23 bp, Homo sapiens
tattagatacacttcttaaatac

SEQ ID NO: 5639516 - DNA, 22 bp, Homo sapiens
tattagatcaaatagttgcata

SEQ ID NO: 5639517 - DNA, 14 bp, Homo sapiens
tattagatgaatta

SEQ ID NO: 5639518 - DNA, 15 bp, Homo sapiens
tattagatgcactta

SEQ ID NO: 5639519 - DNA, 15 bp, Homo sapiens
tattagatgtgattt

SEQ ID NO: 5639520 - DNA, 16 bp, Homo sapiens
tattagatgtgattta

SEQ ID NO: 5639521 - DNA, 23 bp, Homo sapiens
tattagatgtgatttaatagtgt

SEQ ID NO: 5639522 - DNA, 15 bp, Homo sapiens
tattagatgtggttt

SEQ ID NO: 5639523 - DNA, 21 bp, Homo sapiens
tattagatgttctctatcatt

SEQ ID NO: 5639524 - DNA, 18 bp, Homo sapiens
tattagatgttttacaaa

SEQ ID NO: 5639525 - DNA, 20 bp, Homo sapiens
tattagatgttttacaaatt

SEQ ID NO: 5639526 - DNA, 13 bp, Homo sapiens
tattagattgcca

SEQ ID NO: 5639527 - DNA, 21 bp, Homo sapiens
tattagattgctgaattaagg

SEQ ID NO: 5639528 - DNA, 18 bp, Homo sapiens
tattagcatggcatattt

SEQ ID NO: 5639529 - DNA, 15 bp, Homo sapiens
tattagccaaagagg

SEQ ID NO: 5639530 - DNA, 23 bp, Homo sapiens
tattagccaactgtttccctgct

SEQ ID NO: 5639531 - DNA, 13 bp, Homo sapiens
tattagccaggat

SEQ ID NO: 5639532 - DNA, 17 bp, Homo sapiens
tattagccaggatcatg

SEQ ID NO: 5639533 - DNA, 21 bp, Homo sapiens
tattagccaggtaatgtgaat

SEQ ID NO: 5639534 - DNA, 17 bp, Homo sapiens
tattagccctgcatttt

SEQ ID NO: 5639535 - DNA, 20 bp, Homo sapiens
tattagccctgcattttcat

SEQ ID NO: 5639536 - DNA, 22 bp, Homo sapiens
tattagcccttctccatggccc

SEQ ID NO: 5639537 - DNA, 18 bp, Homo sapiens
tattagcgacaacagatt

SEQ ID NO: 5639538 - DNA, 20 bp, Homo sapiens
tattagcgacaacagattgg

SEQ ID NO: 5639539 - DNA, 23 bp, Homo sapiens
tattagcgacaacagattggatt

SEQ ID NO: 5639540 - DNA, 16 bp, Homo sapiens
tattagctttactgtt

SEQ ID NO: 5639541 - DNA, 13 bp, Homo sapiens
tattagctttctc

SEQ ID NO: 5639542 - DNA, 16 bp, Homo sapiens
tattaggaaaagatat

SEQ ID NO: 5639543 - DNA, 20 bp, Homo sapiens
tattaggaaaagatattttt

SEQ ID NO: 5639544 - DNA, 21 bp, Homo sapiens
tattaggaaaataaacagaca

SEQ ID NO: 5639545 - DNA, 19 bp, Homo sapiens
tattaggaagtgtttatgt

SEQ ID NO: 5639546 - DNA, 13 bp, Homo sapiens
tattaggagtaat

SEQ ID NO: 5639547 - DNA, 23 bp, Homo sapiens
tattaggataatacataaatgat

SEQ ID NO: 5639548 - DNA, 16 bp, Homo sapiens
tattagggactgtggt

SEQ ID NO: 5639549 - DNA, 21 bp, Homo sapiens
tattaggtgaatatggaagta

SEQ ID NO: 5639550 - DNA, 17 bp, Homo sapiens
tattaggtgcaatttca

SEQ ID NO: 5639551 - DNA, 18 bp, Homo sapiens
tattagtaataaaacatt

SEQ ID NO: 5639552 - DNA, 14 bp, Homo sapiens
tattagtaccatag

SEQ ID NO: 5639553 - DNA, 17 bp, Homo sapiens
tattagtattgtgaata

SEQ ID NO: 5639554 - DNA, 13 bp, Homo sapiens
tattagtattgtt

SEQ ID NO: 5639555 - DNA, 19 bp, Homo sapiens
tattagtattgttgtcctt

SEQ ID NO: 5639556 - DNA, 17 bp, Homo sapiens
tattagtcagagtttca

SEQ ID NO: 5639557 - DNA, 16 bp, Homo sapiens
tattagtcataaaaca

SEQ ID NO: 5639558 - DNA, 17 bp, Homo sapiens
tattagtcataaaacac

SEQ ID NO: 5639559 - DNA, 21 bp, Homo sapiens
tattagtgacctcagctttga

SEQ ID NO: 5639560 - DNA, 18 bp, Homo sapiens
tattagtgatatttctct

SEQ ID NO: 5639561 - DNA, 19 bp, Homo sapiens
tattagtgatatttctcta

SEQ ID NO: 5639562 - DNA, 21 bp, Homo sapiens
tattagtgatatttctctagt

SEQ ID NO: 5639563 - DNA, 18 bp, Homo sapiens
tattagtgttatatgaac

SEQ ID NO: 5639564 - DNA, 17 bp, Homo sapiens
tattagttaaaacacat

SEQ ID NO: 5639565 - DNA, 19 bp, Homo sapiens
tattagttaatggattaaa

SEQ ID NO: 5639566 - DNA, 16 bp, Homo sapiens
tattagttacaaagtt

SEQ ID NO: 5639567 - DNA, 23 bp, Homo sapiens
tattagttccctgtctcttgaaa

SEQ ID NO: 5639568 - DNA, 15 bp, Homo sapiens
tattagttgccaata

SEQ ID NO: 5639569 - DNA, 17 bp, Homo sapiens
tattagttgccaatatg

SEQ ID NO: 5639570 - DNA, 22 bp, Homo sapiens
tattagtttaccacttgccttt

SEQ ID NO: 5639571 - DNA, 21 bp, Homo sapiens
tattagttttctttgtaaagg

SEQ ID NO: 5639572 - DNA, 14 bp, Homo sapiens
tattagttttgatt

SEQ ID NO: 5639573 - DNA, 19 bp, Homo sapiens
tattataaaaatgtcagaa

SEQ ID NO: 5639574 - DNA, 13 bp, Homo sapiens
tattataaacaag

SEQ ID NO: 5639575 - DNA, 19 bp, Homo sapiens
tattataaacaagaatgaa

SEQ ID NO: 5639576 - DNA, 23 bp, Homo sapiens
tattataaacaagaatgaaggtt

SEQ ID NO: 5639577 - DNA, 15 bp, Homo sapiens
tattataaactataa

SEQ ID NO: 5639578 - DNA, 14 bp, Homo sapiens
tattataaactgta

SEQ ID NO: 5639579 - DNA, 14 bp, Homo sapiens
tattataaataaat

SEQ ID NO: 5639580 - DNA, 15 bp, Homo sapiens
tattataaataaatg

SEQ ID NO: 5639581 - DNA, 19 bp, Homo sapiens
tattataaataaatgccaa

SEQ ID NO: 5639582 - DNA, 15 bp, Homo sapiens
tattataaatatata

SEQ ID NO: 5639583 - DNA, 20 bp, Homo sapiens
tattataaatatatataaag

SEQ ID NO: 5639584 - DNA, 19 bp, Homo sapiens
tattataaatccaaagtaa

SEQ ID NO: 5639585 - DNA, 12 bp, Homo sapiens
tattataaatgt

SEQ ID NO: 5639586 - DNA, 18 bp, Homo sapiens
tattataaattatgttta

SEQ ID NO: 5639587 - DNA, 13 bp, Homo sapiens
tattataaattct

SEQ ID NO: 5639588 - DNA, 19 bp, Homo sapiens
tattataacaagtgtgtct

SEQ ID NO: 5639589 - DNA, 16 bp, Homo sapiens
tattataacttaaaaa

SEQ ID NO: 5639590 - DNA, 17 bp, Homo sapiens
tattataagcattgaaa

SEQ ID NO: 5639591 - DNA, 14 bp, Homo sapiens
tattataagtgctt

SEQ ID NO: 5639592 - DNA, 18 bp, Homo sapiens
tattataagttgaccttt

SEQ ID NO: 5639593 - DNA, 21 bp, Homo sapiens
tattataataatgttctctgg

SEQ ID NO: 5639594 - DNA, 23 bp, Homo sapiens
tattataatataatatggaacct

SEQ ID NO: 5639595 - DNA, 15 bp, Homo sapiens
tattataatatagaa

SEQ ID NO: 5639596 - DNA, 15 bp, Homo sapiens
tattataatcaaagc

SEQ ID NO: 5639597 - DNA, 14 bp, Homo sapiens
tattataattgttg

SEQ ID NO: 5639598 - DNA, 18 bp, Homo sapiens
tattataattgttgatat

SEQ ID NO: 5639599 - DNA, 19 bp, Homo sapiens
tattataatttttttcaat

SEQ ID NO: 5639600 - DNA, 19 bp, Homo sapiens
tattatacaggaaagcaat

SEQ ID NO: 5639601 - DNA, 12 bp, Homo sapiens
tattataccttt

SEQ ID NO: 5639602 - DNA, 18 bp, Homo sapiens
tattatactaagaaaaga

SEQ ID NO: 5639603 - DNA, 19 bp, Homo sapiens
tattatactaagaaaagat

SEQ ID NO: 5639604 - DNA, 14 bp, Homo sapiens
tattatactgtatt

SEQ ID NO: 5639605 - DNA, 21 bp, Homo sapiens
tattatactgttatccatatt

SEQ ID NO: 5639606 - DNA, 13 bp, Homo sapiens
tattatagaaatt

SEQ ID NO: 5639607 - DNA, 15 bp, Homo sapiens
tattatagaaattct

SEQ ID NO: 5639608 - DNA, 20 bp, Homo sapiens
tattatagaaattctgaatt

SEQ ID NO: 5639609 - DNA, 15 bp, Homo sapiens
tattatagacaaaag

SEQ ID NO: 5639610 - DNA, 16 bp, Homo sapiens
tattatagagcagaaa

SEQ ID NO: 5639611 - DNA, 20 bp, Homo sapiens
tattatagagcagaaattct

SEQ ID NO: 5639612 - DNA, 21 bp, Homo sapiens
tattatagcaactttaagaag

SEQ ID NO: 5639613 - DNA, 22 bp, Homo sapiens
tattatagtactgctttactgt

SEQ ID NO: 5639614 - DNA, 15 bp, Homo sapiens
tattatagtctgtac

SEQ ID NO: 5639615 - DNA, 15 bp, Homo sapiens
tattatataaacttt

SEQ ID NO: 5639616 - DNA, 15 bp, Homo sapiens
tattatataaatata

SEQ ID NO: 5639617 - DNA, 13 bp, Homo sapiens
tattatatacata

SEQ ID NO: 5639618 - DNA, 15 bp, Homo sapiens
tattatatatacatt

SEQ ID NO: 5639619 - DNA, 12 bp, Homo sapiens
tattatatatag

SEQ ID NO: 5639620 - DNA, 12 bp, Homo sapiens
tattatatatat

SEQ ID NO: 5639621 - DNA, 17 bp, Homo sapiens
tattatatatatctata

SEQ ID NO: 5639622 - DNA, 19 bp, Homo sapiens
tattatatatgtatatctg

SEQ ID NO: 5639623 - DNA, 20 bp, Homo sapiens
tattatatatttacagaaga

SEQ ID NO: 5639624 - DNA, 15 bp, Homo sapiens
tattatatggcagga

SEQ ID NO: 5639625 - DNA, 21 bp, Homo sapiens
tattatatgtaccctctgaaa

SEQ ID NO: 5639626 - DNA, 17 bp, Homo sapiens
tattatattcattcttt

SEQ ID NO: 5639627 - DNA, 13 bp, Homo sapiens
tattatatttgga

SEQ ID NO: 5639628 - DNA, 16 bp, Homo sapiens
tattatcaaaattctg

SEQ ID NO: 5639629 - DNA, 22 bp, Homo sapiens
tattatcaaagggataaagaaa

SEQ ID NO: 5639630 - DNA, 13 bp, Homo sapiens
tattatcacatta

SEQ ID NO: 5639631 - DNA, 13 bp, Homo sapiens
tattatcactgtc

SEQ ID NO: 5639632 - DNA, 14 bp, Homo sapiens
tattatcactgtct

SEQ ID NO: 5639633 - DNA, 22 bp, Homo sapiens
tattatcagttaaaatcacatt

SEQ ID NO: 5639634 - DNA, 15 bp, Homo sapiens
tattatcataagaat

SEQ ID NO: 5639635 - DNA, 18 bp, Homo sapiens
tattatcatgcaaatgct

SEQ ID NO: 5639636 - DNA, 14 bp, Homo sapiens
tattatcatggtat

SEQ ID NO: 5639637 - DNA, 20 bp, Homo sapiens
tattatcattgctcccctga

SEQ ID NO: 5639638 - DNA, 23 bp, Homo sapiens
tattatcccagcttgctgagggg

SEQ ID NO: 5639639 - DNA, 21 bp, Homo sapiens
tattatccttcacaatttcaa

SEQ ID NO: 5639640 - DNA, 14 bp, Homo sapiens
tattatccttctac

SEQ ID NO: 5639641 - DNA, 17 bp, Homo sapiens
tattatctacctgttct

SEQ ID NO: 5639642 - DNA, 14 bp, Homo sapiens
tattatctgtaaaa

SEQ ID NO: 5639643 - DNA, 13 bp, Homo sapiens
tattatctgtcag

SEQ ID NO: 5639644 - DNA, 13 bp, Homo sapiens
tattatctgtgtt

SEQ ID NO: 5639645 - DNA, 20 bp, Homo sapiens
tattatcttaaacccacata

SEQ ID NO: 5639646 - DNA, 22 bp, Homo sapiens
tattatcttaaacccacataaa

SEQ ID NO: 5639647 - DNA, 23 bp, Homo sapiens
tattatcttaaacccacataaac

SEQ ID NO: 5639648 - DNA, 20 bp, Homo sapiens
tattatcttgttcaggaaaa

SEQ ID NO: 5639649 - DNA, 13 bp, Homo sapiens
tattatctttgta

SEQ ID NO: 5639650 - DNA, 19 bp, Homo sapiens
tattatcttttcatacatt

SEQ ID NO: 5639651 - DNA, 14 bp, Homo sapiens
tattatgaaaaaga

SEQ ID NO: 5639652 - DNA, 12 bp, Homo sapiens
tattatgaaact

SEQ ID NO: 5639653 - DNA, 16 bp, Homo sapiens
tattatgaaggaattt

SEQ ID NO: 5639654 - DNA, 12 bp, Homo sapiens
tattatgaataa

SEQ ID NO: 5639655 - DNA, 12 bp, Homo sapiens
tattatgagcca

SEQ ID NO: 5639656 - DNA, 19 bp, Homo sapiens
tattatgaggctattaaaa

SEQ ID NO: 5639657 - DNA, 19 bp, Homo sapiens
tattatgatgttagaagaa

SEQ ID NO: 5639658 - DNA, 18 bp, Homo sapiens
tattatgatgttttgcaa

SEQ ID NO: 5639659 - DNA, 19 bp, Homo sapiens
tattatgatgttttgcaaa

SEQ ID NO: 5639660 - DNA, 12 bp, Homo sapiens
tattatgcaaaa

SEQ ID NO: 5639661 - DNA, 13 bp, Homo sapiens
tattctattaact

SEQ ID NO: 5639662 - DNA, 20 bp, Homo sapiens
tattctattacattttcagt

SEQ ID NO: 5639663 - DNA, 11 bp, Homo sapiens
tattctattct

SEQ ID NO: 5639664 - DNA, 14 bp, Homo sapiens
tattctattctaat

SEQ ID NO: 5639665 - DNA, 14 bp, Homo sapiens
tattctattttcat

SEQ ID NO: 5639666 - DNA, 14 bp, Homo sapiens
tattctcaccagga

SEQ ID NO: 5639667 - DNA, 13 bp, Homo sapiens
tattctcactcca

SEQ ID NO: 5639668 - DNA, 18 bp, Homo sapiens
tattctcagagcatgtgt

SEQ ID NO: 5639669 - DNA, 15 bp, Homo sapiens
tattctcatgcctca

SEQ ID NO: 5639670 - DNA, 16 bp, Homo sapiens
tattctcatgcctcag

SEQ ID NO: 5639671 - DNA, 17 bp, Homo sapiens
tattctccactttttct

SEQ ID NO: 5639672 - DNA, 16 bp, Homo sapiens
tattctccagacatgg

SEQ ID NO: 5639673 - DNA, 20 bp, Homo sapiens
tattctcctcggactgtgtg

SEQ ID NO: 5639674 - DNA, 17 bp, Homo sapiens
tattctcctgccatggg

SEQ ID NO: 5639675 - DNA, 22 bp, Homo sapiens
tattctccttctgtcaaagtca

SEQ ID NO: 5639676 - DNA, 15 bp, Homo sapiens
tattctcgaatcacc

SEQ ID NO: 5639677 - DNA, 21 bp, Homo sapiens
tattctcggctcaggttttga

SEQ ID NO: 5639678 - DNA, 16 bp, Homo sapiens
tattctctaataaaat

SEQ ID NO: 5639679 - DNA, 22 bp, Homo sapiens
tattctctcacagtgtactcta

SEQ ID NO: 5639680 - DNA, 16 bp, Homo sapiens
tattctctcctcagac

SEQ ID NO: 5639681 - DNA, 17 bp, Homo sapiens
tattctctcctcagact

SEQ ID NO: 5639682 - DNA, 17 bp, Homo sapiens
tattctctcctgtacct

SEQ ID NO: 5639683 - DNA, 18 bp, Homo sapiens
tattctctcctgtacctc

SEQ ID NO: 5639684 - DNA, 13 bp, Homo sapiens
tattctctctatg

SEQ ID NO: 5639685 - DNA, 15 bp, Homo sapiens
tattctctctatgca

SEQ ID NO: 5639686 - DNA, 18 bp, Homo sapiens
tattctctgagctgtgca

SEQ ID NO: 5639687 - DNA, 13 bp, Homo sapiens
tattctctgtaca

SEQ ID NO: 5639688 - DNA, 21 bp, Homo sapiens
tattctcttaatttttcttaa

SEQ ID NO: 5639689 - DNA, 12 bp, Homo sapiens
tattctctttgg

SEQ ID NO: 5639690 - DNA, 14 bp, Homo sapiens
tattctcttttatc

SEQ ID NO: 5639691 - DNA, 18 bp, Homo sapiens
tattctcttttatctgtt

SEQ ID NO: 5639692 - DNA, 16 bp, Homo sapiens
tattctgaagcaacat

SEQ ID NO: 5639693 - DNA, 15 bp, Homo sapiens
tattctgagaaaaca

SEQ ID NO: 5639694 - DNA, 15 bp, Homo sapiens
tattctgagatgact

SEQ ID NO: 5639695 - DNA, 12 bp, Homo sapiens
tattctgagcct

SEQ ID NO: 5639696 - DNA, 15 bp, Homo sapiens
tattctgagccttga

SEQ ID NO: 5639697 - DNA, 18 bp, Homo sapiens
tattctgcttccacatgt

SEQ ID NO: 5639698 - DNA, 14 bp, Homo sapiens
tattctggaaaaaa

SEQ ID NO: 5639699 - DNA, 19 bp, Homo sapiens
tattctggaaaaaaaatat

SEQ ID NO: 5639700 - DNA, 18 bp, Homo sapiens
tattctggggtatggcgt

SEQ ID NO: 5639701 - DNA, 18 bp, Homo sapiens
tattctgtacattttttc

SEQ ID NO: 5639702 - DNA, 19 bp, Homo sapiens
tattctgtagattctgtgg

SEQ ID NO: 5639703 - DNA, 22 bp, Homo sapiens
tattctgtatccgtgaattgct

SEQ ID NO: 5639704 - DNA, 9 bp, Homo sapiens
tattctgtc

SEQ ID NO: 5639705 - DNA, 18 bp, Homo sapiens
tattctgtcagtgttaaa

SEQ ID NO: 5639706 - DNA, 18 bp, Homo sapiens
tattctgtcatttacaca

SEQ ID NO: 5639707 - DNA, 11 bp, Homo sapiens
tattctgtccc

SEQ ID NO: 5639708 - DNA, 12 bp, Homo sapiens
tattctgtggcc

SEQ ID NO: 5639709 - DNA, 15 bp, Homo sapiens
tattctgttaaaatc

SEQ ID NO: 5639710 - DNA, 12 bp, Homo sapiens
tattctgttgct

SEQ ID NO: 5639711 - DNA, 16 bp, Homo sapiens
tattctgttggccagt

SEQ ID NO: 5639712 - DNA, 11 bp, Homo sapiens
tattctgtttt

SEQ ID NO: 5639713 - DNA, 14 bp, Homo sapiens
tattctgttttgtt

SEQ ID NO: 5639714 - DNA, 13 bp, Homo sapiens
tattcttaaaatg

SEQ ID NO: 5639715 - DNA, 13 bp, Homo sapiens
tattcttaagtaa

SEQ ID NO: 5639716 - DNA, 20 bp, Homo sapiens
tattcttcatgaaatgtgtt

SEQ ID NO: 5639717 - DNA, 21 bp, Homo sapiens
tattcttcatgaaatgtgttt

SEQ ID NO: 5639718 - DNA, 14 bp, Homo sapiens
tattcttccaagtt

SEQ ID NO: 5639719 - DNA, 12 bp, Homo sapiens
tattcttccaga

SEQ ID NO: 5639720 - DNA, 14 bp, Homo sapiens
tattcttccagaat

SEQ ID NO: 5639721 - DNA, 17 bp, Homo sapiens
tattcttctagagttca

SEQ ID NO: 5639722 - DNA, 22 bp, Homo sapiens
tattcttctcttccttttatca

SEQ ID NO: 5639723 - DNA, 17 bp, Homo sapiens
tattcttcttgaaaata

SEQ ID NO: 5639724 - DNA, 11 bp, Homo sapiens
tattcttcttt

SEQ ID NO: 5639725 - DNA, 14 bp, Homo sapiens
tattcttgaaagaa

SEQ ID NO: 5639726 - DNA, 15 bp, Homo sapiens
tattcttgaaagaag

SEQ ID NO: 5639727 - DNA, 18 bp, Homo sapiens
tattcttgaaagaagaat

SEQ ID NO: 5639728 - DNA, 23 bp, Homo sapiens
tattcttgaaagaagaatgtgtt

SEQ ID NO: 5639729 - DNA, 13 bp, Homo sapiens
tattcttgaaagt

SEQ ID NO: 5639730 - DNA, 14 bp, Homo sapiens
tattcttgaaagta

SEQ ID NO: 5639731 - DNA, 19 bp, Homo sapiens
tattcttgatcagtagttt

SEQ ID NO: 5639732 - DNA, 22 bp, Homo sapiens
tattcttgatcagtagtttgca

SEQ ID NO: 5639733 - DNA, 19 bp, Homo sapiens
tattcttgatgaaaagctt

SEQ ID NO: 5639734 - DNA, 14 bp, Homo sapiens
tattcttgatgtaa

SEQ ID NO: 5639735 - DNA, 22 bp, Homo sapiens
tattcttgctttagaaaacatt

SEQ ID NO: 5639736 - DNA, 18 bp, Homo sapiens
tattcttgctttcacaaa

SEQ ID NO: 5639737 - DNA, 22 bp, Homo sapiens
tattcttggtactgttgctttg

SEQ ID NO: 5639738 - DNA, 19 bp, Homo sapiens
tattcttgtccacattcta

SEQ ID NO: 5639739 - DNA, 22 bp, Homo sapiens
tattcttgtggttaaaaacctg

SEQ ID NO: 5639740 - DNA, 13 bp, Homo sapiens
tattcttgttata

SEQ ID NO: 5639741 - DNA, 15 bp, Homo sapiens
tattcttgtttgaat

SEQ ID NO: 5639742 - DNA, 23 bp, Homo sapiens
tattcttgttttacatttggatt

SEQ ID NO: 5639743 - DNA, 13 bp, Homo sapiens
tattctttacaaa

SEQ ID NO: 5639744 - DNA, 14 bp, Homo sapiens
tattctttactatt

SEQ ID NO: 5639745 - DNA, 21 bp, Homo sapiens
tattctttcaattctgtaggt

SEQ ID NO: 5639746 - DNA, 13 bp, Homo sapiens
tattctttcacaa

SEQ ID NO: 5639747 - DNA, 16 bp, Homo sapiens
tattctttctcataaa

SEQ ID NO: 5639748 - DNA, 23 bp, Homo sapiens
tattctttgaccaaactgtgggt

SEQ ID NO: 5639749 - DNA, 20 bp, Homo sapiens
tattctttgatgttaacaca

SEQ ID NO: 5639750 - DNA, 24 bp, Homo sapiens
tattctttgatgttaacacatttt

SEQ ID NO: 5639751 - DNA, 21 bp, Homo sapiens
tattctttgtattaccaaagc

SEQ ID NO: 5639752 - DNA, 18 bp, Homo sapiens
tattctttgtgttgataa

SEQ ID NO: 5639753 - DNA, 13 bp, Homo sapiens
tattctttgttaa

SEQ ID NO: 5639754 - DNA, 18 bp, Homo sapiens
tattcttttatataacta

SEQ ID NO: 5639755 - DNA, 12 bp, Homo sapiens
tattcttttcca

SEQ ID NO: 5639756 - DNA, 18 bp, Homo sapiens
tattcttttctgcaaaat

SEQ ID NO: 5639757 - DNA, 12 bp, Homo sapiens
tattcttttgtt

SEQ ID NO: 5639758 - DNA, 20 bp, Homo sapiens
tattcttttgttattaaaaa

SEQ ID NO: 5639759 - DNA, 15 bp, Homo sapiens
tattcttttgtttcc

SEQ ID NO: 5639760 - DNA, 14 bp, Homo sapiens
tattgaaaaaaata

SEQ ID NO: 5639761 - DNA, 21 bp, Homo sapiens
tattgaaaaatacgttttgtg

SEQ ID NO: 5639762 - DNA, 17 bp, Homo sapiens
tattgaaaaattatcag

SEQ ID NO: 5639763 - DNA, 19 bp, Homo sapiens
tattgaaaacacttagtat

SEQ ID NO: 5639764 - DNA, 13 bp, Homo sapiens
tattgaaaacttc

SEQ ID NO: 5639765 - DNA, 15 bp, Homo sapiens
tattgaaaacttcaa

SEQ ID NO: 5639766 - DNA, 22 bp, Homo sapiens
tattgaaaacttcaaagctgaa

SEQ ID NO: 5639767 - DNA, 20 bp, Homo sapiens
tattgaaaagaaaaagaaga

SEQ ID NO: 5639768 - DNA, 14 bp, Homo sapiens
tattgaaaatgtca

SEQ ID NO: 5639769 - DNA, 20 bp, Homo sapiens
tattgaaaatgtcactgtta

SEQ ID NO: 5639770 - DNA, 14 bp, Homo sapiens
tattgaaaattgaa

SEQ ID NO: 5639771 - DNA, 14 bp, Homo sapiens
tattgaaagaatta

SEQ ID NO: 5639772 - DNA, 13 bp, Homo sapiens
tattgaaagccaa

SEQ ID NO: 5639773 - DNA, 20 bp, Homo sapiens
tattgaaaggggacacctgt

SEQ ID NO: 5639774 - DNA, 22 bp, Homo sapiens
tattgaaaggggacacctgtac

SEQ ID NO: 5639775 - DNA, 23 bp, Homo sapiens
tattgaaaggggacacctgtaca

SEQ ID NO: 5639776 - DNA, 13 bp, Homo sapiens
tattgaaatatta

SEQ ID NO: 5639777 - DNA, 22 bp, Homo sapiens
tattgaaatgatttcacagtgt

SEQ ID NO: 5639778 - DNA, 15 bp, Homo sapiens
tattgaaatgctgta

SEQ ID NO: 5639779 - DNA, 16 bp, Homo sapiens
tattgaaattactgaa

SEQ ID NO: 5639780 - DNA, 15 bp, Homo sapiens
tattgaactgagcca

SEQ ID NO: 5639781 - DNA, 19 bp, Homo sapiens
tattgaacttttgtactga

SEQ ID NO: 5639782 - DNA, 17 bp, Homo sapiens
tattgaagaaaagcact

SEQ ID NO: 5639783 - DNA, 18 bp, Homo sapiens
tattgaagaaaagcactt

SEQ ID NO: 5639784 - DNA, 13 bp, Homo sapiens
tattgaagaaaca

SEQ ID NO: 5639785 - DNA, 14 bp, Homo sapiens
tattgaagacaatt

SEQ ID NO: 5639786 - DNA, 21 bp, Homo sapiens
tattgaagacaatttgataca

SEQ ID NO: 5639787 - DNA, 14 bp, Homo sapiens
tattgaagaggata

SEQ ID NO: 5639788 - DNA, 19 bp, Homo sapiens
tattgaagaggatattctt

SEQ ID NO: 5639789 - DNA, 20 bp, Homo sapiens
tattgaagcagagtggcagt

SEQ ID NO: 5639790 - DNA, 16 bp, Homo sapiens
tattgaagcattttat

SEQ ID NO: 5639791 - DNA, 20 bp, Homo sapiens
tattgaaggaagccaaattt

SEQ ID NO: 5639792 - DNA, 21 bp, Homo sapiens
tattgaaggaagccaaattta

SEQ ID NO: 5639793 - DNA, 21 bp, Homo sapiens
tattgaaggaattagaaatga

SEQ ID NO: 5639794 - DNA, 19 bp, Homo sapiens
tattgaagttgtttatcaa

SEQ ID NO: 5639795 - DNA, 22 bp, Homo sapiens
tattgaatactgtctgtatctt

SEQ ID NO: 5639796 - DNA, 13 bp, Homo sapiens
tattgaatattgt

SEQ ID NO: 5639797 - DNA, 11 bp, Homo sapiens
tattgaatcta

SEQ ID NO: 5639798 - DNA, 16 bp, Homo sapiens
tattgaatctatttaa

SEQ ID NO: 5639799 - DNA, 17 bp, Homo sapiens
tattgaatctatttaag

SEQ ID NO: 5639800 - DNA, 18 bp, Homo sapiens
tattgaatgaaacaagca

SEQ ID NO: 5639801 - DNA, 14 bp, Homo sapiens
tattgaatgcctta

SEQ ID NO: 5639802 - DNA, 15 bp, Homo sapiens
tattgaatgccttat

SEQ ID NO: 5639803 - DNA, 13 bp, Homo sapiens
tattgaatgttat

SEQ ID NO: 5639804 - DNA, 14 bp, Homo sapiens
tattgaattagaaa

SEQ ID NO: 5639805 - DNA, 15 bp, Homo sapiens
tattgaattattttg

SEQ ID NO: 5639806 - DNA, 20 bp, Homo sapiens
tattgaattattttgttact

SEQ ID NO: 5639807 - DNA, 14 bp, Homo sapiens
tattgaatttgtgt

SEQ ID NO: 5639808 - DNA, 15 bp, Homo sapiens
tattgacaaactctc

SEQ ID NO: 5639809 - DNA, 13 bp, Homo sapiens
tattgacaataat

SEQ ID NO: 5639810 - DNA, 18 bp, Homo sapiens
tattgacacagaaaatgt

SEQ ID NO: 5639811 - DNA, 20 bp, Homo sapiens
tattgacacagaaaatgttg

SEQ ID NO: 5639812 - DNA, 18 bp, Homo sapiens
tattgacactgtccctct

SEQ ID NO: 5639813 - DNA, 19 bp, Homo sapiens
tattgacactgtccctctt

SEQ ID NO: 5639814 - DNA, 19 bp, Homo sapiens
tattgacaggtcttttcaa

SEQ ID NO: 5639815 - DNA, 21 bp, Homo sapiens
tattgacaggtcttttcaaat

SEQ ID NO: 5639816 - DNA, 14 bp, Homo sapiens
tattgacatttgta

SEQ ID NO: 5639817 - DNA, 15 bp, Homo sapiens
tattgaccaccagtt

SEQ ID NO: 5639818 - DNA, 22 bp, Homo sapiens
tattgaccatgtggttcacgta

SEQ ID NO: 5639819 - DNA, 18 bp, Homo sapiens
tattgacccaaatgtgta

SEQ ID NO: 5639820 - DNA, 15 bp, Homo sapiens
tattgactctgggtc

SEQ ID NO: 5639821 - DNA, 20 bp, Homo sapiens
tattgactctgggtccttcc

SEQ ID NO: 5639822 - DNA, 14 bp, Homo sapiens
tattgacttctctt

SEQ ID NO: 5639823 - DNA, 16 bp, Homo sapiens
tattgacttctcttga

SEQ ID NO: 5639824 - DNA, 23 bp, Homo sapiens
tattgactttatgttgtatgatt

SEQ ID NO: 5639825 - DNA, 15 bp, Homo sapiens
tattgactttcttaa

SEQ ID NO: 5639826 - DNA, 14 bp, Homo sapiens
tattgactttgtct

SEQ ID NO: 5639827 - DNA, 23 bp, Homo sapiens
tattgagaagatcggaacagctc

SEQ ID NO: 5639828 - DNA, 16 bp, Homo sapiens
tattgagaataattat

SEQ ID NO: 5639829 - DNA, 13 bp, Homo sapiens
tattgagaatcag

SEQ ID NO: 5639830 - DNA, 18 bp, Homo sapiens
tattgagaatcccttaaa

SEQ ID NO: 5639831 - DNA, 22 bp, Homo sapiens
tattgagaatcccttaaaatta

SEQ ID NO: 5639832 - DNA, 14 bp, Homo sapiens
tattgagacaaaaa

SEQ ID NO: 5639833 - DNA, 16 bp, Homo sapiens
tattgagagagatgtg

SEQ ID NO: 5639834 - DNA, 21 bp, Homo sapiens
tattgagcaagtatccttcat

SEQ ID NO: 5639835 - DNA, 17 bp, Homo sapiens
tattgagcagaattcat

SEQ ID NO: 5639836 - DNA, 21 bp, Homo sapiens
tattgagcccaaaaacaagca

SEQ ID NO: 5639837 - DNA, 23 bp, Homo sapiens
tattgagccttgcatgtacttga

SEQ ID NO: 5639838 - DNA, 18 bp, Homo sapiens
tattgaggccaagaatat

SEQ ID NO: 5639839 - DNA, 23 bp, Homo sapiens
tattgaggccaagaatattgcaa

SEQ ID NO: 5639840 - DNA, 15 bp, Homo sapiens
tattgaggctttgtg

SEQ ID NO: 5639841 - DNA, 23 bp, Homo sapiens
tatttcacatgagtcaaaacaaa

SEQ ID NO: 5639842 - DNA, 18 bp, Homo sapiens
tatttcacccatctctca

SEQ ID NO: 5639843 - DNA, 18 bp, Homo sapiens
tatttcactaaatgtaaa

SEQ ID NO: 5639844 - DNA, 23 bp, Homo sapiens
tatttcactgaatttcaaacatt

SEQ ID NO: 5639845 - DNA, 16 bp, Homo sapiens
tatttcacttgatgat

SEQ ID NO: 5639846 - DNA, 16 bp, Homo sapiens
tatttcagaagtttaa

SEQ ID NO: 5639847 - DNA, 18 bp, Homo sapiens
tatttcagaatattttgt

SEQ ID NO: 5639848 - DNA, 13 bp, Homo sapiens
tatttcagacatt

SEQ ID NO: 5639849 - DNA, 15 bp, Homo sapiens
tatttcagacatttt

SEQ ID NO: 5639850 - DNA, 19 bp, Homo sapiens
tatttcagacattttcact

SEQ ID NO: 5639851 - DNA, 18 bp, Homo sapiens
tatttcagatatcaaaat

SEQ ID NO: 5639852 - DNA, 17 bp, Homo sapiens
tatttcagattcctcag

SEQ ID NO: 5639853 - DNA, 12 bp, Homo sapiens
tatttcagattt

SEQ ID NO: 5639854 - DNA, 18 bp, Homo sapiens
tatttcagattttgataa

SEQ ID NO: 5639855 - DNA, 13 bp, Homo sapiens
tatttcagtgaat

SEQ ID NO: 5639856 - DNA, 12 bp, Homo sapiens
tatttcagtgac

SEQ ID NO: 5639857 - DNA, 21 bp, Homo sapiens
tatttcagtgataatgttcat

SEQ ID NO: 5639858 - DNA, 15 bp, Homo sapiens
tatttcagtgatttt

SEQ ID NO: 5639859 - DNA, 21 bp, Homo sapiens
tatttcagtgatttttagtaa

SEQ ID NO: 5639860 - DNA, 22 bp, Homo sapiens
tatttcagtggaatagatgtct

SEQ ID NO: 5639861 - DNA, 17 bp, Homo sapiens
tatttcagtgttacctg

SEQ ID NO: 5639862 - DNA, 18 bp, Homo sapiens
tatttcagtgttacctgt

SEQ ID NO: 5639863 - DNA, 20 bp, Homo sapiens
tatttcagtgttacctgtgt

SEQ ID NO: 5639864 - DNA, 22 bp, Homo sapiens
tatttcagttattgtccctggc

SEQ ID NO: 5639865 - DNA, 13 bp, Homo sapiens
tatttcataaatt

SEQ ID NO: 5639866 - DNA, 17 bp, Homo sapiens
tatttcatacaaaactg

SEQ ID NO: 5639867 - DNA, 20 bp, Homo sapiens
tatttcatcacaagaacaca

SEQ ID NO: 5639868 - DNA, 17 bp, Homo sapiens
tatttcatgattcacaa

SEQ ID NO: 5639869 - DNA, 12 bp, Homo sapiens
tatttcatgtgg

SEQ ID NO: 5639870 - DNA, 17 bp, Homo sapiens
tatttcatgtggctgta

SEQ ID NO: 5639871 - DNA, 21 bp, Homo sapiens
tatttcatgtttttgatcaaa

SEQ ID NO: 5639872 - DNA, 16 bp, Homo sapiens
tatttcattatctgta

SEQ ID NO: 5639873 - DNA, 14 bp, Homo sapiens
tatttcattcatat

SEQ ID NO: 5639874 - DNA, 18 bp, Homo sapiens
tatttcatttattttttg

SEQ ID NO: 5639875 - DNA, 18 bp, Homo sapiens
tatttcattttttgcatc

SEQ ID NO: 5639876 - DNA, 18 bp, Homo sapiens
tatttccaaacctggttc

SEQ ID NO: 5639877 - DNA, 15 bp, Homo sapiens
tatttccaaatattc

SEQ ID NO: 5639878 - DNA, 19 bp, Homo sapiens
tatttccaaatattctaaa

SEQ ID NO: 5639879 - DNA, 13 bp, Homo sapiens
tatttccaacaaa

SEQ ID NO: 5639880 - DNA, 14 bp, Homo sapiens
tatttccaatgtga

SEQ ID NO: 5639881 - DNA, 23 bp, Homo sapiens
tatttccaatgtgaaagattatt

SEQ ID NO: 5639882 - DNA, 13 bp, Homo sapiens
tatttccacaaat

SEQ ID NO: 5639883 - DNA, 16 bp, Homo sapiens
tatttccacataaagg

SEQ ID NO: 5639884 - DNA, 17 bp, Homo sapiens
tatttccactaaaaata

SEQ ID NO: 5639885 - DNA, 16 bp, Homo sapiens
tatttccactattttc

SEQ ID NO: 5639886 - DNA, 20 bp, Homo sapiens
tatttccactattttcaaag

SEQ ID NO: 5639887 - DNA, 17 bp, Homo sapiens
tatttccactgaacaaa

SEQ ID NO: 5639888 - DNA, 18 bp, Homo sapiens
tatttccactgaacaaaa

SEQ ID NO: 5639889 - DNA, 14 bp, Homo sapiens
tatttccatattaa

SEQ ID NO: 5639890 - DNA, 15 bp, Homo sapiens
tatttcccatgattt

SEQ ID NO: 5639891 - DNA, 16 bp, Homo sapiens
tatttcccatgatttc

SEQ ID NO: 5639892 - DNA, 21 bp, Homo sapiens
tatttccccaggggaaaatga

SEQ ID NO: 5639893 - DNA, 22 bp, Homo sapiens
tatttccccaggggaaaatgaa

SEQ ID NO: 5639894 - DNA, 15 bp, Homo sapiens
tatttcccccttcat

SEQ ID NO: 5639895 - DNA, 19 bp, Homo sapiens
tatttccctaaaatacatt

SEQ ID NO: 5639896 - DNA, 21 bp, Homo sapiens
tatttccctaaaatacattta

SEQ ID NO: 5639897 - DNA, 16 bp, Homo sapiens
tatttccctacattaa

SEQ ID NO: 5639898 - DNA, 20 bp, Homo sapiens
tatttccctcccctggggac

SEQ ID NO: 5639899 - DNA, 18 bp, Homo sapiens
tatttccctctcattttg

SEQ ID NO: 5639900 - DNA, 16 bp, Homo sapiens
tatttccctttagctg

SEQ ID NO: 5639901 - DNA, 15 bp, Homo sapiens
tatttcctaaggcat

SEQ ID NO: 5639902 - DNA, 19 bp, Homo sapiens
tatttcctataccatttcc

SEQ ID NO: 5639903 - DNA, 14 bp, Homo sapiens
tatttcctctgctg

SEQ ID NO: 5639904 - DNA, 14 bp, Homo sapiens
tatttcctcttgaa

SEQ ID NO: 5639905 - DNA, 15 bp, Homo sapiens
tatttcctgaaataa

SEQ ID NO: 5639906 - DNA, 18 bp, Homo sapiens
tatttcctgaaataaatg

SEQ ID NO: 5639907 - DNA, 21 bp, Homo sapiens
tatttcctgacttgagtgttc

SEQ ID NO: 5639908 - DNA, 11 bp, Homo sapiens
tatttcctgct

SEQ ID NO: 5639909 - DNA, 19 bp, Homo sapiens
tatttcctgtattgcttta

SEQ ID NO: 5639910 - DNA, 15 bp, Homo sapiens
tatttccttaaactg

SEQ ID NO: 5639911 - DNA, 19 bp, Homo sapiens
tatttccttaaactgtgtg

SEQ ID NO: 5639912 - DNA, 19 bp, Homo sapiens
tatttccttatgtgtgtag

SEQ ID NO: 5639913 - DNA, 23 bp, Homo sapiens
tatttccttccagcctttttagg

SEQ ID NO: 5639914 - DNA, 22 bp, Homo sapiens
tatttccttggattttcctgaa

SEQ ID NO: 5639915 - DNA, 22 bp, Homo sapiens
tatttcctttgcgcaaacttta

SEQ ID NO: 5639916 - DNA, 19 bp, Homo sapiens
tatttcctttttctagttt

SEQ ID NO: 5639917 - DNA, 17 bp, Homo sapiens
tatttcgaccctggggc

SEQ ID NO: 5639918 - DNA, 19 bp, Homo sapiens
tatttcgagtgttgtgtta

SEQ ID NO: 5639919 - DNA, 17 bp, Homo sapiens
tatttcggaaatacact

SEQ ID NO: 5639920 - DNA, 16 bp, Homo sapiens
tatttcgtttggtctt

SEQ ID NO: 5639921 - DNA, 12 bp, Homo sapiens
tatttctaaacc

SEQ ID NO: 5639922 - DNA, 22 bp, Homo sapiens
tatttctaaataaaaaaattaa

SEQ ID NO: 5639923 - DNA, 14 bp, Homo sapiens
tatttctaagctta

SEQ ID NO: 5639924 - DNA, 14 bp, Homo sapiens
tatttctaagtatt

SEQ ID NO: 5639925 - DNA, 15 bp, Homo sapiens
tatttctaagtattt

SEQ ID NO: 5639926 - DNA, 17 bp, Homo sapiens
tatttctaagtatttaa

SEQ ID NO: 5639927 - DNA, 19 bp, Homo sapiens
tatttctaatccttttcct

SEQ ID NO: 5639928 - DNA, 16 bp, Homo sapiens
tatttctacagagaaa

SEQ ID NO: 5639929 - DNA, 21 bp, Homo sapiens
tatttctaccattaaaatctt

SEQ ID NO: 5639930 - DNA, 17 bp, Homo sapiens
tatttctactatataca

SEQ ID NO: 5639931 - DNA, 16 bp, Homo sapiens
tatttctactgtcaaa

SEQ ID NO: 5639932 - DNA, 18 bp, Homo sapiens
tatttctactgtcaaatg

SEQ ID NO: 5639933 - DNA, 13 bp, Homo sapiens
tatttctagaagc

SEQ ID NO: 5639934 - DNA, 14 bp, Homo sapiens
tatttctagcagag

SEQ ID NO: 5639935 - DNA, 15 bp, Homo sapiens
tatttctagcagagt

SEQ ID NO: 5639936 - DNA, 13 bp, Homo sapiens
tatttctagccat

SEQ ID NO: 5639937 - DNA, 17 bp, Homo sapiens
tatttctagctttttaa

SEQ ID NO: 5639938 - DNA, 21 bp, Homo sapiens
tatttctagtccaaaattaca

SEQ ID NO: 5639939 - DNA, 19 bp, Homo sapiens
tatttctatatagacttgg

SEQ ID NO: 5639940 - DNA, 18 bp, Homo sapiens
tatttctatattttcatt

SEQ ID NO: 5639941 - DNA, 13 bp, Homo sapiens
tatttctatgaaa

SEQ ID NO: 5639942 - DNA, 19 bp, Homo sapiens
tatttctatgacaaattca

SEQ ID NO: 5639943 - DNA, 15 bp, Homo sapiens
tatttctatgtcatt

SEQ ID NO: 5639944 - DNA, 11 bp, Homo sapiens
tatttctattc

SEQ ID NO: 5639945 - DNA, 19 bp, Homo sapiens
tatttctcaacaaagcaca

SEQ ID NO: 5639946 - DNA, 19 bp, Homo sapiens
tatttctcagctgtgcctt

SEQ ID NO: 5639947 - DNA, 22 bp, Homo sapiens
tatttctcataggctatgccat

SEQ ID NO: 5639948 - DNA, 15 bp, Homo sapiens
tatttctcatctgca

SEQ ID NO: 5639949 - DNA, 14 bp, Homo sapiens
tatttctccagacc

SEQ ID NO: 5639950 - DNA, 15 bp, Homo sapiens
tatttctccagaccc

SEQ ID NO: 5639951 - DNA, 20 bp, Homo sapiens
tatttctccagacccagagg

SEQ ID NO: 5639952 - DNA, 17 bp, Homo sapiens
tatttctccatcccctc

SEQ ID NO: 5639953 - DNA, 18 bp, Homo sapiens
tatttctccatcccctcc

SEQ ID NO: 5639954 - DNA, 21 bp, Homo sapiens
tatttctccatcccctccctg

SEQ ID NO: 5639955 - DNA, 22 bp, Homo sapiens
tatttctcctttgcaatagcag

SEQ ID NO: 5639956 - DNA, 16 bp, Homo sapiens
tatttctctatgttta

SEQ ID NO: 5639957 - DNA, 13 bp, Homo sapiens
tatttctctgtga

SEQ ID NO: 5639958 - DNA, 17 bp, Homo sapiens
tatttctctgtgaatcc

SEQ ID NO: 5639959 - DNA, 18 bp, Homo sapiens
tatttctgaaaaagagaa

SEQ ID NO: 5639960 - DNA, 12 bp, Homo sapiens
tatttctgaaag

SEQ ID NO: 5639961 - DNA, 21 bp, Homo sapiens
tatttctgaaggtagcattct

SEQ ID NO: 5639962 - DNA, 22 bp, Homo sapiens
tatttctgaattcaaagcttgt

SEQ ID NO: 5639963 - DNA, 12 bp, Homo sapiens
tatttctgactc

SEQ ID NO: 5639964 - DNA, 17 bp, Homo sapiens
tatttctgatttcataa

SEQ ID NO: 5639965 - DNA, 14 bp, Homo sapiens
tatttctgcaaaca

SEQ ID NO: 5639966 - DNA, 19 bp, Homo sapiens
tatttctgcctataaattt

SEQ ID NO: 5639967 - DNA, 13 bp, Homo sapiens
tatttctgctgaa

SEQ ID NO: 5639968 - DNA, 16 bp, Homo sapiens
tatttctgctgaattt

SEQ ID NO: 5639969 - DNA, 15 bp, Homo sapiens
tatttctgctttctt

SEQ ID NO: 5639970 - DNA, 17 bp, Homo sapiens
tatttctgggtcttttg

SEQ ID NO: 5639971 - DNA, 18 bp, Homo sapiens
tatttctgggtcttttgc

SEQ ID NO: 5639972 - DNA, 22 bp, Homo sapiens
tatttctgggtcttttgctact

SEQ ID NO: 5639973 - DNA, 12 bp, Homo sapiens
tatttctgtaga

SEQ ID NO: 5639974 - DNA, 14 bp, Homo sapiens
tatttctgtatata

SEQ ID NO: 5639975 - DNA, 16 bp, Homo sapiens
tatttctgtatatttg

SEQ ID NO: 5639976 - DNA, 18 bp, Homo sapiens
tatttctgtatatttgtc

SEQ ID NO: 5639977 - DNA, 21 bp, Homo sapiens
tatttctgtatatttgtcatg

SEQ ID NO: 5639978 - DNA, 17 bp, Homo sapiens
tatttctgtatctgaca

SEQ ID NO: 5639979 - DNA, 15 bp, Homo sapiens
tatttctgtgaaaga

SEQ ID NO: 5639980 - DNA, 13 bp, Homo sapiens
tatttctgtggag

SEQ ID NO: 5639981 - DNA, 14 bp, Homo sapiens
tatttctgtgtcca

SEQ ID NO: 5639982 - DNA, 19 bp, Homo sapiens
tatttctgttccagtcaca

SEQ ID NO: 5639983 - DNA, 13 bp, Homo sapiens
tatttcttaaaca

SEQ ID NO: 5639984 - DNA, 18 bp, Homo sapiens
tatttcttaattattata

SEQ ID NO: 5639985 - DNA, 23 bp, Homo sapiens
tatttcttaattattataaaaat

SEQ ID NO: 5639986 - DNA, 14 bp, Homo sapiens
tatttcttaatttg

SEQ ID NO: 5639987 - DNA, 17 bp, Homo sapiens
tatttcttcaagtgagt

SEQ ID NO: 5639988 - DNA, 14 bp, Homo sapiens
tatttcttcacaaa

SEQ ID NO: 5639989 - DNA, 23 bp, Homo sapiens
tatttcttcccagaatctctgag

SEQ ID NO: 5639990 - DNA, 13 bp, Homo sapiens
tatttcttccctg

SEQ ID NO: 5639991 - DNA, 22 bp, Homo sapiens
tatttcttcctaccaagtcaaa

SEQ ID NO: 5639992 - DNA, 14 bp, Homo sapiens
tatttcttctctta

SEQ ID NO: 5639993 - DNA, 23 bp, Homo sapiens
tatttcttgaagaataaattcta

SEQ ID NO: 5639994 - DNA, 22 bp, Homo sapiens
tatttctttatatttatccact

SEQ ID NO: 5639995 - DNA, 15 bp, Homo sapiens
tatttctttcatcag

SEQ ID NO: 5639996 - DNA, 13 bp, Homo sapiens
tatttctttgtag

SEQ ID NO: 5639997 - DNA, 17 bp, Homo sapiens
tatttctttgtagaata

SEQ ID NO: 5639998 - DNA, 19 bp, Homo sapiens
tatttctttgtgataacaa

SEQ ID NO: 5639999 - DNA, 15 bp, Homo sapiens
tatttcttttatata

SEQ ID NO: 5640000 - DNA, 17 bp, Homo sapiens
tatttcttttgtgcaga

SEQ ID NO: 5640001 - DNA, 23 bp, Homo sapiens
tatttctttttaattattttaaa

SEQ ID NO: 5640002 - DNA, 19 bp, Homo sapiens
tatttcttttttttaataa

SEQ ID NO: 5640003 - DNA, 21 bp, Homo sapiens
tatttgaaaaaagttactgca

SEQ ID NO: 5640004 - DNA, 14 bp, Homo sapiens
tatttgaaaacaga

SEQ ID NO: 5640005 - DNA, 19 bp, Homo sapiens
tatttgaaaacagaaattg

SEQ ID NO: 5640006 - DNA, 22 bp, Homo sapiens
tatttgaaaacagaaattggta

SEQ ID NO: 5640007 - DNA, 19 bp, Homo sapiens
tatttgaaaacatataaag

SEQ ID NO: 5640008 - DNA, 19 bp, Homo sapiens
tatttgaaaattaccttta

SEQ ID NO: 5640009 - DNA, 18 bp, Homo sapiens
tatttgaaaattttactt

SEQ ID NO: 5640010 - DNA, 22 bp, Homo sapiens
tatttgaaacacacagtgacca

SEQ ID NO: 5640011 - DNA, 12 bp, Homo sapiens
tatttgaaactt

SEQ ID NO: 5640012 - DNA, 17 bp, Homo sapiens
tatttgaaatactaaaa

SEQ ID NO: 5640013 - DNA, 18 bp, Homo sapiens
tatttgaaatactaaaag

SEQ ID NO: 5640014 - DNA, 20 bp, Homo sapiens
tatttgaaatactaaaagca

SEQ ID NO: 5640015 - DNA, 21 bp, Homo sapiens
tatttgaaatactaaaagcaa

SEQ ID NO: 5640016 - DNA, 12 bp, Homo sapiens
tatttgaaatag

SEQ ID NO: 5640017 - DNA, 22 bp, Homo sapiens
tatttgaaatagtatacattgt

SEQ ID NO: 5640018 - DNA, 18 bp, Homo sapiens
tatttgaacaatgaagtt

SEQ ID NO: 5640019 - DNA, 20 bp, Homo sapiens
tattttctgtcagatgagaa

SEQ ID NO: 5640020 - DNA, 13 bp, Homo sapiens
tattttctgtgta

SEQ ID NO: 5640021 - DNA, 18 bp, Homo sapiens
tattttctgtgtaaaatg

SEQ ID NO: 5640022 - DNA, 19 bp, Homo sapiens
tattttctgtgtaaaatga

SEQ ID NO: 5640023 - DNA, 19 bp, Homo sapiens
tattttctgtgtgttcctg

SEQ ID NO: 5640024 - DNA, 21 bp, Homo sapiens
tattttctgtgtgttcctggc

SEQ ID NO: 5640025 - DNA, 22 bp, Homo sapiens
tattttctgttcagattaaaaa

SEQ ID NO: 5640026 - DNA, 19 bp, Homo sapiens
tattttctgtttttatgtt

SEQ ID NO: 5640027 - DNA, 21 bp, Homo sapiens
tattttcttacccaatttccc

SEQ ID NO: 5640028 - DNA, 15 bp, Homo sapiens
tattttcttctaagt

SEQ ID NO: 5640029 - DNA, 12 bp, Homo sapiens
tattttctttca

SEQ ID NO: 5640030 - DNA, 12 bp, Homo sapiens
tattttctttct

SEQ ID NO: 5640031 - DNA, 14 bp, Homo sapiens
tattttctttgaaa

SEQ ID NO: 5640032 - DNA, 18 bp, Homo sapiens
tattttctttgaaattca

SEQ ID NO: 5640033 - DNA, 15 bp, Homo sapiens
tattttctttttcct

SEQ ID NO: 5640034 - DNA, 20 bp, Homo sapiens
tattttgaaaacacttattt

SEQ ID NO: 5640035 - DNA, 17 bp, Homo sapiens
tattttgaaaagcttct

SEQ ID NO: 5640036 - DNA, 12 bp, Homo sapiens
tattttgaaata

SEQ ID NO: 5640037 - DNA, 14 bp, Homo sapiens
tattttgaaatgaa

SEQ ID NO: 5640038 - DNA, 17 bp, Homo sapiens
tattttgaagaatattt

SEQ ID NO: 5640039 - DNA, 20 bp, Homo sapiens
tattttgaagaatatttaag

SEQ ID NO: 5640040 - DNA, 23 bp, Homo sapiens
tattttgaagaatatttaagaaa

SEQ ID NO: 5640041 - DNA, 16 bp, Homo sapiens
tattttgaatcaataa

SEQ ID NO: 5640042 - DNA, 22 bp, Homo sapiens
tattttgaatcaataatatatt

SEQ ID NO: 5640043 - DNA, 14 bp, Homo sapiens
tattttgaatgtac

SEQ ID NO: 5640044 - DNA, 18 bp, Homo sapiens
tattttgactgtgattta

SEQ ID NO: 5640045 - DNA, 14 bp, Homo sapiens
tattttgacttgtt

SEQ ID NO: 5640046 - DNA, 21 bp, Homo sapiens
tattttgagaaactgctgcag

SEQ ID NO: 5640047 - DNA, 18 bp, Homo sapiens
tattttgaggtagaggaa

SEQ ID NO: 5640048 - DNA, 13 bp, Homo sapiens
tattttgataaaa

SEQ ID NO: 5640049 - DNA, 17 bp, Homo sapiens
tattttgataaattact

SEQ ID NO: 5640050 - DNA, 16 bp, Homo sapiens
tattttgattattgta

SEQ ID NO: 5640051 - DNA, 18 bp, Homo sapiens
tattttgattattgtatt

SEQ ID NO: 5640052 - DNA, 22 bp, Homo sapiens
tattttgcaaacactgtgatta

SEQ ID NO: 5640053 - DNA, 21 bp, Homo sapiens
tattttgcacgaattttaaaa

SEQ ID NO: 5640054 - DNA, 13 bp, Homo sapiens
tattttgccattt

SEQ ID NO: 5640055 - DNA, 15 bp, Homo sapiens
tattttgctccctct

SEQ ID NO: 5640056 - DNA, 22 bp, Homo sapiens
tattttgctccctctgttaggt

SEQ ID NO: 5640057 - DNA, 16 bp, Homo sapiens
tattttgctccttttc

SEQ ID NO: 5640058 - DNA, 14 bp, Homo sapiens
tattttgctcttgt

SEQ ID NO: 5640059 - DNA, 23 bp, Homo sapiens
tattttgctggagactatttaag

SEQ ID NO: 5640060 - DNA, 14 bp, Homo sapiens
tattttgctgttta

SEQ ID NO: 5640061 - DNA, 13 bp, Homo sapiens
tattttgctttgt

SEQ ID NO: 5640062 - DNA, 18 bp, Homo sapiens
tattttggaaagaagaaa

SEQ ID NO: 5640063 - DNA, 14 bp, Homo sapiens
tattttggaaagtt

SEQ ID NO: 5640064 - DNA, 19 bp, Homo sapiens
tattttggaaattgagtct

SEQ ID NO: 5640065 - DNA, 11 bp, Homo sapiens
tattttggaac

SEQ ID NO: 5640066 - DNA, 18 bp, Homo sapiens
tattttggaataagcatt

SEQ ID NO: 5640067 - DNA, 21 bp, Homo sapiens
tattttggaattggtgtatat

SEQ ID NO: 5640068 - DNA, 16 bp, Homo sapiens
tattttggaggtgctt

SEQ ID NO: 5640069 - DNA, 12 bp, Homo sapiens
tattttggatat

SEQ ID NO: 5640070 - DNA, 21 bp, Homo sapiens
tattttggcttcatttcaatc

SEQ ID NO: 5640071 - DNA, 22 bp, Homo sapiens
tattttgggaggccgaggagag

SEQ ID NO: 5640072 - DNA, 18 bp, Homo sapiens
tattttgggcctgttcct

SEQ ID NO: 5640073 - DNA, 19 bp, Homo sapiens
tattttgggcctgttcctt

SEQ ID NO: 5640074 - DNA, 19 bp, Homo sapiens
tattttgggttcaggcctg

SEQ ID NO: 5640075 - DNA, 21 bp, Homo sapiens
tattttggttcttagttctca

SEQ ID NO: 5640076 - DNA, 21 bp, Homo sapiens
tattttgtaaactcaaaatat

SEQ ID NO: 5640077 - DNA, 22 bp, Homo sapiens
tattttgtaaactgatgtttgt

SEQ ID NO: 5640078 - DNA, 16 bp, Homo sapiens
tattttgtaacttcca

SEQ ID NO: 5640079 - DNA, 13 bp, Homo sapiens
tattttgtaataa

SEQ ID NO: 5640080 - DNA, 16 bp, Homo sapiens
tattttgtaattattg

SEQ ID NO: 5640081 - DNA, 20 bp, Homo sapiens
tattttgtaatttttttgaa

SEQ ID NO: 5640082 - DNA, 15 bp, Homo sapiens
tattttgtactttgt

SEQ ID NO: 5640083 - DNA, 15 bp, Homo sapiens
tattttgtatatatc

SEQ ID NO: 5640084 - DNA, 13 bp, Homo sapiens
tattttgtatgca

SEQ ID NO: 5640085 - DNA, 20 bp, Homo sapiens
tattttgtatgcaagcagtt

SEQ ID NO: 5640086 - DNA, 22 bp, Homo sapiens
tattttgtatgcaagcagtttc

SEQ ID NO: 5640087 - DNA, 12 bp, Homo sapiens
tattttgtcact

SEQ ID NO: 5640088 - DNA, 18 bp, Homo sapiens
tattttgtcactgctgta

SEQ ID NO: 5640089 - DNA, 12 bp, Homo sapiens
tattttgtctaa

SEQ ID NO: 5640090 - DNA, 13 bp, Homo sapiens
tattttgtctaaa

SEQ ID NO: 5640091 - DNA, 17 bp, Homo sapiens
tattttgtcttattctt

SEQ ID NO: 5640092 - DNA, 20 bp, Homo sapiens
tattttgtcttattcttaag

SEQ ID NO: 5640093 - DNA, 17 bp, Homo sapiens
tattttgtgagtttgtt

SEQ ID NO: 5640094 - DNA, 19 bp, Homo sapiens
tattttgtgatgatgctgt

SEQ ID NO: 5640095 - DNA, 21 bp, Homo sapiens
tattttgtggaggcagtgtca

SEQ ID NO: 5640096 - DNA, 19 bp, Homo sapiens
tattttgtggttctatttt

SEQ ID NO: 5640097 - DNA, 15 bp, Homo sapiens
tattttgtgtacaag

SEQ ID NO: 5640098 - DNA, 17 bp, Homo sapiens
tattttgtgtacaagtt

SEQ ID NO: 5640099 - DNA, 15 bp, Homo sapiens
tattttgtgtccttt

SEQ ID NO: 5640100 - DNA, 21 bp, Homo sapiens
tattttgtgtgaccaactgtg

SEQ ID NO: 5640101 - DNA, 23 bp, Homo sapiens
tattttgtgtgaccaactgtgtt

SEQ ID NO: 5640102 - DNA, 19 bp, Homo sapiens
tattttgttaataataaga

SEQ ID NO: 5640103 - DNA, 17 bp, Homo sapiens
tattttgttacactaaa

SEQ ID NO: 5640104 - DNA, 15 bp, Homo sapiens
tattttgttcataca

SEQ ID NO: 5640105 - DNA, 19 bp, Homo sapiens
tattttgttgaccattttg

SEQ ID NO: 5640106 - DNA, 22 bp, Homo sapiens
tattttgttgtgattttgtaca

SEQ ID NO: 5640107 - DNA, 21 bp, Homo sapiens
tattttgttttgtgcagagat

SEQ ID NO: 5640108 - DNA, 24 bp, Homo sapiens
tattttgttttttttgactaaagc

SEQ ID NO: 5640109 - DNA, 19 bp, Homo sapiens
tatttttaaaaagaaatct

SEQ ID NO: 5640110 - DNA, 22 bp, Homo sapiens
tatttttaaaaagtaccacatt

SEQ ID NO: 5640111 - DNA, 17 bp, Homo sapiens
tatttttaaaagatctt

SEQ ID NO: 5640112 - DNA, 13 bp, Homo sapiens
tatttttaaaata

SEQ ID NO: 5640113 - DNA, 19 bp, Homo sapiens
tatttttaaaataatttat

SEQ ID NO: 5640114 - DNA, 15 bp, Homo sapiens
tatttttaaaatatt

SEQ ID NO: 5640115 - DNA, 13 bp, Homo sapiens
tatttttaaagaa

SEQ ID NO: 5640116 - DNA, 14 bp, Homo sapiens
tatttttaaatgga

SEQ ID NO: 5640117 - DNA, 13 bp, Homo sapiens
tatttttaaattt

SEQ ID NO: 5640118 - DNA, 12 bp, Homo sapiens
tatttttaacac

SEQ ID NO: 5640119 - DNA, 18 bp, Homo sapiens
tatttttaactctggatt

SEQ ID NO: 5640120 - DNA, 19 bp, Homo sapiens
tatttttaactctggattt

SEQ ID NO: 5640121 - DNA, 13 bp, Homo sapiens
tatttttaagaaa

SEQ ID NO: 5640122 - DNA, 18 bp, Homo sapiens
tatttttaatatgttgac

SEQ ID NO: 5640123 - DNA, 16 bp, Homo sapiens
tatttttaatggaaag

SEQ ID NO: 5640124 - DNA, 18 bp, Homo sapiens
tatttttaatggaaagtt

SEQ ID NO: 5640125 - DNA, 14 bp, Homo sapiens
tatttttaattaat

SEQ ID NO: 5640126 - DNA, 9 bp, Homo sapiens
tatttttac

SEQ ID NO: 5640127 - DNA, 14 bp, Homo sapiens
tatttttagaataa

SEQ ID NO: 5640128 - DNA, 13 bp, Homo sapiens
tatttttagagat

SEQ ID NO: 5640129 - DNA, 20 bp, Homo sapiens
tatttttagatggttacact

SEQ ID NO: 5640130 - DNA, 12 bp, Homo sapiens
tatttttataaa

SEQ ID NO: 5640131 - DNA, 22 bp, Homo sapiens
tatttttataaatataagcctt

SEQ ID NO: 5640132 - DNA, 16 bp, Homo sapiens
tatttttataatgact

SEQ ID NO: 5640133 - DNA, 17 bp, Homo sapiens
tatttttatacaaacct

SEQ ID NO: 5640134 - DNA, 23 bp, Homo sapiens
tatttttatacaagtaatttcct

SEQ ID NO: 5640135 - DNA, 18 bp, Homo sapiens
tatttttatataatatct

SEQ ID NO: 5640136 - DNA, 15 bp, Homo sapiens
tatttttatatagac

SEQ ID NO: 5640137 - DNA, 23 bp, Homo sapiens
tatttttatatagcttgaaacat

SEQ ID NO: 5640138 - DNA, 23 bp, Homo sapiens
tatttttatattaaagtaaatgg

SEQ ID NO: 5640139 - DNA, 17 bp, Homo sapiens
tatttttatatttcctt

SEQ ID NO: 5640140 - DNA, 21 bp, Homo sapiens
tatttttatcagttacacatg

SEQ ID NO: 5640141 - DNA, 12 bp, Homo sapiens
tatttttatcca

SEQ ID NO: 5640142 - DNA, 17 bp, Homo sapiens
tatttttatgtgcagcg

SEQ ID NO: 5640143 - DNA, 17 bp, Homo sapiens
tatttttattcaaacta

SEQ ID NO: 5640144 - DNA, 23 bp, Homo sapiens
tatttttattcaaactacctata

SEQ ID NO: 5640145 - DNA, 18 bp, Homo sapiens
tatttttatttatttttg

SEQ ID NO: 5640146 - DNA, 14 bp, Homo sapiens
tatttttatttcat

SEQ ID NO: 5640147 - DNA, 15 bp, Homo sapiens
tatttttatttcatt

SEQ ID NO: 5640148 - DNA, 22 bp, Homo sapiens
tatttttatttcattcacatta

SEQ ID NO: 5640149 - DNA, 19 bp, Homo sapiens
tatttttatttctgactct

SEQ ID NO: 5640150 - DNA, 17 bp, Homo sapiens
tatttttatttgtttgt

SEQ ID NO: 5640151 - DNA, 14 bp, Homo sapiens
tatttttatttttg

SEQ ID NO: 5640152 - DNA, 11 bp, Homo sapiens
tatttttcaac

SEQ ID NO: 5640153 - DNA, 15 bp, Homo sapiens
tatttttcaaggcat

SEQ ID NO: 5640154 - DNA, 16 bp, Homo sapiens
tatttttcaaggcatt

SEQ ID NO: 5640155 - DNA, 18 bp, Homo sapiens
tatttttcaataaagcat

SEQ ID NO: 5640156 - DNA, 15 bp, Homo sapiens
tatttttcacagttt

SEQ ID NO: 5640157 - DNA, 12 bp, Homo sapiens
tatttttcactc

SEQ ID NO: 5640158 - DNA, 16 bp, Homo sapiens
tatttttcagatataa

SEQ ID NO: 5640159 - DNA, 23 bp, Homo sapiens
tatttttcagatataaatactga

SEQ ID NO: 5640160 - DNA, 18 bp, Homo sapiens
tatttttcataaacaagt

SEQ ID NO: 5640161 - DNA, 19 bp, Homo sapiens
tatttttcatattgtgcca

SEQ ID NO: 5640162 - DNA, 12 bp, Homo sapiens
tatttttcatta

SEQ ID NO: 5640163 - DNA, 15 bp, Homo sapiens
tatttttccacattt

SEQ ID NO: 5640164 - DNA, 19 bp, Homo sapiens
tatttttccagctccgtgt

SEQ ID NO: 5640165 - DNA, 21 bp, Homo sapiens
tatttttccctgtttgcctat

SEQ ID NO: 5640166 - DNA, 22 bp, Homo sapiens
tatttttccctgtttgcctata

SEQ ID NO: 5640167 - DNA, 19 bp, Homo sapiens
tatttttctaaagaaatat

SEQ ID NO: 5640168 - DNA, 13 bp, Homo sapiens
tatttttctaact

SEQ ID NO: 5640169 - DNA, 16 bp, Homo sapiens
tatttttctaactaca

SEQ ID NO: 5640170 - DNA, 13 bp, Homo sapiens
tatttttctaagt

SEQ ID NO: 5640171 - DNA, 12 bp, Homo sapiens
tatttttctagt

SEQ ID NO: 5640172 - DNA, 14 bp, Homo sapiens
tatttttctagtca

SEQ ID NO: 5640173 - DNA, 15 bp, Homo sapiens
tatttttctctcctg

SEQ ID NO: 5640174 - DNA, 14 bp, Homo sapiens
tatttttctctctc

SEQ ID NO: 5640175 - DNA, 17 bp, Homo sapiens
tatttttctcttgtacc

SEQ ID NO: 5640176 - DNA, 19 bp, Homo sapiens
tatttttctcttgtaccat

SEQ ID NO: 5640177 - DNA, 20 bp, Homo sapiens
tatttttctgggcttttcct

SEQ ID NO: 5640178 - DNA, 14 bp, Homo sapiens
tatttttctgttac

SEQ ID NO: 5640179 - DNA, 15 bp, Homo sapiens
tatttttcttcagac

SEQ ID NO: 5640180 - DNA, 12 bp, Homo sapiens
tatttttcttga

SEQ ID NO: 5640181 - DNA, 20 bp, Homo sapiens
tatttttgaaagaattctat

SEQ ID NO: 5640182 - DNA, 18 bp, Homo sapiens
tatttttgaagtaaatta

SEQ ID NO: 5640183 - DNA, 22 bp, Homo sapiens
tatttttgaagtaaattaaaca

SEQ ID NO: 5640184 - DNA, 17 bp, Homo sapiens
tatttttgaagtctcct

SEQ ID NO: 5640185 - DNA, 13 bp, Homo sapiens
tatttttgaataa

SEQ ID NO: 5640186 - DNA, 18 bp, Homo sapiens
tatttttgactgtagcca

SEQ ID NO: 5640187 - DNA, 14 bp, Homo sapiens
tatttttgatgtat

SEQ ID NO: 5640188 - DNA, 19 bp, Homo sapiens
tatttttgcaaaataagtt

SEQ ID NO: 5640189 - DNA, 17 bp, Homo sapiens
tatttttgcatggcact

SEQ ID NO: 5640190 - DNA, 18 bp, Homo sapiens
tatttttgctgcttctga

SEQ ID NO: 5640191 - DNA, 16 bp, Homo sapiens
tatttttggaggttta

SEQ ID NO: 5640192 - DNA, 19 bp, Homo sapiens
tatttttggcagtctgaat

SEQ ID NO: 5640193 - DNA, 20 bp, Homo sapiens
tatttttggcagtctgaatt

SEQ ID NO: 5640194 - DNA, 17 bp, Homo sapiens
tatttttggcattcctc

SEQ ID NO: 5640195 - DNA, 19 bp, Homo sapiens
tatttttggggcatcctgg

SEQ ID NO: 5640196 - DNA, 21 bp, Homo sapiens
tatttttgggtttggccaggg

SEQ ID NO: 5640197 - DNA, 12 bp, Homo sapiens
tatttttgtaaa

SEQ ID NO: 5640198 - DNA, 18 bp, Homo sapiens
tcaaagaagtcggaatgt

SEQ ID NO: 5640199 - DNA, 15 bp, Homo sapiens
tcaaagaattacagt

SEQ ID NO: 5640200 - DNA, 15 bp, Homo sapiens
tcaaagacatttcat

SEQ ID NO: 5640201 - DNA, 12 bp, Homo sapiens
tcaaagacccca

SEQ ID NO: 5640202 - DNA, 14 bp, Homo sapiens
tcaaagaccccatg

SEQ ID NO: 5640203 - DNA, 17 bp, Homo sapiens
tcaaagaccttgtgtgt

SEQ ID NO: 5640204 - DNA, 19 bp, Homo sapiens
tcaaagaccttgtgtgtat

SEQ ID NO: 5640205 - DNA, 14 bp, Homo sapiens
tcaaagactcaaat

SEQ ID NO: 5640206 - DNA, 16 bp, Homo sapiens
tcaaagactcaaattt

SEQ ID NO: 5640207 - DNA, 17 bp, Homo sapiens
tcaaagactcaaatttt

SEQ ID NO: 5640208 - DNA, 22 bp, Homo sapiens
tcaaagactgtatttagatctc

SEQ ID NO: 5640209 - DNA, 20 bp, Homo sapiens
tcaaagacttcatttaacac

SEQ ID NO: 5640210 - DNA, 19 bp, Homo sapiens
tcaaagagaagatgcctgt

SEQ ID NO: 5640211 - DNA, 15 bp, Homo sapiens
tcaaagagaattgta

SEQ ID NO: 5640212 - DNA, 19 bp, Homo sapiens
tcaaagagatgaggaaata

SEQ ID NO: 5640213 - DNA, 21 bp, Homo sapiens
tcaaagagatgaggaaataag

SEQ ID NO: 5640214 - DNA, 15 bp, Homo sapiens
tcaaagagattcgaa

SEQ ID NO: 5640215 - DNA, 23 bp, Homo sapiens
tcaaagagcacttgagctgtctg

SEQ ID NO: 5640216 - DNA, 20 bp, Homo sapiens
tcaaagaggccagtactttg

SEQ ID NO: 5640217 - DNA, 21 bp, Homo sapiens
tcaaagaggctgaggctggca

SEQ ID NO: 5640218 - DNA, 21 bp, Homo sapiens
tcaaagagggggctctgccca

SEQ ID NO: 5640219 - DNA, 19 bp, Homo sapiens
tcaaagaggtgaacattaa

SEQ ID NO: 5640220 - DNA, 12 bp, Homo sapiens
tcaaagaggttt

SEQ ID NO: 5640221 - DNA, 20 bp, Homo sapiens
tcaaagataaatgaaataaa

SEQ ID NO: 5640222 - DNA, 22 bp, Homo sapiens
tcaaagataaatgaaataaacg

SEQ ID NO: 5640223 - DNA, 17 bp, Homo sapiens
tcaaagataacattgtt

SEQ ID NO: 5640224 - DNA, 15 bp, Homo sapiens
tcaaagatacaagaa

SEQ ID NO: 5640225 - DNA, 16 bp, Homo sapiens
tcaaagatacaagaaa

SEQ ID NO: 5640226 - DNA, 19 bp, Homo sapiens
tcaaagatacaagaaaaag

SEQ ID NO: 5640227 - DNA, 16 bp, Homo sapiens
tcaaagatctttcgtt

SEQ ID NO: 5640228 - DNA, 15 bp, Homo sapiens
tcaaagatgaaagct

SEQ ID NO: 5640229 - DNA, 15 bp, Homo sapiens
tcaaagatgataatt

SEQ ID NO: 5640230 - DNA, 15 bp, Homo sapiens
tcaaagatgatggaa

SEQ ID NO: 5640231 - DNA, 14 bp, Homo sapiens
tcaaagatgcattt

SEQ ID NO: 5640232 - DNA, 15 bp, Homo sapiens
tcaaagatgccccat

SEQ ID NO: 5640233 - DNA, 23 bp, Homo sapiens
tcaaagatgcgtttgcctcctgg

SEQ ID NO: 5640234 - DNA, 20 bp, Homo sapiens
tcaaagatggattaaactca

SEQ ID NO: 5640235 - DNA, 11 bp, Homo sapiens
tcaaagatgta

SEQ ID NO: 5640236 - DNA, 13 bp, Homo sapiens
tcaaagatgtact

SEQ ID NO: 5640237 - DNA, 17 bp, Homo sapiens
tcaaagattctgcattt

SEQ ID NO: 5640238 - DNA, 14 bp, Homo sapiens
tcaaagcaaccacc

SEQ ID NO: 5640239 - DNA, 16 bp, Homo sapiens
tcaaagcaaccacctg

SEQ ID NO: 5640240 - DNA, 19 bp, Homo sapiens
tcaaagcaagcattcagaa

SEQ ID NO: 5640241 - DNA, 13 bp, Homo sapiens
tcaaagcaagggc

SEQ ID NO: 5640242 - DNA, 14 bp, Homo sapiens
tcaaagcaatgcat

SEQ ID NO: 5640243 - DNA, 12 bp, Homo sapiens
tcaaagcaattg

SEQ ID NO: 5640244 - DNA, 19 bp, Homo sapiens
tcaaagcaattgaaatgca

SEQ ID NO: 5640245 - DNA, 15 bp, Homo sapiens
tcaaagcacatatgt

SEQ ID NO: 5640246 - DNA, 22 bp, Homo sapiens
tcaaagcaccaaaataagaaaa

SEQ ID NO: 5640247 - DNA, 20 bp, Homo sapiens
tcaaagcacctgaaccactg

SEQ ID NO: 5640248 - DNA, 21 bp, Homo sapiens
tcaaagcacctgaaccactgt

SEQ ID NO: 5640249 - DNA, 23 bp, Homo sapiens
tcaaagcaccttgaatggaaggt

SEQ ID NO: 5640250 - DNA, 19 bp, Homo sapiens
tcaaagcactgttgagaag

SEQ ID NO: 5640251 - DNA, 10 bp, Homo sapiens
tcaaagcaga

SEQ ID NO: 5640252 - DNA, 20 bp, Homo sapiens
tcaaagcagaagtctggctt

SEQ ID NO: 5640253 - DNA, 23 bp, Homo sapiens
tcaaagcagagtgggacttggag

SEQ ID NO: 5640254 - DNA, 22 bp, Homo sapiens
tcaaagcagcaggactgtggga

SEQ ID NO: 5640255 - DNA, 19 bp, Homo sapiens
tcaaagcaggggagtatgc

SEQ ID NO: 5640256 - DNA, 20 bp, Homo sapiens
tcaaagcatggacatttaga

SEQ ID NO: 5640257 - DNA, 22 bp, Homo sapiens
tcaaagcatggacatttagaag

SEQ ID NO: 5640258 - DNA, 21 bp, Homo sapiens
tcaaagcatgggattattaga

SEQ ID NO: 5640259 - DNA, 18 bp, Homo sapiens
tcaaagccaagtttatat

SEQ ID NO: 5640260 - DNA, 15 bp, Homo sapiens
tcaaagccacattat

SEQ ID NO: 5640261 - DNA, 17 bp, Homo sapiens
tcaaagccacattattt

SEQ ID NO: 5640262 - DNA, 18 bp, Homo sapiens
tcaaagccacattatttc

SEQ ID NO: 5640263 - DNA, 20 bp, Homo sapiens
tcaaagccacattatttcta

SEQ ID NO: 5640264 - DNA, 23 bp, Homo sapiens
tcaaagccagcgtcctcctctgt

SEQ ID NO: 5640265 - DNA, 15 bp, Homo sapiens
tcaaagccagggtct

SEQ ID NO: 5640266 - DNA, 22 bp, Homo sapiens
tcaaagccatatggacactgtg

SEQ ID NO: 5640267 - DNA, 12 bp, Homo sapiens
tcaaagcccaga

SEQ ID NO: 5640268 - DNA, 18 bp, Homo sapiens
tcaaagccccattaactg

SEQ ID NO: 5640269 - DNA, 21 bp, Homo sapiens
tcaaagccccattaactgctt

SEQ ID NO: 5640270 - DNA, 16 bp, Homo sapiens
tcaaagccctgcctct

SEQ ID NO: 5640271 - DNA, 17 bp, Homo sapiens
tcaaagccctgcctctg

SEQ ID NO: 5640272 - DNA, 19 bp, Homo sapiens
tcaaagccctgcctctgtg

SEQ ID NO: 5640273 - DNA, 20 bp, Homo sapiens
tcaaagccctgcctctgtgt

SEQ ID NO: 5640274 - DNA, 11 bp, Homo sapiens
tcaaagccttc

SEQ ID NO: 5640275 - DNA, 17 bp, Homo sapiens
tcaaagcgaacagtcca

SEQ ID NO: 5640276 - DNA, 19 bp, Homo sapiens
tcaaagcggatgctggcca

SEQ ID NO: 5640277 - DNA, 23 bp, Homo sapiens
tcaaagcggtttaaccacattaa

SEQ ID NO: 5640278 - DNA, 15 bp, Homo sapiens
tcaaagctaaaaaat

SEQ ID NO: 5640279 - DNA, 19 bp, Homo sapiens
tcaaagctaggaaaggcag

SEQ ID NO: 5640280 - DNA, 14 bp, Homo sapiens
tcaaagctgaaatg

SEQ ID NO: 5640281 - DNA, 11 bp, Homo sapiens
tcaaagctgcc

SEQ ID NO: 5640282 - DNA, 23 bp, Homo sapiens
tcaaagctgggaagaccctttca

SEQ ID NO: 5640283 - DNA, 17 bp, Homo sapiens
tcaaagcttcaaaaact

SEQ ID NO: 5640284 - DNA, 17 bp, Homo sapiens
tcaaagcttccattcca

SEQ ID NO: 5640285 - DNA, 22 bp, Homo sapiens
tcaaagcttggattaaatacat

SEQ ID NO: 5640286 - DNA, 14 bp, Homo sapiens
tcaaagcttgtgaa

SEQ ID NO: 5640287 - DNA, 18 bp, Homo sapiens
tcaaagctttcctgtttc

SEQ ID NO: 5640288 - DNA, 20 bp, Homo sapiens
tcaaagcttttgtaaaataa

SEQ ID NO: 5640289 - DNA, 16 bp, Homo sapiens
tcaaagctttttccag

SEQ ID NO: 5640290 - DNA, 15 bp, Homo sapiens
tcaaagctttttgaa

SEQ ID NO: 5640291 - DNA, 11 bp, Homo sapiens
tcaaaggaaaa

SEQ ID NO: 5640292 - DNA, 22 bp, Homo sapiens
tcaaaggaaaacacctttattt

SEQ ID NO: 5640293 - DNA, 12 bp, Homo sapiens
tcaaaggaagac

SEQ ID NO: 5640294 - DNA, 15 bp, Homo sapiens
tcaaaggaatataag

SEQ ID NO: 5640295 - DNA, 15 bp, Homo sapiens
tcaaaggacaaagtg

SEQ ID NO: 5640296 - DNA, 13 bp, Homo sapiens
tcaaaggagaaaa

SEQ ID NO: 5640297 - DNA, 15 bp, Homo sapiens
tcaaaggagaaaaaa

SEQ ID NO: 5640298 - DNA, 18 bp, Homo sapiens
tcaaaggagctttctcaa

SEQ ID NO: 5640299 - DNA, 13 bp, Homo sapiens
tcaaaggcagaaa

SEQ ID NO: 5640300 - DNA, 18 bp, Homo sapiens
tcaaaggcatctcccttc

SEQ ID NO: 5640301 - DNA, 19 bp, Homo sapiens
tcaaagggacggtcagttt

SEQ ID NO: 5640302 - DNA, 14 bp, Homo sapiens
tcaaagggactttt

SEQ ID NO: 5640303 - DNA, 16 bp, Homo sapiens
tcaaagggagagaaaa

SEQ ID NO: 5640304 - DNA, 18 bp, Homo sapiens
tcaaagggagagaaaagc

SEQ ID NO: 5640305 - DNA, 17 bp, Homo sapiens
tcaaagggataaagaaa

SEQ ID NO: 5640306 - DNA, 17 bp, Homo sapiens
tcaaagggtgaaaatta

SEQ ID NO: 5640307 - DNA, 15 bp, Homo sapiens
tcaaaggtacttgga

SEQ ID NO: 5640308 - DNA, 16 bp, Homo sapiens
tcaaaggtacttggat

SEQ ID NO: 5640309 - DNA, 19 bp, Homo sapiens
tcaaaggtagccatcatgg

SEQ ID NO: 5640310 - DNA, 22 bp, Homo sapiens
tcaaaggtcgggacagctgtgc

SEQ ID NO: 5640311 - DNA, 16 bp, Homo sapiens
tcaaaggttctaggtt

SEQ ID NO: 5640312 - DNA, 23 bp, Homo sapiens
tcaaaggttctaggtttcaaaga

SEQ ID NO: 5640313 - DNA, 14 bp, Homo sapiens
tcaaagtaaaaatt

SEQ ID NO: 5640314 - DNA, 21 bp, Homo sapiens
tcaaagtaaaggcctcctccc

SEQ ID NO: 5640315 - DNA, 19 bp, Homo sapiens
tcaaagtaatatatcaaat

SEQ ID NO: 5640316 - DNA, 20 bp, Homo sapiens
tcaaagtaatatatcaaatc

SEQ ID NO: 5640317 - DNA, 19 bp, Homo sapiens
tcaaagtaccacactgaaa

SEQ ID NO: 5640318 - DNA, 20 bp, Homo sapiens
tcaaagtagaaactactaat

SEQ ID NO: 5640319 - DNA, 18 bp, Homo sapiens
tcaaagtaggcaggacca

SEQ ID NO: 5640320 - DNA, 14 bp, Homo sapiens
tcaaagtagttagt

SEQ ID NO: 5640321 - DNA, 15 bp, Homo sapiens
tcaaagtagttagtt

SEQ ID NO: 5640322 - DNA, 16 bp, Homo sapiens
tcaaagtataatcttt

SEQ ID NO: 5640323 - DNA, 13 bp, Homo sapiens
tcaaagtatttgt

SEQ ID NO: 5640324 - DNA, 15 bp, Homo sapiens
tcaaagtcagaacaa

SEQ ID NO: 5640325 - DNA, 16 bp, Homo sapiens
tcaaagtcatgatgtt

SEQ ID NO: 5640326 - DNA, 13 bp, Homo sapiens
tcaaagtcattaa

SEQ ID NO: 5640327 - DNA, 18 bp, Homo sapiens
tcaaagtcattaaagaca

SEQ ID NO: 5640328 - DNA, 17 bp, Homo sapiens
tcaaagtctcatagctt

SEQ ID NO: 5640329 - DNA, 20 bp, Homo sapiens
tcaaagtgaaagacatttca

SEQ ID NO: 5640330 - DNA, 22 bp, Homo sapiens
tcaaagtgagaaaatgcctcaa

SEQ ID NO: 5640331 - DNA, 16 bp, Homo sapiens
tcaaagtgcctgggct

SEQ ID NO: 5640332 - DNA, 23 bp, Homo sapiens
tcaaagtgcctgggctcagcctg

SEQ ID NO: 5640333 - DNA, 11 bp, Homo sapiens
tcaaagtggaa

SEQ ID NO: 5640334 - DNA, 16 bp, Homo sapiens
tcaaagtggatgcaat

SEQ ID NO: 5640335 - DNA, 17 bp, Homo sapiens
tcaaagtggggtacagt

SEQ ID NO: 5640336 - DNA, 17 bp, Homo sapiens
tcaaagtggtaaatact

SEQ ID NO: 5640337 - DNA, 18 bp, Homo sapiens
tcaaagtggtacaggaag

SEQ ID NO: 5640338 - DNA, 20 bp, Homo sapiens
tcaaagtgtaaacaccatag

SEQ ID NO: 5640339 - DNA, 17 bp, Homo sapiens
tcaaagtgtaagcactt

SEQ ID NO: 5640340 - DNA, 13 bp, Homo sapiens
tcaaagtgtatat

SEQ ID NO: 5640341 - DNA, 19 bp, Homo sapiens
tcaaagtgtatatttattc

SEQ ID NO: 5640342 - DNA, 21 bp, Homo sapiens
tcaaagtgttgctgtggctcc

SEQ ID NO: 5640343 - DNA, 21 bp, Homo sapiens
tcaaagtgttgtgttcctggc

SEQ ID NO: 5640344 - DNA, 14 bp, Homo sapiens
tcaaagtgtttaat

SEQ ID NO: 5640345 - DNA, 14 bp, Homo sapiens
tcaaagttgaaaat

SEQ ID NO: 5640346 - DNA, 19 bp, Homo sapiens
tcaaagttgcctaaatcca

SEQ ID NO: 5640347 - DNA, 22 bp, Homo sapiens
tcaaagttgcctaaatccattt

SEQ ID NO: 5640348 - DNA, 23 bp, Homo sapiens
tcaaagttgtagttcttgtgcat

SEQ ID NO: 5640349 - DNA, 15 bp, Homo sapiens
tcaaagtttatatgc

SEQ ID NO: 5640350 - DNA, 17 bp, Homo sapiens
tcaaagtttatatgcct

SEQ ID NO: 5640351 - DNA, 11 bp, Homo sapiens
tcaaagtttta

SEQ ID NO: 5640352 - DNA, 22 bp, Homo sapiens
tcaaagttttgaaaagctatta

SEQ ID NO: 5640353 - DNA, 18 bp, Homo sapiens
tcaaagtttttacagtgt

SEQ ID NO: 5640354 - DNA, 19 bp, Homo sapiens
tcaaagtttttacagtgta

SEQ ID NO: 5640355 - DNA, 14 bp, Homo sapiens
tcaaataaaaataa

SEQ ID NO: 5640356 - DNA, 20 bp, Homo sapiens
tcaaataaaaattctagatt

SEQ ID NO: 5640357 - DNA, 15 bp, Homo sapiens
tcaaataaaatatca

SEQ ID NO: 5640358 - DNA, 13 bp, Homo sapiens
tcaaataaacctt

SEQ ID NO: 5640359 - DNA, 20 bp, Homo sapiens
tcaaataaaccttgtttctt

SEQ ID NO: 5640360 - DNA, 23 bp, Homo sapiens
tcaaataaagagagaacaggact

SEQ ID NO: 5640361 - DNA, 21 bp, Homo sapiens
tcaaataaatgtttcccccac

SEQ ID NO: 5640362 - DNA, 22 bp, Homo sapiens
tcaaataaatgtttcccccact

SEQ ID NO: 5640363 - DNA, 14 bp, Homo sapiens
tcaaataaatttct

SEQ ID NO: 5640364 - DNA, 21 bp, Homo sapiens
tcaaataaccctgaatcagag

SEQ ID NO: 5640365 - DNA, 12 bp, Homo sapiens
tcaaataactaa

SEQ ID NO: 5640366 - DNA, 19 bp, Homo sapiens
tcaaataactgcagaaaaa

SEQ ID NO: 5640367 - DNA, 20 bp, Homo sapiens
tcaaataagtatttataata

SEQ ID NO: 5640368 - DNA, 19 bp, Homo sapiens
tcaaataatacatctttat

SEQ ID NO: 5640369 - DNA, 19 bp, Homo sapiens
tcaaataataccttagaag

SEQ ID NO: 5640370 - DNA, 15 bp, Homo sapiens
tcaaataatattcat

SEQ ID NO: 5640371 - DNA, 18 bp, Homo sapiens
tcaaataatccattccaa

SEQ ID NO: 5640372 - DNA, 19 bp, Homo sapiens
tcaaataatgcttttctaa

SEQ ID NO: 5640373 - DNA, 14 bp, Homo sapiens
tcaaatacaaagta

SEQ ID NO: 5640374 - DNA, 19 bp, Homo sapiens
tcaaatacaaagtaaatac

SEQ ID NO: 5640375 - DNA, 20 bp, Homo sapiens
tcaaatacaaagtaaataca

SEQ ID NO: 5640376 - DNA, 17 bp, Homo sapiens
tcaactccaaggcaaat

SEQ ID NO: 5640377 - DNA, 20 bp, Homo sapiens
tcaactccaaggcaaatgtc

SEQ ID NO: 5640378 - DNA, 15 bp, Homo sapiens
tcaactccagctccc

SEQ ID NO: 5640379 - DNA, 12 bp, Homo sapiens
tcaactcctggc

SEQ ID NO: 5640380 - DNA, 13 bp, Homo sapiens
tcaactcctggct

SEQ ID NO: 5640381 - DNA, 14 bp, Homo sapiens
tcaactcctggctc

SEQ ID NO: 5640382 - DNA, 15 bp, Homo sapiens
tcaactcctggctcc

SEQ ID NO: 5640383 - DNA, 14 bp, Homo sapiens
tcaactctgagccc

SEQ ID NO: 5640384 - DNA, 17 bp, Homo sapiens
tcaactctgctgagggt

SEQ ID NO: 5640385 - DNA, 22 bp, Homo sapiens
tcaactctgctgagggtccaga

SEQ ID NO: 5640386 - DNA, 12 bp, Homo sapiens
tcaactctgtga

SEQ ID NO: 5640387 - DNA, 19 bp, Homo sapiens
tcaactctgtgtcccagca

SEQ ID NO: 5640388 - DNA, 19 bp, Homo sapiens
tcaactcttgagtttttca

SEQ ID NO: 5640389 - DNA, 19 bp, Homo sapiens
tcaactgagaagccaagcc

SEQ ID NO: 5640390 - DNA, 19 bp, Homo sapiens
tcaactgaggttcttggga

SEQ ID NO: 5640391 - DNA, 20 bp, Homo sapiens
tcaactgcatcaagatgtga

SEQ ID NO: 5640392 - DNA, 19 bp, Homo sapiens
tcaactgccaaaatgctct

SEQ ID NO: 5640393 - DNA, 20 bp, Homo sapiens
tcaactgccaaaatgctcta

SEQ ID NO: 5640394 - DNA, 15 bp, Homo sapiens
tcaactgcccagcaa

SEQ ID NO: 5640395 - DNA, 22 bp, Homo sapiens
tcaactgcccctgacttaactt

SEQ ID NO: 5640396 - DNA, 14 bp, Homo sapiens
tcaactgcctactc

SEQ ID NO: 5640397 - DNA, 18 bp, Homo sapiens
tcaactgcctactccaaa

SEQ ID NO: 5640398 - DNA, 20 bp, Homo sapiens
tcaactgcctactccaaaat

SEQ ID NO: 5640399 - DNA, 17 bp, Homo sapiens
tcaactgctgttttatg

SEQ ID NO: 5640400 - DNA, 12 bp, Homo sapiens
tcaactgctttg

SEQ ID NO: 5640401 - DNA, 19 bp, Homo sapiens
tcaactggacatcacagca

SEQ ID NO: 5640402 - DNA, 18 bp, Homo sapiens
tcaactggagcaagaagg

SEQ ID NO: 5640403 - DNA, 23 bp, Homo sapiens
tcaactggagcaagaaggaagga

SEQ ID NO: 5640404 - DNA, 21 bp, Homo sapiens
tcaactggagtctatgcttaa

SEQ ID NO: 5640405 - DNA, 22 bp, Homo sapiens
tcaactggggggaccaaatagc

SEQ ID NO: 5640406 - DNA, 18 bp, Homo sapiens
tcaactggggggcaattt

SEQ ID NO: 5640407 - DNA, 16 bp, Homo sapiens
tcaactgggtccagaa

SEQ ID NO: 5640408 - DNA, 17 bp, Homo sapiens
tcaactgggtccagaag

SEQ ID NO: 5640409 - DNA, 22 bp, Homo sapiens
tcaactgtataccgtgtgctcc

SEQ ID NO: 5640410 - DNA, 22 bp, Homo sapiens
tcaactgtattgggccttttgg

SEQ ID NO: 5640411 - DNA, 23 bp, Homo sapiens
tcaactgtcttcctcaaaataaa

SEQ ID NO: 5640412 - DNA, 15 bp, Homo sapiens
tcaacttaaagtgaa

SEQ ID NO: 5640413 - DNA, 15 bp, Homo sapiens
tcaacttaaatcact

SEQ ID NO: 5640414 - DNA, 12 bp, Homo sapiens
tcaacttaacat

SEQ ID NO: 5640415 - DNA, 20 bp, Homo sapiens
tcaacttagtcaataagaaa

SEQ ID NO: 5640416 - DNA, 16 bp, Homo sapiens
tcaacttattctttga

SEQ ID NO: 5640417 - DNA, 18 bp, Homo sapiens
tcaacttatttcataatt

SEQ ID NO: 5640418 - DNA, 19 bp, Homo sapiens
tcaacttatttcataattg

SEQ ID NO: 5640419 - DNA, 22 bp, Homo sapiens
tcaacttatttctgaaaaagag

SEQ ID NO: 5640420 - DNA, 14 bp, Homo sapiens
tcaacttcaggaaa

SEQ ID NO: 5640421 - DNA, 15 bp, Homo sapiens
tcaacttgaagcaag

SEQ ID NO: 5640422 - DNA, 13 bp, Homo sapiens
tcaacttgcaaaa

SEQ ID NO: 5640423 - DNA, 19 bp, Homo sapiens
tcaacttgcatccaactcc

SEQ ID NO: 5640424 - DNA, 14 bp, Homo sapiens
tcaacttggatcat

SEQ ID NO: 5640425 - DNA, 13 bp, Homo sapiens
tcaactttactgt

SEQ ID NO: 5640426 - DNA, 16 bp, Homo sapiens
tcaactttcatttgaa

SEQ ID NO: 5640427 - DNA, 20 bp, Homo sapiens
tcaactttcctcaaatcaaa

SEQ ID NO: 5640428 - DNA, 12 bp, Homo sapiens
tcaactttgaat

SEQ ID NO: 5640429 - DNA, 19 bp, Homo sapiens
tcaactttggttcctgtga

SEQ ID NO: 5640430 - DNA, 16 bp, Homo sapiens
tcaactttgtaaaaat

SEQ ID NO: 5640431 - DNA, 13 bp, Homo sapiens
tcaacttttctga

SEQ ID NO: 5640432 - DNA, 14 bp, Homo sapiens
tcaacttttgacaa

SEQ ID NO: 5640433 - DNA, 17 bp, Homo sapiens
tcaactttttattgcct

SEQ ID NO: 5640434 - DNA, 22 bp, Homo sapiens
tcaactttttattgccttctca

SEQ ID NO: 5640435 - DNA, 13 bp, Homo sapiens
tcaactttttcct

SEQ ID NO: 5640436 - DNA, 16 bp, Homo sapiens
tcaagaaaaaaaggga

SEQ ID NO: 5640437 - DNA, 21 bp, Homo sapiens
tcaagaaaaattattgtataa

SEQ ID NO: 5640438 - DNA, 16 bp, Homo sapiens
tcaagaaaacagcaag

SEQ ID NO: 5640439 - DNA, 15 bp, Homo sapiens
tcaagaaaacaggca

SEQ ID NO: 5640440 - DNA, 16 bp, Homo sapiens
tcaagaaaactggaaa

SEQ ID NO: 5640441 - DNA, 17 bp, Homo sapiens
tcaagaaaactggaaat

SEQ ID NO: 5640442 - DNA, 14 bp, Homo sapiens
tcaagaaaagaatt

SEQ ID NO: 5640443 - DNA, 14 bp, Homo sapiens
tcaagaaaatcttt

SEQ ID NO: 5640444 - DNA, 21 bp, Homo sapiens
tcaagaaaatctttgttgaag

SEQ ID NO: 5640445 - DNA, 17 bp, Homo sapiens
tcaagaaactgaggaat

SEQ ID NO: 5640446 - DNA, 22 bp, Homo sapiens
tcaagaaactgaggaattttct

SEQ ID NO: 5640447 - DNA, 23 bp, Homo sapiens
tcaagaaactgaggaattttctt

SEQ ID NO: 5640448 - DNA, 20 bp, Homo sapiens
tcaagaaagcagtatatatt

SEQ ID NO: 5640449 - DNA, 18 bp, Homo sapiens
tcaagaaagccagtctta

SEQ ID NO: 5640450 - DNA, 20 bp, Homo sapiens
tcaagaaagccagtcttaac

SEQ ID NO: 5640451 - DNA, 15 bp, Homo sapiens
tcaagaaataggtta

SEQ ID NO: 5640452 - DNA, 10 bp, Homo sapiens
tcaagaaatg

SEQ ID NO: 5640453 - DNA, 15 bp, Homo sapiens
tcaagaaatgagtct

SEQ ID NO: 5640454 - DNA, 15 bp, Homo sapiens
tcaagaaattctgct

SEQ ID NO: 5640455 - DNA, 15 bp, Homo sapiens
tcaagaaattttcaa

SEQ ID NO: 5640456 - DNA, 14 bp, Homo sapiens
tcaagaacaagcaa

SEQ ID NO: 5640457 - DNA, 23 bp, Homo sapiens
tcaagaacatgatgggcctgaac

SEQ ID NO: 5640458 - DNA, 15 bp, Homo sapiens
tcaagaacttgttta

SEQ ID NO: 5640459 - DNA, 14 bp, Homo sapiens
tcaagaagaaaaag

SEQ ID NO: 5640460 - DNA, 13 bp, Homo sapiens
tcaagaagaaagt

SEQ ID NO: 5640461 - DNA, 13 bp, Homo sapiens
tcaagaagacact

SEQ ID NO: 5640462 - DNA, 23 bp, Homo sapiens
tcaagaagacggattatctagag

SEQ ID NO: 5640463 - DNA, 17 bp, Homo sapiens
tcaagaagatagttgta

SEQ ID NO: 5640464 - DNA, 20 bp, Homo sapiens
tcaagaagtatttttttaat

SEQ ID NO: 5640465 - DNA, 14 bp, Homo sapiens
tcaagaagttcttt

SEQ ID NO: 5640466 - DNA, 17 bp, Homo sapiens
tcaagaatctagaagat

SEQ ID NO: 5640467 - DNA, 15 bp, Homo sapiens
tcaagaatgcaatat

SEQ ID NO: 5640468 - DNA, 20 bp, Homo sapiens
tcaagaattagaagtctttc

SEQ ID NO: 5640469 - DNA, 18 bp, Homo sapiens
tcaagacaagagctgtta

SEQ ID NO: 5640470 - DNA, 19 bp, Homo sapiens
tcaagacaagagctgttat

SEQ ID NO: 5640471 - DNA, 21 bp, Homo sapiens
tcaagacagatgagcaggagc

SEQ ID NO: 5640472 - DNA, 21 bp, Homo sapiens
tcaagacatagcatccaagtg

SEQ ID NO: 5640473 - DNA, 13 bp, Homo sapiens
tcaagacatttct

SEQ ID NO: 5640474 - DNA, 14 bp, Homo sapiens
tcaagacatttgct

SEQ ID NO: 5640475 - DNA, 13 bp, Homo sapiens
tcaagaccaaatg

SEQ ID NO: 5640476 - DNA, 21 bp, Homo sapiens
tcaagaccaaatggaaacaga

SEQ ID NO: 5640477 - DNA, 23 bp, Homo sapiens
tcaagaccaggctgcagcctcca

SEQ ID NO: 5640478 - DNA, 19 bp, Homo sapiens
tcaagaccagtctggccaa

SEQ ID NO: 5640479 - DNA, 11 bp, Homo sapiens
tcaagaccccc

SEQ ID NO: 5640480 - DNA, 22 bp, Homo sapiens
tcaagacccccatttgtcccag

SEQ ID NO: 5640481 - DNA, 17 bp, Homo sapiens
tcaagacgaggggcagg

SEQ ID NO: 5640482 - DNA, 17 bp, Homo sapiens
tcaagacggatccacag

SEQ ID NO: 5640483 - DNA, 19 bp, Homo sapiens
tcaagacggatccacagta

SEQ ID NO: 5640484 - DNA, 19 bp, Homo sapiens
tcaagactatctacaaaaa

SEQ ID NO: 5640485 - DNA, 17 bp, Homo sapiens
tcaagactatgttctcc

SEQ ID NO: 5640486 - DNA, 12 bp, Homo sapiens
tcaagactgaaa

SEQ ID NO: 5640487 - DNA, 16 bp, Homo sapiens
tcaagactgaattcca

SEQ ID NO: 5640488 - DNA, 14 bp, Homo sapiens
tcaagactgatcat

SEQ ID NO: 5640489 - DNA, 15 bp, Homo sapiens
tcaagactttagctt

SEQ ID NO: 5640490 - DNA, 20 bp, Homo sapiens
tcaagactttagcttttcct

SEQ ID NO: 5640491 - DNA, 21 bp, Homo sapiens
tcaagactttagcttttcctt

SEQ ID NO: 5640492 - DNA, 15 bp, Homo sapiens
tcaagagaatcaaca

SEQ ID NO: 5640493 - DNA, 14 bp, Homo sapiens
tcaagagacatggt

SEQ ID NO: 5640494 - DNA, 15 bp, Homo sapiens
tcaagagactgagtc

SEQ ID NO: 5640495 - DNA, 22 bp, Homo sapiens
tcaagagagaggctgagaaatg

SEQ ID NO: 5640496 - DNA, 16 bp, Homo sapiens
tcaagagatctttctt

SEQ ID NO: 5640497 - DNA, 17 bp, Homo sapiens
tcaagagattctgcctc

SEQ ID NO: 5640498 - DNA, 15 bp, Homo sapiens
tcaagagatttaatt

SEQ ID NO: 5640499 - DNA, 14 bp, Homo sapiens
tcaagagccaagac

SEQ ID NO: 5640500 - DNA, 15 bp, Homo sapiens
tcaagagcctcccct

SEQ ID NO: 5640501 - DNA, 19 bp, Homo sapiens
tcaagagccttaaaacatc

SEQ ID NO: 5640502 - DNA, 17 bp, Homo sapiens
tcaagagctgccctcct

SEQ ID NO: 5640503 - DNA, 22 bp, Homo sapiens
tcaagaggaatgaaaaaagctt

SEQ ID NO: 5640504 - DNA, 23 bp, Homo sapiens
tcaagaggacaatctagctctcc

SEQ ID NO: 5640505 - DNA, 17 bp, Homo sapiens
tcaagaggataaatttt

SEQ ID NO: 5640506 - DNA, 16 bp, Homo sapiens
tcaagaggcagagttc

SEQ ID NO: 5640507 - DNA, 19 bp, Homo sapiens
tcaagaggtttttctcccc

SEQ ID NO: 5640508 - DNA, 15 bp, Homo sapiens
tcaagagtccggatt

SEQ ID NO: 5640509 - DNA, 19 bp, Homo sapiens
tcaagagtccggatttcta

SEQ ID NO: 5640510 - DNA, 21 bp, Homo sapiens
tcaagagtccggatttctaac

SEQ ID NO: 5640511 - DNA, 18 bp, Homo sapiens
tcaagagtctctccagcc

SEQ ID NO: 5640512 - DNA, 19 bp, Homo sapiens
tcaagagtctctccagcct

SEQ ID NO: 5640513 - DNA, 21 bp, Homo sapiens
tcaagagtgaattccctcact

SEQ ID NO: 5640514 - DNA, 15 bp, Homo sapiens
tcaagagtgctgaga

SEQ ID NO: 5640515 - DNA, 12 bp, Homo sapiens
tcaagagtgggg

SEQ ID NO: 5640516 - DNA, 18 bp, Homo sapiens
tcaagagttcagtgctca

SEQ ID NO: 5640517 - DNA, 19 bp, Homo sapiens
tcaagagtttattattgta

SEQ ID NO: 5640518 - DNA, 22 bp, Homo sapiens
tcaagataatcctagagtctta

SEQ ID NO: 5640519 - DNA, 17 bp, Homo sapiens
tcaagatacatgttgta

SEQ ID NO: 5640520 - DNA, 20 bp, Homo sapiens
tcaagatacatgttgtattt

SEQ ID NO: 5640521 - DNA, 18 bp, Homo sapiens
tcaagatacatttcatct

SEQ ID NO: 5640522 - DNA, 22 bp, Homo sapiens
tcaagatactgctactgtaatt

SEQ ID NO: 5640523 - DNA, 19 bp, Homo sapiens
tcaagatatatgtgtatac

SEQ ID NO: 5640524 - DNA, 21 bp, Homo sapiens
tcaagatatatgtgtatacat

SEQ ID NO: 5640525 - DNA, 13 bp, Homo sapiens
tcaagatatggaa

SEQ ID NO: 5640526 - DNA, 18 bp, Homo sapiens
tcaagatattcaggtggc

SEQ ID NO: 5640527 - DNA, 16 bp, Homo sapiens
tcaagatcaatgaaat

SEQ ID NO: 5640528 - DNA, 22 bp, Homo sapiens
tcaagatccaaatgctgtgcaa

SEQ ID NO: 5640529 - DNA, 22 bp, Homo sapiens
tcaagatcctcttgccacatct

SEQ ID NO: 5640530 - DNA, 14 bp, Homo sapiens
tcaagatgagcctg

SEQ ID NO: 5640531 - DNA, 16 bp, Homo sapiens
tcaagatgagcctggg

SEQ ID NO: 5640532 - DNA, 20 bp, Homo sapiens
tcaagatgctacaatggaaa

SEQ ID NO: 5640533 - DNA, 22 bp, Homo sapiens
tcaagatgggtgattatgaaat

SEQ ID NO: 5640534 - DNA, 18 bp, Homo sapiens
tcaagatgttatattaaa

SEQ ID NO: 5640535 - DNA, 20 bp, Homo sapiens
tcaagatgttatattaaaga

SEQ ID NO: 5640536 - DNA, 23 bp, Homo sapiens
tcaagattaattaaaatttggga

SEQ ID NO: 5640537 - DNA, 14 bp, Homo sapiens
tcaagattcagcta

SEQ ID NO: 5640538 - DNA, 16 bp, Homo sapiens
tcaagattcccaggag

SEQ ID NO: 5640539 - DNA, 19 bp, Homo sapiens
tcaagattcccaggagttc

SEQ ID NO: 5640540 - DNA, 20 bp, Homo sapiens
tcaagattcccaggagttct

SEQ ID NO: 5640541 - DNA, 16 bp, Homo sapiens
tcaagattctaaagct

SEQ ID NO: 5640542 - DNA, 18 bp, Homo sapiens
tcaagattctaaagctca

SEQ ID NO: 5640543 - DNA, 16 bp, Homo sapiens
tcaagatttgaccaaa

SEQ ID NO: 5640544 - DNA, 18 bp, Homo sapiens
tcaagattttttttgtaa

SEQ ID NO: 5640545 - DNA, 19 bp, Homo sapiens
tcaagattttttttgtaac

SEQ ID NO: 5640546 - DNA, 20 bp, Homo sapiens
tcaagattttttttgtaact

SEQ ID NO: 5640547 - DNA, 22 bp, Homo sapiens
tcaagattttttttgtaacttc

SEQ ID NO: 5640548 - DNA, 22 bp, Homo sapiens
tcaagcaaaaaaggtaactaac

SEQ ID NO: 5640549 - DNA, 21 bp, Homo sapiens
tcaagcaaacagcttcacaaa

SEQ ID NO: 5640550 - DNA, 14 bp, Homo sapiens
tcaagcaaacatca

SEQ ID NO: 5640551 - DNA, 20 bp, Homo sapiens
tcaagcaaagtattgtgaaa

SEQ ID NO: 5640552 - DNA, 23 bp, Homo sapiens
tcaagcaaatatttatgacctca

SEQ ID NO: 5640553 - DNA, 20 bp, Homo sapiens
tcaatggcaccttcattctc

SEQ ID NO: 5640554 - DNA, 15 bp, Homo sapiens
tcaatggctttgtac

SEQ ID NO: 5640555 - DNA, 12 bp, Homo sapiens
tcaatggctttt

SEQ ID NO: 5640556 - DNA, 21 bp, Homo sapiens
tcaatgggagtgaacatttct

SEQ ID NO: 5640557 - DNA, 23 bp, Homo sapiens
tcaatgggattttctagtttcct

SEQ ID NO: 5640558 - DNA, 17 bp, Homo sapiens
tcaatgggcaatgacag

SEQ ID NO: 5640559 - DNA, 16 bp, Homo sapiens
tcaatgggtaaataaa

SEQ ID NO: 5640560 - DNA, 18 bp, Homo sapiens
tcaatgggtaaataaatg

SEQ ID NO: 5640561 - DNA, 22 bp, Homo sapiens
tcaatgggttttaattttcagt

SEQ ID NO: 5640562 - DNA, 12 bp, Homo sapiens
tcaatggtagat

SEQ ID NO: 5640563 - DNA, 22 bp, Homo sapiens
tcaatggtagattcgctgtccc

SEQ ID NO: 5640564 - DNA, 17 bp, Homo sapiens
tcaatggttcaagtctt

SEQ ID NO: 5640565 - DNA, 19 bp, Homo sapiens
tcaatggtttaacatataa

SEQ ID NO: 5640566 - DNA, 17 bp, Homo sapiens
tcaatgtacatagaccc

SEQ ID NO: 5640567 - DNA, 17 bp, Homo sapiens
tcaatgtacttgtttga

SEQ ID NO: 5640568 - DNA, 20 bp, Homo sapiens
tcaatgtcataaatgtcaca

SEQ ID NO: 5640569 - DNA, 21 bp, Homo sapiens
tcaatgtcataaatgtcacaa

SEQ ID NO: 5640570 - DNA, 19 bp, Homo sapiens
tcaatgtcttaggtcagga

SEQ ID NO: 5640571 - DNA, 12 bp, Homo sapiens
tcaatgtcttcc

SEQ ID NO: 5640572 - DNA, 11 bp, Homo sapiens
tcaatgtgaaa

SEQ ID NO: 5640573 - DNA, 15 bp, Homo sapiens
tcaatgtgattctaa

SEQ ID NO: 5640574 - DNA, 13 bp, Homo sapiens
tcaatgtgcagtg

SEQ ID NO: 5640575 - DNA, 19 bp, Homo sapiens
tcaatgtgctgttgattct

SEQ ID NO: 5640576 - DNA, 20 bp, Homo sapiens
tcaatgtgctgttgattctt

SEQ ID NO: 5640577 - DNA, 22 bp, Homo sapiens
tcaatgtggaaaaaatatttta

SEQ ID NO: 5640578 - DNA, 18 bp, Homo sapiens
tcaatgtggtgatgaaat

SEQ ID NO: 5640579 - DNA, 14 bp, Homo sapiens
tcaatgtgtataaa

SEQ ID NO: 5640580 - DNA, 18 bp, Homo sapiens
tcaatgtgtttaattttg

SEQ ID NO: 5640581 - DNA, 15 bp, Homo sapiens
tcaatgttaaatcta

SEQ ID NO: 5640582 - DNA, 18 bp, Homo sapiens
tcaatgttcattgtaatg

SEQ ID NO: 5640583 - DNA, 12 bp, Homo sapiens
tcaatgttccat

SEQ ID NO: 5640584 - DNA, 13 bp, Homo sapiens
tcaatgtttctgg

SEQ ID NO: 5640585 - DNA, 14 bp, Homo sapiens
tcaatgtttctgga

SEQ ID NO: 5640586 - DNA, 17 bp, Homo sapiens
tcaatgtttctggacat

SEQ ID NO: 5640587 - DNA, 20 bp, Homo sapiens
tcaatgtttctggacattct

SEQ ID NO: 5640588 - DNA, 23 bp, Homo sapiens
tcaatgtttgaggagcatgtttt

SEQ ID NO: 5640589 - DNA, 15 bp, Homo sapiens
tcaatgttttcagtt

SEQ ID NO: 5640590 - DNA, 14 bp, Homo sapiens
tcaatgttttcttt

SEQ ID NO: 5640591 - DNA, 18 bp, Homo sapiens
tcaatgtttttaaaaatc

SEQ ID NO: 5640592 - DNA, 23 bp, Homo sapiens
tcaattaaaatagtctctttaaa

SEQ ID NO: 5640593 - DNA, 15 bp, Homo sapiens
tcaattaaacggatt

SEQ ID NO: 5640594 - DNA, 17 bp, Homo sapiens
tcaattaaagaaataat

SEQ ID NO: 5640595 - DNA, 15 bp, Homo sapiens
tcaattaaagtctat

SEQ ID NO: 5640596 - DNA, 14 bp, Homo sapiens
tcaattaaatgtag

SEQ ID NO: 5640597 - DNA, 19 bp, Homo sapiens
tcaattaatggaaaactgt

SEQ ID NO: 5640598 - DNA, 13 bp, Homo sapiens
tcaattacaggaa

SEQ ID NO: 5640599 - DNA, 16 bp, Homo sapiens
tcaattactggtccaa

SEQ ID NO: 5640600 - DNA, 17 bp, Homo sapiens
tcaattagaaaaggaaa

SEQ ID NO: 5640601 - DNA, 18 bp, Homo sapiens
tcaattagaaaaggaaat

SEQ ID NO: 5640602 - DNA, 22 bp, Homo sapiens
tcaattagatttaaaataaaca

SEQ ID NO: 5640603 - DNA, 22 bp, Homo sapiens
tcaattaggggcaatagtagaa

SEQ ID NO: 5640604 - DNA, 17 bp, Homo sapiens
tcaattagtacagtagc

SEQ ID NO: 5640605 - DNA, 15 bp, Homo sapiens
tcaattatagtttct

SEQ ID NO: 5640606 - DNA, 21 bp, Homo sapiens
tcaattatattgttagtggac

SEQ ID NO: 5640607 - DNA, 15 bp, Homo sapiens
tcaattatctttatc

SEQ ID NO: 5640608 - DNA, 22 bp, Homo sapiens
tcaattattacatttatacatc

SEQ ID NO: 5640609 - DNA, 11 bp, Homo sapiens
tcaattatttc

SEQ ID NO: 5640610 - DNA, 15 bp, Homo sapiens
tcaattcaaaaatgt

SEQ ID NO: 5640611 - DNA, 17 bp, Homo sapiens
tcaattcaaaaatgtac

SEQ ID NO: 5640612 - DNA, 15 bp, Homo sapiens
tcaattcaaaagctc

SEQ ID NO: 5640613 - DNA, 18 bp, Homo sapiens
tcaattcaacacattact

SEQ ID NO: 5640614 - DNA, 13 bp, Homo sapiens
tcaattcaacact

SEQ ID NO: 5640615 - DNA, 15 bp, Homo sapiens
tcaattcaatttgga

SEQ ID NO: 5640616 - DNA, 18 bp, Homo sapiens
tcaattcagattgtcttg

SEQ ID NO: 5640617 - DNA, 13 bp, Homo sapiens
tcaattcagtgat

SEQ ID NO: 5640618 - DNA, 16 bp, Homo sapiens
tcaattcataaaaaca

SEQ ID NO: 5640619 - DNA, 15 bp, Homo sapiens
tcaattcatagaata

SEQ ID NO: 5640620 - DNA, 16 bp, Homo sapiens
tcaattcatatttatg

SEQ ID NO: 5640621 - DNA, 20 bp, Homo sapiens
tcaattcattaataaaatac

SEQ ID NO: 5640622 - DNA, 15 bp, Homo sapiens
tcaattccaacagtt

SEQ ID NO: 5640623 - DNA, 19 bp, Homo sapiens
tcaattccaacagtttaat

SEQ ID NO: 5640624 - DNA, 21 bp, Homo sapiens
tcaattccaccagggccagag

SEQ ID NO: 5640625 - DNA, 13 bp, Homo sapiens
tcaattccctctc

SEQ ID NO: 5640626 - DNA, 20 bp, Homo sapiens
tcaattccctctctcagcac

SEQ ID NO: 5640627 - DNA, 19 bp, Homo sapiens
tcaattccgtagccagctg

SEQ ID NO: 5640628 - DNA, 20 bp, Homo sapiens
tcaattctgatacagcctta

SEQ ID NO: 5640629 - DNA, 18 bp, Homo sapiens
tcaattctgtaattacat

SEQ ID NO: 5640630 - DNA, 20 bp, Homo sapiens
tcaattctgtaggttaaaaa

SEQ ID NO: 5640631 - DNA, 18 bp, Homo sapiens
tcaattctgtgtggtata

SEQ ID NO: 5640632 - DNA, 22 bp, Homo sapiens
tcaattcttcatgcgtgccctt

SEQ ID NO: 5640633 - DNA, 13 bp, Homo sapiens
tcaattcttgaga

SEQ ID NO: 5640634 - DNA, 16 bp, Homo sapiens
tcaattgagtaattct

SEQ ID NO: 5640635 - DNA, 22 bp, Homo sapiens
tcaattgagtaattctagacat

SEQ ID NO: 5640636 - DNA, 17 bp, Homo sapiens
tcaattgagttaaatca

SEQ ID NO: 5640637 - DNA, 22 bp, Homo sapiens
tcaattgagttaaatcagtaat

SEQ ID NO: 5640638 - DNA, 18 bp, Homo sapiens
tcaattgcatctcccaga

SEQ ID NO: 5640639 - DNA, 14 bp, Homo sapiens
tcaattgctttgta

SEQ ID NO: 5640640 - DNA, 16 bp, Homo sapiens
tcaattggcagtgact

SEQ ID NO: 5640641 - DNA, 18 bp, Homo sapiens
tcaattggcagtgacttt

SEQ ID NO: 5640642 - DNA, 18 bp, Homo sapiens
tcaattgtaaattgaatc

SEQ ID NO: 5640643 - DNA, 17 bp, Homo sapiens
tcaattgtgtctgtggt

SEQ ID NO: 5640644 - DNA, 16 bp, Homo sapiens
tcaattgtttaatgtt

SEQ ID NO: 5640645 - DNA, 19 bp, Homo sapiens
tcaattgtttatatggata

SEQ ID NO: 5640646 - DNA, 14 bp, Homo sapiens
tcaatttaaaccca

SEQ ID NO: 5640647 - DNA, 19 bp, Homo sapiens
tcaatttaaacccatttta

SEQ ID NO: 5640648 - DNA, 21 bp, Homo sapiens
tcaatttaaacccattttagt

SEQ ID NO: 5640649 - DNA, 16 bp, Homo sapiens
tcaatttaaatgttta

SEQ ID NO: 5640650 - DNA, 17 bp, Homo sapiens
tcaatttaaatgtttac

SEQ ID NO: 5640651 - DNA, 19 bp, Homo sapiens
tcaatttaagatacaaata

SEQ ID NO: 5640652 - DNA, 17 bp, Homo sapiens
tcaatttactttttaaa

SEQ ID NO: 5640653 - DNA, 23 bp, Homo sapiens
tcaatttactttttaaacagtgt

SEQ ID NO: 5640654 - DNA, 17 bp, Homo sapiens
tcaatttattgcacaaa

SEQ ID NO: 5640655 - DNA, 20 bp, Homo sapiens
tcaatttatttgaatgattt

SEQ ID NO: 5640656 - DNA, 20 bp, Homo sapiens
tcaatttcaaacttttgaaa

SEQ ID NO: 5640657 - DNA, 22 bp, Homo sapiens
tcaatttcaaacttttgaaaga

SEQ ID NO: 5640658 - DNA, 19 bp, Homo sapiens
tcaatttcaattttgtctg

SEQ ID NO: 5640659 - DNA, 13 bp, Homo sapiens
tcaatttcatgtt

SEQ ID NO: 5640660 - DNA, 15 bp, Homo sapiens
tcaatttcattatca

SEQ ID NO: 5640661 - DNA, 13 bp, Homo sapiens
tcaatttccaaga

SEQ ID NO: 5640662 - DNA, 16 bp, Homo sapiens
tcaatttcccacccat

SEQ ID NO: 5640663 - DNA, 21 bp, Homo sapiens
tcaatttcccacccatctcca

SEQ ID NO: 5640664 - DNA, 12 bp, Homo sapiens
tcaatttccctc

SEQ ID NO: 5640665 - DNA, 18 bp, Homo sapiens
tcaatttccctcaggttc

SEQ ID NO: 5640666 - DNA, 21 bp, Homo sapiens
tcaatttccctgactcctcta

SEQ ID NO: 5640667 - DNA, 20 bp, Homo sapiens
tcaatttcctcatctgggtc

SEQ ID NO: 5640668 - DNA, 18 bp, Homo sapiens
tcaatttctaatgtttac

SEQ ID NO: 5640669 - DNA, 15 bp, Homo sapiens
tcaatttctgtgttg

SEQ ID NO: 5640670 - DNA, 16 bp, Homo sapiens
tcaatttgaaatcacc

SEQ ID NO: 5640671 - DNA, 16 bp, Homo sapiens
tcaatttgatgtggtg

SEQ ID NO: 5640672 - DNA, 20 bp, Homo sapiens
tcaatttgccattggtttct

SEQ ID NO: 5640673 - DNA, 14 bp, Homo sapiens
tcaatttgctgaaa

SEQ ID NO: 5640674 - DNA, 23 bp, Homo sapiens
tcaatttggagcattaactaaat

SEQ ID NO: 5640675 - DNA, 17 bp, Homo sapiens
tcaatttggatatttgg

SEQ ID NO: 5640676 - DNA, 20 bp, Homo sapiens
tcaatttgggggacatgcta

SEQ ID NO: 5640677 - DNA, 13 bp, Homo sapiens
tcaatttgtatat

SEQ ID NO: 5640678 - DNA, 20 bp, Homo sapiens
tcaatttgtcattttgaagc

SEQ ID NO: 5640679 - DNA, 19 bp, Homo sapiens
tcaatttgttaacagagca

SEQ ID NO: 5640680 - DNA, 13 bp, Homo sapiens
tcaattttaaaca

SEQ ID NO: 5640681 - DNA, 15 bp, Homo sapiens
tcaattttaaacata

SEQ ID NO: 5640682 - DNA, 16 bp, Homo sapiens
tcaattttaaacatat

SEQ ID NO: 5640683 - DNA, 21 bp, Homo sapiens
tcaattttatccctcacctgt

SEQ ID NO: 5640684 - DNA, 22 bp, Homo sapiens
tcaattttatccctcacctgta

SEQ ID NO: 5640685 - DNA, 16 bp, Homo sapiens
tcaattttatgtattc

SEQ ID NO: 5640686 - DNA, 16 bp, Homo sapiens
tcaattttcactgtgt

SEQ ID NO: 5640687 - DNA, 18 bp, Homo sapiens
tcaattttcattaaactt

SEQ ID NO: 5640688 - DNA, 22 bp, Homo sapiens
tcaattttctttagcttttacc

SEQ ID NO: 5640689 - DNA, 14 bp, Homo sapiens
tcaattttgaaaac

SEQ ID NO: 5640690 - DNA, 17 bp, Homo sapiens
tcaattttggtttttct

SEQ ID NO: 5640691 - DNA, 17 bp, Homo sapiens
tcaattttgtatttaat

SEQ ID NO: 5640692 - DNA, 20 bp, Homo sapiens
tcaattttgtatttaatgat

SEQ ID NO: 5640693 - DNA, 14 bp, Homo sapiens
tcaatttttaggaa

SEQ ID NO: 5640694 - DNA, 14 bp, Homo sapiens
tcaatttttataca

SEQ ID NO: 5640695 - DNA, 22 bp, Homo sapiens
tcaatttttatacatatcagaa

SEQ ID NO: 5640696 - DNA, 20 bp, Homo sapiens
tcaatttttcccagtatttt

SEQ ID NO: 5640697 - DNA, 23 bp, Homo sapiens
tcaatttttcttatttcatttct

SEQ ID NO: 5640698 - DNA, 17 bp, Homo sapiens
tcaatttttgtctcaga

SEQ ID NO: 5640699 - DNA, 19 bp, Homo sapiens
tcaatttttgtctcagaag

SEQ ID NO: 5640700 - DNA, 14 bp, Homo sapiens
tcaattttttcaaa

SEQ ID NO: 5640701 - DNA, 18 bp, Homo sapiens
tcacaaaaaaagtaattg

SEQ ID NO: 5640702 - DNA, 14 bp, Homo sapiens
tcacaaaaaagaag

SEQ ID NO: 5640703 - DNA, 14 bp, Homo sapiens
tcacaaaaacaaaa

SEQ ID NO: 5640704 - DNA, 16 bp, Homo sapiens
tcacaaaaacaaaaaa

SEQ ID NO: 5640705 - DNA, 18 bp, Homo sapiens
tcacaaaaaggcaaatat

SEQ ID NO: 5640706 - DNA, 16 bp, Homo sapiens
tcacaaaaatttgaac

SEQ ID NO: 5640707 - DNA, 20 bp, Homo sapiens
tcacaaaaatttgaacactg

SEQ ID NO: 5640708 - DNA, 16 bp, Homo sapiens
tcacaaaacagccttt

SEQ ID NO: 5640709 - DNA, 17 bp, Homo sapiens
tcacaaaacctggcaca

SEQ ID NO: 5640710 - DNA, 21 bp, Homo sapiens
tcacaaaacctggcacaatgg

SEQ ID NO: 5640711 - DNA, 12 bp, Homo sapiens
tcacaaaagaaa

SEQ ID NO: 5640712 - DNA, 19 bp, Homo sapiens
tcacaaaagctgtgtctct

SEQ ID NO: 5640713 - DNA, 20 bp, Homo sapiens
tcacaaaagctgtgtctctg

SEQ ID NO: 5640714 - DNA, 21 bp, Homo sapiens
tcacaaaagctgtgtctctgt

SEQ ID NO: 5640715 - DNA, 23 bp, Homo sapiens
tcacaaaaggctggatgtgcttt

SEQ ID NO: 5640716 - DNA, 19 bp, Homo sapiens
tcacaaaaggttcttctgg

SEQ ID NO: 5640717 - DNA, 13 bp, Homo sapiens
tcacaaaatgcaa

SEQ ID NO: 5640718 - DNA, 13 bp, Homo sapiens
tcacaaaatgtct

SEQ ID NO: 5640719 - DNA, 17 bp, Homo sapiens
tcacaaaccagcctggg

SEQ ID NO: 5640720 - DNA, 16 bp, Homo sapiens
tcacaaactacctctg

SEQ ID NO: 5640721 - DNA, 19 bp, Homo sapiens
tcacaaactgatctaaaat

SEQ ID NO: 5640722 - DNA, 21 bp, Homo sapiens
tcacaaactgatctaaaatgt

SEQ ID NO: 5640723 - DNA, 12 bp, Homo sapiens
tcacaaactgtg

SEQ ID NO: 5640724 - DNA, 18 bp, Homo sapiens
tcacaaactgtgaaaata

SEQ ID NO: 5640725 - DNA, 20 bp, Homo sapiens
tcacaaactgtgaaaatagt

SEQ ID NO: 5640726 - DNA, 19 bp, Homo sapiens
tcacaaagagatgtccttg

SEQ ID NO: 5640727 - DNA, 14 bp, Homo sapiens
tcacaaagagctga

SEQ ID NO: 5640728 - DNA, 15 bp, Homo sapiens
tcacaaagcccaagg

SEQ ID NO: 5640729 - DNA, 18 bp, Homo sapiens
tcacaaagctaaatacat

SEQ ID NO: 5640730 - DNA, 19 bp, Homo sapiens
tcacaaagctaaatacatg

SEQ ID NO: 5640731 - DNA, 20 bp, Homo sapiens
tcacattggagtcactgcca

SEQ ID NO: 5640732 - DNA, 18 bp, Homo sapiens
tcacattgttcaactccc

SEQ ID NO: 5640733 - DNA, 13 bp, Homo sapiens
tcacattgtttct

SEQ ID NO: 5640734 - DNA, 11 bp, Homo sapiens
tcacatttaaa

SEQ ID NO: 5640735 - DNA, 13 bp, Homo sapiens
tcacatttaatat

SEQ ID NO: 5640736 - DNA, 19 bp, Homo sapiens
tcacatttagaaaagtgaa

SEQ ID NO: 5640737 - DNA, 15 bp, Homo sapiens
tcacatttgaattct

SEQ ID NO: 5640738 - DNA, 15 bp, Homo sapiens
tcacatttgatgtac

SEQ ID NO: 5640739 - DNA, 19 bp, Homo sapiens
tcacatttgatgtacatgt

SEQ ID NO: 5640740 - DNA, 20 bp, Homo sapiens
tcacatttggaatttaaaga

SEQ ID NO: 5640741 - DNA, 23 bp, Homo sapiens
tcacatttgtgaactcaaacgat

SEQ ID NO: 5640742 - DNA, 18 bp, Homo sapiens
tcacattttaagtgcttc

SEQ ID NO: 5640743 - DNA, 18 bp, Homo sapiens
tcacattttccttttcaa

SEQ ID NO: 5640744 - DNA, 13 bp, Homo sapiens
tcacattttctca

SEQ ID NO: 5640745 - DNA, 22 bp, Homo sapiens
tcacattttgttaagaagttga

SEQ ID NO: 5640746 - DNA, 19 bp, Homo sapiens
tcacatttttacttggtgt

SEQ ID NO: 5640747 - DNA, 20 bp, Homo sapiens
tcacatttttacttggtgta

SEQ ID NO: 5640748 - DNA, 20 bp, Homo sapiens
tcacatttttatacctgttt

SEQ ID NO: 5640749 - DNA, 17 bp, Homo sapiens
tcacattttttatgggc

SEQ ID NO: 5640750 - DNA, 14 bp, Homo sapiens
tcacatttttttct

SEQ ID NO: 5640751 - DNA, 17 bp, Homo sapiens
tcacatttttttctacc

SEQ ID NO: 5640752 - DNA, 16 bp, Homo sapiens
tcaccaaaagacactg

SEQ ID NO: 5640753 - DNA, 18 bp, Homo sapiens
tcaccaaacaacttggtt

SEQ ID NO: 5640754 - DNA, 22 bp, Homo sapiens
tcaccaaagatctgctcctcgc

SEQ ID NO: 5640755 - DNA, 18 bp, Homo sapiens
tcaccaaagtattaatgt

SEQ ID NO: 5640756 - DNA, 17 bp, Homo sapiens
tcaccaaatagtgtgaa

SEQ ID NO: 5640757 - DNA, 15 bp, Homo sapiens
tcaccaacacagttg

SEQ ID NO: 5640758 - DNA, 17 bp, Homo sapiens
tcaccaacgtctgtgcc

SEQ ID NO: 5640759 - DNA, 12 bp, Homo sapiens
tcaccaaggaaa

SEQ ID NO: 5640760 - DNA, 14 bp, Homo sapiens
tcaccaaggcagtg

SEQ ID NO: 5640761 - DNA, 20 bp, Homo sapiens
tcaccaaggcagtgcatgca

SEQ ID NO: 5640762 - DNA, 23 bp, Homo sapiens
tcaccaaggcagtgcatgcatgt

SEQ ID NO: 5640763 - DNA, 17 bp, Homo sapiens
tcaccaaggtggcttct

SEQ ID NO: 5640764 - DNA, 17 bp, Homo sapiens
tcaccaataacttcaga

SEQ ID NO: 5640765 - DNA, 22 bp, Homo sapiens
tcaccaataacttcagagaagt

SEQ ID NO: 5640766 - DNA, 15 bp, Homo sapiens
tcaccaatgagcctt

SEQ ID NO: 5640767 - DNA, 16 bp, Homo sapiens
tcaccaatgagcctta

SEQ ID NO: 5640768 - DNA, 23 bp, Homo sapiens
tcaccaatgtacccaccgggcca

SEQ ID NO: 5640769 - DNA, 15 bp, Homo sapiens
tcaccaatgttgtac

SEQ ID NO: 5640770 - DNA, 14 bp, Homo sapiens
tcaccaattaaaaa

SEQ ID NO: 5640771 - DNA, 18 bp, Homo sapiens
tcaccaattccacttcct

SEQ ID NO: 5640772 - DNA, 22 bp, Homo sapiens
tcaccacaaactgtaatacaat

SEQ ID NO: 5640773 - DNA, 19 bp, Homo sapiens
tcaccacaaccctgttgct

SEQ ID NO: 5640774 - DNA, 23 bp, Homo sapiens
tcaccacaaccctgttgctacat

SEQ ID NO: 5640775 - DNA, 21 bp, Homo sapiens
tcaccacaagccaccttttgt

SEQ ID NO: 5640776 - DNA, 17 bp, Homo sapiens
tcaccacaagctgagca

SEQ ID NO: 5640777 - DNA, 18 bp, Homo sapiens
tcaccacacccaggtctc

SEQ ID NO: 5640778 - DNA, 14 bp, Homo sapiens
tcaccacagacttt

SEQ ID NO: 5640779 - DNA, 16 bp, Homo sapiens
tcaccacagccttcta

SEQ ID NO: 5640780 - DNA, 20 bp, Homo sapiens
tcaccacatcttgtcttttc

SEQ ID NO: 5640781 - DNA, 21 bp, Homo sapiens
tcaccacatcttgtcttttcc

SEQ ID NO: 5640782 - DNA, 17 bp, Homo sapiens
tcaccacattctgtctc

SEQ ID NO: 5640783 - DNA, 19 bp, Homo sapiens
tcaccacattctgtctctg

SEQ ID NO: 5640784 - DNA, 22 bp, Homo sapiens
tcaccacattctgtctctgctt

SEQ ID NO: 5640785 - DNA, 19 bp, Homo sapiens
tcaccaccacacccctgcc

SEQ ID NO: 5640786 - DNA, 12 bp, Homo sapiens
tcaccaccaccc

SEQ ID NO: 5640787 - DNA, 18 bp, Homo sapiens
tcaccaccacccctacca

SEQ ID NO: 5640788 - DNA, 13 bp, Homo sapiens
tcaccacccagcc

SEQ ID NO: 5640789 - DNA, 14 bp, Homo sapiens
tcaccacccagccc

SEQ ID NO: 5640790 - DNA, 15 bp, Homo sapiens
tcaccacccagccct

SEQ ID NO: 5640791 - DNA, 17 bp, Homo sapiens
tcaccacccagcccttc

SEQ ID NO: 5640792 - DNA, 19 bp, Homo sapiens
tcaccacccagcccttcct

SEQ ID NO: 5640793 - DNA, 22 bp, Homo sapiens
tcaccaccccagtgaggacctc

SEQ ID NO: 5640794 - DNA, 12 bp, Homo sapiens
tcaccaccccca

SEQ ID NO: 5640795 - DNA, 17 bp, Homo sapiens
tcaccaccccctgtccc

SEQ ID NO: 5640796 - DNA, 15 bp, Homo sapiens
tcaccaccctcccct

SEQ ID NO: 5640797 - DNA, 11 bp, Homo sapiens
tcaccaccctg

SEQ ID NO: 5640798 - DNA, 13 bp, Homo sapiens
tcaccacctctcc

SEQ ID NO: 5640799 - DNA, 21 bp, Homo sapiens
tcaccacctctttctacagcc

SEQ ID NO: 5640800 - DNA, 15 bp, Homo sapiens
tcaccaccttcccag

SEQ ID NO: 5640801 - DNA, 21 bp, Homo sapiens
tcaccacgatgacgcctctgg

SEQ ID NO: 5640802 - DNA, 15 bp, Homo sapiens
tcaccacgcagagag

SEQ ID NO: 5640803 - DNA, 18 bp, Homo sapiens
tcaccacgtggggccatg

SEQ ID NO: 5640804 - DNA, 14 bp, Homo sapiens
tcaccactcctctc

SEQ ID NO: 5640805 - DNA, 13 bp, Homo sapiens
tcaccagaataaa

SEQ ID NO: 5640806 - DNA, 20 bp, Homo sapiens
tcaccagaattagtcctcac

SEQ ID NO: 5640807 - DNA, 23 bp, Homo sapiens
tcaccagaattagtcctcacagc

SEQ ID NO: 5640808 - DNA, 14 bp, Homo sapiens
tcaccagaatttct

SEQ ID NO: 5640809 - DNA, 16 bp, Homo sapiens
tcaccagactttggct

SEQ ID NO: 5640810 - DNA, 19 bp, Homo sapiens
tcaccagagactttagggg

SEQ ID NO: 5640811 - DNA, 17 bp, Homo sapiens
tcaccagagcttctctg

SEQ ID NO: 5640812 - DNA, 22 bp, Homo sapiens
tcaccagagcttctctgggctg

SEQ ID NO: 5640813 - DNA, 13 bp, Homo sapiens
tcaccagcaacat

SEQ ID NO: 5640814 - DNA, 21 bp, Homo sapiens
tcaccagcaactctgactctt

SEQ ID NO: 5640815 - DNA, 19 bp, Homo sapiens
tcaccagccccactgccag

SEQ ID NO: 5640816 - DNA, 22 bp, Homo sapiens
tcaccagccccactgccagcag

SEQ ID NO: 5640817 - DNA, 24 bp, Homo sapiens
tcaccagccccactgccagcagca

SEQ ID NO: 5640818 - DNA, 16 bp, Homo sapiens
tcaccagccccagtgc

SEQ ID NO: 5640819 - DNA, 20 bp, Homo sapiens
tcaccagccctgcagcccac

SEQ ID NO: 5640820 - DNA, 17 bp, Homo sapiens
tcaccagcctgactgca

SEQ ID NO: 5640821 - DNA, 11 bp, Homo sapiens
tcaccagcctt

SEQ ID NO: 5640822 - DNA, 17 bp, Homo sapiens
tcaccagcgttgggttt

SEQ ID NO: 5640823 - DNA, 14 bp, Homo sapiens
tcaccagctcagcc

SEQ ID NO: 5640824 - DNA, 21 bp, Homo sapiens
tcaccagctcagccccggcca

SEQ ID NO: 5640825 - DNA, 19 bp, Homo sapiens
tcaccagctgcaaagtgtt

SEQ ID NO: 5640826 - DNA, 15 bp, Homo sapiens
tcaccagctgcctct

SEQ ID NO: 5640827 - DNA, 13 bp, Homo sapiens
tcaccagctgctg

SEQ ID NO: 5640828 - DNA, 20 bp, Homo sapiens
tcaccagctgctgtgcccca

SEQ ID NO: 5640829 - DNA, 22 bp, Homo sapiens
tcaccaggaatgttaaagtcag

SEQ ID NO: 5640830 - DNA, 17 bp, Homo sapiens
tcaccaggacttggggt

SEQ ID NO: 5640831 - DNA, 16 bp, Homo sapiens
tcaccaggagattaca

SEQ ID NO: 5640832 - DNA, 16 bp, Homo sapiens
tcaccaggatgaaggc

SEQ ID NO: 5640833 - DNA, 19 bp, Homo sapiens
tcaccaggcagcctctggg

SEQ ID NO: 5640834 - DNA, 20 bp, Homo sapiens
tcaccaggcagcctctgggg

SEQ ID NO: 5640835 - DNA, 15 bp, Homo sapiens
tcaccaggcccacga

SEQ ID NO: 5640836 - DNA, 14 bp, Homo sapiens
tcaccaggcctggc

SEQ ID NO: 5640837 - DNA, 15 bp, Homo sapiens
tcaccaggcctggcc

SEQ ID NO: 5640838 - DNA, 17 bp, Homo sapiens
tcaccaggggaggagcc

SEQ ID NO: 5640839 - DNA, 24 bp, Homo sapiens
tcaccaggggaggagcctgtgcgt

SEQ ID NO: 5640840 - DNA, 18 bp, Homo sapiens
tcaccaggggcaggcaca

SEQ ID NO: 5640841 - DNA, 21 bp, Homo sapiens
tcaccagggtccgcaccagct

SEQ ID NO: 5640842 - DNA, 16 bp, Homo sapiens
tcaccaggtgcatctg

SEQ ID NO: 5640843 - DNA, 17 bp, Homo sapiens
tcaccaggtgcatctgc

SEQ ID NO: 5640844 - DNA, 22 bp, Homo sapiens
tcaccaggtgcatgcatgccct

SEQ ID NO: 5640845 - DNA, 21 bp, Homo sapiens
tcaccagtacattctcagttt

SEQ ID NO: 5640846 - DNA, 19 bp, Homo sapiens
tcaccagtctgtctactgt

SEQ ID NO: 5640847 - DNA, 23 bp, Homo sapiens
tcaccagtctgtctactgtggtg

SEQ ID NO: 5640848 - DNA, 15 bp, Homo sapiens
tcaccagtgccacgt

SEQ ID NO: 5640849 - DNA, 19 bp, Homo sapiens
tcaccagtgcgattctgga

SEQ ID NO: 5640850 - DNA, 21 bp, Homo sapiens
tcaccagtggccttggtcctt

SEQ ID NO: 5640851 - DNA, 16 bp, Homo sapiens
tcaccagtggcctttc

SEQ ID NO: 5640852 - DNA, 17 bp, Homo sapiens
tcaccagtgtcccctcc

SEQ ID NO: 5640853 - DNA, 20 bp, Homo sapiens
tcaccagtgtcccctccact

SEQ ID NO: 5640854 - DNA, 16 bp, Homo sapiens
tcaccagtgtttttct

SEQ ID NO: 5640855 - DNA, 20 bp, Homo sapiens
tcaccagttaaaagcatttt

SEQ ID NO: 5640856 - DNA, 19 bp, Homo sapiens
tcaccatagggctggggac

SEQ ID NO: 5640857 - DNA, 23 bp, Homo sapiens
tcaccatagttttgtttaatttg

SEQ ID NO: 5640858 - DNA, 15 bp, Homo sapiens
tcaccatatttgaat

SEQ ID NO: 5640859 - DNA, 21 bp, Homo sapiens
tcaccatatttgaattggcct

SEQ ID NO: 5640860 - DNA, 23 bp, Homo sapiens
tcaccatatttgaattggcctga

SEQ ID NO: 5640861 - DNA, 20 bp, Homo sapiens
tcaccatcaatcctgattcc

SEQ ID NO: 5640862 - DNA, 16 bp, Homo sapiens
tcaccatcatttctag

SEQ ID NO: 5640863 - DNA, 17 bp, Homo sapiens
tcaccatcatttctagt

SEQ ID NO: 5640864 - DNA, 20 bp, Homo sapiens
tcaccatccagagaccaaat

SEQ ID NO: 5640865 - DNA, 23 bp, Homo sapiens
tcaccatccagagaccaaataat

SEQ ID NO: 5640866 - DNA, 17 bp, Homo sapiens
tcaccatccagtgggcc

SEQ ID NO: 5640867 - DNA, 14 bp, Homo sapiens
tcaccatcctcaga

SEQ ID NO: 5640868 - DNA, 15 bp, Homo sapiens
tcaccatccttagac

SEQ ID NO: 5640869 - DNA, 17 bp, Homo sapiens
tcaccatctacctgctt

SEQ ID NO: 5640870 - DNA, 14 bp, Homo sapiens
tcaccatctcaggc

SEQ ID NO: 5640871 - DNA, 21 bp, Homo sapiens
tcaccatctcaggccacctgc

SEQ ID NO: 5640872 - DNA, 19 bp, Homo sapiens
tcaccatctttgaggtgag

SEQ ID NO: 5640873 - DNA, 20 bp, Homo sapiens
tcaccatctttgaggtgagg

SEQ ID NO: 5640874 - DNA, 13 bp, Homo sapiens
tcaccatctttgt

SEQ ID NO: 5640875 - DNA, 21 bp, Homo sapiens
tcaccatgatggccaggctga

SEQ ID NO: 5640876 - DNA, 16 bp, Homo sapiens
tcaccatgggaggtgg

SEQ ID NO: 5640877 - DNA, 21 bp, Homo sapiens
tcaccatgggaggtggggcct

SEQ ID NO: 5640878 - DNA, 20 bp, Homo sapiens
tcaccatgtaaaacaaaaaa

SEQ ID NO: 5640879 - DNA, 21 bp, Homo sapiens
tcaccatgtaaaacaaaaaac

SEQ ID NO: 5640880 - DNA, 18 bp, Homo sapiens
tcaccatgtaacaaccag

SEQ ID NO: 5640881 - DNA, 17 bp, Homo sapiens
tcaccatgtaagcactc

SEQ ID NO: 5640882 - DNA, 19 bp, Homo sapiens
tcaccatgtattttgtaaa

SEQ ID NO: 5640883 - DNA, 13 bp, Homo sapiens
tcaccatgttagc

SEQ ID NO: 5640884 - DNA, 21 bp, Homo sapiens
tcaccatgttagccaggctgg

SEQ ID NO: 5640885 - DNA, 17 bp, Homo sapiens
tcaccatgttagcctta

SEQ ID NO: 5640886 - DNA, 18 bp, Homo sapiens
tcaccatgttagccttag

SEQ ID NO: 5640887 - DNA, 21 bp, Homo sapiens
tcaccatgttggccaggctgg

SEQ ID NO: 5640888 - DNA, 23 bp, Homo sapiens
tcaccattataatgaatttagtg

SEQ ID NO: 5640889 - DNA, 21 bp, Homo sapiens
tcaccattcgtacataatact

SEQ ID NO: 5640890 - DNA, 21 bp, Homo sapiens
tcaccattctgcatttagctg

SEQ ID NO: 5640891 - DNA, 19 bp, Homo sapiens
tcaccatttccccagggca

SEQ ID NO: 5640892 - DNA, 17 bp, Homo sapiens
tcaccatttgattatgt

SEQ ID NO: 5640893 - DNA, 19 bp, Homo sapiens
tcacccaaacacttctgct

SEQ ID NO: 5640894 - DNA, 21 bp, Homo sapiens
tcacccaaacacttctgcttt

SEQ ID NO: 5640895 - DNA, 16 bp, Homo sapiens
tcacccaaagcctgtc

SEQ ID NO: 5640896 - DNA, 20 bp, Homo sapiens
tcacccaaagcctgtcccag

SEQ ID NO: 5640897 - DNA, 22 bp, Homo sapiens
tcacccaaagcctgtcccagga

SEQ ID NO: 5640898 - DNA, 16 bp, Homo sapiens
tcacccaatcccagtt

SEQ ID NO: 5640899 - DNA, 19 bp, Homo sapiens
tcacccaatcccagttctt

SEQ ID NO: 5640900 - DNA, 19 bp, Homo sapiens
tcacccacaaccctctgga

SEQ ID NO: 5640901 - DNA, 15 bp, Homo sapiens
tcacccacagaaaga

SEQ ID NO: 5640902 - DNA, 22 bp, Homo sapiens
tcacccacagggctaagagcta

SEQ ID NO: 5640903 - DNA, 13 bp, Homo sapiens
tcacccaccagct

SEQ ID NO: 5640904 - DNA, 23 bp, Homo sapiens
tcacccaccaggccagctcagga

SEQ ID NO: 5640905 - DNA, 18 bp, Homo sapiens
tcacccaccatggaccag

SEQ ID NO: 5640906 - DNA, 16 bp, Homo sapiens
tcacccaccccatgga

SEQ ID NO: 5640907 - DNA, 22 bp, Homo sapiens
tcacctgtttttaagctgtttc

SEQ ID NO: 5640908 - DNA, 23 bp, Homo sapiens
tcaccttaagaaagtgtctctgt

SEQ ID NO: 5640909 - DNA, 14 bp, Homo sapiens
tcaccttatgtatt

SEQ ID NO: 5640910 - DNA, 15 bp, Homo sapiens
tcaccttatgtatta

SEQ ID NO: 5640911 - DNA, 19 bp, Homo sapiens
tcaccttatgtattatttt

SEQ ID NO: 5640912 - DNA, 22 bp, Homo sapiens
tcaccttatgtattattttcta

SEQ ID NO: 5640913 - DNA, 15 bp, Homo sapiens
tcaccttccaacact

SEQ ID NO: 5640914 - DNA, 21 bp, Homo sapiens
tcaccttccaggacccctggg

SEQ ID NO: 5640915 - DNA, 11 bp, Homo sapiens
tcaccttccct

SEQ ID NO: 5640916 - DNA, 12 bp, Homo sapiens
tcaccttccctc

SEQ ID NO: 5640917 - DNA, 22 bp, Homo sapiens
tcaccttcctcagctcagctgg

SEQ ID NO: 5640918 - DNA, 14 bp, Homo sapiens
tcaccttcctgggc

SEQ ID NO: 5640919 - DNA, 15 bp, Homo sapiens
tcaccttcctgggca

SEQ ID NO: 5640920 - DNA, 21 bp, Homo sapiens
tcaccttcgtttactatgcct

SEQ ID NO: 5640921 - DNA, 20 bp, Homo sapiens
tcaccttctgttttagagtt

SEQ ID NO: 5640922 - DNA, 16 bp, Homo sapiens
tcaccttctttgtaat

SEQ ID NO: 5640923 - DNA, 18 bp, Homo sapiens
tcaccttgcaacacacag

SEQ ID NO: 5640924 - DNA, 19 bp, Homo sapiens
tcaccttgccgagagaggc

SEQ ID NO: 5640925 - DNA, 13 bp, Homo sapiens
tcaccttggaagg

SEQ ID NO: 5640926 - DNA, 18 bp, Homo sapiens
tcaccttggcaccagaca

SEQ ID NO: 5640927 - DNA, 19 bp, Homo sapiens
tcaccttggcaccagacac

SEQ ID NO: 5640928 - DNA, 16 bp, Homo sapiens
tcaccttgggctgggg

SEQ ID NO: 5640929 - DNA, 14 bp, Homo sapiens
tcaccttggggcct

SEQ ID NO: 5640930 - DNA, 21 bp, Homo sapiens
tcaccttgtaaccagtgcaga

SEQ ID NO: 5640931 - DNA, 13 bp, Homo sapiens
tcaccttgtattc

SEQ ID NO: 5640932 - DNA, 17 bp, Homo sapiens
tcaccttgtgtggcgca

SEQ ID NO: 5640933 - DNA, 20 bp, Homo sapiens
tcaccttgtgtgttccaagt

SEQ ID NO: 5640934 - DNA, 20 bp, Homo sapiens
tcacctttagaacaggagac

SEQ ID NO: 5640935 - DNA, 19 bp, Homo sapiens
tcacctttatatatgtact

SEQ ID NO: 5640936 - DNA, 14 bp, Homo sapiens
tcacctttcccacc

SEQ ID NO: 5640937 - DNA, 14 bp, Homo sapiens
tcacctttctgggc

SEQ ID NO: 5640938 - DNA, 20 bp, Homo sapiens
tcacctttctgggctttctc

SEQ ID NO: 5640939 - DNA, 22 bp, Homo sapiens
tcacctttctgggctttctcct

SEQ ID NO: 5640940 - DNA, 19 bp, Homo sapiens
tcacctttcttcttgtgtc

SEQ ID NO: 5640941 - DNA, 17 bp, Homo sapiens
tcacctttcttttgtaa

SEQ ID NO: 5640942 - DNA, 14 bp, Homo sapiens
tcacctttggtgca

SEQ ID NO: 5640943 - DNA, 14 bp, Homo sapiens
tcacctttgtaaga

SEQ ID NO: 5640944 - DNA, 12 bp, Homo sapiens
tcacctttgtag

SEQ ID NO: 5640945 - DNA, 12 bp, Homo sapiens
tcacctttgtcc

SEQ ID NO: 5640946 - DNA, 17 bp, Homo sapiens
tcacctttgtgtatttt

SEQ ID NO: 5640947 - DNA, 12 bp, Homo sapiens
tcaccttttaaa

SEQ ID NO: 5640948 - DNA, 17 bp, Homo sapiens
tcaccttttcaggaaaa

SEQ ID NO: 5640949 - DNA, 18 bp, Homo sapiens
tcaccttttctgtggctg

SEQ ID NO: 5640950 - DNA, 20 bp, Homo sapiens
tcacctttttgacttttcca

SEQ ID NO: 5640951 - DNA, 17 bp, Homo sapiens
tcacgaaactggaataa

SEQ ID NO: 5640952 - DNA, 19 bp, Homo sapiens
tcacgaatattatgcccag

SEQ ID NO: 5640953 - DNA, 20 bp, Homo sapiens
tcacgaatattatgcccagt

SEQ ID NO: 5640954 - DNA, 12 bp, Homo sapiens
tcacgacaatgt

SEQ ID NO: 5640955 - DNA, 18 bp, Homo sapiens
tcacgacacatttgcctt

SEQ ID NO: 5640956 - DNA, 18 bp, Homo sapiens
tcacgacaggaaaaaggt

SEQ ID NO: 5640957 - DNA, 19 bp, Homo sapiens
tcacgagcccattctcatg

SEQ ID NO: 5640958 - DNA, 23 bp, Homo sapiens
tcacgagcctttgtttttctcca

SEQ ID NO: 5640959 - DNA, 23 bp, Homo sapiens
tcacgagggtaggaccctcatga

SEQ ID NO: 5640960 - DNA, 16 bp, Homo sapiens
tcacgagtcatccaga

SEQ ID NO: 5640961 - DNA, 14 bp, Homo sapiens
tcacgattccagtg

SEQ ID NO: 5640962 - DNA, 15 bp, Homo sapiens
tcacgattccagtgc

SEQ ID NO: 5640963 - DNA, 13 bp, Homo sapiens
tcacgatttgcag

SEQ ID NO: 5640964 - DNA, 16 bp, Homo sapiens
tcacgcaacttgaaat

SEQ ID NO: 5640965 - DNA, 17 bp, Homo sapiens
tcacgcacctcccatcc

SEQ ID NO: 5640966 - DNA, 13 bp, Homo sapiens
tcacgccaccccc

SEQ ID NO: 5640967 - DNA, 17 bp, Homo sapiens
tcacgccacccccgccc

SEQ ID NO: 5640968 - DNA, 16 bp, Homo sapiens
tcacgccactgcactc

SEQ ID NO: 5640969 - DNA, 22 bp, Homo sapiens
tcacgccactgcactccagcct

SEQ ID NO: 5640970 - DNA, 18 bp, Homo sapiens
tcacgccagacttcccac

SEQ ID NO: 5640971 - DNA, 20 bp, Homo sapiens
tcacgccattctcctgcctc

SEQ ID NO: 5640972 - DNA, 20 bp, Homo sapiens
tcacgccattgtactccagc

SEQ ID NO: 5640973 - DNA, 21 bp, Homo sapiens
tcacgccattgtactccagcc

SEQ ID NO: 5640974 - DNA, 22 bp, Homo sapiens
tcacgccattgtactccagcct

SEQ ID NO: 5640975 - DNA, 16 bp, Homo sapiens
tcacgcccagcctcct

SEQ ID NO: 5640976 - DNA, 17 bp, Homo sapiens
tcacgccccgctgtgtc

SEQ ID NO: 5640977 - DNA, 20 bp, Homo sapiens
tcacgcctataatcccagca

SEQ ID NO: 5640978 - DNA, 15 bp, Homo sapiens
tcacgcctgaaactt

SEQ ID NO: 5640979 - DNA, 16 bp, Homo sapiens
tcacgcctgtaatccc

SEQ ID NO: 5640980 - DNA, 23 bp, Homo sapiens
tcacgcctgtaatcccagcactt

SEQ ID NO: 5640981 - DNA, 13 bp, Homo sapiens
tcacgcctgtgca

SEQ ID NO: 5640982 - DNA, 13 bp, Homo sapiens
tcacgctcaccca

SEQ ID NO: 5640983 - DNA, 22 bp, Homo sapiens
tcacgctcacccagtcacctcc

SEQ ID NO: 5640984 - DNA, 23 bp, Homo sapiens
tcacgctcccaacacaaggtggg

SEQ ID NO: 5640985 - DNA, 12 bp, Homo sapiens
tcacgctccccg

SEQ ID NO: 5640986 - DNA, 13 bp, Homo sapiens
tcacgctccctga

SEQ ID NO: 5640987 - DNA, 16 bp, Homo sapiens
tcacgctctggacatg

SEQ ID NO: 5640988 - DNA, 17 bp, Homo sapiens
tcacgctctggtgcagt

SEQ ID NO: 5640989 - DNA, 21 bp, Homo sapiens
tcacgctgacagcctcctagg

SEQ ID NO: 5640990 - DNA, 14 bp, Homo sapiens
tcacgctggcttcc

SEQ ID NO: 5640991 - DNA, 15 bp, Homo sapiens
tcacgctggcttcca

SEQ ID NO: 5640992 - DNA, 18 bp, Homo sapiens
tcacgctggggctctctg

SEQ ID NO: 5640993 - DNA, 23 bp, Homo sapiens
tcacgctggggctctctgagact

SEQ ID NO: 5640994 - DNA, 20 bp, Homo sapiens
tcacgcttgcctggtcaccc

SEQ ID NO: 5640995 - DNA, 12 bp, Homo sapiens
tcacgctttcat

SEQ ID NO: 5640996 - DNA, 16 bp, Homo sapiens
tcacgctttcatgacc

SEQ ID NO: 5640997 - DNA, 15 bp, Homo sapiens
tcacgctttcctgaa

SEQ ID NO: 5640998 - DNA, 17 bp, Homo sapiens
tcacgctttcctgaatc

SEQ ID NO: 5640999 - DNA, 16 bp, Homo sapiens
tcacggaagttttcaa

SEQ ID NO: 5641000 - DNA, 23 bp, Homo sapiens
tcacggaccactcgaggcctgca

SEQ ID NO: 5641001 - DNA, 15 bp, Homo sapiens
tcacggactctttgc

SEQ ID NO: 5641002 - DNA, 17 bp, Homo sapiens
tcacggactctttgctg

SEQ ID NO: 5641003 - DNA, 13 bp, Homo sapiens
tcacggcatgttt

SEQ ID NO: 5641004 - DNA, 20 bp, Homo sapiens
tcacggccacacagctgccg

SEQ ID NO: 5641005 - DNA, 14 bp, Homo sapiens
tcacggccaggcag

SEQ ID NO: 5641006 - DNA, 16 bp, Homo sapiens
tcacggcctggcatgc

SEQ ID NO: 5641007 - DNA, 14 bp, Homo sapiens
tcacggctgcgcac

SEQ ID NO: 5641008 - DNA, 18 bp, Homo sapiens
tcacggctgcgcactgtg

SEQ ID NO: 5641009 - DNA, 14 bp, Homo sapiens
tcacgggcccgctc

SEQ ID NO: 5641010 - DNA, 17 bp, Homo sapiens
tcacgggccctgcccca

SEQ ID NO: 5641011 - DNA, 18 bp, Homo sapiens
tcacgggcggtcctgcac

SEQ ID NO: 5641012 - DNA, 21 bp, Homo sapiens
tcacgggcggtcctgcacaga

SEQ ID NO: 5641013 - DNA, 21 bp, Homo sapiens
tcacggggttccctcctagct

SEQ ID NO: 5641014 - DNA, 22 bp, Homo sapiens
tcacggggttggctgttccaga

SEQ ID NO: 5641015 - DNA, 23 bp, Homo sapiens
tcacggggttggctgttccagac

SEQ ID NO: 5641016 - DNA, 17 bp, Homo sapiens
tcacggtgccaggtttt

SEQ ID NO: 5641017 - DNA, 18 bp, Homo sapiens
tcacgtaaagctagaaat

SEQ ID NO: 5641018 - DNA, 13 bp, Homo sapiens
tcacgtaaatatt

SEQ ID NO: 5641019 - DNA, 21 bp, Homo sapiens
tcacgtacaaaactctgtata

SEQ ID NO: 5641020 - DNA, 20 bp, Homo sapiens
tcacgtatttcacagagcac

SEQ ID NO: 5641021 - DNA, 14 bp, Homo sapiens
tcacgtcactgcca

SEQ ID NO: 5641022 - DNA, 17 bp, Homo sapiens
tcacgtcataggaagtt

SEQ ID NO: 5641023 - DNA, 21 bp, Homo sapiens
tcacgtctctgccgcctgcgt

SEQ ID NO: 5641024 - DNA, 13 bp, Homo sapiens
tcacgtctgacaa

SEQ ID NO: 5641025 - DNA, 20 bp, Homo sapiens
tcacgtctgacaaatgtgta

SEQ ID NO: 5641026 - DNA, 17 bp, Homo sapiens
tcacgtgaccagccccg

SEQ ID NO: 5641027 - DNA, 16 bp, Homo sapiens
tcacgtgaccctgtgc

SEQ ID NO: 5641028 - DNA, 17 bp, Homo sapiens
tcacgtgaccctgtgcc

SEQ ID NO: 5641029 - DNA, 16 bp, Homo sapiens
tcacgtgaggcccctg

SEQ ID NO: 5641030 - DNA, 14 bp, Homo sapiens
tcacgtgcaggaca

SEQ ID NO: 5641031 - DNA, 18 bp, Homo sapiens
tcacgtgcaggacagctc

SEQ ID NO: 5641032 - DNA, 23 bp, Homo sapiens
tcacgtgcgctgggcacttccct

SEQ ID NO: 5641033 - DNA, 20 bp, Homo sapiens
tcacgtggtcaaggcccggc

SEQ ID NO: 5641034 - DNA, 19 bp, Homo sapiens
tcacgtgtaaacaggatta

SEQ ID NO: 5641035 - DNA, 16 bp, Homo sapiens
tcacgtgtactggctc

SEQ ID NO: 5641036 - DNA, 18 bp, Homo sapiens
tcacgtgtactggctcct

SEQ ID NO: 5641037 - DNA, 16 bp, Homo sapiens
tcacgtgtgtgactca

SEQ ID NO: 5641038 - DNA, 17 bp, Homo sapiens
tcacgtgtgtgactcag

SEQ ID NO: 5641039 - DNA, 21 bp, Homo sapiens
tcacgtgtgtgtatgctgtgt

SEQ ID NO: 5641040 - DNA, 20 bp, Homo sapiens
tcacgttaccatttacatgt

SEQ ID NO: 5641041 - DNA, 14 bp, Homo sapiens
tcacgttggccctc

SEQ ID NO: 5641042 - DNA, 20 bp, Homo sapiens
tcacgttggggtgatttaat

SEQ ID NO: 5641043 - DNA, 22 bp, Homo sapiens
tcacgtttcatgtaatcctcaa

SEQ ID NO: 5641044 - DNA, 15 bp, Homo sapiens
tcacgtttcttcccc

SEQ ID NO: 5641045 - DNA, 18 bp, Homo sapiens
tcactaaaagcatgaatt

SEQ ID NO: 5641046 - DNA, 22 bp, Homo sapiens
tcactaaaagcatgaattggaa

SEQ ID NO: 5641047 - DNA, 19 bp, Homo sapiens
tcactaaaaggaagacagt

SEQ ID NO: 5641048 - DNA, 21 bp, Homo sapiens
tcactaaaagtctccaaaaca

SEQ ID NO: 5641049 - DNA, 13 bp, Homo sapiens
tcactaaaagtgt

SEQ ID NO: 5641050 - DNA, 19 bp, Homo sapiens
tcactaaaccgataatgca

SEQ ID NO: 5641051 - DNA, 13 bp, Homo sapiens
tcactaaactctg

SEQ ID NO: 5641052 - DNA, 21 bp, Homo sapiens
tcactaaagcatgaaatgtga

SEQ ID NO: 5641053 - DNA, 17 bp, Homo sapiens
tcactaaatcttttata

SEQ ID NO: 5641054 - DNA, 15 bp, Homo sapiens
tcactaaatgtaaaa

SEQ ID NO: 5641055 - DNA, 14 bp, Homo sapiens
tcactaacagggag

SEQ ID NO: 5641056 - DNA, 22 bp, Homo sapiens
tcactaacagggagaagtagct

SEQ ID NO: 5641057 - DNA, 16 bp, Homo sapiens
tcactaacattatatt

SEQ ID NO: 5641058 - DNA, 21 bp, Homo sapiens
tcactaacattatattgcaat

SEQ ID NO: 5641059 - DNA, 14 bp, Homo sapiens
tcactaagaaagaa

SEQ ID NO: 5641060 - DNA, 22 bp, Homo sapiens
tcactaagaacaaaagaagcag

SEQ ID NO: 5641061 - DNA, 16 bp, Homo sapiens
tcactaagaatataaa

SEQ ID NO: 5641062 - DNA, 20 bp, Homo sapiens
tcactaataaagtctgtctg

SEQ ID NO: 5641063 - DNA, 19 bp, Homo sapiens
tcactaatcatgagaaaaa

SEQ ID NO: 5641064 - DNA, 16 bp, Homo sapiens
tcactaatcttgaatg

SEQ ID NO: 5641065 - DNA, 14 bp, Homo sapiens
tcactaattcatta

SEQ ID NO: 5641066 - DNA, 15 bp, Homo sapiens
tcactaattcattaa

SEQ ID NO: 5641067 - DNA, 18 bp, Homo sapiens
tcactaattcattaatct

SEQ ID NO: 5641068 - DNA, 13 bp, Homo sapiens
tcactacaacctc

SEQ ID NO: 5641069 - DNA, 19 bp, Homo sapiens
tcactacatgggccagccc

SEQ ID NO: 5641070 - DNA, 23 bp, Homo sapiens
tcactaccctaatagactaaatg

SEQ ID NO: 5641071 - DNA, 23 bp, Homo sapiens
tcactacctttatagctcatcac

SEQ ID NO: 5641072 - DNA, 23 bp, Homo sapiens
tcactacctttatagctctcatc

SEQ ID NO: 5641073 - DNA, 14 bp, Homo sapiens
tcactactcagcat

SEQ ID NO: 5641074 - DNA, 12 bp, Homo sapiens
tcactactgcag

SEQ ID NO: 5641075 - DNA, 15 bp, Homo sapiens
tcactactgcattta

SEQ ID NO: 5641076 - DNA, 13 bp, Homo sapiens
tcactactggtct

SEQ ID NO: 5641077 - DNA, 14 bp, Homo sapiens
tcactactggtctg

SEQ ID NO: 5641078 - DNA, 11 bp, Homo sapiens
tcactactgta

SEQ ID NO: 5641079 - DNA, 19 bp, Homo sapiens
tcactagaatggataaaat

SEQ ID NO: 5641080 - DNA, 21 bp, Homo sapiens
tcactagagacaaatctttaa

SEQ ID NO: 5641081 - DNA, 14 bp, Homo sapiens
tcactagcagctgc

SEQ ID NO: 5641082 - DNA, 17 bp, Homo sapiens
tcactagcagctgcagt

SEQ ID NO: 5641083 - DNA, 22 bp, Homo sapiens
tcactagccatgctttatgtgg

SEQ ID NO: 5641084 - DNA, 23 bp, Homo sapiens
tcactagctccccaatccctgac

SEQ ID NO: 5641085 - DNA, 20 bp, Homo sapiens
tcagaaccttgtcccagcca

SEQ ID NO: 5641086 - DNA, 14 bp, Homo sapiens
tcagaactaaattt

SEQ ID NO: 5641087 - DNA, 20 bp, Homo sapiens
tcagaactaaatttttcata

SEQ ID NO: 5641088 - DNA, 22 bp, Homo sapiens
tcagaactaaatttttcataga

SEQ ID NO: 5641089 - DNA, 16 bp, Homo sapiens
tcagaactaactttgg

SEQ ID NO: 5641090 - DNA, 16 bp, Homo sapiens
tcagaactatgttttt

SEQ ID NO: 5641091 - DNA, 21 bp, Homo sapiens
tcagaactcaaatggggccag

SEQ ID NO: 5641092 - DNA, 16 bp, Homo sapiens
tcagaactcctttcta

SEQ ID NO: 5641093 - DNA, 15 bp, Homo sapiens
tcagaactctcagac

SEQ ID NO: 5641094 - DNA, 16 bp, Homo sapiens
tcagaactctcagact

SEQ ID NO: 5641095 - DNA, 14 bp, Homo sapiens
tcagaactcttcct

SEQ ID NO: 5641096 - DNA, 15 bp, Homo sapiens
tcagaactcttcctc

SEQ ID NO: 5641097 - DNA, 21 bp, Homo sapiens
tcagaactgaaataaaaaatt

SEQ ID NO: 5641098 - DNA, 19 bp, Homo sapiens
tcagaactgcccttgctgc

SEQ ID NO: 5641099 - DNA, 15 bp, Homo sapiens
tcagaactgtcccat

SEQ ID NO: 5641100 - DNA, 20 bp, Homo sapiens
tcagaactgtcggaggaaag

SEQ ID NO: 5641101 - DNA, 15 bp, Homo sapiens
tcagaactgtgccac

SEQ ID NO: 5641102 - DNA, 17 bp, Homo sapiens
tcagaacttcaggtgtg

SEQ ID NO: 5641103 - DNA, 18 bp, Homo sapiens
tcagaacttcatctgcca

SEQ ID NO: 5641104 - DNA, 16 bp, Homo sapiens
tcagaacttgctgctg

SEQ ID NO: 5641105 - DNA, 18 bp, Homo sapiens
tcagaacttgctgctgtc

SEQ ID NO: 5641106 - DNA, 21 bp, Homo sapiens
tcagaactttagtattaaatc

SEQ ID NO: 5641107 - DNA, 20 bp, Homo sapiens
tcagaagaaaaagaagctga

SEQ ID NO: 5641108 - DNA, 18 bp, Homo sapiens
tcagaagaaaggccaagg

SEQ ID NO: 5641109 - DNA, 23 bp, Homo sapiens
tcagaagaaaggccaaggtgctg

SEQ ID NO: 5641110 - DNA, 13 bp, Homo sapiens
tcagaagaaattt

SEQ ID NO: 5641111 - DNA, 18 bp, Homo sapiens
tcagaagaagtgggagca

SEQ ID NO: 5641112 - DNA, 21 bp, Homo sapiens
tcagaagaagtgggagcagct

SEQ ID NO: 5641113 - DNA, 22 bp, Homo sapiens
tcagaagaagtgggagcagctt

SEQ ID NO: 5641114 - DNA, 17 bp, Homo sapiens
tcagaagaatcttcctg

SEQ ID NO: 5641115 - DNA, 13 bp, Homo sapiens
tcagaagacacta

SEQ ID NO: 5641116 - DNA, 17 bp, Homo sapiens
tcagaagagttgtgcac

SEQ ID NO: 5641117 - DNA, 14 bp, Homo sapiens
tcagaagcaaacaa

SEQ ID NO: 5641118 - DNA, 14 bp, Homo sapiens
tcagaagcaagcca

SEQ ID NO: 5641119 - DNA, 16 bp, Homo sapiens
tcagaagcaaggaagt

SEQ ID NO: 5641120 - DNA, 20 bp, Homo sapiens
tcagaagcacagaatatttt

SEQ ID NO: 5641121 - DNA, 15 bp, Homo sapiens
tcagaagccagtctg

SEQ ID NO: 5641122 - DNA, 21 bp, Homo sapiens
tcagaagccccatttgcacag

SEQ ID NO: 5641123 - DNA, 22 bp, Homo sapiens
tcagaagcctattgtaaataca

SEQ ID NO: 5641124 - DNA, 22 bp, Homo sapiens
tcagaagcctccaagcctgcct

SEQ ID NO: 5641125 - DNA, 23 bp, Homo sapiens
tcagaagcctccaagcctgcctc

SEQ ID NO: 5641126 - DNA, 15 bp, Homo sapiens
tcagaagcctgaggc

SEQ ID NO: 5641127 - DNA, 23 bp, Homo sapiens
tcagaagcctgggggcctggctg

SEQ ID NO: 5641128 - DNA, 14 bp, Homo sapiens
tcagaagccttctt

SEQ ID NO: 5641129 - DNA, 16 bp, Homo sapiens
tcagaagccttcttgc

SEQ ID NO: 5641130 - DNA, 18 bp, Homo sapiens
tcagaagccttcttgctg

SEQ ID NO: 5641131 - DNA, 19 bp, Homo sapiens
tcagaagccttcttgctgc

SEQ ID NO: 5641132 - DNA, 20 bp, Homo sapiens
tcagaagccttcttgctgcc

SEQ ID NO: 5641133 - DNA, 15 bp, Homo sapiens
tcagaagctattttt

SEQ ID NO: 5641134 - DNA, 19 bp, Homo sapiens
tcagaagcttctgaaaaca

SEQ ID NO: 5641135 - DNA, 13 bp, Homo sapiens
tcagaaggacggc

SEQ ID NO: 5641136 - DNA, 12 bp, Homo sapiens
tcagaaggagaa

SEQ ID NO: 5641137 - DNA, 14 bp, Homo sapiens
tcagaaggagaagg

SEQ ID NO: 5641138 - DNA, 19 bp, Homo sapiens
tcagaaggagaaggaagga

SEQ ID NO: 5641139 - DNA, 22 bp, Homo sapiens
tcagaaggagaaggctggagaa

SEQ ID NO: 5641140 - DNA, 15 bp, Homo sapiens
tcagaaggagacaga

SEQ ID NO: 5641141 - DNA, 17 bp, Homo sapiens
tcagaaggatgcccaga

SEQ ID NO: 5641142 - DNA, 17 bp, Homo sapiens
tcagaaggcctcactca

SEQ ID NO: 5641143 - DNA, 17 bp, Homo sapiens
tcagaaggctggggcca

SEQ ID NO: 5641144 - DNA, 20 bp, Homo sapiens
tcagaaggctggggccagtg

SEQ ID NO: 5641145 - DNA, 14 bp, Homo sapiens
tcagaaggcttcat

SEQ ID NO: 5641146 - DNA, 17 bp, Homo sapiens
tcagaaggctttgggat

SEQ ID NO: 5641147 - DNA, 12 bp, Homo sapiens
tcagaagggagg

SEQ ID NO: 5641148 - DNA, 13 bp, Homo sapiens
tcagaagggctat

SEQ ID NO: 5641149 - DNA, 20 bp, Homo sapiens
tcagaaggggaggggagaca

SEQ ID NO: 5641150 - DNA, 22 bp, Homo sapiens
tcagaaggtaggggccgtgtcc

SEQ ID NO: 5641151 - DNA, 18 bp, Homo sapiens
tcagaaggttcacccagc

SEQ ID NO: 5641152 - DNA, 18 bp, Homo sapiens
tcagaagtaactcccact

SEQ ID NO: 5641153 - DNA, 19 bp, Homo sapiens
tcagaagtatggaattttc

SEQ ID NO: 5641154 - DNA, 15 bp, Homo sapiens
tcagaagtcatcttg

SEQ ID NO: 5641155 - DNA, 18 bp, Homo sapiens
tcagaagtctagttttat

SEQ ID NO: 5641156 - DNA, 15 bp, Homo sapiens
tcagaagtctttcag

SEQ ID NO: 5641157 - DNA, 17 bp, Homo sapiens
tcagaagtgaaaaagac

SEQ ID NO: 5641158 - DNA, 12 bp, Homo sapiens
tcagaagtgatt

SEQ ID NO: 5641159 - DNA, 14 bp, Homo sapiens
tcagaagttaacat

SEQ ID NO: 5641160 - DNA, 17 bp, Homo sapiens
tcagaagtttggcaata

SEQ ID NO: 5641161 - DNA, 15 bp, Homo sapiens
tcagaataaagaaca

SEQ ID NO: 5641162 - DNA, 16 bp, Homo sapiens
tcagaataaagaacat

SEQ ID NO: 5641163 - DNA, 12 bp, Homo sapiens
tcagaataaatg

SEQ ID NO: 5641164 - DNA, 12 bp, Homo sapiens
tcagaataaatt

SEQ ID NO: 5641165 - DNA, 23 bp, Homo sapiens
tcagaataaattgatcctttgat

SEQ ID NO: 5641166 - DNA, 22 bp, Homo sapiens
tcagaatagctgttttgtgtat

SEQ ID NO: 5641167 - DNA, 15 bp, Homo sapiens
tcagaataggaaaac

SEQ ID NO: 5641168 - DNA, 19 bp, Homo sapiens
tcagaatagtgatgtgttc

SEQ ID NO: 5641169 - DNA, 21 bp, Homo sapiens
tcagaatagttattctctaag

SEQ ID NO: 5641170 - DNA, 19 bp, Homo sapiens
tcagaatataacatgtaaa

SEQ ID NO: 5641171 - DNA, 18 bp, Homo sapiens
tcagaatatattcacttt

SEQ ID NO: 5641172 - DNA, 16 bp, Homo sapiens
tcagaatatgattcac

SEQ ID NO: 5641173 - DNA, 19 bp, Homo sapiens
tcagaatattctttttata

SEQ ID NO: 5641174 - DNA, 12 bp, Homo sapiens
tcagaatatttt

SEQ ID NO: 5641175 - DNA, 15 bp, Homo sapiens
tcagaatattttcaa

SEQ ID NO: 5641176 - DNA, 16 bp, Homo sapiens
tcagaatcaaaccttt

SEQ ID NO: 5641177 - DNA, 21 bp, Homo sapiens
tcagaatcaaacctttttata

SEQ ID NO: 5641178 - DNA, 21 bp, Homo sapiens
tcagaatcaaatctgagcctt

SEQ ID NO: 5641179 - DNA, 17 bp, Homo sapiens
tcagaatcacttctgag

SEQ ID NO: 5641180 - DNA, 17 bp, Homo sapiens
tcagaatcaggttgaca

SEQ ID NO: 5641181 - DNA, 15 bp, Homo sapiens
tcagaatcatgctgt

SEQ ID NO: 5641182 - DNA, 22 bp, Homo sapiens
tcagaatccaagtgaacactag

SEQ ID NO: 5641183 - DNA, 18 bp, Homo sapiens
tcagaatcccttaacagt

SEQ ID NO: 5641184 - DNA, 17 bp, Homo sapiens
tcagaatccttggctga

SEQ ID NO: 5641185 - DNA, 18 bp, Homo sapiens
tcagaatctcaaataact

SEQ ID NO: 5641186 - DNA, 19 bp, Homo sapiens
tcagaatctcaaataacta

SEQ ID NO: 5641187 - DNA, 17 bp, Homo sapiens
tcagaatctctcttctt

SEQ ID NO: 5641188 - DNA, 18 bp, Homo sapiens
tcagaatctgaatgtaat

SEQ ID NO: 5641189 - DNA, 13 bp, Homo sapiens
tcagaatctttaa

SEQ ID NO: 5641190 - DNA, 15 bp, Homo sapiens
tcagaatctttcctt

SEQ ID NO: 5641191 - DNA, 16 bp, Homo sapiens
tcagaatctttgttaa

SEQ ID NO: 5641192 - DNA, 17 bp, Homo sapiens
tcagaatcttttcaatg

SEQ ID NO: 5641193 - DNA, 19 bp, Homo sapiens
tcagaatgctattgaaaat

SEQ ID NO: 5641194 - DNA, 14 bp, Homo sapiens
tcagaatgctctac

SEQ ID NO: 5641195 - DNA, 17 bp, Homo sapiens
tcagaatgctctacttc

SEQ ID NO: 5641196 - DNA, 15 bp, Homo sapiens
tcagaatggaaagaa

SEQ ID NO: 5641197 - DNA, 20 bp, Homo sapiens
tcagaatggcagtcctggag

SEQ ID NO: 5641198 - DNA, 14 bp, Homo sapiens
tcagaatgggggct

SEQ ID NO: 5641199 - DNA, 18 bp, Homo sapiens
tcagaatgtgcaaagcag

SEQ ID NO: 5641200 - DNA, 21 bp, Homo sapiens
tcagaatgttgtgttggtatt

SEQ ID NO: 5641201 - DNA, 16 bp, Homo sapiens
tcagaattaaactttt

SEQ ID NO: 5641202 - DNA, 13 bp, Homo sapiens
tcagaattatgat

SEQ ID NO: 5641203 - DNA, 20 bp, Homo sapiens
tcagaattatttttaaaaag

SEQ ID NO: 5641204 - DNA, 21 bp, Homo sapiens
tcagaattcggtgtgctgcca

SEQ ID NO: 5641205 - DNA, 23 bp, Homo sapiens
tcagaattcggtgtgctgccaac

SEQ ID NO: 5641206 - DNA, 16 bp, Homo sapiens
tcagaattgaaacact

SEQ ID NO: 5641207 - DNA, 20 bp, Homo sapiens
tcagaattggcataatttgt

SEQ ID NO: 5641208 - DNA, 22 bp, Homo sapiens
tcagaattgtttttagaaattt

SEQ ID NO: 5641209 - DNA, 22 bp, Homo sapiens
tcagaatttgtgttgaaggaac

SEQ ID NO: 5641210 - DNA, 20 bp, Homo sapiens
tcagaattttatactttccc

SEQ ID NO: 5641211 - DNA, 23 bp, Homo sapiens
tcagaattttatactttccctac

SEQ ID NO: 5641212 - DNA, 19 bp, Homo sapiens
tcagaattttggaaaaatg

SEQ ID NO: 5641213 - DNA, 20 bp, Homo sapiens
tcagaattttggaaaaatgt

SEQ ID NO: 5641214 - DNA, 14 bp, Homo sapiens
tcagaattttgtat

SEQ ID NO: 5641215 - DNA, 18 bp, Homo sapiens
tcagaatttttaactgta

SEQ ID NO: 5641216 - DNA, 13 bp, Homo sapiens
tcagacaaaatgg

SEQ ID NO: 5641217 - DNA, 14 bp, Homo sapiens
tcagacaaaatgga

SEQ ID NO: 5641218 - DNA, 13 bp, Homo sapiens
tcagacaaattac

SEQ ID NO: 5641219 - DNA, 23 bp, Homo sapiens
tcagacaacattatgatctaata

SEQ ID NO: 5641220 - DNA, 14 bp, Homo sapiens
tcagacaagacaga

SEQ ID NO: 5641221 - DNA, 23 bp, Homo sapiens
tcagacaagacagaggggagcag

SEQ ID NO: 5641222 - DNA, 20 bp, Homo sapiens
tcagacaagcactattttat

SEQ ID NO: 5641223 - DNA, 22 bp, Homo sapiens
tcagacaagcactattttatat

SEQ ID NO: 5641224 - DNA, 20 bp, Homo sapiens
tcagacaagtgttttggaaa

SEQ ID NO: 5641225 - DNA, 20 bp, Homo sapiens
tcagacaataccactggtta

SEQ ID NO: 5641226 - DNA, 16 bp, Homo sapiens
tcagacaatccactct

SEQ ID NO: 5641227 - DNA, 23 bp, Homo sapiens
tcagacaatccactctcaggagg

SEQ ID NO: 5641228 - DNA, 22 bp, Homo sapiens
tcagacaattcagaagcatcac

SEQ ID NO: 5641229 - DNA, 15 bp, Homo sapiens
tcagacacagctctt

SEQ ID NO: 5641230 - DNA, 20 bp, Homo sapiens
tcagacacaggaaaaataaa

SEQ ID NO: 5641231 - DNA, 20 bp, Homo sapiens
tcagacacatgctatgttct

SEQ ID NO: 5641232 - DNA, 15 bp, Homo sapiens
tcagacaccctcaac

SEQ ID NO: 5641233 - DNA, 22 bp, Homo sapiens
tcagacaccctcaacctcttct

SEQ ID NO: 5641234 - DNA, 17 bp, Homo sapiens
tcagacaccctctcctt

SEQ ID NO: 5641235 - DNA, 22 bp, Homo sapiens
tcagacacctgttcacagaaaa

SEQ ID NO: 5641236 - DNA, 16 bp, Homo sapiens
tcagacacgattgaga

SEQ ID NO: 5641237 - DNA, 16 bp, Homo sapiens
tcagacactacatgat

SEQ ID NO: 5641238 - DNA, 15 bp, Homo sapiens
tcagacactctggct

SEQ ID NO: 5641239 - DNA, 17 bp, Homo sapiens
tcagacactctggctgg

SEQ ID NO: 5641240 - DNA, 14 bp, Homo sapiens
tcagacactttgga

SEQ ID NO: 5641241 - DNA, 21 bp, Homo sapiens
tcagacagaagggtaatgcgt

SEQ ID NO: 5641242 - DNA, 21 bp, Homo sapiens
tcagacagacttatacacccc

SEQ ID NO: 5641243 - DNA, 17 bp, Homo sapiens
tcagacagagaggactg

SEQ ID NO: 5641244 - DNA, 13 bp, Homo sapiens
tcagacagatgtc

SEQ ID NO: 5641245 - DNA, 19 bp, Homo sapiens
tcagacagatgtcagcttc

SEQ ID NO: 5641246 - DNA, 18 bp, Homo sapiens
tcagacagctgcctggga

SEQ ID NO: 5641247 - DNA, 14 bp, Homo sapiens
tcagacataaagcc

SEQ ID NO: 5641248 - DNA, 15 bp, Homo sapiens
tcagacataaagcca

SEQ ID NO: 5641249 - DNA, 16 bp, Homo sapiens
tcagacatccacataa

SEQ ID NO: 5641250 - DNA, 22 bp, Homo sapiens
tcagacatctgaggttttattt

SEQ ID NO: 5641251 - DNA, 22 bp, Homo sapiens
tcagacatgaaaactattttaa

SEQ ID NO: 5641252 - DNA, 19 bp, Homo sapiens
tcagacatgaaatgtacat

SEQ ID NO: 5641253 - DNA, 16 bp, Homo sapiens
tcagaccaaggaacaa

SEQ ID NO: 5641254 - DNA, 14 bp, Homo sapiens
tcagaccacggctc

SEQ ID NO: 5641255 - DNA, 18 bp, Homo sapiens
tcagaccagtactgggaa

SEQ ID NO: 5641256 - DNA, 13 bp, Homo sapiens
tcagacccagatg

SEQ ID NO: 5641257 - DNA, 17 bp, Homo sapiens
tcagacccaggagtcca

SEQ ID NO: 5641258 - DNA, 20 bp, Homo sapiens
tcagacccaggagtccagac

SEQ ID NO: 5641259 - DNA, 20 bp, Homo sapiens
tcagacccaggagtccagcc

SEQ ID NO: 5641260 - DNA, 23 bp, Homo sapiens
tcagacccaggggtccaggcccc

SEQ ID NO: 5641261 - DNA, 21 bp, Homo sapiens
tcagacccataaaccacctcc

SEQ ID NO: 5641262 - DNA, 17 bp, Homo sapiens
tcagatgatctctccac

SEQ ID NO: 5641263 - DNA, 12 bp, Homo sapiens
tcagatgatggc

SEQ ID NO: 5641264 - DNA, 20 bp, Homo sapiens
tcagatgatggccatttcta

SEQ ID NO: 5641265 - DNA, 21 bp, Homo sapiens
tcagatgatggccatttctaa

SEQ ID NO: 5641266 - DNA, 15 bp, Homo sapiens
tcagatgcaggttgg

SEQ ID NO: 5641267 - DNA, 18 bp, Homo sapiens
tcagatgcagttttcaaa

SEQ ID NO: 5641268 - DNA, 20 bp, Homo sapiens
tcagatgcagttttcaaatt

SEQ ID NO: 5641269 - DNA, 22 bp, Homo sapiens
tcagatgcccagagggcccagg

SEQ ID NO: 5641270 - DNA, 17 bp, Homo sapiens
tcagatgcgtgcccagc

SEQ ID NO: 5641271 - DNA, 12 bp, Homo sapiens
tcagatgctcaa

SEQ ID NO: 5641272 - DNA, 16 bp, Homo sapiens
tcagatgctgaattga

SEQ ID NO: 5641273 - DNA, 13 bp, Homo sapiens
tcagatgctggtc

SEQ ID NO: 5641274 - DNA, 23 bp, Homo sapiens
tcagatgctggtcatcctgggca

SEQ ID NO: 5641275 - DNA, 14 bp, Homo sapiens
tcagatgcttctgg

SEQ ID NO: 5641276 - DNA, 21 bp, Homo sapiens
tcagatggaaccgcaggaagc

SEQ ID NO: 5641277 - DNA, 13 bp, Homo sapiens
tcagatggaggtt

SEQ ID NO: 5641278 - DNA, 21 bp, Homo sapiens
tcagatggaggttctcagagc

SEQ ID NO: 5641279 - DNA, 15 bp, Homo sapiens
tcagatggatgtaga

SEQ ID NO: 5641280 - DNA, 16 bp, Homo sapiens
tcagatggcagctttt

SEQ ID NO: 5641281 - DNA, 17 bp, Homo sapiens
tcagatggctgaggcag

SEQ ID NO: 5641282 - DNA, 15 bp, Homo sapiens
tcagatgggaacagt

SEQ ID NO: 5641283 - DNA, 18 bp, Homo sapiens
tcagatgggaagacatga

SEQ ID NO: 5641284 - DNA, 22 bp, Homo sapiens
tcagatgggaggaaagagagca

SEQ ID NO: 5641285 - DNA, 13 bp, Homo sapiens
tcagatggggcct

SEQ ID NO: 5641286 - DNA, 17 bp, Homo sapiens
tcagatgggtctgatat

SEQ ID NO: 5641287 - DNA, 15 bp, Homo sapiens
tcagatggtgtcatt

SEQ ID NO: 5641288 - DNA, 22 bp, Homo sapiens
tcagatggtgtcatttagtaag

SEQ ID NO: 5641289 - DNA, 14 bp, Homo sapiens
tcagatgtcttctg

SEQ ID NO: 5641290 - DNA, 15 bp, Homo sapiens
tcagatgtgcaataa

SEQ ID NO: 5641291 - DNA, 16 bp, Homo sapiens
tcagatgtggagccag

SEQ ID NO: 5641292 - DNA, 18 bp, Homo sapiens
tcagatgtggagccaggc

SEQ ID NO: 5641293 - DNA, 20 bp, Homo sapiens
tcagatgtggagccaggcgt

SEQ ID NO: 5641294 - DNA, 17 bp, Homo sapiens
tcagatgttaaaataaa

SEQ ID NO: 5641295 - DNA, 16 bp, Homo sapiens
tcagatgtttcatcaa

SEQ ID NO: 5641296 - DNA, 17 bp, Homo sapiens
tcagatgtttcatcaat

SEQ ID NO: 5641297 - DNA, 13 bp, Homo sapiens
tcagatgtttcca

SEQ ID NO: 5641298 - DNA, 14 bp, Homo sapiens
tcagatgtttccaa

SEQ ID NO: 5641299 - DNA, 11 bp, Homo sapiens
tcagatgtttt

SEQ ID NO: 5641300 - DNA, 23 bp, Homo sapiens
tcagatgttttacgcaaggaagg

SEQ ID NO: 5641301 - DNA, 17 bp, Homo sapiens
tcagattaaattacagc

SEQ ID NO: 5641302 - DNA, 15 bp, Homo sapiens
tcagattagacacta

SEQ ID NO: 5641303 - DNA, 22 bp, Homo sapiens
tcagattagatgtgccaataac

SEQ ID NO: 5641304 - DNA, 14 bp, Homo sapiens
tcagattcccagag

SEQ ID NO: 5641305 - DNA, 14 bp, Homo sapiens
tcagattccccact

SEQ ID NO: 5641306 - DNA, 20 bp, Homo sapiens
tcagattccccactcagcct

SEQ ID NO: 5641307 - DNA, 21 bp, Homo sapiens
tcagattccccccatctccat

SEQ ID NO: 5641308 - DNA, 14 bp, Homo sapiens
tcagattcttgcat

SEQ ID NO: 5641309 - DNA, 19 bp, Homo sapiens
tcagattcttgctgtgacc

SEQ ID NO: 5641310 - DNA, 20 bp, Homo sapiens
tcagattgacagcatataga

SEQ ID NO: 5641311 - DNA, 22 bp, Homo sapiens
tcagattgacctataaaacaaa

SEQ ID NO: 5641312 - DNA, 18 bp, Homo sapiens
tcagattgactaaataaa

SEQ ID NO: 5641313 - DNA, 13 bp, Homo sapiens
tcagattgctgaa

SEQ ID NO: 5641314 - DNA, 15 bp, Homo sapiens
tcagattgctgaatc

SEQ ID NO: 5641315 - DNA, 20 bp, Homo sapiens
tcagattgcttaaaagcatt

SEQ ID NO: 5641316 - DNA, 24 bp, Homo sapiens
tcagattggggtgttagaagtgca

SEQ ID NO: 5641317 - DNA, 16 bp, Homo sapiens
tcagattgtcttgcaa

SEQ ID NO: 5641318 - DNA, 18 bp, Homo sapiens
tcagattgtcttgcaact

SEQ ID NO: 5641319 - DNA, 23 bp, Homo sapiens
tcagattgtggaatgttggataa

SEQ ID NO: 5641320 - DNA, 18 bp, Homo sapiens
tcagattgttaagggcat

SEQ ID NO: 5641321 - DNA, 21 bp, Homo sapiens
tcagatttaagccttacaaag

SEQ ID NO: 5641322 - DNA, 16 bp, Homo sapiens
tcagatttccacagag

SEQ ID NO: 5641323 - DNA, 15 bp, Homo sapiens
tcagatttctgagga

SEQ ID NO: 5641324 - DNA, 16 bp, Homo sapiens
tcagatttctgaggaa

SEQ ID NO: 5641325 - DNA, 19 bp, Homo sapiens
tcagatttctggttgttat

SEQ ID NO: 5641326 - DNA, 11 bp, Homo sapiens
tcagatttctt

SEQ ID NO: 5641327 - DNA, 18 bp, Homo sapiens
tcagatttcttaatgtct

SEQ ID NO: 5641328 - DNA, 20 bp, Homo sapiens
tcagatttgcacaaaaagat

SEQ ID NO: 5641329 - DNA, 22 bp, Homo sapiens
tcagatttgccttattggcagc

SEQ ID NO: 5641330 - DNA, 16 bp, Homo sapiens
tcagattttaaaaagg

SEQ ID NO: 5641331 - DNA, 21 bp, Homo sapiens
tcagattttaaaaagtcttca

SEQ ID NO: 5641332 - DNA, 22 bp, Homo sapiens
tcagattttactgtctatggat

SEQ ID NO: 5641333 - DNA, 15 bp, Homo sapiens
tcagattttcctgtg

SEQ ID NO: 5641334 - DNA, 14 bp, Homo sapiens
tcagattttctcct

SEQ ID NO: 5641335 - DNA, 21 bp, Homo sapiens
tcagattttgataactgttta

SEQ ID NO: 5641336 - DNA, 18 bp, Homo sapiens
tcagattttttaaaattt

SEQ ID NO: 5641337 - DNA, 14 bp, Homo sapiens
tcagattttttcct

SEQ ID NO: 5641338 - DNA, 20 bp, Homo sapiens
tcagcaaaaagcaaaatcat

SEQ ID NO: 5641339 - DNA, 14 bp, Homo sapiens
tcagcaaacacaat

SEQ ID NO: 5641340 - DNA, 17 bp, Homo sapiens
tcagcaaacacaataag

SEQ ID NO: 5641341 - DNA, 13 bp, Homo sapiens
tcagcaaaccatt

SEQ ID NO: 5641342 - DNA, 20 bp, Homo sapiens
tcagcaaagctacaggactg

SEQ ID NO: 5641343 - DNA, 19 bp, Homo sapiens
tcagcaaaggtcttgaata

SEQ ID NO: 5641344 - DNA, 18 bp, Homo sapiens
tcagcaaatgccttttca

SEQ ID NO: 5641345 - DNA, 22 bp, Homo sapiens
tcagcaaatgccttttcaaatg

SEQ ID NO: 5641346 - DNA, 21 bp, Homo sapiens
tcagcaaattaattggcagca

SEQ ID NO: 5641347 - DNA, 15 bp, Homo sapiens
tcagcaaattccaga

SEQ ID NO: 5641348 - DNA, 14 bp, Homo sapiens
tcagcaaattcttg

SEQ ID NO: 5641349 - DNA, 15 bp, Homo sapiens
tcagcaaattcttga

SEQ ID NO: 5641350 - DNA, 20 bp, Homo sapiens
tcagcaaattcttgaataaa

SEQ ID NO: 5641351 - DNA, 15 bp, Homo sapiens
tcagcaaatttaaga

SEQ ID NO: 5641352 - DNA, 21 bp, Homo sapiens
tcagcaaccctacagtatata

SEQ ID NO: 5641353 - DNA, 12 bp, Homo sapiens
tcagcaagactt

SEQ ID NO: 5641354 - DNA, 12 bp, Homo sapiens
tcagcaagagaa

SEQ ID NO: 5641355 - DNA, 20 bp, Homo sapiens
tcagcaagaggaggacagaa

SEQ ID NO: 5641356 - DNA, 12 bp, Homo sapiens
tcagcaaggcca

SEQ ID NO: 5641357 - DNA, 13 bp, Homo sapiens
tcagcaaggccac

SEQ ID NO: 5641358 - DNA, 14 bp, Homo sapiens
tcagcaaggccacc

SEQ ID NO: 5641359 - DNA, 17 bp, Homo sapiens
tcagcaaggccacctct

SEQ ID NO: 5641360 - DNA, 18 bp, Homo sapiens
tcagcaaggccacctctt

SEQ ID NO: 5641361 - DNA, 14 bp, Homo sapiens
tcagcaaggggctg

SEQ ID NO: 5641362 - DNA, 19 bp, Homo sapiens
tcagcaagtagagcagagt

SEQ ID NO: 5641363 - DNA, 13 bp, Homo sapiens
tcagcaagtgccc

SEQ ID NO: 5641364 - DNA, 19 bp, Homo sapiens
tcagcaagtgcccagtgga

SEQ ID NO: 5641365 - DNA, 12 bp, Homo sapiens
tcagcaagtgta

SEQ ID NO: 5641366 - DNA, 17 bp, Homo sapiens
tcagcaagtgtacagta

SEQ ID NO: 5641367 - DNA, 21 bp, Homo sapiens
tcagcaagttagaactagcca

SEQ ID NO: 5641368 - DNA, 18 bp, Homo sapiens
tcagcaatagggtgcagt

SEQ ID NO: 5641369 - DNA, 14 bp, Homo sapiens
tcagcaattaaaga

SEQ ID NO: 5641370 - DNA, 18 bp, Homo sapiens
tcagcaatttcagaacca

SEQ ID NO: 5641371 - DNA, 20 bp, Homo sapiens
tcagcacagataaaaagtgg

SEQ ID NO: 5641372 - DNA, 22 bp, Homo sapiens
tcagcacagataaaaagtggaa

SEQ ID NO: 5641373 - DNA, 14 bp, Homo sapiens
tcagcacaggaatt

SEQ ID NO: 5641374 - DNA, 17 bp, Homo sapiens
tcagcacatatgggaac

SEQ ID NO: 5641375 - DNA, 14 bp, Homo sapiens
tcagcacatctcaa

SEQ ID NO: 5641376 - DNA, 19 bp, Homo sapiens
tcagcaccaagagcagctg

SEQ ID NO: 5641377 - DNA, 13 bp, Homo sapiens
tcagcaccaccct

SEQ ID NO: 5641378 - DNA, 14 bp, Homo sapiens
tcagcaccacccta

SEQ ID NO: 5641379 - DNA, 18 bp, Homo sapiens
tcagcaccacgtgccaag

SEQ ID NO: 5641380 - DNA, 14 bp, Homo sapiens
tcagcaccatggag

SEQ ID NO: 5641381 - DNA, 20 bp, Homo sapiens
tcagcaccatggaggcaggc

SEQ ID NO: 5641382 - DNA, 18 bp, Homo sapiens
tcagcaccccactcctca

SEQ ID NO: 5641383 - DNA, 14 bp, Homo sapiens
tcagcacccccttc

SEQ ID NO: 5641384 - DNA, 17 bp, Homo sapiens
tcagcacccccttctct

SEQ ID NO: 5641385 - DNA, 23 bp, Homo sapiens
tcagcacccccttctctgcccat

SEQ ID NO: 5641386 - DNA, 17 bp, Homo sapiens
tcagcacccctgtctct

SEQ ID NO: 5641387 - DNA, 15 bp, Homo sapiens
tcagcaccccttcca

SEQ ID NO: 5641388 - DNA, 12 bp, Homo sapiens
tcagcaccctgg

SEQ ID NO: 5641389 - DNA, 17 bp, Homo sapiens
tcagcaccctgggtgcc

SEQ ID NO: 5641390 - DNA, 19 bp, Homo sapiens
tcagcaccctgggtgccat

SEQ ID NO: 5641391 - DNA, 21 bp, Homo sapiens
tcagcacctacagtgtacagt

SEQ ID NO: 5641392 - DNA, 22 bp, Homo sapiens
tcagcacctacagtgtacagtc

SEQ ID NO: 5641393 - DNA, 20 bp, Homo sapiens
tcagcaccttggcccaggag

SEQ ID NO: 5641394 - DNA, 22 bp, Homo sapiens
tcagcaccttggcccaggagct

SEQ ID NO: 5641395 - DNA, 21 bp, Homo sapiens
tcagcacgagacccatttcct

SEQ ID NO: 5641396 - DNA, 16 bp, Homo sapiens
tcagcacgatttctgt

SEQ ID NO: 5641397 - DNA, 17 bp, Homo sapiens
tcagcacgatttctgtt

SEQ ID NO: 5641398 - DNA, 18 bp, Homo sapiens
tcagcacgatttctgttt

SEQ ID NO: 5641399 - DNA, 16 bp, Homo sapiens
tcagcactcagaaaag

SEQ ID NO: 5641400 - DNA, 18 bp, Homo sapiens
tcagcactctgtaaaatg

SEQ ID NO: 5641401 - DNA, 15 bp, Homo sapiens
tcagcactgaaaata

SEQ ID NO: 5641402 - DNA, 19 bp, Homo sapiens
tcagcactgatggaaaata

SEQ ID NO: 5641403 - DNA, 17 bp, Homo sapiens
tcagcactgatttcaca

SEQ ID NO: 5641404 - DNA, 22 bp, Homo sapiens
tcagcactgcctgctcccatcc

SEQ ID NO: 5641405 - DNA, 14 bp, Homo sapiens
tcagcactggattg

SEQ ID NO: 5641406 - DNA, 21 bp, Homo sapiens
tcagcactggattgtagaact

SEQ ID NO: 5641407 - DNA, 18 bp, Homo sapiens
tcagcactgtttgaagat

SEQ ID NO: 5641408 - DNA, 16 bp, Homo sapiens
tcagcacttggccctt

SEQ ID NO: 5641409 - DNA, 15 bp, Homo sapiens
tcagcacttgtctca

SEQ ID NO: 5641410 - DNA, 18 bp, Homo sapiens
tcagcacttgtctcattt

SEQ ID NO: 5641411 - DNA, 21 bp, Homo sapiens
tcagcacttgtctcattttaa

SEQ ID NO: 5641412 - DNA, 22 bp, Homo sapiens
tcagcactttaaagaggctgtg

SEQ ID NO: 5641413 - DNA, 22 bp, Homo sapiens
tcagcactttgggaggccgagg

SEQ ID NO: 5641414 - DNA, 23 bp, Homo sapiens
tcagcactttgggaggctgaggc

SEQ ID NO: 5641415 - DNA, 17 bp, Homo sapiens
tcagcagaaacccccag

SEQ ID NO: 5641416 - DNA, 18 bp, Homo sapiens
tcagcagaaacccccagg

SEQ ID NO: 5641417 - DNA, 20 bp, Homo sapiens
tcagcagaaacccccaggag

SEQ ID NO: 5641418 - DNA, 21 bp, Homo sapiens
tcagcagaaacccccaggagg

SEQ ID NO: 5641419 - DNA, 17 bp, Homo sapiens
tcagcagaacctgcaca

SEQ ID NO: 5641420 - DNA, 18 bp, Homo sapiens
tcagcagaacctgtagga

SEQ ID NO: 5641421 - DNA, 14 bp, Homo sapiens
tcagcagacacaca

SEQ ID NO: 5641422 - DNA, 17 bp, Homo sapiens
tcagcagacacacatgg

SEQ ID NO: 5641423 - DNA, 13 bp, Homo sapiens
tcagcagacactc

SEQ ID NO: 5641424 - DNA, 15 bp, Homo sapiens
tcagcagacactcca

SEQ ID NO: 5641425 - DNA, 20 bp, Homo sapiens
tcagcagactttctctgtgt

SEQ ID NO: 5641426 - DNA, 15 bp, Homo sapiens
tcagcagagacgggg

SEQ ID NO: 5641427 - DNA, 18 bp, Homo sapiens
tcagcagagtgagggggt

SEQ ID NO: 5641428 - DNA, 12 bp, Homo sapiens
tcagcagagtgc

SEQ ID NO: 5641429 - DNA, 16 bp, Homo sapiens
tcagcagcaacaactg

SEQ ID NO: 5641430 - DNA, 23 bp, Homo sapiens
tcagcagcaacaactgtcagttc

SEQ ID NO: 5641431 - DNA, 19 bp, Homo sapiens
tcagcagcagagagccctg

SEQ ID NO: 5641432 - DNA, 15 bp, Homo sapiens
tcagcagccagctcc

SEQ ID NO: 5641433 - DNA, 12 bp, Homo sapiens
tcagcagccagt

SEQ ID NO: 5641434 - DNA, 14 bp, Homo sapiens
tcagcagccagtct

SEQ ID NO: 5641435 - DNA, 15 bp, Homo sapiens
tcagcagccagtctc

SEQ ID NO: 5641436 - DNA, 16 bp, Homo sapiens
tcagcagccagtctca

SEQ ID NO: 5641437 - DNA, 24 bp, Homo sapiens
tcagcagccagtctcagagaccag

SEQ ID NO: 5641438 - DNA, 12 bp, Homo sapiens
tcagcagccccc

SEQ ID NO: 5641439 - DNA, 17 bp, Homo sapiens
tcagcagccctcctcac

SEQ ID NO: 5641440 - DNA, 23 bp, Homo sapiens
tcagctggcggaacctggctgcg

SEQ ID NO: 5641441 - DNA, 22 bp, Homo sapiens
tcagctggctgagacactgaag

SEQ ID NO: 5641442 - DNA, 18 bp, Homo sapiens
tcagctgggagccagtgt

SEQ ID NO: 5641443 - DNA, 22 bp, Homo sapiens
tcagctgggagccagtgtgccc

SEQ ID NO: 5641444 - DNA, 22 bp, Homo sapiens
tcagctgggtcacatccatccc

SEQ ID NO: 5641445 - DNA, 19 bp, Homo sapiens
tcagctggtggatggtgac

SEQ ID NO: 5641446 - DNA, 17 bp, Homo sapiens
tcagctggtgtcagtcc

SEQ ID NO: 5641447 - DNA, 22 bp, Homo sapiens
tcagctggttactcagggttca

SEQ ID NO: 5641448 - DNA, 23 bp, Homo sapiens
tcagctgtaagaagagactggga

SEQ ID NO: 5641449 - DNA, 12 bp, Homo sapiens
tcagctgtactt

SEQ ID NO: 5641450 - DNA, 12 bp, Homo sapiens
tcagctgtcacc

SEQ ID NO: 5641451 - DNA, 21 bp, Homo sapiens
tcagctgtcacctgctcacag

SEQ ID NO: 5641452 - DNA, 13 bp, Homo sapiens
tcagctgtcctcc

SEQ ID NO: 5641453 - DNA, 14 bp, Homo sapiens
tcagctgtcctccc

SEQ ID NO: 5641454 - DNA, 18 bp, Homo sapiens
tcagctgtcctccctcca

SEQ ID NO: 5641455 - DNA, 19 bp, Homo sapiens
tcagctgtcctccctccac

SEQ ID NO: 5641456 - DNA, 15 bp, Homo sapiens
tcagctgtcctgcag

SEQ ID NO: 5641457 - DNA, 21 bp, Homo sapiens
tcagctgtcgggggccactgt

SEQ ID NO: 5641458 - DNA, 22 bp, Homo sapiens
tcagctgtcgggggccactgtg

SEQ ID NO: 5641459 - DNA, 23 bp, Homo sapiens
tcagctgtcgggggccactgtgt

SEQ ID NO: 5641460 - DNA, 15 bp, Homo sapiens
tcagctgtctgtcat

SEQ ID NO: 5641461 - DNA, 13 bp, Homo sapiens
tcagctgtctttt

SEQ ID NO: 5641462 - DNA, 19 bp, Homo sapiens
tcagctgtcttttggagga

SEQ ID NO: 5641463 - DNA, 21 bp, Homo sapiens
tcagctgtgaacatggactct

SEQ ID NO: 5641464 - DNA, 18 bp, Homo sapiens
tcagctgtggctggagga

SEQ ID NO: 5641465 - DNA, 21 bp, Homo sapiens
tcagctgtggggaacacagct

SEQ ID NO: 5641466 - DNA, 22 bp, Homo sapiens
tcagctgtggggaacatggctg

SEQ ID NO: 5641467 - DNA, 18 bp, Homo sapiens
tcagctgtggtcccaccc

SEQ ID NO: 5641468 - DNA, 15 bp, Homo sapiens
tcagctgttcagatt

SEQ ID NO: 5641469 - DNA, 19 bp, Homo sapiens
tcagctgttgcaggcagtg

SEQ ID NO: 5641470 - DNA, 16 bp, Homo sapiens
tcagctgtttgtcata

SEQ ID NO: 5641471 - DNA, 17 bp, Homo sapiens
tcagcttaaaataaaca

SEQ ID NO: 5641472 - DNA, 19 bp, Homo sapiens
tcagcttaaaattggtaat

SEQ ID NO: 5641473 - DNA, 20 bp, Homo sapiens
tcagcttaattctccttccc

SEQ ID NO: 5641474 - DNA, 21 bp, Homo sapiens
tcagcttaatttaagtttgta

SEQ ID NO: 5641475 - DNA, 18 bp, Homo sapiens
tcagcttaggggctgctg

SEQ ID NO: 5641476 - DNA, 13 bp, Homo sapiens
tcagcttataatg

SEQ ID NO: 5641477 - DNA, 19 bp, Homo sapiens
tcagcttatctcttttata

SEQ ID NO: 5641478 - DNA, 20 bp, Homo sapiens
tcagcttatctcttttatat

SEQ ID NO: 5641479 - DNA, 19 bp, Homo sapiens
tcagcttcaaataaagtaa

SEQ ID NO: 5641480 - DNA, 23 bp, Homo sapiens
tcagcttcagaatggcattgtac

SEQ ID NO: 5641481 - DNA, 17 bp, Homo sapiens
tcagcttcagactttta

SEQ ID NO: 5641482 - DNA, 14 bp, Homo sapiens
tcagcttcatttcc

SEQ ID NO: 5641483 - DNA, 18 bp, Homo sapiens
tcagcttcatttgtgtca

SEQ ID NO: 5641484 - DNA, 21 bp, Homo sapiens
tcagcttcatttgtgtcaatg

SEQ ID NO: 5641485 - DNA, 16 bp, Homo sapiens
tcagcttcccaacaat

SEQ ID NO: 5641486 - DNA, 21 bp, Homo sapiens
tcagcttcccaagtagctgag

SEQ ID NO: 5641487 - DNA, 18 bp, Homo sapiens
tcagcttccccagtagct

SEQ ID NO: 5641488 - DNA, 19 bp, Homo sapiens
tcagcttccccagtagctg

SEQ ID NO: 5641489 - DNA, 15 bp, Homo sapiens
tcagcttcctaccca

SEQ ID NO: 5641490 - DNA, 22 bp, Homo sapiens
tcagcttcctgctgctggggcc

SEQ ID NO: 5641491 - DNA, 23 bp, Homo sapiens
tcagcttctaattttgtgctctt

SEQ ID NO: 5641492 - DNA, 20 bp, Homo sapiens
tcagcttctatccttgactt

SEQ ID NO: 5641493 - DNA, 13 bp, Homo sapiens
tcagcttctccca

SEQ ID NO: 5641494 - DNA, 16 bp, Homo sapiens
tcagcttctgctgggc

SEQ ID NO: 5641495 - DNA, 17 bp, Homo sapiens
tcagcttctgctgggct

SEQ ID NO: 5641496 - DNA, 22 bp, Homo sapiens
tcagcttctgctgggctggggc

SEQ ID NO: 5641497 - DNA, 23 bp, Homo sapiens
tcagcttctgctgggctggggcc

SEQ ID NO: 5641498 - DNA, 12 bp, Homo sapiens
tcagcttctgtt

SEQ ID NO: 5641499 - DNA, 17 bp, Homo sapiens
tcagcttcttcctaggt

SEQ ID NO: 5641500 - DNA, 18 bp, Homo sapiens
tcagcttcttcctaggtc

SEQ ID NO: 5641501 - DNA, 14 bp, Homo sapiens
tcagcttgaacctg

SEQ ID NO: 5641502 - DNA, 15 bp, Homo sapiens
tcagcttggcactca

SEQ ID NO: 5641503 - DNA, 23 bp, Homo sapiens
tcagcttggcactcaggtgctga

SEQ ID NO: 5641504 - DNA, 21 bp, Homo sapiens
tcagcttgtaaatagctcagg

SEQ ID NO: 5641505 - DNA, 16 bp, Homo sapiens
tcagcttgtttctata

SEQ ID NO: 5641506 - DNA, 12 bp, Homo sapiens
tcagctttaaag

SEQ ID NO: 5641507 - DNA, 21 bp, Homo sapiens
tcagctttataataaactgtt

SEQ ID NO: 5641508 - DNA, 20 bp, Homo sapiens
tcagctttatttttctttaa

SEQ ID NO: 5641509 - DNA, 16 bp, Homo sapiens
tcagctttcagagcca

SEQ ID NO: 5641510 - DNA, 17 bp, Homo sapiens
tcagctttcagagccag

SEQ ID NO: 5641511 - DNA, 18 bp, Homo sapiens
tcagctttcagagccagt

SEQ ID NO: 5641512 - DNA, 16 bp, Homo sapiens
tcagctttccctgcca

SEQ ID NO: 5641513 - DNA, 14 bp, Homo sapiens
tcagctttccctgg

SEQ ID NO: 5641514 - DNA, 15 bp, Homo sapiens
tcagctttccctggc

SEQ ID NO: 5641515 - DNA, 20 bp, Homo sapiens
tcagctttccctggctcagg

SEQ ID NO: 5641516 - DNA, 21 bp, Homo sapiens
tcagctttctttaaagttctt

SEQ ID NO: 5641517 - DNA, 19 bp, Homo sapiens
tcagctttgcttcatgttc

SEQ ID NO: 5641518 - DNA, 19 bp, Homo sapiens
tcagctttggattgctggg

SEQ ID NO: 5641519 - DNA, 15 bp, Homo sapiens
tcagctttggctctg

SEQ ID NO: 5641520 - DNA, 23 bp, Homo sapiens
tcagctttttgatcctctactgt

SEQ ID NO: 5641521 - DNA, 14 bp, Homo sapiens
tcagctttttgtat

SEQ ID NO: 5641522 - DNA, 21 bp, Homo sapiens
tcagctttttgtattaacaaa

SEQ ID NO: 5641523 - DNA, 16 bp, Homo sapiens
tcagcttttttttcag

SEQ ID NO: 5641524 - DNA, 13 bp, Homo sapiens
tcaggaaaaatga

SEQ ID NO: 5641525 - DNA, 16 bp, Homo sapiens
tcaggaaaacagctag

SEQ ID NO: 5641526 - DNA, 18 bp, Homo sapiens
tcaggaaaagcctctgtg

SEQ ID NO: 5641527 - DNA, 17 bp, Homo sapiens
tcaggaaaaggcctggg

SEQ ID NO: 5641528 - DNA, 19 bp, Homo sapiens
tcaggaaaaggcctggggt

SEQ ID NO: 5641529 - DNA, 21 bp, Homo sapiens
tcaggaaaatgtattgattca

SEQ ID NO: 5641530 - DNA, 22 bp, Homo sapiens
tcaggaaaatgtattgattcaa

SEQ ID NO: 5641531 - DNA, 12 bp, Homo sapiens
tcaggaaagaat

SEQ ID NO: 5641532 - DNA, 14 bp, Homo sapiens
tcaggaaagacagg

SEQ ID NO: 5641533 - DNA, 15 bp, Homo sapiens
tcaggaaagacaggc

SEQ ID NO: 5641534 - DNA, 14 bp, Homo sapiens
tcaggaaagacgga

SEQ ID NO: 5641535 - DNA, 18 bp, Homo sapiens
tcaggaaagagagcacca

SEQ ID NO: 5641536 - DNA, 15 bp, Homo sapiens
tcaggaaaggaatca

SEQ ID NO: 5641537 - DNA, 22 bp, Homo sapiens
tcaggaaaggctgtagaaggaa

SEQ ID NO: 5641538 - DNA, 18 bp, Homo sapiens
tcaggaaatatatatgtg

SEQ ID NO: 5641539 - DNA, 19 bp, Homo sapiens
tcaggaaatatatatgtgt

SEQ ID NO: 5641540 - DNA, 20 bp, Homo sapiens
tcaggaaatcaaatatgcaa

SEQ ID NO: 5641541 - DNA, 22 bp, Homo sapiens
tcaggaaatcaaatatgcaaag

SEQ ID NO: 5641542 - DNA, 18 bp, Homo sapiens
tcaggaaatgaaaggtga

SEQ ID NO: 5641543 - DNA, 23 bp, Homo sapiens
tcaggaaatttttgcatgtttaa

SEQ ID NO: 5641544 - DNA, 13 bp, Homo sapiens
tcaggaacagaag

SEQ ID NO: 5641545 - DNA, 18 bp, Homo sapiens
tcaggaacagctatggga

SEQ ID NO: 5641546 - DNA, 18 bp, Homo sapiens
tcaggaaccagggcctcc

SEQ ID NO: 5641547 - DNA, 19 bp, Homo sapiens
tcaggaaccagggcctccc

SEQ ID NO: 5641548 - DNA, 22 bp, Homo sapiens
tcaggaacccaccctctccaca

SEQ ID NO: 5641549 - DNA, 16 bp, Homo sapiens
tcaggaaccctggaga

SEQ ID NO: 5641550 - DNA, 15 bp, Homo sapiens
tcaggaacctggacc

SEQ ID NO: 5641551 - DNA, 20 bp, Homo sapiens
tcaggaagaaaccccaagca

SEQ ID NO: 5641552 - DNA, 23 bp, Homo sapiens
tcaggaagaaaggagtctgcaca

SEQ ID NO: 5641553 - DNA, 15 bp, Homo sapiens
tcaggaagaaatcac

SEQ ID NO: 5641554 - DNA, 18 bp, Homo sapiens
tcaggaagaagagatgca

SEQ ID NO: 5641555 - DNA, 22 bp, Homo sapiens
tcaggaagactggacccccagc

SEQ ID NO: 5641556 - DNA, 16 bp, Homo sapiens
tcaggaagagaaggag

SEQ ID NO: 5641557 - DNA, 23 bp, Homo sapiens
tcaggaagagctatggcccagaa

SEQ ID NO: 5641558 - DNA, 23 bp, Homo sapiens
tcaggaagcaggtgtcctttccc

SEQ ID NO: 5641559 - DNA, 23 bp, Homo sapiens
tcaggaagcccggtggcgtggca

SEQ ID NO: 5641560 - DNA, 11 bp, Homo sapiens
tcaggaagctc

SEQ ID NO: 5641561 - DNA, 14 bp, Homo sapiens
tcaggaagctcagg

SEQ ID NO: 5641562 - DNA, 16 bp, Homo sapiens
tcaggaagctcagggc

SEQ ID NO: 5641563 - DNA, 17 bp, Homo sapiens
tcaggaagggagaggag

SEQ ID NO: 5641564 - DNA, 18 bp, Homo sapiens
tcaggaagggagaggagg

SEQ ID NO: 5641565 - DNA, 22 bp, Homo sapiens
tcaggaatatctgttcccagcc

SEQ ID NO: 5641566 - DNA, 23 bp, Homo sapiens
tcaggaatatgcatcccacagcc

SEQ ID NO: 5641567 - DNA, 22 bp, Homo sapiens
tcaggaatcatcaggaacgttt

SEQ ID NO: 5641568 - DNA, 12 bp, Homo sapiens
tcaggaatgggc

SEQ ID NO: 5641569 - DNA, 21 bp, Homo sapiens
tcaggaatgggccaagccagg

SEQ ID NO: 5641570 - DNA, 17 bp, Homo sapiens
tcaggaattccctggaa

SEQ ID NO: 5641571 - DNA, 20 bp, Homo sapiens
tcaggaattgcccattgttt

SEQ ID NO: 5641572 - DNA, 15 bp, Homo sapiens
tcaggaattgtcaaa

SEQ ID NO: 5641573 - DNA, 16 bp, Homo sapiens
tcaggaatttaagaat

SEQ ID NO: 5641574 - DNA, 18 bp, Homo sapiens
tcaggaatttaagaattt

SEQ ID NO: 5641575 - DNA, 16 bp, Homo sapiens
tcaggacacaggcctg

SEQ ID NO: 5641576 - DNA, 19 bp, Homo sapiens
tcaggacagctgcttctgt

SEQ ID NO: 5641577 - DNA, 16 bp, Homo sapiens
tcaggacatggggcat

SEQ ID NO: 5641578 - DNA, 23 bp, Homo sapiens
tcaggaccaaaaaacctcactgg

SEQ ID NO: 5641579 - DNA, 16 bp, Homo sapiens
tcaggaccaccctgcc

SEQ ID NO: 5641580 - DNA, 17 bp, Homo sapiens
tcaggaccaccctgcca

SEQ ID NO: 5641581 - DNA, 23 bp, Homo sapiens
tcaggaccactcagttaaggaag

SEQ ID NO: 5641582 - DNA, 15 bp, Homo sapiens
tcaggaccattttag

SEQ ID NO: 5641583 - DNA, 17 bp, Homo sapiens
tcaggacccaggccctc

SEQ ID NO: 5641584 - DNA, 22 bp, Homo sapiens
tcaggacccaggccctccatgg

SEQ ID NO: 5641585 - DNA, 15 bp, Homo sapiens
tcaggacccaggccg

SEQ ID NO: 5641586 - DNA, 18 bp, Homo sapiens
tcaggaccccactggaga

SEQ ID NO: 5641587 - DNA, 14 bp, Homo sapiens
tcaggaccccagag

SEQ ID NO: 5641588 - DNA, 18 bp, Homo sapiens
tcaggaccccatctgctg

SEQ ID NO: 5641589 - DNA, 23 bp, Homo sapiens
tcaggaccccatctgctgagctc

SEQ ID NO: 5641590 - DNA, 17 bp, Homo sapiens
tcaggaccctcgctggc

SEQ ID NO: 5641591 - DNA, 19 bp, Homo sapiens
tcaggaccctcgctggccc

SEQ ID NO: 5641592 - DNA, 20 bp, Homo sapiens
tcaggaccctcgctggcccc

SEQ ID NO: 5641593 - DNA, 23 bp, Homo sapiens
tcaggacctccggggagagcaga

SEQ ID NO: 5641594 - DNA, 16 bp, Homo sapiens
tcaggacggctcctca

SEQ ID NO: 5641595 - DNA, 21 bp, Homo sapiens
tcaggactcagaagcctctgg

SEQ ID NO: 5641596 - DNA, 17 bp, Homo sapiens
tcaggactctctccagg

SEQ ID NO: 5641597 - DNA, 21 bp, Homo sapiens
tcaggactctgcgggaggctg

SEQ ID NO: 5641598 - DNA, 22 bp, Homo sapiens
tcaggactctgcgggaggctgg

SEQ ID NO: 5641599 - DNA, 18 bp, Homo sapiens
tcaggactgtgaccaaag

SEQ ID NO: 5641600 - DNA, 20 bp, Homo sapiens
tcaggacttaacggctccag

SEQ ID NO: 5641601 - DNA, 17 bp, Homo sapiens
tcaggacttgaaagaaa

SEQ ID NO: 5641602 - DNA, 15 bp, Homo sapiens
tcaggacttggtctg

SEQ ID NO: 5641603 - DNA, 20 bp, Homo sapiens
tcaggagaatagcttttact

SEQ ID NO: 5641604 - DNA, 18 bp, Homo sapiens
tcaggagaattagatttc

SEQ ID NO: 5641605 - DNA, 24 bp, Homo sapiens
tcaggagagagtctaagataaaag

SEQ ID NO: 5641606 - DNA, 13 bp, Homo sapiens
tcaggagagcagc

SEQ ID NO: 5641607 - DNA, 17 bp, Homo sapiens
tcaggagagcatcacca

SEQ ID NO: 5641608 - DNA, 20 bp, Homo sapiens
tcaggagagccctctgctgc

SEQ ID NO: 5641609 - DNA, 22 bp, Homo sapiens
tcaggagagtagaacagataat

SEQ ID NO: 5641610 - DNA, 18 bp, Homo sapiens
tcaggagagtgcagatct

SEQ ID NO: 5641611 - DNA, 14 bp, Homo sapiens
tcaggagagtgtgc

SEQ ID NO: 5641612 - DNA, 20 bp, Homo sapiens
tcaggagagtgtgcaactgg

SEQ ID NO: 5641613 - DNA, 14 bp, Homo sapiens
tcaggagatgggga

SEQ ID NO: 5641614 - DNA, 22 bp, Homo sapiens
tcaggggcacctccggctgcct

SEQ ID NO: 5641615 - DNA, 23 bp, Homo sapiens
tcaggggcaggtggtggaggggc

SEQ ID NO: 5641616 - DNA, 15 bp, Homo sapiens
tcaggggccagagag

SEQ ID NO: 5641617 - DNA, 18 bp, Homo sapiens
tcaggggccctggagcag

SEQ ID NO: 5641618 - DNA, 15 bp, Homo sapiens
tcaggggcctctctc

SEQ ID NO: 5641619 - DNA, 15 bp, Homo sapiens
tcaggggctccatgc

SEQ ID NO: 5641620 - DNA, 17 bp, Homo sapiens
tcaggggctccatgctg

SEQ ID NO: 5641621 - DNA, 14 bp, Homo sapiens
tcaggggctcccta

SEQ ID NO: 5641622 - DNA, 14 bp, Homo sapiens
tcaggggctgcccg

SEQ ID NO: 5641623 - DNA, 16 bp, Homo sapiens
tcaggggctgcccgct

SEQ ID NO: 5641624 - DNA, 21 bp, Homo sapiens
tcaggggctgcccgctcccag

SEQ ID NO: 5641625 - DNA, 14 bp, Homo sapiens
tcaggggctgggca

SEQ ID NO: 5641626 - DNA, 16 bp, Homo sapiens
tcagggggaagaagca

SEQ ID NO: 5641627 - DNA, 22 bp, Homo sapiens
tcagggggaagaagcagagaga

SEQ ID NO: 5641628 - DNA, 17 bp, Homo sapiens
tcagggggagtctttgc

SEQ ID NO: 5641629 - DNA, 16 bp, Homo sapiens
tcagggggccagctgg

SEQ ID NO: 5641630 - DNA, 20 bp, Homo sapiens
tcagggggccagctggggag

SEQ ID NO: 5641631 - DNA, 13 bp, Homo sapiens
tcagggggccagg

SEQ ID NO: 5641632 - DNA, 20 bp, Homo sapiens
tcaggggggttgtgaggcct

SEQ ID NO: 5641633 - DNA, 19 bp, Homo sapiens
tcagggggtaggagagcac

SEQ ID NO: 5641634 - DNA, 20 bp, Homo sapiens
tcaggggtacattctagctg

SEQ ID NO: 5641635 - DNA, 22 bp, Homo sapiens
tcaggggtcaggtgtcaggccc

SEQ ID NO: 5641636 - DNA, 23 bp, Homo sapiens
tcaggggtcgtcaccacctctcc

SEQ ID NO: 5641637 - DNA, 20 bp, Homo sapiens
tcaggggtctgagctccagc

SEQ ID NO: 5641638 - DNA, 18 bp, Homo sapiens
tcaggggtgacacagact

SEQ ID NO: 5641639 - DNA, 19 bp, Homo sapiens
tcaggggtgacacagactc

SEQ ID NO: 5641640 - DNA, 20 bp, Homo sapiens
tcaggggtgacacagactca

SEQ ID NO: 5641641 - DNA, 16 bp, Homo sapiens
tcaggggtgactcaga

SEQ ID NO: 5641642 - DNA, 14 bp, Homo sapiens
tcaggggtgcacag

SEQ ID NO: 5641643 - DNA, 18 bp, Homo sapiens
tcaggggtgcattctggc

SEQ ID NO: 5641644 - DNA, 14 bp, Homo sapiens
tcaggggtgctggg

SEQ ID NO: 5641645 - DNA, 19 bp, Homo sapiens
tcaggggtgctggggcaga

SEQ ID NO: 5641646 - DNA, 17 bp, Homo sapiens
tcaggggtggagaagtg

SEQ ID NO: 5641647 - DNA, 18 bp, Homo sapiens
tcaggggttcgagaccag

SEQ ID NO: 5641648 - DNA, 15 bp, Homo sapiens
tcagggtaagctgct

SEQ ID NO: 5641649 - DNA, 16 bp, Homo sapiens
tcagggtagcagcaga

SEQ ID NO: 5641650 - DNA, 15 bp, Homo sapiens
tcagggtcatagcat

SEQ ID NO: 5641651 - DNA, 19 bp, Homo sapiens
tcagggtccctggtggcag

SEQ ID NO: 5641652 - DNA, 16 bp, Homo sapiens
tcagggtctccttcct

SEQ ID NO: 5641653 - DNA, 12 bp, Homo sapiens
tcagggtctctg

SEQ ID NO: 5641654 - DNA, 17 bp, Homo sapiens
tcagggtctctgctgcc

SEQ ID NO: 5641655 - DNA, 18 bp, Homo sapiens
tcagggtctctgctgccg

SEQ ID NO: 5641656 - DNA, 17 bp, Homo sapiens
tcagggtgaatcagatg

SEQ ID NO: 5641657 - DNA, 23 bp, Homo sapiens
tcagggtgagacgtgatgggcta

SEQ ID NO: 5641658 - DNA, 16 bp, Homo sapiens
tcagggtgatgccagg

SEQ ID NO: 5641659 - DNA, 20 bp, Homo sapiens
tcagggtgggccactctccc

SEQ ID NO: 5641660 - DNA, 17 bp, Homo sapiens
tcagggtgtgaggccac

SEQ ID NO: 5641661 - DNA, 19 bp, Homo sapiens
tcagggtgtgaggccacac

SEQ ID NO: 5641662 - DNA, 18 bp, Homo sapiens
tcagggtgtgggatctga

SEQ ID NO: 5641663 - DNA, 21 bp, Homo sapiens
tcagggttaagcctgtaatta

SEQ ID NO: 5641664 - DNA, 21 bp, Homo sapiens
tcagggttatacacagaaaag

SEQ ID NO: 5641665 - DNA, 16 bp, Homo sapiens
tcagggttatttgagg

SEQ ID NO: 5641666 - DNA, 19 bp, Homo sapiens
tcagggttggcccctgccc

SEQ ID NO: 5641667 - DNA, 17 bp, Homo sapiens
tcaggtaaaaacttcat

SEQ ID NO: 5641668 - DNA, 13 bp, Homo sapiens
tcaggtaaatctt

SEQ ID NO: 5641669 - DNA, 22 bp, Homo sapiens
tcaggtaacaggcagatacagg

SEQ ID NO: 5641670 - DNA, 15 bp, Homo sapiens
tcaggtaatacaaac

SEQ ID NO: 5641671 - DNA, 16 bp, Homo sapiens
tcaggtaatacaaact

SEQ ID NO: 5641672 - DNA, 19 bp, Homo sapiens
tcaggtacagagaaggaat

SEQ ID NO: 5641673 - DNA, 14 bp, Homo sapiens
tcaggtacggagaa

SEQ ID NO: 5641674 - DNA, 16 bp, Homo sapiens
tcaggtacggagaaga

SEQ ID NO: 5641675 - DNA, 14 bp, Homo sapiens
tcaggtactcctgc

SEQ ID NO: 5641676 - DNA, 16 bp, Homo sapiens
tcaggtactcctgcca

SEQ ID NO: 5641677 - DNA, 14 bp, Homo sapiens
tcaggtacttgtaa

SEQ ID NO: 5641678 - DNA, 16 bp, Homo sapiens
tcaggtagccaccacc

SEQ ID NO: 5641679 - DNA, 23 bp, Homo sapiens
tcaggtaggcccttgtcctgcca

SEQ ID NO: 5641680 - DNA, 19 bp, Homo sapiens
tcaggtagggagctaagga

SEQ ID NO: 5641681 - DNA, 14 bp, Homo sapiens
tcaggtagtactgg

SEQ ID NO: 5641682 - DNA, 19 bp, Homo sapiens
tcaggtagttgcaattgaa

SEQ ID NO: 5641683 - DNA, 15 bp, Homo sapiens
tcaggtattaagaaa

SEQ ID NO: 5641684 - DNA, 21 bp, Homo sapiens
tcaggtattgattgaaaaaag

SEQ ID NO: 5641685 - DNA, 16 bp, Homo sapiens
tcaggtcagagcccag

SEQ ID NO: 5641686 - DNA, 14 bp, Homo sapiens
tcaggtcagctggg

SEQ ID NO: 5641687 - DNA, 18 bp, Homo sapiens
tcaggtcagggtgaggat

SEQ ID NO: 5641688 - DNA, 17 bp, Homo sapiens
tcaggtcaggtggctgt

SEQ ID NO: 5641689 - DNA, 23 bp, Homo sapiens
tcaggtccaggccagtgggcctg

SEQ ID NO: 5641690 - DNA, 19 bp, Homo sapiens
tcaggtcccagttgctgtc

SEQ ID NO: 5641691 - DNA, 14 bp, Homo sapiens
tcaggtccccatgg

SEQ ID NO: 5641692 - DNA, 15 bp, Homo sapiens
tcaggtcccctggcc

SEQ ID NO: 5641693 - DNA, 17 bp, Homo sapiens
tcaggtccgtgggccgt

SEQ ID NO: 5641694 - DNA, 16 bp, Homo sapiens
tcaggtcctcagagaa

SEQ ID NO: 5641695 - DNA, 18 bp, Homo sapiens
tcaggtcctgctcagcag

SEQ ID NO: 5641696 - DNA, 21 bp, Homo sapiens
tcaggtctcccacgtgggaga

SEQ ID NO: 5641697 - DNA, 20 bp, Homo sapiens
tcaggtctctgtgggtggga

SEQ ID NO: 5641698 - DNA, 22 bp, Homo sapiens
tcaggtctgtaactgcccagcc

SEQ ID NO: 5641699 - DNA, 14 bp, Homo sapiens
tcaggtctgtatgt

SEQ ID NO: 5641700 - DNA, 17 bp, Homo sapiens
tcaggtctgtatgtcat

SEQ ID NO: 5641701 - DNA, 13 bp, Homo sapiens
tcaggtgaaaatg

SEQ ID NO: 5641702 - DNA, 18 bp, Homo sapiens
tcaggtgaaaatgttcat

SEQ ID NO: 5641703 - DNA, 16 bp, Homo sapiens
tcaggtgaaaggaaat

SEQ ID NO: 5641704 - DNA, 21 bp, Homo sapiens
tcaggtgaacacttagtgatc

SEQ ID NO: 5641705 - DNA, 21 bp, Homo sapiens
tcaggtgaataataaaatcaa

SEQ ID NO: 5641706 - DNA, 23 bp, Homo sapiens
tcaggtgaataataaaatcaaaa

SEQ ID NO: 5641707 - DNA, 17 bp, Homo sapiens
tcaggtgacatgtgaaa

SEQ ID NO: 5641708 - DNA, 22 bp, Homo sapiens
tcaggtgaccaaaatccccttc

SEQ ID NO: 5641709 - DNA, 16 bp, Homo sapiens
tcaggtgacctcctgc

SEQ ID NO: 5641710 - DNA, 18 bp, Homo sapiens
tcaggtgacctcctgcag

SEQ ID NO: 5641711 - DNA, 12 bp, Homo sapiens
tcaggtgacttt

SEQ ID NO: 5641712 - DNA, 21 bp, Homo sapiens
tcaggtgagaagcagaggaag

SEQ ID NO: 5641713 - DNA, 23 bp, Homo sapiens
tcaggtgattccaggatggtttg

SEQ ID NO: 5641714 - DNA, 19 bp, Homo sapiens
tcaggtgcacacatcacca

SEQ ID NO: 5641715 - DNA, 16 bp, Homo sapiens
tcaggtgcagaggaag

SEQ ID NO: 5641716 - DNA, 23 bp, Homo sapiens
tcaggtgcagtcccagtccttga

SEQ ID NO: 5641717 - DNA, 12 bp, Homo sapiens
tcaggtgccact

SEQ ID NO: 5641718 - DNA, 16 bp, Homo sapiens
tcaggtgccactgacc

SEQ ID NO: 5641719 - DNA, 18 bp, Homo sapiens
tcaggtgccttacatctt

SEQ ID NO: 5641720 - DNA, 14 bp, Homo sapiens
tcaggtgctgccat

SEQ ID NO: 5641721 - DNA, 15 bp, Homo sapiens
tcaggtgctggggcc

SEQ ID NO: 5641722 - DNA, 23 bp, Homo sapiens
tcaggtgctggggcctggttccc

SEQ ID NO: 5641723 - DNA, 13 bp, Homo sapiens
tcaggtggaacag

SEQ ID NO: 5641724 - DNA, 23 bp, Homo sapiens
tcaggtggaacaggaggaactgg

SEQ ID NO: 5641725 - DNA, 13 bp, Homo sapiens
tcaggtggaccct

SEQ ID NO: 5641726 - DNA, 16 bp, Homo sapiens
tcaggtggcatttgca

SEQ ID NO: 5641727 - DNA, 17 bp, Homo sapiens
tcaggtggcatttgcag

SEQ ID NO: 5641728 - DNA, 18 bp, Homo sapiens
tcaggtggcatttgcagg

SEQ ID NO: 5641729 - DNA, 11 bp, Homo sapiens
tcaggtggcca

SEQ ID NO: 5641730 - DNA, 13 bp, Homo sapiens
tcaggtggccaga

SEQ ID NO: 5641731 - DNA, 16 bp, Homo sapiens
tcaggtggccagaaga

SEQ ID NO: 5641732 - DNA, 19 bp, Homo sapiens
tcaggtggccagaagagct

SEQ ID NO: 5641733 - DNA, 14 bp, Homo sapiens
tcaggtggctgtgg

SEQ ID NO: 5641734 - DNA, 19 bp, Homo sapiens
tcaggtgggcggtgtgtct

SEQ ID NO: 5641735 - DNA, 22 bp, Homo sapiens
tcaggtggggagtccagggctc

SEQ ID NO: 5641736 - DNA, 19 bp, Homo sapiens
tcaggtggggcagcttgag

SEQ ID NO: 5641737 - DNA, 20 bp, Homo sapiens
tcaggtggtgtccttcttcc

SEQ ID NO: 5641738 - DNA, 13 bp, Homo sapiens
tcaggtgtataaa

SEQ ID NO: 5641739 - DNA, 23 bp, Homo sapiens
tcaggtgtatagggaattttcat

SEQ ID NO: 5641740 - DNA, 15 bp, Homo sapiens
tcaggtgtcaggccc

SEQ ID NO: 5641741 - DNA, 22 bp, Homo sapiens
tcaggtgtcatggactgttgcc

SEQ ID NO: 5641742 - DNA, 22 bp, Homo sapiens
tcaggtgtccctgcacttgcag

SEQ ID NO: 5641743 - DNA, 23 bp, Homo sapiens
tcaggtgtgataaaatgttgaac

SEQ ID NO: 5641744 - DNA, 22 bp, Homo sapiens
tcaggtgtgcctgttgctttct

SEQ ID NO: 5641745 - DNA, 19 bp, Homo sapiens
tcaggtgtggcggtgcgtg

SEQ ID NO: 5641746 - DNA, 22 bp, Homo sapiens
tcaggtgtggcggtgcgtgcct

SEQ ID NO: 5641747 - DNA, 22 bp, Homo sapiens
tcaggttactcgttcttcagca

SEQ ID NO: 5641748 - DNA, 15 bp, Homo sapiens
tcaggttatactcct

SEQ ID NO: 5641749 - DNA, 19 bp, Homo sapiens
tcaggttatcgaaataaca

SEQ ID NO: 5641750 - DNA, 20 bp, Homo sapiens
tcaggttatcgaaataacaa

SEQ ID NO: 5641751 - DNA, 23 bp, Homo sapiens
tcaggttatcgaaataacaatgt

SEQ ID NO: 5641752 - DNA, 17 bp, Homo sapiens
tcaggttccctgccaca

SEQ ID NO: 5641753 - DNA, 16 bp, Homo sapiens
tcaggttcctacagga

SEQ ID NO: 5641754 - DNA, 18 bp, Homo sapiens
tcaggttcctacaggaga

SEQ ID NO: 5641755 - DNA, 13 bp, Homo sapiens
tcaggttcctttt

SEQ ID NO: 5641756 - DNA, 19 bp, Homo sapiens
tcaggttctattttcttaa

SEQ ID NO: 5641757 - DNA, 18 bp, Homo sapiens
tcaggttcttagtgtcac

SEQ ID NO: 5641758 - DNA, 20 bp, Homo sapiens
tcaggttgctggttgctgtg

SEQ ID NO: 5641759 - DNA, 19 bp, Homo sapiens
tcaggttgtagtaaagaaa

SEQ ID NO: 5641760 - DNA, 19 bp, Homo sapiens
tcaggtttgtcatcagatg

SEQ ID NO: 5641761 - DNA, 14 bp, Homo sapiens
tcaggttttcaggt

SEQ ID NO: 5641762 - DNA, 20 bp, Homo sapiens
tcaggttttcttttaagaat

SEQ ID NO: 5641763 - DNA, 13 bp, Homo sapiens
tcaggttttgtaa

SEQ ID NO: 5641764 - DNA, 14 bp, Homo sapiens
tcaggttttgtaaa

SEQ ID NO: 5641765 - DNA, 20 bp, Homo sapiens
tcagtaaaagtcttctccca

SEQ ID NO: 5641766 - DNA, 18 bp, Homo sapiens
tcagtaaataactggaaa

SEQ ID NO: 5641767 - DNA, 15 bp, Homo sapiens
tcagtaacataactg

SEQ ID NO: 5641768 - DNA, 20 bp, Homo sapiens
tcagtaacataactgcttct

SEQ ID NO: 5641769 - DNA, 22 bp, Homo sapiens
tcagtaacataactgcttcttg

SEQ ID NO: 5641770 - DNA, 21 bp, Homo sapiens
tcagtaacccccttaaattta

SEQ ID NO: 5641771 - DNA, 21 bp, Homo sapiens
tcagtaacttacccttaggga

SEQ ID NO: 5641772 - DNA, 17 bp, Homo sapiens
tcagtaacttttaaaag

SEQ ID NO: 5641773 - DNA, 17 bp, Homo sapiens
tcagtaagaaaaagaag

SEQ ID NO: 5641774 - DNA, 13 bp, Homo sapiens
tcagtaagacgac

SEQ ID NO: 5641775 - DNA, 21 bp, Homo sapiens
tcagtaagacgacaaggaaag

SEQ ID NO: 5641776 - DNA, 22 bp, Homo sapiens
tcagtaagacgacaaggaaagg

SEQ ID NO: 5641777 - DNA, 16 bp, Homo sapiens
tcagtaagctgtgtgg

SEQ ID NO: 5641778 - DNA, 16 bp, Homo sapiens
tcagtaagtataacaa

SEQ ID NO: 5641779 - DNA, 14 bp, Homo sapiens
tcagtaagttatct

SEQ ID NO: 5641780 - DNA, 23 bp, Homo sapiens
tcagtaagttatctttgaatatg

SEQ ID NO: 5641781 - DNA, 16 bp, Homo sapiens
tcagtaatataatttg

SEQ ID NO: 5641782 - DNA, 14 bp, Homo sapiens
tcagtaatatttat

SEQ ID NO: 5641783 - DNA, 17 bp, Homo sapiens
tcagtaatcacttttca

SEQ ID NO: 5641784 - DNA, 12 bp, Homo sapiens
tcagtaatctgt

SEQ ID NO: 5641785 - DNA, 22 bp, Homo sapiens
tcagtaatgcagtttttaaaaa

SEQ ID NO: 5641786 - DNA, 18 bp, Homo sapiens
tcagtaatttagaaatca

SEQ ID NO: 5641787 - DNA, 19 bp, Homo sapiens
tcagtaatttagaaatcat

SEQ ID NO: 5641788 - DNA, 14 bp, Homo sapiens
tcagtaatttgagg

SEQ ID NO: 5641789 - DNA, 18 bp, Homo sapiens
tcagtaatttgaggacaa

SEQ ID NO: 5641790 - DNA, 15 bp, Homo sapiens
tcagtgtgttgactt

SEQ ID NO: 5641791 - DNA, 15 bp, Homo sapiens
tcagtgttaaattca

SEQ ID NO: 5641792 - DNA, 21 bp, Homo sapiens
tcagtgttaatactgagaaaa

SEQ ID NO: 5641793 - DNA, 22 bp, Homo sapiens
tcagtgttaatactgagaaaaa

SEQ ID NO: 5641794 - DNA, 23 bp, Homo sapiens
tcagtgttaatactgagaaaaag

SEQ ID NO: 5641795 - DNA, 15 bp, Homo sapiens
tcagtgttacctgtg

SEQ ID NO: 5641796 - DNA, 17 bp, Homo sapiens
tcagtgttacctgtgtg

SEQ ID NO: 5641797 - DNA, 18 bp, Homo sapiens
tcagtgttacctgtgtgc

SEQ ID NO: 5641798 - DNA, 23 bp, Homo sapiens
tcagtgttactgcctataatctt

SEQ ID NO: 5641799 - DNA, 20 bp, Homo sapiens
tcagtgttcagccaaacagt

SEQ ID NO: 5641800 - DNA, 12 bp, Homo sapiens
tcagtgttccca

SEQ ID NO: 5641801 - DNA, 11 bp, Homo sapiens
tcagtgttgac

SEQ ID NO: 5641802 - DNA, 17 bp, Homo sapiens
tcagtgttgacatagcc

SEQ ID NO: 5641803 - DNA, 15 bp, Homo sapiens
tcagtgttggtatat

SEQ ID NO: 5641804 - DNA, 11 bp, Homo sapiens
tcagtgtttaa

SEQ ID NO: 5641805 - DNA, 14 bp, Homo sapiens
tcagtgtttatgtg

SEQ ID NO: 5641806 - DNA, 15 bp, Homo sapiens
tcagtgtttggtgca

SEQ ID NO: 5641807 - DNA, 19 bp, Homo sapiens
tcagtgttttcattttaga

SEQ ID NO: 5641808 - DNA, 16 bp, Homo sapiens
tcagtgttttggactc

SEQ ID NO: 5641809 - DNA, 20 bp, Homo sapiens
tcagttaaaatcacatttta

SEQ ID NO: 5641810 - DNA, 16 bp, Homo sapiens
tcagttaacgtcaccc

SEQ ID NO: 5641811 - DNA, 20 bp, Homo sapiens
tcagttaactattgcattta

SEQ ID NO: 5641812 - DNA, 14 bp, Homo sapiens
tcagttaagaaaaa

SEQ ID NO: 5641813 - DNA, 15 bp, Homo sapiens
tcagttaagaaaaaa

SEQ ID NO: 5641814 - DNA, 18 bp, Homo sapiens
tcagttaagtttttccct

SEQ ID NO: 5641815 - DNA, 13 bp, Homo sapiens
tcagttacacagg

SEQ ID NO: 5641816 - DNA, 15 bp, Homo sapiens
tcagttacagaaagt

SEQ ID NO: 5641817 - DNA, 14 bp, Homo sapiens
tcagttacagtggc

SEQ ID NO: 5641818 - DNA, 18 bp, Homo sapiens
tcagttactcagccctgg

SEQ ID NO: 5641819 - DNA, 15 bp, Homo sapiens
tcagttacttacctg

SEQ ID NO: 5641820 - DNA, 16 bp, Homo sapiens
tcagttaggctagaga

SEQ ID NO: 5641821 - DNA, 21 bp, Homo sapiens
tcagttatacagttataaaat

SEQ ID NO: 5641822 - DNA, 17 bp, Homo sapiens
tcagttatattttgctg

SEQ ID NO: 5641823 - DNA, 17 bp, Homo sapiens
tcagttatgagtataat

SEQ ID NO: 5641824 - DNA, 13 bp, Homo sapiens
tcagttattaaat

SEQ ID NO: 5641825 - DNA, 20 bp, Homo sapiens
tcagttcaaagtcatgatgt

SEQ ID NO: 5641826 - DNA, 15 bp, Homo sapiens
tcagttcaaatgtta

SEQ ID NO: 5641827 - DNA, 22 bp, Homo sapiens
tcagttcaacctggtggcacca

SEQ ID NO: 5641828 - DNA, 18 bp, Homo sapiens
tcagttcaatcaaacttt

SEQ ID NO: 5641829 - DNA, 22 bp, Homo sapiens
tcagttcaatcaaactttcagc

SEQ ID NO: 5641830 - DNA, 14 bp, Homo sapiens
tcagttcagaaaaa

SEQ ID NO: 5641831 - DNA, 15 bp, Homo sapiens
tcagttcagaaaaaa

SEQ ID NO: 5641832 - DNA, 14 bp, Homo sapiens
tcagttcagcttta

SEQ ID NO: 5641833 - DNA, 16 bp, Homo sapiens
tcagttcatatgcaga

SEQ ID NO: 5641834 - DNA, 23 bp, Homo sapiens
tcagttcatcctgcatgggaaaa

SEQ ID NO: 5641835 - DNA, 23 bp, Homo sapiens
tcagttcattgacctcatcatta

SEQ ID NO: 5641836 - DNA, 14 bp, Homo sapiens
tcagttcatttcct

SEQ ID NO: 5641837 - DNA, 13 bp, Homo sapiens
tcagttccaaagt

SEQ ID NO: 5641838 - DNA, 12 bp, Homo sapiens
tcagttccaaga

SEQ ID NO: 5641839 - DNA, 15 bp, Homo sapiens
tcagttccagctttt

SEQ ID NO: 5641840 - DNA, 16 bp, Homo sapiens
tcagttccagcttttg

SEQ ID NO: 5641841 - DNA, 20 bp, Homo sapiens
tcagttccaggcctgatctt

SEQ ID NO: 5641842 - DNA, 14 bp, Homo sapiens
tcagttcccagaat

SEQ ID NO: 5641843 - DNA, 16 bp, Homo sapiens
tcagttcccagaatca

SEQ ID NO: 5641844 - DNA, 15 bp, Homo sapiens
tcagttcccagctcc

SEQ ID NO: 5641845 - DNA, 20 bp, Homo sapiens
tcagttcccccagtacctcc

SEQ ID NO: 5641846 - DNA, 22 bp, Homo sapiens
tcagttcccggagcacagccct

SEQ ID NO: 5641847 - DNA, 23 bp, Homo sapiens
tcagttcccggagcacagccctg

SEQ ID NO: 5641848 - DNA, 20 bp, Homo sapiens
tcagttccctcctgcccagg

SEQ ID NO: 5641849 - DNA, 22 bp, Homo sapiens
tcagttccctcctgcccaggac

SEQ ID NO: 5641850 - DNA, 16 bp, Homo sapiens
tcagttcccttggcct

SEQ ID NO: 5641851 - DNA, 18 bp, Homo sapiens
tcagttcccttggcctca

SEQ ID NO: 5641852 - DNA, 19 bp, Homo sapiens
tcagttcccttggcctcag

SEQ ID NO: 5641853 - DNA, 19 bp, Homo sapiens
tcagttccgtcagaaagtg

SEQ ID NO: 5641854 - DNA, 19 bp, Homo sapiens
tcagttcctctttgcatgg

SEQ ID NO: 5641855 - DNA, 19 bp, Homo sapiens
tcagttctacggatcatca

SEQ ID NO: 5641856 - DNA, 16 bp, Homo sapiens
tcagttctaggccttt

SEQ ID NO: 5641857 - DNA, 22 bp, Homo sapiens
tcagttctaggcctttcctctg

SEQ ID NO: 5641858 - DNA, 15 bp, Homo sapiens
tcagttctagttgat

SEQ ID NO: 5641859 - DNA, 19 bp, Homo sapiens
tcagttctcatcttgtaaa

SEQ ID NO: 5641860 - DNA, 22 bp, Homo sapiens
tcagttctctactccctcttgt

SEQ ID NO: 5641861 - DNA, 13 bp, Homo sapiens
tcagttctgcttg

SEQ ID NO: 5641862 - DNA, 15 bp, Homo sapiens
tcagttctgtgtaca

SEQ ID NO: 5641863 - DNA, 20 bp, Homo sapiens
tcagttctgtgtacatttta

SEQ ID NO: 5641864 - DNA, 21 bp, Homo sapiens
tcagttctgtgtggtgcattc

SEQ ID NO: 5641865 - DNA, 21 bp, Homo sapiens
tcagttcttggtgctctgtgt

SEQ ID NO: 5641866 - DNA, 16 bp, Homo sapiens
tcagttgagaaacagt

SEQ ID NO: 5641867 - DNA, 23 bp, Homo sapiens
tcagttgagcttcatataccagc

SEQ ID NO: 5641868 - DNA, 17 bp, Homo sapiens
tcagttgattttctgga

SEQ ID NO: 5641869 - DNA, 18 bp, Homo sapiens
tcagttgctcaaaaagaa

SEQ ID NO: 5641870 - DNA, 20 bp, Homo sapiens
tcagttgctctctgttcaag

SEQ ID NO: 5641871 - DNA, 14 bp, Homo sapiens
tcagttggacagta

SEQ ID NO: 5641872 - DNA, 22 bp, Homo sapiens
tcagttggagaaaatgaagaaa

SEQ ID NO: 5641873 - DNA, 14 bp, Homo sapiens
tcagttggcctctg

SEQ ID NO: 5641874 - DNA, 14 bp, Homo sapiens
tcagttggctgact

SEQ ID NO: 5641875 - DNA, 15 bp, Homo sapiens
tcagttgggtttcac

SEQ ID NO: 5641876 - DNA, 23 bp, Homo sapiens
tcagttgggtttcacgagtgttc

SEQ ID NO: 5641877 - DNA, 15 bp, Homo sapiens
tcagttggtaagctt

SEQ ID NO: 5641878 - DNA, 22 bp, Homo sapiens
tcagttgtggcctcattcagca

SEQ ID NO: 5641879 - DNA, 13 bp, Homo sapiens
tcagttgtgtttt

SEQ ID NO: 5641880 - DNA, 16 bp, Homo sapiens
tcagttgtgtttttta

SEQ ID NO: 5641881 - DNA, 17 bp, Homo sapiens
tcagttgttagtgtgtc

SEQ ID NO: 5641882 - DNA, 17 bp, Homo sapiens
tcagttgttatttattg

SEQ ID NO: 5641883 - DNA, 19 bp, Homo sapiens
tcagttgtttgtttttgct

SEQ ID NO: 5641884 - DNA, 19 bp, Homo sapiens
tcagtttaatccttctagt

SEQ ID NO: 5641885 - DNA, 13 bp, Homo sapiens
tcagtttaatgca

SEQ ID NO: 5641886 - DNA, 23 bp, Homo sapiens
tcagtttaatgcaagagaacatt

SEQ ID NO: 5641887 - DNA, 13 bp, Homo sapiens
tcagtttacatct

SEQ ID NO: 5641888 - DNA, 18 bp, Homo sapiens
tcagtttagaacctacaa

SEQ ID NO: 5641889 - DNA, 19 bp, Homo sapiens
tcagtttaggccttggctt

SEQ ID NO: 5641890 - DNA, 16 bp, Homo sapiens
tcagtttatctgttca

SEQ ID NO: 5641891 - DNA, 19 bp, Homo sapiens
tcagtttcaattcagtgct

SEQ ID NO: 5641892 - DNA, 19 bp, Homo sapiens
tcagtttcacagaaaataa

SEQ ID NO: 5641893 - DNA, 20 bp, Homo sapiens
tcagtttccaattatttgac

SEQ ID NO: 5641894 - DNA, 23 bp, Homo sapiens
tcagtttccccaacacacagcag

SEQ ID NO: 5641895 - DNA, 21 bp, Homo sapiens
tcagtttccgaatctctttcc

SEQ ID NO: 5641896 - DNA, 14 bp, Homo sapiens
tcagtttcctctcc

SEQ ID NO: 5641897 - DNA, 16 bp, Homo sapiens
tcagtttcctggtctg

SEQ ID NO: 5641898 - DNA, 14 bp, Homo sapiens
tcagtttctatcaa

SEQ ID NO: 5641899 - DNA, 18 bp, Homo sapiens
tcagtttctccatcagct

SEQ ID NO: 5641900 - DNA, 20 bp, Homo sapiens
tcagtttcttctccagactg

SEQ ID NO: 5641901 - DNA, 22 bp, Homo sapiens
tcagtttcttctgcgcctcagg

SEQ ID NO: 5641902 - DNA, 21 bp, Homo sapiens
tcagtttgaaaatattttgtt

SEQ ID NO: 5641903 - DNA, 22 bp, Homo sapiens
tcagtttgatacagtattgaaa

SEQ ID NO: 5641904 - DNA, 15 bp, Homo sapiens
tcagtttgcagagta

SEQ ID NO: 5641905 - DNA, 16 bp, Homo sapiens
tcagtttgcagagtag

SEQ ID NO: 5641906 - DNA, 17 bp, Homo sapiens
tcagtttggctgtaatt

SEQ ID NO: 5641907 - DNA, 20 bp, Homo sapiens
tcagtttgtgaagtgattga

SEQ ID NO: 5641908 - DNA, 15 bp, Homo sapiens
tcagttttaaaaatg

SEQ ID NO: 5641909 - DNA, 21 bp, Homo sapiens
tcagttttagtttcaaaatgt

SEQ ID NO: 5641910 - DNA, 22 bp, Homo sapiens
tcagttttagtttcaaaatgtt

SEQ ID NO: 5641911 - DNA, 16 bp, Homo sapiens
tcagttttatcatttt

SEQ ID NO: 5641912 - DNA, 14 bp, Homo sapiens
tcagttttatcttt

SEQ ID NO: 5641913 - DNA, 12 bp, Homo sapiens
tcagttttcaca

SEQ ID NO: 5641914 - DNA, 16 bp, Homo sapiens
tcagttttcacagagg

SEQ ID NO: 5641915 - DNA, 17 bp, Homo sapiens
tcagttttcacagaggc

SEQ ID NO: 5641916 - DNA, 16 bp, Homo sapiens
tcagttttcaggagtg

SEQ ID NO: 5641917 - DNA, 13 bp, Homo sapiens
tcagttttcattt

SEQ ID NO: 5641918 - DNA, 14 bp, Homo sapiens
tcagttttcccact

SEQ ID NO: 5641919 - DNA, 12 bp, Homo sapiens
tcagttttccta

SEQ ID NO: 5641920 - DNA, 20 bp, Homo sapiens
tcagttttcctagtctttgg

SEQ ID NO: 5641921 - DNA, 20 bp, Homo sapiens
tcagttttcctctcaataaa

SEQ ID NO: 5641922 - DNA, 13 bp, Homo sapiens
tcagttttccttc

SEQ ID NO: 5641923 - DNA, 19 bp, Homo sapiens
tcagttttccttctgttaa

SEQ ID NO: 5641924 - DNA, 12 bp, Homo sapiens
tcagttttggtg

SEQ ID NO: 5641925 - DNA, 15 bp, Homo sapiens
tcagttttgtacata

SEQ ID NO: 5641926 - DNA, 12 bp, Homo sapiens
tcagttttgtat

SEQ ID NO: 5641927 - DNA, 18 bp, Homo sapiens
tcagttttgtataactta

SEQ ID NO: 5641928 - DNA, 19 bp, Homo sapiens
tcagtttttattaatctac

SEQ ID NO: 5641929 - DNA, 13 bp, Homo sapiens
tcagtttttcact

SEQ ID NO: 5641930 - DNA, 14 bp, Homo sapiens
tcagtttttcattt

SEQ ID NO: 5641931 - DNA, 15 bp, Homo sapiens
tcagtttttcatttg

SEQ ID NO: 5641932 - DNA, 17 bp, Homo sapiens
tcagtttttcatttgtt

SEQ ID NO: 5641933 - DNA, 14 bp, Homo sapiens
tcagtttttcctcc

SEQ ID NO: 5641934 - DNA, 14 bp, Homo sapiens
tcagtttttgctga

SEQ ID NO: 5641935 - DNA, 17 bp, Homo sapiens
tcagtttttgtatcttg

SEQ ID NO: 5641936 - DNA, 15 bp, Homo sapiens
tcagtttttgttctt

SEQ ID NO: 5641937 - DNA, 23 bp, Homo sapiens
tcagttttttatctgggttctct

SEQ ID NO: 5641938 - DNA, 18 bp, Homo sapiens
tcagtttttttaaatgcc

SEQ ID NO: 5641939 - DNA, 18 bp, Homo sapiens
tcagtttttttttttcca

SEQ ID NO: 5641940 - DNA, 19 bp, Homo sapiens
tcagtttttttttttccag

SEQ ID NO: 5641941 - DNA, 20 bp, Homo sapiens
tcataaaaacaagtcatttt

SEQ ID NO: 5641942 - DNA, 20 bp, Homo sapiens
tcataaaaagcaaaacaaaa

SEQ ID NO: 5641943 - DNA, 22 bp, Homo sapiens
tcataaaaagcctgcaatttca

SEQ ID NO: 5641944 - DNA, 22 bp, Homo sapiens
tcataaaaataaaatctgtaaa

SEQ ID NO: 5641945 - DNA, 21 bp, Homo sapiens
tcataaaacggtgctttctgt

SEQ ID NO: 5641946 - DNA, 12 bp, Homo sapiens
tcataaaactgt

SEQ ID NO: 5641947 - DNA, 13 bp, Homo sapiens
tcataaaagagac

SEQ ID NO: 5641948 - DNA, 15 bp, Homo sapiens
tcataaaatgcatac

SEQ ID NO: 5641949 - DNA, 21 bp, Homo sapiens
tcataaaatgcatactgttga

SEQ ID NO: 5641950 - DNA, 17 bp, Homo sapiens
tcataaaatgctatttt

SEQ ID NO: 5641951 - DNA, 19 bp, Homo sapiens
tcataaaatgctattttaa

SEQ ID NO: 5641952 - DNA, 20 bp, Homo sapiens
tcataaaatgctattttaaa

SEQ ID NO: 5641953 - DNA, 19 bp, Homo sapiens
tcataaacagatgaataaa

SEQ ID NO: 5641954 - DNA, 13 bp, Homo sapiens
tcataaacagcat

SEQ ID NO: 5641955 - DNA, 16 bp, Homo sapiens
tcataaacagcattta

SEQ ID NO: 5641956 - DNA, 17 bp, Homo sapiens
tcataaacagcatttat

SEQ ID NO: 5641957 - DNA, 23 bp, Homo sapiens
tcataaacagcatttattacctt

SEQ ID NO: 5641958 - DNA, 19 bp, Homo sapiens
tcataaacattttacatgc

SEQ ID NO: 5641959 - DNA, 14 bp, Homo sapiens
tcataaacctgttt

SEQ ID NO: 5641960 - DNA, 15 bp, Homo sapiens
tcataaactgagcct

SEQ ID NO: 5641961 - DNA, 22 bp, Homo sapiens
tcataaactgagcctcttttca

SEQ ID NO: 5641962 - DNA, 14 bp, Homo sapiens
tcataaactgtgtg

SEQ ID NO: 5641963 - DNA, 12 bp, Homo sapiens
tcataaactttt

SEQ ID NO: 5641964 - DNA, 14 bp, Homo sapiens
tcataaagaaaaat

SEQ ID NO: 5641965 - DNA, 16 bp, Homo sapiens
tcataaagatgttaaa

SEQ ID NO: 5641966 - DNA, 18 bp, Homo sapiens
tcataaagatgttaaatg

SEQ ID NO: 5641967 - DNA, 24 bp, Homo sapiens
tcataaagcaggcagaactcatct

SEQ ID NO: 5641968 - DNA, 19 bp, Homo sapiens
tcatccctttctcccagtg

SEQ ID NO: 5641969 - DNA, 13 bp, Homo sapiens
tcatccctttggt

SEQ ID NO: 5641970 - DNA, 17 bp, Homo sapiens
tcatccgagcaaggtgg

SEQ ID NO: 5641971 - DNA, 14 bp, Homo sapiens
tcatccgcactgta

SEQ ID NO: 5641972 - DNA, 14 bp, Homo sapiens
tcatccgcctgtgg

SEQ ID NO: 5641973 - DNA, 18 bp, Homo sapiens
tcatccgcctgtgggcgc

SEQ ID NO: 5641974 - DNA, 14 bp, Homo sapiens
tcatccgttgtgac

SEQ ID NO: 5641975 - DNA, 22 bp, Homo sapiens
tcatccgttgtgactctaggct

SEQ ID NO: 5641976 - DNA, 16 bp, Homo sapiens
tcatccgtttcagctg

SEQ ID NO: 5641977 - DNA, 12 bp, Homo sapiens
tcatcctaacaa

SEQ ID NO: 5641978 - DNA, 18 bp, Homo sapiens
tcatcctattacttttca

SEQ ID NO: 5641979 - DNA, 20 bp, Homo sapiens
tcatcctattacttttcatc

SEQ ID NO: 5641980 - DNA, 11 bp, Homo sapiens
tcatcctcagc

SEQ ID NO: 5641981 - DNA, 13 bp, Homo sapiens
tcatcctcaggaa

SEQ ID NO: 5641982 - DNA, 18 bp, Homo sapiens
tcatcctcatacccaccc

SEQ ID NO: 5641983 - DNA, 17 bp, Homo sapiens
tcatcctccccaggacc

SEQ ID NO: 5641984 - DNA, 20 bp, Homo sapiens
tcatcctccctgaccctgct

SEQ ID NO: 5641985 - DNA, 19 bp, Homo sapiens
tcatcctcccttgccccag

SEQ ID NO: 5641986 - DNA, 20 bp, Homo sapiens
tcatcctcccttgccccagg

SEQ ID NO: 5641987 - DNA, 12 bp, Homo sapiens
tcatcctcctcc

SEQ ID NO: 5641988 - DNA, 13 bp, Homo sapiens
tcatcctcctccc

SEQ ID NO: 5641989 - DNA, 17 bp, Homo sapiens
tcatcctcctccccagc

SEQ ID NO: 5641990 - DNA, 15 bp, Homo sapiens
tcatcctcctcctca

SEQ ID NO: 5641991 - DNA, 16 bp, Homo sapiens
tcatcctcctcctcat

SEQ ID NO: 5641992 - DNA, 14 bp, Homo sapiens
tcatcctcctggac

SEQ ID NO: 5641993 - DNA, 22 bp, Homo sapiens
tcatcctccttataagcccagc

SEQ ID NO: 5641994 - DNA, 16 bp, Homo sapiens
tcatcctcctttcagt

SEQ ID NO: 5641995 - DNA, 22 bp, Homo sapiens
tcatcctctccacagctgcctc

SEQ ID NO: 5641996 - DNA, 16 bp, Homo sapiens
tcatcctgactctgcc

SEQ ID NO: 5641997 - DNA, 17 bp, Homo sapiens
tcatcctgactctgccc

SEQ ID NO: 5641998 - DNA, 19 bp, Homo sapiens
tcatcctgactctgccccc

SEQ ID NO: 5641999 - DNA, 13 bp, Homo sapiens
tcatcctgagccc

SEQ ID NO: 5642000 - DNA, 15 bp, Homo sapiens
tcatcctgattttta

SEQ ID NO: 5642001 - DNA, 17 bp, Homo sapiens
tcatcctgccctgcagc

SEQ ID NO: 5642002 - DNA, 15 bp, Homo sapiens
tcatcctgccttcat

SEQ ID NO: 5642003 - DNA, 20 bp, Homo sapiens
tcatcctgctcttttgtgat

SEQ ID NO: 5642004 - DNA, 15 bp, Homo sapiens
tcatcctgcttctct

SEQ ID NO: 5642005 - DNA, 16 bp, Homo sapiens
tcatcctggcctcctt

SEQ ID NO: 5642006 - DNA, 13 bp, Homo sapiens
tcatcctgggcat

SEQ ID NO: 5642007 - DNA, 15 bp, Homo sapiens
tcatcctgtgctcgg

SEQ ID NO: 5642008 - DNA, 12 bp, Homo sapiens
tcatcctgtgtc

SEQ ID NO: 5642009 - DNA, 17 bp, Homo sapiens
tcatcctgtgtggggag

SEQ ID NO: 5642010 - DNA, 22 bp, Homo sapiens
tcatcctgtgtggggaggcagc

SEQ ID NO: 5642011 - DNA, 15 bp, Homo sapiens
tcatcctgttttctc

SEQ ID NO: 5642012 - DNA, 18 bp, Homo sapiens
tcatccttagaaatcagt

SEQ ID NO: 5642013 - DNA, 18 bp, Homo sapiens
tcatccttagcaacagcc

SEQ ID NO: 5642014 - DNA, 22 bp, Homo sapiens
tcatccttatgagactcttaaa

SEQ ID NO: 5642015 - DNA, 15 bp, Homo sapiens
tcatccttccatcca

SEQ ID NO: 5642016 - DNA, 14 bp, Homo sapiens
tcatccttctttcc

SEQ ID NO: 5642017 - DNA, 18 bp, Homo sapiens
tcatccttgcccaggtga

SEQ ID NO: 5642018 - DNA, 20 bp, Homo sapiens
tcatccttggtctttgtatc

SEQ ID NO: 5642019 - DNA, 17 bp, Homo sapiens
tcatccttggtgctctt

SEQ ID NO: 5642020 - DNA, 21 bp, Homo sapiens
tcatccttggtgctcttgctt

SEQ ID NO: 5642021 - DNA, 13 bp, Homo sapiens
tcatccttgtctt

SEQ ID NO: 5642022 - DNA, 14 bp, Homo sapiens
tcatccttgtctta

SEQ ID NO: 5642023 - DNA, 24 bp, Homo sapiens
tcatcctttaagaaaaacatctgg

SEQ ID NO: 5642024 - DNA, 19 bp, Homo sapiens
tcatccttttctcctatct

SEQ ID NO: 5642025 - DNA, 21 bp, Homo sapiens
tcatcgaaaattcatttcaca

SEQ ID NO: 5642026 - DNA, 19 bp, Homo sapiens
tcatcgaacaaactgatgc

SEQ ID NO: 5642027 - DNA, 23 bp, Homo sapiens
tcatcgaagggattgtgtatctg

SEQ ID NO: 5642028 - DNA, 22 bp, Homo sapiens
tcatcgacttagcctgagtcat

SEQ ID NO: 5642029 - DNA, 14 bp, Homo sapiens
tcatcgccagaggt

SEQ ID NO: 5642030 - DNA, 15 bp, Homo sapiens
tcatcgccagaggtg

SEQ ID NO: 5642031 - DNA, 20 bp, Homo sapiens
tcatcgggattgtctttttt

SEQ ID NO: 5642032 - DNA, 18 bp, Homo sapiens
tcatcgggcccagggaca

SEQ ID NO: 5642033 - DNA, 13 bp, Homo sapiens
tcatcgtctttta

SEQ ID NO: 5642034 - DNA, 14 bp, Homo sapiens
tcatctaaatgaaa

SEQ ID NO: 5642035 - DNA, 17 bp, Homo sapiens
tcatctaataaatcagt

SEQ ID NO: 5642036 - DNA, 22 bp, Homo sapiens
tcatctaatgtattatgagcca

SEQ ID NO: 5642037 - DNA, 19 bp, Homo sapiens
tcatctacaagcatttgcc

SEQ ID NO: 5642038 - DNA, 13 bp, Homo sapiens
tcatctacacata

SEQ ID NO: 5642039 - DNA, 15 bp, Homo sapiens
tcatctacacatata

SEQ ID NO: 5642040 - DNA, 22 bp, Homo sapiens
tcatctacacatataaacacag

SEQ ID NO: 5642041 - DNA, 22 bp, Homo sapiens
tcatctaccattttctggttct

SEQ ID NO: 5642042 - DNA, 14 bp, Homo sapiens
tcatctacctagat

SEQ ID NO: 5642043 - DNA, 13 bp, Homo sapiens
tcatctaggattt

SEQ ID NO: 5642044 - DNA, 14 bp, Homo sapiens
tcatctaggatttt

SEQ ID NO: 5642045 - DNA, 18 bp, Homo sapiens
tcatctaggtaaattaca

SEQ ID NO: 5642046 - DNA, 20 bp, Homo sapiens
tcatctagttaagtcgctga

SEQ ID NO: 5642047 - DNA, 17 bp, Homo sapiens
tcatctataaaatgagg

SEQ ID NO: 5642048 - DNA, 22 bp, Homo sapiens
tcatctatagttgatatgtttt

SEQ ID NO: 5642049 - DNA, 20 bp, Homo sapiens
tcatctatgagggtgtttcc

SEQ ID NO: 5642050 - DNA, 21 bp, Homo sapiens
tcatctatgagggtgtttcct

SEQ ID NO: 5642051 - DNA, 18 bp, Homo sapiens
tcatctatgctctttcct

SEQ ID NO: 5642052 - DNA, 15 bp, Homo sapiens
tcatctattcaagca

SEQ ID NO: 5642053 - DNA, 21 bp, Homo sapiens
tcatctattcaagcacttaca

SEQ ID NO: 5642054 - DNA, 16 bp, Homo sapiens
tcatctatttggaacc

SEQ ID NO: 5642055 - DNA, 18 bp, Homo sapiens
tcatctattttgatgcag

SEQ ID NO: 5642056 - DNA, 23 bp, Homo sapiens
tcatctattttgatgcagcattt

SEQ ID NO: 5642057 - DNA, 16 bp, Homo sapiens
tcatctcaaacactgc

SEQ ID NO: 5642058 - DNA, 17 bp, Homo sapiens
tcatctcaaatccttga

SEQ ID NO: 5642059 - DNA, 20 bp, Homo sapiens
tcatctcagagtccactgtg

SEQ ID NO: 5642060 - DNA, 15 bp, Homo sapiens
tcatctcagcaatca

SEQ ID NO: 5642061 - DNA, 13 bp, Homo sapiens
tcatctcagcttt
